United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 42

SEQ ID NO: 1758356 - DNA, 18 bp, Homo sapiens
ctctgcccagcttgggcc

SEQ ID NO: 1758357 - DNA, 18 bp, Homo sapiens
ctctgccccaagcagcca

SEQ ID NO: 1758358 - DNA, 21 bp, Homo sapiens
ctctgccccaagcagccagcc

SEQ ID NO: 1758359 - DNA, 24 bp, Homo sapiens
ctctgccccaagcagccagccagt

SEQ ID NO: 1758360 - DNA, 12 bp, Homo sapiens
ctctgccccaat

SEQ ID NO: 1758361 - DNA, 12 bp, Homo sapiens
ctctgccccagc

SEQ ID NO: 1758362 - DNA, 13 bp, Homo sapiens
ctctgccccagcc

SEQ ID NO: 1758363 - DNA, 17 bp, Homo sapiens
ctctgccccagcctgtc

SEQ ID NO: 1758364 - DNA, 19 bp, Homo sapiens
ctctgccccagctctggct

SEQ ID NO: 1758365 - DNA, 23 bp, Homo sapiens
ctctgccccatcattgcacctgc

SEQ ID NO: 1758366 - DNA, 21 bp, Homo sapiens
ctctgcccccatttccccgat

SEQ ID NO: 1758367 - DNA, 20 bp, Homo sapiens
ctctgcccccgcgggttcta

SEQ ID NO: 1758368 - DNA, 22 bp, Homo sapiens
ctctgcccccgcgggttctaga

SEQ ID NO: 1758369 - DNA, 18 bp, Homo sapiens
ctctgccccctcccccat

SEQ ID NO: 1758370 - DNA, 21 bp, Homo sapiens
ctctgcccctattgggagagg

SEQ ID NO: 1758371 - DNA, 20 bp, Homo sapiens
ctctgccctccctccttcct

SEQ ID NO: 1758372 - DNA, 15 bp, Homo sapiens
ctctgccctctgctg

SEQ ID NO: 1758373 - DNA, 19 bp, Homo sapiens
ctctgccctgccctagctc

SEQ ID NO: 1758374 - DNA, 20 bp, Homo sapiens
ctctgccctgccctagctcc

SEQ ID NO: 1758375 - DNA, 11 bp, Homo sapiens
ctctgccctgg

SEQ ID NO: 1758376 - DNA, 14 bp, Homo sapiens
ctctgccctgtgta

SEQ ID NO: 1758377 - DNA, 21 bp, Homo sapiens
ctctgcccttgatcagcccca

SEQ ID NO: 1758378 - DNA, 16 bp, Homo sapiens
ctctgccgcctgcgtt

SEQ ID NO: 1758379 - DNA, 20 bp, Homo sapiens
ctctgccggtcccccatgcc

SEQ ID NO: 1758380 - DNA, 22 bp, Homo sapiens
ctctgccggtcgggcagccagc

SEQ ID NO: 1758381 - DNA, 23 bp, Homo sapiens
ctctgccggtcgggcagccagca

SEQ ID NO: 1758382 - DNA, 24 bp, Homo sapiens
ctctgccggtcgggcagccagcag

SEQ ID NO: 1758383 - DNA, 17 bp, Homo sapiens
ctctgcctctgcctgca

SEQ ID NO: 1758384 - DNA, 18 bp, Homo sapiens
ctctgcctgaaatgttac

SEQ ID NO: 1758385 - DNA, 13 bp, Homo sapiens
ctctgcctgcact

SEQ ID NO: 1758386 - DNA, 24 bp, Homo sapiens
ctctgcctgcactccctggccttg

SEQ ID NO: 1758387 - DNA, 22 bp, Homo sapiens
ctctgcctgcattctgccgtgt

SEQ ID NO: 1758388 - DNA, 11 bp, Homo sapiens
ctctgcctggg

SEQ ID NO: 1758389 - DNA, 13 bp, Homo sapiens
ctctgcctgggac

SEQ ID NO: 1758390 - DNA, 22 bp, Homo sapiens
ctctgcctgggatgggctccca

SEQ ID NO: 1758391 - DNA, 20 bp, Homo sapiens
ctctgcctgtgagccagtct

SEQ ID NO: 1758392 - DNA, 13 bp, Homo sapiens
ctctgccttctca

SEQ ID NO: 1758393 - DNA, 18 bp, Homo sapiens
ctctgccttctcaggccc

SEQ ID NO: 1758394 - DNA, 14 bp, Homo sapiens
ctctgcctttatga

SEQ ID NO: 1758395 - DNA, 13 bp, Homo sapiens
ctctgcctttgct

SEQ ID NO: 1758396 - DNA, 13 bp, Homo sapiens
ctctgcgccaggc

SEQ ID NO: 1758397 - DNA, 14 bp, Homo sapiens
ctctgcgccaggca

SEQ ID NO: 1758398 - DNA, 21 bp, Homo sapiens
ctctgcgccaggcagagctga

SEQ ID NO: 1758399 - DNA, 15 bp, Homo sapiens
ctctgcgtctatcct

SEQ ID NO: 1758400 - DNA, 23 bp, Homo sapiens
ctctgcgtgcagggacaaagagg

SEQ ID NO: 1758401 - DNA, 12 bp, Homo sapiens
ctctgctagact

SEQ ID NO: 1758402 - DNA, 20 bp, Homo sapiens
ctctgctatttctcttgctg

SEQ ID NO: 1758403 - DNA, 13 bp, Homo sapiens
ctctgctccacca

SEQ ID NO: 1758404 - DNA, 19 bp, Homo sapiens
ctcttgaccaggctgcctc

SEQ ID NO: 1758405 - DNA, 16 bp, Homo sapiens
ctcttgactcttgcct

SEQ ID NO: 1758406 - DNA, 19 bp, Homo sapiens
ctcttgagagctcaggcag

SEQ ID NO: 1758407 - DNA, 18 bp, Homo sapiens
ctcttgagcagtggctgg

SEQ ID NO: 1758408 - DNA, 21 bp, Homo sapiens
ctcttgagcatcaatcttgtt

SEQ ID NO: 1758409 - DNA, 22 bp, Homo sapiens
ctcttgagcatcaatcttgtta

SEQ ID NO: 1758410 - DNA, 22 bp, Homo sapiens
ctcttgagctggcctctctagc

SEQ ID NO: 1758411 - DNA, 14 bp, Homo sapiens
ctcttgaggccagg

SEQ ID NO: 1758412 - DNA, 17 bp, Homo sapiens
ctcttgaggccaggagt

SEQ ID NO: 1758413 - DNA, 14 bp, Homo sapiens
ctcttgagggagct

SEQ ID NO: 1758414 - DNA, 23 bp, Homo sapiens
ctcttgagtttgtcgctcatgtg

SEQ ID NO: 1758415 - DNA, 19 bp, Homo sapiens
ctcttgatacccccctctg

SEQ ID NO: 1758416 - DNA, 23 bp, Homo sapiens
ctcttgatacccccctctgtctt

SEQ ID NO: 1758417 - DNA, 20 bp, Homo sapiens
ctcttgatggtggactaagc

SEQ ID NO: 1758418 - DNA, 16 bp, Homo sapiens
ctcttgattaagggct

SEQ ID NO: 1758419 - DNA, 14 bp, Homo sapiens
ctcttgattcctgg

SEQ ID NO: 1758420 - DNA, 15 bp, Homo sapiens
ctcttgattcctggt

SEQ ID NO: 1758421 - DNA, 17 bp, Homo sapiens
ctcttgatttgggtgga

SEQ ID NO: 1758422 - DNA, 14 bp, Homo sapiens
ctcttgcacccgcc

SEQ ID NO: 1758423 - DNA, 18 bp, Homo sapiens
ctcttgcatctgggccag

SEQ ID NO: 1758424 - DNA, 14 bp, Homo sapiens
ctcttgcccatcct

SEQ ID NO: 1758425 - DNA, 19 bp, Homo sapiens
ctcttgcccatcctgactg

SEQ ID NO: 1758426 - DNA, 23 bp, Homo sapiens
ctcttgcccgcacccctccctgc

SEQ ID NO: 1758427 - DNA, 21 bp, Homo sapiens
ctcttgcccttccctgtccct

SEQ ID NO: 1758428 - DNA, 17 bp, Homo sapiens
ctcttgcgggcctggac

SEQ ID NO: 1758429 - DNA, 15 bp, Homo sapiens
ctcttgctcagagct

SEQ ID NO: 1758430 - DNA, 14 bp, Homo sapiens
ctcttgctctcttg

SEQ ID NO: 1758431 - DNA, 16 bp, Homo sapiens
ctcttgctctcttgtg

SEQ ID NO: 1758432 - DNA, 15 bp, Homo sapiens
ctcttggagaagtct

SEQ ID NO: 1758433 - DNA, 18 bp, Homo sapiens
ctcttggagaagtctcag

SEQ ID NO: 1758434 - DNA, 23 bp, Homo sapiens
ctcttggagctgagatgagcccc

SEQ ID NO: 1758435 - DNA, 17 bp, Homo sapiens
ctcttggctattgaaga

SEQ ID NO: 1758436 - DNA, 22 bp, Homo sapiens
ctcttggctatttctgtgtcca

SEQ ID NO: 1758437 - DNA, 16 bp, Homo sapiens
ctcttggctgacccct

SEQ ID NO: 1758438 - DNA, 22 bp, Homo sapiens
ctcttggctgacccctctggtg

SEQ ID NO: 1758439 - DNA, 20 bp, Homo sapiens
ctcttgggggccggggggaa

SEQ ID NO: 1758440 - DNA, 17 bp, Homo sapiens
ctcttggtcagcttttg

SEQ ID NO: 1758441 - DNA, 21 bp, Homo sapiens
ctcttggtgggtgtggccagc

SEQ ID NO: 1758442 - DNA, 20 bp, Homo sapiens
ctcttggtttccttccttgg

SEQ ID NO: 1758443 - DNA, 21 bp, Homo sapiens
ctcttgtataagatcctagat

SEQ ID NO: 1758444 - DNA, 18 bp, Homo sapiens
ctcttgtccctttcccta

SEQ ID NO: 1758445 - DNA, 15 bp, Homo sapiens
ctcttgtcctcttct

SEQ ID NO: 1758446 - DNA, 14 bp, Homo sapiens
ctcttgtcctggcc

SEQ ID NO: 1758447 - DNA, 16 bp, Homo sapiens
ctcttgtcctggccct

SEQ ID NO: 1758448 - DNA, 18 bp, Homo sapiens
ctcttgtcctggcccttc

SEQ ID NO: 1758449 - DNA, 23 bp, Homo sapiens
ctcttgtcctggcccttcagtct

SEQ ID NO: 1758450 - DNA, 17 bp, Homo sapiens
ctcttgtcttcctattt

SEQ ID NO: 1758451 - DNA, 22 bp, Homo sapiens
ctcttgtgtaactaatttgtgg

SEQ ID NO: 1758452 - DNA, 19 bp, Homo sapiens
ctcttgtttttattaattt

SEQ ID NO: 1758453 - DNA, 15 bp, Homo sapiens
ctctttaaaaactca

SEQ ID NO: 1758454 - DNA, 18 bp, Homo sapiens
ctctttaaaaactcactt

SEQ ID NO: 1758455 - DNA, 17 bp, Homo sapiens
ctctttaacatacaaga

SEQ ID NO: 1758456 - DNA, 15 bp, Homo sapiens
ctctttaaccctccc

SEQ ID NO: 1758457 - DNA, 21 bp, Homo sapiens
ctctttaagagttagtttctt

SEQ ID NO: 1758458 - DNA, 16 bp, Homo sapiens
ctctttaatcttcagt

SEQ ID NO: 1758459 - DNA, 22 bp, Homo sapiens
ctctttactcccttcctggcct

SEQ ID NO: 1758460 - DNA, 23 bp, Homo sapiens
ctctttactcccttcctggcctc

SEQ ID NO: 1758461 - DNA, 12 bp, Homo sapiens
ctctttagccag

SEQ ID NO: 1758462 - DNA, 18 bp, Homo sapiens
ctctttagtgttctgttt

SEQ ID NO: 1758463 - DNA, 14 bp, Homo sapiens
ctctttatacagct

SEQ ID NO: 1758464 - DNA, 18 bp, Homo sapiens
ctctttatcaagcaacat

SEQ ID NO: 1758465 - DNA, 22 bp, Homo sapiens
ctctttatcaagcaacattctt

SEQ ID NO: 1758466 - DNA, 20 bp, Homo sapiens
ctctttatttctagcagagt

SEQ ID NO: 1758467 - DNA, 14 bp, Homo sapiens
ctctttcacattgt

SEQ ID NO: 1758468 - DNA, 12 bp, Homo sapiens
ctctttcagaga

SEQ ID NO: 1758469 - DNA, 13 bp, Homo sapiens
ctctttccctgcg

SEQ ID NO: 1758470 - DNA, 20 bp, Homo sapiens
ctctttcctatttcagtgtt

SEQ ID NO: 1758471 - DNA, 22 bp, Homo sapiens
ctctttcctgttgttgttaatg

SEQ ID NO: 1758472 - DNA, 19 bp, Homo sapiens
ctctttccttgaaaataaa

SEQ ID NO: 1758473 - DNA, 17 bp, Homo sapiens
ctctttctatgcccgtg

SEQ ID NO: 1758474 - DNA, 17 bp, Homo sapiens
ctctttctctgccagtg

SEQ ID NO: 1758475 - DNA, 13 bp, Homo sapiens
ctctttctgctct

SEQ ID NO: 1758476 - DNA, 14 bp, Homo sapiens
ctctttctgctctg

SEQ ID NO: 1758477 - DNA, 15 bp, Homo sapiens
ctctttctgctctgc

SEQ ID NO: 1758478 - DNA, 12 bp, Homo sapiens
ctctttcttgtt

SEQ ID NO: 1758479 - DNA, 13 bp, Homo sapiens
ctctttcttgttt

SEQ ID NO: 1758480 - DNA, 22 bp, Homo sapiens
ctctttcttgtttgtcagcatc

SEQ ID NO: 1758481 - DNA, 22 bp, Homo sapiens
ctctttgaaatagtctgtgtga

SEQ ID NO: 1758482 - DNA, 23 bp, Homo sapiens
ctctttgacaattcctagataaa

SEQ ID NO: 1758483 - DNA, 13 bp, Homo sapiens
ctctttggaaata

SEQ ID NO: 1758484 - DNA, 17 bp, Homo sapiens
ctctttgggcagtgcca

SEQ ID NO: 1758485 - DNA, 19 bp, Homo sapiens
ctctttgggcagtgccatg

SEQ ID NO: 1758486 - DNA, 19 bp, Homo sapiens
ctctttgggtccattcaga

SEQ ID NO: 1758487 - DNA, 21 bp, Homo sapiens
ctctttgtggggaagaggggc

SEQ ID NO: 1758488 - DNA, 23 bp, Homo sapiens
ctctttgtgggtttttcatcttt

SEQ ID NO: 1758489 - DNA, 22 bp, Homo sapiens
ctcttttatctcctgaaaaaag

SEQ ID NO: 1758490 - DNA, 23 bp, Homo sapiens
ctcttttccactccattgtcgta

SEQ ID NO: 1758491 - DNA, 20 bp, Homo sapiens
ctcttttcccctttcctgtc

SEQ ID NO: 1758492 - DNA, 22 bp, Homo sapiens
ctcttttcctggtgctcttttt

SEQ ID NO: 1758493 - DNA, 19 bp, Homo sapiens
ctcttttctaagtggcgtg

SEQ ID NO: 1758494 - DNA, 23 bp, Homo sapiens
ctcttttctaagtggcgtgtgca

SEQ ID NO: 1758495 - DNA, 20 bp, Homo sapiens
ctcttttctattttgttttt

SEQ ID NO: 1758496 - DNA, 16 bp, Homo sapiens
ctcttttcttctcagg

SEQ ID NO: 1758497 - DNA, 11 bp, Homo sapiens
ctcttttggac

SEQ ID NO: 1758498 - DNA, 13 bp, Homo sapiens
ctcttttgtgatg

SEQ ID NO: 1758499 - DNA, 17 bp, Homo sapiens
ctcttttgtgatgaaca

SEQ ID NO: 1758500 - DNA, 23 bp, Homo sapiens
ctctttttgttgttgttgttctt

SEQ ID NO: 1758501 - DNA, 13 bp, Homo sapiens
ctctttttttgag

SEQ ID NO: 1758502 - DNA, 19 bp, Homo sapiens
ctctttttttggcccaggc

SEQ ID NO: 1758503 - DNA, 21 bp, Homo sapiens
ctgaaaaatcacatcctggcc

SEQ ID NO: 1758504 - DNA, 23 bp, Homo sapiens
ctgaaaaatcacatcctggcctg

SEQ ID NO: 1758505 - DNA, 13 bp, Homo sapiens
ctgaaaaatggga

SEQ ID NO: 1758506 - DNA, 21 bp, Homo sapiens
ctgaaaaatggtaattgttgc

SEQ ID NO: 1758507 - DNA, 14 bp, Homo sapiens
ctgaaaacccagag

SEQ ID NO: 1758508 - DNA, 16 bp, Homo sapiens
ctgaaaagaaggaaag

SEQ ID NO: 1758509 - DNA, 18 bp, Homo sapiens
ctgaaaagaaggaatata

SEQ ID NO: 1758510 - DNA, 18 bp, Homo sapiens
ctgaaaaggatcgaggca

SEQ ID NO: 1758511 - DNA, 10 bp, Homo sapiens
ctgaaaaggg

SEQ ID NO: 1758512 - DNA, 19 bp, Homo sapiens
ctgaaaagggcactcccaa

SEQ ID NO: 1758513 - DNA, 17 bp, Homo sapiens
ctgaaaagggcggaaga

SEQ ID NO: 1758514 - DNA, 11 bp, Homo sapiens
ctgaaaatatt

SEQ ID NO: 1758515 - DNA, 17 bp, Homo sapiens
ctgaaaatattctactg

SEQ ID NO: 1758516 - DNA, 19 bp, Homo sapiens
ctgaaaatatttttttcta

SEQ ID NO: 1758517 - DNA, 13 bp, Homo sapiens
ctgaaaatgcaaa

SEQ ID NO: 1758518 - DNA, 12 bp, Homo sapiens
ctgaccaccctc

SEQ ID NO: 1758519 - DNA, 22 bp, Homo sapiens
ctgaccacgctttctagctgtt

SEQ ID NO: 1758520 - DNA, 15 bp, Homo sapiens
ctgaccagagaatgc

SEQ ID NO: 1758521 - DNA, 20 bp, Homo sapiens
ctgaccagcggctgctcaag

SEQ ID NO: 1758522 - DNA, 19 bp, Homo sapiens
ctgaccagctgctccgagg

SEQ ID NO: 1758523 - DNA, 14 bp, Homo sapiens
ctgaccatctgtga

SEQ ID NO: 1758524 - DNA, 15 bp, Homo sapiens
ctgaccatctgtgac

SEQ ID NO: 1758525 - DNA, 16 bp, Homo sapiens
ctgaccatctgtgact

SEQ ID NO: 1758526 - DNA, 15 bp, Homo sapiens
ctgaccatgcgtcag

SEQ ID NO: 1758527 - DNA, 23 bp, Homo sapiens
ctgaccatgcgtcaggggcctag

SEQ ID NO: 1758528 - DNA, 15 bp, Homo sapiens
ctgaccatgctcatc

SEQ ID NO: 1758529 - DNA, 20 bp, Homo sapiens
ctgaccatgctcatctgctg

SEQ ID NO: 1758530 - DNA, 18 bp, Homo sapiens
ctgaccatttcaggggtc

SEQ ID NO: 1758531 - DNA, 13 bp, Homo sapiens
ctgacccaactgg

SEQ ID NO: 1758532 - DNA, 16 bp, Homo sapiens
ctgacccaactggggg

SEQ ID NO: 1758533 - DNA, 15 bp, Homo sapiens
ctgacccactgatct

SEQ ID NO: 1758534 - DNA, 23 bp, Homo sapiens
ctgacccactttgtaatttttgc

SEQ ID NO: 1758535 - DNA, 16 bp, Homo sapiens
ctgacccagagtggag

SEQ ID NO: 1758536 - DNA, 21 bp, Homo sapiens
ctgacccagccccttgagaaa

SEQ ID NO: 1758537 - DNA, 16 bp, Homo sapiens
ctgacccagtccctgg

SEQ ID NO: 1758538 - DNA, 18 bp, Homo sapiens
ctgacccagtccctgggg

SEQ ID NO: 1758539 - DNA, 23 bp, Homo sapiens
ctgacccagtgcccccactgacc

SEQ ID NO: 1758540 - DNA, 15 bp, Homo sapiens
ctgaccccctcccct

SEQ ID NO: 1758541 - DNA, 18 bp, Homo sapiens
ctgaccccgagaagtgct

SEQ ID NO: 1758542 - DNA, 19 bp, Homo sapiens
ctgaccccgagaagtgctc

SEQ ID NO: 1758543 - DNA, 23 bp, Homo sapiens
ctgaccccgagaagtgctcttgg

SEQ ID NO: 1758544 - DNA, 13 bp, Homo sapiens
ctgacccctctgg

SEQ ID NO: 1758545 - DNA, 15 bp, Homo sapiens
ctgacccctctggtg

SEQ ID NO: 1758546 - DNA, 13 bp, Homo sapiens
ctgacccctgctc

SEQ ID NO: 1758547 - DNA, 17 bp, Homo sapiens
ctgacccggaggaaagg

SEQ ID NO: 1758548 - DNA, 12 bp, Homo sapiens
ctgaccctgggc

SEQ ID NO: 1758549 - DNA, 17 bp, Homo sapiens
ctgaccctgggcctgga

SEQ ID NO: 1758550 - DNA, 16 bp, Homo sapiens
ctgacccttccagaca

SEQ ID NO: 1758551 - DNA, 17 bp, Homo sapiens
ctgacccttccagacat

SEQ ID NO: 1758552 - DNA, 14 bp, Homo sapiens
ctgacctaccccag

SEQ ID NO: 1758553 - DNA, 21 bp, Homo sapiens
ctgacctaccccagccaggct

SEQ ID NO: 1758554 - DNA, 20 bp, Homo sapiens
ctgacctacctcaaagggca

SEQ ID NO: 1758555 - DNA, 12 bp, Homo sapiens
ctgacctcacct

SEQ ID NO: 1758556 - DNA, 13 bp, Homo sapiens
ctgacctcacctg

SEQ ID NO: 1758557 - DNA, 18 bp, Homo sapiens
ctgacctcacctggtcct

SEQ ID NO: 1758558 - DNA, 21 bp, Homo sapiens
ctgacctcacctggtcctccg

SEQ ID NO: 1758559 - DNA, 17 bp, Homo sapiens
ctgacctcactgtcctg

SEQ ID NO: 1758560 - DNA, 21 bp, Homo sapiens
ctgacctccctctaatttatc

SEQ ID NO: 1758561 - DNA, 18 bp, Homo sapiens
ctgacctccgcccctgcc

SEQ ID NO: 1758562 - DNA, 12 bp, Homo sapiens
ctgacctgcagg

SEQ ID NO: 1758563 - DNA, 13 bp, Homo sapiens
ctgacctgcaggc

SEQ ID NO: 1758564 - DNA, 20 bp, Homo sapiens
ctgacctggtgggagcacct

SEQ ID NO: 1758565 - DNA, 17 bp, Homo sapiens
ctgacctgtcatgcccc

SEQ ID NO: 1758566 - DNA, 22 bp, Homo sapiens
ctgacctgtcatgcccccctca

SEQ ID NO: 1758567 - DNA, 23 bp, Homo sapiens
ctgacctgtcatgcccccctcaa

SEQ ID NO: 1758568 - DNA, 19 bp, Homo sapiens
ctgaccttagcgttctgga

SEQ ID NO: 1758569 - DNA, 14 bp, Homo sapiens
ctgaccttggagag

SEQ ID NO: 1758570 - DNA, 19 bp, Homo sapiens
ctgaccttggagagacaca

SEQ ID NO: 1758571 - DNA, 13 bp, Homo sapiens
ctgacgccctgcg

SEQ ID NO: 1758572 - DNA, 21 bp, Homo sapiens
ctgacgccctgcgttggagcc

SEQ ID NO: 1758573 - DNA, 20 bp, Homo sapiens
ctgacgcttgtgacagtgcc

SEQ ID NO: 1758574 - DNA, 16 bp, Homo sapiens
ctgacggagtcctgtg

SEQ ID NO: 1758575 - DNA, 19 bp, Homo sapiens
ctgacggccagggagaagc

SEQ ID NO: 1758576 - DNA, 19 bp, Homo sapiens
ctgacgtagaaagatcctt

SEQ ID NO: 1758577 - DNA, 13 bp, Homo sapiens
ctgacgtccacct

SEQ ID NO: 1758578 - DNA, 17 bp, Homo sapiens
ctgacgtgccttttgca

SEQ ID NO: 1758579 - DNA, 23 bp, Homo sapiens
ctgacgtgccttttgcacccctc

SEQ ID NO: 1758580 - DNA, 19 bp, Homo sapiens
ctgactaaactttttttct

SEQ ID NO: 1758581 - DNA, 15 bp, Homo sapiens
ctgactactttgcct

SEQ ID NO: 1758582 - DNA, 15 bp, Homo sapiens
ctgactatgacataa

SEQ ID NO: 1758583 - DNA, 18 bp, Homo sapiens
ctgactattcttgatgta

SEQ ID NO: 1758584 - DNA, 20 bp, Homo sapiens
ctgactattcttgatgtaaa

SEQ ID NO: 1758585 - DNA, 21 bp, Homo sapiens
ctgactattcttgatgtaaaa

SEQ ID NO: 1758586 - DNA, 22 bp, Homo sapiens
ctgactattcttgatgtaaaat

SEQ ID NO: 1758587 - DNA, 18 bp, Homo sapiens
ctgactcaattatttgca

SEQ ID NO: 1758588 - DNA, 20 bp, Homo sapiens
ctgactccagagtctgagcc

SEQ ID NO: 1758589 - DNA, 21 bp, Homo sapiens
ctgactccagagtctgagccc

SEQ ID NO: 1758590 - DNA, 15 bp, Homo sapiens
ctgactccttagaga

SEQ ID NO: 1758591 - DNA, 15 bp, Homo sapiens
ctgactcggtttctc

SEQ ID NO: 1758592 - DNA, 14 bp, Homo sapiens
ctgactctcacctg

SEQ ID NO: 1758593 - DNA, 15 bp, Homo sapiens
ctgactctgaaatct

SEQ ID NO: 1758594 - DNA, 20 bp, Homo sapiens
ctgactctgaaatctgaaga

SEQ ID NO: 1758595 - DNA, 15 bp, Homo sapiens
ctgactctgactcat

SEQ ID NO: 1758596 - DNA, 12 bp, Homo sapiens
ctgactcttatt

SEQ ID NO: 1758597 - DNA, 13 bp, Homo sapiens
ctgactcttattt

SEQ ID NO: 1758598 - DNA, 20 bp, Homo sapiens
ctgactcttattttttaaaa

SEQ ID NO: 1758599 - DNA, 16 bp, Homo sapiens
ctgactgaggcctgct

SEQ ID NO: 1758600 - DNA, 19 bp, Homo sapiens
ctgactgatgttgagggaa

SEQ ID NO: 1758601 - DNA, 15 bp, Homo sapiens
ctgactgcagccccc

SEQ ID NO: 1758602 - DNA, 14 bp, Homo sapiens
ctgactgccaagcc

SEQ ID NO: 1758603 - DNA, 18 bp, Homo sapiens
ctgactgccaagccagat

SEQ ID NO: 1758604 - DNA, 22 bp, Homo sapiens
ctgactgcccgctcctcgggaa

SEQ ID NO: 1758605 - DNA, 21 bp, Homo sapiens
ctgactgctcagaacttgctg

SEQ ID NO: 1758606 - DNA, 17 bp, Homo sapiens
ctgactgtccaggagct

SEQ ID NO: 1758607 - DNA, 13 bp, Homo sapiens
ctgactgtttatt

SEQ ID NO: 1758608 - DNA, 16 bp, Homo sapiens
ctgactgtttatttaa

SEQ ID NO: 1758609 - DNA, 19 bp, Homo sapiens
ctgactgtttatttaagga

SEQ ID NO: 1758610 - DNA, 22 bp, Homo sapiens
ctgactgtttatttaaggatgg

SEQ ID NO: 1758611 - DNA, 20 bp, Homo sapiens
ctgacttaagcaaaagaaaa

SEQ ID NO: 1758612 - DNA, 16 bp, Homo sapiens
ctgacttcagtgggac

SEQ ID NO: 1758613 - DNA, 16 bp, Homo sapiens
ctgacttcctctgatt

SEQ ID NO: 1758614 - DNA, 13 bp, Homo sapiens
ctgacttctaagt

SEQ ID NO: 1758615 - DNA, 13 bp, Homo sapiens
ctgacttctgcct

SEQ ID NO: 1758616 - DNA, 15 bp, Homo sapiens
ctgacttctgcctgg

SEQ ID NO: 1758617 - DNA, 16 bp, Homo sapiens
ctgacttctgcctgga

SEQ ID NO: 1758618 - DNA, 18 bp, Homo sapiens
ctgacttctgcctggaga

SEQ ID NO: 1758619 - DNA, 12 bp, Homo sapiens
ctgacttgcttt

SEQ ID NO: 1758620 - DNA, 13 bp, Homo sapiens
ctgacttgcttta

SEQ ID NO: 1758621 - DNA, 20 bp, Homo sapiens
ctgacttggatcccaaagca

SEQ ID NO: 1758622 - DNA, 21 bp, Homo sapiens
ctgacttggatcccaaagcaa

SEQ ID NO: 1758623 - DNA, 17 bp, Homo sapiens
ctgacttggcacttaag

SEQ ID NO: 1758624 - DNA, 17 bp, Homo sapiens
ctgacttgtttgtcttc

SEQ ID NO: 1758625 - DNA, 20 bp, Homo sapiens
ctgacttgtttgtcttccat

SEQ ID NO: 1758626 - DNA, 18 bp, Homo sapiens
ctgactttctgattactg

SEQ ID NO: 1758627 - DNA, 12 bp, Homo sapiens
ctgagaaactct

SEQ ID NO: 1758628 - DNA, 13 bp, Homo sapiens
ctgagaaagacta

SEQ ID NO: 1758629 - DNA, 15 bp, Homo sapiens
ctgagaaagactatt

SEQ ID NO: 1758630 - DNA, 18 bp, Homo sapiens
ctgagaaagactattcaa

SEQ ID NO: 1758631 - DNA, 20 bp, Homo sapiens
ctgagaactcgttcacctcc

SEQ ID NO: 1758632 - DNA, 16 bp, Homo sapiens
ctgagaagctctgaag

SEQ ID NO: 1758633 - DNA, 15 bp, Homo sapiens
ctgagggtgcccttt

SEQ ID NO: 1758634 - DNA, 15 bp, Homo sapiens
ctgagggtggagact

SEQ ID NO: 1758635 - DNA, 19 bp, Homo sapiens
ctgagggtgtttcttcctg

SEQ ID NO: 1758636 - DNA, 20 bp, Homo sapiens
ctgagggtgtttcttcctgc

SEQ ID NO: 1758637 - DNA, 14 bp, Homo sapiens
ctgaggtcactgct

SEQ ID NO: 1758638 - DNA, 19 bp, Homo sapiens
ctgaggtcaggagttcaag

SEQ ID NO: 1758639 - DNA, 21 bp, Homo sapiens
ctgaggtccttatgtcctgtc

SEQ ID NO: 1758640 - DNA, 19 bp, Homo sapiens
ctgaggtctcttgagggag

SEQ ID NO: 1758641 - DNA, 20 bp, Homo sapiens
ctgaggtgggcagatcacga

SEQ ID NO: 1758642 - DNA, 15 bp, Homo sapiens
ctgaggtgggcccag

SEQ ID NO: 1758643 - DNA, 17 bp, Homo sapiens
ctgaggtgggcccagga

SEQ ID NO: 1758644 - DNA, 18 bp, Homo sapiens
ctgaggtgggctggggct

SEQ ID NO: 1758645 - DNA, 14 bp, Homo sapiens
ctgaggttcctctg

SEQ ID NO: 1758646 - DNA, 15 bp, Homo sapiens
ctgaggttcctctgc

SEQ ID NO: 1758647 - DNA, 18 bp, Homo sapiens
ctgagtagctctgccttt

SEQ ID NO: 1758648 - DNA, 20 bp, Homo sapiens
ctgagtagctggaattacag

SEQ ID NO: 1758649 - DNA, 20 bp, Homo sapiens
ctgagtagctggattacagg

SEQ ID NO: 1758650 - DNA, 15 bp, Homo sapiens
ctgagtcaaatccag

SEQ ID NO: 1758651 - DNA, 17 bp, Homo sapiens
ctgagtcaactggagca

SEQ ID NO: 1758652 - DNA, 18 bp, Homo sapiens
ctgagtcagtgctctcag

SEQ ID NO: 1758653 - DNA, 21 bp, Homo sapiens
ctgagtcagtgctctcagctg

SEQ ID NO: 1758654 - DNA, 17 bp, Homo sapiens
ctgagtcatctgttagg

SEQ ID NO: 1758655 - DNA, 22 bp, Homo sapiens
ctgagtcatgatctccctgccg

SEQ ID NO: 1758656 - DNA, 21 bp, Homo sapiens
ctgagtcccaggagctgccca

SEQ ID NO: 1758657 - DNA, 22 bp, Homo sapiens
ctgagtcccaggagctgcccag

SEQ ID NO: 1758658 - DNA, 21 bp, Homo sapiens
ctgagtcctggtttcctggca

SEQ ID NO: 1758659 - DNA, 18 bp, Homo sapiens
ctgagtcctgtctctgcc

SEQ ID NO: 1758660 - DNA, 20 bp, Homo sapiens
ctgagtcggccccacatggg

SEQ ID NO: 1758661 - DNA, 18 bp, Homo sapiens
ctgagtcgtacagaaagc

SEQ ID NO: 1758662 - DNA, 21 bp, Homo sapiens
ctgagtcgtacagaaagctgc

SEQ ID NO: 1758663 - DNA, 16 bp, Homo sapiens
ctgagtctccagggcc

SEQ ID NO: 1758664 - DNA, 13 bp, Homo sapiens
ctgagtgaaaaat

SEQ ID NO: 1758665 - DNA, 14 bp, Homo sapiens
ctgagtgacagagc

SEQ ID NO: 1758666 - DNA, 19 bp, Homo sapiens
ctgagtgcagccgtttgag

SEQ ID NO: 1758667 - DNA, 17 bp, Homo sapiens
ctgagtggaatgcaggg

SEQ ID NO: 1758668 - DNA, 23 bp, Homo sapiens
ctgagtggaatgcagggaagagg

SEQ ID NO: 1758669 - DNA, 16 bp, Homo sapiens
ctgagtggcagcagcc

SEQ ID NO: 1758670 - DNA, 13 bp, Homo sapiens
ctgagtggcaggg

SEQ ID NO: 1758671 - DNA, 15 bp, Homo sapiens
ctgagtgggaagccc

SEQ ID NO: 1758672 - DNA, 22 bp, Homo sapiens
ctgagtgtcatgaagtgcacag

SEQ ID NO: 1758673 - DNA, 22 bp, Homo sapiens
ctgagttacttgtctgaggcct

SEQ ID NO: 1758674 - DNA, 23 bp, Homo sapiens
ctgagttacttgtctgaggcctc

SEQ ID NO: 1758675 - DNA, 13 bp, Homo sapiens
ctgagttataaat

SEQ ID NO: 1758676 - DNA, 14 bp, Homo sapiens
ctgagttataaata

SEQ ID NO: 1758677 - DNA, 13 bp, Homo sapiens
ctgagttatgatg

SEQ ID NO: 1758678 - DNA, 15 bp, Homo sapiens
ctgagttgcttttca

SEQ ID NO: 1758679 - DNA, 14 bp, Homo sapiens
ctgagttggcctgg

SEQ ID NO: 1758680 - DNA, 18 bp, Homo sapiens
ctgagttggcctggccat

SEQ ID NO: 1758681 - DNA, 14 bp, Homo sapiens
ctgagttgttctaa

SEQ ID NO: 1758682 - DNA, 18 bp, Homo sapiens
ctgagtttaccatttgta

SEQ ID NO: 1758683 - DNA, 12 bp, Homo sapiens
ctgagtttccta

SEQ ID NO: 1758684 - DNA, 20 bp, Homo sapiens
ctgagttttgtgtttgttgt

SEQ ID NO: 1758685 - DNA, 15 bp, Homo sapiens
ctgagttttgttttg

SEQ ID NO: 1758686 - DNA, 22 bp, Homo sapiens
ctgataaacattaaacactgta

SEQ ID NO: 1758687 - DNA, 16 bp, Homo sapiens
ctgataaacctaatat

SEQ ID NO: 1758688 - DNA, 22 bp, Homo sapiens
ctgataaacctaatattcaatg

SEQ ID NO: 1758689 - DNA, 14 bp, Homo sapiens
ctgataaactgacg

SEQ ID NO: 1758690 - DNA, 14 bp, Homo sapiens
ctgataaagaaaga

SEQ ID NO: 1758691 - DNA, 18 bp, Homo sapiens
ctgataaagcacagctgt

SEQ ID NO: 1758692 - DNA, 22 bp, Homo sapiens
ctgataaatattcacacttgaa

SEQ ID NO: 1758693 - DNA, 13 bp, Homo sapiens
ctgataacaacct

SEQ ID NO: 1758694 - DNA, 18 bp, Homo sapiens
ctgataacttggggaggc

SEQ ID NO: 1758695 - DNA, 22 bp, Homo sapiens
ctgatagaaatggtttcctctg

SEQ ID NO: 1758696 - DNA, 23 bp, Homo sapiens
ctgatagaaatggtttcctctgg

SEQ ID NO: 1758697 - DNA, 18 bp, Homo sapiens
ctgatagtcacctgctgg

SEQ ID NO: 1758698 - DNA, 19 bp, Homo sapiens
ctgatagtcacctgctggt

SEQ ID NO: 1758699 - DNA, 21 bp, Homo sapiens
ctgatagtcacctgctggttg

SEQ ID NO: 1758700 - DNA, 15 bp, Homo sapiens
ctgatatatgtgttt

SEQ ID NO: 1758701 - DNA, 21 bp, Homo sapiens
ctgatatgatttaaaacatgt

SEQ ID NO: 1758702 - DNA, 14 bp, Homo sapiens
ctgatattaatcaa

SEQ ID NO: 1758703 - DNA, 21 bp, Homo sapiens
ctgatattaatcaaaattgtc

SEQ ID NO: 1758704 - DNA, 18 bp, Homo sapiens
ctgatcaaaaataaacta

SEQ ID NO: 1758705 - DNA, 18 bp, Homo sapiens
ctgatcaagtcaccggag

SEQ ID NO: 1758706 - DNA, 22 bp, Homo sapiens
ctgatcaagtcaccggagcttt

SEQ ID NO: 1758707 - DNA, 15 bp, Homo sapiens
ctgatcacccaatgc

SEQ ID NO: 1758708 - DNA, 17 bp, Homo sapiens
ctgatcaggcttcctgg

SEQ ID NO: 1758709 - DNA, 18 bp, Homo sapiens
ctgatcatcgccagaggt

SEQ ID NO: 1758710 - DNA, 15 bp, Homo sapiens
ctgatccagagcaca

SEQ ID NO: 1758711 - DNA, 20 bp, Homo sapiens
ctgatccagcctttccaagt

SEQ ID NO: 1758712 - DNA, 16 bp, Homo sapiens
ctgatccagtttccgg

SEQ ID NO: 1758713 - DNA, 14 bp, Homo sapiens
ctgatcccaccccc

SEQ ID NO: 1758714 - DNA, 18 bp, Homo sapiens
ctgatcccaccccctcct

SEQ ID NO: 1758715 - DNA, 20 bp, Homo sapiens
ctgatcccattttcctctga

SEQ ID NO: 1758716 - DNA, 23 bp, Homo sapiens
ctgatcccggccggccctggctt

SEQ ID NO: 1758717 - DNA, 20 bp, Homo sapiens
ctgatccctgaacccctggc

SEQ ID NO: 1758718 - DNA, 22 bp, Homo sapiens
ctgatccctgaacccctggcca

SEQ ID NO: 1758719 - DNA, 16 bp, Homo sapiens
ctgatccctgctctct

SEQ ID NO: 1758720 - DNA, 16 bp, Homo sapiens
ctgatcctaagaattt

SEQ ID NO: 1758721 - DNA, 15 bp, Homo sapiens
ctgatcctgctccag

SEQ ID NO: 1758722 - DNA, 18 bp, Homo sapiens
ctgatcctgctccagcag

SEQ ID NO: 1758723 - DNA, 17 bp, Homo sapiens
ctgatcctgctgacctc

SEQ ID NO: 1758724 - DNA, 18 bp, Homo sapiens
ctgatcctggaggcccag

SEQ ID NO: 1758725 - DNA, 20 bp, Homo sapiens
ctgatcgccaacctttcccc

SEQ ID NO: 1758726 - DNA, 15 bp, Homo sapiens
ctgatcgtgctaaat

SEQ ID NO: 1758727 - DNA, 15 bp, Homo sapiens
ctgatctcagggaag

SEQ ID NO: 1758728 - DNA, 23 bp, Homo sapiens
ctgatctctactaccacaaggaa

SEQ ID NO: 1758729 - DNA, 11 bp, Homo sapiens
ctgatctgccc

SEQ ID NO: 1758730 - DNA, 17 bp, Homo sapiens
ctgatctgcccatcgtg

SEQ ID NO: 1758731 - DNA, 21 bp, Homo sapiens
ctgatctgcccatcgtgaaga

SEQ ID NO: 1758732 - DNA, 23 bp, Homo sapiens
ctgatctgcccatcgtgaagaag

SEQ ID NO: 1758733 - DNA, 12 bp, Homo sapiens
ctgatctggacc

SEQ ID NO: 1758734 - DNA, 13 bp, Homo sapiens
ctgatctggaccc

SEQ ID NO: 1758735 - DNA, 18 bp, Homo sapiens
ctgatctttgtatattac

SEQ ID NO: 1758736 - DNA, 16 bp, Homo sapiens
ctgatgaaatctgcta

SEQ ID NO: 1758737 - DNA, 22 bp, Homo sapiens
ctgatgaaatctgctagaaagt

SEQ ID NO: 1758738 - DNA, 12 bp, Homo sapiens
ctgatgaagaag

SEQ ID NO: 1758739 - DNA, 23 bp, Homo sapiens
ctgatgaatgtaaagttacactg

SEQ ID NO: 1758740 - DNA, 17 bp, Homo sapiens
ctgatgagatttttaaa

SEQ ID NO: 1758741 - DNA, 23 bp, Homo sapiens
ctgatgagtgattgacacacagc

SEQ ID NO: 1758742 - DNA, 18 bp, Homo sapiens
ctgatgagtttcactgta

SEQ ID NO: 1758743 - DNA, 20 bp, Homo sapiens
ctgatgatttgtttttgtat

SEQ ID NO: 1758744 - DNA, 14 bp, Homo sapiens
ctgatgattttcct

SEQ ID NO: 1758745 - DNA, 14 bp, Homo sapiens
ctgatgcagacaca

SEQ ID NO: 1758746 - DNA, 14 bp, Homo sapiens
ctgatgcccctgac

SEQ ID NO: 1758747 - DNA, 20 bp, Homo sapiens
ctgcagcaggtgctgggctg

SEQ ID NO: 1758748 - DNA, 23 bp, Homo sapiens
ctgcagcaggtgctgggctggac

SEQ ID NO: 1758749 - DNA, 11 bp, Homo sapiens
ctgcagcatga

SEQ ID NO: 1758750 - DNA, 12 bp, Homo sapiens
ctgcagccagcc

SEQ ID NO: 1758751 - DNA, 14 bp, Homo sapiens
ctgcagccagctca

SEQ ID NO: 1758752 - DNA, 21 bp, Homo sapiens
ctgcagcccaaaacccagggc

SEQ ID NO: 1758753 - DNA, 22 bp, Homo sapiens
ctgcagcccaaaacccagggca

SEQ ID NO: 1758754 - DNA, 16 bp, Homo sapiens
ctgcagccctgccagt

SEQ ID NO: 1758755 - DNA, 11 bp, Homo sapiens
ctgcagcctcc

SEQ ID NO: 1758756 - DNA, 12 bp, Homo sapiens
ctgcagcctcca

SEQ ID NO: 1758757 - DNA, 14 bp, Homo sapiens
ctgcagcctccact

SEQ ID NO: 1758758 - DNA, 22 bp, Homo sapiens
ctgcagcctcccttccatgccc

SEQ ID NO: 1758759 - DNA, 19 bp, Homo sapiens
ctgcagcctccgcctcccg

SEQ ID NO: 1758760 - DNA, 16 bp, Homo sapiens
ctgcagcctcctcctg

SEQ ID NO: 1758761 - DNA, 17 bp, Homo sapiens
ctgcagcctcctcctga

SEQ ID NO: 1758762 - DNA, 18 bp, Homo sapiens
ctgcagcctcctcctgac

SEQ ID NO: 1758763 - DNA, 18 bp, Homo sapiens
ctgcagcctttgcctccc

SEQ ID NO: 1758764 - DNA, 18 bp, Homo sapiens
ctgcagcggcaggaccgc

SEQ ID NO: 1758765 - DNA, 19 bp, Homo sapiens
ctgcagctcaagggctggc

SEQ ID NO: 1758766 - DNA, 20 bp, Homo sapiens
ctgcagctcaagggctggca

SEQ ID NO: 1758767 - DNA, 14 bp, Homo sapiens
ctgcagctgacctc

SEQ ID NO: 1758768 - DNA, 12 bp, Homo sapiens
ctgcagctgctg

SEQ ID NO: 1758769 - DNA, 20 bp, Homo sapiens
ctgcagctgtttcaaagttg

SEQ ID NO: 1758770 - DNA, 21 bp, Homo sapiens
ctgcagcttctaactggtaaa

SEQ ID NO: 1758771 - DNA, 18 bp, Homo sapiens
ctgcaggaaatagtcact

SEQ ID NO: 1758772 - DNA, 19 bp, Homo sapiens
ctgcaggaacgagcactgg

SEQ ID NO: 1758773 - DNA, 20 bp, Homo sapiens
ctgcaggaacgagcactggc

SEQ ID NO: 1758774 - DNA, 23 bp, Homo sapiens
ctgcaggaacgagcactggccag

SEQ ID NO: 1758775 - DNA, 13 bp, Homo sapiens
ctgcaggaagaaa

SEQ ID NO: 1758776 - DNA, 17 bp, Homo sapiens
ctgcaggaagaaacttt

SEQ ID NO: 1758777 - DNA, 16 bp, Homo sapiens
ctgcaggacttctgcc

SEQ ID NO: 1758778 - DNA, 22 bp, Homo sapiens
ctgcaggacttctgcctgaacc

SEQ ID NO: 1758779 - DNA, 17 bp, Homo sapiens
ctgcaggagtgtcctgc

SEQ ID NO: 1758780 - DNA, 19 bp, Homo sapiens
ctgcaggccaagagcagag

SEQ ID NO: 1758781 - DNA, 21 bp, Homo sapiens
ctgcaggccaagagcagaggc

SEQ ID NO: 1758782 - DNA, 11 bp, Homo sapiens
ctgcaggcccc

SEQ ID NO: 1758783 - DNA, 13 bp, Homo sapiens
ctgcaggccctgg

SEQ ID NO: 1758784 - DNA, 18 bp, Homo sapiens
ctgcaggccctggcctcc

SEQ ID NO: 1758785 - DNA, 16 bp, Homo sapiens
ctgcaggctccatgca

SEQ ID NO: 1758786 - DNA, 22 bp, Homo sapiens
ctgcaggctccatgcacctccc

SEQ ID NO: 1758787 - DNA, 11 bp, Homo sapiens
ctgcaggctgg

SEQ ID NO: 1758788 - DNA, 21 bp, Homo sapiens
ctgcaggcttaggtcctcact

SEQ ID NO: 1758789 - DNA, 15 bp, Homo sapiens
ctgcagggacacggg

SEQ ID NO: 1758790 - DNA, 20 bp, Homo sapiens
ctgcagggacacgggcagcc

SEQ ID NO: 1758791 - DNA, 14 bp, Homo sapiens
ctgcagggccatct

SEQ ID NO: 1758792 - DNA, 20 bp, Homo sapiens
ctgcagggccgcgagaggcc

SEQ ID NO: 1758793 - DNA, 16 bp, Homo sapiens
ctgcaggggcctctgt

SEQ ID NO: 1758794 - DNA, 16 bp, Homo sapiens
ctgcagggtggtgctg

SEQ ID NO: 1758795 - DNA, 19 bp, Homo sapiens
ctgcagggtggtgctggga

SEQ ID NO: 1758796 - DNA, 22 bp, Homo sapiens
ctgcagggtggtgctgggactg

SEQ ID NO: 1758797 - DNA, 23 bp, Homo sapiens
ctgcagggtggtgctgggactga

SEQ ID NO: 1758798 - DNA, 16 bp, Homo sapiens
ctgcaggtacttcctc

SEQ ID NO: 1758799 - DNA, 20 bp, Homo sapiens
ctgcaggtcagttgtaataa

SEQ ID NO: 1758800 - DNA, 18 bp, Homo sapiens
ctgcaggtgttctgctga

SEQ ID NO: 1758801 - DNA, 11 bp, Homo sapiens
ctgcagtcaca

SEQ ID NO: 1758802 - DNA, 21 bp, Homo sapiens
ctgcagtcatctcccctcctg

SEQ ID NO: 1758803 - DNA, 23 bp, Homo sapiens
ctgcagtcatctcccctcctggc

SEQ ID NO: 1758804 - DNA, 14 bp, Homo sapiens
ctgcagtccgcagt

SEQ ID NO: 1758805 - DNA, 16 bp, Homo sapiens
ctgcagtcggcatgcc

SEQ ID NO: 1758806 - DNA, 17 bp, Homo sapiens
ctgcagtcggcatgcca

SEQ ID NO: 1758807 - DNA, 22 bp, Homo sapiens
ctgcagtcggcatgccaggacc

SEQ ID NO: 1758808 - DNA, 17 bp, Homo sapiens
ctgcagtcttctctctg

SEQ ID NO: 1758809 - DNA, 18 bp, Homo sapiens
ctgcagtcttctctctgg

SEQ ID NO: 1758810 - DNA, 23 bp, Homo sapiens
ctgcagtcttctctctggctcag

SEQ ID NO: 1758811 - DNA, 16 bp, Homo sapiens
ctgcagtgaggctgta

SEQ ID NO: 1758812 - DNA, 18 bp, Homo sapiens
ctgcagtgatggcgcggg

SEQ ID NO: 1758813 - DNA, 22 bp, Homo sapiens
ctgcagtgatggcgcgggaggc

SEQ ID NO: 1758814 - DNA, 9 bp, Homo sapiens
ctgcagtgc

SEQ ID NO: 1758815 - DNA, 11 bp, Homo sapiens
ctgcagtgcca

SEQ ID NO: 1758816 - DNA, 18 bp, Homo sapiens
ctgcagtgccagctccct

SEQ ID NO: 1758817 - DNA, 14 bp, Homo sapiens
ctgcagtgtgcccc

SEQ ID NO: 1758818 - DNA, 23 bp, Homo sapiens
ctgcagttcatccgcactgtaaa

SEQ ID NO: 1758819 - DNA, 14 bp, Homo sapiens
ctgcagtttcctgg

SEQ ID NO: 1758820 - DNA, 15 bp, Homo sapiens
ctgcagtttggccct

SEQ ID NO: 1758821 - DNA, 21 bp, Homo sapiens
ctgcagtttggccctggagcc

SEQ ID NO: 1758822 - DNA, 15 bp, Homo sapiens
ctgcagtttttcagg

SEQ ID NO: 1758823 - DNA, 14 bp, Homo sapiens
ctgcataagtaatt

SEQ ID NO: 1758824 - DNA, 15 bp, Homo sapiens
ctgcataatgtttct

SEQ ID NO: 1758825 - DNA, 22 bp, Homo sapiens
ctgcataatgtttctggatttc

SEQ ID NO: 1758826 - DNA, 17 bp, Homo sapiens
ctgcatacccgggcagg

SEQ ID NO: 1758827 - DNA, 23 bp, Homo sapiens
ctgcataggagtttggaggaagt

SEQ ID NO: 1758828 - DNA, 21 bp, Homo sapiens
ctgcatatcctggtgtctagt

SEQ ID NO: 1758829 - DNA, 14 bp, Homo sapiens
ctgcatatttgtgc

SEQ ID NO: 1758830 - DNA, 14 bp, Homo sapiens
ctgcatcatctgta

SEQ ID NO: 1758831 - DNA, 20 bp, Homo sapiens
ctgcatccgtagttccctga

SEQ ID NO: 1758832 - DNA, 13 bp, Homo sapiens
ctgcatccttcct

SEQ ID NO: 1758833 - DNA, 15 bp, Homo sapiens
ctgcatctactccca

SEQ ID NO: 1758834 - DNA, 13 bp, Homo sapiens
ctgcatgaaaaat

SEQ ID NO: 1758835 - DNA, 15 bp, Homo sapiens
ctgcatgaatatcat

SEQ ID NO: 1758836 - DNA, 16 bp, Homo sapiens
ctgcatgagctggcaa

SEQ ID NO: 1758837 - DNA, 20 bp, Homo sapiens
ctgcatgatgtttgcccaaa

SEQ ID NO: 1758838 - DNA, 17 bp, Homo sapiens
ctgcatgctctggaagc

SEQ ID NO: 1758839 - DNA, 19 bp, Homo sapiens
ctgcatggacctaacattc

SEQ ID NO: 1758840 - DNA, 22 bp, Homo sapiens
ctgcatggacctaacattcgat

SEQ ID NO: 1758841 - DNA, 19 bp, Homo sapiens
ctgcatggggaggcagcag

SEQ ID NO: 1758842 - DNA, 23 bp, Homo sapiens
ctgcatggggctggggtcctcct

SEQ ID NO: 1758843 - DNA, 24 bp, Homo sapiens
ctgcatggggctggggtcctcctg

SEQ ID NO: 1758844 - DNA, 20 bp, Homo sapiens
ctgcatgtagaggcttgttt

SEQ ID NO: 1758845 - DNA, 20 bp, Homo sapiens
ctgcattcacccagacagct

SEQ ID NO: 1758846 - DNA, 16 bp, Homo sapiens
ctgcattcctgtgccc

SEQ ID NO: 1758847 - DNA, 13 bp, Homo sapiens
ctgcattctctcc

SEQ ID NO: 1758848 - DNA, 16 bp, Homo sapiens
ctgcattctctcccat

SEQ ID NO: 1758849 - DNA, 19 bp, Homo sapiens
ctgcattctctcccatcct

SEQ ID NO: 1758850 - DNA, 22 bp, Homo sapiens
ctgcattctctcccatcctggg

SEQ ID NO: 1758851 - DNA, 21 bp, Homo sapiens
ctgcattctgcctctctagga

SEQ ID NO: 1758852 - DNA, 23 bp, Homo sapiens
ctgcattgagcttgcatgcttgc

SEQ ID NO: 1758853 - DNA, 17 bp, Homo sapiens
ctgcattgctagataaa

SEQ ID NO: 1758854 - DNA, 15 bp, Homo sapiens
ctgcattggcctggc

SEQ ID NO: 1758855 - DNA, 17 bp, Homo sapiens
ctgcattggcctggcct

SEQ ID NO: 1758856 - DNA, 21 bp, Homo sapiens
ctgcattggcctggcctccag

SEQ ID NO: 1758857 - DNA, 23 bp, Homo sapiens
ctgcattggcctggcctccagct

SEQ ID NO: 1758858 - DNA, 20 bp, Homo sapiens
ctgcatttcacatgccttgc

SEQ ID NO: 1758859 - DNA, 14 bp, Homo sapiens
ctgcattttcctct

SEQ ID NO: 1758860 - DNA, 22 bp, Homo sapiens
ctgcattttcctcttgtcctgg

SEQ ID NO: 1758861 - DNA, 17 bp, Homo sapiens
ctgcccaggagcagctt

SEQ ID NO: 1758862 - DNA, 21 bp, Homo sapiens
ctgcccaggggtgccccctcc

SEQ ID NO: 1758863 - DNA, 23 bp, Homo sapiens
ctgcccagtcgaccccaaaggaa

SEQ ID NO: 1758864 - DNA, 19 bp, Homo sapiens
ctgcccagtgcaaaccact

SEQ ID NO: 1758865 - DNA, 12 bp, Homo sapiens
ctgcccagtgtt

SEQ ID NO: 1758866 - DNA, 21 bp, Homo sapiens
ctgcccagtgttgtttgtaaa

SEQ ID NO: 1758867 - DNA, 21 bp, Homo sapiens
ctgcccatcgtgaagaagcct

SEQ ID NO: 1758868 - DNA, 15 bp, Homo sapiens
ctgccccaaacaaat

SEQ ID NO: 1758869 - DNA, 16 bp, Homo sapiens
ctgccccaactcctgg

SEQ ID NO: 1758870 - DNA, 21 bp, Homo sapiens
ctgccccaactcctggaagct

SEQ ID NO: 1758871 - DNA, 12 bp, Homo sapiens
ctgccccaagca

SEQ ID NO: 1758872 - DNA, 16 bp, Homo sapiens
ctgccccaagcagcca

SEQ ID NO: 1758873 - DNA, 18 bp, Homo sapiens
ctgccccaagcagccagc

SEQ ID NO: 1758874 - DNA, 23 bp, Homo sapiens
ctgccccaagcccccaaccccgc

SEQ ID NO: 1758875 - DNA, 19 bp, Homo sapiens
ctgccccaatcgggtccag

SEQ ID NO: 1758876 - DNA, 15 bp, Homo sapiens
ctgccccacctgccg

SEQ ID NO: 1758877 - DNA, 23 bp, Homo sapiens
ctgccccagaggtcgcagctacc

SEQ ID NO: 1758878 - DNA, 14 bp, Homo sapiens
ctgccccagcccag

SEQ ID NO: 1758879 - DNA, 14 bp, Homo sapiens
ctgccccagccccg

SEQ ID NO: 1758880 - DNA, 14 bp, Homo sapiens
ctgccccagcctgt

SEQ ID NO: 1758881 - DNA, 19 bp, Homo sapiens
ctgccccagctctggcttc

SEQ ID NO: 1758882 - DNA, 21 bp, Homo sapiens
ctgccccaggccggagcccag

SEQ ID NO: 1758883 - DNA, 13 bp, Homo sapiens
ctgccccaggcct

SEQ ID NO: 1758884 - DNA, 22 bp, Homo sapiens
ctgccccatcattgcacctgca

SEQ ID NO: 1758885 - DNA, 15 bp, Homo sapiens
ctgcccccaccccgg

SEQ ID NO: 1758886 - DNA, 16 bp, Homo sapiens
ctgcccccaggactgg

SEQ ID NO: 1758887 - DNA, 18 bp, Homo sapiens
ctgcccccaggactgggc

SEQ ID NO: 1758888 - DNA, 19 bp, Homo sapiens
ctgcccccaggactgggcc

SEQ ID NO: 1758889 - DNA, 14 bp, Homo sapiens
ctgcccccatctcc

SEQ ID NO: 1758890 - DNA, 19 bp, Homo sapiens
ctgccccccagcctctggc

SEQ ID NO: 1758891 - DNA, 21 bp, Homo sapiens
ctgccccccagcctctggcat

SEQ ID NO: 1758892 - DNA, 15 bp, Homo sapiens
ctgccccccctaaga

SEQ ID NO: 1758893 - DNA, 20 bp, Homo sapiens
ctgccccccctaagagacac

SEQ ID NO: 1758894 - DNA, 21 bp, Homo sapiens
ctgccccccgaggctgctaga

SEQ ID NO: 1758895 - DNA, 23 bp, Homo sapiens
ctgcccccgctcccgctcccagg

SEQ ID NO: 1758896 - DNA, 19 bp, Homo sapiens
ctgccccctcgggggcctg

SEQ ID NO: 1758897 - DNA, 20 bp, Homo sapiens
ctgccccctcgggggcctgt

SEQ ID NO: 1758898 - DNA, 21 bp, Homo sapiens
ctgccccctcgggggcctgtg

SEQ ID NO: 1758899 - DNA, 17 bp, Homo sapiens
ctgccccggcctcctcg

SEQ ID NO: 1758900 - DNA, 20 bp, Homo sapiens
ctgccccgggtccccagctc

SEQ ID NO: 1758901 - DNA, 21 bp, Homo sapiens
ctgccccgttgcttcccgctg

SEQ ID NO: 1758902 - DNA, 20 bp, Homo sapiens
ctgcccctaatctctgtagg

SEQ ID NO: 1758903 - DNA, 23 bp, Homo sapiens
ctgcccctacgggcgctgcagcc

SEQ ID NO: 1758904 - DNA, 17 bp, Homo sapiens
ctgcccctaggatgctg

SEQ ID NO: 1758905 - DNA, 14 bp, Homo sapiens
ctgcccctccccca

SEQ ID NO: 1758906 - DNA, 13 bp, Homo sapiens
ctgcccctccctt

SEQ ID NO: 1758907 - DNA, 13 bp, Homo sapiens
ctgcccctctcac

SEQ ID NO: 1758908 - DNA, 13 bp, Homo sapiens
ctgcccctggcac

SEQ ID NO: 1758909 - DNA, 14 bp, Homo sapiens
ctgcccctggcacc

SEQ ID NO: 1758910 - DNA, 22 bp, Homo sapiens
ctgccccttcctttaaaaaact

SEQ ID NO: 1758911 - DNA, 13 bp, Homo sapiens
ctgccccttgggc

SEQ ID NO: 1758912 - DNA, 19 bp, Homo sapiens
ctgccccttgggcatccac

SEQ ID NO: 1758913 - DNA, 16 bp, Homo sapiens
ctgcccgagagagctc

SEQ ID NO: 1758914 - DNA, 21 bp, Homo sapiens
ctgcccgctcccaacccccct

SEQ ID NO: 1758915 - DNA, 13 bp, Homo sapiens
ctgcccggggtgg

SEQ ID NO: 1758916 - DNA, 16 bp, Homo sapiens
ctgcccgtcttcagcc

SEQ ID NO: 1758917 - DNA, 17 bp, Homo sapiens
ctgccctaacctgacag

SEQ ID NO: 1758918 - DNA, 12 bp, Homo sapiens
ctgccctaagcc

SEQ ID NO: 1758919 - DNA, 21 bp, Homo sapiens
ctgccctaagcccccagggcc

SEQ ID NO: 1758920 - DNA, 15 bp, Homo sapiens
ctgccctagctccac

SEQ ID NO: 1758921 - DNA, 22 bp, Homo sapiens
ctgccctagctccacaccctct

SEQ ID NO: 1758922 - DNA, 13 bp, Homo sapiens
ctgccctagctga

SEQ ID NO: 1758923 - DNA, 16 bp, Homo sapiens
ctgccctagctgaccc

SEQ ID NO: 1758924 - DNA, 17 bp, Homo sapiens
ctgccctagctgacccc

SEQ ID NO: 1758925 - DNA, 20 bp, Homo sapiens
ctgccctagctgaccccgag

SEQ ID NO: 1758926 - DNA, 16 bp, Homo sapiens
ctgccctatgggcctg

SEQ ID NO: 1758927 - DNA, 12 bp, Homo sapiens
ctgccctcactc

SEQ ID NO: 1758928 - DNA, 13 bp, Homo sapiens
ctgccctcactcc

SEQ ID NO: 1758929 - DNA, 20 bp, Homo sapiens
ctgccctcccaagtcccacc

SEQ ID NO: 1758930 - DNA, 20 bp, Homo sapiens
ctgccctcccacagcctcct

SEQ ID NO: 1758931 - DNA, 12 bp, Homo sapiens
ctgccctcccct

SEQ ID NO: 1758932 - DNA, 17 bp, Homo sapiens
ctgccctcccctgctcc

SEQ ID NO: 1758933 - DNA, 17 bp, Homo sapiens
ctgccctccttaatttg

SEQ ID NO: 1758934 - DNA, 22 bp, Homo sapiens
ctgccctcgtggccagcccggc

SEQ ID NO: 1758935 - DNA, 12 bp, Homo sapiens
ctgccctctgcc

SEQ ID NO: 1758936 - DNA, 15 bp, Homo sapiens
ctgccctctgctctg

SEQ ID NO: 1758937 - DNA, 16 bp, Homo sapiens
ctgccctctgctgctg

SEQ ID NO: 1758938 - DNA, 15 bp, Homo sapiens
ctgccctctgggtcc

SEQ ID NO: 1758939 - DNA, 19 bp, Homo sapiens
ctgccctcttaagatctga

SEQ ID NO: 1758940 - DNA, 21 bp, Homo sapiens
ctgccctgatgcgtctaccca

SEQ ID NO: 1758941 - DNA, 20 bp, Homo sapiens
ctgccctgcacgtcatggga

SEQ ID NO: 1758942 - DNA, 16 bp, Homo sapiens
ctgccctgccactttg

SEQ ID NO: 1758943 - DNA, 15 bp, Homo sapiens
ctgccctgcctgagg

SEQ ID NO: 1758944 - DNA, 16 bp, Homo sapiens
ctgccctgcctgagga

SEQ ID NO: 1758945 - DNA, 17 bp, Homo sapiens
ctgccctgcctgaggag

SEQ ID NO: 1758946 - DNA, 13 bp, Homo sapiens
ctgccctggcagc

SEQ ID NO: 1758947 - DNA, 18 bp, Homo sapiens
ctgccctggcagcagcag

SEQ ID NO: 1758948 - DNA, 17 bp, Homo sapiens
ctgccctggcagggtca

SEQ ID NO: 1758949 - DNA, 13 bp, Homo sapiens
ctgccctggccct

SEQ ID NO: 1758950 - DNA, 15 bp, Homo sapiens
ctgccctggccctga

SEQ ID NO: 1758951 - DNA, 18 bp, Homo sapiens
ctgccctggccctgaggt

SEQ ID NO: 1758952 - DNA, 22 bp, Homo sapiens
ctgccctggccctgaggtgtgg

SEQ ID NO: 1758953 - DNA, 21 bp, Homo sapiens
ctgccctgggcgagcccctcc

SEQ ID NO: 1758954 - DNA, 21 bp, Homo sapiens
ctgccctgggttcttccacag

SEQ ID NO: 1758955 - DNA, 16 bp, Homo sapiens
ctgccctggtgctgcc

SEQ ID NO: 1758956 - DNA, 17 bp, Homo sapiens
ctgccctggtgctgcca

SEQ ID NO: 1758957 - DNA, 12 bp, Homo sapiens
ctgccctgtgat

SEQ ID NO: 1758958 - DNA, 21 bp, Homo sapiens
ctgccctgtgatatgtctgct

SEQ ID NO: 1758959 - DNA, 21 bp, Homo sapiens
ctgccctgttgtgtatagatg

SEQ ID NO: 1758960 - DNA, 18 bp, Homo sapiens
ctgcccttcctcctgatg

SEQ ID NO: 1758961 - DNA, 14 bp, Homo sapiens
ctgcccttctcaag

SEQ ID NO: 1758962 - DNA, 16 bp, Homo sapiens
ctgcccttgatcagcc

SEQ ID NO: 1758963 - DNA, 16 bp, Homo sapiens
ctgcccttgttgcctg

SEQ ID NO: 1758964 - DNA, 19 bp, Homo sapiens
ctgcccttttcaggaagct

SEQ ID NO: 1758965 - DNA, 18 bp, Homo sapiens
ctgccctttttgaaatca

SEQ ID NO: 1758966 - DNA, 15 bp, Homo sapiens
ctgccgaacacacat

SEQ ID NO: 1758967 - DNA, 19 bp, Homo sapiens
ctgccgaacacacatccca

SEQ ID NO: 1758968 - DNA, 23 bp, Homo sapiens
ctgccgacttggagactcctggt

SEQ ID NO: 1758969 - DNA, 21 bp, Homo sapiens
ctgccgagacagaccctctgc

SEQ ID NO: 1758970 - DNA, 17 bp, Homo sapiens
ctgccgcaacagttttt

SEQ ID NO: 1758971 - DNA, 16 bp, Homo sapiens
ctgccgcagacgggca

SEQ ID NO: 1758972 - DNA, 19 bp, Homo sapiens
ctgccgcagacgggcacag

SEQ ID NO: 1758973 - DNA, 20 bp, Homo sapiens
ctgccgcagacgggcacaga

SEQ ID NO: 1758974 - DNA, 14 bp, Homo sapiens
ctgccgcagagctg

SEQ ID NO: 1758975 - DNA, 17 bp, Homo sapiens
ctgccgcatgctccctc

SEQ ID NO: 1758976 - DNA, 15 bp, Homo sapiens
ctgctactcctgtgc

SEQ ID NO: 1758977 - DNA, 17 bp, Homo sapiens
ctgctactcctgtgctc

SEQ ID NO: 1758978 - DNA, 20 bp, Homo sapiens
ctgctacttcactgtcatct

SEQ ID NO: 1758979 - DNA, 22 bp, Homo sapiens
ctgctacttccccagctctcag

SEQ ID NO: 1758980 - DNA, 18 bp, Homo sapiens
ctgctagaacctctcgta

SEQ ID NO: 1758981 - DNA, 16 bp, Homo sapiens
ctgctagagacgctga

SEQ ID NO: 1758982 - DNA, 23 bp, Homo sapiens
ctgctagagcaacccctgtaccc

SEQ ID NO: 1758983 - DNA, 16 bp, Homo sapiens
ctgctagattttaatt

SEQ ID NO: 1758984 - DNA, 20 bp, Homo sapiens
ctgctagattttaatttatt

SEQ ID NO: 1758985 - DNA, 21 bp, Homo sapiens
ctgctagattttaatttattt

SEQ ID NO: 1758986 - DNA, 23 bp, Homo sapiens
ctgctagattttaatttatttgt

SEQ ID NO: 1758987 - DNA, 16 bp, Homo sapiens
ctgctagcaaatggca

SEQ ID NO: 1758988 - DNA, 22 bp, Homo sapiens
ctgctagcacttggagccaagg

SEQ ID NO: 1758989 - DNA, 19 bp, Homo sapiens
ctgctagctgtagaaatgt

SEQ ID NO: 1758990 - DNA, 16 bp, Homo sapiens
ctgctaggcgctgggg

SEQ ID NO: 1758991 - DNA, 20 bp, Homo sapiens
ctgctagtagtgttctagat

SEQ ID NO: 1758992 - DNA, 17 bp, Homo sapiens
ctgctagtgctgtaata

SEQ ID NO: 1758993 - DNA, 21 bp, Homo sapiens
ctgctagtgctgtaatattgt

SEQ ID NO: 1758994 - DNA, 18 bp, Homo sapiens
ctgctatatataaaacgg

SEQ ID NO: 1758995 - DNA, 16 bp, Homo sapiens
ctgctatccccatctc

SEQ ID NO: 1758996 - DNA, 20 bp, Homo sapiens
ctgctatccccatctccctg

SEQ ID NO: 1758997 - DNA, 23 bp, Homo sapiens
ctgctatccccatctccctgcct

SEQ ID NO: 1758998 - DNA, 16 bp, Homo sapiens
ctgctatcctgccaaa

SEQ ID NO: 1758999 - DNA, 22 bp, Homo sapiens
ctgctatttccctccttgggct

SEQ ID NO: 1759000 - DNA, 21 bp, Homo sapiens
ctgctcaactctacccctgct

SEQ ID NO: 1759001 - DNA, 23 bp, Homo sapiens
ctgctcaagaagacatggagact

SEQ ID NO: 1759002 - DNA, 15 bp, Homo sapiens
ctgctcaatacatct

SEQ ID NO: 1759003 - DNA, 15 bp, Homo sapiens
ctgctcaccgcccat

SEQ ID NO: 1759004 - DNA, 23 bp, Homo sapiens
ctgctcaccgcccatcagggttc

SEQ ID NO: 1759005 - DNA, 23 bp, Homo sapiens
ctgctcacctgtgtgcccagcac

SEQ ID NO: 1759006 - DNA, 16 bp, Homo sapiens
ctgctcacgtctctgc

SEQ ID NO: 1759007 - DNA, 19 bp, Homo sapiens
ctgctcacgtctctgccgc

SEQ ID NO: 1759008 - DNA, 20 bp, Homo sapiens
ctgctcacgtctctgccgcc

SEQ ID NO: 1759009 - DNA, 22 bp, Homo sapiens
ctgctcacgtctctgccgcctg

SEQ ID NO: 1759010 - DNA, 19 bp, Homo sapiens
ctgctcagaacttgctgct

SEQ ID NO: 1759011 - DNA, 13 bp, Homo sapiens
ctgctcagacaga

SEQ ID NO: 1759012 - DNA, 13 bp, Homo sapiens
ctgctcagcagcc

SEQ ID NO: 1759013 - DNA, 15 bp, Homo sapiens
ctgctcagcagccag

SEQ ID NO: 1759014 - DNA, 16 bp, Homo sapiens
ctgctcagcagccagt

SEQ ID NO: 1759015 - DNA, 21 bp, Homo sapiens
ctgctcagccctgcaccatgc

SEQ ID NO: 1759016 - DNA, 14 bp, Homo sapiens
ctgctcagctctgg

SEQ ID NO: 1759017 - DNA, 18 bp, Homo sapiens
ctgctcagctctggtcca

SEQ ID NO: 1759018 - DNA, 18 bp, Homo sapiens
ctgctcagtaaagcactt

SEQ ID NO: 1759019 - DNA, 15 bp, Homo sapiens
ctgctcatccaaagt

SEQ ID NO: 1759020 - DNA, 17 bp, Homo sapiens
ctgctcatccaaagttg

SEQ ID NO: 1759021 - DNA, 18 bp, Homo sapiens
ctgctcattacagttctt

SEQ ID NO: 1759022 - DNA, 22 bp, Homo sapiens
ctgctcattttgacaaagtgcc

SEQ ID NO: 1759023 - DNA, 21 bp, Homo sapiens
ctgctccaccaaggggctctt

SEQ ID NO: 1759024 - DNA, 14 bp, Homo sapiens
ctgctccaccagca

SEQ ID NO: 1759025 - DNA, 17 bp, Homo sapiens
ctgctccaccagcagca

SEQ ID NO: 1759026 - DNA, 22 bp, Homo sapiens
ctgctccaccagcagcatggca

SEQ ID NO: 1759027 - DNA, 21 bp, Homo sapiens
ctgctccacccttggcctgtc

SEQ ID NO: 1759028 - DNA, 11 bp, Homo sapiens
ctgctccagaa

SEQ ID NO: 1759029 - DNA, 20 bp, Homo sapiens
ctgctccagaagatgccagc

SEQ ID NO: 1759030 - DNA, 21 bp, Homo sapiens
ctgctccagacctgatcctgg

SEQ ID NO: 1759031 - DNA, 15 bp, Homo sapiens
ctgctccatgactgg

SEQ ID NO: 1759032 - DNA, 14 bp, Homo sapiens
ctgctcccaccacc

SEQ ID NO: 1759033 - DNA, 17 bp, Homo sapiens
ctgctcccagatgcctt

SEQ ID NO: 1759034 - DNA, 15 bp, Homo sapiens
ctgctcccagcctct

SEQ ID NO: 1759035 - DNA, 23 bp, Homo sapiens
ctgctcccagtgggagcttcccg

SEQ ID NO: 1759036 - DNA, 18 bp, Homo sapiens
ctgctccccaggccaccc

SEQ ID NO: 1759037 - DNA, 12 bp, Homo sapiens
ctgctcccccac

SEQ ID NO: 1759038 - DNA, 13 bp, Homo sapiens
ctgctcccccacc

SEQ ID NO: 1759039 - DNA, 21 bp, Homo sapiens
ctgctcccccaccccctcccc

SEQ ID NO: 1759040 - DNA, 15 bp, Homo sapiens
ctgctccctggcatt

SEQ ID NO: 1759041 - DNA, 14 bp, Homo sapiens
ctgctccctgtctg

SEQ ID NO: 1759042 - DNA, 16 bp, Homo sapiens
ctgctccctgtctgtg

SEQ ID NO: 1759043 - DNA, 18 bp, Homo sapiens
ctgctccctgtctgtgtc

SEQ ID NO: 1759044 - DNA, 19 bp, Homo sapiens
ctgctccctgtctgtgtcc

SEQ ID NO: 1759045 - DNA, 14 bp, Homo sapiens
ctgctccgcccgct

SEQ ID NO: 1759046 - DNA, 15 bp, Homo sapiens
ctgctccgtggactg

SEQ ID NO: 1759047 - DNA, 14 bp, Homo sapiens
ctgctcctcatggt

SEQ ID NO: 1759048 - DNA, 11 bp, Homo sapiens
ctgctcctcca

SEQ ID NO: 1759049 - DNA, 14 bp, Homo sapiens
ctgctcctccaggg

SEQ ID NO: 1759050 - DNA, 24 bp, Homo sapiens
ctgctcctccagggccacgtgcca

SEQ ID NO: 1759051 - DNA, 17 bp, Homo sapiens
ctgctcctccctgcccc

SEQ ID NO: 1759052 - DNA, 16 bp, Homo sapiens
ctgctcctccctggct

SEQ ID NO: 1759053 - DNA, 10 bp, Homo sapiens
ctgctcctgc

SEQ ID NO: 1759054 - DNA, 16 bp, Homo sapiens
ctgctcctgcttttct

SEQ ID NO: 1759055 - DNA, 18 bp, Homo sapiens
ctgctcctttaccctctt

SEQ ID NO: 1759056 - DNA, 15 bp, Homo sapiens
ctgctctaacacctg

SEQ ID NO: 1759057 - DNA, 17 bp, Homo sapiens
ctgctctaacagccctc

SEQ ID NO: 1759058 - DNA, 21 bp, Homo sapiens
ctgctctagattcataaatac

SEQ ID NO: 1759059 - DNA, 13 bp, Homo sapiens
ctgctctagccag

SEQ ID NO: 1759060 - DNA, 15 bp, Homo sapiens
ctgctctagccagga

SEQ ID NO: 1759061 - DNA, 20 bp, Homo sapiens
ctgctctagctggcaggaca

SEQ ID NO: 1759062 - DNA, 22 bp, Homo sapiens
ctgctctagctggcaggacaca

SEQ ID NO: 1759063 - DNA, 16 bp, Homo sapiens
ctgctctagggaatct

SEQ ID NO: 1759064 - DNA, 16 bp, Homo sapiens
ctgctctagtgggaca

SEQ ID NO: 1759065 - DNA, 17 bp, Homo sapiens
ctgctctagtgggacag

SEQ ID NO: 1759066 - DNA, 21 bp, Homo sapiens
ctgctctagtgggacagccca

SEQ ID NO: 1759067 - DNA, 15 bp, Homo sapiens
ctgctctcagcctcc

SEQ ID NO: 1759068 - DNA, 19 bp, Homo sapiens
ctgctctcagcctcccaca

SEQ ID NO: 1759069 - DNA, 16 bp, Homo sapiens
ctgctctccttcctgg

SEQ ID NO: 1759070 - DNA, 18 bp, Homo sapiens
ctgctctcttcaggaggc

SEQ ID NO: 1759071 - DNA, 11 bp, Homo sapiens
ctgctctgcca

SEQ ID NO: 1759072 - DNA, 12 bp, Homo sapiens
ctgctctgccat

SEQ ID NO: 1759073 - DNA, 18 bp, Homo sapiens
ctgctctgccatcttcag

SEQ ID NO: 1759074 - DNA, 17 bp, Homo sapiens
ctgctctgcctggagtg

SEQ ID NO: 1759075 - DNA, 21 bp, Homo sapiens
ctgctctgggacgtggacatg

SEQ ID NO: 1759076 - DNA, 21 bp, Homo sapiens
ctgctctggtggcttaagtga

SEQ ID NO: 1759077 - DNA, 15 bp, Homo sapiens
ctgctcttagtgccc

SEQ ID NO: 1759078 - DNA, 21 bp, Homo sapiens
ctgctcttcatcccattccag

SEQ ID NO: 1759079 - DNA, 20 bp, Homo sapiens
ctgctcttgcatctgggcca

SEQ ID NO: 1759080 - DNA, 16 bp, Homo sapiens
ctgctctttattgcag

SEQ ID NO: 1759081 - DNA, 21 bp, Homo sapiens
ctgctctttattgcagaatgt

SEQ ID NO: 1759082 - DNA, 14 bp, Homo sapiens
ctgctctttctctg

SEQ ID NO: 1759083 - DNA, 16 bp, Homo sapiens
ctgctctttctctgcc

SEQ ID NO: 1759084 - DNA, 22 bp, Homo sapiens
ctgctctttctctgccagtgac

SEQ ID NO: 1759085 - DNA, 15 bp, Homo sapiens
ctgctcttttgtgat

SEQ ID NO: 1759086 - DNA, 14 bp, Homo sapiens
ctgctgaacacagt

SEQ ID NO: 1759087 - DNA, 21 bp, Homo sapiens
ctgctgaagatgaatcaatgg

SEQ ID NO: 1759088 - DNA, 14 bp, Homo sapiens
ctgctgaagctgct

SEQ ID NO: 1759089 - DNA, 16 bp, Homo sapiens
ctgctgaataataaac

SEQ ID NO: 1759090 - DNA, 21 bp, Homo sapiens
ctggagcccctcctcccccgg

SEQ ID NO: 1759091 - DNA, 22 bp, Homo sapiens
ctggagcccctcctcccccggc

SEQ ID NO: 1759092 - DNA, 14 bp, Homo sapiens
ctggagcccctggg

SEQ ID NO: 1759093 - DNA, 17 bp, Homo sapiens
ctggagcccctgggtgg

SEQ ID NO: 1759094 - DNA, 15 bp, Homo sapiens
ctggagccctgggcg

SEQ ID NO: 1759095 - DNA, 15 bp, Homo sapiens
ctggagcccttgggt

SEQ ID NO: 1759096 - DNA, 18 bp, Homo sapiens
ctggagctcttggaagag

SEQ ID NO: 1759097 - DNA, 23 bp, Homo sapiens
ctggagctgtccttcattccgtt

SEQ ID NO: 1759098 - DNA, 19 bp, Homo sapiens
ctggagcttaattttctgt

SEQ ID NO: 1759099 - DNA, 15 bp, Homo sapiens
ctggagcttttaaaa

SEQ ID NO: 1759100 - DNA, 22 bp, Homo sapiens
ctggaggaagttctccagcttc

SEQ ID NO: 1759101 - DNA, 23 bp, Homo sapiens
ctggaggaagttctccagcttca

SEQ ID NO: 1759102 - DNA, 12 bp, Homo sapiens
ctggaggagaag

SEQ ID NO: 1759103 - DNA, 14 bp, Homo sapiens
ctggaggagaagta

SEQ ID NO: 1759104 - DNA, 14 bp, Homo sapiens
ctggaggagctggc

SEQ ID NO: 1759105 - DNA, 21 bp, Homo sapiens
ctggaggagctggcctgtggc

SEQ ID NO: 1759106 - DNA, 17 bp, Homo sapiens
ctggaggattttccagt

SEQ ID NO: 1759107 - DNA, 18 bp, Homo sapiens
ctggaggcacgcaccact

SEQ ID NO: 1759108 - DNA, 21 bp, Homo sapiens
ctggaggcacgcaccactgct

SEQ ID NO: 1759109 - DNA, 16 bp, Homo sapiens
ctggaggcagggcctt

SEQ ID NO: 1759110 - DNA, 23 bp, Homo sapiens
ctggaggcagggccttgcccaga

SEQ ID NO: 1759111 - DNA, 20 bp, Homo sapiens
ctggaggcagggggtgaggg

SEQ ID NO: 1759112 - DNA, 12 bp, Homo sapiens
ctggaggcccag

SEQ ID NO: 1759113 - DNA, 13 bp, Homo sapiens
ctggaggcccagg

SEQ ID NO: 1759114 - DNA, 15 bp, Homo sapiens
ctggaggcccaggct

SEQ ID NO: 1759115 - DNA, 13 bp, Homo sapiens
ctggaggcccctg

SEQ ID NO: 1759116 - DNA, 20 bp, Homo sapiens
ctggaggcccctggagccag

SEQ ID NO: 1759117 - DNA, 21 bp, Homo sapiens
ctggaggcccctggagccaga

SEQ ID NO: 1759118 - DNA, 15 bp, Homo sapiens
ctggaggccgaggac

SEQ ID NO: 1759119 - DNA, 17 bp, Homo sapiens
ctggaggccgaggacca

SEQ ID NO: 1759120 - DNA, 19 bp, Homo sapiens
ctggaggccgaggaccacc

SEQ ID NO: 1759121 - DNA, 21 bp, Homo sapiens
ctggaggccgaggaccaccag

SEQ ID NO: 1759122 - DNA, 13 bp, Homo sapiens
ctggaggcctcag

SEQ ID NO: 1759123 - DNA, 18 bp, Homo sapiens
ctggaggcctcaggtgct

SEQ ID NO: 1759124 - DNA, 19 bp, Homo sapiens
ctggaggcctcaggtgctg

SEQ ID NO: 1759125 - DNA, 21 bp, Homo sapiens
ctggaggcctcaggtgctgtc

SEQ ID NO: 1759126 - DNA, 14 bp, Homo sapiens
ctggaggcctcgcc

SEQ ID NO: 1759127 - DNA, 18 bp, Homo sapiens
ctggaggccttccagctg

SEQ ID NO: 1759128 - DNA, 19 bp, Homo sapiens
ctggaggccttccagctgc

SEQ ID NO: 1759129 - DNA, 20 bp, Homo sapiens
ctggaggccttccagctgct

SEQ ID NO: 1759130 - DNA, 22 bp, Homo sapiens
ctggaggccttccagctgctgt

SEQ ID NO: 1759131 - DNA, 22 bp, Homo sapiens
ctggaggggagagctttgtgct

SEQ ID NO: 1759132 - DNA, 13 bp, Homo sapiens
ctggaggggaggg

SEQ ID NO: 1759133 - DNA, 17 bp, Homo sapiens
ctggaggggcaccaggt

SEQ ID NO: 1759134 - DNA, 16 bp, Homo sapiens
ctggaggggtgtggct

SEQ ID NO: 1759135 - DNA, 20 bp, Homo sapiens
ctggaggggtgtggctcctt

SEQ ID NO: 1759136 - DNA, 23 bp, Homo sapiens
ctggagggtgggttggggagggg

SEQ ID NO: 1759137 - DNA, 16 bp, Homo sapiens
ctggaggtctccaggg

SEQ ID NO: 1759138 - DNA, 23 bp, Homo sapiens
ctggaggtctccaggggcctgca

SEQ ID NO: 1759139 - DNA, 15 bp, Homo sapiens
ctggaggtctggctg

SEQ ID NO: 1759140 - DNA, 19 bp, Homo sapiens
ctggaggtctggctgagcc

SEQ ID NO: 1759141 - DNA, 24 bp, Homo sapiens
ctggaggtctggctgagcccctgg

SEQ ID NO: 1759142 - DNA, 14 bp, Homo sapiens
ctggaggtgtggga

SEQ ID NO: 1759143 - DNA, 22 bp, Homo sapiens
ctggagtcacatcagtgaggag

SEQ ID NO: 1759144 - DNA, 14 bp, Homo sapiens
ctggagtcaggtgt

SEQ ID NO: 1759145 - DNA, 15 bp, Homo sapiens
ctggagtccagtctc

SEQ ID NO: 1759146 - DNA, 16 bp, Homo sapiens
ctggagtctcagagca

SEQ ID NO: 1759147 - DNA, 18 bp, Homo sapiens
ctggagtgaggcttccag

SEQ ID NO: 1759148 - DNA, 23 bp, Homo sapiens
ctggagtgaggcttccaggctct

SEQ ID NO: 1759149 - DNA, 24 bp, Homo sapiens
ctggagtgaggcttccaggctctt

SEQ ID NO: 1759150 - DNA, 16 bp, Homo sapiens
ctggagtgattctaga

SEQ ID NO: 1759151 - DNA, 16 bp, Homo sapiens
ctggagtgcagggagg

SEQ ID NO: 1759152 - DNA, 22 bp, Homo sapiens
ctggagtgcccccagcccagag

SEQ ID NO: 1759153 - DNA, 23 bp, Homo sapiens
ctggagtgcgctcttggtccctg

SEQ ID NO: 1759154 - DNA, 19 bp, Homo sapiens
ctggagttcagcagtgatg

SEQ ID NO: 1759155 - DNA, 19 bp, Homo sapiens
ctggagttccttatccctc

SEQ ID NO: 1759156 - DNA, 24 bp, Homo sapiens
ctggagttccttatccctctcttc

SEQ ID NO: 1759157 - DNA, 15 bp, Homo sapiens
ctggagttgatctgg

SEQ ID NO: 1759158 - DNA, 16 bp, Homo sapiens
ctggagttgatctgga

SEQ ID NO: 1759159 - DNA, 18 bp, Homo sapiens
ctggagttgatctggaac

SEQ ID NO: 1759160 - DNA, 16 bp, Homo sapiens
ctggagttttgatttg

SEQ ID NO: 1759161 - DNA, 17 bp, Homo sapiens
ctggataaagccactga

SEQ ID NO: 1759162 - DNA, 20 bp, Homo sapiens
ctggatatgttgttaaacac

SEQ ID NO: 1759163 - DNA, 23 bp, Homo sapiens
ctggatatttcaatcttttaaat

SEQ ID NO: 1759164 - DNA, 17 bp, Homo sapiens
ctggatcagtcctttga

SEQ ID NO: 1759165 - DNA, 21 bp, Homo sapiens
ctggatcagtcctttgatcag

SEQ ID NO: 1759166 - DNA, 22 bp, Homo sapiens
ctggatccatcttgagccacag

SEQ ID NO: 1759167 - DNA, 23 bp, Homo sapiens
ctggatccctgcccttctcaaga

SEQ ID NO: 1759168 - DNA, 16 bp, Homo sapiens
ctggatctagaaggga

SEQ ID NO: 1759169 - DNA, 23 bp, Homo sapiens
ctggatctatccctgcggcctcc

SEQ ID NO: 1759170 - DNA, 18 bp, Homo sapiens
ctggatctcctgctgcct

SEQ ID NO: 1759171 - DNA, 22 bp, Homo sapiens
ctggatctcctgctgccttttc

SEQ ID NO: 1759172 - DNA, 14 bp, Homo sapiens
ctggatctgtgagg

SEQ ID NO: 1759173 - DNA, 13 bp, Homo sapiens
ctggatgaaggca

SEQ ID NO: 1759174 - DNA, 15 bp, Homo sapiens
ctggatgagaaacag

SEQ ID NO: 1759175 - DNA, 19 bp, Homo sapiens
ctggatgagaaacagctca

SEQ ID NO: 1759176 - DNA, 20 bp, Homo sapiens
ctggatgatttcatcttctg

SEQ ID NO: 1759177 - DNA, 17 bp, Homo sapiens
ctggatgcacagatgcc

SEQ ID NO: 1759178 - DNA, 23 bp, Homo sapiens
ctggatgctgttgagggccaaga

SEQ ID NO: 1759179 - DNA, 20 bp, Homo sapiens
ctggatggaaagacaaactg

SEQ ID NO: 1759180 - DNA, 19 bp, Homo sapiens
ctggatggccgggctgctg

SEQ ID NO: 1759181 - DNA, 13 bp, Homo sapiens
ctggatgtaaatc

SEQ ID NO: 1759182 - DNA, 14 bp, Homo sapiens
ctggatgtaaatcc

SEQ ID NO: 1759183 - DNA, 19 bp, Homo sapiens
ctggatgtctgccaatttt

SEQ ID NO: 1759184 - DNA, 20 bp, Homo sapiens
ctggattataagttctattt

SEQ ID NO: 1759185 - DNA, 19 bp, Homo sapiens
ctggattcacgccctcttg

SEQ ID NO: 1759186 - DNA, 17 bp, Homo sapiens
ctggattcattgtctct

SEQ ID NO: 1759187 - DNA, 22 bp, Homo sapiens
ctggattgatcggagcctcctc

SEQ ID NO: 1759188 - DNA, 23 bp, Homo sapiens
ctggattggttggcaaactaaag

SEQ ID NO: 1759189 - DNA, 22 bp, Homo sapiens
ctggatttgggagctctgcttg

SEQ ID NO: 1759190 - DNA, 23 bp, Homo sapiens
ctggatttgggagctctgcttgc

SEQ ID NO: 1759191 - DNA, 19 bp, Homo sapiens
ctggattttgccctctcct

SEQ ID NO: 1759192 - DNA, 22 bp, Homo sapiens
ctggcaaaccctcccagaaaca

SEQ ID NO: 1759193 - DNA, 17 bp, Homo sapiens
ctggcaaacgtttctca

SEQ ID NO: 1759194 - DNA, 15 bp, Homo sapiens
ctggcaacagagcga

SEQ ID NO: 1759195 - DNA, 17 bp, Homo sapiens
ctggcaacatctttatc

SEQ ID NO: 1759196 - DNA, 18 bp, Homo sapiens
ctggcaagaaagcttgag

SEQ ID NO: 1759197 - DNA, 14 bp, Homo sapiens
ctggcaagcaggga

SEQ ID NO: 1759198 - DNA, 20 bp, Homo sapiens
ctggcaaggactttgtacat

SEQ ID NO: 1759199 - DNA, 20 bp, Homo sapiens
ctggcaataagatacacagc

SEQ ID NO: 1759200 - DNA, 22 bp, Homo sapiens
ctggcaatggatgaactgaaag

SEQ ID NO: 1759201 - DNA, 15 bp, Homo sapiens
ctggcaattgtctat

SEQ ID NO: 1759202 - DNA, 18 bp, Homo sapiens
ctggcaattgtctattta

SEQ ID NO: 1759203 - DNA, 18 bp, Homo sapiens
ctggctgaaccctgtgct

SEQ ID NO: 1759204 - DNA, 19 bp, Homo sapiens
ctggctgaaccctgtgctg

SEQ ID NO: 1759205 - DNA, 12 bp, Homo sapiens
ctggctgaagaa

SEQ ID NO: 1759206 - DNA, 20 bp, Homo sapiens
ctggctgaagaatgaagacc

SEQ ID NO: 1759207 - DNA, 17 bp, Homo sapiens
ctggctgagcccctggg

SEQ ID NO: 1759208 - DNA, 19 bp, Homo sapiens
ctggctgaggttcctctgc

SEQ ID NO: 1759209 - DNA, 21 bp, Homo sapiens
ctggctgaggttcctctgcct

SEQ ID NO: 1759210 - DNA, 23 bp, Homo sapiens
ctggctgaggttcctctgcctgc

SEQ ID NO: 1759211 - DNA, 22 bp, Homo sapiens
ctggctgagtggaatgcaggga

SEQ ID NO: 1759212 - DNA, 12 bp, Homo sapiens
ctggctgatgat

SEQ ID NO: 1759213 - DNA, 19 bp, Homo sapiens
ctggctgatgatccagaac

SEQ ID NO: 1759214 - DNA, 12 bp, Homo sapiens
ctggctgccagg

SEQ ID NO: 1759215 - DNA, 15 bp, Homo sapiens
ctggctgccaggcgt

SEQ ID NO: 1759216 - DNA, 16 bp, Homo sapiens
ctggctgccaggcgtt

SEQ ID NO: 1759217 - DNA, 13 bp, Homo sapiens
ctggctgcccaga

SEQ ID NO: 1759218 - DNA, 18 bp, Homo sapiens
ctggctggagtctcagag

SEQ ID NO: 1759219 - DNA, 19 bp, Homo sapiens
ctggctggagtctcagagc

SEQ ID NO: 1759220 - DNA, 21 bp, Homo sapiens
ctggctggagtctcagagcac

SEQ ID NO: 1759221 - DNA, 22 bp, Homo sapiens
ctggctggagtctcagagcaca

SEQ ID NO: 1759222 - DNA, 16 bp, Homo sapiens
ctggctggcctgagca

SEQ ID NO: 1759223 - DNA, 17 bp, Homo sapiens
ctggctgggctggctga

SEQ ID NO: 1759224 - DNA, 14 bp, Homo sapiens
ctggctggggcaga

SEQ ID NO: 1759225 - DNA, 17 bp, Homo sapiens
ctggctggggcagaggg

SEQ ID NO: 1759226 - DNA, 18 bp, Homo sapiens
ctggctggggcagagggg

SEQ ID NO: 1759227 - DNA, 23 bp, Homo sapiens
ctggctggggcagaggggcagcc

SEQ ID NO: 1759228 - DNA, 18 bp, Homo sapiens
ctggctggtgggccccca

SEQ ID NO: 1759229 - DNA, 16 bp, Homo sapiens
ctggctgtaaggctct

SEQ ID NO: 1759230 - DNA, 15 bp, Homo sapiens
ctggctgtctagaat

SEQ ID NO: 1759231 - DNA, 15 bp, Homo sapiens
ctggctgtctgcctg

SEQ ID NO: 1759232 - DNA, 21 bp, Homo sapiens
ctggctgtctgtctgcagtgc

SEQ ID NO: 1759233 - DNA, 21 bp, Homo sapiens
ctggctgtgaatgccaaagcc

SEQ ID NO: 1759234 - DNA, 12 bp, Homo sapiens
ctggctgtgaca

SEQ ID NO: 1759235 - DNA, 21 bp, Homo sapiens
ctggctgtgagacgaggcagg

SEQ ID NO: 1759236 - DNA, 19 bp, Homo sapiens
ctggctgtgagcagcctcc

SEQ ID NO: 1759237 - DNA, 23 bp, Homo sapiens
ctggctgtgcccagcaggcccag

SEQ ID NO: 1759238 - DNA, 15 bp, Homo sapiens
ctggctgtgcccctg

SEQ ID NO: 1759239 - DNA, 15 bp, Homo sapiens
ctggctgtggaggcc

SEQ ID NO: 1759240 - DNA, 19 bp, Homo sapiens
ctggctgtggaggcctgat

SEQ ID NO: 1759241 - DNA, 19 bp, Homo sapiens
ctggctgtgtaaccttggg

SEQ ID NO: 1759242 - DNA, 20 bp, Homo sapiens
ctggctgtgtaaccttgggt

SEQ ID NO: 1759243 - DNA, 22 bp, Homo sapiens
ctggcttagtgccacccacctt

SEQ ID NO: 1759244 - DNA, 21 bp, Homo sapiens
ctggcttcaccatcaatcctg

SEQ ID NO: 1759245 - DNA, 15 bp, Homo sapiens
ctggcttcccatagt

SEQ ID NO: 1759246 - DNA, 13 bp, Homo sapiens
ctggcttccctgg

SEQ ID NO: 1759247 - DNA, 16 bp, Homo sapiens
ctggcttccctggaag

SEQ ID NO: 1759248 - DNA, 17 bp, Homo sapiens
ctggcttccctggaagc

SEQ ID NO: 1759249 - DNA, 18 bp, Homo sapiens
ctggcttccctggaagct

SEQ ID NO: 1759250 - DNA, 12 bp, Homo sapiens
ctggcttctctc

SEQ ID NO: 1759251 - DNA, 19 bp, Homo sapiens
ctggcttctctcttttcct

SEQ ID NO: 1759252 - DNA, 12 bp, Homo sapiens
ctggcttctgtg

SEQ ID NO: 1759253 - DNA, 17 bp, Homo sapiens
ctggcttgaaggactgc

SEQ ID NO: 1759254 - DNA, 14 bp, Homo sapiens
ctggcttgctccag

SEQ ID NO: 1759255 - DNA, 15 bp, Homo sapiens
ctggcttgctccagg

SEQ ID NO: 1759256 - DNA, 16 bp, Homo sapiens
ctggcttgctccaggg

SEQ ID NO: 1759257 - DNA, 18 bp, Homo sapiens
ctggcttgctccagggtc

SEQ ID NO: 1759258 - DNA, 14 bp, Homo sapiens
ctggcttgcttgcc

SEQ ID NO: 1759259 - DNA, 12 bp, Homo sapiens
ctggcttggagg

SEQ ID NO: 1759260 - DNA, 15 bp, Homo sapiens
ctggcttgtacattt

SEQ ID NO: 1759261 - DNA, 16 bp, Homo sapiens
ctggcttgtacatttt

SEQ ID NO: 1759262 - DNA, 17 bp, Homo sapiens
ctggctttaagccttca

SEQ ID NO: 1759263 - DNA, 14 bp, Homo sapiens
ctggctttgcctct

SEQ ID NO: 1759264 - DNA, 13 bp, Homo sapiens
ctggctttgctct

SEQ ID NO: 1759265 - DNA, 15 bp, Homo sapiens
ctggcttttcactgc

SEQ ID NO: 1759266 - DNA, 23 bp, Homo sapiens
ctggcttttcactgctggctgcc

SEQ ID NO: 1759267 - DNA, 15 bp, Homo sapiens
ctggctttttctgcc

SEQ ID NO: 1759268 - DNA, 22 bp, Homo sapiens
ctggctttttctgccactgagg

SEQ ID NO: 1759269 - DNA, 16 bp, Homo sapiens
ctgggaaataagagag

SEQ ID NO: 1759270 - DNA, 17 bp, Homo sapiens
ctgggaaataagagaga

SEQ ID NO: 1759271 - DNA, 18 bp, Homo sapiens
ctgggaacatgacccagc

SEQ ID NO: 1759272 - DNA, 19 bp, Homo sapiens
ctgggaacatgacccagcc

SEQ ID NO: 1759273 - DNA, 22 bp, Homo sapiens
ctgggaacccaagtccaagcat

SEQ ID NO: 1759274 - DNA, 23 bp, Homo sapiens
ctgggaagagaagagggcccagc

SEQ ID NO: 1759275 - DNA, 14 bp, Homo sapiens
ctgggaagagctcc

SEQ ID NO: 1759276 - DNA, 17 bp, Homo sapiens
ctgggaagataggctct

SEQ ID NO: 1759277 - DNA, 18 bp, Homo sapiens
ctgggaagataggctctg

SEQ ID NO: 1759278 - DNA, 21 bp, Homo sapiens
ctgggaagataggctctgcac

SEQ ID NO: 1759279 - DNA, 24 bp, Homo sapiens
ctgggaagataggctctgcacaga

SEQ ID NO: 1759280 - DNA, 20 bp, Homo sapiens
ctgggaagctgtactcagag

SEQ ID NO: 1759281 - DNA, 18 bp, Homo sapiens
ctgggaagcttgagcctc

SEQ ID NO: 1759282 - DNA, 18 bp, Homo sapiens
ctgggaaggagggagctg

SEQ ID NO: 1759283 - DNA, 17 bp, Homo sapiens
ctgggaagggagagggc

SEQ ID NO: 1759284 - DNA, 15 bp, Homo sapiens
ctgggaatgggagag

SEQ ID NO: 1759285 - DNA, 15 bp, Homo sapiens
ctgggacagcccagg

SEQ ID NO: 1759286 - DNA, 13 bp, Homo sapiens
ctgggacagctgg

SEQ ID NO: 1759287 - DNA, 15 bp, Homo sapiens
ctgggacagctggct

SEQ ID NO: 1759288 - DNA, 19 bp, Homo sapiens
ctgggacagctggctgggc

SEQ ID NO: 1759289 - DNA, 19 bp, Homo sapiens
ctgggacatcaggagactg

SEQ ID NO: 1759290 - DNA, 15 bp, Homo sapiens
ctgggaccagagcca

SEQ ID NO: 1759291 - DNA, 16 bp, Homo sapiens
ctgggaccagagccag

SEQ ID NO: 1759292 - DNA, 18 bp, Homo sapiens
ctgggaccagagccagat

SEQ ID NO: 1759293 - DNA, 21 bp, Homo sapiens
ctgggacccacctccccctcc

SEQ ID NO: 1759294 - DNA, 14 bp, Homo sapiens
ctgggacccagcta

SEQ ID NO: 1759295 - DNA, 21 bp, Homo sapiens
ctgggacccagctactctgtc

SEQ ID NO: 1759296 - DNA, 18 bp, Homo sapiens
ctgggacccctcccaacc

SEQ ID NO: 1759297 - DNA, 18 bp, Homo sapiens
ctgggacctgccaggcag

SEQ ID NO: 1759298 - DNA, 22 bp, Homo sapiens
ctgggacgtggacatgcctcaa

SEQ ID NO: 1759299 - DNA, 18 bp, Homo sapiens
ctgggactctcctcctcc

SEQ ID NO: 1759300 - DNA, 13 bp, Homo sapiens
ctgggactgagcc

SEQ ID NO: 1759301 - DNA, 14 bp, Homo sapiens
ctgggactggccag

SEQ ID NO: 1759302 - DNA, 21 bp, Homo sapiens
ctgggagaaaatcatcaagaa

SEQ ID NO: 1759303 - DNA, 18 bp, Homo sapiens
ctgggagaacctcaggct

SEQ ID NO: 1759304 - DNA, 18 bp, Homo sapiens
ctgggagaccctccccac

SEQ ID NO: 1759305 - DNA, 18 bp, Homo sapiens
ctgggagccacttctccc

SEQ ID NO: 1759306 - DNA, 13 bp, Homo sapiens
ctgggagccagtc

SEQ ID NO: 1759307 - DNA, 16 bp, Homo sapiens
ctgggagctccactct

SEQ ID NO: 1759308 - DNA, 11 bp, Homo sapiens
ctgggagcttc

SEQ ID NO: 1759309 - DNA, 13 bp, Homo sapiens
ctgggaggaaaag

SEQ ID NO: 1759310 - DNA, 22 bp, Homo sapiens
ctgggaggaaaagaaaagaggg

SEQ ID NO: 1759311 - DNA, 22 bp, Homo sapiens
ctgggaggaaggacttccctgt

SEQ ID NO: 1759312 - DNA, 16 bp, Homo sapiens
ctgggaggagggagag

SEQ ID NO: 1759313 - DNA, 20 bp, Homo sapiens
ctgggaggagggagagggag

SEQ ID NO: 1759314 - DNA, 23 bp, Homo sapiens
ctgggaggagggagagggaggtc

SEQ ID NO: 1759315 - DNA, 17 bp, Homo sapiens
ctgggaggcaagaaaag

SEQ ID NO: 1759316 - DNA, 19 bp, Homo sapiens
ctgggaggcaagaaaagga

SEQ ID NO: 1759317 - DNA, 17 bp, Homo sapiens
ctgggaggcaagagggg

SEQ ID NO: 1759318 - DNA, 20 bp, Homo sapiens
ctgggttagggtgtgtgttc

SEQ ID NO: 1759319 - DNA, 21 bp, Homo sapiens
ctgggttagggtgtgtgttca

SEQ ID NO: 1759320 - DNA, 15 bp, Homo sapiens
ctgggttcccactcc

SEQ ID NO: 1759321 - DNA, 21 bp, Homo sapiens
ctgggttcccactcccggcct

SEQ ID NO: 1759322 - DNA, 14 bp, Homo sapiens
ctgggttccctttc

SEQ ID NO: 1759323 - DNA, 21 bp, Homo sapiens
ctgggttcttccacagcacaa

SEQ ID NO: 1759324 - DNA, 17 bp, Homo sapiens
ctgggttcttgttttat

SEQ ID NO: 1759325 - DNA, 14 bp, Homo sapiens
ctgggttggtgcac

SEQ ID NO: 1759326 - DNA, 19 bp, Homo sapiens
ctgggtttggaccccagct

SEQ ID NO: 1759327 - DNA, 20 bp, Homo sapiens
ctgggtttggaccccagctg

SEQ ID NO: 1759328 - DNA, 22 bp, Homo sapiens
ctgggtttggaccccagctggg

SEQ ID NO: 1759329 - DNA, 14 bp, Homo sapiens
ctggtaacagtggc

SEQ ID NO: 1759330 - DNA, 15 bp, Homo sapiens
ctggtaatcttgctc

SEQ ID NO: 1759331 - DNA, 16 bp, Homo sapiens
ctggtaattcctctcc

SEQ ID NO: 1759332 - DNA, 15 bp, Homo sapiens
ctggtaattgtacaa

SEQ ID NO: 1759333 - DNA, 16 bp, Homo sapiens
ctggtaattgtacaat

SEQ ID NO: 1759334 - DNA, 16 bp, Homo sapiens
ctggtacaacggaggc

SEQ ID NO: 1759335 - DNA, 13 bp, Homo sapiens
ctggtacccagcc

SEQ ID NO: 1759336 - DNA, 17 bp, Homo sapiens
ctggtacccagccatct

SEQ ID NO: 1759337 - DNA, 23 bp, Homo sapiens
ctggtacccagccatctgcccag

SEQ ID NO: 1759338 - DNA, 14 bp, Homo sapiens
ctggtaccctcctg

SEQ ID NO: 1759339 - DNA, 16 bp, Homo sapiens
ctggtaccctcctggc

SEQ ID NO: 1759340 - DNA, 13 bp, Homo sapiens
ctggtacctgccc

SEQ ID NO: 1759341 - DNA, 19 bp, Homo sapiens
ctggtacctggacggtgcg

SEQ ID NO: 1759342 - DNA, 18 bp, Homo sapiens
ctggtactccctctcagg

SEQ ID NO: 1759343 - DNA, 21 bp, Homo sapiens
ctggtactccctctcaggatc

SEQ ID NO: 1759344 - DNA, 16 bp, Homo sapiens
ctggtagagaccccca

SEQ ID NO: 1759345 - DNA, 18 bp, Homo sapiens
ctggtagagacccccagg

SEQ ID NO: 1759346 - DNA, 17 bp, Homo sapiens
ctggtagatgctgaggc

SEQ ID NO: 1759347 - DNA, 15 bp, Homo sapiens
ctggtagcagcaggc

SEQ ID NO: 1759348 - DNA, 18 bp, Homo sapiens
ctggtagcagcaggctca

SEQ ID NO: 1759349 - DNA, 17 bp, Homo sapiens
ctggtaggttgggacac

SEQ ID NO: 1759350 - DNA, 22 bp, Homo sapiens
ctggtaggttgggacaccaggg

SEQ ID NO: 1759351 - DNA, 19 bp, Homo sapiens
ctggtatatccaaaagctt

SEQ ID NO: 1759352 - DNA, 20 bp, Homo sapiens
ctggtattctgttctggagg

SEQ ID NO: 1759353 - DNA, 16 bp, Homo sapiens
ctggtcactctgccct

SEQ ID NO: 1759354 - DNA, 19 bp, Homo sapiens
ctggtcactctgccctctg

SEQ ID NO: 1759355 - DNA, 21 bp, Homo sapiens
ctggtcactctgccctctgct

SEQ ID NO: 1759356 - DNA, 22 bp, Homo sapiens
ctggtcagagagacctcatcct

SEQ ID NO: 1759357 - DNA, 17 bp, Homo sapiens
ctggtcaggtatttcag

SEQ ID NO: 1759358 - DNA, 19 bp, Homo sapiens
ctggtcagtctttgctcag

SEQ ID NO: 1759359 - DNA, 21 bp, Homo sapiens
ctggtcattaatgtgtcccct

SEQ ID NO: 1759360 - DNA, 12 bp, Homo sapiens
ctggtccagctc

SEQ ID NO: 1759361 - DNA, 17 bp, Homo sapiens
ctggtccagctctgaca

SEQ ID NO: 1759362 - DNA, 15 bp, Homo sapiens
ctggtccagggaagc

SEQ ID NO: 1759363 - DNA, 19 bp, Homo sapiens
ctggtccatgtaaatactt

SEQ ID NO: 1759364 - DNA, 13 bp, Homo sapiens
ctggtcccctcct

SEQ ID NO: 1759365 - DNA, 15 bp, Homo sapiens
ctggtcccctcctca

SEQ ID NO: 1759366 - DNA, 19 bp, Homo sapiens
ctggtcccggggccagcac

SEQ ID NO: 1759367 - DNA, 12 bp, Homo sapiens
ctggtccctgcc

SEQ ID NO: 1759368 - DNA, 13 bp, Homo sapiens
ctggtccctgccc

SEQ ID NO: 1759369 - DNA, 17 bp, Homo sapiens
ctggtccctgccctccc

SEQ ID NO: 1759370 - DNA, 19 bp, Homo sapiens
ctggtccctggtccttcac

SEQ ID NO: 1759371 - DNA, 17 bp, Homo sapiens
ctggtcccttgcagcta

SEQ ID NO: 1759372 - DNA, 23 bp, Homo sapiens
ctggtcctccgcctactgtccct

SEQ ID NO: 1759373 - DNA, 19 bp, Homo sapiens
ctggtcctggccgtcccta

SEQ ID NO: 1759374 - DNA, 13 bp, Homo sapiens
ctggtcctggcct

SEQ ID NO: 1759375 - DNA, 13 bp, Homo sapiens
ctggtcctggctg

SEQ ID NO: 1759376 - DNA, 14 bp, Homo sapiens
ctggtccttattta

SEQ ID NO: 1759377 - DNA, 13 bp, Homo sapiens
ctggtcgctcctg

SEQ ID NO: 1759378 - DNA, 16 bp, Homo sapiens
ctggtcgctcctgccc

SEQ ID NO: 1759379 - DNA, 19 bp, Homo sapiens
ctggtctataccttaagaa

SEQ ID NO: 1759380 - DNA, 23 bp, Homo sapiens
ctggtctcgaactcctggcctca

SEQ ID NO: 1759381 - DNA, 15 bp, Homo sapiens
ctggtctgtctggat

SEQ ID NO: 1759382 - DNA, 19 bp, Homo sapiens
ctggtcttgttagaaaaca

SEQ ID NO: 1759383 - DNA, 16 bp, Homo sapiens
ctggtgaacactgtga

SEQ ID NO: 1759384 - DNA, 20 bp, Homo sapiens
ctggtgaagctcacttctgg

SEQ ID NO: 1759385 - DNA, 19 bp, Homo sapiens
ctggtgagtcttggcggca

SEQ ID NO: 1759386 - DNA, 21 bp, Homo sapiens
ctggtgagtcttggcggcagc

SEQ ID NO: 1759387 - DNA, 14 bp, Homo sapiens
ctggtgatggtttc

SEQ ID NO: 1759388 - DNA, 19 bp, Homo sapiens
ctggtgcacgcaggcacag

SEQ ID NO: 1759389 - DNA, 12 bp, Homo sapiens
ctggtgcagaat

SEQ ID NO: 1759390 - DNA, 17 bp, Homo sapiens
ctggtgcagggcctcca

SEQ ID NO: 1759391 - DNA, 17 bp, Homo sapiens
ctggtgcattgctgtgt

SEQ ID NO: 1759392 - DNA, 21 bp, Homo sapiens
ctggtgccaaatagccccaga

SEQ ID NO: 1759393 - DNA, 16 bp, Homo sapiens
ctggtgccaatttcaa

SEQ ID NO: 1759394 - DNA, 20 bp, Homo sapiens
ctggtgccccacctgcctgg

SEQ ID NO: 1759395 - DNA, 21 bp, Homo sapiens
ctggtgccccacctgcctggt

SEQ ID NO: 1759396 - DNA, 19 bp, Homo sapiens
ctggtgcgaccccccaccc

SEQ ID NO: 1759397 - DNA, 15 bp, Homo sapiens
ctggtgcgggcctgg

SEQ ID NO: 1759398 - DNA, 18 bp, Homo sapiens
ctggtgcgggcctggccc

SEQ ID NO: 1759399 - DNA, 15 bp, Homo sapiens
ctggtgctactccat

SEQ ID NO: 1759400 - DNA, 16 bp, Homo sapiens
ctggtgctctctgcca

SEQ ID NO: 1759401 - DNA, 17 bp, Homo sapiens
ctggtgctgcagcaccg

SEQ ID NO: 1759402 - DNA, 17 bp, Homo sapiens
ctggtgcttccaaatat

SEQ ID NO: 1759403 - DNA, 12 bp, Homo sapiens
ctggtgctttag

SEQ ID NO: 1759404 - DNA, 16 bp, Homo sapiens
ctggtggacagtcctg

SEQ ID NO: 1759405 - DNA, 20 bp, Homo sapiens
ctggtggaccacaggcatct

SEQ ID NO: 1759406 - DNA, 20 bp, Homo sapiens
ctggtggatctaagaagggc

SEQ ID NO: 1759407 - DNA, 22 bp, Homo sapiens
ctggtggccccgtttctggtgg

SEQ ID NO: 1759408 - DNA, 16 bp, Homo sapiens
ctggtggcccctgcct

SEQ ID NO: 1759409 - DNA, 20 bp, Homo sapiens
ctggtggcccgacagcctgg

SEQ ID NO: 1759410 - DNA, 18 bp, Homo sapiens
ctggtggccctgtgcctg

SEQ ID NO: 1759411 - DNA, 13 bp, Homo sapiens
ctggtggccttgg

SEQ ID NO: 1759412 - DNA, 14 bp, Homo sapiens
ctggtggccttggg

SEQ ID NO: 1759413 - DNA, 12 bp, Homo sapiens
ctggtggctcct

SEQ ID NO: 1759414 - DNA, 19 bp, Homo sapiens
ctggtggctgggcccagca

SEQ ID NO: 1759415 - DNA, 20 bp, Homo sapiens
ctggtggctgggcccagcag

SEQ ID NO: 1759416 - DNA, 20 bp, Homo sapiens
ctggtggcttaagtgagcag

SEQ ID NO: 1759417 - DNA, 21 bp, Homo sapiens
ctggtggcttaagtgagcaga

SEQ ID NO: 1759418 - DNA, 23 bp, Homo sapiens
ctggtggcttaagtgagcagaac

SEQ ID NO: 1759419 - DNA, 17 bp, Homo sapiens
ctggtgggagcacctgc

SEQ ID NO: 1759420 - DNA, 19 bp, Homo sapiens
ctggtgggagcacctgcca

SEQ ID NO: 1759421 - DNA, 20 bp, Homo sapiens
ctggtgggagcacctgccag

SEQ ID NO: 1759422 - DNA, 13 bp, Homo sapiens
ctggtggggctga

SEQ ID NO: 1759423 - DNA, 18 bp, Homo sapiens
ctggtggggctgagcctg

SEQ ID NO: 1759424 - DNA, 16 bp, Homo sapiens
ctggtggggctgtcct

SEQ ID NO: 1759425 - DNA, 17 bp, Homo sapiens
ctggtggggctgtcctg

SEQ ID NO: 1759426 - DNA, 17 bp, Homo sapiens
ctggtgggtcagcccag

SEQ ID NO: 1759427 - DNA, 22 bp, Homo sapiens
ctggtgggtcagcccagcacct

SEQ ID NO: 1759428 - DNA, 22 bp, Homo sapiens
ctggtgggtggagtcaggcttc

SEQ ID NO: 1759429 - DNA, 21 bp, Homo sapiens
ctggtgggtggcccagagcct

SEQ ID NO: 1759430 - DNA, 17 bp, Homo sapiens
ctggtggtacctgtgct

SEQ ID NO: 1759431 - DNA, 18 bp, Homo sapiens
ctggtggtctgttggcag

SEQ ID NO: 1759432 - DNA, 15 bp, Homo sapiens
ctgtcatcactccct

SEQ ID NO: 1759433 - DNA, 17 bp, Homo sapiens
ctgtcatcactccctgg

SEQ ID NO: 1759434 - DNA, 18 bp, Homo sapiens
ctgtcatcactccctgga

SEQ ID NO: 1759435 - DNA, 21 bp, Homo sapiens
ctgtcatcactccctggatgt

SEQ ID NO: 1759436 - DNA, 17 bp, Homo sapiens
ctgtcatccagctcact

SEQ ID NO: 1759437 - DNA, 18 bp, Homo sapiens
ctgtcatgaaatcagcaa

SEQ ID NO: 1759438 - DNA, 14 bp, Homo sapiens
ctgtcatgcttcat

SEQ ID NO: 1759439 - DNA, 15 bp, Homo sapiens
ctgtcattgcacata

SEQ ID NO: 1759440 - DNA, 15 bp, Homo sapiens
ctgtcatttgaacct

SEQ ID NO: 1759441 - DNA, 13 bp, Homo sapiens
ctgtcatttttaa

SEQ ID NO: 1759442 - DNA, 19 bp, Homo sapiens
ctgtccaaaggaggctggc

SEQ ID NO: 1759443 - DNA, 20 bp, Homo sapiens
ctgtccaacctaaccccttt

SEQ ID NO: 1759444 - DNA, 23 bp, Homo sapiens
ctgtccaacctaacccctttcct

SEQ ID NO: 1759445 - DNA, 16 bp, Homo sapiens
ctgtccacatccccag

SEQ ID NO: 1759446 - DNA, 19 bp, Homo sapiens
ctgtccacatccccagagc

SEQ ID NO: 1759447 - DNA, 20 bp, Homo sapiens
ctgtccacatccccagagcc

SEQ ID NO: 1759448 - DNA, 13 bp, Homo sapiens
ctgtccagcctgg

SEQ ID NO: 1759449 - DNA, 13 bp, Homo sapiens
ctgtccagctcca

SEQ ID NO: 1759450 - DNA, 12 bp, Homo sapiens
ctgtccaggcag

SEQ ID NO: 1759451 - DNA, 19 bp, Homo sapiens
ctgtccaggcagctccctc

SEQ ID NO: 1759452 - DNA, 15 bp, Homo sapiens
ctgtccaggccactg

SEQ ID NO: 1759453 - DNA, 19 bp, Homo sapiens
ctgtccaggccactgtggc

SEQ ID NO: 1759454 - DNA, 20 bp, Homo sapiens
ctgtccagggccctgagctc

SEQ ID NO: 1759455 - DNA, 21 bp, Homo sapiens
ctgtcccaccaactctgcact

SEQ ID NO: 1759456 - DNA, 16 bp, Homo sapiens
ctgtcccacccacaca

SEQ ID NO: 1759457 - DNA, 19 bp, Homo sapiens
ctgtcccacccacacagct

SEQ ID NO: 1759458 - DNA, 20 bp, Homo sapiens
ctgtcccacccacacagctg

SEQ ID NO: 1759459 - DNA, 22 bp, Homo sapiens
ctgtcccacccacacagctgcc

SEQ ID NO: 1759460 - DNA, 14 bp, Homo sapiens
ctgtcccaccccca

SEQ ID NO: 1759461 - DNA, 17 bp, Homo sapiens
ctgtcccactactgtag

SEQ ID NO: 1759462 - DNA, 23 bp, Homo sapiens
ctgtcccagagcttattggccac

SEQ ID NO: 1759463 - DNA, 14 bp, Homo sapiens
ctgtcccagctacc

SEQ ID NO: 1759464 - DNA, 15 bp, Homo sapiens
ctgtcccattctaga

SEQ ID NO: 1759465 - DNA, 17 bp, Homo sapiens
ctgtcccattctagatc

SEQ ID NO: 1759466 - DNA, 12 bp, Homo sapiens
ctgtccccaccc

SEQ ID NO: 1759467 - DNA, 19 bp, Homo sapiens
ctgtccccaccctccactc

SEQ ID NO: 1759468 - DNA, 16 bp, Homo sapiens
ctgtcccccagctctg

SEQ ID NO: 1759469 - DNA, 13 bp, Homo sapiens
ctgtcccctcagc

SEQ ID NO: 1759470 - DNA, 18 bp, Homo sapiens
ctgtcccctctgtcatca

SEQ ID NO: 1759471 - DNA, 21 bp, Homo sapiens
ctgtccccttctctcatctct

SEQ ID NO: 1759472 - DNA, 22 bp, Homo sapiens
ctgtccccttctctcatctctt

SEQ ID NO: 1759473 - DNA, 23 bp, Homo sapiens
ctgtccccttctctcatctctta

SEQ ID NO: 1759474 - DNA, 14 bp, Homo sapiens
ctgtcccgccttcc

SEQ ID NO: 1759475 - DNA, 12 bp, Homo sapiens
ctgtccctccag

SEQ ID NO: 1759476 - DNA, 17 bp, Homo sapiens
ctgtccctccaggccca

SEQ ID NO: 1759477 - DNA, 22 bp, Homo sapiens
ctgtccctccaggcccatctca

SEQ ID NO: 1759478 - DNA, 16 bp, Homo sapiens
ctgtccctccatccca

SEQ ID NO: 1759479 - DNA, 17 bp, Homo sapiens
ctgtccctctagtgcct

SEQ ID NO: 1759480 - DNA, 17 bp, Homo sapiens
ctgtccctctcagtgcc

SEQ ID NO: 1759481 - DNA, 21 bp, Homo sapiens
ctgtccctctcagtgccttct

SEQ ID NO: 1759482 - DNA, 22 bp, Homo sapiens
ctgtccctctcagtgccttctc

SEQ ID NO: 1759483 - DNA, 13 bp, Homo sapiens
ctgtccctgcagg

SEQ ID NO: 1759484 - DNA, 23 bp, Homo sapiens
ctgtcccttgcttgcctgcaggg

SEQ ID NO: 1759485 - DNA, 18 bp, Homo sapiens
ctgtccctttgctcccgg

SEQ ID NO: 1759486 - DNA, 20 bp, Homo sapiens
ctgtccctttgctcccggca

SEQ ID NO: 1759487 - DNA, 13 bp, Homo sapiens
ctgtcccttttct

SEQ ID NO: 1759488 - DNA, 17 bp, Homo sapiens
ctgtccggcccagtgcc

SEQ ID NO: 1759489 - DNA, 18 bp, Homo sapiens
ctgtccggcccagtgcca

SEQ ID NO: 1759490 - DNA, 22 bp, Homo sapiens
ctgtccggcccagtgccactgc

SEQ ID NO: 1759491 - DNA, 23 bp, Homo sapiens
ctgtccgggtgccagggctgcag

SEQ ID NO: 1759492 - DNA, 18 bp, Homo sapiens
ctgtcctacttctgactt

SEQ ID NO: 1759493 - DNA, 15 bp, Homo sapiens
ctgtcctaggccaca

SEQ ID NO: 1759494 - DNA, 22 bp, Homo sapiens
ctgtcctcagccttgccagaga

SEQ ID NO: 1759495 - DNA, 21 bp, Homo sapiens
ctgtcctcccgagctcctctt

SEQ ID NO: 1759496 - DNA, 23 bp, Homo sapiens
ctgtcctcctcggatcaccgaga

SEQ ID NO: 1759497 - DNA, 21 bp, Homo sapiens
ctgtcctcgaattttatctgt

SEQ ID NO: 1759498 - DNA, 23 bp, Homo sapiens
ctgtcctcgaattttatctgtgg

SEQ ID NO: 1759499 - DNA, 14 bp, Homo sapiens
ctgtcctctgtagt

SEQ ID NO: 1759500 - DNA, 12 bp, Homo sapiens
ctgtcctgagcc

SEQ ID NO: 1759501 - DNA, 13 bp, Homo sapiens
ctgtcctgagccc

SEQ ID NO: 1759502 - DNA, 20 bp, Homo sapiens
ctgtcctgagccccctgcac

SEQ ID NO: 1759503 - DNA, 22 bp, Homo sapiens
ctgtcctgagccccctgcaccc

SEQ ID NO: 1759504 - DNA, 21 bp, Homo sapiens
ctgtcctgaggagccctgagg

SEQ ID NO: 1759505 - DNA, 14 bp, Homo sapiens
ctgtcctgcagcaa

SEQ ID NO: 1759506 - DNA, 15 bp, Homo sapiens
ctgtcctgcagcaaa

SEQ ID NO: 1759507 - DNA, 16 bp, Homo sapiens
ctgtcctgcagcaaac

SEQ ID NO: 1759508 - DNA, 14 bp, Homo sapiens
ctgtcctgctcacc

SEQ ID NO: 1759509 - DNA, 16 bp, Homo sapiens
ctgtcctgctcacctg

SEQ ID NO: 1759510 - DNA, 19 bp, Homo sapiens
ctgtcctgctcacctgtgt

SEQ ID NO: 1759511 - DNA, 12 bp, Homo sapiens
ctgtcctgctgc

SEQ ID NO: 1759512 - DNA, 12 bp, Homo sapiens
ctgtcctgggca

SEQ ID NO: 1759513 - DNA, 14 bp, Homo sapiens
ctgtcctgggcatg

SEQ ID NO: 1759514 - DNA, 12 bp, Homo sapiens
ctgtcctggtcc

SEQ ID NO: 1759515 - DNA, 18 bp, Homo sapiens
ctgtcctggtcctgatgc

SEQ ID NO: 1759516 - DNA, 19 bp, Homo sapiens
ctgtcctggtggctgggcc

SEQ ID NO: 1759517 - DNA, 14 bp, Homo sapiens
ctgtcctgtacatt

SEQ ID NO: 1759518 - DNA, 14 bp, Homo sapiens
ctgtcctgtcctgc

SEQ ID NO: 1759519 - DNA, 16 bp, Homo sapiens
ctgtcctgtcctgctc

SEQ ID NO: 1759520 - DNA, 12 bp, Homo sapiens
ctgtcctgtgac

SEQ ID NO: 1759521 - DNA, 12 bp, Homo sapiens
ctgtccttccct

SEQ ID NO: 1759522 - DNA, 18 bp, Homo sapiens
ctgtccttccctgccact

SEQ ID NO: 1759523 - DNA, 13 bp, Homo sapiens
ctgtcctttcctt

SEQ ID NO: 1759524 - DNA, 15 bp, Homo sapiens
ctgtccttttaggaa

SEQ ID NO: 1759525 - DNA, 19 bp, Homo sapiens
ctgtccttttaggaatatg

SEQ ID NO: 1759526 - DNA, 21 bp, Homo sapiens
ctgtcgaaggggaggcacact

SEQ ID NO: 1759527 - DNA, 15 bp, Homo sapiens
ctgtcgctgcctcca

SEQ ID NO: 1759528 - DNA, 15 bp, Homo sapiens
ctgtcggcaccatgt

SEQ ID NO: 1759529 - DNA, 21 bp, Homo sapiens
ctgtctaagcagttttgtaaa

SEQ ID NO: 1759530 - DNA, 22 bp, Homo sapiens
ctgtctaagcagttttgtaaat

SEQ ID NO: 1759531 - DNA, 13 bp, Homo sapiens
ctgtctacatttc

SEQ ID NO: 1759532 - DNA, 14 bp, Homo sapiens
ctgtctacctggtc

SEQ ID NO: 1759533 - DNA, 13 bp, Homo sapiens
ctgtctactgtgg

SEQ ID NO: 1759534 - DNA, 14 bp, Homo sapiens
ctgtctactgtggt

SEQ ID NO: 1759535 - DNA, 16 bp, Homo sapiens
ctgtctactgtggtga

SEQ ID NO: 1759536 - DNA, 16 bp, Homo sapiens
ctgtctagactggcct

SEQ ID NO: 1759537 - DNA, 17 bp, Homo sapiens
ctgtctagactggccta

SEQ ID NO: 1759538 - DNA, 12 bp, Homo sapiens
ctgtctagagta

SEQ ID NO: 1759539 - DNA, 19 bp, Homo sapiens
ctgtctaggactgcagtgt

SEQ ID NO: 1759540 - DNA, 21 bp, Homo sapiens
ctgtctaggactgcagtgtgg

SEQ ID NO: 1759541 - DNA, 22 bp, Homo sapiens
ctgtctattaaaattctgatgt

SEQ ID NO: 1759542 - DNA, 23 bp, Homo sapiens
ctgtctcaagagggcactggtgg

SEQ ID NO: 1759543 - DNA, 14 bp, Homo sapiens
ctgtctcacctgga

SEQ ID NO: 1759544 - DNA, 12 bp, Homo sapiens
ctgtctcagcct

SEQ ID NO: 1759545 - DNA, 15 bp, Homo sapiens
ctgtctcagcctcct

SEQ ID NO: 1759546 - DNA, 18 bp, Homo sapiens
ctgtctcagcctcctgag

SEQ ID NO: 1759547 - DNA, 24 bp, Homo sapiens
ctgtggaccgtggacaggcccagc

SEQ ID NO: 1759548 - DNA, 15 bp, Homo sapiens
ctgtggagttcctgc

SEQ ID NO: 1759549 - DNA, 16 bp, Homo sapiens
ctgtggagttcctgct

SEQ ID NO: 1759550 - DNA, 19 bp, Homo sapiens
ctgtggagttcctgctccg

SEQ ID NO: 1759551 - DNA, 14 bp, Homo sapiens
ctgtggattctata

SEQ ID NO: 1759552 - DNA, 23 bp, Homo sapiens
ctgtggcacagacttctggaagg

SEQ ID NO: 1759553 - DNA, 15 bp, Homo sapiens
ctgtggcacttgcct

SEQ ID NO: 1759554 - DNA, 17 bp, Homo sapiens
ctgtggcacttgcctgg

SEQ ID NO: 1759555 - DNA, 20 bp, Homo sapiens
ctgtggcacttgcctgggtc

SEQ ID NO: 1759556 - DNA, 19 bp, Homo sapiens
ctgtggcagagttacagtt

SEQ ID NO: 1759557 - DNA, 21 bp, Homo sapiens
ctgtggcagccgtcccaggcc

SEQ ID NO: 1759558 - DNA, 15 bp, Homo sapiens
ctgtggcagctgccc

SEQ ID NO: 1759559 - DNA, 22 bp, Homo sapiens
ctgtggcagctgcccctggcac

SEQ ID NO: 1759560 - DNA, 12 bp, Homo sapiens
ctgtggcaggag

SEQ ID NO: 1759561 - DNA, 16 bp, Homo sapiens
ctgtggcaggaggctt

SEQ ID NO: 1759562 - DNA, 18 bp, Homo sapiens
ctgtggcataaattgcat

SEQ ID NO: 1759563 - DNA, 17 bp, Homo sapiens
ctgtggcatctttgcct

SEQ ID NO: 1759564 - DNA, 19 bp, Homo sapiens
ctgtggccacagccccctt

SEQ ID NO: 1759565 - DNA, 14 bp, Homo sapiens
ctgtggccagagct

SEQ ID NO: 1759566 - DNA, 17 bp, Homo sapiens
ctgtggccagagctgga

SEQ ID NO: 1759567 - DNA, 23 bp, Homo sapiens
ctgtggccagcttgttatttata

SEQ ID NO: 1759568 - DNA, 13 bp, Homo sapiens
ctgtggccctggc

SEQ ID NO: 1759569 - DNA, 22 bp, Homo sapiens
ctgtggccctggccactaaagc

SEQ ID NO: 1759570 - DNA, 22 bp, Homo sapiens
ctgtggccgcacgcctctccct

SEQ ID NO: 1759571 - DNA, 13 bp, Homo sapiens
ctgtggcctgggc

SEQ ID NO: 1759572 - DNA, 14 bp, Homo sapiens
ctgtggcctgggca

SEQ ID NO: 1759573 - DNA, 21 bp, Homo sapiens
ctgtggcctgtgtccagcagc

SEQ ID NO: 1759574 - DNA, 22 bp, Homo sapiens
ctgtggcgactctgcagagtca

SEQ ID NO: 1759575 - DNA, 15 bp, Homo sapiens
ctgtggcggtgcctg

SEQ ID NO: 1759576 - DNA, 23 bp, Homo sapiens
ctgtggctcacagtggggccagc

SEQ ID NO: 1759577 - DNA, 14 bp, Homo sapiens
ctgtggctggagga

SEQ ID NO: 1759578 - DNA, 21 bp, Homo sapiens
ctgtggctggaggagctggcc

SEQ ID NO: 1759579 - DNA, 22 bp, Homo sapiens
ctgtggctggaggagctggcct

SEQ ID NO: 1759580 - DNA, 24 bp, Homo sapiens
ctgtggctggaggagctggcctgt

SEQ ID NO: 1759581 - DNA, 16 bp, Homo sapiens
ctgtgggagagcgaag

SEQ ID NO: 1759582 - DNA, 16 bp, Homo sapiens
ctgtgggatgtgccag

SEQ ID NO: 1759583 - DNA, 18 bp, Homo sapiens
ctgtggggaacacagcta

SEQ ID NO: 1759584 - DNA, 13 bp, Homo sapiens
ctgtggggagccg

SEQ ID NO: 1759585 - DNA, 18 bp, Homo sapiens
ctgtggggagccgagggc

SEQ ID NO: 1759586 - DNA, 21 bp, Homo sapiens
ctgtggggaggggttgttttg

SEQ ID NO: 1759587 - DNA, 17 bp, Homo sapiens
ctgtggggatctcaggg

SEQ ID NO: 1759588 - DNA, 21 bp, Homo sapiens
ctgtggggatctcaggggctg

SEQ ID NO: 1759589 - DNA, 17 bp, Homo sapiens
ctgtggggcaggagtgc

SEQ ID NO: 1759590 - DNA, 23 bp, Homo sapiens
ctgtggggcaggagtgccaggac

SEQ ID NO: 1759591 - DNA, 16 bp, Homo sapiens
ctgtggggcccccaca

SEQ ID NO: 1759592 - DNA, 23 bp, Homo sapiens
ctgtggggcccttgggccacgct

SEQ ID NO: 1759593 - DNA, 14 bp, Homo sapiens
ctgtggggctacag

SEQ ID NO: 1759594 - DNA, 23 bp, Homo sapiens
ctgtgggggtgagggtcccatgt

SEQ ID NO: 1759595 - DNA, 13 bp, Homo sapiens
ctgtgggtctctg

SEQ ID NO: 1759596 - DNA, 18 bp, Homo sapiens
ctgtgggtctctgaaggg

SEQ ID NO: 1759597 - DNA, 21 bp, Homo sapiens
ctgtggtaggggcagggaggc

SEQ ID NO: 1759598 - DNA, 16 bp, Homo sapiens
ctgtggtcacagcgga

SEQ ID NO: 1759599 - DNA, 18 bp, Homo sapiens
ctgtggtggctccccctc

SEQ ID NO: 1759600 - DNA, 20 bp, Homo sapiens
ctgtggtggctccccctctg

SEQ ID NO: 1759601 - DNA, 16 bp, Homo sapiens
ctgtggttcctctgct

SEQ ID NO: 1759602 - DNA, 17 bp, Homo sapiens
ctgtggtttcagatgtg

SEQ ID NO: 1759603 - DNA, 18 bp, Homo sapiens
ctgtggttttcccctccc

SEQ ID NO: 1759604 - DNA, 20 bp, Homo sapiens
ctgtggttttcccctccctg

SEQ ID NO: 1759605 - DNA, 21 bp, Homo sapiens
ctgtggttttcccctccctgg

SEQ ID NO: 1759606 - DNA, 22 bp, Homo sapiens
ctgtggttttcccctccctggg

SEQ ID NO: 1759607 - DNA, 19 bp, Homo sapiens
ctgtgtaacatccaagcca

SEQ ID NO: 1759608 - DNA, 21 bp, Homo sapiens
ctgtgtaacatccaagccaga

SEQ ID NO: 1759609 - DNA, 15 bp, Homo sapiens
ctgtgtaaccttggg

SEQ ID NO: 1759610 - DNA, 18 bp, Homo sapiens
ctgtgtaactttctctta

SEQ ID NO: 1759611 - DNA, 15 bp, Homo sapiens
ctgtgtaagaagctg

SEQ ID NO: 1759612 - DNA, 16 bp, Homo sapiens
ctgtgtaatctctgat

SEQ ID NO: 1759613 - DNA, 18 bp, Homo sapiens
ctgtgtaatctctgatta

SEQ ID NO: 1759614 - DNA, 21 bp, Homo sapiens
ctgtgtacagaattctgctac

SEQ ID NO: 1759615 - DNA, 17 bp, Homo sapiens
ctgtgtacataactgaa

SEQ ID NO: 1759616 - DNA, 21 bp, Homo sapiens
ctgtgtacctctagaatccca

SEQ ID NO: 1759617 - DNA, 13 bp, Homo sapiens
ctgtgtagccgcc

SEQ ID NO: 1759618 - DNA, 18 bp, Homo sapiens
ctgtgtagccgccctgag

SEQ ID NO: 1759619 - DNA, 21 bp, Homo sapiens
ctgtgtagccgccctgagaga

SEQ ID NO: 1759620 - DNA, 13 bp, Homo sapiens
ctgtgtatagctt

SEQ ID NO: 1759621 - DNA, 14 bp, Homo sapiens
ctgtgtatgtacat

SEQ ID NO: 1759622 - DNA, 15 bp, Homo sapiens
ctgtgtattccaaga

SEQ ID NO: 1759623 - DNA, 19 bp, Homo sapiens
ctgtgtattttttaaagct

SEQ ID NO: 1759624 - DNA, 18 bp, Homo sapiens
ctgtgtcaaggtgaagca

SEQ ID NO: 1759625 - DNA, 19 bp, Homo sapiens
ctgtgtcacccagactgga

SEQ ID NO: 1759626 - DNA, 18 bp, Homo sapiens
ctgtgtcatttcttcact

SEQ ID NO: 1759627 - DNA, 23 bp, Homo sapiens
ctgtgtccagagacatgggcctc

SEQ ID NO: 1759628 - DNA, 18 bp, Homo sapiens
ctgtgtccatgcgctcag

SEQ ID NO: 1759629 - DNA, 14 bp, Homo sapiens
ctgtgtcccagcca

SEQ ID NO: 1759630 - DNA, 19 bp, Homo sapiens
ctgtgtcccagccacgcag

SEQ ID NO: 1759631 - DNA, 23 bp, Homo sapiens
ctgtgtcccagccacgcagggcc

SEQ ID NO: 1759632 - DNA, 13 bp, Homo sapiens
ctgtgtcccatga

SEQ ID NO: 1759633 - DNA, 15 bp, Homo sapiens
ctgtgtcccatgacc

SEQ ID NO: 1759634 - DNA, 21 bp, Homo sapiens
ctgtgtccccgatgctgacct

SEQ ID NO: 1759635 - DNA, 16 bp, Homo sapiens
ctgtgtcctaaggccc

SEQ ID NO: 1759636 - DNA, 18 bp, Homo sapiens
ctgtgtcctccaccatgc

SEQ ID NO: 1759637 - DNA, 21 bp, Homo sapiens
ctgtgtcctccaccatgcact

SEQ ID NO: 1759638 - DNA, 13 bp, Homo sapiens
ctgtgtcctggtg

SEQ ID NO: 1759639 - DNA, 14 bp, Homo sapiens
ctgtgtcctggtgc

SEQ ID NO: 1759640 - DNA, 15 bp, Homo sapiens
ctgtgtcctggtgct

SEQ ID NO: 1759641 - DNA, 17 bp, Homo sapiens
ctgtgtcctggtgctct

SEQ ID NO: 1759642 - DNA, 16 bp, Homo sapiens
ctgtgtcgtagccaag

SEQ ID NO: 1759643 - DNA, 20 bp, Homo sapiens
ctgtgtctaagattctagat

SEQ ID NO: 1759644 - DNA, 15 bp, Homo sapiens
ctgtgtctcctctca

SEQ ID NO: 1759645 - DNA, 22 bp, Homo sapiens
ctgtgtctgcccaatgaataat

SEQ ID NO: 1759646 - DNA, 18 bp, Homo sapiens
ctgtgtgaatacctgctc

SEQ ID NO: 1759647 - DNA, 19 bp, Homo sapiens
ctgtgtgaatacctgctca

SEQ ID NO: 1759648 - DNA, 14 bp, Homo sapiens
ctgtgtgaatccag

SEQ ID NO: 1759649 - DNA, 19 bp, Homo sapiens
ctgtgtgaccctgggcaag

SEQ ID NO: 1759650 - DNA, 14 bp, Homo sapiens
ctgtgtgattaaaa

SEQ ID NO: 1759651 - DNA, 14 bp, Homo sapiens
ctgtgtgcagcaac

SEQ ID NO: 1759652 - DNA, 19 bp, Homo sapiens
ctgtgtgcccagcacctgg

SEQ ID NO: 1759653 - DNA, 15 bp, Homo sapiens
ctgtgtgccccactc

SEQ ID NO: 1759654 - DNA, 16 bp, Homo sapiens
ctgtgtgccccactcc

SEQ ID NO: 1759655 - DNA, 21 bp, Homo sapiens
ctgtgtgccccactccagcct

SEQ ID NO: 1759656 - DNA, 17 bp, Homo sapiens
ctgtgtgctgactgaac

SEQ ID NO: 1759657 - DNA, 19 bp, Homo sapiens
ctgtgtgctgactgaacat

SEQ ID NO: 1759658 - DNA, 12 bp, Homo sapiens
ctgtgtggagag

SEQ ID NO: 1759659 - DNA, 17 bp, Homo sapiens
ctgtgtggcagttaatt

SEQ ID NO: 1759660 - DNA, 16 bp, Homo sapiens
ctgtgtggctcctggg

SEQ ID NO: 1759661 - DNA, 15 bp, Homo sapiens
cttaaagagggacag

SEQ ID NO: 1759662 - DNA, 22 bp, Homo sapiens
cttaaagagggacaggctgaag

SEQ ID NO: 1759663 - DNA, 19 bp, Homo sapiens
cttaaagatttatcaaatc

SEQ ID NO: 1759664 - DNA, 18 bp, Homo sapiens
cttaaagcaaagtcactt

SEQ ID NO: 1759665 - DNA, 23 bp, Homo sapiens
cttaaagcaaagtcacttctcca

SEQ ID NO: 1759666 - DNA, 20 bp, Homo sapiens
cttaaataatgcttcagata

SEQ ID NO: 1759667 - DNA, 21 bp, Homo sapiens
cttaaataatgcttcagatat

SEQ ID NO: 1759668 - DNA, 21 bp, Homo sapiens
cttaaatgaaagcatgtggca

SEQ ID NO: 1759669 - DNA, 20 bp, Homo sapiens
cttaaatgctcattttctgg

SEQ ID NO: 1759670 - DNA, 16 bp, Homo sapiens
cttaaatggaattatt

SEQ ID NO: 1759671 - DNA, 19 bp, Homo sapiens
cttaaatggaattattttg

SEQ ID NO: 1759672 - DNA, 21 bp, Homo sapiens
cttaaatggaattattttgaa

SEQ ID NO: 1759673 - DNA, 20 bp, Homo sapiens
cttaaattatatatttattt

SEQ ID NO: 1759674 - DNA, 21 bp, Homo sapiens
cttaaattgcttttgttgtga

SEQ ID NO: 1759675 - DNA, 12 bp, Homo sapiens
cttaaatttaat

SEQ ID NO: 1759676 - DNA, 20 bp, Homo sapiens
cttaaatttcttatgtgaca

SEQ ID NO: 1759677 - DNA, 15 bp, Homo sapiens
cttaaatttgttctt

SEQ ID NO: 1759678 - DNA, 16 bp, Homo sapiens
cttaaattttaattta

SEQ ID NO: 1759679 - DNA, 17 bp, Homo sapiens
cttaaattttcttcctt

SEQ ID NO: 1759680 - DNA, 20 bp, Homo sapiens
cttaaattttcttcctttga

SEQ ID NO: 1759681 - DNA, 17 bp, Homo sapiens
cttaacaaaccaacatc

SEQ ID NO: 1759682 - DNA, 20 bp, Homo sapiens
cttaacaaaccaacatcttt

SEQ ID NO: 1759683 - DNA, 17 bp, Homo sapiens
cttaacacactggccat

SEQ ID NO: 1759684 - DNA, 14 bp, Homo sapiens
cttaaccagtctct

SEQ ID NO: 1759685 - DNA, 17 bp, Homo sapiens
cttaacccacctctcct

SEQ ID NO: 1759686 - DNA, 12 bp, Homo sapiens
cttaaccctgtg

SEQ ID NO: 1759687 - DNA, 12 bp, Homo sapiens
cttaaccttaaa

SEQ ID NO: 1759688 - DNA, 18 bp, Homo sapiens
cttaaccttaaccttaaa

SEQ ID NO: 1759689 - DNA, 16 bp, Homo sapiens
cttaacggctccagga

SEQ ID NO: 1759690 - DNA, 20 bp, Homo sapiens
cttaactaaatgataaatgt

SEQ ID NO: 1759691 - DNA, 12 bp, Homo sapiens
cttaactaattt

SEQ ID NO: 1759692 - DNA, 20 bp, Homo sapiens
cttaactataaggtgcctca

SEQ ID NO: 1759693 - DNA, 14 bp, Homo sapiens
cttaacttcttaaa

SEQ ID NO: 1759694 - DNA, 11 bp, Homo sapiens
cttaagaacac

SEQ ID NO: 1759695 - DNA, 23 bp, Homo sapiens
cttaagacaaatgggactgatgt

SEQ ID NO: 1759696 - DNA, 13 bp, Homo sapiens
cttaagacggaag

SEQ ID NO: 1759697 - DNA, 16 bp, Homo sapiens
cttaagacggaagtaa

SEQ ID NO: 1759698 - DNA, 20 bp, Homo sapiens
cttaagattaattttctctt

SEQ ID NO: 1759699 - DNA, 18 bp, Homo sapiens
cttaagcaaaagaaaaag

SEQ ID NO: 1759700 - DNA, 12 bp, Homo sapiens
cttaagcaaagg

SEQ ID NO: 1759701 - DNA, 19 bp, Homo sapiens
cttaagcagaacaaatgtg

SEQ ID NO: 1759702 - DNA, 13 bp, Homo sapiens
cttaagcagcatg

SEQ ID NO: 1759703 - DNA, 19 bp, Homo sapiens
cttaagcagcatggaaaaa

SEQ ID NO: 1759704 - DNA, 16 bp, Homo sapiens
cttaagcaggtttgtt

SEQ ID NO: 1759705 - DNA, 20 bp, Homo sapiens
cttaagccaaactcaggccc

SEQ ID NO: 1759706 - DNA, 23 bp, Homo sapiens
cttaagctaggatgttgctcaga

SEQ ID NO: 1759707 - DNA, 21 bp, Homo sapiens
cttaaggatggagccagctct

SEQ ID NO: 1759708 - DNA, 20 bp, Homo sapiens
cttaaggattgtgatatttt

SEQ ID NO: 1759709 - DNA, 20 bp, Homo sapiens
cttaaggggtatcatgtatg

SEQ ID NO: 1759710 - DNA, 17 bp, Homo sapiens
cttaagggttgaaggca

SEQ ID NO: 1759711 - DNA, 21 bp, Homo sapiens
cttaagggttgaaggcagtct

SEQ ID NO: 1759712 - DNA, 22 bp, Homo sapiens
cttaagtaagcaacagcataac

SEQ ID NO: 1759713 - DNA, 19 bp, Homo sapiens
cttaagtaatcatctaagt

SEQ ID NO: 1759714 - DNA, 18 bp, Homo sapiens
cttaagtcttccttaaat

SEQ ID NO: 1759715 - DNA, 14 bp, Homo sapiens
cttaagtgcacttt

SEQ ID NO: 1759716 - DNA, 16 bp, Homo sapiens
cttaagtgtttctcaa

SEQ ID NO: 1759717 - DNA, 20 bp, Homo sapiens
cttaagtgtttctcaaaaga

SEQ ID NO: 1759718 - DNA, 18 bp, Homo sapiens
cttaagttttagtcttta

SEQ ID NO: 1759719 - DNA, 20 bp, Homo sapiens
cttaataaattgtgtttcct

SEQ ID NO: 1759720 - DNA, 20 bp, Homo sapiens
cttaataactgtgtactgtt

SEQ ID NO: 1759721 - DNA, 17 bp, Homo sapiens
cttaataatttttacct

SEQ ID NO: 1759722 - DNA, 17 bp, Homo sapiens
cttaatactgttattct

SEQ ID NO: 1759723 - DNA, 21 bp, Homo sapiens
cttaatactgttattctttgc

SEQ ID NO: 1759724 - DNA, 14 bp, Homo sapiens
cttaatagaggagc

SEQ ID NO: 1759725 - DNA, 22 bp, Homo sapiens
cttaatcaggtcctcagagaat

SEQ ID NO: 1759726 - DNA, 15 bp, Homo sapiens
cttaatccattaaaa

SEQ ID NO: 1759727 - DNA, 17 bp, Homo sapiens
cttaatcttgctttctt

SEQ ID NO: 1759728 - DNA, 14 bp, Homo sapiens
cttaatctttgaaa

SEQ ID NO: 1759729 - DNA, 18 bp, Homo sapiens
cttaatgacattcccctc

SEQ ID NO: 1759730 - DNA, 23 bp, Homo sapiens
cttaatgacattcccctcccacc

SEQ ID NO: 1759731 - DNA, 22 bp, Homo sapiens
cttaatgtgattactgctctat

SEQ ID NO: 1759732 - DNA, 14 bp, Homo sapiens
cttaatgtttattc

SEQ ID NO: 1759733 - DNA, 23 bp, Homo sapiens
cttaatgtttattcctgataata

SEQ ID NO: 1759734 - DNA, 16 bp, Homo sapiens
cttaattaaaagaata

SEQ ID NO: 1759735 - DNA, 18 bp, Homo sapiens
cttaattattatttgtgt

SEQ ID NO: 1759736 - DNA, 19 bp, Homo sapiens
cttaattattatttgtgtt

SEQ ID NO: 1759737 - DNA, 16 bp, Homo sapiens
cttaattctttgttct

SEQ ID NO: 1759738 - DNA, 18 bp, Homo sapiens
cttaattctttgttctgt

SEQ ID NO: 1759739 - DNA, 19 bp, Homo sapiens
cttaattgttcattttgag

SEQ ID NO: 1759740 - DNA, 14 bp, Homo sapiens
cttaatttatttct

SEQ ID NO: 1759741 - DNA, 20 bp, Homo sapiens
cttaatttcctttttgacac

SEQ ID NO: 1759742 - DNA, 22 bp, Homo sapiens
cttaatttcctttttgacactg

SEQ ID NO: 1759743 - DNA, 13 bp, Homo sapiens
cttaatttgcaca

SEQ ID NO: 1759744 - DNA, 22 bp, Homo sapiens
cttaattttctgtggatcattt

SEQ ID NO: 1759745 - DNA, 22 bp, Homo sapiens
cttacaaagggaaagcctctgg

SEQ ID NO: 1759746 - DNA, 16 bp, Homo sapiens
cttacaaatgtgaaac

SEQ ID NO: 1759747 - DNA, 16 bp, Homo sapiens
cttacaagccagctgg

SEQ ID NO: 1759748 - DNA, 17 bp, Homo sapiens
cttacaagccagctgga

SEQ ID NO: 1759749 - DNA, 18 bp, Homo sapiens
cttacaattgcactgctg

SEQ ID NO: 1759750 - DNA, 12 bp, Homo sapiens
cttacactgagg

SEQ ID NO: 1759751 - DNA, 14 bp, Homo sapiens
cttacacttataaa

SEQ ID NO: 1759752 - DNA, 19 bp, Homo sapiens
cttacatactaggtgcctt

SEQ ID NO: 1759753 - DNA, 14 bp, Homo sapiens
cttacatcttttct

SEQ ID NO: 1759754 - DNA, 14 bp, Homo sapiens
cttacatgttttct

SEQ ID NO: 1759755 - DNA, 22 bp, Homo sapiens
cttacattagcagtttgctttg

SEQ ID NO: 1759756 - DNA, 13 bp, Homo sapiens
cttacattgaaaa

SEQ ID NO: 1759757 - DNA, 17 bp, Homo sapiens
cttacatttttacaata

SEQ ID NO: 1759758 - DNA, 22 bp, Homo sapiens
cttacatttttacaataaataa

SEQ ID NO: 1759759 - DNA, 17 bp, Homo sapiens
cttaccaagttgtgctt

SEQ ID NO: 1759760 - DNA, 13 bp, Homo sapiens
cttaccagaagct

SEQ ID NO: 1759761 - DNA, 22 bp, Homo sapiens
cttacccaaactgttcaagaaa

SEQ ID NO: 1759762 - DNA, 21 bp, Homo sapiens
cttacccagattgtgtacata

SEQ ID NO: 1759763 - DNA, 23 bp, Homo sapiens
cttacccagattgtgtacataga

SEQ ID NO: 1759764 - DNA, 20 bp, Homo sapiens
cttaccccttagcctccctg

SEQ ID NO: 1759765 - DNA, 22 bp, Homo sapiens
cttacccggagaaggccgctgc

SEQ ID NO: 1759766 - DNA, 22 bp, Homo sapiens
cttacctgaaaagtagagaaat

SEQ ID NO: 1759767 - DNA, 19 bp, Homo sapiens
cttacctgggcattcttgt

SEQ ID NO: 1759768 - DNA, 19 bp, Homo sapiens
cttaccttgaactgaaggc

SEQ ID NO: 1759769 - DNA, 14 bp, Homo sapiens
cttacgctttgtca

SEQ ID NO: 1759770 - DNA, 21 bp, Homo sapiens
cttactaaacattttgttatt

SEQ ID NO: 1759771 - DNA, 20 bp, Homo sapiens
cttactagtactatttctta

SEQ ID NO: 1759772 - DNA, 13 bp, Homo sapiens
cttactatttctg

SEQ ID NO: 1759773 - DNA, 18 bp, Homo sapiens
cttactctcctctttcct

SEQ ID NO: 1759774 - DNA, 13 bp, Homo sapiens
cttactctgagcc

SEQ ID NO: 1759775 - DNA, 14 bp, Homo sapiens
cttcactgccatga

SEQ ID NO: 1759776 - DNA, 18 bp, Homo sapiens
cttcactggcgccttctc

SEQ ID NO: 1759777 - DNA, 19 bp, Homo sapiens
cttcactggcgccttctcg

SEQ ID NO: 1759778 - DNA, 24 bp, Homo sapiens
cttcactggcgccttctcggagct

SEQ ID NO: 1759779 - DNA, 17 bp, Homo sapiens
cttcactgtgaggggaa

SEQ ID NO: 1759780 - DNA, 18 bp, Homo sapiens
cttcactgtggccacagc

SEQ ID NO: 1759781 - DNA, 19 bp, Homo sapiens
cttcactgttccctctggc

SEQ ID NO: 1759782 - DNA, 21 bp, Homo sapiens
cttcactgttccctctggctt

SEQ ID NO: 1759783 - DNA, 20 bp, Homo sapiens
cttcagacacatgctatgtt

SEQ ID NO: 1759784 - DNA, 15 bp, Homo sapiens
cttcagacccagaga

SEQ ID NO: 1759785 - DNA, 11 bp, Homo sapiens
cttcagagcct

SEQ ID NO: 1759786 - DNA, 19 bp, Homo sapiens
cttcagagcctagccacct

SEQ ID NO: 1759787 - DNA, 19 bp, Homo sapiens
cttcagagtgaagaatctt

SEQ ID NO: 1759788 - DNA, 16 bp, Homo sapiens
cttcagagtttgtcat

SEQ ID NO: 1759789 - DNA, 13 bp, Homo sapiens
cttcagatctgag

SEQ ID NO: 1759790 - DNA, 21 bp, Homo sapiens
cttcagcacaggaattctcaa

SEQ ID NO: 1759791 - DNA, 15 bp, Homo sapiens
cttcagcagcagctc

SEQ ID NO: 1759792 - DNA, 15 bp, Homo sapiens
cttcagccaggagct

SEQ ID NO: 1759793 - DNA, 18 bp, Homo sapiens
cttcagccaggagctggg

SEQ ID NO: 1759794 - DNA, 12 bp, Homo sapiens
cttcagcccagg

SEQ ID NO: 1759795 - DNA, 13 bp, Homo sapiens
cttcagcccaggc

SEQ ID NO: 1759796 - DNA, 17 bp, Homo sapiens
cttcagcccaggctttt

SEQ ID NO: 1759797 - DNA, 14 bp, Homo sapiens
cttcagcccccacc

SEQ ID NO: 1759798 - DNA, 22 bp, Homo sapiens
cttcagccctaacatagtgtct

SEQ ID NO: 1759799 - DNA, 15 bp, Homo sapiens
cttcagccctcaccc

SEQ ID NO: 1759800 - DNA, 23 bp, Homo sapiens
cttcagcctagccgacctcagcc

SEQ ID NO: 1759801 - DNA, 15 bp, Homo sapiens
cttcagctccaggga

SEQ ID NO: 1759802 - DNA, 15 bp, Homo sapiens
cttcagctctttttg

SEQ ID NO: 1759803 - DNA, 19 bp, Homo sapiens
cttcagctgtacttcgtct

SEQ ID NO: 1759804 - DNA, 22 bp, Homo sapiens
cttcaggaggccctggtgtcag

SEQ ID NO: 1759805 - DNA, 21 bp, Homo sapiens
cttcaggatattggttcttcc

SEQ ID NO: 1759806 - DNA, 15 bp, Homo sapiens
cttcaggctcttctc

SEQ ID NO: 1759807 - DNA, 17 bp, Homo sapiens
cttcaggctcttctcct

SEQ ID NO: 1759808 - DNA, 22 bp, Homo sapiens
cttcaggctcttctcctttcac

SEQ ID NO: 1759809 - DNA, 16 bp, Homo sapiens
cttcaggcttctgtca

SEQ ID NO: 1759810 - DNA, 17 bp, Homo sapiens
cttcagggcagggctct

SEQ ID NO: 1759811 - DNA, 14 bp, Homo sapiens
cttcagggccagaa

SEQ ID NO: 1759812 - DNA, 18 bp, Homo sapiens
cttcagggccagaaggag

SEQ ID NO: 1759813 - DNA, 23 bp, Homo sapiens
cttcaggggagtcccgtcaggac

SEQ ID NO: 1759814 - DNA, 17 bp, Homo sapiens
cttcaggggcacttcat

SEQ ID NO: 1759815 - DNA, 16 bp, Homo sapiens
cttcaggtggaaaaac

SEQ ID NO: 1759816 - DNA, 22 bp, Homo sapiens
cttcagtaccctctcagctcca

SEQ ID NO: 1759817 - DNA, 22 bp, Homo sapiens
cttcagtctctataccaataaa

SEQ ID NO: 1759818 - DNA, 14 bp, Homo sapiens
cttcagtctgctcc

SEQ ID NO: 1759819 - DNA, 15 bp, Homo sapiens
cttcagtctgctcca

SEQ ID NO: 1759820 - DNA, 22 bp, Homo sapiens
cttcagtgaatatttttgtatt

SEQ ID NO: 1759821 - DNA, 18 bp, Homo sapiens
cttcagtgactcctgctg

SEQ ID NO: 1759822 - DNA, 20 bp, Homo sapiens
cttcagtgactcctgctggt

SEQ ID NO: 1759823 - DNA, 11 bp, Homo sapiens
cttcagtgccc

SEQ ID NO: 1759824 - DNA, 15 bp, Homo sapiens
cttcagtgcccacca

SEQ ID NO: 1759825 - DNA, 17 bp, Homo sapiens
cttcagtgcccaccaac

SEQ ID NO: 1759826 - DNA, 18 bp, Homo sapiens
cttcagtgctacattttg

SEQ ID NO: 1759827 - DNA, 15 bp, Homo sapiens
cttcagtgggagaaa

SEQ ID NO: 1759828 - DNA, 16 bp, Homo sapiens
cttcagtgtaatgtga

SEQ ID NO: 1759829 - DNA, 23 bp, Homo sapiens
cttcagtgtaatgtgacttcatg

SEQ ID NO: 1759830 - DNA, 15 bp, Homo sapiens
cttcagttgcttgtc

SEQ ID NO: 1759831 - DNA, 23 bp, Homo sapiens
cttcagtttaatgtctcctttgc

SEQ ID NO: 1759832 - DNA, 20 bp, Homo sapiens
cttcagtttcacagaaaata

SEQ ID NO: 1759833 - DNA, 21 bp, Homo sapiens
cttcagtttcattttcctgtg

SEQ ID NO: 1759834 - DNA, 22 bp, Homo sapiens
cttcataccgcctcgtgccagc

SEQ ID NO: 1759835 - DNA, 22 bp, Homo sapiens
cttcataggcggtcatgtgtgc

SEQ ID NO: 1759836 - DNA, 14 bp, Homo sapiens
cttcatcaagaaat

SEQ ID NO: 1759837 - DNA, 17 bp, Homo sapiens
cttcatcattccctctc

SEQ ID NO: 1759838 - DNA, 18 bp, Homo sapiens
cttcatcattccctctca

SEQ ID NO: 1759839 - DNA, 15 bp, Homo sapiens
cttcatcccattcca

SEQ ID NO: 1759840 - DNA, 16 bp, Homo sapiens
cttcatcccattccag

SEQ ID NO: 1759841 - DNA, 15 bp, Homo sapiens
cttcatccctttcca

SEQ ID NO: 1759842 - DNA, 19 bp, Homo sapiens
cttcatccggcagcctgga

SEQ ID NO: 1759843 - DNA, 13 bp, Homo sapiens
cttcatcctcctc

SEQ ID NO: 1759844 - DNA, 11 bp, Homo sapiens
cttcatcctct

SEQ ID NO: 1759845 - DNA, 18 bp, Homo sapiens
cttcatctgactatgaca

SEQ ID NO: 1759846 - DNA, 19 bp, Homo sapiens
cttcatctgactatgacat

SEQ ID NO: 1759847 - DNA, 21 bp, Homo sapiens
cttcatctgactatgacataa

SEQ ID NO: 1759848 - DNA, 15 bp, Homo sapiens
cttcatcttcctgtg

SEQ ID NO: 1759849 - DNA, 19 bp, Homo sapiens
cttcatcttcctgtgtcct

SEQ ID NO: 1759850 - DNA, 16 bp, Homo sapiens
cttcatgacagcctcc

SEQ ID NO: 1759851 - DNA, 13 bp, Homo sapiens
cttcatgcaatga

SEQ ID NO: 1759852 - DNA, 17 bp, Homo sapiens
cttcatgcaatgacatc

SEQ ID NO: 1759853 - DNA, 22 bp, Homo sapiens
cttcatgcaatgacatcttcaa

SEQ ID NO: 1759854 - DNA, 15 bp, Homo sapiens
cttcatgcccttctg

SEQ ID NO: 1759855 - DNA, 14 bp, Homo sapiens
cttcatgcctttgt

SEQ ID NO: 1759856 - DNA, 16 bp, Homo sapiens
cttcatgcctttgtaa

SEQ ID NO: 1759857 - DNA, 19 bp, Homo sapiens
cttcatgcctttgtaagtt

SEQ ID NO: 1759858 - DNA, 17 bp, Homo sapiens
cttcatgcttgacatac

SEQ ID NO: 1759859 - DNA, 13 bp, Homo sapiens
cttcatggaccaa

SEQ ID NO: 1759860 - DNA, 15 bp, Homo sapiens
cttcatggaccaaga

SEQ ID NO: 1759861 - DNA, 22 bp, Homo sapiens
cttcatggaccaagaatgagct

SEQ ID NO: 1759862 - DNA, 13 bp, Homo sapiens
cttcatggatggg

SEQ ID NO: 1759863 - DNA, 17 bp, Homo sapiens
cttcattctaaaccaaa

SEQ ID NO: 1759864 - DNA, 18 bp, Homo sapiens
cttcattctaaaccaaaa

SEQ ID NO: 1759865 - DNA, 20 bp, Homo sapiens
cttcattctaaaccaaaaca

SEQ ID NO: 1759866 - DNA, 13 bp, Homo sapiens
cttcattctcctt

SEQ ID NO: 1759867 - DNA, 20 bp, Homo sapiens
cttcattcttgaaagctgtg

SEQ ID NO: 1759868 - DNA, 21 bp, Homo sapiens
cttcattcttgaaagctgtgg

SEQ ID NO: 1759869 - DNA, 18 bp, Homo sapiens
cttcattctttactgcac

SEQ ID NO: 1759870 - DNA, 19 bp, Homo sapiens
cttcattctttactgcact

SEQ ID NO: 1759871 - DNA, 19 bp, Homo sapiens
cttcattgccttaactgga

SEQ ID NO: 1759872 - DNA, 20 bp, Homo sapiens
cttcatttgacacaaagctt

SEQ ID NO: 1759873 - DNA, 14 bp, Homo sapiens
cttcattttcatta

SEQ ID NO: 1759874 - DNA, 19 bp, Homo sapiens
cttccaaaacctgcttcct

SEQ ID NO: 1759875 - DNA, 20 bp, Homo sapiens
cttccaaaacctgcttcctt

SEQ ID NO: 1759876 - DNA, 21 bp, Homo sapiens
cttccaaaacctgcttccttc

SEQ ID NO: 1759877 - DNA, 12 bp, Homo sapiens
cttccaaagaaa

SEQ ID NO: 1759878 - DNA, 22 bp, Homo sapiens
cttccaaagagggatgtttgga

SEQ ID NO: 1759879 - DNA, 21 bp, Homo sapiens
cttccaaagtaaaattgctgt

SEQ ID NO: 1759880 - DNA, 16 bp, Homo sapiens
cttccaaatcctggaa

SEQ ID NO: 1759881 - DNA, 18 bp, Homo sapiens
cttccaaatcctggaagg

SEQ ID NO: 1759882 - DNA, 19 bp, Homo sapiens
cttccaaatgcaatttgat

SEQ ID NO: 1759883 - DNA, 11 bp, Homo sapiens
cttccaaatgt

SEQ ID NO: 1759884 - DNA, 18 bp, Homo sapiens
cttccaacaaggacagcc

SEQ ID NO: 1759885 - DNA, 21 bp, Homo sapiens
cttccaaccatttatcttgaa

SEQ ID NO: 1759886 - DNA, 19 bp, Homo sapiens
cttccaacccattagccat

SEQ ID NO: 1759887 - DNA, 17 bp, Homo sapiens
cttccaaggagaccaag

SEQ ID NO: 1759888 - DNA, 18 bp, Homo sapiens
cttccaaggccctgcttt

SEQ ID NO: 1759889 - DNA, 21 bp, Homo sapiens
cttcctgtcaagcaatcaaga

SEQ ID NO: 1759890 - DNA, 23 bp, Homo sapiens
cttcctgtccactctcggggccc

SEQ ID NO: 1759891 - DNA, 22 bp, Homo sapiens
cttcctgtgaagtttaattgtc

SEQ ID NO: 1759892 - DNA, 16 bp, Homo sapiens
cttcctgtgatccacc

SEQ ID NO: 1759893 - DNA, 22 bp, Homo sapiens
cttcctgtgtactctttatttc

SEQ ID NO: 1759894 - DNA, 20 bp, Homo sapiens
cttcctgtttcagacccccc

SEQ ID NO: 1759895 - DNA, 23 bp, Homo sapiens
cttcctgtttcagacccccccat

SEQ ID NO: 1759896 - DNA, 19 bp, Homo sapiens
cttccttaattcactccca

SEQ ID NO: 1759897 - DNA, 21 bp, Homo sapiens
cttccttaattcactcccaca

SEQ ID NO: 1759898 - DNA, 16 bp, Homo sapiens
cttccttacccaaact

SEQ ID NO: 1759899 - DNA, 23 bp, Homo sapiens
cttccttatgtatcagtgtcctt

SEQ ID NO: 1759900 - DNA, 22 bp, Homo sapiens
cttccttcagggtttaatagac

SEQ ID NO: 1759901 - DNA, 11 bp, Homo sapiens
cttccttccct

SEQ ID NO: 1759902 - DNA, 12 bp, Homo sapiens
cttccttccctg

SEQ ID NO: 1759903 - DNA, 14 bp, Homo sapiens
cttccttccctggc

SEQ ID NO: 1759904 - DNA, 15 bp, Homo sapiens
cttccttccctggct

SEQ ID NO: 1759905 - DNA, 22 bp, Homo sapiens
cttccttctaccccaaggccag

SEQ ID NO: 1759906 - DNA, 11 bp, Homo sapiens
cttccttctgg

SEQ ID NO: 1759907 - DNA, 14 bp, Homo sapiens
cttccttgaccagc

SEQ ID NO: 1759908 - DNA, 18 bp, Homo sapiens
cttccttgagacacggag

SEQ ID NO: 1759909 - DNA, 23 bp, Homo sapiens
cttccttgagacacggagcccag

SEQ ID NO: 1759910 - DNA, 12 bp, Homo sapiens
cttccttgcccc

SEQ ID NO: 1759911 - DNA, 19 bp, Homo sapiens
cttccttgctgtcctaggc

SEQ ID NO: 1759912 - DNA, 20 bp, Homo sapiens
cttccttgctgtcctaggcc

SEQ ID NO: 1759913 - DNA, 18 bp, Homo sapiens
cttcctttaggtctggtt

SEQ ID NO: 1759914 - DNA, 13 bp, Homo sapiens
cttcctttataat

SEQ ID NO: 1759915 - DNA, 15 bp, Homo sapiens
cttcctttataatat

SEQ ID NO: 1759916 - DNA, 16 bp, Homo sapiens
cttcctttcaggccaa

SEQ ID NO: 1759917 - DNA, 19 bp, Homo sapiens
cttcctttcaggccaaggc

SEQ ID NO: 1759918 - DNA, 13 bp, Homo sapiens
cttcctttctctc

SEQ ID NO: 1759919 - DNA, 21 bp, Homo sapiens
cttccttttagcctagttcat

SEQ ID NO: 1759920 - DNA, 14 bp, Homo sapiens
cttccttttccctg

SEQ ID NO: 1759921 - DNA, 16 bp, Homo sapiens
cttccttttccctgct

SEQ ID NO: 1759922 - DNA, 22 bp, Homo sapiens
cttccttttccctgcttccagg

SEQ ID NO: 1759923 - DNA, 15 bp, Homo sapiens
cttcgaaaggccttc

SEQ ID NO: 1759924 - DNA, 23 bp, Homo sapiens
cttcgaccacagcaagccatcat

SEQ ID NO: 1759925 - DNA, 19 bp, Homo sapiens
cttcgactactgctcctgt

SEQ ID NO: 1759926 - DNA, 20 bp, Homo sapiens
cttcgactactgctcctgtg

SEQ ID NO: 1759927 - DNA, 19 bp, Homo sapiens
cttcgatcaagctacttta

SEQ ID NO: 1759928 - DNA, 16 bp, Homo sapiens
cttcgcaggcatgtcc

SEQ ID NO: 1759929 - DNA, 22 bp, Homo sapiens
cttcgccaaggttgtagcatgg

SEQ ID NO: 1759930 - DNA, 13 bp, Homo sapiens
cttcgctagaaaa

SEQ ID NO: 1759931 - DNA, 13 bp, Homo sapiens
cttcgctgaaatt

SEQ ID NO: 1759932 - DNA, 21 bp, Homo sapiens
cttcgctgctctagctggcag

SEQ ID NO: 1759933 - DNA, 12 bp, Homo sapiens
cttcgctggact

SEQ ID NO: 1759934 - DNA, 23 bp, Homo sapiens
cttcgctgtgatgcatgagctcc

SEQ ID NO: 1759935 - DNA, 22 bp, Homo sapiens
cttcggagatgaggagtaaaat

SEQ ID NO: 1759936 - DNA, 22 bp, Homo sapiens
cttcggagggcccctgcgtggg

SEQ ID NO: 1759937 - DNA, 15 bp, Homo sapiens
cttcgggctgtgccc

SEQ ID NO: 1759938 - DNA, 16 bp, Homo sapiens
cttcggtttctgagca

SEQ ID NO: 1759939 - DNA, 17 bp, Homo sapiens
cttcgtgcccccccttc

SEQ ID NO: 1759940 - DNA, 13 bp, Homo sapiens
cttcgtggttgtg

SEQ ID NO: 1759941 - DNA, 22 bp, Homo sapiens
cttcgtgtctctcccaccccgg

SEQ ID NO: 1759942 - DNA, 18 bp, Homo sapiens
cttcgtttattttcaaga

SEQ ID NO: 1759943 - DNA, 13 bp, Homo sapiens
cttctaaaacaat

SEQ ID NO: 1759944 - DNA, 21 bp, Homo sapiens
cttctaaaacttgtatgttta

SEQ ID NO: 1759945 - DNA, 24 bp, Homo sapiens
cttctaaatgagtcactgagcatc

SEQ ID NO: 1759946 - DNA, 23 bp, Homo sapiens
cttctaaatggcaaaggaaggtg

SEQ ID NO: 1759947 - DNA, 13 bp, Homo sapiens
cttctaagaagac

SEQ ID NO: 1759948 - DNA, 16 bp, Homo sapiens
cttctaagaagacatt

SEQ ID NO: 1759949 - DNA, 17 bp, Homo sapiens
cttctaagaagacattt

SEQ ID NO: 1759950 - DNA, 15 bp, Homo sapiens
cttctaagatgccag

SEQ ID NO: 1759951 - DNA, 18 bp, Homo sapiens
cttctacatttgagggcc

SEQ ID NO: 1759952 - DNA, 12 bp, Homo sapiens
cttctacccaga

SEQ ID NO: 1759953 - DNA, 18 bp, Homo sapiens
cttctaccccaaggccag

SEQ ID NO: 1759954 - DNA, 19 bp, Homo sapiens
cttctaccccaaggccagt

SEQ ID NO: 1759955 - DNA, 14 bp, Homo sapiens
cttctacctgccct

SEQ ID NO: 1759956 - DNA, 16 bp, Homo sapiens
cttctacctgccctca

SEQ ID NO: 1759957 - DNA, 13 bp, Homo sapiens
cttctactcccct

SEQ ID NO: 1759958 - DNA, 23 bp, Homo sapiens
cttctactcttgagagctcaggc

SEQ ID NO: 1759959 - DNA, 18 bp, Homo sapiens
cttctactgagccttcag

SEQ ID NO: 1759960 - DNA, 19 bp, Homo sapiens
cttctactttcatcttaaa

SEQ ID NO: 1759961 - DNA, 13 bp, Homo sapiens
cttctacttttaa

SEQ ID NO: 1759962 - DNA, 21 bp, Homo sapiens
cttctacttttaagttgctga

SEQ ID NO: 1759963 - DNA, 9 bp, Homo sapiens
cttctagag

SEQ ID NO: 1759964 - DNA, 13 bp, Homo sapiens
cttctagagttca

SEQ ID NO: 1759965 - DNA, 15 bp, Homo sapiens
cttctagagttttat

SEQ ID NO: 1759966 - DNA, 16 bp, Homo sapiens
cttctagatctcagcc

SEQ ID NO: 1759967 - DNA, 16 bp, Homo sapiens
cttctaggagaacttt

SEQ ID NO: 1759968 - DNA, 22 bp, Homo sapiens
cttctaggatagctaactgtaa

SEQ ID NO: 1759969 - DNA, 16 bp, Homo sapiens
cttctaggttctaaaa

SEQ ID NO: 1759970 - DNA, 16 bp, Homo sapiens
cttctagtcttggcca

SEQ ID NO: 1759971 - DNA, 14 bp, Homo sapiens
cttctagtttccca

SEQ ID NO: 1759972 - DNA, 20 bp, Homo sapiens
cttctataattttgccttta

SEQ ID NO: 1759973 - DNA, 15 bp, Homo sapiens
cttctatattttaat

SEQ ID NO: 1759974 - DNA, 20 bp, Homo sapiens
cttctatattttaatagaaa

SEQ ID NO: 1759975 - DNA, 16 bp, Homo sapiens
cttctatcattccaat

SEQ ID NO: 1759976 - DNA, 15 bp, Homo sapiens
cttctatcccaggag

SEQ ID NO: 1759977 - DNA, 17 bp, Homo sapiens
cttctatgtccaacaga

SEQ ID NO: 1759978 - DNA, 22 bp, Homo sapiens
cttctatgtccaacagagtgga

SEQ ID NO: 1759979 - DNA, 18 bp, Homo sapiens
cttctattaatcaagaga

SEQ ID NO: 1759980 - DNA, 21 bp, Homo sapiens
cttctattctagcctgcattg

SEQ ID NO: 1759981 - DNA, 16 bp, Homo sapiens
cttctattttgtaaac

SEQ ID NO: 1759982 - DNA, 12 bp, Homo sapiens
cttctattttta

SEQ ID NO: 1759983 - DNA, 12 bp, Homo sapiens
cttctcaagact

SEQ ID NO: 1759984 - DNA, 17 bp, Homo sapiens
cttctcaagttctaaga

SEQ ID NO: 1759985 - DNA, 19 bp, Homo sapiens
cttctcacttcaattaatg

SEQ ID NO: 1759986 - DNA, 18 bp, Homo sapiens
cttctcaggccccgggct

SEQ ID NO: 1759987 - DNA, 23 bp, Homo sapiens
cttctcaggccccgggcttccct

SEQ ID NO: 1759988 - DNA, 24 bp, Homo sapiens
cttctcaggccccgggcttccctt

SEQ ID NO: 1759989 - DNA, 20 bp, Homo sapiens
cttctcaggctctgccctgc

SEQ ID NO: 1759990 - DNA, 21 bp, Homo sapiens
cttctcatcatattgtatgta

SEQ ID NO: 1759991 - DNA, 14 bp, Homo sapiens
cttctcatgatcca

SEQ ID NO: 1759992 - DNA, 14 bp, Homo sapiens
cttctcatttcacc

SEQ ID NO: 1759993 - DNA, 15 bp, Homo sapiens
cttctcatttcaccc

SEQ ID NO: 1759994 - DNA, 17 bp, Homo sapiens
cttctcatttcacccct

SEQ ID NO: 1759995 - DNA, 14 bp, Homo sapiens
cttctccacctccc

SEQ ID NO: 1759996 - DNA, 17 bp, Homo sapiens
cttctccatctggcagg

SEQ ID NO: 1759997 - DNA, 20 bp, Homo sapiens
cttctcccaaatgtctattt

SEQ ID NO: 1759998 - DNA, 16 bp, Homo sapiens
cttctcccacatgagg

SEQ ID NO: 1759999 - DNA, 13 bp, Homo sapiens
cttctcccagtgt

SEQ ID NO: 1760000 - DNA, 15 bp, Homo sapiens
cttctcccagtgtga

SEQ ID NO: 1760001 - DNA, 13 bp, Homo sapiens
cttctccccagcc

SEQ ID NO: 1760002 - DNA, 16 bp, Homo sapiens
cttctccccagccaga

SEQ ID NO: 1760003 - DNA, 17 bp, Homo sapiens
cttctccccagccagag

SEQ ID NO: 1760004 - DNA, 11 bp, Homo sapiens
cttgagcctcc

SEQ ID NO: 1760005 - DNA, 15 bp, Homo sapiens
cttgagcctccccca

SEQ ID NO: 1760006 - DNA, 12 bp, Homo sapiens
cttgagctcagg

SEQ ID NO: 1760007 - DNA, 16 bp, Homo sapiens
cttgagctcaggagtt

SEQ ID NO: 1760008 - DNA, 21 bp, Homo sapiens
cttgagctcccctggagccag

SEQ ID NO: 1760009 - DNA, 13 bp, Homo sapiens
cttgagctggcct

SEQ ID NO: 1760010 - DNA, 14 bp, Homo sapiens
cttgagctggcctc

SEQ ID NO: 1760011 - DNA, 17 bp, Homo sapiens
cttgagcttaaacagaa

SEQ ID NO: 1760012 - DNA, 21 bp, Homo sapiens
cttgagcttggcagctgaact

SEQ ID NO: 1760013 - DNA, 19 bp, Homo sapiens
cttgaggaagcccaggctc

SEQ ID NO: 1760014 - DNA, 22 bp, Homo sapiens
cttgaggagtgtgagaatcaaa

SEQ ID NO: 1760015 - DNA, 16 bp, Homo sapiens
cttgaggatggagagc

SEQ ID NO: 1760016 - DNA, 19 bp, Homo sapiens
cttgaggattgtggaaaac

SEQ ID NO: 1760017 - DNA, 19 bp, Homo sapiens
cttgaggccaagatggctg

SEQ ID NO: 1760018 - DNA, 16 bp, Homo sapiens
cttgagggagcttagc

SEQ ID NO: 1760019 - DNA, 15 bp, Homo sapiens
cttgagtaaaaaggt

SEQ ID NO: 1760020 - DNA, 15 bp, Homo sapiens
cttgagtaagtgaag

SEQ ID NO: 1760021 - DNA, 21 bp, Homo sapiens
cttgagtgagaagagcttgca

SEQ ID NO: 1760022 - DNA, 22 bp, Homo sapiens
cttgagtgagaagagcttgcac

SEQ ID NO: 1760023 - DNA, 23 bp, Homo sapiens
cttgagtggggttatctctgtgt

SEQ ID NO: 1760024 - DNA, 13 bp, Homo sapiens
cttgagtgttcct

SEQ ID NO: 1760025 - DNA, 16 bp, Homo sapiens
cttgagttattaaaat

SEQ ID NO: 1760026 - DNA, 16 bp, Homo sapiens
cttgataaagggccaa

SEQ ID NO: 1760027 - DNA, 18 bp, Homo sapiens
cttgatacccccctctgt

SEQ ID NO: 1760028 - DNA, 19 bp, Homo sapiens
cttgatacccccctctgtc

SEQ ID NO: 1760029 - DNA, 17 bp, Homo sapiens
cttgatatagaaagctg

SEQ ID NO: 1760030 - DNA, 15 bp, Homo sapiens
cttgatatcattcag

SEQ ID NO: 1760031 - DNA, 13 bp, Homo sapiens
cttgatatttgta

SEQ ID NO: 1760032 - DNA, 14 bp, Homo sapiens
cttgatatttgtat

SEQ ID NO: 1760033 - DNA, 13 bp, Homo sapiens
cttgatctctctt

SEQ ID NO: 1760034 - DNA, 13 bp, Homo sapiens
cttgatcttaaag

SEQ ID NO: 1760035 - DNA, 23 bp, Homo sapiens
cttgatgcagttttaatacttgt

SEQ ID NO: 1760036 - DNA, 21 bp, Homo sapiens
cttgatgccagagggccagca

SEQ ID NO: 1760037 - DNA, 15 bp, Homo sapiens
cttgatgtaaaatct

SEQ ID NO: 1760038 - DNA, 20 bp, Homo sapiens
cttgatgtaaaatcttgtca

SEQ ID NO: 1760039 - DNA, 13 bp, Homo sapiens
cttgatgtacata

SEQ ID NO: 1760040 - DNA, 21 bp, Homo sapiens
cttgatgtcatgtacttcctg

SEQ ID NO: 1760041 - DNA, 18 bp, Homo sapiens
cttgatgttccacctgcc

SEQ ID NO: 1760042 - DNA, 15 bp, Homo sapiens
cttgatgtttcctgg

SEQ ID NO: 1760043 - DNA, 16 bp, Homo sapiens
cttgatgtttcctgga

SEQ ID NO: 1760044 - DNA, 19 bp, Homo sapiens
cttgatgtttcctggaagc

SEQ ID NO: 1760045 - DNA, 20 bp, Homo sapiens
cttgatgtttcctggaagca

SEQ ID NO: 1760046 - DNA, 19 bp, Homo sapiens
cttgatgttttttctgtaa

SEQ ID NO: 1760047 - DNA, 23 bp, Homo sapiens
cttgatgttttttctgtaatgta

SEQ ID NO: 1760048 - DNA, 15 bp, Homo sapiens
cttgattaaatcaac

SEQ ID NO: 1760049 - DNA, 13 bp, Homo sapiens
cttgattcctggc

SEQ ID NO: 1760050 - DNA, 14 bp, Homo sapiens
cttgattcctggct

SEQ ID NO: 1760051 - DNA, 16 bp, Homo sapiens
cttgattcctggctct

SEQ ID NO: 1760052 - DNA, 21 bp, Homo sapiens
cttgattcctggtttgactca

SEQ ID NO: 1760053 - DNA, 13 bp, Homo sapiens
cttgattgagaaa

SEQ ID NO: 1760054 - DNA, 14 bp, Homo sapiens
cttgattgagaaag

SEQ ID NO: 1760055 - DNA, 13 bp, Homo sapiens
cttgattggaagg

SEQ ID NO: 1760056 - DNA, 19 bp, Homo sapiens
cttgattttcaagctttca

SEQ ID NO: 1760057 - DNA, 23 bp, Homo sapiens
cttgattttccatctaaaaatat

SEQ ID NO: 1760058 - DNA, 23 bp, Homo sapiens
cttgcaaatacctcctccctaat

SEQ ID NO: 1760059 - DNA, 18 bp, Homo sapiens
cttgcaagcatgcttgtg

SEQ ID NO: 1760060 - DNA, 16 bp, Homo sapiens
cttgcacacttcccca

SEQ ID NO: 1760061 - DNA, 17 bp, Homo sapiens
cttgcacacttccccat

SEQ ID NO: 1760062 - DNA, 23 bp, Homo sapiens
cttgcacagccaacgagacacat

SEQ ID NO: 1760063 - DNA, 23 bp, Homo sapiens
cttgcacagtcactgctcttcag

SEQ ID NO: 1760064 - DNA, 15 bp, Homo sapiens
cttgcacccgcctct

SEQ ID NO: 1760065 - DNA, 17 bp, Homo sapiens
cttgcacccgcctctcc

SEQ ID NO: 1760066 - DNA, 12 bp, Homo sapiens
cttgcacctgca

SEQ ID NO: 1760067 - DNA, 20 bp, Homo sapiens
cttgcacgaccgccccagtt

SEQ ID NO: 1760068 - DNA, 15 bp, Homo sapiens
cttgcagcatttact

SEQ ID NO: 1760069 - DNA, 21 bp, Homo sapiens
cttgcagcatttactatgcac

SEQ ID NO: 1760070 - DNA, 22 bp, Homo sapiens
cttgcagcatttactatgcaca

SEQ ID NO: 1760071 - DNA, 16 bp, Homo sapiens
cttgcagctggcccac

SEQ ID NO: 1760072 - DNA, 17 bp, Homo sapiens
cttgcagctggcccact

SEQ ID NO: 1760073 - DNA, 20 bp, Homo sapiens
cttgcagctggcccactgct

SEQ ID NO: 1760074 - DNA, 22 bp, Homo sapiens
cttgcagtatgatggcaggaga

SEQ ID NO: 1760075 - DNA, 20 bp, Homo sapiens
cttgcataggctcttaagca

SEQ ID NO: 1760076 - DNA, 18 bp, Homo sapiens
cttgcattgaatatatta

SEQ ID NO: 1760077 - DNA, 21 bp, Homo sapiens
cttgcatttgtggtaatctac

SEQ ID NO: 1760078 - DNA, 20 bp, Homo sapiens
cttgccaaaaaatagcacac

SEQ ID NO: 1760079 - DNA, 20 bp, Homo sapiens
cttgccaaagtacagaattt

SEQ ID NO: 1760080 - DNA, 21 bp, Homo sapiens
cttgccaaagtacagaatttg

SEQ ID NO: 1760081 - DNA, 17 bp, Homo sapiens
cttgccaagaaaatgaa

SEQ ID NO: 1760082 - DNA, 14 bp, Homo sapiens
cttgccaaggcaga

SEQ ID NO: 1760083 - DNA, 17 bp, Homo sapiens
cttgccaaggcagaggc

SEQ ID NO: 1760084 - DNA, 19 bp, Homo sapiens
cttgccaaggcagaggcct

SEQ ID NO: 1760085 - DNA, 13 bp, Homo sapiens
cttgccagagccg

SEQ ID NO: 1760086 - DNA, 13 bp, Homo sapiens
cttgccagccaga

SEQ ID NO: 1760087 - DNA, 23 bp, Homo sapiens
cttgccagccagaagcctctgcc

SEQ ID NO: 1760088 - DNA, 18 bp, Homo sapiens
cttgccatccattctgga

SEQ ID NO: 1760089 - DNA, 13 bp, Homo sapiens
cttgccatgcagg

SEQ ID NO: 1760090 - DNA, 23 bp, Homo sapiens
cttgccatgcaggaagaggccca

SEQ ID NO: 1760091 - DNA, 15 bp, Homo sapiens
cttgccattctcttg

SEQ ID NO: 1760092 - DNA, 18 bp, Homo sapiens
cttgccatttgtagcttt

SEQ ID NO: 1760093 - DNA, 16 bp, Homo sapiens
cttgcccactgcctgc

SEQ ID NO: 1760094 - DNA, 17 bp, Homo sapiens
cttgcccactgcctgcc

SEQ ID NO: 1760095 - DNA, 22 bp, Homo sapiens
cttgcccactgcctgcctcccc

SEQ ID NO: 1760096 - DNA, 13 bp, Homo sapiens
cttgcccagagat

SEQ ID NO: 1760097 - DNA, 19 bp, Homo sapiens
cttgcccagagatgcctcc

SEQ ID NO: 1760098 - DNA, 15 bp, Homo sapiens
cttgcccagggctca

SEQ ID NO: 1760099 - DNA, 20 bp, Homo sapiens
cttgcccagggctcagcctg

SEQ ID NO: 1760100 - DNA, 21 bp, Homo sapiens
cttgcccagggctcagcctgg

SEQ ID NO: 1760101 - DNA, 16 bp, Homo sapiens
cttgcccatcctgact

SEQ ID NO: 1760102 - DNA, 22 bp, Homo sapiens
cttgcccccatccctcggaccc

SEQ ID NO: 1760103 - DNA, 20 bp, Homo sapiens
cttgcccgcacccctccctg

SEQ ID NO: 1760104 - DNA, 22 bp, Homo sapiens
cttgcccgcacccctccctgct

SEQ ID NO: 1760105 - DNA, 19 bp, Homo sapiens
cttgcccgccagcctcagt

SEQ ID NO: 1760106 - DNA, 20 bp, Homo sapiens
cttgcccggattctgggagg

SEQ ID NO: 1760107 - DNA, 16 bp, Homo sapiens
cttgcccgtcgtgtgc

SEQ ID NO: 1760108 - DNA, 19 bp, Homo sapiens
cttgccctccctttctctc

SEQ ID NO: 1760109 - DNA, 14 bp, Homo sapiens
cttgccctccgcct

SEQ ID NO: 1760110 - DNA, 14 bp, Homo sapiens
cttgccctgttaaa

SEQ ID NO: 1760111 - DNA, 22 bp, Homo sapiens
cttgccctgttaaaagatgaaa

SEQ ID NO: 1760112 - DNA, 17 bp, Homo sapiens
cttgcccttccctgtcc

SEQ ID NO: 1760113 - DNA, 18 bp, Homo sapiens
cttgcccttggagctgcc

SEQ ID NO: 1760114 - DNA, 14 bp, Homo sapiens
cttgccgagcctaa

SEQ ID NO: 1760115 - DNA, 21 bp, Homo sapiens
cttgcctaaatcccaagaaat

SEQ ID NO: 1760116 - DNA, 23 bp, Homo sapiens
cttgcctaaatttaatgctgcct

SEQ ID NO: 1760117 - DNA, 18 bp, Homo sapiens
cttgcctaggccaaatgc

SEQ ID NO: 1760118 - DNA, 16 bp, Homo sapiens
cttggtgtccacctgg

SEQ ID NO: 1760119 - DNA, 19 bp, Homo sapiens
cttggtgtccacctggccc

SEQ ID NO: 1760120 - DNA, 17 bp, Homo sapiens
cttggttcatcagtgtt

SEQ ID NO: 1760121 - DNA, 13 bp, Homo sapiens
cttggttctaaag

SEQ ID NO: 1760122 - DNA, 17 bp, Homo sapiens
cttggttgggtcctcac

SEQ ID NO: 1760123 - DNA, 19 bp, Homo sapiens
cttggttggtagggtggga

SEQ ID NO: 1760124 - DNA, 21 bp, Homo sapiens
cttggttgtgtttttctttct

SEQ ID NO: 1760125 - DNA, 16 bp, Homo sapiens
cttggtttggggagaa

SEQ ID NO: 1760126 - DNA, 18 bp, Homo sapiens
cttggtttggggagaaat

SEQ ID NO: 1760127 - DNA, 23 bp, Homo sapiens
cttggtttttactgctctgagaa

SEQ ID NO: 1760128 - DNA, 19 bp, Homo sapiens
cttgtaaaaaaagcaaaaa

SEQ ID NO: 1760129 - DNA, 20 bp, Homo sapiens
cttgtaaataaagtctattt

SEQ ID NO: 1760130 - DNA, 22 bp, Homo sapiens
cttgtaaataaagtctattttt

SEQ ID NO: 1760131 - DNA, 15 bp, Homo sapiens
cttgtaaatacacca

SEQ ID NO: 1760132 - DNA, 18 bp, Homo sapiens
cttgtaaatctttttgct

SEQ ID NO: 1760133 - DNA, 13 bp, Homo sapiens
cttgtaaatgttt

SEQ ID NO: 1760134 - DNA, 14 bp, Homo sapiens
cttgtaaatgtttc

SEQ ID NO: 1760135 - DNA, 17 bp, Homo sapiens
cttgtaactccaccaac

SEQ ID NO: 1760136 - DNA, 15 bp, Homo sapiens
cttgtaagccatcag

SEQ ID NO: 1760137 - DNA, 12 bp, Homo sapiens
cttgtaatatgt

SEQ ID NO: 1760138 - DNA, 14 bp, Homo sapiens
cttgtaatatgtat

SEQ ID NO: 1760139 - DNA, 16 bp, Homo sapiens
cttgtaattctaaatg

SEQ ID NO: 1760140 - DNA, 16 bp, Homo sapiens
cttgtaatttttattt

SEQ ID NO: 1760141 - DNA, 13 bp, Homo sapiens
cttgtacaaaata

SEQ ID NO: 1760142 - DNA, 18 bp, Homo sapiens
cttgtacatttttaaatt

SEQ ID NO: 1760143 - DNA, 20 bp, Homo sapiens
cttgtacatttttaaattct

SEQ ID NO: 1760144 - DNA, 20 bp, Homo sapiens
cttgtaccatagaaaaatgt

SEQ ID NO: 1760145 - DNA, 17 bp, Homo sapiens
cttgtactatgttaata

SEQ ID NO: 1760146 - DNA, 13 bp, Homo sapiens
cttgtacttctgt

SEQ ID NO: 1760147 - DNA, 23 bp, Homo sapiens
cttgtactttatttttctgatag

SEQ ID NO: 1760148 - DNA, 15 bp, Homo sapiens
cttgtagtgtgtgct

SEQ ID NO: 1760149 - DNA, 18 bp, Homo sapiens
cttgtatatttgtacaaa

SEQ ID NO: 1760150 - DNA, 22 bp, Homo sapiens
cttgtattccttttagcagtag

SEQ ID NO: 1760151 - DNA, 14 bp, Homo sapiens
cttgtattgacttt

SEQ ID NO: 1760152 - DNA, 19 bp, Homo sapiens
cttgtattgactttatgtt

SEQ ID NO: 1760153 - DNA, 20 bp, Homo sapiens
cttgtatttaaatattaaat

SEQ ID NO: 1760154 - DNA, 16 bp, Homo sapiens
cttgtatttaattctt

SEQ ID NO: 1760155 - DNA, 15 bp, Homo sapiens
cttgtatttccaaac

SEQ ID NO: 1760156 - DNA, 19 bp, Homo sapiens
cttgtcaaagaaggtgctg

SEQ ID NO: 1760157 - DNA, 15 bp, Homo sapiens
cttgtcacaataaat

SEQ ID NO: 1760158 - DNA, 16 bp, Homo sapiens
cttgtcactagcagct

SEQ ID NO: 1760159 - DNA, 23 bp, Homo sapiens
cttgtcactggtagaccaaaata

SEQ ID NO: 1760160 - DNA, 19 bp, Homo sapiens
cttgtcatgtgtataaaaa

SEQ ID NO: 1760161 - DNA, 18 bp, Homo sapiens
cttgtccagcgcctagtg

SEQ ID NO: 1760162 - DNA, 22 bp, Homo sapiens
cttgtccagttcaaataagaaa

SEQ ID NO: 1760163 - DNA, 16 bp, Homo sapiens
cttgtcctatgtcaat

SEQ ID NO: 1760164 - DNA, 16 bp, Homo sapiens
cttgtcctcttctgct

SEQ ID NO: 1760165 - DNA, 22 bp, Homo sapiens
cttgtcctcttctgctcttttc

SEQ ID NO: 1760166 - DNA, 13 bp, Homo sapiens
cttgtcctgccag

SEQ ID NO: 1760167 - DNA, 17 bp, Homo sapiens
cttgtcctgccagctgc

SEQ ID NO: 1760168 - DNA, 22 bp, Homo sapiens
cttgtcctgccagctgccttcc

SEQ ID NO: 1760169 - DNA, 15 bp, Homo sapiens
cttgtcctgctctct

SEQ ID NO: 1760170 - DNA, 19 bp, Homo sapiens
cttgtcctgctctcttcag

SEQ ID NO: 1760171 - DNA, 21 bp, Homo sapiens
cttgtcctgctctcttcagga

SEQ ID NO: 1760172 - DNA, 22 bp, Homo sapiens
cttgtcctgctctcttcaggag

SEQ ID NO: 1760173 - DNA, 16 bp, Homo sapiens
cttgtcctggcccttc

SEQ ID NO: 1760174 - DNA, 20 bp, Homo sapiens
cttgtcctggcccttcagtc

SEQ ID NO: 1760175 - DNA, 23 bp, Homo sapiens
cttgtcctttatattttttgtct

SEQ ID NO: 1760176 - DNA, 14 bp, Homo sapiens
cttgtcctttccct

SEQ ID NO: 1760177 - DNA, 15 bp, Homo sapiens
cttgtcctttccctt

SEQ ID NO: 1760178 - DNA, 23 bp, Homo sapiens
cttgtctccactaaatgagctcc

SEQ ID NO: 1760179 - DNA, 13 bp, Homo sapiens
cttgtctctgggc

SEQ ID NO: 1760180 - DNA, 14 bp, Homo sapiens
cttgtctgaggcct

SEQ ID NO: 1760181 - DNA, 16 bp, Homo sapiens
cttgtctgaggcctca

SEQ ID NO: 1760182 - DNA, 19 bp, Homo sapiens
cttgtctgaggcctcatcc

SEQ ID NO: 1760183 - DNA, 20 bp, Homo sapiens
cttgtctgaggcctcatccc

SEQ ID NO: 1760184 - DNA, 21 bp, Homo sapiens
cttgtctgaggcctcatccct

SEQ ID NO: 1760185 - DNA, 22 bp, Homo sapiens
cttgtctgaggcctcatccctc

SEQ ID NO: 1760186 - DNA, 17 bp, Homo sapiens
cttgtctgtcaaatgtt

SEQ ID NO: 1760187 - DNA, 21 bp, Homo sapiens
cttgtcttctggtactttctg

SEQ ID NO: 1760188 - DNA, 23 bp, Homo sapiens
cttgtcttgtaattgtggattaa

SEQ ID NO: 1760189 - DNA, 16 bp, Homo sapiens
cttgtgaaacacagct

SEQ ID NO: 1760190 - DNA, 17 bp, Homo sapiens
cttgtgaaacacagctg

SEQ ID NO: 1760191 - DNA, 18 bp, Homo sapiens
cttgtgaaacacagctgt

SEQ ID NO: 1760192 - DNA, 14 bp, Homo sapiens
cttgtgacagtgcc

SEQ ID NO: 1760193 - DNA, 15 bp, Homo sapiens
cttgtgacagtgcct

SEQ ID NO: 1760194 - DNA, 15 bp, Homo sapiens
cttgtgacattaaaa

SEQ ID NO: 1760195 - DNA, 12 bp, Homo sapiens
cttgtgactttt

SEQ ID NO: 1760196 - DNA, 22 bp, Homo sapiens
cttgtgacttttgctttaattc

SEQ ID NO: 1760197 - DNA, 15 bp, Homo sapiens
cttgtgagagcccat

SEQ ID NO: 1760198 - DNA, 17 bp, Homo sapiens
cttgtgattatttatta

SEQ ID NO: 1760199 - DNA, 16 bp, Homo sapiens
cttgtgattggctgca

SEQ ID NO: 1760200 - DNA, 21 bp, Homo sapiens
cttgtgcaaaatatttgacta

SEQ ID NO: 1760201 - DNA, 17 bp, Homo sapiens
cttgtgcaattgtcttt

SEQ ID NO: 1760202 - DNA, 18 bp, Homo sapiens
cttgtgcaattgtctttt

SEQ ID NO: 1760203 - DNA, 11 bp, Homo sapiens
cttgtgccata

SEQ ID NO: 1760204 - DNA, 14 bp, Homo sapiens
cttgtgccctgccc

SEQ ID NO: 1760205 - DNA, 16 bp, Homo sapiens
cttgtgccctgccccc

SEQ ID NO: 1760206 - DNA, 17 bp, Homo sapiens
cttgtgccctgccccca

SEQ ID NO: 1760207 - DNA, 19 bp, Homo sapiens
cttgtgccctgcctccacc

SEQ ID NO: 1760208 - DNA, 17 bp, Homo sapiens
cttgtgctcacgctccc

SEQ ID NO: 1760209 - DNA, 18 bp, Homo sapiens
cttgtgcttggtggggct

SEQ ID NO: 1760210 - DNA, 17 bp, Homo sapiens
cttgtggactggctgtg

SEQ ID NO: 1760211 - DNA, 16 bp, Homo sapiens
cttgtggcagcaacgg

SEQ ID NO: 1760212 - DNA, 21 bp, Homo sapiens
cttgtgggaccagtcccacac

SEQ ID NO: 1760213 - DNA, 14 bp, Homo sapiens
cttgtgggagacag

SEQ ID NO: 1760214 - DNA, 17 bp, Homo sapiens
cttgtgggagacagcag

SEQ ID NO: 1760215 - DNA, 14 bp, Homo sapiens
cttgtggggccagg

SEQ ID NO: 1760216 - DNA, 21 bp, Homo sapiens
cttgtggtgtgaccatgttca

SEQ ID NO: 1760217 - DNA, 18 bp, Homo sapiens
cttgtggtgttcctgaag

SEQ ID NO: 1760218 - DNA, 15 bp, Homo sapiens
cttgtggttgaaatc

SEQ ID NO: 1760219 - DNA, 20 bp, Homo sapiens
cttgtgtaactaatttgtgg

SEQ ID NO: 1760220 - DNA, 21 bp, Homo sapiens
cttgtgtctctgtgcttttaa

SEQ ID NO: 1760221 - DNA, 15 bp, Homo sapiens
cttgtgtctgtacac

SEQ ID NO: 1760222 - DNA, 20 bp, Homo sapiens
cttgtgtgtcaggccctctg

SEQ ID NO: 1760223 - DNA, 22 bp, Homo sapiens
cttgtgtgtcaggccctctgcc

SEQ ID NO: 1760224 - DNA, 19 bp, Homo sapiens
cttgtgttaagtatgtgta

SEQ ID NO: 1760225 - DNA, 16 bp, Homo sapiens
cttgttaagatagtta

SEQ ID NO: 1760226 - DNA, 14 bp, Homo sapiens
cttgttaatgtcat

SEQ ID NO: 1760227 - DNA, 16 bp, Homo sapiens
cttgttccagctcttt

SEQ ID NO: 1760228 - DNA, 13 bp, Homo sapiens
cttgttgcagatg

SEQ ID NO: 1760229 - DNA, 13 bp, Homo sapiens
cttgttgcctgca

SEQ ID NO: 1760230 - DNA, 21 bp, Homo sapiens
cttgttgcctgcacccttccc

SEQ ID NO: 1760231 - DNA, 14 bp, Homo sapiens
cttgttggagcctg

SEQ ID NO: 1760232 - DNA, 20 bp, Homo sapiens
cttgttgggattcctgaccc

SEQ ID NO: 1760233 - DNA, 19 bp, Homo sapiens
ctttgctccgctcccaccg

SEQ ID NO: 1760234 - DNA, 21 bp, Homo sapiens
ctttgctccgctcccaccgcc

SEQ ID NO: 1760235 - DNA, 13 bp, Homo sapiens
ctttgctctggag

SEQ ID NO: 1760236 - DNA, 22 bp, Homo sapiens
ctttgctcttgtcggggtgggg

SEQ ID NO: 1760237 - DNA, 10 bp, Homo sapiens
ctttgctgct

SEQ ID NO: 1760238 - DNA, 13 bp, Homo sapiens
ctttgctgctaca

SEQ ID NO: 1760239 - DNA, 14 bp, Homo sapiens
ctttgctgtactct

SEQ ID NO: 1760240 - DNA, 19 bp, Homo sapiens
ctttgctgtactcttgctg

SEQ ID NO: 1760241 - DNA, 21 bp, Homo sapiens
ctttgctgtactcttgctgat

SEQ ID NO: 1760242 - DNA, 23 bp, Homo sapiens
ctttgcttatgaatatttataac

SEQ ID NO: 1760243 - DNA, 18 bp, Homo sapiens
ctttgcttccgccactca

SEQ ID NO: 1760244 - DNA, 17 bp, Homo sapiens
ctttgctttctgaattg

SEQ ID NO: 1760245 - DNA, 22 bp, Homo sapiens
ctttgctttctgaattggaagg

SEQ ID NO: 1760246 - DNA, 17 bp, Homo sapiens
ctttggaaacaggacca

SEQ ID NO: 1760247 - DNA, 20 bp, Homo sapiens
ctttggaaagttactgtaaa

SEQ ID NO: 1760248 - DNA, 21 bp, Homo sapiens
ctttggaaagttactgtaaat

SEQ ID NO: 1760249 - DNA, 17 bp, Homo sapiens
ctttggaacaagacagc

SEQ ID NO: 1760250 - DNA, 21 bp, Homo sapiens
ctttggaacaagacagccttc

SEQ ID NO: 1760251 - DNA, 13 bp, Homo sapiens
ctttggaagcagc

SEQ ID NO: 1760252 - DNA, 14 bp, Homo sapiens
ctttggaagcagcc

SEQ ID NO: 1760253 - DNA, 21 bp, Homo sapiens
ctttggacctaaatggcctca

SEQ ID NO: 1760254 - DNA, 16 bp, Homo sapiens
ctttggacctaatcca

SEQ ID NO: 1760255 - DNA, 18 bp, Homo sapiens
ctttggagatgctgaggg

SEQ ID NO: 1760256 - DNA, 22 bp, Homo sapiens
ctttggagtcccctcacctcct

SEQ ID NO: 1760257 - DNA, 23 bp, Homo sapiens
ctttggatgattttttaagcaga

SEQ ID NO: 1760258 - DNA, 21 bp, Homo sapiens
ctttggattctaaatacatgc

SEQ ID NO: 1760259 - DNA, 17 bp, Homo sapiens
ctttggcaatttcctgg

SEQ ID NO: 1760260 - DNA, 12 bp, Homo sapiens
ctttggcactgg

SEQ ID NO: 1760261 - DNA, 17 bp, Homo sapiens
ctttggcactggggcac

SEQ ID NO: 1760262 - DNA, 21 bp, Homo sapiens
ctttggccccactttgaaggg

SEQ ID NO: 1760263 - DNA, 24 bp, Homo sapiens
ctttggcctggggtgcatctcctc

SEQ ID NO: 1760264 - DNA, 18 bp, Homo sapiens
ctttggctgcaggtgttc

SEQ ID NO: 1760265 - DNA, 24 bp, Homo sapiens
ctttggcttaaagcatcctcctcc

SEQ ID NO: 1760266 - DNA, 16 bp, Homo sapiens
ctttggcttctcctgt

SEQ ID NO: 1760267 - DNA, 14 bp, Homo sapiens
ctttgggaaaacat

SEQ ID NO: 1760268 - DNA, 19 bp, Homo sapiens
ctttgggaacactggcctg

SEQ ID NO: 1760269 - DNA, 14 bp, Homo sapiens
ctttgggaggcagg

SEQ ID NO: 1760270 - DNA, 15 bp, Homo sapiens
ctttgggaggcaggg

SEQ ID NO: 1760271 - DNA, 20 bp, Homo sapiens
ctttgggaggccgaggcggg

SEQ ID NO: 1760272 - DNA, 17 bp, Homo sapiens
ctttgggaggctgaggc

SEQ ID NO: 1760273 - DNA, 14 bp, Homo sapiens
ctttgggctgccct

SEQ ID NO: 1760274 - DNA, 19 bp, Homo sapiens
ctttgggctgccctggtgc

SEQ ID NO: 1760275 - DNA, 23 bp, Homo sapiens
ctttgggctttgcaggctctggg

SEQ ID NO: 1760276 - DNA, 24 bp, Homo sapiens
ctttggggacagttggcagagaag

SEQ ID NO: 1760277 - DNA, 20 bp, Homo sapiens
ctttgggtcctgggcaggtg

SEQ ID NO: 1760278 - DNA, 14 bp, Homo sapiens
ctttgggtggctca

SEQ ID NO: 1760279 - DNA, 20 bp, Homo sapiens
ctttgggtggctcactactg

SEQ ID NO: 1760280 - DNA, 23 bp, Homo sapiens
ctttgggtggctcactactgaac

SEQ ID NO: 1760281 - DNA, 17 bp, Homo sapiens
ctttgggtttcttgttt

SEQ ID NO: 1760282 - DNA, 15 bp, Homo sapiens
ctttggtaggtaaat

SEQ ID NO: 1760283 - DNA, 17 bp, Homo sapiens
ctttggtaggtaaatct

SEQ ID NO: 1760284 - DNA, 16 bp, Homo sapiens
ctttggtgaactgttg

SEQ ID NO: 1760285 - DNA, 22 bp, Homo sapiens
ctttggtgcagaggtttcttga

SEQ ID NO: 1760286 - DNA, 14 bp, Homo sapiens
ctttggttaaaaat

SEQ ID NO: 1760287 - DNA, 21 bp, Homo sapiens
ctttggttatttcagccccca

SEQ ID NO: 1760288 - DNA, 19 bp, Homo sapiens
ctttggttccttctctggg

SEQ ID NO: 1760289 - DNA, 20 bp, Homo sapiens
ctttggttccttctctgggt

SEQ ID NO: 1760290 - DNA, 15 bp, Homo sapiens
ctttggttctaagga

SEQ ID NO: 1760291 - DNA, 16 bp, Homo sapiens
ctttggttctaaggac

SEQ ID NO: 1760292 - DNA, 21 bp, Homo sapiens
ctttggttctggccagaatgc

SEQ ID NO: 1760293 - DNA, 16 bp, Homo sapiens
ctttggtttctgtctg

SEQ ID NO: 1760294 - DNA, 13 bp, Homo sapiens
ctttggtttgaca

SEQ ID NO: 1760295 - DNA, 19 bp, Homo sapiens
ctttggttttgctgagatc

SEQ ID NO: 1760296 - DNA, 11 bp, Homo sapiens
ctttggttttt

SEQ ID NO: 1760297 - DNA, 23 bp, Homo sapiens
ctttgtaaatgcatattaaataa

SEQ ID NO: 1760298 - DNA, 21 bp, Homo sapiens
ctttgtaagacatttgtatat

SEQ ID NO: 1760299 - DNA, 19 bp, Homo sapiens
ctttgtatataggcttctc

SEQ ID NO: 1760300 - DNA, 22 bp, Homo sapiens
ctttgtatctttctttctctaa

SEQ ID NO: 1760301 - DNA, 20 bp, Homo sapiens
ctttgtcaccacgtggggct

SEQ ID NO: 1760302 - DNA, 17 bp, Homo sapiens
ctttgtcttttcaatct

SEQ ID NO: 1760303 - DNA, 14 bp, Homo sapiens
ctttgtgattccat

SEQ ID NO: 1760304 - DNA, 13 bp, Homo sapiens
ctttgtgcattct

SEQ ID NO: 1760305 - DNA, 14 bp, Homo sapiens
ctttgtgcattctg

SEQ ID NO: 1760306 - DNA, 13 bp, Homo sapiens
ctttgtgcctttg

SEQ ID NO: 1760307 - DNA, 17 bp, Homo sapiens
ctttgtgcctttggcct

SEQ ID NO: 1760308 - DNA, 21 bp, Homo sapiens
ctttgtgcttgtcattccaga

SEQ ID NO: 1760309 - DNA, 22 bp, Homo sapiens
ctttgtggcagtggccaggcag

SEQ ID NO: 1760310 - DNA, 16 bp, Homo sapiens
ctttgtggggaagagg

SEQ ID NO: 1760311 - DNA, 16 bp, Homo sapiens
ctttgtgtagctttgc

SEQ ID NO: 1760312 - DNA, 18 bp, Homo sapiens
ctttgtgtagctttgctc

SEQ ID NO: 1760313 - DNA, 15 bp, Homo sapiens
ctttgtgtgattgaa

SEQ ID NO: 1760314 - DNA, 14 bp, Homo sapiens
ctttgtgttcattt

SEQ ID NO: 1760315 - DNA, 17 bp, Homo sapiens
ctttgtgttcatttcat

SEQ ID NO: 1760316 - DNA, 14 bp, Homo sapiens
ctttgtgtttctat

SEQ ID NO: 1760317 - DNA, 22 bp, Homo sapiens
ctttgttatttttgtttcttcc

SEQ ID NO: 1760318 - DNA, 18 bp, Homo sapiens
ctttgttctaaagatgga

SEQ ID NO: 1760319 - DNA, 22 bp, Homo sapiens
ctttgttgaactgttagaatgt

SEQ ID NO: 1760320 - DNA, 21 bp, Homo sapiens
ctttgttgcaagtactgctgt

SEQ ID NO: 1760321 - DNA, 18 bp, Homo sapiens
ctttgttgtctacattaa

SEQ ID NO: 1760322 - DNA, 23 bp, Homo sapiens
ctttgttgtctccctctttctca

SEQ ID NO: 1760323 - DNA, 15 bp, Homo sapiens
ctttgtttaataaag

SEQ ID NO: 1760324 - DNA, 19 bp, Homo sapiens
ctttgtttctttttacagc

SEQ ID NO: 1760325 - DNA, 21 bp, Homo sapiens
ctttgtttgttcttgttttta

SEQ ID NO: 1760326 - DNA, 11 bp, Homo sapiens
ctttgttttat

SEQ ID NO: 1760327 - DNA, 19 bp, Homo sapiens
ctttgttttgatgtttgtg

SEQ ID NO: 1760328 - DNA, 23 bp, Homo sapiens
ctttgttttgatgtttgtggcct

SEQ ID NO: 1760329 - DNA, 13 bp, Homo sapiens
ctttgtttttccg

SEQ ID NO: 1760330 - DNA, 22 bp, Homo sapiens
cttttaaaaaatactctgctat

SEQ ID NO: 1760331 - DNA, 16 bp, Homo sapiens
cttttaaaaatgtttg

SEQ ID NO: 1760332 - DNA, 15 bp, Homo sapiens
cttttaaacaggcaa

SEQ ID NO: 1760333 - DNA, 12 bp, Homo sapiens
cttttaaagacc

SEQ ID NO: 1760334 - DNA, 19 bp, Homo sapiens
cttttaaagactacctggg

SEQ ID NO: 1760335 - DNA, 22 bp, Homo sapiens
cttttaaaggggcagaaaaact

SEQ ID NO: 1760336 - DNA, 23 bp, Homo sapiens
cttttaaaggggcagaaaaactc

SEQ ID NO: 1760337 - DNA, 13 bp, Homo sapiens
cttttaaagtgtt

SEQ ID NO: 1760338 - DNA, 14 bp, Homo sapiens
cttttaagaaacac

SEQ ID NO: 1760339 - DNA, 17 bp, Homo sapiens
cttttaagatcttgtta

SEQ ID NO: 1760340 - DNA, 18 bp, Homo sapiens
cttttaaggataaatcat

SEQ ID NO: 1760341 - DNA, 15 bp, Homo sapiens
cttttaatgcttcat

SEQ ID NO: 1760342 - DNA, 17 bp, Homo sapiens
cttttaatgcttcattc

SEQ ID NO: 1760343 - DNA, 23 bp, Homo sapiens
cttttaatggcatttctctttaa

SEQ ID NO: 1760344 - DNA, 23 bp, Homo sapiens
cttttaattaatgaaatatctgt

SEQ ID NO: 1760345 - DNA, 15 bp, Homo sapiens
cttttaattctcatt

SEQ ID NO: 1760346 - DNA, 22 bp, Homo sapiens
cttttaattgaaattaactttt

SEQ ID NO: 1760347 - DNA, 20 bp, Homo sapiens
gaaaaaaatactatttaaga

SEQ ID NO: 1760348 - DNA, 13 bp, Homo sapiens
gaaaaaaatgact

SEQ ID NO: 1760349 - DNA, 16 bp, Homo sapiens
gaaaaaaatgactaaa

SEQ ID NO: 1760350 - DNA, 19 bp, Homo sapiens
gaaaaaaattacaaggcaa

SEQ ID NO: 1760351 - DNA, 14 bp, Homo sapiens
gaaaaaaattgaaa

SEQ ID NO: 1760352 - DNA, 11 bp, Homo sapiens
gaaaaaatata

SEQ ID NO: 1760353 - DNA, 21 bp, Homo sapiens
gaaaaaatatatgtatataca

SEQ ID NO: 1760354 - DNA, 19 bp, Homo sapiens
gaaaaaatgatgttcattt

SEQ ID NO: 1760355 - DNA, 16 bp, Homo sapiens
gaaaaaatggtataaa

SEQ ID NO: 1760356 - DNA, 16 bp, Homo sapiens
gaaaaacaacatcatt

SEQ ID NO: 1760357 - DNA, 13 bp, Homo sapiens
gaaaaacaatctt

SEQ ID NO: 1760358 - DNA, 17 bp, Homo sapiens
gaaaaacaattttctgt

SEQ ID NO: 1760359 - DNA, 15 bp, Homo sapiens
gaaaaacacaagcaa

SEQ ID NO: 1760360 - DNA, 23 bp, Homo sapiens
gaaaaacaccgcttctgcctttt

SEQ ID NO: 1760361 - DNA, 20 bp, Homo sapiens
gaaaaagagcatatactggt

SEQ ID NO: 1760362 - DNA, 18 bp, Homo sapiens
gaaaaagcatgatgggaa

SEQ ID NO: 1760363 - DNA, 13 bp, Homo sapiens
gaaaaaggaaata

SEQ ID NO: 1760364 - DNA, 18 bp, Homo sapiens
gaaaaaggctgaaaagaa

SEQ ID NO: 1760365 - DNA, 14 bp, Homo sapiens
gaaaaagtttgttt

SEQ ID NO: 1760366 - DNA, 15 bp, Homo sapiens
gaaaaataaaatgtt

SEQ ID NO: 1760367 - DNA, 16 bp, Homo sapiens
gaaaaataaaatgttt

SEQ ID NO: 1760368 - DNA, 22 bp, Homo sapiens
gaaaaataaagacacctggttg

SEQ ID NO: 1760369 - DNA, 21 bp, Homo sapiens
gaaaaatataatgttgataat

SEQ ID NO: 1760370 - DNA, 10 bp, Homo sapiens
gaaaaatatt

SEQ ID NO: 1760371 - DNA, 16 bp, Homo sapiens
gaaaaatatttaatgt

SEQ ID NO: 1760372 - DNA, 20 bp, Homo sapiens
gaaaaatatttaatgttgaa

SEQ ID NO: 1760373 - DNA, 20 bp, Homo sapiens
gaaaaatcaagtattataaa

SEQ ID NO: 1760374 - DNA, 18 bp, Homo sapiens
gaaaaatccagaaagaaa

SEQ ID NO: 1760375 - DNA, 17 bp, Homo sapiens
gaaaaatctcaattgaa

SEQ ID NO: 1760376 - DNA, 18 bp, Homo sapiens
gaaaaatctcaattgaaa

SEQ ID NO: 1760377 - DNA, 20 bp, Homo sapiens
gaaaaatgcccttaaatcat

SEQ ID NO: 1760378 - DNA, 15 bp, Homo sapiens
gaaaaatgggaaata

SEQ ID NO: 1760379 - DNA, 12 bp, Homo sapiens
gaaaaatgggag

SEQ ID NO: 1760380 - DNA, 23 bp, Homo sapiens
gaaaaatggttgatggaaaataa

SEQ ID NO: 1760381 - DNA, 15 bp, Homo sapiens
gaaaaatgtataaaa

SEQ ID NO: 1760382 - DNA, 14 bp, Homo sapiens
gaaaaattaacttt

SEQ ID NO: 1760383 - DNA, 15 bp, Homo sapiens
gaaaaattaactttt

SEQ ID NO: 1760384 - DNA, 12 bp, Homo sapiens
gaaaaattatag

SEQ ID NO: 1760385 - DNA, 19 bp, Homo sapiens
gaaaacaaaattttatttt

SEQ ID NO: 1760386 - DNA, 17 bp, Homo sapiens
gaaaacaaagttctatt

SEQ ID NO: 1760387 - DNA, 22 bp, Homo sapiens
gaaaacaccatggagatgaaat

SEQ ID NO: 1760388 - DNA, 16 bp, Homo sapiens
gaaaacagaacactta

SEQ ID NO: 1760389 - DNA, 14 bp, Homo sapiens
gaaaacagggtctg

SEQ ID NO: 1760390 - DNA, 18 bp, Homo sapiens
gaaaacagggtctgggac

SEQ ID NO: 1760391 - DNA, 14 bp, Homo sapiens
gaaaacagtacaga

SEQ ID NO: 1760392 - DNA, 14 bp, Homo sapiens
gaaaacatgttaat

SEQ ID NO: 1760393 - DNA, 19 bp, Homo sapiens
gaaaaccaagccgtggctt

SEQ ID NO: 1760394 - DNA, 21 bp, Homo sapiens
gaaaaccaagccgtggcttcc

SEQ ID NO: 1760395 - DNA, 13 bp, Homo sapiens
gaaaaccacagtc

SEQ ID NO: 1760396 - DNA, 15 bp, Homo sapiens
gaaaaccacagtcag

SEQ ID NO: 1760397 - DNA, 22 bp, Homo sapiens
gaaaacccagagaggaatcaga

SEQ ID NO: 1760398 - DNA, 14 bp, Homo sapiens
gaaaaccccagcat

SEQ ID NO: 1760399 - DNA, 13 bp, Homo sapiens
gaaaacccctccc

SEQ ID NO: 1760400 - DNA, 17 bp, Homo sapiens
gaaaacccttgggccag

SEQ ID NO: 1760401 - DNA, 20 bp, Homo sapiens
gaaaacccttgggccagaag

SEQ ID NO: 1760402 - DNA, 21 bp, Homo sapiens
gaaaacccttgggccagaagt

SEQ ID NO: 1760403 - DNA, 22 bp, Homo sapiens
gaaaacccttgggccagaagta

SEQ ID NO: 1760404 - DNA, 21 bp, Homo sapiens
gaaaacctaagtcctttatgt

SEQ ID NO: 1760405 - DNA, 17 bp, Homo sapiens
gaaaacctctcctgacc

SEQ ID NO: 1760406 - DNA, 13 bp, Homo sapiens
gaaaacggagctg

SEQ ID NO: 1760407 - DNA, 14 bp, Homo sapiens
gaaaacggagctga

SEQ ID NO: 1760408 - DNA, 22 bp, Homo sapiens
gaaaactagcattacattatta

SEQ ID NO: 1760409 - DNA, 13 bp, Homo sapiens
gaaaactgtaaat

SEQ ID NO: 1760410 - DNA, 13 bp, Homo sapiens
gaaaacttagcca

SEQ ID NO: 1760411 - DNA, 17 bp, Homo sapiens
gaaaacttagccagagt

SEQ ID NO: 1760412 - DNA, 15 bp, Homo sapiens
gaaaagaaaacaaaa

SEQ ID NO: 1760413 - DNA, 16 bp, Homo sapiens
gaaaagaaagaaacca

SEQ ID NO: 1760414 - DNA, 14 bp, Homo sapiens
gaaaagaagaaact

SEQ ID NO: 1760415 - DNA, 19 bp, Homo sapiens
gaaaagaatacagaaagat

SEQ ID NO: 1760416 - DNA, 16 bp, Homo sapiens
gaaaagaccagggctt

SEQ ID NO: 1760417 - DNA, 16 bp, Homo sapiens
gaaaagaccctgagac

SEQ ID NO: 1760418 - DNA, 14 bp, Homo sapiens
gaaaagactccaaa

SEQ ID NO: 1760419 - DNA, 16 bp, Homo sapiens
gaaaagactccaaaga

SEQ ID NO: 1760420 - DNA, 20 bp, Homo sapiens
gaaaagactccaaagaaatg

SEQ ID NO: 1760421 - DNA, 16 bp, Homo sapiens
gaaaagatccccaaga

SEQ ID NO: 1760422 - DNA, 14 bp, Homo sapiens
gaaaagattttaac

SEQ ID NO: 1760423 - DNA, 18 bp, Homo sapiens
gaaaagcacacacaataa

SEQ ID NO: 1760424 - DNA, 14 bp, Homo sapiens
gaaaagcacctgcc

SEQ ID NO: 1760425 - DNA, 18 bp, Homo sapiens
gaaaagccaaaggtcaaa

SEQ ID NO: 1760426 - DNA, 23 bp, Homo sapiens
gaaaagcccccagttaatactcc

SEQ ID NO: 1760427 - DNA, 18 bp, Homo sapiens
gaaaagcctgaactattt

SEQ ID NO: 1760428 - DNA, 24 bp, Homo sapiens
gaaaagctagtgtacctcctctca

SEQ ID NO: 1760429 - DNA, 12 bp, Homo sapiens
gaaaaggaaaaa

SEQ ID NO: 1760430 - DNA, 13 bp, Homo sapiens
gaaaaggaagact

SEQ ID NO: 1760431 - DNA, 20 bp, Homo sapiens
gaaaaggaagactagaggct

SEQ ID NO: 1760432 - DNA, 14 bp, Homo sapiens
gaaaaggatctaag

SEQ ID NO: 1760433 - DNA, 20 bp, Homo sapiens
gaaaaggctggagagagatt

SEQ ID NO: 1760434 - DNA, 19 bp, Homo sapiens
gaaaagggcggaagagtta

SEQ ID NO: 1760435 - DNA, 18 bp, Homo sapiens
gaaaaggtgataaaatca

SEQ ID NO: 1760436 - DNA, 16 bp, Homo sapiens
gaaaagtacatttaat

SEQ ID NO: 1760437 - DNA, 16 bp, Homo sapiens
gaaaagtgaattgaag

SEQ ID NO: 1760438 - DNA, 19 bp, Homo sapiens
gaaaagtgcatatttatcc

SEQ ID NO: 1760439 - DNA, 11 bp, Homo sapiens
gaaaagtgcct

SEQ ID NO: 1760440 - DNA, 19 bp, Homo sapiens
gaaaagtgcctgagctggg

SEQ ID NO: 1760441 - DNA, 15 bp, Homo sapiens
gaaaagttaaactaa

SEQ ID NO: 1760442 - DNA, 16 bp, Homo sapiens
gaaaagttggaaggat

SEQ ID NO: 1760443 - DNA, 14 bp, Homo sapiens
gaaaagttgtctta

SEQ ID NO: 1760444 - DNA, 18 bp, Homo sapiens
gaaaataaaaagagaaac

SEQ ID NO: 1760445 - DNA, 15 bp, Homo sapiens
gaaaataaaactaag

SEQ ID NO: 1760446 - DNA, 19 bp, Homo sapiens
gaaaataaaatattcactc

SEQ ID NO: 1760447 - DNA, 21 bp, Homo sapiens
gaaaataaggcacccatctgt

SEQ ID NO: 1760448 - DNA, 15 bp, Homo sapiens
gaaaatacaataaac

SEQ ID NO: 1760449 - DNA, 16 bp, Homo sapiens
gaaaatacaataaact

SEQ ID NO: 1760450 - DNA, 15 bp, Homo sapiens
gaaaatacttaaatg

SEQ ID NO: 1760451 - DNA, 13 bp, Homo sapiens
gaaaatagattag

SEQ ID NO: 1760452 - DNA, 22 bp, Homo sapiens
gaaaatatctgctcaaaacttt

SEQ ID NO: 1760453 - DNA, 14 bp, Homo sapiens
gaaaatcaaataca

SEQ ID NO: 1760454 - DNA, 11 bp, Homo sapiens
gaaaatcagca

SEQ ID NO: 1760455 - DNA, 21 bp, Homo sapiens
gaaaatcatcaagaagggctg

SEQ ID NO: 1760456 - DNA, 23 bp, Homo sapiens
gaaaatcatcaagaagggctgca

SEQ ID NO: 1760457 - DNA, 22 bp, Homo sapiens
gaaaatgaatatctattaatat

SEQ ID NO: 1760458 - DNA, 17 bp, Homo sapiens
gaaaatgacttatttct

SEQ ID NO: 1760459 - DNA, 20 bp, Homo sapiens
gaaaatgagaaaggacagag

SEQ ID NO: 1760460 - DNA, 20 bp, Homo sapiens
gaaaatgagtatttggtcca

SEQ ID NO: 1760461 - DNA, 16 bp, Homo sapiens
gaaaatgatctgagtc

SEQ ID NO: 1760462 - DNA, 18 bp, Homo sapiens
gaaatcaaccctctcctg

SEQ ID NO: 1760463 - DNA, 15 bp, Homo sapiens
gaaatcacagaatca

SEQ ID NO: 1760464 - DNA, 20 bp, Homo sapiens
gaaatcactttacctgcagg

SEQ ID NO: 1760465 - DNA, 19 bp, Homo sapiens
gaaatcagttgtgaataca

SEQ ID NO: 1760466 - DNA, 21 bp, Homo sapiens
gaaatcagttgtgaatacatt

SEQ ID NO: 1760467 - DNA, 15 bp, Homo sapiens
gaaatcattgtagaa

SEQ ID NO: 1760468 - DNA, 20 bp, Homo sapiens
gaaatccataaactaagaga

SEQ ID NO: 1760469 - DNA, 14 bp, Homo sapiens
gaaatccattcaca

SEQ ID NO: 1760470 - DNA, 18 bp, Homo sapiens
gaaatcgagagtgtgctc

SEQ ID NO: 1760471 - DNA, 20 bp, Homo sapiens
gaaatctactgaattggctt

SEQ ID NO: 1760472 - DNA, 22 bp, Homo sapiens
gaaatctactgaattggcttcc

SEQ ID NO: 1760473 - DNA, 20 bp, Homo sapiens
gaaatctcctaacaaaagaa

SEQ ID NO: 1760474 - DNA, 20 bp, Homo sapiens
gaaatctcctttagccatca

SEQ ID NO: 1760475 - DNA, 13 bp, Homo sapiens
gaaatctggccca

SEQ ID NO: 1760476 - DNA, 19 bp, Homo sapiens
gaaatctgggatgtactgt

SEQ ID NO: 1760477 - DNA, 12 bp, Homo sapiens
gaaatgaaaggg

SEQ ID NO: 1760478 - DNA, 13 bp, Homo sapiens
gaaatgaaaggga

SEQ ID NO: 1760479 - DNA, 20 bp, Homo sapiens
gaaatgcattattttgaatg

SEQ ID NO: 1760480 - DNA, 19 bp, Homo sapiens
gaaatgcattttattcttt

SEQ ID NO: 1760481 - DNA, 21 bp, Homo sapiens
gaaatgcattttattctttaa

SEQ ID NO: 1760482 - DNA, 15 bp, Homo sapiens
gaaatgctaatgtaa

SEQ ID NO: 1760483 - DNA, 20 bp, Homo sapiens
gaaatgctattgttgtgggc

SEQ ID NO: 1760484 - DNA, 15 bp, Homo sapiens
gaaatgctgctggcc

SEQ ID NO: 1760485 - DNA, 16 bp, Homo sapiens
gaaatgctgctggcca

SEQ ID NO: 1760486 - DNA, 17 bp, Homo sapiens
gaaatgctgctggccaa

SEQ ID NO: 1760487 - DNA, 14 bp, Homo sapiens
gaaatggaaatttt

SEQ ID NO: 1760488 - DNA, 15 bp, Homo sapiens
gaaatggagaagctc

SEQ ID NO: 1760489 - DNA, 18 bp, Homo sapiens
gaaatggcgtctgctctg

SEQ ID NO: 1760490 - DNA, 22 bp, Homo sapiens
gaaatggcgtctgctctggtgg

SEQ ID NO: 1760491 - DNA, 24 bp, Homo sapiens
gaaatggcgtctgctctggtggct

SEQ ID NO: 1760492 - DNA, 15 bp, Homo sapiens
gaaatggcttttctt

SEQ ID NO: 1760493 - DNA, 18 bp, Homo sapiens
gaaatgggagatggtcag

SEQ ID NO: 1760494 - DNA, 16 bp, Homo sapiens
gaaatgtaccttcttt

SEQ ID NO: 1760495 - DNA, 22 bp, Homo sapiens
gaaatgtaggcatcatgcatgt

SEQ ID NO: 1760496 - DNA, 18 bp, Homo sapiens
gaaatgtaggtcctcaga

SEQ ID NO: 1760497 - DNA, 16 bp, Homo sapiens
gaaatgtatcctgata

SEQ ID NO: 1760498 - DNA, 15 bp, Homo sapiens
gaaatgtcataaatt

SEQ ID NO: 1760499 - DNA, 20 bp, Homo sapiens
gaaatgtcataaattactgt

SEQ ID NO: 1760500 - DNA, 14 bp, Homo sapiens
gaaatgtctgctgg

SEQ ID NO: 1760501 - DNA, 19 bp, Homo sapiens
gaaatgtgaatttttattg

SEQ ID NO: 1760502 - DNA, 18 bp, Homo sapiens
gaaatgttcacaaggtac

SEQ ID NO: 1760503 - DNA, 16 bp, Homo sapiens
gaaatgtttgctgaac

SEQ ID NO: 1760504 - DNA, 15 bp, Homo sapiens
gaaattagatttgtg

SEQ ID NO: 1760505 - DNA, 18 bp, Homo sapiens
gaaattatgtatgtttac

SEQ ID NO: 1760506 - DNA, 19 bp, Homo sapiens
gaaattcagaacagcctgc

SEQ ID NO: 1760507 - DNA, 13 bp, Homo sapiens
gaaattcaggtac

SEQ ID NO: 1760508 - DNA, 20 bp, Homo sapiens
gaaattcgaaaacataaaga

SEQ ID NO: 1760509 - DNA, 15 bp, Homo sapiens
gaaattctccaggat

SEQ ID NO: 1760510 - DNA, 16 bp, Homo sapiens
gaaattctcctggagg

SEQ ID NO: 1760511 - DNA, 12 bp, Homo sapiens
gaaattctgaaa

SEQ ID NO: 1760512 - DNA, 14 bp, Homo sapiens
gaaattctgaaaac

SEQ ID NO: 1760513 - DNA, 16 bp, Homo sapiens
gaaattctggcccagc

SEQ ID NO: 1760514 - DNA, 12 bp, Homo sapiens
gaaattctgttt

SEQ ID NO: 1760515 - DNA, 14 bp, Homo sapiens
gaaattctgttttt

SEQ ID NO: 1760516 - DNA, 15 bp, Homo sapiens
gaaattctgttttta

SEQ ID NO: 1760517 - DNA, 23 bp, Homo sapiens
gaaattgagctgctttttttgaa

SEQ ID NO: 1760518 - DNA, 22 bp, Homo sapiens
gaaattgattaaggctttcttt

SEQ ID NO: 1760519 - DNA, 14 bp, Homo sapiens
gaaattggctggat

SEQ ID NO: 1760520 - DNA, 15 bp, Homo sapiens
gaaattggctggatg

SEQ ID NO: 1760521 - DNA, 17 bp, Homo sapiens
gaaattgggtgaagagc

SEQ ID NO: 1760522 - DNA, 20 bp, Homo sapiens
gaaattgtctagcagagcag

SEQ ID NO: 1760523 - DNA, 12 bp, Homo sapiens
gaaattgtttat

SEQ ID NO: 1760524 - DNA, 23 bp, Homo sapiens
gaaatttaattcatgtttcttaa

SEQ ID NO: 1760525 - DNA, 17 bp, Homo sapiens
gaaatttgttataatga

SEQ ID NO: 1760526 - DNA, 15 bp, Homo sapiens
gaaattttatatgct

SEQ ID NO: 1760527 - DNA, 19 bp, Homo sapiens
gaaattttatatgcttact

SEQ ID NO: 1760528 - DNA, 21 bp, Homo sapiens
gaaattttcaagagtctaata

SEQ ID NO: 1760529 - DNA, 17 bp, Homo sapiens
gaaattttgtaagaagg

SEQ ID NO: 1760530 - DNA, 19 bp, Homo sapiens
gaaattttgtaagaaggca

SEQ ID NO: 1760531 - DNA, 15 bp, Homo sapiens
gaacaaaacctacac

SEQ ID NO: 1760532 - DNA, 14 bp, Homo sapiens
gaacaaaataaatt

SEQ ID NO: 1760533 - DNA, 20 bp, Homo sapiens
gaacaaatgtgtttttctat

SEQ ID NO: 1760534 - DNA, 16 bp, Homo sapiens
gaacaaattctttagt

SEQ ID NO: 1760535 - DNA, 15 bp, Homo sapiens
gaacaactactgtga

SEQ ID NO: 1760536 - DNA, 15 bp, Homo sapiens
gaacaacttgtagca

SEQ ID NO: 1760537 - DNA, 15 bp, Homo sapiens
gaacaagacagcctt

SEQ ID NO: 1760538 - DNA, 17 bp, Homo sapiens
gaacaagcatgtctctc

SEQ ID NO: 1760539 - DNA, 18 bp, Homo sapiens
gaacaagtcacagctgca

SEQ ID NO: 1760540 - DNA, 21 bp, Homo sapiens
gaacaagttgtttcattgact

SEQ ID NO: 1760541 - DNA, 17 bp, Homo sapiens
gaacaataatgagagca

SEQ ID NO: 1760542 - DNA, 17 bp, Homo sapiens
gaacaataggtaaagct

SEQ ID NO: 1760543 - DNA, 16 bp, Homo sapiens
gaacacaaaacttgaa

SEQ ID NO: 1760544 - DNA, 14 bp, Homo sapiens
gaacacaaatttat

SEQ ID NO: 1760545 - DNA, 18 bp, Homo sapiens
gaacacaagggatataaa

SEQ ID NO: 1760546 - DNA, 23 bp, Homo sapiens
gaacacacacgctccctggaagc

SEQ ID NO: 1760547 - DNA, 12 bp, Homo sapiens
gaacacagtgtc

SEQ ID NO: 1760548 - DNA, 18 bp, Homo sapiens
gaacacagttgaattttt

SEQ ID NO: 1760549 - DNA, 15 bp, Homo sapiens
gaacacattttaaat

SEQ ID NO: 1760550 - DNA, 20 bp, Homo sapiens
gaacaccattgaaggcttaa

SEQ ID NO: 1760551 - DNA, 21 bp, Homo sapiens
gaacacccgactcctcaaaag

SEQ ID NO: 1760552 - DNA, 16 bp, Homo sapiens
gaacaccctatatttt

SEQ ID NO: 1760553 - DNA, 18 bp, Homo sapiens
gaacacctatgcaaagat

SEQ ID NO: 1760554 - DNA, 15 bp, Homo sapiens
gaacacgattttcaa

SEQ ID NO: 1760555 - DNA, 20 bp, Homo sapiens
gaacacggagtggccgggcc

SEQ ID NO: 1760556 - DNA, 18 bp, Homo sapiens
gaacactaattcataatc

SEQ ID NO: 1760557 - DNA, 21 bp, Homo sapiens
gaacactactgctaaatcctc

SEQ ID NO: 1760558 - DNA, 22 bp, Homo sapiens
gaacactcatgtctggagtccc

SEQ ID NO: 1760559 - DNA, 13 bp, Homo sapiens
gaacactggacct

SEQ ID NO: 1760560 - DNA, 12 bp, Homo sapiens
gaacactgtgac

SEQ ID NO: 1760561 - DNA, 18 bp, Homo sapiens
gaacactgtgaccaggct

SEQ ID NO: 1760562 - DNA, 15 bp, Homo sapiens
gaacacttttaataa

SEQ ID NO: 1760563 - DNA, 21 bp, Homo sapiens
gaacagaaaacaaaagagaga

SEQ ID NO: 1760564 - DNA, 12 bp, Homo sapiens
gaacagaaggat

SEQ ID NO: 1760565 - DNA, 12 bp, Homo sapiens
gaacagaatgtt

SEQ ID NO: 1760566 - DNA, 17 bp, Homo sapiens
gaacagacaacagaagt

SEQ ID NO: 1760567 - DNA, 19 bp, Homo sapiens
gaacagacaacagaagtca

SEQ ID NO: 1760568 - DNA, 18 bp, Homo sapiens
gaacagataatcagtgtg

SEQ ID NO: 1760569 - DNA, 22 bp, Homo sapiens
gaacagatggggtctgtgactg

SEQ ID NO: 1760570 - DNA, 16 bp, Homo sapiens
gaacagccctcggcct

SEQ ID NO: 1760571 - DNA, 14 bp, Homo sapiens
gaacagcgggagac

SEQ ID NO: 1760572 - DNA, 16 bp, Homo sapiens
gaacagcgggagacct

SEQ ID NO: 1760573 - DNA, 21 bp, Homo sapiens
gaacagcgggagacctgtgct

SEQ ID NO: 1760574 - DNA, 23 bp, Homo sapiens
gaacagctatgggagccccaggg

SEQ ID NO: 1760575 - DNA, 14 bp, Homo sapiens
gaacagctggtgcc

SEQ ID NO: 1760576 - DNA, 21 bp, Homo sapiens
gaacaggaatccttactgata

SEQ ID NO: 1760577 - DNA, 19 bp, Homo sapiens
gaagccaagtggggtgctg

SEQ ID NO: 1760578 - DNA, 17 bp, Homo sapiens
gaagccacaggcctgag

SEQ ID NO: 1760579 - DNA, 11 bp, Homo sapiens
gaagccagcca

SEQ ID NO: 1760580 - DNA, 12 bp, Homo sapiens
gaagccagccac

SEQ ID NO: 1760581 - DNA, 14 bp, Homo sapiens
gaagccagccacag

SEQ ID NO: 1760582 - DNA, 17 bp, Homo sapiens
gaagccagccacagacc

SEQ ID NO: 1760583 - DNA, 21 bp, Homo sapiens
gaagccagccacagacccctg

SEQ ID NO: 1760584 - DNA, 22 bp, Homo sapiens
gaagccagccacagacccctgg

SEQ ID NO: 1760585 - DNA, 10 bp, Homo sapiens
gaagccagct

SEQ ID NO: 1760586 - DNA, 15 bp, Homo sapiens
gaagccagctgccct

SEQ ID NO: 1760587 - DNA, 13 bp, Homo sapiens
gaagccaggtaca

SEQ ID NO: 1760588 - DNA, 17 bp, Homo sapiens
gaagccaggtacaggag

SEQ ID NO: 1760589 - DNA, 18 bp, Homo sapiens
gaagccaggtacaggaga

SEQ ID NO: 1760590 - DNA, 19 bp, Homo sapiens
gaagccaggtacaggagag

SEQ ID NO: 1760591 - DNA, 23 bp, Homo sapiens
gaagccatgagttccagaaagta

SEQ ID NO: 1760592 - DNA, 15 bp, Homo sapiens
gaagcccaagtgaaa

SEQ ID NO: 1760593 - DNA, 18 bp, Homo sapiens
gaagcccaataaacctct

SEQ ID NO: 1760594 - DNA, 19 bp, Homo sapiens
gaagcccaataaacctctt

SEQ ID NO: 1760595 - DNA, 19 bp, Homo sapiens
gaagcccagcccctactgc

SEQ ID NO: 1760596 - DNA, 18 bp, Homo sapiens
gaagcccattcattagaa

SEQ ID NO: 1760597 - DNA, 18 bp, Homo sapiens
gaagccccctcttcctcc

SEQ ID NO: 1760598 - DNA, 18 bp, Homo sapiens
gaagccccttggagagag

SEQ ID NO: 1760599 - DNA, 13 bp, Homo sapiens
gaagccctcccag

SEQ ID NO: 1760600 - DNA, 19 bp, Homo sapiens
gaagccctccttccacgga

SEQ ID NO: 1760601 - DNA, 19 bp, Homo sapiens
gaagccctggatttcagaa

SEQ ID NO: 1760602 - DNA, 17 bp, Homo sapiens
gaagccgactctggccc

SEQ ID NO: 1760603 - DNA, 22 bp, Homo sapiens
gaagccgactctggccctggcc

SEQ ID NO: 1760604 - DNA, 22 bp, Homo sapiens
gaagccggacacggcttcactg

SEQ ID NO: 1760605 - DNA, 23 bp, Homo sapiens
gaagccggacacggcttcactga

SEQ ID NO: 1760606 - DNA, 16 bp, Homo sapiens
gaagccggacagctgc

SEQ ID NO: 1760607 - DNA, 23 bp, Homo sapiens
gaagccggacagctgcccagaca

SEQ ID NO: 1760608 - DNA, 18 bp, Homo sapiens
gaagccggcggcccaagc

SEQ ID NO: 1760609 - DNA, 16 bp, Homo sapiens
gaagccgggaacagac

SEQ ID NO: 1760610 - DNA, 21 bp, Homo sapiens
gaagccggggtgtaacttcct

SEQ ID NO: 1760611 - DNA, 22 bp, Homo sapiens
gaagccggggtgtaacttcctg

SEQ ID NO: 1760612 - DNA, 23 bp, Homo sapiens
gaagccggggtgtaacttcctgc

SEQ ID NO: 1760613 - DNA, 16 bp, Homo sapiens
gaagccgtctgactcc

SEQ ID NO: 1760614 - DNA, 19 bp, Homo sapiens
gaagccgtctgactccaga

SEQ ID NO: 1760615 - DNA, 22 bp, Homo sapiens
gaagccgtctgactccagagtc

SEQ ID NO: 1760616 - DNA, 23 bp, Homo sapiens
gaagccgtctgactccagagtct

SEQ ID NO: 1760617 - DNA, 24 bp, Homo sapiens
gaagccgtctgactccagagtctg

SEQ ID NO: 1760618 - DNA, 21 bp, Homo sapiens
gaagcctccaagcctgcctcc

SEQ ID NO: 1760619 - DNA, 14 bp, Homo sapiens
gaagcctggattcc

SEQ ID NO: 1760620 - DNA, 17 bp, Homo sapiens
gaagccttaccacgcag

SEQ ID NO: 1760621 - DNA, 19 bp, Homo sapiens
gaagcggagagagccaaga

SEQ ID NO: 1760622 - DNA, 14 bp, Homo sapiens
gaagctaaagtcat

SEQ ID NO: 1760623 - DNA, 21 bp, Homo sapiens
gaagctaaagtcatccatcct

SEQ ID NO: 1760624 - DNA, 14 bp, Homo sapiens
gaagctaagctgca

SEQ ID NO: 1760625 - DNA, 20 bp, Homo sapiens
gaagctaataaaattcgctt

SEQ ID NO: 1760626 - DNA, 23 bp, Homo sapiens
gaagctaataaaattcgctttct

SEQ ID NO: 1760627 - DNA, 17 bp, Homo sapiens
gaagctaccagagctct

SEQ ID NO: 1760628 - DNA, 15 bp, Homo sapiens
gaagctactgcatga

SEQ ID NO: 1760629 - DNA, 15 bp, Homo sapiens
gaagctacttctcca

SEQ ID NO: 1760630 - DNA, 13 bp, Homo sapiens
gaagctcagcctt

SEQ ID NO: 1760631 - DNA, 14 bp, Homo sapiens
gaagctcagccttc

SEQ ID NO: 1760632 - DNA, 12 bp, Homo sapiens
gaagctcagctg

SEQ ID NO: 1760633 - DNA, 15 bp, Homo sapiens
gaagctcctccagtg

SEQ ID NO: 1760634 - DNA, 17 bp, Homo sapiens
gaagctcctctccccag

SEQ ID NO: 1760635 - DNA, 20 bp, Homo sapiens
gaagctcctctccccagccc

SEQ ID NO: 1760636 - DNA, 22 bp, Homo sapiens
gaagctcctctccccagcccag

SEQ ID NO: 1760637 - DNA, 12 bp, Homo sapiens
gaagctcctgct

SEQ ID NO: 1760638 - DNA, 16 bp, Homo sapiens
gaagctctccaggccc

SEQ ID NO: 1760639 - DNA, 14 bp, Homo sapiens
gaagctctccgagc

SEQ ID NO: 1760640 - DNA, 20 bp, Homo sapiens
gaagctctgaagtcacatca

SEQ ID NO: 1760641 - DNA, 19 bp, Homo sapiens
gaagctctggctgaaccct

SEQ ID NO: 1760642 - DNA, 22 bp, Homo sapiens
gaagctctgtttataaaaacaa

SEQ ID NO: 1760643 - DNA, 21 bp, Homo sapiens
gaagctcttttctcctgcaga

SEQ ID NO: 1760644 - DNA, 14 bp, Homo sapiens
gaagctgatccagt

SEQ ID NO: 1760645 - DNA, 13 bp, Homo sapiens
gaagctgctgacc

SEQ ID NO: 1760646 - DNA, 14 bp, Homo sapiens
gaagctggagcagc

SEQ ID NO: 1760647 - DNA, 17 bp, Homo sapiens
gaagctggcagaacgga

SEQ ID NO: 1760648 - DNA, 17 bp, Homo sapiens
gaagctggccgagggtc

SEQ ID NO: 1760649 - DNA, 23 bp, Homo sapiens
gaagctggccgagggtcctggct

SEQ ID NO: 1760650 - DNA, 14 bp, Homo sapiens
gaagctggcctgag

SEQ ID NO: 1760651 - DNA, 15 bp, Homo sapiens
gaagctggcctgaga

SEQ ID NO: 1760652 - DNA, 22 bp, Homo sapiens
gaagctggcctgagaggggaag

SEQ ID NO: 1760653 - DNA, 20 bp, Homo sapiens
gaagctggctgggctggctg

SEQ ID NO: 1760654 - DNA, 12 bp, Homo sapiens
gaagctgggtga

SEQ ID NO: 1760655 - DNA, 14 bp, Homo sapiens
gaagctggtgccct

SEQ ID NO: 1760656 - DNA, 16 bp, Homo sapiens
gaagctgtactcagag

SEQ ID NO: 1760657 - DNA, 14 bp, Homo sapiens
gaagctgtactttt

SEQ ID NO: 1760658 - DNA, 12 bp, Homo sapiens
gaagctgtgtcc

SEQ ID NO: 1760659 - DNA, 17 bp, Homo sapiens
gaagctgtgtccttgca

SEQ ID NO: 1760660 - DNA, 21 bp, Homo sapiens
gaagctgttgggagaaagcaa

SEQ ID NO: 1760661 - DNA, 13 bp, Homo sapiens
gaagcttctaatt

SEQ ID NO: 1760662 - DNA, 15 bp, Homo sapiens
gaagcttgactccca

SEQ ID NO: 1760663 - DNA, 17 bp, Homo sapiens
gaagcttgagcctcccc

SEQ ID NO: 1760664 - DNA, 19 bp, Homo sapiens
gaagcttgagcctccccca

SEQ ID NO: 1760665 - DNA, 21 bp, Homo sapiens
gaagcttgttgaaaacccaga

SEQ ID NO: 1760666 - DNA, 18 bp, Homo sapiens
gaagctttaccagctgaa

SEQ ID NO: 1760667 - DNA, 15 bp, Homo sapiens
gaaggaaaaattcaa

SEQ ID NO: 1760668 - DNA, 19 bp, Homo sapiens
gaaggaaagaaagaaggaa

SEQ ID NO: 1760669 - DNA, 21 bp, Homo sapiens
gaaggaaagaagggggccctg

SEQ ID NO: 1760670 - DNA, 22 bp, Homo sapiens
gaaggaaagaagggggccctgc

SEQ ID NO: 1760671 - DNA, 23 bp, Homo sapiens
gaaggaaagatttgtgaactgga

SEQ ID NO: 1760672 - DNA, 15 bp, Homo sapiens
gaaggaacaaagaca

SEQ ID NO: 1760673 - DNA, 23 bp, Homo sapiens
gaaggaagataggacgtatttat

SEQ ID NO: 1760674 - DNA, 14 bp, Homo sapiens
gaaggaagggcaga

SEQ ID NO: 1760675 - DNA, 15 bp, Homo sapiens
gaaggaagggcagag

SEQ ID NO: 1760676 - DNA, 23 bp, Homo sapiens
gaaggaatagccagagaggagca

SEQ ID NO: 1760677 - DNA, 17 bp, Homo sapiens
gaaggaatctgtgcaga

SEQ ID NO: 1760678 - DNA, 17 bp, Homo sapiens
gaaggaatttgtacttc

SEQ ID NO: 1760679 - DNA, 15 bp, Homo sapiens
gaaggacacttcctg

SEQ ID NO: 1760680 - DNA, 16 bp, Homo sapiens
gaaggacaggaagctg

SEQ ID NO: 1760681 - DNA, 14 bp, Homo sapiens
gaaggacaggaccc

SEQ ID NO: 1760682 - DNA, 14 bp, Homo sapiens
gaaggacggtgcca

SEQ ID NO: 1760683 - DNA, 19 bp, Homo sapiens
gaaggactgacgagagatg

SEQ ID NO: 1760684 - DNA, 17 bp, Homo sapiens
gaaggagactcacctct

SEQ ID NO: 1760685 - DNA, 23 bp, Homo sapiens
gaaggagactcacctctgcctca

SEQ ID NO: 1760686 - DNA, 13 bp, Homo sapiens
gaaggagagcctg

SEQ ID NO: 1760687 - DNA, 22 bp, Homo sapiens
gaaggagcccagccagaaagca

SEQ ID NO: 1760688 - DNA, 19 bp, Homo sapiens
gaaggaggagggcgcccat

SEQ ID NO: 1760689 - DNA, 15 bp, Homo sapiens
gaaggaggcagactg

SEQ ID NO: 1760690 - DNA, 19 bp, Homo sapiens
gaaggaggccaaccagccc

SEQ ID NO: 1760691 - DNA, 13 bp, Homo sapiens
gaatattgtgatt

SEQ ID NO: 1760692 - DNA, 16 bp, Homo sapiens
gaatatttataacagc

SEQ ID NO: 1760693 - DNA, 18 bp, Homo sapiens
gaatatttataacagcat

SEQ ID NO: 1760694 - DNA, 18 bp, Homo sapiens
gaatatttatatttcact

SEQ ID NO: 1760695 - DNA, 19 bp, Homo sapiens
gaatatttatatttcacta

SEQ ID NO: 1760696 - DNA, 19 bp, Homo sapiens
gaatatttattacctctga

SEQ ID NO: 1760697 - DNA, 16 bp, Homo sapiens
gaatattttatcctgt

SEQ ID NO: 1760698 - DNA, 22 bp, Homo sapiens
gaatatttttagactatttctt

SEQ ID NO: 1760699 - DNA, 17 bp, Homo sapiens
gaatatttttgtatttt

SEQ ID NO: 1760700 - DNA, 14 bp, Homo sapiens
gaatcaacagggca

SEQ ID NO: 1760701 - DNA, 21 bp, Homo sapiens
gaatcaagatgtcagactggc

SEQ ID NO: 1760702 - DNA, 18 bp, Homo sapiens
gaatcactgtgctcagcc

SEQ ID NO: 1760703 - DNA, 16 bp, Homo sapiens
gaatcagaagaaaggc

SEQ ID NO: 1760704 - DNA, 22 bp, Homo sapiens
gaatcagaagatagtcttggaa

SEQ ID NO: 1760705 - DNA, 19 bp, Homo sapiens
gaatcatacttagcaaagt

SEQ ID NO: 1760706 - DNA, 15 bp, Homo sapiens
gaatcatgagcctgc

SEQ ID NO: 1760707 - DNA, 17 bp, Homo sapiens
gaatcatgagcctgctg

SEQ ID NO: 1760708 - DNA, 19 bp, Homo sapiens
gaatcatgagcctgctgga

SEQ ID NO: 1760709 - DNA, 14 bp, Homo sapiens
gaatcatgtttctt

SEQ ID NO: 1760710 - DNA, 15 bp, Homo sapiens
gaatcatgtttcttt

SEQ ID NO: 1760711 - DNA, 17 bp, Homo sapiens
gaatccaaatctgtcct

SEQ ID NO: 1760712 - DNA, 12 bp, Homo sapiens
gaatccaagatt

SEQ ID NO: 1760713 - DNA, 14 bp, Homo sapiens
gaatccaagcctcc

SEQ ID NO: 1760714 - DNA, 15 bp, Homo sapiens
gaatccaagcctcca

SEQ ID NO: 1760715 - DNA, 16 bp, Homo sapiens
gaatccaagcgaggtc

SEQ ID NO: 1760716 - DNA, 18 bp, Homo sapiens
gaatccacaaggacctct

SEQ ID NO: 1760717 - DNA, 16 bp, Homo sapiens
gaatccacatttctaa

SEQ ID NO: 1760718 - DNA, 17 bp, Homo sapiens
gaatccacatttctaaa

SEQ ID NO: 1760719 - DNA, 15 bp, Homo sapiens
gaatccagcaggtca

SEQ ID NO: 1760720 - DNA, 18 bp, Homo sapiens
gaatccataaatgtgttc

SEQ ID NO: 1760721 - DNA, 20 bp, Homo sapiens
gaatccattgaactggaaga

SEQ ID NO: 1760722 - DNA, 17 bp, Homo sapiens
gaatcccagaggtggga

SEQ ID NO: 1760723 - DNA, 19 bp, Homo sapiens
gaatcccagcagcagagaa

SEQ ID NO: 1760724 - DNA, 16 bp, Homo sapiens
gaatcccctccctgtc

SEQ ID NO: 1760725 - DNA, 18 bp, Homo sapiens
gaatcccggcggaaagcc

SEQ ID NO: 1760726 - DNA, 21 bp, Homo sapiens
gaatcccttaacagttgtatt

SEQ ID NO: 1760727 - DNA, 14 bp, Homo sapiens
gaatccgaagggaa

SEQ ID NO: 1760728 - DNA, 15 bp, Homo sapiens
gaatccgaagggaat

SEQ ID NO: 1760729 - DNA, 15 bp, Homo sapiens
gaatccgtgtgtgtg

SEQ ID NO: 1760730 - DNA, 18 bp, Homo sapiens
gaatcctcagttggaatc

SEQ ID NO: 1760731 - DNA, 16 bp, Homo sapiens
gaatcctcccttccca

SEQ ID NO: 1760732 - DNA, 16 bp, Homo sapiens
gaatcctctcctttct

SEQ ID NO: 1760733 - DNA, 14 bp, Homo sapiens
gaatcctggcagcc

SEQ ID NO: 1760734 - DNA, 16 bp, Homo sapiens
gaatccttactgatat

SEQ ID NO: 1760735 - DNA, 15 bp, Homo sapiens
gaatccttatctata

SEQ ID NO: 1760736 - DNA, 16 bp, Homo sapiens
gaatccttccattcca

SEQ ID NO: 1760737 - DNA, 19 bp, Homo sapiens
gaatcgcttgaacctggga

SEQ ID NO: 1760738 - DNA, 13 bp, Homo sapiens
gaatctaaacgtg

SEQ ID NO: 1760739 - DNA, 22 bp, Homo sapiens
gaatctaaacgtggtcaccttc

SEQ ID NO: 1760740 - DNA, 18 bp, Homo sapiens
gaatctaaggataatgaa

SEQ ID NO: 1760741 - DNA, 23 bp, Homo sapiens
gaatctaaggataatgaaataat

SEQ ID NO: 1760742 - DNA, 21 bp, Homo sapiens
gaatctagaaatgttcacaag

SEQ ID NO: 1760743 - DNA, 17 bp, Homo sapiens
gaatctatatttaacaa

SEQ ID NO: 1760744 - DNA, 12 bp, Homo sapiens
gaatctatgcca

SEQ ID NO: 1760745 - DNA, 15 bp, Homo sapiens
gaatctattatactg

SEQ ID NO: 1760746 - DNA, 17 bp, Homo sapiens
gaatctcaacatgtctc

SEQ ID NO: 1760747 - DNA, 21 bp, Homo sapiens
gaatctcaacatgtctcctac

SEQ ID NO: 1760748 - DNA, 19 bp, Homo sapiens
gaatctcaagatgggggca

SEQ ID NO: 1760749 - DNA, 18 bp, Homo sapiens
gaatctcataatttatac

SEQ ID NO: 1760750 - DNA, 16 bp, Homo sapiens
gaatctcatccctcaa

SEQ ID NO: 1760751 - DNA, 19 bp, Homo sapiens
gaatctctatgtatattct

SEQ ID NO: 1760752 - DNA, 21 bp, Homo sapiens
gaatctctatgtatattctat

SEQ ID NO: 1760753 - DNA, 15 bp, Homo sapiens
gaatctctgtgcctt

SEQ ID NO: 1760754 - DNA, 12 bp, Homo sapiens
gaatctcttcac

SEQ ID NO: 1760755 - DNA, 13 bp, Homo sapiens
gaatctcttcact

SEQ ID NO: 1760756 - DNA, 15 bp, Homo sapiens
gaatctcttcactac

SEQ ID NO: 1760757 - DNA, 17 bp, Homo sapiens
gaatctgagctgcaggt

SEQ ID NO: 1760758 - DNA, 13 bp, Homo sapiens
gaatctgctcact

SEQ ID NO: 1760759 - DNA, 15 bp, Homo sapiens
gaatctgctgttgcc

SEQ ID NO: 1760760 - DNA, 21 bp, Homo sapiens
gaatctgctgttgccatagcc

SEQ ID NO: 1760761 - DNA, 13 bp, Homo sapiens
gaatctggattat

SEQ ID NO: 1760762 - DNA, 18 bp, Homo sapiens
gaatcttaatgcttgtaa

SEQ ID NO: 1760763 - DNA, 15 bp, Homo sapiens
gaatcttcacctcag

SEQ ID NO: 1760764 - DNA, 16 bp, Homo sapiens
gaatcttcacctcaga

SEQ ID NO: 1760765 - DNA, 11 bp, Homo sapiens
gaatcttctgg

SEQ ID NO: 1760766 - DNA, 16 bp, Homo sapiens
gaatcttgactttctg

SEQ ID NO: 1760767 - DNA, 19 bp, Homo sapiens
gaatctttgtaccaaaatt

SEQ ID NO: 1760768 - DNA, 13 bp, Homo sapiens
gaatgaaaataac

SEQ ID NO: 1760769 - DNA, 20 bp, Homo sapiens
gaatgaaaataactgaattt

SEQ ID NO: 1760770 - DNA, 23 bp, Homo sapiens
gaatgaaaataactgaatttgga

SEQ ID NO: 1760771 - DNA, 16 bp, Homo sapiens
gaatgaaattgctgaa

SEQ ID NO: 1760772 - DNA, 12 bp, Homo sapiens
gaatgaagacca

SEQ ID NO: 1760773 - DNA, 14 bp, Homo sapiens
gaatgaagttctgc

SEQ ID NO: 1760774 - DNA, 15 bp, Homo sapiens
gaatgaagttctgct

SEQ ID NO: 1760775 - DNA, 15 bp, Homo sapiens
gaatgaataaaacaa

SEQ ID NO: 1760776 - DNA, 17 bp, Homo sapiens
gaatgaatttatcttta

SEQ ID NO: 1760777 - DNA, 12 bp, Homo sapiens
gaatgaatttca

SEQ ID NO: 1760778 - DNA, 19 bp, Homo sapiens
gaatgacggtaagtgttct

SEQ ID NO: 1760779 - DNA, 20 bp, Homo sapiens
gaatgacttccccaatatct

SEQ ID NO: 1760780 - DNA, 13 bp, Homo sapiens
gaatgagacatcc

SEQ ID NO: 1760781 - DNA, 15 bp, Homo sapiens
gaatgagacatccag

SEQ ID NO: 1760782 - DNA, 19 bp, Homo sapiens
gaatgagagttccttctca

SEQ ID NO: 1760783 - DNA, 14 bp, Homo sapiens
gaatgaggaaaatt

SEQ ID NO: 1760784 - DNA, 23 bp, Homo sapiens
gaatgaggaataataagttaaac

SEQ ID NO: 1760785 - DNA, 20 bp, Homo sapiens
gaatgaggcacttatcagca

SEQ ID NO: 1760786 - DNA, 23 bp, Homo sapiens
gaatgaggcacttatcagcatga

SEQ ID NO: 1760787 - DNA, 14 bp, Homo sapiens
gaatgaggtcccag

SEQ ID NO: 1760788 - DNA, 15 bp, Homo sapiens
gaatgaggtcccagg

SEQ ID NO: 1760789 - DNA, 21 bp, Homo sapiens
gaatgaggtcccaggcagaga

SEQ ID NO: 1760790 - DNA, 16 bp, Homo sapiens
gaatgatctcttcttt

SEQ ID NO: 1760791 - DNA, 17 bp, Homo sapiens
gaatgatctcttctttt

SEQ ID NO: 1760792 - DNA, 21 bp, Homo sapiens
gaatgatggtttccaatttca

SEQ ID NO: 1760793 - DNA, 22 bp, Homo sapiens
gaatgatgttttaaaaaaattt

SEQ ID NO: 1760794 - DNA, 13 bp, Homo sapiens
gaatgattaatca

SEQ ID NO: 1760795 - DNA, 20 bp, Homo sapiens
gaatgattggtagcaaagga

SEQ ID NO: 1760796 - DNA, 16 bp, Homo sapiens
gaatgatttccaaaga

SEQ ID NO: 1760797 - DNA, 22 bp, Homo sapiens
gaatgatttccaaagagaaaaa

SEQ ID NO: 1760798 - DNA, 18 bp, Homo sapiens
gaatgatttttcattggc

SEQ ID NO: 1760799 - DNA, 19 bp, Homo sapiens
gaatgcacaagaatggatc

SEQ ID NO: 1760800 - DNA, 20 bp, Homo sapiens
gaatgcacactagcctctcc

SEQ ID NO: 1760801 - DNA, 16 bp, Homo sapiens
gaatgcagaagcaaac

SEQ ID NO: 1760802 - DNA, 18 bp, Homo sapiens
gaatgcagaggtctccaa

SEQ ID NO: 1760803 - DNA, 18 bp, Homo sapiens
gaatgcagattcctgggc

SEQ ID NO: 1760804 - DNA, 20 bp, Homo sapiens
gaatgcagattcctgggcct

SEQ ID NO: 1760805 - DNA, 23 bp, Homo sapiens
gaatgcagattcctgggcctgtc

SEQ ID NO: 1760806 - DNA, 19 bp, Homo sapiens
gacaatcagtcccctccca

SEQ ID NO: 1760807 - DNA, 20 bp, Homo sapiens
gacaatggaccctttttgtt

SEQ ID NO: 1760808 - DNA, 23 bp, Homo sapiens
gacaattaatgattaaagactgt

SEQ ID NO: 1760809 - DNA, 16 bp, Homo sapiens
gacaattagaaaaaag

SEQ ID NO: 1760810 - DNA, 16 bp, Homo sapiens
gacaatttgatacata

SEQ ID NO: 1760811 - DNA, 22 bp, Homo sapiens
gacaatttgatacataataaaa

SEQ ID NO: 1760812 - DNA, 15 bp, Homo sapiens
gacaattttgtctta

SEQ ID NO: 1760813 - DNA, 24 bp, Homo sapiens
gacaattttgtcttaagtgtttct

SEQ ID NO: 1760814 - DNA, 16 bp, Homo sapiens
gacacaaaaagtagat

SEQ ID NO: 1760815 - DNA, 22 bp, Homo sapiens
gacacaaggtgatttcagactg

SEQ ID NO: 1760816 - DNA, 12 bp, Homo sapiens
gacacacacaca

SEQ ID NO: 1760817 - DNA, 15 bp, Homo sapiens
gacacacacacgcac

SEQ ID NO: 1760818 - DNA, 23 bp, Homo sapiens
gacacacacacgcacgcacacac

SEQ ID NO: 1760819 - DNA, 15 bp, Homo sapiens
gacacacagcactct

SEQ ID NO: 1760820 - DNA, 16 bp, Homo sapiens
gacacaccgcggccag

SEQ ID NO: 1760821 - DNA, 17 bp, Homo sapiens
gacacacctcacgcagg

SEQ ID NO: 1760822 - DNA, 15 bp, Homo sapiens
gacacactaaccaag

SEQ ID NO: 1760823 - DNA, 13 bp, Homo sapiens
gacacagaattat

SEQ ID NO: 1760824 - DNA, 18 bp, Homo sapiens
gacacagcacaagggcac

SEQ ID NO: 1760825 - DNA, 11 bp, Homo sapiens
gacacagcagc

SEQ ID NO: 1760826 - DNA, 18 bp, Homo sapiens
gacacagcagcttcacca

SEQ ID NO: 1760827 - DNA, 19 bp, Homo sapiens
gacacagcagcttcaccag

SEQ ID NO: 1760828 - DNA, 15 bp, Homo sapiens
gacacagcctccccc

SEQ ID NO: 1760829 - DNA, 13 bp, Homo sapiens
gacacagctcttc

SEQ ID NO: 1760830 - DNA, 20 bp, Homo sapiens
gacacagctcttcattccat

SEQ ID NO: 1760831 - DNA, 18 bp, Homo sapiens
gacacagtgatgaatgta

SEQ ID NO: 1760832 - DNA, 18 bp, Homo sapiens
gacacagttatcaaaaag

SEQ ID NO: 1760833 - DNA, 14 bp, Homo sapiens
gacacagttcctgg

SEQ ID NO: 1760834 - DNA, 15 bp, Homo sapiens
gacacagttcctggg

SEQ ID NO: 1760835 - DNA, 20 bp, Homo sapiens
gacacataaatctgtctgat

SEQ ID NO: 1760836 - DNA, 17 bp, Homo sapiens
gacacatcgttttgggg

SEQ ID NO: 1760837 - DNA, 19 bp, Homo sapiens
gacacatgaaggtaaataa

SEQ ID NO: 1760838 - DNA, 23 bp, Homo sapiens
gacacattaatgataaactcaga

SEQ ID NO: 1760839 - DNA, 16 bp, Homo sapiens
gacaccaataaatgtt

SEQ ID NO: 1760840 - DNA, 13 bp, Homo sapiens
gacaccatcctga

SEQ ID NO: 1760841 - DNA, 17 bp, Homo sapiens
gacaccatcctgagcca

SEQ ID NO: 1760842 - DNA, 14 bp, Homo sapiens
gacaccatgtgcaa

SEQ ID NO: 1760843 - DNA, 17 bp, Homo sapiens
gacaccatgtgcaataa

SEQ ID NO: 1760844 - DNA, 23 bp, Homo sapiens
gacaccattaccaaaataataaa

SEQ ID NO: 1760845 - DNA, 13 bp, Homo sapiens
gacaccccctccc

SEQ ID NO: 1760846 - DNA, 16 bp, Homo sapiens
gacaccccttcctgct

SEQ ID NO: 1760847 - DNA, 13 bp, Homo sapiens
gacaccctctgcc

SEQ ID NO: 1760848 - DNA, 14 bp, Homo sapiens
gacaccctctgggg

SEQ ID NO: 1760849 - DNA, 23 bp, Homo sapiens
gacaccctctgggggtcctctct

SEQ ID NO: 1760850 - DNA, 15 bp, Homo sapiens
gacacctaatgtccc

SEQ ID NO: 1760851 - DNA, 17 bp, Homo sapiens
gacacctactgagtggc

SEQ ID NO: 1760852 - DNA, 12 bp, Homo sapiens
gacacctccccc

SEQ ID NO: 1760853 - DNA, 18 bp, Homo sapiens
gacacctcgcccttcagc

SEQ ID NO: 1760854 - DNA, 17 bp, Homo sapiens
gacacctgcacctcccc

SEQ ID NO: 1760855 - DNA, 19 bp, Homo sapiens
gacacctgcacctcccccc

SEQ ID NO: 1760856 - DNA, 20 bp, Homo sapiens
gacacctggccgcctccagg

SEQ ID NO: 1760857 - DNA, 21 bp, Homo sapiens
gacacctggccgcctccagga

SEQ ID NO: 1760858 - DNA, 14 bp, Homo sapiens
gacaccttggacat

SEQ ID NO: 1760859 - DNA, 17 bp, Homo sapiens
gacacgcgctctccacc

SEQ ID NO: 1760860 - DNA, 23 bp, Homo sapiens
gacacgctcgcgggcagcgggcc

SEQ ID NO: 1760861 - DNA, 12 bp, Homo sapiens
gacacggcttca

SEQ ID NO: 1760862 - DNA, 17 bp, Homo sapiens
gacacgggcagcctggc

SEQ ID NO: 1760863 - DNA, 15 bp, Homo sapiens
gacacggggcagtgg

SEQ ID NO: 1760864 - DNA, 14 bp, Homo sapiens
gacacgtggcctgc

SEQ ID NO: 1760865 - DNA, 17 bp, Homo sapiens
gacactaagttatagta

SEQ ID NO: 1760866 - DNA, 16 bp, Homo sapiens
gacactacatatctaa

SEQ ID NO: 1760867 - DNA, 15 bp, Homo sapiens
gacactaccctgaga

SEQ ID NO: 1760868 - DNA, 18 bp, Homo sapiens
gacactagcccaatgaaa

SEQ ID NO: 1760869 - DNA, 13 bp, Homo sapiens
gacactcagacct

SEQ ID NO: 1760870 - DNA, 15 bp, Homo sapiens
gacactcagacctga

SEQ ID NO: 1760871 - DNA, 19 bp, Homo sapiens
gacactcctataaggagag

SEQ ID NO: 1760872 - DNA, 19 bp, Homo sapiens
gacactctatatgtagtgc

SEQ ID NO: 1760873 - DNA, 12 bp, Homo sapiens
gacactctgctc

SEQ ID NO: 1760874 - DNA, 12 bp, Homo sapiens
gacactgcctgg

SEQ ID NO: 1760875 - DNA, 19 bp, Homo sapiens
gacactgggcagcaaggct

SEQ ID NO: 1760876 - DNA, 20 bp, Homo sapiens
gacactggtgccatgtcagc

SEQ ID NO: 1760877 - DNA, 12 bp, Homo sapiens
gacactgtacaa

SEQ ID NO: 1760878 - DNA, 20 bp, Homo sapiens
gacactgtgcccagcccgga

SEQ ID NO: 1760879 - DNA, 18 bp, Homo sapiens
gacactgtgtaagaagct

SEQ ID NO: 1760880 - DNA, 19 bp, Homo sapiens
gacacttccctctgtttct

SEQ ID NO: 1760881 - DNA, 21 bp, Homo sapiens
gacacttccctctgtttctct

SEQ ID NO: 1760882 - DNA, 15 bp, Homo sapiens
gacacttcctgccta

SEQ ID NO: 1760883 - DNA, 22 bp, Homo sapiens
gacacttgccttcttcacccag

SEQ ID NO: 1760884 - DNA, 23 bp, Homo sapiens
gacactttaattaccaacctgtt

SEQ ID NO: 1760885 - DNA, 22 bp, Homo sapiens
gacactttgaaatgtgtttctg

SEQ ID NO: 1760886 - DNA, 15 bp, Homo sapiens
gacagaaaagtgcct

SEQ ID NO: 1760887 - DNA, 17 bp, Homo sapiens
gacagaaaatatgtatt

SEQ ID NO: 1760888 - DNA, 23 bp, Homo sapiens
gacagaaagcctccgctgggctt

SEQ ID NO: 1760889 - DNA, 18 bp, Homo sapiens
gacagaacttgaatgtgt

SEQ ID NO: 1760890 - DNA, 15 bp, Homo sapiens
gacagaaggactggt

SEQ ID NO: 1760891 - DNA, 16 bp, Homo sapiens
gacagaatatgtttca

SEQ ID NO: 1760892 - DNA, 13 bp, Homo sapiens
gacagaattctcc

SEQ ID NO: 1760893 - DNA, 15 bp, Homo sapiens
gacagacacacacac

SEQ ID NO: 1760894 - DNA, 18 bp, Homo sapiens
gacagaccacatctttat

SEQ ID NO: 1760895 - DNA, 22 bp, Homo sapiens
gacagaccacatctttatctgt

SEQ ID NO: 1760896 - DNA, 15 bp, Homo sapiens
gacagaccacttgcc

SEQ ID NO: 1760897 - DNA, 17 bp, Homo sapiens
gacagaccctctgccgc

SEQ ID NO: 1760898 - DNA, 21 bp, Homo sapiens
gacagagaaggttcttcttat

SEQ ID NO: 1760899 - DNA, 13 bp, Homo sapiens
gacagagaatctt

SEQ ID NO: 1760900 - DNA, 15 bp, Homo sapiens
gacagagacacctgc

SEQ ID NO: 1760901 - DNA, 17 bp, Homo sapiens
gacagagacacctgcac

SEQ ID NO: 1760902 - DNA, 15 bp, Homo sapiens
gacagagacccagat

SEQ ID NO: 1760903 - DNA, 18 bp, Homo sapiens
gacagagacgcaggaatg

SEQ ID NO: 1760904 - DNA, 20 bp, Homo sapiens
gacagagagaggggagagag

SEQ ID NO: 1760905 - DNA, 16 bp, Homo sapiens
gacagagaggactgta

SEQ ID NO: 1760906 - DNA, 16 bp, Homo sapiens
gacagagccagcggct

SEQ ID NO: 1760907 - DNA, 13 bp, Homo sapiens
gacagagccagga

SEQ ID NO: 1760908 - DNA, 18 bp, Homo sapiens
gacagagcccagcatccc

SEQ ID NO: 1760909 - DNA, 13 bp, Homo sapiens
gacagagctctgg

SEQ ID NO: 1760910 - DNA, 15 bp, Homo sapiens
gacagaggccggggt

SEQ ID NO: 1760911 - DNA, 17 bp, Homo sapiens
gacagagggtggctgga

SEQ ID NO: 1760912 - DNA, 23 bp, Homo sapiens
gacagaggttgtagtgagccaag

SEQ ID NO: 1760913 - DNA, 14 bp, Homo sapiens
gacagatgccccag

SEQ ID NO: 1760914 - DNA, 14 bp, Homo sapiens
gacagcaagtgagc

SEQ ID NO: 1760915 - DNA, 16 bp, Homo sapiens
gacagcaagtgagcag

SEQ ID NO: 1760916 - DNA, 17 bp, Homo sapiens
gacagcagcctgtatgt

SEQ ID NO: 1760917 - DNA, 14 bp, Homo sapiens
gacagcagctcagg

SEQ ID NO: 1760918 - DNA, 15 bp, Homo sapiens
gacagcagctcaggc

SEQ ID NO: 1760919 - DNA, 18 bp, Homo sapiens
gacagcagctcaggcaca

SEQ ID NO: 1760920 - DNA, 12 bp, Homo sapiens
gacagcagctgg

SEQ ID NO: 1760921 - DNA, 16 bp, Homo sapiens
gacatggtgcctgaga

SEQ ID NO: 1760922 - DNA, 17 bp, Homo sapiens
gacatggtgcctgagag

SEQ ID NO: 1760923 - DNA, 23 bp, Homo sapiens
gacatggtgcctgagaggcaggc

SEQ ID NO: 1760924 - DNA, 21 bp, Homo sapiens
gacatgtcagagcttggccct

SEQ ID NO: 1760925 - DNA, 16 bp, Homo sapiens
gacatgtgaggaggaa

SEQ ID NO: 1760926 - DNA, 17 bp, Homo sapiens
gacatgtgaggaggaaa

SEQ ID NO: 1760927 - DNA, 17 bp, Homo sapiens
gacatgtggggccaggt

SEQ ID NO: 1760928 - DNA, 13 bp, Homo sapiens
gacatgtgggtgg

SEQ ID NO: 1760929 - DNA, 15 bp, Homo sapiens
gacatgtgggtggag

SEQ ID NO: 1760930 - DNA, 16 bp, Homo sapiens
gacatgtgggtggaga

SEQ ID NO: 1760931 - DNA, 19 bp, Homo sapiens
gacatgtgggtggagaagg

SEQ ID NO: 1760932 - DNA, 16 bp, Homo sapiens
gacatgtggtgggaca

SEQ ID NO: 1760933 - DNA, 18 bp, Homo sapiens
gacatgtttgtgctctgt

SEQ ID NO: 1760934 - DNA, 17 bp, Homo sapiens
gacatgtttttatatgt

SEQ ID NO: 1760935 - DNA, 23 bp, Homo sapiens
gacattaaatctatgaagtatat

SEQ ID NO: 1760936 - DNA, 19 bp, Homo sapiens
gacattaacaaataaaaaa

SEQ ID NO: 1760937 - DNA, 21 bp, Homo sapiens
gacattaataaagttgctttt

SEQ ID NO: 1760938 - DNA, 17 bp, Homo sapiens
gacattatgtggtttta

SEQ ID NO: 1760939 - DNA, 21 bp, Homo sapiens
gacattcaaaaaactctctcc

SEQ ID NO: 1760940 - DNA, 15 bp, Homo sapiens
gacattcccctccca

SEQ ID NO: 1760941 - DNA, 23 bp, Homo sapiens
gacattcctaagagtggaggagg

SEQ ID NO: 1760942 - DNA, 13 bp, Homo sapiens
gacattctcacat

SEQ ID NO: 1760943 - DNA, 19 bp, Homo sapiens
gacattctctttgataaca

SEQ ID NO: 1760944 - DNA, 23 bp, Homo sapiens
gacattgacctatttccagaaat

SEQ ID NO: 1760945 - DNA, 19 bp, Homo sapiens
gacattgctctatgtctgc

SEQ ID NO: 1760946 - DNA, 23 bp, Homo sapiens
gacattgctttactgtcaaaata

SEQ ID NO: 1760947 - DNA, 23 bp, Homo sapiens
gacattggcacctaatccaggca

SEQ ID NO: 1760948 - DNA, 14 bp, Homo sapiens
gacatttagaagaa

SEQ ID NO: 1760949 - DNA, 21 bp, Homo sapiens
gacatttctctaactcctgcc

SEQ ID NO: 1760950 - DNA, 16 bp, Homo sapiens
gacatttctttgtgct

SEQ ID NO: 1760951 - DNA, 17 bp, Homo sapiens
gacatttgtgtggaaat

SEQ ID NO: 1760952 - DNA, 11 bp, Homo sapiens
gacattttatt

SEQ ID NO: 1760953 - DNA, 12 bp, Homo sapiens
gacattttctgg

SEQ ID NO: 1760954 - DNA, 20 bp, Homo sapiens
gacattttctttcatgggca

SEQ ID NO: 1760955 - DNA, 17 bp, Homo sapiens
gacattttgtgtgagac

SEQ ID NO: 1760956 - DNA, 23 bp, Homo sapiens
gacattttgtgtgagacttaaaa

SEQ ID NO: 1760957 - DNA, 18 bp, Homo sapiens
gaccaaagactgcagaac

SEQ ID NO: 1760958 - DNA, 16 bp, Homo sapiens
gaccaacagaaacctt

SEQ ID NO: 1760959 - DNA, 15 bp, Homo sapiens
gaccaacatccagtc

SEQ ID NO: 1760960 - DNA, 16 bp, Homo sapiens
gaccaactggcttctg

SEQ ID NO: 1760961 - DNA, 12 bp, Homo sapiens
gaccaagaactg

SEQ ID NO: 1760962 - DNA, 16 bp, Homo sapiens
gaccaagagagaaaga

SEQ ID NO: 1760963 - DNA, 18 bp, Homo sapiens
gaccaagagagaaagaag

SEQ ID NO: 1760964 - DNA, 15 bp, Homo sapiens
gaccaagcatcttgg

SEQ ID NO: 1760965 - DNA, 23 bp, Homo sapiens
gaccaaggcaaggcaggtgcctc

SEQ ID NO: 1760966 - DNA, 18 bp, Homo sapiens
gaccaaggtaccgatttc

SEQ ID NO: 1760967 - DNA, 16 bp, Homo sapiens
gaccaatagcccacag

SEQ ID NO: 1760968 - DNA, 13 bp, Homo sapiens
gaccaattcaacc

SEQ ID NO: 1760969 - DNA, 18 bp, Homo sapiens
gaccaattgtgctgccat

SEQ ID NO: 1760970 - DNA, 18 bp, Homo sapiens
gaccacaccagcctcctg

SEQ ID NO: 1760971 - DNA, 16 bp, Homo sapiens
gaccacaccctgtact

SEQ ID NO: 1760972 - DNA, 17 bp, Homo sapiens
gaccacacctccctgaa

SEQ ID NO: 1760973 - DNA, 20 bp, Homo sapiens
gaccacacctccctgaacca

SEQ ID NO: 1760974 - DNA, 16 bp, Homo sapiens
gaccacacctgcctct

SEQ ID NO: 1760975 - DNA, 18 bp, Homo sapiens
gaccacaccttggccttc

SEQ ID NO: 1760976 - DNA, 23 bp, Homo sapiens
gaccacagcaagccatcatcctc

SEQ ID NO: 1760977 - DNA, 14 bp, Homo sapiens
gaccacagctgctg

SEQ ID NO: 1760978 - DNA, 18 bp, Homo sapiens
gaccacagctgctggcca

SEQ ID NO: 1760979 - DNA, 19 bp, Homo sapiens
gaccacagctgctggccag

SEQ ID NO: 1760980 - DNA, 23 bp, Homo sapiens
gaccacagggttcaaaatgtctg

SEQ ID NO: 1760981 - DNA, 19 bp, Homo sapiens
gaccacagtgggtggcacc

SEQ ID NO: 1760982 - DNA, 16 bp, Homo sapiens
gaccaccagcaggcag

SEQ ID NO: 1760983 - DNA, 17 bp, Homo sapiens
gaccaccagccccagca

SEQ ID NO: 1760984 - DNA, 20 bp, Homo sapiens
gaccaccagccccagcaaga

SEQ ID NO: 1760985 - DNA, 20 bp, Homo sapiens
gaccaccccgcctgccctca

SEQ ID NO: 1760986 - DNA, 17 bp, Homo sapiens
gaccaccctcccctctc

SEQ ID NO: 1760987 - DNA, 18 bp, Homo sapiens
gaccaccctcccctctct

SEQ ID NO: 1760988 - DNA, 23 bp, Homo sapiens
gaccacctagtctgtaactcttt

SEQ ID NO: 1760989 - DNA, 14 bp, Homo sapiens
gaccacctgcttct

SEQ ID NO: 1760990 - DNA, 15 bp, Homo sapiens
gaccacctgcttctg

SEQ ID NO: 1760991 - DNA, 21 bp, Homo sapiens
gaccacctgcttctgaactca

SEQ ID NO: 1760992 - DNA, 17 bp, Homo sapiens
gaccacgcccgtcctgc

SEQ ID NO: 1760993 - DNA, 21 bp, Homo sapiens
gaccacgcccgtcctgcctgt

SEQ ID NO: 1760994 - DNA, 21 bp, Homo sapiens
gaccacgctttctagctgttg

SEQ ID NO: 1760995 - DNA, 20 bp, Homo sapiens
gaccacggacgtttccatca

SEQ ID NO: 1760996 - DNA, 21 bp, Homo sapiens
gaccacggacgtttccatcag

SEQ ID NO: 1760997 - DNA, 22 bp, Homo sapiens
gaccacggacgtttccatcagg

SEQ ID NO: 1760998 - DNA, 14 bp, Homo sapiens
gaccacggagggag

SEQ ID NO: 1760999 - DNA, 20 bp, Homo sapiens
gaccactcctgtccctgtag

SEQ ID NO: 1761000 - DNA, 14 bp, Homo sapiens
gaccactgaattca

SEQ ID NO: 1761001 - DNA, 19 bp, Homo sapiens
gaccactgaattcactcca

SEQ ID NO: 1761002 - DNA, 12 bp, Homo sapiens
gaccactgcatg

SEQ ID NO: 1761003 - DNA, 11 bp, Homo sapiens
gaccactgtct

SEQ ID NO: 1761004 - DNA, 22 bp, Homo sapiens
gaccactgtctccacccacctt

SEQ ID NO: 1761005 - DNA, 22 bp, Homo sapiens
gaccacttccaggggaacctgc

SEQ ID NO: 1761006 - DNA, 23 bp, Homo sapiens
gaccacttccaggggaacctgcc

SEQ ID NO: 1761007 - DNA, 14 bp, Homo sapiens
gaccagaatgaaaa

SEQ ID NO: 1761008 - DNA, 15 bp, Homo sapiens
gaccagaatgaaaac

SEQ ID NO: 1761009 - DNA, 14 bp, Homo sapiens
gaccagagaatgca

SEQ ID NO: 1761010 - DNA, 21 bp, Homo sapiens
gaccagagacccaacagcagt

SEQ ID NO: 1761011 - DNA, 23 bp, Homo sapiens
gaccagagccagatgcaggacag

SEQ ID NO: 1761012 - DNA, 14 bp, Homo sapiens
gaccagagctgtct

SEQ ID NO: 1761013 - DNA, 16 bp, Homo sapiens
gaccagagctgtctga

SEQ ID NO: 1761014 - DNA, 19 bp, Homo sapiens
gaccagaggagccttttta

SEQ ID NO: 1761015 - DNA, 21 bp, Homo sapiens
gaccagaggagcctttttaaa

SEQ ID NO: 1761016 - DNA, 18 bp, Homo sapiens
gaccagatctttctcttc

SEQ ID NO: 1761017 - DNA, 21 bp, Homo sapiens
gaccagatctttctcttccct

SEQ ID NO: 1761018 - DNA, 23 bp, Homo sapiens
gaccagatgtccgtctctcttgc

SEQ ID NO: 1761019 - DNA, 20 bp, Homo sapiens
gaccagcaacttgtcttttt

SEQ ID NO: 1761020 - DNA, 15 bp, Homo sapiens
gaccagcactcagcc

SEQ ID NO: 1761021 - DNA, 17 bp, Homo sapiens
gaccagcactcagcctc

SEQ ID NO: 1761022 - DNA, 22 bp, Homo sapiens
gaccagcagacagagccaggag

SEQ ID NO: 1761023 - DNA, 23 bp, Homo sapiens
gaccagcagacagagccaggaga

SEQ ID NO: 1761024 - DNA, 17 bp, Homo sapiens
gaccagcaggctggcct

SEQ ID NO: 1761025 - DNA, 17 bp, Homo sapiens
gaccagcagtctgcctg

SEQ ID NO: 1761026 - DNA, 13 bp, Homo sapiens
gaccagcctggcc

SEQ ID NO: 1761027 - DNA, 20 bp, Homo sapiens
gaccagcctgtaccttgctg

SEQ ID NO: 1761028 - DNA, 15 bp, Homo sapiens
gaccagcctgtccaa

SEQ ID NO: 1761029 - DNA, 15 bp, Homo sapiens
gaccagcggctgctc

SEQ ID NO: 1761030 - DNA, 17 bp, Homo sapiens
gaccagcggctgctcaa

SEQ ID NO: 1761031 - DNA, 17 bp, Homo sapiens
gaccagctcagaggccc

SEQ ID NO: 1761032 - DNA, 15 bp, Homo sapiens
gaccagctctcttcc

SEQ ID NO: 1761033 - DNA, 15 bp, Homo sapiens
gaccagctgctccga

SEQ ID NO: 1761034 - DNA, 12 bp, Homo sapiens
gaccagctgggg

SEQ ID NO: 1761035 - DNA, 15 bp, Homo sapiens
gactccaaagaaatg

SEQ ID NO: 1761036 - DNA, 18 bp, Homo sapiens
gactccaaagaaatgtaa

SEQ ID NO: 1761037 - DNA, 18 bp, Homo sapiens
gactccaaggagctactg

SEQ ID NO: 1761038 - DNA, 19 bp, Homo sapiens
gactccaatggggccagca

SEQ ID NO: 1761039 - DNA, 13 bp, Homo sapiens
gactccacctcaa

SEQ ID NO: 1761040 - DNA, 22 bp, Homo sapiens
gactccagaatctgctgttgcc

SEQ ID NO: 1761041 - DNA, 15 bp, Homo sapiens
gactccagagtctga

SEQ ID NO: 1761042 - DNA, 17 bp, Homo sapiens
gactccagagtctgagc

SEQ ID NO: 1761043 - DNA, 11 bp, Homo sapiens
gactccaggcc

SEQ ID NO: 1761044 - DNA, 19 bp, Homo sapiens
gactccaggcccaaggctc

SEQ ID NO: 1761045 - DNA, 14 bp, Homo sapiens
gactccaggcctga

SEQ ID NO: 1761046 - DNA, 16 bp, Homo sapiens
gactccaggcctgacc

SEQ ID NO: 1761047 - DNA, 14 bp, Homo sapiens
gactccatctcttc

SEQ ID NO: 1761048 - DNA, 15 bp, Homo sapiens
gactccatggctaag

SEQ ID NO: 1761049 - DNA, 22 bp, Homo sapiens
gactcccaagtttccatagcaa

SEQ ID NO: 1761050 - DNA, 12 bp, Homo sapiens
gactccctcctc

SEQ ID NO: 1761051 - DNA, 14 bp, Homo sapiens
gactccctcctcac

SEQ ID NO: 1761052 - DNA, 19 bp, Homo sapiens
gactccctcctcacctctg

SEQ ID NO: 1761053 - DNA, 20 bp, Homo sapiens
gactccctcctcacctctgg

SEQ ID NO: 1761054 - DNA, 19 bp, Homo sapiens
gactccgccctcctcgggc

SEQ ID NO: 1761055 - DNA, 16 bp, Homo sapiens
gactccgttggccact

SEQ ID NO: 1761056 - DNA, 17 bp, Homo sapiens
gactccgttggccactc

SEQ ID NO: 1761057 - DNA, 21 bp, Homo sapiens
gactcctaatagcttttcctg

SEQ ID NO: 1761058 - DNA, 14 bp, Homo sapiens
gactcctcaggaga

SEQ ID NO: 1761059 - DNA, 16 bp, Homo sapiens
gactcctcaggagaga

SEQ ID NO: 1761060 - DNA, 19 bp, Homo sapiens
gactcctcaggagagaccc

SEQ ID NO: 1761061 - DNA, 21 bp, Homo sapiens
gactcctgcctgagtttccag

SEQ ID NO: 1761062 - DNA, 13 bp, Homo sapiens
gactcctgctggt

SEQ ID NO: 1761063 - DNA, 17 bp, Homo sapiens
gactcctggtctgtgaa

SEQ ID NO: 1761064 - DNA, 18 bp, Homo sapiens
gactcctgttgccatgga

SEQ ID NO: 1761065 - DNA, 19 bp, Homo sapiens
gactcgagaactttcattt

SEQ ID NO: 1761066 - DNA, 12 bp, Homo sapiens
gactctaaatgc

SEQ ID NO: 1761067 - DNA, 16 bp, Homo sapiens
gactctaagctggagc

SEQ ID NO: 1761068 - DNA, 19 bp, Homo sapiens
gactctagagtccaaggtt

SEQ ID NO: 1761069 - DNA, 14 bp, Homo sapiens
gactctagcaaggc

SEQ ID NO: 1761070 - DNA, 16 bp, Homo sapiens
gactctagcaaggctc

SEQ ID NO: 1761071 - DNA, 22 bp, Homo sapiens
gactctcccaggcctgcctgca

SEQ ID NO: 1761072 - DNA, 12 bp, Homo sapiens
gactctctgtga

SEQ ID NO: 1761073 - DNA, 13 bp, Homo sapiens
gactctctgtgac

SEQ ID NO: 1761074 - DNA, 15 bp, Homo sapiens
gactctgaaaaacat

SEQ ID NO: 1761075 - DNA, 23 bp, Homo sapiens
gactctgatctctgtagtggccc

SEQ ID NO: 1761076 - DNA, 12 bp, Homo sapiens
gactctgcacat

SEQ ID NO: 1761077 - DNA, 20 bp, Homo sapiens
gactctgcacatgtcttgta

SEQ ID NO: 1761078 - DNA, 19 bp, Homo sapiens
gactctgcagagtcactca

SEQ ID NO: 1761079 - DNA, 12 bp, Homo sapiens
gactctgcccca

SEQ ID NO: 1761080 - DNA, 18 bp, Homo sapiens
gactctggaggtcatctg

SEQ ID NO: 1761081 - DNA, 12 bp, Homo sapiens
gactctggccct

SEQ ID NO: 1761082 - DNA, 14 bp, Homo sapiens
gactctggccctgg

SEQ ID NO: 1761083 - DNA, 19 bp, Homo sapiens
gactctgtctacctggtct

SEQ ID NO: 1761084 - DNA, 23 bp, Homo sapiens
gactgaaaaaaaaaaagaagaag

SEQ ID NO: 1761085 - DNA, 21 bp, Homo sapiens
gactgaaagaagaaaacagta

SEQ ID NO: 1761086 - DNA, 18 bp, Homo sapiens
gactgaaagcagcagcta

SEQ ID NO: 1761087 - DNA, 15 bp, Homo sapiens
gactgaaagtagggg

SEQ ID NO: 1761088 - DNA, 14 bp, Homo sapiens
gactgaacatgttt

SEQ ID NO: 1761089 - DNA, 13 bp, Homo sapiens
gactgaagaagat

SEQ ID NO: 1761090 - DNA, 13 bp, Homo sapiens
gactgaaggggca

SEQ ID NO: 1761091 - DNA, 23 bp, Homo sapiens
gactgaaggggcacaccactgcc

SEQ ID NO: 1761092 - DNA, 13 bp, Homo sapiens
gactgaattccaa

SEQ ID NO: 1761093 - DNA, 15 bp, Homo sapiens
gactgaccaaagact

SEQ ID NO: 1761094 - DNA, 18 bp, Homo sapiens
gactgaccaaagactgca

SEQ ID NO: 1761095 - DNA, 22 bp, Homo sapiens
gactgaccaaagactgcagaac

SEQ ID NO: 1761096 - DNA, 23 bp, Homo sapiens
gactgaccaaagactgcagaacc

SEQ ID NO: 1761097 - DNA, 23 bp, Homo sapiens
gactgaccacaccaaccaggcct

SEQ ID NO: 1761098 - DNA, 14 bp, Homo sapiens
gactgactgcagcc

SEQ ID NO: 1761099 - DNA, 18 bp, Homo sapiens
gactgactgcagccccct

SEQ ID NO: 1761100 - DNA, 16 bp, Homo sapiens
gactgagactggcact

SEQ ID NO: 1761101 - DNA, 12 bp, Homo sapiens
gactgagcagcc

SEQ ID NO: 1761102 - DNA, 14 bp, Homo sapiens
gactgagccagtcc

SEQ ID NO: 1761103 - DNA, 14 bp, Homo sapiens
gactgagctctcca

SEQ ID NO: 1761104 - DNA, 17 bp, Homo sapiens
gactgagctctccaggc

SEQ ID NO: 1761105 - DNA, 16 bp, Homo sapiens
gactgaggacaggccc

SEQ ID NO: 1761106 - DNA, 21 bp, Homo sapiens
gactgaggcctgagcgctcct

SEQ ID NO: 1761107 - DNA, 13 bp, Homo sapiens
gactgaggcctgc

SEQ ID NO: 1761108 - DNA, 17 bp, Homo sapiens
gactgagggcagtgccc

SEQ ID NO: 1761109 - DNA, 14 bp, Homo sapiens
gactgagtcagatg

SEQ ID NO: 1761110 - DNA, 15 bp, Homo sapiens
gactgagtgggaagc

SEQ ID NO: 1761111 - DNA, 16 bp, Homo sapiens
gactgagtgggaagcc

SEQ ID NO: 1761112 - DNA, 19 bp, Homo sapiens
gactgatgtcatcttgagc

SEQ ID NO: 1761113 - DNA, 13 bp, Homo sapiens
gactgcaccaaca

SEQ ID NO: 1761114 - DNA, 23 bp, Homo sapiens
gactgcagaggggaaagacttcc

SEQ ID NO: 1761115 - DNA, 13 bp, Homo sapiens
gactgcagctgct

SEQ ID NO: 1761116 - DNA, 19 bp, Homo sapiens
gactgcagtcggcatgcca

SEQ ID NO: 1761117 - DNA, 12 bp, Homo sapiens
gactgcagtgtg

SEQ ID NO: 1761118 - DNA, 18 bp, Homo sapiens
gactgcatggggaggcag

SEQ ID NO: 1761119 - DNA, 19 bp, Homo sapiens
gactgcatggggaggcagc

SEQ ID NO: 1761120 - DNA, 21 bp, Homo sapiens
gactgcatgtaccatttgcat

SEQ ID NO: 1761121 - DNA, 22 bp, Homo sapiens
gactgcatttaaatttgatttc

SEQ ID NO: 1761122 - DNA, 11 bp, Homo sapiens
gactgccaaat

SEQ ID NO: 1761123 - DNA, 16 bp, Homo sapiens
gactgccaagccagat

SEQ ID NO: 1761124 - DNA, 13 bp, Homo sapiens
gactgccaggtgg

SEQ ID NO: 1761125 - DNA, 18 bp, Homo sapiens
gactgccccaactcctgg

SEQ ID NO: 1761126 - DNA, 17 bp, Homo sapiens
gactgccctctcgactg

SEQ ID NO: 1761127 - DNA, 18 bp, Homo sapiens
gactgcctgtctccatga

SEQ ID NO: 1761128 - DNA, 16 bp, Homo sapiens
gactgcgttctgcaag

SEQ ID NO: 1761129 - DNA, 14 bp, Homo sapiens
gactgctacctctg

SEQ ID NO: 1761130 - DNA, 20 bp, Homo sapiens
gactgctacctctgagaaga

SEQ ID NO: 1761131 - DNA, 20 bp, Homo sapiens
gactgctcagaacttgctgc

SEQ ID NO: 1761132 - DNA, 23 bp, Homo sapiens
gactgctcagaacttgctgctgt

SEQ ID NO: 1761133 - DNA, 14 bp, Homo sapiens
gactgctgggactg

SEQ ID NO: 1761134 - DNA, 15 bp, Homo sapiens
gactgcttcccatcc

SEQ ID NO: 1761135 - DNA, 14 bp, Homo sapiens
gactggaagacact

SEQ ID NO: 1761136 - DNA, 19 bp, Homo sapiens
gactggaagacacttcaga

SEQ ID NO: 1761137 - DNA, 17 bp, Homo sapiens
gactggaagttgtggat

SEQ ID NO: 1761138 - DNA, 22 bp, Homo sapiens
gactggaagttgtggatatcag

SEQ ID NO: 1761139 - DNA, 16 bp, Homo sapiens
gactggaatgcagtga

SEQ ID NO: 1761140 - DNA, 22 bp, Homo sapiens
gactggagaaaacccctcccac

SEQ ID NO: 1761141 - DNA, 15 bp, Homo sapiens
gactggagtccctgt

SEQ ID NO: 1761142 - DNA, 22 bp, Homo sapiens
gactggagtgaggcttccaggc

SEQ ID NO: 1761143 - DNA, 18 bp, Homo sapiens
gactggatcttctatcat

SEQ ID NO: 1761144 - DNA, 18 bp, Homo sapiens
gactggcacagttttctg

SEQ ID NO: 1761145 - DNA, 20 bp, Homo sapiens
gactggcacttagcccaaga

SEQ ID NO: 1761146 - DNA, 14 bp, Homo sapiens
gactggcagaagca

SEQ ID NO: 1761147 - DNA, 16 bp, Homo sapiens
gactggcagtaaccta

SEQ ID NO: 1761148 - DNA, 21 bp, Homo sapiens
gactggcctaggggccagggc

SEQ ID NO: 1761149 - DNA, 14 bp, Homo sapiens
gactggctggctgc

SEQ ID NO: 1761150 - DNA, 16 bp, Homo sapiens
gagaataaaattccta

SEQ ID NO: 1761151 - DNA, 16 bp, Homo sapiens
gagaataaatttggga

SEQ ID NO: 1761152 - DNA, 22 bp, Homo sapiens
gagaataagagaaagaaaatga

SEQ ID NO: 1761153 - DNA, 18 bp, Homo sapiens
gagaataagttcatacaa

SEQ ID NO: 1761154 - DNA, 23 bp, Homo sapiens
gagaataccttggtctcacctat

SEQ ID NO: 1761155 - DNA, 15 bp, Homo sapiens
gagaatagaaacgta

SEQ ID NO: 1761156 - DNA, 14 bp, Homo sapiens
gagaatagagctgc

SEQ ID NO: 1761157 - DNA, 15 bp, Homo sapiens
gagaatagagctgcc

SEQ ID NO: 1761158 - DNA, 16 bp, Homo sapiens
gagaatagagctgcca

SEQ ID NO: 1761159 - DNA, 16 bp, Homo sapiens
gagaatagcagagagc

SEQ ID NO: 1761160 - DNA, 21 bp, Homo sapiens
gagaatagcagagagccaaat

SEQ ID NO: 1761161 - DNA, 21 bp, Homo sapiens
gagaatataccttatttattt

SEQ ID NO: 1761162 - DNA, 23 bp, Homo sapiens
gagaatattagctttactgtttg

SEQ ID NO: 1761163 - DNA, 22 bp, Homo sapiens
gagaatatttactaactaaata

SEQ ID NO: 1761164 - DNA, 23 bp, Homo sapiens
gagaatcacctgaaccccagagg

SEQ ID NO: 1761165 - DNA, 16 bp, Homo sapiens
gagaatcatgtttctt

SEQ ID NO: 1761166 - DNA, 20 bp, Homo sapiens
gagaatcccactttctatag

SEQ ID NO: 1761167 - DNA, 14 bp, Homo sapiens
gagaatcctccctt

SEQ ID NO: 1761168 - DNA, 18 bp, Homo sapiens
gagaatcctctcctttct

SEQ ID NO: 1761169 - DNA, 14 bp, Homo sapiens
gagaatcgcttgaa

SEQ ID NO: 1761170 - DNA, 19 bp, Homo sapiens
gagaatgagagcgacacag

SEQ ID NO: 1761171 - DNA, 15 bp, Homo sapiens
gagaatgagtgggaa

SEQ ID NO: 1761172 - DNA, 23 bp, Homo sapiens
gagaatggcccagtcctctccca

SEQ ID NO: 1761173 - DNA, 19 bp, Homo sapiens
gagaatggctgggtcaggg

SEQ ID NO: 1761174 - DNA, 22 bp, Homo sapiens
gagaatggctgggtcagggcca

SEQ ID NO: 1761175 - DNA, 17 bp, Homo sapiens
gagaatggtgctgttta

SEQ ID NO: 1761176 - DNA, 15 bp, Homo sapiens
gagaatgtaagaact

SEQ ID NO: 1761177 - DNA, 23 bp, Homo sapiens
gagaatgtgtgtgtgtggcaggg

SEQ ID NO: 1761178 - DNA, 16 bp, Homo sapiens
gagaatgtgtttcaaa

SEQ ID NO: 1761179 - DNA, 18 bp, Homo sapiens
gagaattgcttgaaccca

SEQ ID NO: 1761180 - DNA, 21 bp, Homo sapiens
gagaatttctaccatttcaga

SEQ ID NO: 1761181 - DNA, 15 bp, Homo sapiens
gagaattttaaatta

SEQ ID NO: 1761182 - DNA, 13 bp, Homo sapiens
gagacaagccctg

SEQ ID NO: 1761183 - DNA, 17 bp, Homo sapiens
gagacaagccctggcaa

SEQ ID NO: 1761184 - DNA, 18 bp, Homo sapiens
gagacaaggagggcacag

SEQ ID NO: 1761185 - DNA, 15 bp, Homo sapiens
gagacaaggtgctaa

SEQ ID NO: 1761186 - DNA, 16 bp, Homo sapiens
gagacaaggtgctaac

SEQ ID NO: 1761187 - DNA, 18 bp, Homo sapiens
gagacacaaaagatggga

SEQ ID NO: 1761188 - DNA, 15 bp, Homo sapiens
gagacaccatcctga

SEQ ID NO: 1761189 - DNA, 16 bp, Homo sapiens
gagacaccatcctgag

SEQ ID NO: 1761190 - DNA, 22 bp, Homo sapiens
gagacaccccttcctgctgaca

SEQ ID NO: 1761191 - DNA, 15 bp, Homo sapiens
gagacaccctctggg

SEQ ID NO: 1761192 - DNA, 22 bp, Homo sapiens
gagacaccctctgggggtcctc

SEQ ID NO: 1761193 - DNA, 17 bp, Homo sapiens
gagacacctgcacctcc

SEQ ID NO: 1761194 - DNA, 19 bp, Homo sapiens
gagacacctgcacctcccc

SEQ ID NO: 1761195 - DNA, 21 bp, Homo sapiens
gagacacctgcacctcccccc

SEQ ID NO: 1761196 - DNA, 17 bp, Homo sapiens
gagacactggcccctca

SEQ ID NO: 1761197 - DNA, 15 bp, Homo sapiens
gagacagaaagcctc

SEQ ID NO: 1761198 - DNA, 22 bp, Homo sapiens
gagacagagccaagcactgctc

SEQ ID NO: 1761199 - DNA, 15 bp, Homo sapiens
gagacagcagcctgt

SEQ ID NO: 1761200 - DNA, 18 bp, Homo sapiens
gagacaggacagaatgtg

SEQ ID NO: 1761201 - DNA, 19 bp, Homo sapiens
gagacaggacagaatgtgt

SEQ ID NO: 1761202 - DNA, 16 bp, Homo sapiens
gagacagggtaggaaa

SEQ ID NO: 1761203 - DNA, 19 bp, Homo sapiens
gagacagggtctcgctctg

SEQ ID NO: 1761204 - DNA, 17 bp, Homo sapiens
gagacagtcctttccca

SEQ ID NO: 1761205 - DNA, 13 bp, Homo sapiens
gagacagtgaatt

SEQ ID NO: 1761206 - DNA, 17 bp, Homo sapiens
gagacagttgagagcgg

SEQ ID NO: 1761207 - DNA, 14 bp, Homo sapiens
gagaccaacctgac

SEQ ID NO: 1761208 - DNA, 16 bp, Homo sapiens
gagaccaacctgacca

SEQ ID NO: 1761209 - DNA, 23 bp, Homo sapiens
gagaccaagactctgaaatctca

SEQ ID NO: 1761210 - DNA, 18 bp, Homo sapiens
gagaccaagtcctggcta

SEQ ID NO: 1761211 - DNA, 19 bp, Homo sapiens
gagaccaagtcctggctac

SEQ ID NO: 1761212 - DNA, 16 bp, Homo sapiens
gagaccagcctgggca

SEQ ID NO: 1761213 - DNA, 19 bp, Homo sapiens
gagaccagcctgggcagca

SEQ ID NO: 1761214 - DNA, 17 bp, Homo sapiens
gagaccaggctgtgtcc

SEQ ID NO: 1761215 - DNA, 16 bp, Homo sapiens
gagaccagggagcctt

SEQ ID NO: 1761216 - DNA, 23 bp, Homo sapiens
gagaccagttgaataaaagtgca

SEQ ID NO: 1761217 - DNA, 22 bp, Homo sapiens
gagaccagttgggagcactgga

SEQ ID NO: 1761218 - DNA, 14 bp, Homo sapiens
gagaccatcctggc

SEQ ID NO: 1761219 - DNA, 16 bp, Homo sapiens
gagaccatcctggcta

SEQ ID NO: 1761220 - DNA, 13 bp, Homo sapiens
gagacccagatct

SEQ ID NO: 1761221 - DNA, 22 bp, Homo sapiens
gagaccccaaagactctggagg

SEQ ID NO: 1761222 - DNA, 14 bp, Homo sapiens
gagacccccaggcc

SEQ ID NO: 1761223 - DNA, 15 bp, Homo sapiens
gagacccccatccag

SEQ ID NO: 1761224 - DNA, 19 bp, Homo sapiens
gagacccccatccagcctc

SEQ ID NO: 1761225 - DNA, 20 bp, Homo sapiens
gagacccccatccagcctcc

SEQ ID NO: 1761226 - DNA, 13 bp, Homo sapiens
gagacccctgtct

SEQ ID NO: 1761227 - DNA, 14 bp, Homo sapiens
gagacccctgtctc

SEQ ID NO: 1761228 - DNA, 15 bp, Homo sapiens
gagacccctgtctcc

SEQ ID NO: 1761229 - DNA, 23 bp, Homo sapiens
gagacccgggaaggaaggctctc

SEQ ID NO: 1761230 - DNA, 14 bp, Homo sapiens
gagaccctccccac

SEQ ID NO: 1761231 - DNA, 20 bp, Homo sapiens
gagaccctccccacagtgcc

SEQ ID NO: 1761232 - DNA, 14 bp, Homo sapiens
gagaccctgcaaga

SEQ ID NO: 1761233 - DNA, 23 bp, Homo sapiens
gagaccctgcaagaccacggagg

SEQ ID NO: 1761234 - DNA, 16 bp, Homo sapiens
gagacccttttctcag

SEQ ID NO: 1761235 - DNA, 18 bp, Homo sapiens
gagacccttttctcagga

SEQ ID NO: 1761236 - DNA, 20 bp, Homo sapiens
gagacctcatcctgctcttt

SEQ ID NO: 1761237 - DNA, 14 bp, Homo sapiens
gagacctccagcta

SEQ ID NO: 1761238 - DNA, 17 bp, Homo sapiens
gagacctgccctctctg

SEQ ID NO: 1761239 - DNA, 14 bp, Homo sapiens
gagacgaggcaggg

SEQ ID NO: 1761240 - DNA, 21 bp, Homo sapiens
gagacggcgattttcgggctg

SEQ ID NO: 1761241 - DNA, 19 bp, Homo sapiens
gagacggtttccagggagg

SEQ ID NO: 1761242 - DNA, 15 bp, Homo sapiens
gagacgtggtgggac

SEQ ID NO: 1761243 - DNA, 20 bp, Homo sapiens
gagacgtttataaacagaaa

SEQ ID NO: 1761244 - DNA, 23 bp, Homo sapiens
gagacgtttataaacagaaatgg

SEQ ID NO: 1761245 - DNA, 22 bp, Homo sapiens
gagactaagccctgtcgagaca

SEQ ID NO: 1761246 - DNA, 15 bp, Homo sapiens
gagactcacctctgc

SEQ ID NO: 1761247 - DNA, 16 bp, Homo sapiens
gagactcacctctgcc

SEQ ID NO: 1761248 - DNA, 17 bp, Homo sapiens
gagactcagggccccag

SEQ ID NO: 1761249 - DNA, 16 bp, Homo sapiens
gagactcagtgcagat

SEQ ID NO: 1761250 - DNA, 15 bp, Homo sapiens
gagactccacctcaa

SEQ ID NO: 1761251 - DNA, 23 bp, Homo sapiens
gagactccagaatctgctgttgc

SEQ ID NO: 1761252 - DNA, 14 bp, Homo sapiens
gagactccatctca

SEQ ID NO: 1761253 - DNA, 18 bp, Homo sapiens
gagactcgactctgtgcc

SEQ ID NO: 1761254 - DNA, 17 bp, Homo sapiens
gagactcgagaactttc

SEQ ID NO: 1761255 - DNA, 19 bp, Homo sapiens
gagactctagggtccagtg

SEQ ID NO: 1761256 - DNA, 20 bp, Homo sapiens
gagactgaaagcagcagcta

SEQ ID NO: 1761257 - DNA, 14 bp, Homo sapiens
gagactgagcagcc

SEQ ID NO: 1761258 - DNA, 22 bp, Homo sapiens
gagactgataacttggggaggc

SEQ ID NO: 1761259 - DNA, 15 bp, Homo sapiens
gagactgccatacat

SEQ ID NO: 1761260 - DNA, 19 bp, Homo sapiens
gagactgcgggatggtcct

SEQ ID NO: 1761261 - DNA, 16 bp, Homo sapiens
gagactgcgttctgca

SEQ ID NO: 1761262 - DNA, 17 bp, Homo sapiens
gagactgcttcccatcc

SEQ ID NO: 1761263 - DNA, 17 bp, Homo sapiens
gagactggcacttagcc

SEQ ID NO: 1761264 - DNA, 22 bp, Homo sapiens
gagccatcccttcggagccaac

SEQ ID NO: 1761265 - DNA, 17 bp, Homo sapiens
gagccatgcgccccctc

SEQ ID NO: 1761266 - DNA, 13 bp, Homo sapiens
gagcccacaacct

SEQ ID NO: 1761267 - DNA, 22 bp, Homo sapiens
gagcccacatggccgggccctc

SEQ ID NO: 1761268 - DNA, 20 bp, Homo sapiens
gagcccactgcccaccccct

SEQ ID NO: 1761269 - DNA, 20 bp, Homo sapiens
gagcccagaaaacctccagt

SEQ ID NO: 1761270 - DNA, 14 bp, Homo sapiens
gagcccagctacat

SEQ ID NO: 1761271 - DNA, 21 bp, Homo sapiens
gagcccagctacattcctcag

SEQ ID NO: 1761272 - DNA, 13 bp, Homo sapiens
gagcccagctcca

SEQ ID NO: 1761273 - DNA, 14 bp, Homo sapiens
gagcccagctccaa

SEQ ID NO: 1761274 - DNA, 11 bp, Homo sapiens
gagcccaggag

SEQ ID NO: 1761275 - DNA, 12 bp, Homo sapiens
gagcccaggagt

SEQ ID NO: 1761276 - DNA, 17 bp, Homo sapiens
gagcccagtgaagcctc

SEQ ID NO: 1761277 - DNA, 13 bp, Homo sapiens
gagcccatgctca

SEQ ID NO: 1761278 - DNA, 22 bp, Homo sapiens
gagcccatgctcaaccactgtg

SEQ ID NO: 1761279 - DNA, 13 bp, Homo sapiens
gagcccattccca

SEQ ID NO: 1761280 - DNA, 14 bp, Homo sapiens
gagccccacacgga

SEQ ID NO: 1761281 - DNA, 16 bp, Homo sapiens
gagccccacacggagg

SEQ ID NO: 1761282 - DNA, 20 bp, Homo sapiens
gagccccacagagcaggaag

SEQ ID NO: 1761283 - DNA, 19 bp, Homo sapiens
gagccccacgtggagctcg

SEQ ID NO: 1761284 - DNA, 13 bp, Homo sapiens
gagccccagggtc

SEQ ID NO: 1761285 - DNA, 18 bp, Homo sapiens
gagccccatggtgggtag

SEQ ID NO: 1761286 - DNA, 15 bp, Homo sapiens
gagcccccagccctg

SEQ ID NO: 1761287 - DNA, 22 bp, Homo sapiens
gagcccccccaacactgtgccc

SEQ ID NO: 1761288 - DNA, 23 bp, Homo sapiens
gagccccctgcacccacccctgc

SEQ ID NO: 1761289 - DNA, 20 bp, Homo sapiens
gagcccctaccccacaccag

SEQ ID NO: 1761290 - DNA, 15 bp, Homo sapiens
gagcccctcctccag

SEQ ID NO: 1761291 - DNA, 23 bp, Homo sapiens
gagcccctcctctgagcagcctc

SEQ ID NO: 1761292 - DNA, 12 bp, Homo sapiens
gagcccctcctt

SEQ ID NO: 1761293 - DNA, 13 bp, Homo sapiens
gagcccctccttc

SEQ ID NO: 1761294 - DNA, 13 bp, Homo sapiens
gagcccctcggct

SEQ ID NO: 1761295 - DNA, 15 bp, Homo sapiens
gagcccctcggctct

SEQ ID NO: 1761296 - DNA, 20 bp, Homo sapiens
gagcccctcggctctggagg

SEQ ID NO: 1761297 - DNA, 22 bp, Homo sapiens
gagcccctgaaagcctcacgta

SEQ ID NO: 1761298 - DNA, 17 bp, Homo sapiens
gagcccgatattctccc

SEQ ID NO: 1761299 - DNA, 18 bp, Homo sapiens
gagcccgatattctccct

SEQ ID NO: 1761300 - DNA, 22 bp, Homo sapiens
gagcccgatattctccctgacc

SEQ ID NO: 1761301 - DNA, 14 bp, Homo sapiens
gagcccgcactgtc

SEQ ID NO: 1761302 - DNA, 17 bp, Homo sapiens
gagcccgcactgtccca

SEQ ID NO: 1761303 - DNA, 21 bp, Homo sapiens
gagcccgcagggccatgcaga

SEQ ID NO: 1761304 - DNA, 22 bp, Homo sapiens
gagcccgcagggccatgcagac

SEQ ID NO: 1761305 - DNA, 17 bp, Homo sapiens
gagcccgcgtgctggag

SEQ ID NO: 1761306 - DNA, 18 bp, Homo sapiens
gagcccgcgtgctggaga

SEQ ID NO: 1761307 - DNA, 19 bp, Homo sapiens
gagcccgcgtgctggagaa

SEQ ID NO: 1761308 - DNA, 17 bp, Homo sapiens
gagcccgggctgcctgg

SEQ ID NO: 1761309 - DNA, 18 bp, Homo sapiens
gagcccgggctgcctggg

SEQ ID NO: 1761310 - DNA, 16 bp, Homo sapiens
gagccctaaccccttc

SEQ ID NO: 1761311 - DNA, 19 bp, Homo sapiens
gagccctaaccccttccag

SEQ ID NO: 1761312 - DNA, 18 bp, Homo sapiens
gagccctactccctgcag

SEQ ID NO: 1761313 - DNA, 22 bp, Homo sapiens
gagccctactccctgcagatgc

SEQ ID NO: 1761314 - DNA, 16 bp, Homo sapiens
gagccctccaggcctg

SEQ ID NO: 1761315 - DNA, 12 bp, Homo sapiens
gagccctgagga

SEQ ID NO: 1761316 - DNA, 13 bp, Homo sapiens
gagccctgaggac

SEQ ID NO: 1761317 - DNA, 18 bp, Homo sapiens
gagccctgaggacctctc

SEQ ID NO: 1761318 - DNA, 22 bp, Homo sapiens
gagccctgaggacctctcagca

SEQ ID NO: 1761319 - DNA, 18 bp, Homo sapiens
gagccctggagagcccca

SEQ ID NO: 1761320 - DNA, 19 bp, Homo sapiens
gagccctggagagccccat

SEQ ID NO: 1761321 - DNA, 16 bp, Homo sapiens
gagcccttcactgcca

SEQ ID NO: 1761322 - DNA, 19 bp, Homo sapiens
gagcccttcactgccatga

SEQ ID NO: 1761323 - DNA, 19 bp, Homo sapiens
gagccgagatcacgccact

SEQ ID NO: 1761324 - DNA, 19 bp, Homo sapiens
gagccgaggggagagaggg

SEQ ID NO: 1761325 - DNA, 14 bp, Homo sapiens
gagccgccgtggct

SEQ ID NO: 1761326 - DNA, 13 bp, Homo sapiens
gagccggcggcct

SEQ ID NO: 1761327 - DNA, 21 bp, Homo sapiens
gagccgggcacattgagctgt

SEQ ID NO: 1761328 - DNA, 16 bp, Homo sapiens
gagccgggcccctggg

SEQ ID NO: 1761329 - DNA, 22 bp, Homo sapiens
gagccgggcctcccaccgcagc

SEQ ID NO: 1761330 - DNA, 22 bp, Homo sapiens
gagccggtaactgtcctgtcct

SEQ ID NO: 1761331 - DNA, 14 bp, Homo sapiens
gagccgtgatgcct

SEQ ID NO: 1761332 - DNA, 20 bp, Homo sapiens
gagcctacctgtatgtcaat

SEQ ID NO: 1761333 - DNA, 13 bp, Homo sapiens
gagcctagccacc

SEQ ID NO: 1761334 - DNA, 15 bp, Homo sapiens
gagcctagccacctc

SEQ ID NO: 1761335 - DNA, 18 bp, Homo sapiens
gagcctagccacctccca

SEQ ID NO: 1761336 - DNA, 20 bp, Homo sapiens
gagcctagccacctcccacc

SEQ ID NO: 1761337 - DNA, 17 bp, Homo sapiens
gagcctagcggagccca

SEQ ID NO: 1761338 - DNA, 21 bp, Homo sapiens
gagcctagcggagcccagcct

SEQ ID NO: 1761339 - DNA, 23 bp, Homo sapiens
gagcctagcggagcccagcctgg

SEQ ID NO: 1761340 - DNA, 15 bp, Homo sapiens
gagcctagctcctgc

SEQ ID NO: 1761341 - DNA, 13 bp, Homo sapiens
gagcctcagaaga

SEQ ID NO: 1761342 - DNA, 14 bp, Homo sapiens
gagcctcagaagaa

SEQ ID NO: 1761343 - DNA, 18 bp, Homo sapiens
gagcctcccaccagagcc

SEQ ID NO: 1761344 - DNA, 16 bp, Homo sapiens
gagcctcccccaaagc

SEQ ID NO: 1761345 - DNA, 16 bp, Homo sapiens
gagcctctgctcccca

SEQ ID NO: 1761346 - DNA, 16 bp, Homo sapiens
gagcctctgctggaag

SEQ ID NO: 1761347 - DNA, 19 bp, Homo sapiens
gagcctgaattttgttgct

SEQ ID NO: 1761348 - DNA, 13 bp, Homo sapiens
gagcctgccaaga

SEQ ID NO: 1761349 - DNA, 16 bp, Homo sapiens
gagcctgccctcactc

SEQ ID NO: 1761350 - DNA, 19 bp, Homo sapiens
gagcctgccgcccccgcct

SEQ ID NO: 1761351 - DNA, 22 bp, Homo sapiens
gagcctgccgcccccgcctggg

SEQ ID NO: 1761352 - DNA, 23 bp, Homo sapiens
gagcctgccgcccccgcctgggc

SEQ ID NO: 1761353 - DNA, 18 bp, Homo sapiens
gagcctgctctccgcgcc

SEQ ID NO: 1761354 - DNA, 10 bp, Homo sapiens
gagcctgctg

SEQ ID NO: 1761355 - DNA, 16 bp, Homo sapiens
gagcctgctggaagcc

SEQ ID NO: 1761356 - DNA, 17 bp, Homo sapiens
gagcctggcacaggact

SEQ ID NO: 1761357 - DNA, 17 bp, Homo sapiens
gagcctggcccatagaa

SEQ ID NO: 1761358 - DNA, 18 bp, Homo sapiens
gagcctggcccatagaaa

SEQ ID NO: 1761359 - DNA, 23 bp, Homo sapiens
gagcctggctccgtccaggagcc

SEQ ID NO: 1761360 - DNA, 15 bp, Homo sapiens
gagcctgtcaccaga

SEQ ID NO: 1761361 - DNA, 16 bp, Homo sapiens
gagcctgtcaccagag

SEQ ID NO: 1761362 - DNA, 20 bp, Homo sapiens
gagccttcgtgccccccctt

SEQ ID NO: 1761363 - DNA, 23 bp, Homo sapiens
gagccttgcagatatctgcatgt

SEQ ID NO: 1761364 - DNA, 14 bp, Homo sapiens
gagccttgctgggc

SEQ ID NO: 1761365 - DNA, 19 bp, Homo sapiens
gagccttgctgggccaggg

SEQ ID NO: 1761366 - DNA, 20 bp, Homo sapiens
gagccttggtgtccacctgg

SEQ ID NO: 1761367 - DNA, 18 bp, Homo sapiens
gagccttggttcatcagt

SEQ ID NO: 1761368 - DNA, 22 bp, Homo sapiens
gagccttgtgagatccttcaca

SEQ ID NO: 1761369 - DNA, 13 bp, Homo sapiens
gagcctttccaaa

SEQ ID NO: 1761370 - DNA, 22 bp, Homo sapiens
gagcctttggaagtctgcgccc

SEQ ID NO: 1761371 - DNA, 17 bp, Homo sapiens
gagccttttgctctctg

SEQ ID NO: 1761372 - DNA, 19 bp, Homo sapiens
gagcgagagatcaaagatg

SEQ ID NO: 1761373 - DNA, 16 bp, Homo sapiens
gagcgagcatccccca

SEQ ID NO: 1761374 - DNA, 13 bp, Homo sapiens
gagcgaggaaagg

SEQ ID NO: 1761375 - DNA, 15 bp, Homo sapiens
gagcgaggaaaggat

SEQ ID NO: 1761376 - DNA, 12 bp, Homo sapiens
gagcgcaagata

SEQ ID NO: 1761377 - DNA, 20 bp, Homo sapiens
gagcgcacctgccccctggt

SEQ ID NO: 1761378 - DNA, 14 bp, Homo sapiens
gagcgccagctcct

SEQ ID NO: 1761379 - DNA, 23 bp, Homo sapiens
gaggagctggcctgtggcacagc

SEQ ID NO: 1761380 - DNA, 19 bp, Homo sapiens
gaggagctgggagccgggc

SEQ ID NO: 1761381 - DNA, 14 bp, Homo sapiens
gaggagctgggccc

SEQ ID NO: 1761382 - DNA, 14 bp, Homo sapiens
gaggaggacacagc

SEQ ID NO: 1761383 - DNA, 15 bp, Homo sapiens
gaggaggaggacaca

SEQ ID NO: 1761384 - DNA, 14 bp, Homo sapiens
gaggaggaggagcc

SEQ ID NO: 1761385 - DNA, 15 bp, Homo sapiens
gaggaggaggagcct

SEQ ID NO: 1761386 - DNA, 15 bp, Homo sapiens
gaggaggccacctct

SEQ ID NO: 1761387 - DNA, 19 bp, Homo sapiens
gaggaggccacctctccaa

SEQ ID NO: 1761388 - DNA, 20 bp, Homo sapiens
gaggaggccacctctccaag

SEQ ID NO: 1761389 - DNA, 22 bp, Homo sapiens
gaggaggcccttaagggaagct

SEQ ID NO: 1761390 - DNA, 15 bp, Homo sapiens
gaggagggaatgatt

SEQ ID NO: 1761391 - DNA, 16 bp, Homo sapiens
gaggagggaatgattg

SEQ ID NO: 1761392 - DNA, 14 bp, Homo sapiens
gaggagggagaaga

SEQ ID NO: 1761393 - DNA, 14 bp, Homo sapiens
gaggagggaggcca

SEQ ID NO: 1761394 - DNA, 19 bp, Homo sapiens
gaggagggatgctgctccg

SEQ ID NO: 1761395 - DNA, 20 bp, Homo sapiens
gaggagggcgtgactcaccc

SEQ ID NO: 1761396 - DNA, 21 bp, Homo sapiens
gaggaggggaaggggctgagg

SEQ ID NO: 1761397 - DNA, 12 bp, Homo sapiens
gaggaggggagg

SEQ ID NO: 1761398 - DNA, 13 bp, Homo sapiens
gaggaggggaggg

SEQ ID NO: 1761399 - DNA, 15 bp, Homo sapiens
gaggagggtggggga

SEQ ID NO: 1761400 - DNA, 23 bp, Homo sapiens
gaggaggtgacaaaccatttcca

SEQ ID NO: 1761401 - DNA, 15 bp, Homo sapiens
gaggaggtggcagcc

SEQ ID NO: 1761402 - DNA, 20 bp, Homo sapiens
gaggaggtggcagccctgta

SEQ ID NO: 1761403 - DNA, 22 bp, Homo sapiens
gaggaggtggcagccctgtagg

SEQ ID NO: 1761404 - DNA, 18 bp, Homo sapiens
gaggaggtgtctggggtg

SEQ ID NO: 1761405 - DNA, 15 bp, Homo sapiens
gaggaggtgtgagga

SEQ ID NO: 1761406 - DNA, 20 bp, Homo sapiens
gaggagtaacaatacaaatg

SEQ ID NO: 1761407 - DNA, 22 bp, Homo sapiens
gaggagtaacaatacaaatgga

SEQ ID NO: 1761408 - DNA, 13 bp, Homo sapiens
gaggagtgaggaa

SEQ ID NO: 1761409 - DNA, 16 bp, Homo sapiens
gaggataaagaaaaga

SEQ ID NO: 1761410 - DNA, 17 bp, Homo sapiens
gaggataaagaaaagac

SEQ ID NO: 1761411 - DNA, 13 bp, Homo sapiens
gaggatacagagg

SEQ ID NO: 1761412 - DNA, 21 bp, Homo sapiens
gaggatacatttaataaaact

SEQ ID NO: 1761413 - DNA, 17 bp, Homo sapiens
gaggatatttattactt

SEQ ID NO: 1761414 - DNA, 20 bp, Homo sapiens
gaggatcactggagcccagg

SEQ ID NO: 1761415 - DNA, 16 bp, Homo sapiens
gaggatgccttttctg

SEQ ID NO: 1761416 - DNA, 17 bp, Homo sapiens
gaggatgccttttctgt

SEQ ID NO: 1761417 - DNA, 19 bp, Homo sapiens
gaggatgccttttctgtga

SEQ ID NO: 1761418 - DNA, 12 bp, Homo sapiens
gaggatggagag

SEQ ID NO: 1761419 - DNA, 13 bp, Homo sapiens
gaggatggagaga

SEQ ID NO: 1761420 - DNA, 22 bp, Homo sapiens
gaggatggtagaagtttggctg

SEQ ID NO: 1761421 - DNA, 15 bp, Homo sapiens
gaggatttcaagcct

SEQ ID NO: 1761422 - DNA, 15 bp, Homo sapiens
gaggatttctgggac

SEQ ID NO: 1761423 - DNA, 16 bp, Homo sapiens
gaggatttctgggacc

SEQ ID NO: 1761424 - DNA, 14 bp, Homo sapiens
gaggcaaacagcaa

SEQ ID NO: 1761425 - DNA, 16 bp, Homo sapiens
gaggcaaagctggctc

SEQ ID NO: 1761426 - DNA, 20 bp, Homo sapiens
gaggcaaagctggctcacct

SEQ ID NO: 1761427 - DNA, 14 bp, Homo sapiens
gaggcaacaggatt

SEQ ID NO: 1761428 - DNA, 13 bp, Homo sapiens
gaggcaagagaat

SEQ ID NO: 1761429 - DNA, 17 bp, Homo sapiens
gaggcaagctgaaattt

SEQ ID NO: 1761430 - DNA, 13 bp, Homo sapiens
gaggcaccagctc

SEQ ID NO: 1761431 - DNA, 14 bp, Homo sapiens
gaggcaccagctct

SEQ ID NO: 1761432 - DNA, 16 bp, Homo sapiens
gaggcaccagctctgt

SEQ ID NO: 1761433 - DNA, 21 bp, Homo sapiens
gaggcaccagctctgtggcct

SEQ ID NO: 1761434 - DNA, 13 bp, Homo sapiens
gaggcaccaggaa

SEQ ID NO: 1761435 - DNA, 17 bp, Homo sapiens
gaggcaccaggaagccg

SEQ ID NO: 1761436 - DNA, 17 bp, Homo sapiens
gaggcaccggcgctgca

SEQ ID NO: 1761437 - DNA, 18 bp, Homo sapiens
gaggcaccggcgctgcag

SEQ ID NO: 1761438 - DNA, 20 bp, Homo sapiens
gaggcaccggcgctgcaggt

SEQ ID NO: 1761439 - DNA, 22 bp, Homo sapiens
gaggcacgcaccactgcttccc

SEQ ID NO: 1761440 - DNA, 18 bp, Homo sapiens
gaggcactgaagtgctta

SEQ ID NO: 1761441 - DNA, 15 bp, Homo sapiens
gaggcacttccacct

SEQ ID NO: 1761442 - DNA, 14 bp, Homo sapiens
gaggcagaaagata

SEQ ID NO: 1761443 - DNA, 23 bp, Homo sapiens
gaggcagaaagatacagacattc

SEQ ID NO: 1761444 - DNA, 23 bp, Homo sapiens
gaggcagaagaattgaacccagg

SEQ ID NO: 1761445 - DNA, 16 bp, Homo sapiens
gaggcagacagcagct

SEQ ID NO: 1761446 - DNA, 19 bp, Homo sapiens
gaggcagacagcagctcag

SEQ ID NO: 1761447 - DNA, 21 bp, Homo sapiens
gaggcagacagcagctcaggc

SEQ ID NO: 1761448 - DNA, 13 bp, Homo sapiens
gaggcagcagagc

SEQ ID NO: 1761449 - DNA, 21 bp, Homo sapiens
gaggcagcgtgaaagcagatg

SEQ ID NO: 1761450 - DNA, 18 bp, Homo sapiens
gaggcaggcatggccctg

SEQ ID NO: 1761451 - DNA, 15 bp, Homo sapiens
gaggcagggagggga

SEQ ID NO: 1761452 - DNA, 17 bp, Homo sapiens
gaggcaggggctctgct

SEQ ID NO: 1761453 - DNA, 17 bp, Homo sapiens
gaggcaggggtcctgca

SEQ ID NO: 1761454 - DNA, 23 bp, Homo sapiens
gaggcaggggtcctgcaggtcct

SEQ ID NO: 1761455 - DNA, 10 bp, Homo sapiens
gaggcaggtg

SEQ ID NO: 1761456 - DNA, 20 bp, Homo sapiens
gaggcagtgatgacttgctg

SEQ ID NO: 1761457 - DNA, 14 bp, Homo sapiens
gaggcagtggctag

SEQ ID NO: 1761458 - DNA, 22 bp, Homo sapiens
gaggcagtgtggttatgttccc

SEQ ID NO: 1761459 - DNA, 20 bp, Homo sapiens
gaggcatcctacccttttct

SEQ ID NO: 1761460 - DNA, 22 bp, Homo sapiens
gaggcatgactaatgcttttta

SEQ ID NO: 1761461 - DNA, 15 bp, Homo sapiens
gaggcatggggcatg

SEQ ID NO: 1761462 - DNA, 19 bp, Homo sapiens
gaggcatggggcatgtcct

SEQ ID NO: 1761463 - DNA, 17 bp, Homo sapiens
gaggccaaccagcccga

SEQ ID NO: 1761464 - DNA, 14 bp, Homo sapiens
gaggccaagatggc

SEQ ID NO: 1761465 - DNA, 20 bp, Homo sapiens
gaggccaagatggctgctgc

SEQ ID NO: 1761466 - DNA, 13 bp, Homo sapiens
gaggccaaggcag

SEQ ID NO: 1761467 - DNA, 20 bp, Homo sapiens
gaggccacattgctggctgc

SEQ ID NO: 1761468 - DNA, 22 bp, Homo sapiens
gaggccacattgctggctgccc

SEQ ID NO: 1761469 - DNA, 18 bp, Homo sapiens
gaggccacccactgaccc

SEQ ID NO: 1761470 - DNA, 13 bp, Homo sapiens
gaggccaccggga

SEQ ID NO: 1761471 - DNA, 12 bp, Homo sapiens
gaggccacctct

SEQ ID NO: 1761472 - DNA, 14 bp, Homo sapiens
gaggccacctctcc

SEQ ID NO: 1761473 - DNA, 18 bp, Homo sapiens
gaggccacctctccaagg

SEQ ID NO: 1761474 - DNA, 20 bp, Homo sapiens
gaggccacctctccaagggc

SEQ ID NO: 1761475 - DNA, 21 bp, Homo sapiens
gaggccagaggcccccagccc

SEQ ID NO: 1761476 - DNA, 16 bp, Homo sapiens
gaggccagccccaccc

SEQ ID NO: 1761477 - DNA, 22 bp, Homo sapiens
gaggccagccccacccaggagg

SEQ ID NO: 1761478 - DNA, 12 bp, Homo sapiens
gaggccagcctg

SEQ ID NO: 1761479 - DNA, 20 bp, Homo sapiens
gaggccagggcagcaaggga

SEQ ID NO: 1761480 - DNA, 15 bp, Homo sapiens
gaggccagtaggaga

SEQ ID NO: 1761481 - DNA, 13 bp, Homo sapiens
gaggcccaaggag

SEQ ID NO: 1761482 - DNA, 15 bp, Homo sapiens
gaggcccactagagg

SEQ ID NO: 1761483 - DNA, 21 bp, Homo sapiens
gaggcccactagagggcccat

SEQ ID NO: 1761484 - DNA, 23 bp, Homo sapiens
gaggcccactagagggcccatca

SEQ ID NO: 1761485 - DNA, 16 bp, Homo sapiens
gaggcccagcccctcc

SEQ ID NO: 1761486 - DNA, 15 bp, Homo sapiens
gaggcccagcgggca

SEQ ID NO: 1761487 - DNA, 14 bp, Homo sapiens
gaggcccaggcacc

SEQ ID NO: 1761488 - DNA, 15 bp, Homo sapiens
gaggcccaggcacca

SEQ ID NO: 1761489 - DNA, 22 bp, Homo sapiens
gaggcccaggcaccaccaggag

SEQ ID NO: 1761490 - DNA, 23 bp, Homo sapiens
gaggcccaggcaccaccaggagc

SEQ ID NO: 1761491 - DNA, 15 bp, Homo sapiens
gaggcccaggctggg

SEQ ID NO: 1761492 - DNA, 17 bp, Homo sapiens
gaggcccaggctgggaa

SEQ ID NO: 1761493 - DNA, 13 bp, Homo sapiens
gaggcccagttca

SEQ ID NO: 1761494 - DNA, 15 bp, Homo sapiens
gaggtggaagccctc

SEQ ID NO: 1761495 - DNA, 13 bp, Homo sapiens
gaggtggagaaaa

SEQ ID NO: 1761496 - DNA, 22 bp, Homo sapiens
gaggtggagccaagtggtccag

SEQ ID NO: 1761497 - DNA, 19 bp, Homo sapiens
gaggtggagcttgcagtga

SEQ ID NO: 1761498 - DNA, 23 bp, Homo sapiens
gaggtggaggaagatagcgcata

SEQ ID NO: 1761499 - DNA, 16 bp, Homo sapiens
gaggtggagggaggga

SEQ ID NO: 1761500 - DNA, 18 bp, Homo sapiens
gaggtggagggagggaag

SEQ ID NO: 1761501 - DNA, 22 bp, Homo sapiens
gaggtggatgttatgaacagct

SEQ ID NO: 1761502 - DNA, 16 bp, Homo sapiens
gaggtggcagccctgt

SEQ ID NO: 1761503 - DNA, 14 bp, Homo sapiens
gaggtggctgggtt

SEQ ID NO: 1761504 - DNA, 18 bp, Homo sapiens
gaggtgggcagctgggcc

SEQ ID NO: 1761505 - DNA, 12 bp, Homo sapiens
gaggtgggcagg

SEQ ID NO: 1761506 - DNA, 14 bp, Homo sapiens
gaggtgggcaggtg

SEQ ID NO: 1761507 - DNA, 22 bp, Homo sapiens
gaggtgggcccaggaccagctg

SEQ ID NO: 1761508 - DNA, 16 bp, Homo sapiens
gaggtgggctggggct

SEQ ID NO: 1761509 - DNA, 24 bp, Homo sapiens
gaggtgggctggggctgctcccct

SEQ ID NO: 1761510 - DNA, 21 bp, Homo sapiens
gaggtgtctggggtgagggag

SEQ ID NO: 1761511 - DNA, 22 bp, Homo sapiens
gaggtgtctggggtgagggagt

SEQ ID NO: 1761512 - DNA, 15 bp, Homo sapiens
gaggtgtgggggctg

SEQ ID NO: 1761513 - DNA, 19 bp, Homo sapiens
gaggttactttagttagca

SEQ ID NO: 1761514 - DNA, 22 bp, Homo sapiens
gaggttataggtcactcctggg

SEQ ID NO: 1761515 - DNA, 18 bp, Homo sapiens
gaggttatctgcctggcc

SEQ ID NO: 1761516 - DNA, 22 bp, Homo sapiens
gaggttatctgcctggcctggc

SEQ ID NO: 1761517 - DNA, 14 bp, Homo sapiens
gaggttctaaggcc

SEQ ID NO: 1761518 - DNA, 14 bp, Homo sapiens
gaggttctgggcct

SEQ ID NO: 1761519 - DNA, 18 bp, Homo sapiens
gaggttgaaaaacaaaat

SEQ ID NO: 1761520 - DNA, 13 bp, Homo sapiens
gaggttgaagcca

SEQ ID NO: 1761521 - DNA, 16 bp, Homo sapiens
gaggttgcagcatgag

SEQ ID NO: 1761522 - DNA, 13 bp, Homo sapiens
gaggttgcaggga

SEQ ID NO: 1761523 - DNA, 15 bp, Homo sapiens
gaggttgcagtgagc

SEQ ID NO: 1761524 - DNA, 19 bp, Homo sapiens
gaggttgcagtgagctgag

SEQ ID NO: 1761525 - DNA, 12 bp, Homo sapiens
gaggttgggctt

SEQ ID NO: 1761526 - DNA, 17 bp, Homo sapiens
gaggttggggtgtacta

SEQ ID NO: 1761527 - DNA, 17 bp, Homo sapiens
gaggtttggtttcctgt

SEQ ID NO: 1761528 - DNA, 15 bp, Homo sapiens
gaggttttaaagtga

SEQ ID NO: 1761529 - DNA, 18 bp, Homo sapiens
gaggttttaatgtctgtt

SEQ ID NO: 1761530 - DNA, 18 bp, Homo sapiens
gaggttttattctgactt

SEQ ID NO: 1761531 - DNA, 15 bp, Homo sapiens
gagtaaaaactagaa

SEQ ID NO: 1761532 - DNA, 16 bp, Homo sapiens
gagtaaatacaggtag

SEQ ID NO: 1761533 - DNA, 18 bp, Homo sapiens
gagtaaatatatatgtca

SEQ ID NO: 1761534 - DNA, 15 bp, Homo sapiens
gagtaacaatacaaa

SEQ ID NO: 1761535 - DNA, 20 bp, Homo sapiens
gagtaacaatacaaatggat

SEQ ID NO: 1761536 - DNA, 21 bp, Homo sapiens
gagtaactatcgaaatgacgg

SEQ ID NO: 1761537 - DNA, 19 bp, Homo sapiens
gagtaactggttgctgtgt

SEQ ID NO: 1761538 - DNA, 15 bp, Homo sapiens
gagtaatcaggcagc

SEQ ID NO: 1761539 - DNA, 17 bp, Homo sapiens
gagtaatcaggcagcct

SEQ ID NO: 1761540 - DNA, 22 bp, Homo sapiens
gagtaatgggtttcatatttct

SEQ ID NO: 1761541 - DNA, 20 bp, Homo sapiens
gagtaatgtgactaaaggaa

SEQ ID NO: 1761542 - DNA, 14 bp, Homo sapiens
gagtaatttcattt

SEQ ID NO: 1761543 - DNA, 20 bp, Homo sapiens
gagtacagatactgtgagct

SEQ ID NO: 1761544 - DNA, 19 bp, Homo sapiens
gagtacctactgtgtgcca

SEQ ID NO: 1761545 - DNA, 22 bp, Homo sapiens
gagtacctgctgccccagctga

SEQ ID NO: 1761546 - DNA, 14 bp, Homo sapiens
gagtactatattta

SEQ ID NO: 1761547 - DNA, 20 bp, Homo sapiens
gagtactatatttgtgaata

SEQ ID NO: 1761548 - DNA, 13 bp, Homo sapiens
gagtagccaagct

SEQ ID NO: 1761549 - DNA, 19 bp, Homo sapiens
gagtagccgagagcctgct

SEQ ID NO: 1761550 - DNA, 17 bp, Homo sapiens
gagtagctagtttgctt

SEQ ID NO: 1761551 - DNA, 12 bp, Homo sapiens
gagtagctggat

SEQ ID NO: 1761552 - DNA, 11 bp, Homo sapiens
gagtaggccct

SEQ ID NO: 1761553 - DNA, 18 bp, Homo sapiens
gagtatgcttgggccctg

SEQ ID NO: 1761554 - DNA, 13 bp, Homo sapiens
gagtatttccctt

SEQ ID NO: 1761555 - DNA, 19 bp, Homo sapiens
gagtatttcccttccaaag

SEQ ID NO: 1761556 - DNA, 17 bp, Homo sapiens
gagtatttttaacactt

SEQ ID NO: 1761557 - DNA, 15 bp, Homo sapiens
gagtcaaaaattaaa

SEQ ID NO: 1761558 - DNA, 13 bp, Homo sapiens
gagtcaaaacaaa

SEQ ID NO: 1761559 - DNA, 21 bp, Homo sapiens
gagtcaaagctgaccatggat

SEQ ID NO: 1761560 - DNA, 14 bp, Homo sapiens
gagtcaaatccagt

SEQ ID NO: 1761561 - DNA, 17 bp, Homo sapiens
gagtcaaatccagtggt

SEQ ID NO: 1761562 - DNA, 18 bp, Homo sapiens
gagtcaaatccagtggtg

SEQ ID NO: 1761563 - DNA, 19 bp, Homo sapiens
gagtcaatcccctcattca

SEQ ID NO: 1761564 - DNA, 20 bp, Homo sapiens
gagtcaatcccctcattcag

SEQ ID NO: 1761565 - DNA, 12 bp, Homo sapiens
gagtcacacagt

SEQ ID NO: 1761566 - DNA, 13 bp, Homo sapiens
gagtcacctcctc

SEQ ID NO: 1761567 - DNA, 14 bp, Homo sapiens
gagtcacctcctcc

SEQ ID NO: 1761568 - DNA, 23 bp, Homo sapiens
gagtcacctcctccactcactcc

SEQ ID NO: 1761569 - DNA, 12 bp, Homo sapiens
gagtcacctgca

SEQ ID NO: 1761570 - DNA, 17 bp, Homo sapiens
gagtcacctgctccaga

SEQ ID NO: 1761571 - DNA, 18 bp, Homo sapiens
gagtcacctgctccagaa

SEQ ID NO: 1761572 - DNA, 12 bp, Homo sapiens
gagtcactgcct

SEQ ID NO: 1761573 - DNA, 22 bp, Homo sapiens
gagtcagaatgtgaaaaaggaa

SEQ ID NO: 1761574 - DNA, 13 bp, Homo sapiens
gagtcagaggaga

SEQ ID NO: 1761575 - DNA, 14 bp, Homo sapiens
gagtcagaggagaa

SEQ ID NO: 1761576 - DNA, 16 bp, Homo sapiens
gagtcagaggagaaga

SEQ ID NO: 1761577 - DNA, 21 bp, Homo sapiens
gagtcagcaccttggcccagg

SEQ ID NO: 1761578 - DNA, 14 bp, Homo sapiens
gagtcagctctctg

SEQ ID NO: 1761579 - DNA, 15 bp, Homo sapiens
gagtcagctctctgc

SEQ ID NO: 1761580 - DNA, 17 bp, Homo sapiens
gagtcagctctctgccc

SEQ ID NO: 1761581 - DNA, 19 bp, Homo sapiens
gagtcaggcttctcttgct

SEQ ID NO: 1761582 - DNA, 16 bp, Homo sapiens
gagtcataaaccttaa

SEQ ID NO: 1761583 - DNA, 13 bp, Homo sapiens
gagtcatctccat

SEQ ID NO: 1761584 - DNA, 18 bp, Homo sapiens
gagtcatgatctccctgc

SEQ ID NO: 1761585 - DNA, 21 bp, Homo sapiens
gagtccatttcccacatcttt

SEQ ID NO: 1761586 - DNA, 16 bp, Homo sapiens
gagtcccaaggaaagc

SEQ ID NO: 1761587 - DNA, 21 bp, Homo sapiens
gagtcccagagcaggaggccc

SEQ ID NO: 1761588 - DNA, 20 bp, Homo sapiens
gagtcccaggggcagccaca

SEQ ID NO: 1761589 - DNA, 21 bp, Homo sapiens
gagtcccaggggcagccacac

SEQ ID NO: 1761590 - DNA, 23 bp, Homo sapiens
gagtcccaggggcagccacacca

SEQ ID NO: 1761591 - DNA, 16 bp, Homo sapiens
gagtcccctccaggaa

SEQ ID NO: 1761592 - DNA, 11 bp, Homo sapiens
gagtccctcca

SEQ ID NO: 1761593 - DNA, 16 bp, Homo sapiens
gagtccctccaaaggg

SEQ ID NO: 1761594 - DNA, 21 bp, Homo sapiens
gagtccctgtgatggccaggc

SEQ ID NO: 1761595 - DNA, 21 bp, Homo sapiens
gagtcccttaatcttatgggg

SEQ ID NO: 1761596 - DNA, 17 bp, Homo sapiens
gagtcctaggacttaaa

SEQ ID NO: 1761597 - DNA, 20 bp, Homo sapiens
gagtcctgtctctgcctgcg

SEQ ID NO: 1761598 - DNA, 14 bp, Homo sapiens
gagtccttaaaatg

SEQ ID NO: 1761599 - DNA, 12 bp, Homo sapiens
gagtcggcccca

SEQ ID NO: 1761600 - DNA, 16 bp, Homo sapiens
gagtcggtctgctttg

SEQ ID NO: 1761601 - DNA, 17 bp, Homo sapiens
gagtcgtggggtgtgct

SEQ ID NO: 1761602 - DNA, 19 bp, Homo sapiens
gagtcgtggggtgtgctgg

SEQ ID NO: 1761603 - DNA, 11 bp, Homo sapiens
gagtctaaaga

SEQ ID NO: 1761604 - DNA, 18 bp, Homo sapiens
gagtctaatagtctttgc

SEQ ID NO: 1761605 - DNA, 19 bp, Homo sapiens
gagtctaatagtctttgcc

SEQ ID NO: 1761606 - DNA, 20 bp, Homo sapiens
gagtctagaagttgtttgtc

SEQ ID NO: 1761607 - DNA, 11 bp, Homo sapiens
gagtctagatt

SEQ ID NO: 1761608 - DNA, 13 bp, Homo sapiens
gagtctagattca

SEQ ID NO: 1761609 - DNA, 19 bp, Homo sapiens
gatctgatggtgagctggg

SEQ ID NO: 1761610 - DNA, 15 bp, Homo sapiens
gatctgcacagtcag

SEQ ID NO: 1761611 - DNA, 11 bp, Homo sapiens
gatctgcccat

SEQ ID NO: 1761612 - DNA, 14 bp, Homo sapiens
gatctgcctgggcc

SEQ ID NO: 1761613 - DNA, 15 bp, Homo sapiens
gatctgcctgggcct

SEQ ID NO: 1761614 - DNA, 18 bp, Homo sapiens
gatctgcctgggcctgtg

SEQ ID NO: 1761615 - DNA, 22 bp, Homo sapiens
gatctgcctgggcctgtgcagc

SEQ ID NO: 1761616 - DNA, 19 bp, Homo sapiens
gatctgcggatctcagctt

SEQ ID NO: 1761617 - DNA, 18 bp, Homo sapiens
gatctgctgggctctgcc

SEQ ID NO: 1761618 - DNA, 20 bp, Homo sapiens
gatctggaacccagactcag

SEQ ID NO: 1761619 - DNA, 16 bp, Homo sapiens
gatctggaacctcagc

SEQ ID NO: 1761620 - DNA, 19 bp, Homo sapiens
gatctggaacctcagcctg

SEQ ID NO: 1761621 - DNA, 16 bp, Homo sapiens
gatctggcacactccc

SEQ ID NO: 1761622 - DNA, 14 bp, Homo sapiens
gatctggggagagc

SEQ ID NO: 1761623 - DNA, 18 bp, Homo sapiens
gatctggggctctgggat

SEQ ID NO: 1761624 - DNA, 20 bp, Homo sapiens
gatctgtatatacaataaca

SEQ ID NO: 1761625 - DNA, 17 bp, Homo sapiens
gatctgtcctcagcctt

SEQ ID NO: 1761626 - DNA, 19 bp, Homo sapiens
gatctgtgacacatcgttt

SEQ ID NO: 1761627 - DNA, 15 bp, Homo sapiens
gatctgtgattggct

SEQ ID NO: 1761628 - DNA, 16 bp, Homo sapiens
gatctgtgattggctg

SEQ ID NO: 1761629 - DNA, 17 bp, Homo sapiens
gatctgtgattggctgg

SEQ ID NO: 1761630 - DNA, 18 bp, Homo sapiens
gatctgtgattggctggt

SEQ ID NO: 1761631 - DNA, 13 bp, Homo sapiens
gatctgtgcccca

SEQ ID NO: 1761632 - DNA, 18 bp, Homo sapiens
gatctgtgccccatgcct

SEQ ID NO: 1761633 - DNA, 13 bp, Homo sapiens
gatctgtgtggct

SEQ ID NO: 1761634 - DNA, 20 bp, Homo sapiens
gatctgtgtggctcctgggc

SEQ ID NO: 1761635 - DNA, 14 bp, Homo sapiens
gatctgttttctgg

SEQ ID NO: 1761636 - DNA, 17 bp, Homo sapiens
gatctgttttctggaag

SEQ ID NO: 1761637 - DNA, 22 bp, Homo sapiens
gatctgttttgtggtttggaat

SEQ ID NO: 1761638 - DNA, 13 bp, Homo sapiens
gatcttagattct

SEQ ID NO: 1761639 - DNA, 14 bp, Homo sapiens
gatcttagattctc

SEQ ID NO: 1761640 - DNA, 20 bp, Homo sapiens
gatcttctgggagcaggaac

SEQ ID NO: 1761641 - DNA, 16 bp, Homo sapiens
gatcttgagagctgct

SEQ ID NO: 1761642 - DNA, 19 bp, Homo sapiens
gatcttggcttactgcagc

SEQ ID NO: 1761643 - DNA, 15 bp, Homo sapiens
gatcttgtgctcagc

SEQ ID NO: 1761644 - DNA, 17 bp, Homo sapiens
gatcttgttactgtgat

SEQ ID NO: 1761645 - DNA, 12 bp, Homo sapiens
gatctttcagaa

SEQ ID NO: 1761646 - DNA, 18 bp, Homo sapiens
gatctttcagaaatataa

SEQ ID NO: 1761647 - DNA, 11 bp, Homo sapiens
gatctttcagg

SEQ ID NO: 1761648 - DNA, 13 bp, Homo sapiens
gatctttctagag

SEQ ID NO: 1761649 - DNA, 12 bp, Homo sapiens
gatctttctctt

SEQ ID NO: 1761650 - DNA, 18 bp, Homo sapiens
gatctttctttccaaaac

SEQ ID NO: 1761651 - DNA, 20 bp, Homo sapiens
gatctttctttccaaaacat

SEQ ID NO: 1761652 - DNA, 13 bp, Homo sapiens
gatctttgactga

SEQ ID NO: 1761653 - DNA, 15 bp, Homo sapiens
gatctttgactgaaa

SEQ ID NO: 1761654 - DNA, 17 bp, Homo sapiens
gatctttttatattctt

SEQ ID NO: 1761655 - DNA, 18 bp, Homo sapiens
gatgaaaaatatttctga

SEQ ID NO: 1761656 - DNA, 15 bp, Homo sapiens
gatgaaaaattatag

SEQ ID NO: 1761657 - DNA, 18 bp, Homo sapiens
gatgaaaactaaggattt

SEQ ID NO: 1761658 - DNA, 17 bp, Homo sapiens
gatgaaaagctttgttt

SEQ ID NO: 1761659 - DNA, 21 bp, Homo sapiens
gatgaaaagtatattgataac

SEQ ID NO: 1761660 - DNA, 14 bp, Homo sapiens
gatgaaaataattt

SEQ ID NO: 1761661 - DNA, 19 bp, Homo sapiens
gatgaaaataattttccaa

SEQ ID NO: 1761662 - DNA, 14 bp, Homo sapiens
gatgaaaatatttg

SEQ ID NO: 1761663 - DNA, 16 bp, Homo sapiens
gatgaaagttccccca

SEQ ID NO: 1761664 - DNA, 14 bp, Homo sapiens
gatgaacatctaac

SEQ ID NO: 1761665 - DNA, 13 bp, Homo sapiens
gatgaacctgcag

SEQ ID NO: 1761666 - DNA, 19 bp, Homo sapiens
gatgaacttattctgtaga

SEQ ID NO: 1761667 - DNA, 14 bp, Homo sapiens
gatgaatatgagct

SEQ ID NO: 1761668 - DNA, 18 bp, Homo sapiens
gatgaatctacatttgtt

SEQ ID NO: 1761669 - DNA, 23 bp, Homo sapiens
gatgaatgaggtcccaggcagag

SEQ ID NO: 1761670 - DNA, 15 bp, Homo sapiens
gatgaatgccgtgga

SEQ ID NO: 1761671 - DNA, 14 bp, Homo sapiens
gatgaatgtactat

SEQ ID NO: 1761672 - DNA, 16 bp, Homo sapiens
gatgaatgtactatgt

SEQ ID NO: 1761673 - DNA, 14 bp, Homo sapiens
gatgaatgtattta

SEQ ID NO: 1761674 - DNA, 15 bp, Homo sapiens
gatgaattgataaaa

SEQ ID NO: 1761675 - DNA, 20 bp, Homo sapiens
gatgaattttctgcagctgt

SEQ ID NO: 1761676 - DNA, 16 bp, Homo sapiens
gatgacaaaatggaaa

SEQ ID NO: 1761677 - DNA, 17 bp, Homo sapiens
gatgacaacttcccagt

SEQ ID NO: 1761678 - DNA, 18 bp, Homo sapiens
gatgacacataaatctgt

SEQ ID NO: 1761679 - DNA, 17 bp, Homo sapiens
gatgacaccctggcctg

SEQ ID NO: 1761680 - DNA, 22 bp, Homo sapiens
gatgacataaaatttacattta

SEQ ID NO: 1761681 - DNA, 17 bp, Homo sapiens
gatgaccagggatgctg

SEQ ID NO: 1761682 - DNA, 21 bp, Homo sapiens
gatgacgacgacaacgatgat

SEQ ID NO: 1761683 - DNA, 18 bp, Homo sapiens
gatgactaaaatatttat

SEQ ID NO: 1761684 - DNA, 13 bp, Homo sapiens
gatgactctctcc

SEQ ID NO: 1761685 - DNA, 23 bp, Homo sapiens
gatgacttagcgtcaagacattt

SEQ ID NO: 1761686 - DNA, 12 bp, Homo sapiens
gatgagaaaaaa

SEQ ID NO: 1761687 - DNA, 17 bp, Homo sapiens
gatgagaaacagctcag

SEQ ID NO: 1761688 - DNA, 20 bp, Homo sapiens
gatgagaacagataaagatt

SEQ ID NO: 1761689 - DNA, 17 bp, Homo sapiens
gatgagatttgccagca

SEQ ID NO: 1761690 - DNA, 19 bp, Homo sapiens
gatgaggcaaacagcaaga

SEQ ID NO: 1761691 - DNA, 22 bp, Homo sapiens
gatgaggccgctagaggcctga

SEQ ID NO: 1761692 - DNA, 12 bp, Homo sapiens
gatgagggaagg

SEQ ID NO: 1761693 - DNA, 20 bp, Homo sapiens
gatgagtgattgacacacag

SEQ ID NO: 1761694 - DNA, 18 bp, Homo sapiens
gatgatacaagattagaa

SEQ ID NO: 1761695 - DNA, 19 bp, Homo sapiens
gatgatcagctgtttgtca

SEQ ID NO: 1761696 - DNA, 22 bp, Homo sapiens
gatgatcccagtcactcctctc

SEQ ID NO: 1761697 - DNA, 21 bp, Homo sapiens
gatgatctactcagaaatttt

SEQ ID NO: 1761698 - DNA, 16 bp, Homo sapiens
gatgatctttaaaata

SEQ ID NO: 1761699 - DNA, 16 bp, Homo sapiens
gatgatgaaaactaag

SEQ ID NO: 1761700 - DNA, 14 bp, Homo sapiens
gatgatgatgaaaa

SEQ ID NO: 1761701 - DNA, 14 bp, Homo sapiens
gatgatgctgccag

SEQ ID NO: 1761702 - DNA, 16 bp, Homo sapiens
gatgatgtctcttgta

SEQ ID NO: 1761703 - DNA, 23 bp, Homo sapiens
gatgattaaataagattctaacg

SEQ ID NO: 1761704 - DNA, 23 bp, Homo sapiens
gatgattctggattctaaacaac

SEQ ID NO: 1761705 - DNA, 20 bp, Homo sapiens
gatgattgcttgagctcagg

SEQ ID NO: 1761706 - DNA, 14 bp, Homo sapiens
gatgcaaagaaaat

SEQ ID NO: 1761707 - DNA, 15 bp, Homo sapiens
gatgcacatttctgg

SEQ ID NO: 1761708 - DNA, 17 bp, Homo sapiens
gatgcacatttctggat

SEQ ID NO: 1761709 - DNA, 19 bp, Homo sapiens
gatgcacgtggggcccact

SEQ ID NO: 1761710 - DNA, 23 bp, Homo sapiens
gatgcacgtggggcccactgctc

SEQ ID NO: 1761711 - DNA, 16 bp, Homo sapiens
gatgcagagtaagtat

SEQ ID NO: 1761712 - DNA, 12 bp, Homo sapiens
gatgcagctact

SEQ ID NO: 1761713 - DNA, 18 bp, Homo sapiens
gatgcagctactggaatg

SEQ ID NO: 1761714 - DNA, 14 bp, Homo sapiens
gatgcagtgcttcc

SEQ ID NO: 1761715 - DNA, 18 bp, Homo sapiens
gatgcatacagttttcta

SEQ ID NO: 1761716 - DNA, 20 bp, Homo sapiens
gatgcatggcctctaagagt

SEQ ID NO: 1761717 - DNA, 17 bp, Homo sapiens
gatgcatgtcttttaaa

SEQ ID NO: 1761718 - DNA, 22 bp, Homo sapiens
gatgcatgtcttttaaaatgca

SEQ ID NO: 1761719 - DNA, 16 bp, Homo sapiens
gatgcatttaataaag

SEQ ID NO: 1761720 - DNA, 21 bp, Homo sapiens
gatgcatttaataaagatgag

SEQ ID NO: 1761721 - DNA, 17 bp, Homo sapiens
gatgccacacagagtgg

SEQ ID NO: 1761722 - DNA, 12 bp, Homo sapiens
gatgccacccta

SEQ ID NO: 1761723 - DNA, 15 bp, Homo sapiens
gatgccaccggcctg

SEQ ID NO: 1761724 - DNA, 18 bp, Homo sapiens
gattctggatctcctgct

SEQ ID NO: 1761725 - DNA, 19 bp, Homo sapiens
gattctggatggccgggct

SEQ ID NO: 1761726 - DNA, 23 bp, Homo sapiens
gattctggatggccgggctgctg

SEQ ID NO: 1761727 - DNA, 16 bp, Homo sapiens
gattctggctttaagc

SEQ ID NO: 1761728 - DNA, 15 bp, Homo sapiens
gattctgggaggaag

SEQ ID NO: 1761729 - DNA, 22 bp, Homo sapiens
gattctgggaggaagcaggttg

SEQ ID NO: 1761730 - DNA, 22 bp, Homo sapiens
gattctgggaggcaagaaaagg

SEQ ID NO: 1761731 - DNA, 22 bp, Homo sapiens
gattctggttccagggtccctc

SEQ ID NO: 1761732 - DNA, 22 bp, Homo sapiens
gattctgtgtcagagcccagcc

SEQ ID NO: 1761733 - DNA, 21 bp, Homo sapiens
gattctgtttattcttccaga

SEQ ID NO: 1761734 - DNA, 18 bp, Homo sapiens
gattcttcccgctcccca

SEQ ID NO: 1761735 - DNA, 16 bp, Homo sapiens
gattcttctgtgttta

SEQ ID NO: 1761736 - DNA, 17 bp, Homo sapiens
gattcttgattcctggc

SEQ ID NO: 1761737 - DNA, 18 bp, Homo sapiens
gattcttgtaaatctttt

SEQ ID NO: 1761738 - DNA, 14 bp, Homo sapiens
gattctttaaggag

SEQ ID NO: 1761739 - DNA, 19 bp, Homo sapiens
gattctttaatagaagttt

SEQ ID NO: 1761740 - DNA, 14 bp, Homo sapiens
gattctttccccag

SEQ ID NO: 1761741 - DNA, 15 bp, Homo sapiens
gattctttccccaga

SEQ ID NO: 1761742 - DNA, 21 bp, Homo sapiens
gattgaagtattttgctggaa

SEQ ID NO: 1761743 - DNA, 16 bp, Homo sapiens
gattgaatgtgtgatg

SEQ ID NO: 1761744 - DNA, 15 bp, Homo sapiens
gattgacacacagca

SEQ ID NO: 1761745 - DNA, 13 bp, Homo sapiens
gattgagaaagat

SEQ ID NO: 1761746 - DNA, 17 bp, Homo sapiens
gattgaggggccctggc

SEQ ID NO: 1761747 - DNA, 19 bp, Homo sapiens
gattgatatctataaaata

SEQ ID NO: 1761748 - DNA, 17 bp, Homo sapiens
gattgattttaaaatgt

SEQ ID NO: 1761749 - DNA, 21 bp, Homo sapiens
gattgcaatatctgaagccct

SEQ ID NO: 1761750 - DNA, 19 bp, Homo sapiens
gattgcacgtggcctcttg

SEQ ID NO: 1761751 - DNA, 20 bp, Homo sapiens
gattgcacgtggcctcttga

SEQ ID NO: 1761752 - DNA, 18 bp, Homo sapiens
gattgcagaaaggagaga

SEQ ID NO: 1761753 - DNA, 21 bp, Homo sapiens
gattgcagaaaggagagacgt

SEQ ID NO: 1761754 - DNA, 16 bp, Homo sapiens
gattgcagaattgttt

SEQ ID NO: 1761755 - DNA, 11 bp, Homo sapiens
gattgcagctt

SEQ ID NO: 1761756 - DNA, 14 bp, Homo sapiens
gattgcccctggct

SEQ ID NO: 1761757 - DNA, 20 bp, Homo sapiens
gattgcccctggctttgcct

SEQ ID NO: 1761758 - DNA, 13 bp, Homo sapiens
gattgcctctgaa

SEQ ID NO: 1761759 - DNA, 13 bp, Homo sapiens
gattgctccagag

SEQ ID NO: 1761760 - DNA, 13 bp, Homo sapiens
gattgctgaggca

SEQ ID NO: 1761761 - DNA, 23 bp, Homo sapiens
gattgctgtgtgttgcctgggac

SEQ ID NO: 1761762 - DNA, 18 bp, Homo sapiens
gattgcttaaaatagcaa

SEQ ID NO: 1761763 - DNA, 18 bp, Homo sapiens
gattgcttgagctcagga

SEQ ID NO: 1761764 - DNA, 21 bp, Homo sapiens
gattgctttgcattactgtcc

SEQ ID NO: 1761765 - DNA, 22 bp, Homo sapiens
gattggacaggagatcagcagc

SEQ ID NO: 1761766 - DNA, 11 bp, Homo sapiens
gattggattat

SEQ ID NO: 1761767 - DNA, 14 bp, Homo sapiens
gattggattattca

SEQ ID NO: 1761768 - DNA, 20 bp, Homo sapiens
gattggcctgtagagttgct

SEQ ID NO: 1761769 - DNA, 23 bp, Homo sapiens
gattggcctgtagagttgctgag

SEQ ID NO: 1761770 - DNA, 17 bp, Homo sapiens
gattggctcacactgag

SEQ ID NO: 1761771 - DNA, 18 bp, Homo sapiens
gattggctcacactgaga

SEQ ID NO: 1761772 - DNA, 16 bp, Homo sapiens
gattggctttaaacac

SEQ ID NO: 1761773 - DNA, 17 bp, Homo sapiens
gattgggggctggtgcc

SEQ ID NO: 1761774 - DNA, 20 bp, Homo sapiens
gattggtgattcaaagtgtt

SEQ ID NO: 1761775 - DNA, 15 bp, Homo sapiens
gattggttgtgcctt

SEQ ID NO: 1761776 - DNA, 19 bp, Homo sapiens
gattggttgtgccttccct

SEQ ID NO: 1761777 - DNA, 11 bp, Homo sapiens
gattgtacacg

SEQ ID NO: 1761778 - DNA, 20 bp, Homo sapiens
gattgtattgttgaaaaagt

SEQ ID NO: 1761779 - DNA, 11 bp, Homo sapiens
gattgtgtaca

SEQ ID NO: 1761780 - DNA, 21 bp, Homo sapiens
gattgtgtggtgttttggatt

SEQ ID NO: 1761781 - DNA, 16 bp, Homo sapiens
gattgttaaaataact

SEQ ID NO: 1761782 - DNA, 22 bp, Homo sapiens
gattgtttaaagaagctctcca

SEQ ID NO: 1761783 - DNA, 21 bp, Homo sapiens
gatttaaagtgaacacacaca

SEQ ID NO: 1761784 - DNA, 19 bp, Homo sapiens
gatttaacagtcatttaaa

SEQ ID NO: 1761785 - DNA, 21 bp, Homo sapiens
gatttaagcaaaggctccctc

SEQ ID NO: 1761786 - DNA, 15 bp, Homo sapiens
gatttaagccttaca

SEQ ID NO: 1761787 - DNA, 20 bp, Homo sapiens
gatttaagccttacaaaggg

SEQ ID NO: 1761788 - DNA, 13 bp, Homo sapiens
gatttaaggtatt

SEQ ID NO: 1761789 - DNA, 10 bp, Homo sapiens
gatttacatt

SEQ ID NO: 1761790 - DNA, 20 bp, Homo sapiens
gatttagaaaaaagtttaca

SEQ ID NO: 1761791 - DNA, 16 bp, Homo sapiens
gatttagatatgcaaa

SEQ ID NO: 1761792 - DNA, 14 bp, Homo sapiens
gatttagctattta

SEQ ID NO: 1761793 - DNA, 20 bp, Homo sapiens
gatttagctatttattgttc

SEQ ID NO: 1761794 - DNA, 18 bp, Homo sapiens
gatttagctgtggctccc

SEQ ID NO: 1761795 - DNA, 20 bp, Homo sapiens
gatttaggagaagccaggaa

SEQ ID NO: 1761796 - DNA, 14 bp, Homo sapiens
gatttatcaaatca

SEQ ID NO: 1761797 - DNA, 12 bp, Homo sapiens
gatttattgtaa

SEQ ID NO: 1761798 - DNA, 12 bp, Homo sapiens
gatttatttgga

SEQ ID NO: 1761799 - DNA, 16 bp, Homo sapiens
gatttatttggagtgg

SEQ ID NO: 1761800 - DNA, 11 bp, Homo sapiens
gatttcaaact

SEQ ID NO: 1761801 - DNA, 20 bp, Homo sapiens
gatttcaaacttaaacaaaa

SEQ ID NO: 1761802 - DNA, 21 bp, Homo sapiens
gatttcaacatgagtgtattt

SEQ ID NO: 1761803 - DNA, 15 bp, Homo sapiens
gatttcaagcctgcc

SEQ ID NO: 1761804 - DNA, 14 bp, Homo sapiens
gatttcactaggac

SEQ ID NO: 1761805 - DNA, 16 bp, Homo sapiens
gatttcagaggctgca

SEQ ID NO: 1761806 - DNA, 16 bp, Homo sapiens
gatttcagtttttcat

SEQ ID NO: 1761807 - DNA, 21 bp, Homo sapiens
gatttcagtttttcatttgtt

SEQ ID NO: 1761808 - DNA, 16 bp, Homo sapiens
gatttcatacctcaga

SEQ ID NO: 1761809 - DNA, 15 bp, Homo sapiens
gatttcatactgtaa

SEQ ID NO: 1761810 - DNA, 17 bp, Homo sapiens
gatttcatctgctctcc

SEQ ID NO: 1761811 - DNA, 20 bp, Homo sapiens
gatttcatctgctctccttc

SEQ ID NO: 1761812 - DNA, 21 bp, Homo sapiens
gatttcatctgctctccttcc

SEQ ID NO: 1761813 - DNA, 22 bp, Homo sapiens
gatttcatctgctctccttcct

SEQ ID NO: 1761814 - DNA, 16 bp, Homo sapiens
gatttcatcttctgga

SEQ ID NO: 1761815 - DNA, 18 bp, Homo sapiens
gatttcatcttctggaat

SEQ ID NO: 1761816 - DNA, 13 bp, Homo sapiens
gatttcatgattt

SEQ ID NO: 1761817 - DNA, 19 bp, Homo sapiens
gatttccagaaccacactt

SEQ ID NO: 1761818 - DNA, 18 bp, Homo sapiens
gatttccaggcccctgag

SEQ ID NO: 1761819 - DNA, 18 bp, Homo sapiens
gatttccatgggccccac

SEQ ID NO: 1761820 - DNA, 12 bp, Homo sapiens
gatttcccctct

SEQ ID NO: 1761821 - DNA, 22 bp, Homo sapiens
gatttcctacagaaatactgct

SEQ ID NO: 1761822 - DNA, 16 bp, Homo sapiens
gatttctcattgactt

SEQ ID NO: 1761823 - DNA, 22 bp, Homo sapiens
gatttctcattgacttttataa

SEQ ID NO: 1761824 - DNA, 10 bp, Homo sapiens
gatttctctg

SEQ ID NO: 1761825 - DNA, 11 bp, Homo sapiens
gatttctggga

SEQ ID NO: 1761826 - DNA, 14 bp, Homo sapiens
gatttctgttcagc

SEQ ID NO: 1761827 - DNA, 19 bp, Homo sapiens
gatttcttcgctgctctag

SEQ ID NO: 1761828 - DNA, 11 bp, Homo sapiens
gatttctttcc

SEQ ID NO: 1761829 - DNA, 23 bp, Homo sapiens
gatttctttctttgcaccaaaga

SEQ ID NO: 1761830 - DNA, 19 bp, Homo sapiens
gatttgatgagttaactgt

SEQ ID NO: 1761831 - DNA, 16 bp, Homo sapiens
gatttgattcattttc

SEQ ID NO: 1761832 - DNA, 21 bp, Homo sapiens
gatttgattcattttcctgtt

SEQ ID NO: 1761833 - DNA, 11 bp, Homo sapiens
gatttgcaata

SEQ ID NO: 1761834 - DNA, 19 bp, Homo sapiens
gatttgcaggattcccttc

SEQ ID NO: 1761835 - DNA, 15 bp, Homo sapiens
gatttgcctgtgcca

SEQ ID NO: 1761836 - DNA, 19 bp, Homo sapiens
gatttggcactagccaaag

SEQ ID NO: 1761837 - DNA, 20 bp, Homo sapiens
gatttggggctcagagtggg

SEQ ID NO: 1761838 - DNA, 16 bp, Homo sapiens
gatttgtagcactgag

SEQ ID NO: 1761839 - DNA, 20 bp, Homo sapiens
gcaagttttccctgaagtta

SEQ ID NO: 1761840 - DNA, 13 bp, Homo sapiens
gcaataaaattta

SEQ ID NO: 1761841 - DNA, 21 bp, Homo sapiens
gcaataaatctgacccagtgc

SEQ ID NO: 1761842 - DNA, 15 bp, Homo sapiens
gcaataactctggga

SEQ ID NO: 1761843 - DNA, 18 bp, Homo sapiens
gcaataatggtcccatcc

SEQ ID NO: 1761844 - DNA, 20 bp, Homo sapiens
gcaataatggtcccatccag

SEQ ID NO: 1761845 - DNA, 22 bp, Homo sapiens
gcaataatggtcccatccaggc

SEQ ID NO: 1761846 - DNA, 13 bp, Homo sapiens
gcaataattgttt

SEQ ID NO: 1761847 - DNA, 19 bp, Homo sapiens
gcaataatttgtacaatgg

SEQ ID NO: 1761848 - DNA, 20 bp, Homo sapiens
gcaataatttgtacaatggt

SEQ ID NO: 1761849 - DNA, 20 bp, Homo sapiens
gcaatacgtttgtgcagaat

SEQ ID NO: 1761850 - DNA, 21 bp, Homo sapiens
gcaatagttttttacttctct

SEQ ID NO: 1761851 - DNA, 16 bp, Homo sapiens
gcaatataagcataaa

SEQ ID NO: 1761852 - DNA, 17 bp, Homo sapiens
gcaatataagcataaaa

SEQ ID NO: 1761853 - DNA, 14 bp, Homo sapiens
gcaatatagaaaca

SEQ ID NO: 1761854 - DNA, 11 bp, Homo sapiens
gcaatatataa

SEQ ID NO: 1761855 - DNA, 21 bp, Homo sapiens
gcaatattctgtaactattgg

SEQ ID NO: 1761856 - DNA, 18 bp, Homo sapiens
gcaatatttgaattttaa

SEQ ID NO: 1761857 - DNA, 23 bp, Homo sapiens
gcaatcacacgactgtcatctaa

SEQ ID NO: 1761858 - DNA, 23 bp, Homo sapiens
gcaatcctcccacttcagcctcc

SEQ ID NO: 1761859 - DNA, 16 bp, Homo sapiens
gcaatgaaaaattctc

SEQ ID NO: 1761860 - DNA, 21 bp, Homo sapiens
gcaatgcaaatgtctaattgt

SEQ ID NO: 1761861 - DNA, 20 bp, Homo sapiens
gcaatggatcagccaaggcc

SEQ ID NO: 1761862 - DNA, 22 bp, Homo sapiens
gcaatggtgtcagtatccaggc

SEQ ID NO: 1761863 - DNA, 17 bp, Homo sapiens
gcaatgtaagcatactt

SEQ ID NO: 1761864 - DNA, 20 bp, Homo sapiens
gcaatgtactcttccgatgt

SEQ ID NO: 1761865 - DNA, 23 bp, Homo sapiens
gcaatgtactcttccgatgtttg

SEQ ID NO: 1761866 - DNA, 14 bp, Homo sapiens
gcaatgtatagtgt

SEQ ID NO: 1761867 - DNA, 22 bp, Homo sapiens
gcaatgtatttagctacagctt

SEQ ID NO: 1761868 - DNA, 15 bp, Homo sapiens
gcaatgtgccttgat

SEQ ID NO: 1761869 - DNA, 14 bp, Homo sapiens
gcaatgtgctactg

SEQ ID NO: 1761870 - DNA, 22 bp, Homo sapiens
gcaattaaacttccaaagaaag

SEQ ID NO: 1761871 - DNA, 18 bp, Homo sapiens
gcaattagtctgaaactg

SEQ ID NO: 1761872 - DNA, 21 bp, Homo sapiens
gcaattagtctgaaactggct

SEQ ID NO: 1761873 - DNA, 16 bp, Homo sapiens
gcaattccaggctgag

SEQ ID NO: 1761874 - DNA, 20 bp, Homo sapiens
gcaattccaggctgagccat

SEQ ID NO: 1761875 - DNA, 18 bp, Homo sapiens
gcaattcccctctgctgc

SEQ ID NO: 1761876 - DNA, 23 bp, Homo sapiens
gcaattctcctgcctcagcctcc

SEQ ID NO: 1761877 - DNA, 15 bp, Homo sapiens
gcaattctgactgtc

SEQ ID NO: 1761878 - DNA, 14 bp, Homo sapiens
gcaattgccctgta

SEQ ID NO: 1761879 - DNA, 23 bp, Homo sapiens
gcaatttaatattttgcacagtt

SEQ ID NO: 1761880 - DNA, 18 bp, Homo sapiens
gcaatttcaaggttctaa

SEQ ID NO: 1761881 - DNA, 14 bp, Homo sapiens
gcaatttcatatgc

SEQ ID NO: 1761882 - DNA, 18 bp, Homo sapiens
gcaatttccttttttgtt

SEQ ID NO: 1761883 - DNA, 19 bp, Homo sapiens
gcaatttctaatttttaag

SEQ ID NO: 1761884 - DNA, 22 bp, Homo sapiens
gcaatttctaatttttaagaat

SEQ ID NO: 1761885 - DNA, 20 bp, Homo sapiens
gcaattttagtgtattaatc

SEQ ID NO: 1761886 - DNA, 14 bp, Homo sapiens
gcaattttgtaacg

SEQ ID NO: 1761887 - DNA, 13 bp, Homo sapiens
gcacaaaaaatga

SEQ ID NO: 1761888 - DNA, 14 bp, Homo sapiens
gcacaaaagcagat

SEQ ID NO: 1761889 - DNA, 13 bp, Homo sapiens
gcacaaacatgaa

SEQ ID NO: 1761890 - DNA, 22 bp, Homo sapiens
gcacaaacttgtgagcatcaga

SEQ ID NO: 1761891 - DNA, 13 bp, Homo sapiens
gcacaaagctcaa

SEQ ID NO: 1761892 - DNA, 19 bp, Homo sapiens
gcacaagaggaagagagag

SEQ ID NO: 1761893 - DNA, 17 bp, Homo sapiens
gcacaagccagggtgtg

SEQ ID NO: 1761894 - DNA, 18 bp, Homo sapiens
gcacaagtaacacatttg

SEQ ID NO: 1761895 - DNA, 17 bp, Homo sapiens
gcacaatctgtaaattt

SEQ ID NO: 1761896 - DNA, 20 bp, Homo sapiens
gcacaatggtcttacattgg

SEQ ID NO: 1761897 - DNA, 18 bp, Homo sapiens
gcacacacaaacctactg

SEQ ID NO: 1761898 - DNA, 12 bp, Homo sapiens
gcacacacacaa

SEQ ID NO: 1761899 - DNA, 13 bp, Homo sapiens
gcacacacatctg

SEQ ID NO: 1761900 - DNA, 16 bp, Homo sapiens
gcacacacatctggcc

SEQ ID NO: 1761901 - DNA, 21 bp, Homo sapiens
gcacacacatctggccctgac

SEQ ID NO: 1761902 - DNA, 22 bp, Homo sapiens
gcacacaccaccacgcctggct

SEQ ID NO: 1761903 - DNA, 13 bp, Homo sapiens
gcacacagactgg

SEQ ID NO: 1761904 - DNA, 18 bp, Homo sapiens
gcacacagctactctccc

SEQ ID NO: 1761905 - DNA, 16 bp, Homo sapiens
gcacacagctgagcac

SEQ ID NO: 1761906 - DNA, 23 bp, Homo sapiens
gcacacagctgagcacttagcag

SEQ ID NO: 1761907 - DNA, 13 bp, Homo sapiens
gcacacaggacag

SEQ ID NO: 1761908 - DNA, 22 bp, Homo sapiens
gcacacagtacacaccagaaga

SEQ ID NO: 1761909 - DNA, 14 bp, Homo sapiens
gcacacatatatag

SEQ ID NO: 1761910 - DNA, 21 bp, Homo sapiens
gcacaccactgccctgcctgc

SEQ ID NO: 1761911 - DNA, 15 bp, Homo sapiens
gcacaccagccgctg

SEQ ID NO: 1761912 - DNA, 19 bp, Homo sapiens
gcacaccagccgctgcagg

SEQ ID NO: 1761913 - DNA, 16 bp, Homo sapiens
gcacacccctggggct

SEQ ID NO: 1761914 - DNA, 15 bp, Homo sapiens
gcacacccgtgtgca

SEQ ID NO: 1761915 - DNA, 15 bp, Homo sapiens
gcacacctcagcccc

SEQ ID NO: 1761916 - DNA, 16 bp, Homo sapiens
gcacacctcagcccca

SEQ ID NO: 1761917 - DNA, 21 bp, Homo sapiens
gcacaccttttccccaggagc

SEQ ID NO: 1761918 - DNA, 20 bp, Homo sapiens
gcacacggctggtcactctg

SEQ ID NO: 1761919 - DNA, 22 bp, Homo sapiens
gcacacggctggtcactctgcc

SEQ ID NO: 1761920 - DNA, 22 bp, Homo sapiens
gcacacgggaaagccttaaaaa

SEQ ID NO: 1761921 - DNA, 14 bp, Homo sapiens
gcacacgggcgagc

SEQ ID NO: 1761922 - DNA, 15 bp, Homo sapiens
gcacactcccctgca

SEQ ID NO: 1761923 - DNA, 13 bp, Homo sapiens
gcacactccctct

SEQ ID NO: 1761924 - DNA, 13 bp, Homo sapiens
gcacactgaggcc

SEQ ID NO: 1761925 - DNA, 11 bp, Homo sapiens
gcacacttccc

SEQ ID NO: 1761926 - DNA, 21 bp, Homo sapiens
gcacacttccccatctttgat

SEQ ID NO: 1761927 - DNA, 20 bp, Homo sapiens
gcacagaaacacaatatttt

SEQ ID NO: 1761928 - DNA, 21 bp, Homo sapiens
gcacagaaggaatctgtgcag

SEQ ID NO: 1761929 - DNA, 14 bp, Homo sapiens
gcacagaatatttt

SEQ ID NO: 1761930 - DNA, 15 bp, Homo sapiens
gcacagacaagcagc

SEQ ID NO: 1761931 - DNA, 17 bp, Homo sapiens
gcacagacacgctcgcg

SEQ ID NO: 1761932 - DNA, 21 bp, Homo sapiens
gcacagacttctggaaggctg

SEQ ID NO: 1761933 - DNA, 22 bp, Homo sapiens
gcacagagcgtccttccccctg

SEQ ID NO: 1761934 - DNA, 17 bp, Homo sapiens
gcacagatatttccatt

SEQ ID NO: 1761935 - DNA, 23 bp, Homo sapiens
gcacagcaccgggggagagggac

SEQ ID NO: 1761936 - DNA, 23 bp, Homo sapiens
gcacagcatttgctttcctctga

SEQ ID NO: 1761937 - DNA, 17 bp, Homo sapiens
gcacagccaaatttaaa

SEQ ID NO: 1761938 - DNA, 16 bp, Homo sapiens
gcacagccacccgtgg

SEQ ID NO: 1761939 - DNA, 23 bp, Homo sapiens
gcacagccacccgtggggtgctg

SEQ ID NO: 1761940 - DNA, 23 bp, Homo sapiens
gcacagccctccgaccctcatgg

SEQ ID NO: 1761941 - DNA, 16 bp, Homo sapiens
gcacagccctgagtgt

SEQ ID NO: 1761942 - DNA, 20 bp, Homo sapiens
gcacagccctgagtgtccca

SEQ ID NO: 1761943 - DNA, 12 bp, Homo sapiens
gcacagccctgg

SEQ ID NO: 1761944 - DNA, 13 bp, Homo sapiens
gcacagccctggg

SEQ ID NO: 1761945 - DNA, 11 bp, Homo sapiens
gcacagccctt

SEQ ID NO: 1761946 - DNA, 23 bp, Homo sapiens
gcacagcctagggtcttgggggt

SEQ ID NO: 1761947 - DNA, 12 bp, Homo sapiens
gcacagctgctt

SEQ ID NO: 1761948 - DNA, 16 bp, Homo sapiens
gcacagctgtagtggg

SEQ ID NO: 1761949 - DNA, 18 bp, Homo sapiens
gcacagcttgacctgagg

SEQ ID NO: 1761950 - DNA, 22 bp, Homo sapiens
gcacagcttgacctgaggctgt

SEQ ID NO: 1761951 - DNA, 16 bp, Homo sapiens
gcacaggaggcaggca

SEQ ID NO: 1761952 - DNA, 21 bp, Homo sapiens
gcacaggaggcaggcatggcc

SEQ ID NO: 1761953 - DNA, 19 bp, Homo sapiens
gcagaagtctggctttgct

SEQ ID NO: 1761954 - DNA, 21 bp, Homo sapiens
gcagaagtgctctttgtggca

SEQ ID NO: 1761955 - DNA, 18 bp, Homo sapiens
gcagaataatctttgggt

SEQ ID NO: 1761956 - DNA, 16 bp, Homo sapiens
gcagaatactggtctc

SEQ ID NO: 1761957 - DNA, 14 bp, Homo sapiens
gcagaatggaggca

SEQ ID NO: 1761958 - DNA, 19 bp, Homo sapiens
gcagaatgtaagtgggccc

SEQ ID NO: 1761959 - DNA, 19 bp, Homo sapiens
gcagaatgttgtacttgaa

SEQ ID NO: 1761960 - DNA, 20 bp, Homo sapiens
gcagaattttaatgtgaaga

SEQ ID NO: 1761961 - DNA, 13 bp, Homo sapiens
gcagacaaacaga

SEQ ID NO: 1761962 - DNA, 17 bp, Homo sapiens
gcagacaaagccctgtc

SEQ ID NO: 1761963 - DNA, 14 bp, Homo sapiens
gcagacaagagctg

SEQ ID NO: 1761964 - DNA, 12 bp, Homo sapiens
gcagacacaccg

SEQ ID NO: 1761965 - DNA, 18 bp, Homo sapiens
gcagacacaccgcggcca

SEQ ID NO: 1761966 - DNA, 12 bp, Homo sapiens
gcagacagagcc

SEQ ID NO: 1761967 - DNA, 21 bp, Homo sapiens
gcagacagagccaggagaagc

SEQ ID NO: 1761968 - DNA, 22 bp, Homo sapiens
gcagacagagccaggagaagct

SEQ ID NO: 1761969 - DNA, 13 bp, Homo sapiens
gcagacagcagct

SEQ ID NO: 1761970 - DNA, 20 bp, Homo sapiens
gcagacaggccatgtgagcc

SEQ ID NO: 1761971 - DNA, 21 bp, Homo sapiens
gcagacaggccatgtgagcca

SEQ ID NO: 1761972 - DNA, 22 bp, Homo sapiens
gcagacaggccatgtgagccac

SEQ ID NO: 1761973 - DNA, 23 bp, Homo sapiens
gcagacaggcggggcccagcgct

SEQ ID NO: 1761974 - DNA, 13 bp, Homo sapiens
gcagaccaccccg

SEQ ID NO: 1761975 - DNA, 17 bp, Homo sapiens
gcagaccaccccgcctg

SEQ ID NO: 1761976 - DNA, 18 bp, Homo sapiens
gcagaccccttggccagc

SEQ ID NO: 1761977 - DNA, 22 bp, Homo sapiens
gcagacctgtcaccctgcagga

SEQ ID NO: 1761978 - DNA, 21 bp, Homo sapiens
gcagacgcagcagctgggacc

SEQ ID NO: 1761979 - DNA, 15 bp, Homo sapiens
gcagacgggcacaga

SEQ ID NO: 1761980 - DNA, 17 bp, Homo sapiens
gcagacgggcacagaca

SEQ ID NO: 1761981 - DNA, 18 bp, Homo sapiens
gcagacgggcacagacac

SEQ ID NO: 1761982 - DNA, 15 bp, Homo sapiens
gcagactatgcaaac

SEQ ID NO: 1761983 - DNA, 21 bp, Homo sapiens
gcagactgctgctagagccag

SEQ ID NO: 1761984 - DNA, 19 bp, Homo sapiens
gcagactggtttgcagtga

SEQ ID NO: 1761985 - DNA, 12 bp, Homo sapiens
gcagactgtgaa

SEQ ID NO: 1761986 - DNA, 15 bp, Homo sapiens
gcagacttcccagct

SEQ ID NO: 1761987 - DNA, 23 bp, Homo sapiens
gcagacttcttaaaaggagctcg

SEQ ID NO: 1761988 - DNA, 15 bp, Homo sapiens
gcagagaaggcctct

SEQ ID NO: 1761989 - DNA, 20 bp, Homo sapiens
gcagagaatcatacttagca

SEQ ID NO: 1761990 - DNA, 10 bp, Homo sapiens
gcagagaatg

SEQ ID NO: 1761991 - DNA, 19 bp, Homo sapiens
gcagagaatggctgggtca

SEQ ID NO: 1761992 - DNA, 21 bp, Homo sapiens
gcagagaatggctgggtcagg

SEQ ID NO: 1761993 - DNA, 15 bp, Homo sapiens
gcagagacactttgt

SEQ ID NO: 1761994 - DNA, 17 bp, Homo sapiens
gcagagacaggacctga

SEQ ID NO: 1761995 - DNA, 18 bp, Homo sapiens
gcagagagagaggacaga

SEQ ID NO: 1761996 - DNA, 14 bp, Homo sapiens
gcagagagccaaat

SEQ ID NO: 1761997 - DNA, 16 bp, Homo sapiens
gcagagagccaaatct

SEQ ID NO: 1761998 - DNA, 20 bp, Homo sapiens
gcagagagccaaatctgacc

SEQ ID NO: 1761999 - DNA, 18 bp, Homo sapiens
gcagagaggtggagaact

SEQ ID NO: 1762000 - DNA, 21 bp, Homo sapiens
gcagagaggtggagaactggg

SEQ ID NO: 1762001 - DNA, 22 bp, Homo sapiens
gcagagaggtggagaactggga

SEQ ID NO: 1762002 - DNA, 15 bp, Homo sapiens
gcagagatgtactgc

SEQ ID NO: 1762003 - DNA, 23 bp, Homo sapiens
gcagagatttctcattgactttt

SEQ ID NO: 1762004 - DNA, 18 bp, Homo sapiens
gcagagcaaatgagggag

SEQ ID NO: 1762005 - DNA, 18 bp, Homo sapiens
gcagagcaattccaggct

SEQ ID NO: 1762006 - DNA, 19 bp, Homo sapiens
gcagagcaattccaggctg

SEQ ID NO: 1762007 - DNA, 20 bp, Homo sapiens
gcagagcaattccaggctga

SEQ ID NO: 1762008 - DNA, 15 bp, Homo sapiens
gcagagcaggaagga

SEQ ID NO: 1762009 - DNA, 14 bp, Homo sapiens
gcagagccatgggc

SEQ ID NO: 1762010 - DNA, 18 bp, Homo sapiens
gcagagccatgggcctgg

SEQ ID NO: 1762011 - DNA, 22 bp, Homo sapiens
gcagagccatgggcctgggcct

SEQ ID NO: 1762012 - DNA, 20 bp, Homo sapiens
gcagagccctccaggcctgc

SEQ ID NO: 1762013 - DNA, 13 bp, Homo sapiens
gcagagcctgagt

SEQ ID NO: 1762014 - DNA, 23 bp, Homo sapiens
gcagagccttctcagaagcacag

SEQ ID NO: 1762015 - DNA, 21 bp, Homo sapiens
gcagagcggggtcccctctgt

SEQ ID NO: 1762016 - DNA, 20 bp, Homo sapiens
gcagagctctcccctcctgc

SEQ ID NO: 1762017 - DNA, 12 bp, Homo sapiens
gcagagctggct

SEQ ID NO: 1762018 - DNA, 13 bp, Homo sapiens
gcagagctggctc

SEQ ID NO: 1762019 - DNA, 14 bp, Homo sapiens
gcagagctggctct

SEQ ID NO: 1762020 - DNA, 17 bp, Homo sapiens
gcagagctggctctgag

SEQ ID NO: 1762021 - DNA, 15 bp, Homo sapiens
gcagaggaaagacag

SEQ ID NO: 1762022 - DNA, 19 bp, Homo sapiens
gcagaggacagtctggaga

SEQ ID NO: 1762023 - DNA, 16 bp, Homo sapiens
gcagaggaccagggcc

SEQ ID NO: 1762024 - DNA, 16 bp, Homo sapiens
gcagaggatgttcata

SEQ ID NO: 1762025 - DNA, 20 bp, Homo sapiens
gcagaggcctgggctgggaa

SEQ ID NO: 1762026 - DNA, 20 bp, Homo sapiens
gcagaggcgtactacccagc

SEQ ID NO: 1762027 - DNA, 11 bp, Homo sapiens
gcagaggctgg

SEQ ID NO: 1762028 - DNA, 19 bp, Homo sapiens
gcagaggctggaggcaggg

SEQ ID NO: 1762029 - DNA, 14 bp, Homo sapiens
gcagagggaggaag

SEQ ID NO: 1762030 - DNA, 18 bp, Homo sapiens
gcagagggctggaggccc

SEQ ID NO: 1762031 - DNA, 21 bp, Homo sapiens
gcagagggctggaggcccagg

SEQ ID NO: 1762032 - DNA, 23 bp, Homo sapiens
gcagagggctggaggcccaggct

SEQ ID NO: 1762033 - DNA, 15 bp, Homo sapiens
gcagaggggcagccg

SEQ ID NO: 1762034 - DNA, 16 bp, Homo sapiens
gcagaggggctttctg

SEQ ID NO: 1762035 - DNA, 18 bp, Homo sapiens
gcagaggggctttctgga

SEQ ID NO: 1762036 - DNA, 20 bp, Homo sapiens
gcagaggggctttctggaga

SEQ ID NO: 1762037 - DNA, 16 bp, Homo sapiens
gcagaggtaccctggg

SEQ ID NO: 1762038 - DNA, 14 bp, Homo sapiens
gcagaggtctccaa

SEQ ID NO: 1762039 - DNA, 19 bp, Homo sapiens
gcagaggtctccaaactga

SEQ ID NO: 1762040 - DNA, 16 bp, Homo sapiens
gcagaggtctgtgctg

SEQ ID NO: 1762041 - DNA, 22 bp, Homo sapiens
gcagaggttgcagtgagctgag

SEQ ID NO: 1762042 - DNA, 16 bp, Homo sapiens
gcagaggtttcttgaa

SEQ ID NO: 1762043 - DNA, 19 bp, Homo sapiens
gcagagtgaggatgtgttt

SEQ ID NO: 1762044 - DNA, 17 bp, Homo sapiens
gcagagtgcacagctgt

SEQ ID NO: 1762045 - DNA, 18 bp, Homo sapiens
gcagagtgcacagctgtc

SEQ ID NO: 1762046 - DNA, 14 bp, Homo sapiens
gcagagtggactgc

SEQ ID NO: 1762047 - DNA, 13 bp, Homo sapiens
gcagagttaaatc

SEQ ID NO: 1762048 - DNA, 20 bp, Homo sapiens
gcagagttacagttctgtgg

SEQ ID NO: 1762049 - DNA, 24 bp, Homo sapiens
gcagagtttgtgtgttgtcttgaa

SEQ ID NO: 1762050 - DNA, 22 bp, Homo sapiens
gcagataagttggagcaggggt

SEQ ID NO: 1762051 - DNA, 14 bp, Homo sapiens
gcagatccaggact

SEQ ID NO: 1762052 - DNA, 20 bp, Homo sapiens
gcagatcttccgtggtcaga

SEQ ID NO: 1762053 - DNA, 16 bp, Homo sapiens
gcagatgccaccctag

SEQ ID NO: 1762054 - DNA, 23 bp, Homo sapiens
gcagatggacagcgatgagggga

SEQ ID NO: 1762055 - DNA, 13 bp, Homo sapiens
gcagatggagacc

SEQ ID NO: 1762056 - DNA, 17 bp, Homo sapiens
gcagatgggcggacggc

SEQ ID NO: 1762057 - DNA, 16 bp, Homo sapiens
gcagatggtctgagtt

SEQ ID NO: 1762058 - DNA, 18 bp, Homo sapiens
gcagatgttagatatttt

SEQ ID NO: 1762059 - DNA, 20 bp, Homo sapiens
gcagatgttagatatttttc

SEQ ID NO: 1762060 - DNA, 19 bp, Homo sapiens
gcagatgttcaaatattgt

SEQ ID NO: 1762061 - DNA, 14 bp, Homo sapiens
gcagattcctgggc

SEQ ID NO: 1762062 - DNA, 18 bp, Homo sapiens
gcagattcctgggcctgt

SEQ ID NO: 1762063 - DNA, 22 bp, Homo sapiens
gcagattgaatatatatgatga

SEQ ID NO: 1762064 - DNA, 20 bp, Homo sapiens
gcagattgtgtaacaatttt

SEQ ID NO: 1762065 - DNA, 21 bp, Homo sapiens
gcagattttcagcaaactctt

SEQ ID NO: 1762066 - DNA, 16 bp, Homo sapiens
gcagattttggccatg

SEQ ID NO: 1762067 - DNA, 22 bp, Homo sapiens
gcaggctcctggctgtgcccag

SEQ ID NO: 1762068 - DNA, 16 bp, Homo sapiens
gcaggctctgggctca

SEQ ID NO: 1762069 - DNA, 15 bp, Homo sapiens
gcaggctgacatctg

SEQ ID NO: 1762070 - DNA, 21 bp, Homo sapiens
gcaggctgcacctctggctag

SEQ ID NO: 1762071 - DNA, 12 bp, Homo sapiens
gcaggctggaga

SEQ ID NO: 1762072 - DNA, 22 bp, Homo sapiens
gcaggctggccagtccaggctg

SEQ ID NO: 1762073 - DNA, 17 bp, Homo sapiens
gcaggctggcctatgtg

SEQ ID NO: 1762074 - DNA, 15 bp, Homo sapiens
gcaggctggctggcc

SEQ ID NO: 1762075 - DNA, 15 bp, Homo sapiens
gcaggctggctgttg

SEQ ID NO: 1762076 - DNA, 10 bp, Homo sapiens
gcaggctggg

SEQ ID NO: 1762077 - DNA, 15 bp, Homo sapiens
gcaggctgggccatg

SEQ ID NO: 1762078 - DNA, 17 bp, Homo sapiens
gcagggaaagctccacg

SEQ ID NO: 1762079 - DNA, 22 bp, Homo sapiens
gcagggaaaggctctgaaagcc

SEQ ID NO: 1762080 - DNA, 14 bp, Homo sapiens
gcagggaagagggc

SEQ ID NO: 1762081 - DNA, 13 bp, Homo sapiens
gcagggaaggaca

SEQ ID NO: 1762082 - DNA, 21 bp, Homo sapiens
gcagggaaggacaggaccctc

SEQ ID NO: 1762083 - DNA, 18 bp, Homo sapiens
gcagggaatgcagcagga

SEQ ID NO: 1762084 - DNA, 14 bp, Homo sapiens
gcagggacaaagag

SEQ ID NO: 1762085 - DNA, 15 bp, Homo sapiens
gcagggacaaagagg

SEQ ID NO: 1762086 - DNA, 19 bp, Homo sapiens
gcagggacacgggcagcct

SEQ ID NO: 1762087 - DNA, 16 bp, Homo sapiens
gcagggacctgagagc

SEQ ID NO: 1762088 - DNA, 16 bp, Homo sapiens
gcagggagctgggccc

SEQ ID NO: 1762089 - DNA, 12 bp, Homo sapiens
gcagggaggcaa

SEQ ID NO: 1762090 - DNA, 22 bp, Homo sapiens
gcagggaggcaacactgctgtc

SEQ ID NO: 1762091 - DNA, 24 bp, Homo sapiens
gcagggaggcaacactgctgtcca

SEQ ID NO: 1762092 - DNA, 13 bp, Homo sapiens
gcagggaggggac

SEQ ID NO: 1762093 - DNA, 14 bp, Homo sapiens
gcagggaggggact

SEQ ID NO: 1762094 - DNA, 20 bp, Homo sapiens
gcagggaggggaggcagatg

SEQ ID NO: 1762095 - DNA, 20 bp, Homo sapiens
gcagggatgatggcagagcc

SEQ ID NO: 1762096 - DNA, 19 bp, Homo sapiens
gcagggattaacctctgca

SEQ ID NO: 1762097 - DNA, 19 bp, Homo sapiens
gcagggattgctgccactt

SEQ ID NO: 1762098 - DNA, 22 bp, Homo sapiens
gcagggcaaatgacatgcactg

SEQ ID NO: 1762099 - DNA, 23 bp, Homo sapiens
gcagggcaaatgacatgcactga

SEQ ID NO: 1762100 - DNA, 12 bp, Homo sapiens
gcagggcagccg

SEQ ID NO: 1762101 - DNA, 15 bp, Homo sapiens
gcagggcatctcctg

SEQ ID NO: 1762102 - DNA, 23 bp, Homo sapiens
gcagggccactcaacagagagga

SEQ ID NO: 1762103 - DNA, 16 bp, Homo sapiens
gcagggccatccactg

SEQ ID NO: 1762104 - DNA, 19 bp, Homo sapiens
gcagggccatccactgtga

SEQ ID NO: 1762105 - DNA, 21 bp, Homo sapiens
gcagggccatccactgtgacg

SEQ ID NO: 1762106 - DNA, 22 bp, Homo sapiens
gcagggccatctgactgccaag

SEQ ID NO: 1762107 - DNA, 16 bp, Homo sapiens
gcagggccatgcagac

SEQ ID NO: 1762108 - DNA, 18 bp, Homo sapiens
gcagggccatgcagacct

SEQ ID NO: 1762109 - DNA, 20 bp, Homo sapiens
gcagggcccacgtgtatagt

SEQ ID NO: 1762110 - DNA, 20 bp, Homo sapiens
gcagggccgcgagaggccga

SEQ ID NO: 1762111 - DNA, 22 bp, Homo sapiens
gcagggccgcgagaggccgagc

SEQ ID NO: 1762112 - DNA, 14 bp, Homo sapiens
gcagggcctgggcc

SEQ ID NO: 1762113 - DNA, 18 bp, Homo sapiens
gcagggccttgcccagag

SEQ ID NO: 1762114 - DNA, 18 bp, Homo sapiens
gcagggcggtctcactcc

SEQ ID NO: 1762115 - DNA, 13 bp, Homo sapiens
gcagggctcccat

SEQ ID NO: 1762116 - DNA, 15 bp, Homo sapiens
gcagggctgtgcttg

SEQ ID NO: 1762117 - DNA, 17 bp, Homo sapiens
gcagggctttaaaattc

SEQ ID NO: 1762118 - DNA, 20 bp, Homo sapiens
gcaggggaattttctctcca

SEQ ID NO: 1762119 - DNA, 19 bp, Homo sapiens
gcaggggagacaggagcct

SEQ ID NO: 1762120 - DNA, 22 bp, Homo sapiens
gcaggggagacaggagcctagc

SEQ ID NO: 1762121 - DNA, 16 bp, Homo sapiens
gcaggggcctggagat

SEQ ID NO: 1762122 - DNA, 20 bp, Homo sapiens
gcaggggcctggagatcctc

SEQ ID NO: 1762123 - DNA, 23 bp, Homo sapiens
gcaggggcgggtggatcacctga

SEQ ID NO: 1762124 - DNA, 15 bp, Homo sapiens
gcagggggccccgcc

SEQ ID NO: 1762125 - DNA, 16 bp, Homo sapiens
gcaggggggctgtgcc

SEQ ID NO: 1762126 - DNA, 22 bp, Homo sapiens
gcaggggggctgtgccaacctg

SEQ ID NO: 1762127 - DNA, 16 bp, Homo sapiens
gcagggggtgaggggc

SEQ ID NO: 1762128 - DNA, 22 bp, Homo sapiens
gcaggggtcagtgcagcagagg

SEQ ID NO: 1762129 - DNA, 18 bp, Homo sapiens
gcaggggtggctgcctca

SEQ ID NO: 1762130 - DNA, 21 bp, Homo sapiens
gcaggggttggtcaaggccac

SEQ ID NO: 1762131 - DNA, 16 bp, Homo sapiens
gcagggtcaagcctct

SEQ ID NO: 1762132 - DNA, 18 bp, Homo sapiens
gcagggtccacagctgga

SEQ ID NO: 1762133 - DNA, 13 bp, Homo sapiens
gcagggtccacgc

SEQ ID NO: 1762134 - DNA, 15 bp, Homo sapiens
gcagggtccacgcct

SEQ ID NO: 1762135 - DNA, 19 bp, Homo sapiens
gcagggtctgtttggactg

SEQ ID NO: 1762136 - DNA, 21 bp, Homo sapiens
gcagggtctgtttggactgca

SEQ ID NO: 1762137 - DNA, 21 bp, Homo sapiens
gcaggtaattttttgtctgct

SEQ ID NO: 1762138 - DNA, 14 bp, Homo sapiens
gcaggtaccactga

SEQ ID NO: 1762139 - DNA, 22 bp, Homo sapiens
gcaggtacttcctcctgatggc

SEQ ID NO: 1762140 - DNA, 20 bp, Homo sapiens
gcaggtagatcgcttgagcc

SEQ ID NO: 1762141 - DNA, 14 bp, Homo sapiens
gcaggtcacactgg

SEQ ID NO: 1762142 - DNA, 17 bp, Homo sapiens
gcaggtcacactggggg

SEQ ID NO: 1762143 - DNA, 16 bp, Homo sapiens
gcaggtcactgtcact

SEQ ID NO: 1762144 - DNA, 16 bp, Homo sapiens
gcaggtctcttctggg

SEQ ID NO: 1762145 - DNA, 17 bp, Homo sapiens
gcaggtctcttctgggc

SEQ ID NO: 1762146 - DNA, 21 bp, Homo sapiens
gcaggtctgcaagggcccaga

SEQ ID NO: 1762147 - DNA, 23 bp, Homo sapiens
gcaggtctgcaagggcccagagt

SEQ ID NO: 1762148 - DNA, 17 bp, Homo sapiens
gcaggtgactgtgctgt

SEQ ID NO: 1762149 - DNA, 14 bp, Homo sapiens
gcaggtgagaaccc

SEQ ID NO: 1762150 - DNA, 22 bp, Homo sapiens
gcaggtgattggaccaggccat

SEQ ID NO: 1762151 - DNA, 16 bp, Homo sapiens
gcaggtgccatgcctg

SEQ ID NO: 1762152 - DNA, 21 bp, Homo sapiens
gcaggtgccatgcctgctccc

SEQ ID NO: 1762153 - DNA, 22 bp, Homo sapiens
gcaggtgccatgcctgctccct

SEQ ID NO: 1762154 - DNA, 23 bp, Homo sapiens
gcaggtgccatgcctgctccctg

SEQ ID NO: 1762155 - DNA, 14 bp, Homo sapiens
gcaggtgcctccag

SEQ ID NO: 1762156 - DNA, 21 bp, Homo sapiens
gcaggtgcctccaggtgtgca

SEQ ID NO: 1762157 - DNA, 12 bp, Homo sapiens
gcaggtgctgcc

SEQ ID NO: 1762158 - DNA, 17 bp, Homo sapiens
gcaggtggactgactgt

SEQ ID NO: 1762159 - DNA, 20 bp, Homo sapiens
gcaggtggactgactgtgtt

SEQ ID NO: 1762160 - DNA, 19 bp, Homo sapiens
gcaggtggccacagcagga

SEQ ID NO: 1762161 - DNA, 17 bp, Homo sapiens
gcaggtggccgcccctg

SEQ ID NO: 1762162 - DNA, 20 bp, Homo sapiens
gcaggtggccgcccctgagg

SEQ ID NO: 1762163 - DNA, 21 bp, Homo sapiens
gcaggtggccgcccctgaggc

SEQ ID NO: 1762164 - DNA, 16 bp, Homo sapiens
gcaggtgggctgcctg

SEQ ID NO: 1762165 - DNA, 21 bp, Homo sapiens
gcaggtgtgggatctggggag

SEQ ID NO: 1762166 - DNA, 19 bp, Homo sapiens
gcaggtgtggtggctcatg

SEQ ID NO: 1762167 - DNA, 16 bp, Homo sapiens
gcaggtgttctgctga

SEQ ID NO: 1762168 - DNA, 20 bp, Homo sapiens
gcaggttatgtcagcagctc

SEQ ID NO: 1762169 - DNA, 13 bp, Homo sapiens
gcaggttcagttt

SEQ ID NO: 1762170 - DNA, 14 bp, Homo sapiens
gcaggttccccaag

SEQ ID NO: 1762171 - DNA, 19 bp, Homo sapiens
gcaggttccccaagggccc

SEQ ID NO: 1762172 - DNA, 19 bp, Homo sapiens
gcaggttctcagctgggct

SEQ ID NO: 1762173 - DNA, 19 bp, Homo sapiens
gcaggttctgcctgctttg

SEQ ID NO: 1762174 - DNA, 20 bp, Homo sapiens
gcaggtttgttttcagcact

SEQ ID NO: 1762175 - DNA, 22 bp, Homo sapiens
gcagtacctgggaaaggaccca

SEQ ID NO: 1762176 - DNA, 19 bp, Homo sapiens
gcagtagaaataatatgca

SEQ ID NO: 1762177 - DNA, 16 bp, Homo sapiens
gcagtagttttcaaaa

SEQ ID NO: 1762178 - DNA, 20 bp, Homo sapiens
gcagtattgagttgtttaaa

SEQ ID NO: 1762179 - DNA, 16 bp, Homo sapiens
gcagtattttgtgtcc

SEQ ID NO: 1762180 - DNA, 17 bp, Homo sapiens
gcagtccagccagctcc

SEQ ID NO: 1762181 - DNA, 15 bp, Homo sapiens
gcattgttatttaat

SEQ ID NO: 1762182 - DNA, 15 bp, Homo sapiens
gcatttaaaatacca

SEQ ID NO: 1762183 - DNA, 15 bp, Homo sapiens
gcatttaataaagat

SEQ ID NO: 1762184 - DNA, 17 bp, Homo sapiens
gcatttaatggcagcta

SEQ ID NO: 1762185 - DNA, 19 bp, Homo sapiens
gcatttatggtcaacactt

SEQ ID NO: 1762186 - DNA, 18 bp, Homo sapiens
gcatttcaaagccctgcc

SEQ ID NO: 1762187 - DNA, 23 bp, Homo sapiens
gcatttcaaagccctgcctctgt

SEQ ID NO: 1762188 - DNA, 12 bp, Homo sapiens
gcatttcaatcc

SEQ ID NO: 1762189 - DNA, 23 bp, Homo sapiens
gcatttcacctgtgacaaaggat

SEQ ID NO: 1762190 - DNA, 22 bp, Homo sapiens
gcatttcattcaaatcagtgat

SEQ ID NO: 1762191 - DNA, 12 bp, Homo sapiens
gcatttcctgct

SEQ ID NO: 1762192 - DNA, 18 bp, Homo sapiens
gcatttctcttcctaaat

SEQ ID NO: 1762193 - DNA, 13 bp, Homo sapiens
gcatttgagaaat

SEQ ID NO: 1762194 - DNA, 23 bp, Homo sapiens
gcatttgctctttcatctctgct

SEQ ID NO: 1762195 - DNA, 13 bp, Homo sapiens
gcatttggtctca

SEQ ID NO: 1762196 - DNA, 15 bp, Homo sapiens
gcatttggtgagagt

SEQ ID NO: 1762197 - DNA, 22 bp, Homo sapiens
gcatttggtgagagtcaaagct

SEQ ID NO: 1762198 - DNA, 19 bp, Homo sapiens
gcatttggttttacacagg

SEQ ID NO: 1762199 - DNA, 22 bp, Homo sapiens
gcatttgtataaagaaactggt

SEQ ID NO: 1762200 - DNA, 18 bp, Homo sapiens
gcatttgtcaatgacagt

SEQ ID NO: 1762201 - DNA, 17 bp, Homo sapiens
gcatttgtgctagaaat

SEQ ID NO: 1762202 - DNA, 21 bp, Homo sapiens
gcatttgtgctagaaattttc

SEQ ID NO: 1762203 - DNA, 21 bp, Homo sapiens
gcatttgtggtaatctacacc

SEQ ID NO: 1762204 - DNA, 16 bp, Homo sapiens
gcatttgtgttattat

SEQ ID NO: 1762205 - DNA, 23 bp, Homo sapiens
gcattttcctcttgtcctggccc

SEQ ID NO: 1762206 - DNA, 15 bp, Homo sapiens
gcattttgaaacaaa

SEQ ID NO: 1762207 - DNA, 16 bp, Homo sapiens
gcatttttatgcagac

SEQ ID NO: 1762208 - DNA, 18 bp, Homo sapiens
gcatttttatgcagacag

SEQ ID NO: 1762209 - DNA, 17 bp, Homo sapiens
gccaaaccaagcaaatt

SEQ ID NO: 1762210 - DNA, 22 bp, Homo sapiens
gccaaacccatgaggcaatgtc

SEQ ID NO: 1762211 - DNA, 13 bp, Homo sapiens
gccaaacccctag

SEQ ID NO: 1762212 - DNA, 22 bp, Homo sapiens
gccaaacccctagagacagtga

SEQ ID NO: 1762213 - DNA, 15 bp, Homo sapiens
gccaaaccctgtctg

SEQ ID NO: 1762214 - DNA, 20 bp, Homo sapiens
gccaaacccttgctttcctg

SEQ ID NO: 1762215 - DNA, 19 bp, Homo sapiens
gccaaactgtagatgaaga

SEQ ID NO: 1762216 - DNA, 16 bp, Homo sapiens
gccaaagaaacaagct

SEQ ID NO: 1762217 - DNA, 17 bp, Homo sapiens
gccaaagaaacaagctg

SEQ ID NO: 1762218 - DNA, 19 bp, Homo sapiens
gccaaagaaacaagctgtg

SEQ ID NO: 1762219 - DNA, 20 bp, Homo sapiens
gccaaagaaacaagctgtgc

SEQ ID NO: 1762220 - DNA, 23 bp, Homo sapiens
gccaaagagcctcccaccagagc

SEQ ID NO: 1762221 - DNA, 15 bp, Homo sapiens
gccaaagagcctttc

SEQ ID NO: 1762222 - DNA, 16 bp, Homo sapiens
gccaaagagcctttcc

SEQ ID NO: 1762223 - DNA, 15 bp, Homo sapiens
gccaaagataaaagg

SEQ ID NO: 1762224 - DNA, 16 bp, Homo sapiens
gccaaagcacagctgg

SEQ ID NO: 1762225 - DNA, 20 bp, Homo sapiens
gccaaaggctggtggcaagt

SEQ ID NO: 1762226 - DNA, 17 bp, Homo sapiens
gccaaagtacagaattt

SEQ ID NO: 1762227 - DNA, 19 bp, Homo sapiens
gccaaataaatcatcctca

SEQ ID NO: 1762228 - DNA, 16 bp, Homo sapiens
gccaaataatgtctct

SEQ ID NO: 1762229 - DNA, 22 bp, Homo sapiens
gccaaataatgtctctgtgaga

SEQ ID NO: 1762230 - DNA, 19 bp, Homo sapiens
gccaaataggagggagact

SEQ ID NO: 1762231 - DNA, 21 bp, Homo sapiens
gccaaataggagggagactgt

SEQ ID NO: 1762232 - DNA, 15 bp, Homo sapiens
gccaaatatgtcctg

SEQ ID NO: 1762233 - DNA, 22 bp, Homo sapiens
gccaaatccttggagtcccagg

SEQ ID NO: 1762234 - DNA, 11 bp, Homo sapiens
gccaaatctga

SEQ ID NO: 1762235 - DNA, 19 bp, Homo sapiens
gccaaatgaccgagccctg

SEQ ID NO: 1762236 - DNA, 19 bp, Homo sapiens
gccaaattgctgcatattt

SEQ ID NO: 1762237 - DNA, 23 bp, Homo sapiens
gccaaattgctgcatatttgtgc

SEQ ID NO: 1762238 - DNA, 18 bp, Homo sapiens
gccaaatttcctgtttga

SEQ ID NO: 1762239 - DNA, 20 bp, Homo sapiens
gccaacaagaccgccccagg

SEQ ID NO: 1762240 - DNA, 17 bp, Homo sapiens
gccaacagaagcttcca

SEQ ID NO: 1762241 - DNA, 13 bp, Homo sapiens
gccaacagttgta

SEQ ID NO: 1762242 - DNA, 15 bp, Homo sapiens
gccaaccagcctttg

SEQ ID NO: 1762243 - DNA, 13 bp, Homo sapiens
gccaaccatacct

SEQ ID NO: 1762244 - DNA, 23 bp, Homo sapiens
gccaaccccgccctaggcctggc

SEQ ID NO: 1762245 - DNA, 15 bp, Homo sapiens
gccaacctaaaactc

SEQ ID NO: 1762246 - DNA, 19 bp, Homo sapiens
gccaacctggacttcctgt

SEQ ID NO: 1762247 - DNA, 14 bp, Homo sapiens
gccaacgaagccgg

SEQ ID NO: 1762248 - DNA, 21 bp, Homo sapiens
gccaacgagacacattgcctt

SEQ ID NO: 1762249 - DNA, 17 bp, Homo sapiens
gccaacgtggacctgcc

SEQ ID NO: 1762250 - DNA, 20 bp, Homo sapiens
gccaactagcccctggggtg

SEQ ID NO: 1762251 - DNA, 17 bp, Homo sapiens
gccaactgatctgttat

SEQ ID NO: 1762252 - DNA, 19 bp, Homo sapiens
gccaactgcaaaaaaagcc

SEQ ID NO: 1762253 - DNA, 21 bp, Homo sapiens
gccaactgcaaaaaaagcctc

SEQ ID NO: 1762254 - DNA, 23 bp, Homo sapiens
gccaactgccaggctgcctcctg

SEQ ID NO: 1762255 - DNA, 21 bp, Homo sapiens
gccaacttgatgttccacctg

SEQ ID NO: 1762256 - DNA, 14 bp, Homo sapiens
gccaacttgtaaat

SEQ ID NO: 1762257 - DNA, 20 bp, Homo sapiens
gccaacttgtaaatacacca

SEQ ID NO: 1762258 - DNA, 20 bp, Homo sapiens
gccaagaaaagggctgacat

SEQ ID NO: 1762259 - DNA, 18 bp, Homo sapiens
gccaagaaaatgaaggga

SEQ ID NO: 1762260 - DNA, 20 bp, Homo sapiens
gccaagaacagaaaacaaga

SEQ ID NO: 1762261 - DNA, 19 bp, Homo sapiens
gccaagaagcagtggcctt

SEQ ID NO: 1762262 - DNA, 13 bp, Homo sapiens
gccaagaatactt

SEQ ID NO: 1762263 - DNA, 15 bp, Homo sapiens
gccaagactcctcag

SEQ ID NO: 1762264 - DNA, 20 bp, Homo sapiens
gccaagagcagaggcagcga

SEQ ID NO: 1762265 - DNA, 18 bp, Homo sapiens
gccaagagcccgtctgct

SEQ ID NO: 1762266 - DNA, 18 bp, Homo sapiens
gccaagatcgcaccactg

SEQ ID NO: 1762267 - DNA, 19 bp, Homo sapiens
gccaagatcgcaccactgc

SEQ ID NO: 1762268 - DNA, 22 bp, Homo sapiens
gccaagatggctgctgcctgct

SEQ ID NO: 1762269 - DNA, 13 bp, Homo sapiens
gccaagcactgct

SEQ ID NO: 1762270 - DNA, 14 bp, Homo sapiens
gccaagcactgctc

SEQ ID NO: 1762271 - DNA, 17 bp, Homo sapiens
gccaagcactgctcacg

SEQ ID NO: 1762272 - DNA, 20 bp, Homo sapiens
gccaagcagaaaaaaaagtg

SEQ ID NO: 1762273 - DNA, 11 bp, Homo sapiens
gccaagccaga

SEQ ID NO: 1762274 - DNA, 15 bp, Homo sapiens
gccaagccagattct

SEQ ID NO: 1762275 - DNA, 14 bp, Homo sapiens
gccaagcctaggcc

SEQ ID NO: 1762276 - DNA, 15 bp, Homo sapiens
gccaagctttaaatt

SEQ ID NO: 1762277 - DNA, 21 bp, Homo sapiens
gccaaggcagaggcctgggct

SEQ ID NO: 1762278 - DNA, 22 bp, Homo sapiens
gccaaggctatgaagggacagc

SEQ ID NO: 1762279 - DNA, 19 bp, Homo sapiens
gccaagggaacctgtgtcc

SEQ ID NO: 1762280 - DNA, 18 bp, Homo sapiens
gccaagggccccaggggc

SEQ ID NO: 1762281 - DNA, 18 bp, Homo sapiens
gccaagggggtgactgga

SEQ ID NO: 1762282 - DNA, 19 bp, Homo sapiens
gccaagggggtgactggaa

SEQ ID NO: 1762283 - DNA, 20 bp, Homo sapiens
gccaagggggtgactggaag

SEQ ID NO: 1762284 - DNA, 14 bp, Homo sapiens
gccaaggtgccacc

SEQ ID NO: 1762285 - DNA, 19 bp, Homo sapiens
gccaaggtggagggaagga

SEQ ID NO: 1762286 - DNA, 16 bp, Homo sapiens
gccaaggtgggctgag

SEQ ID NO: 1762287 - DNA, 23 bp, Homo sapiens
gccaaggtgggctgagccctggc

SEQ ID NO: 1762288 - DNA, 20 bp, Homo sapiens
gccaagtaaacagggtacct

SEQ ID NO: 1762289 - DNA, 16 bp, Homo sapiens
gccaagtaagaaagtg

SEQ ID NO: 1762290 - DNA, 22 bp, Homo sapiens
gccaagtcctagctcctcctcc

SEQ ID NO: 1762291 - DNA, 18 bp, Homo sapiens
gccaagtctaatgaagag

SEQ ID NO: 1762292 - DNA, 16 bp, Homo sapiens
gccaagtctcagaaga

SEQ ID NO: 1762293 - DNA, 13 bp, Homo sapiens
gccaagtgctctt

SEQ ID NO: 1762294 - DNA, 13 bp, Homo sapiens
gccaagtggggtg

SEQ ID NO: 1762295 - DNA, 12 bp, Homo sapiens
gccaggccagcc

SEQ ID NO: 1762296 - DNA, 17 bp, Homo sapiens
gccaggcccatctcagg

SEQ ID NO: 1762297 - DNA, 22 bp, Homo sapiens
gccaggcccatctcaggtgcca

SEQ ID NO: 1762298 - DNA, 13 bp, Homo sapiens
gccaggcccgcac

SEQ ID NO: 1762299 - DNA, 16 bp, Homo sapiens
gccaggcccggggctg

SEQ ID NO: 1762300 - DNA, 18 bp, Homo sapiens
gccaggcccggggctggc

SEQ ID NO: 1762301 - DNA, 20 bp, Homo sapiens
gccaggcctgtatgaggctt

SEQ ID NO: 1762302 - DNA, 12 bp, Homo sapiens
gccaggcgctgc

SEQ ID NO: 1762303 - DNA, 16 bp, Homo sapiens
gccaggcgggctcaag

SEQ ID NO: 1762304 - DNA, 22 bp, Homo sapiens
gccaggctcctacctgtctgct

SEQ ID NO: 1762305 - DNA, 20 bp, Homo sapiens
gccaggctccttcctgtctt

SEQ ID NO: 1762306 - DNA, 21 bp, Homo sapiens
gccaggctccttcctgtcttc

SEQ ID NO: 1762307 - DNA, 14 bp, Homo sapiens
gccaggctgccaag

SEQ ID NO: 1762308 - DNA, 15 bp, Homo sapiens
gccaggctgcctcct

SEQ ID NO: 1762309 - DNA, 16 bp, Homo sapiens
gccaggctgcctcctg

SEQ ID NO: 1762310 - DNA, 21 bp, Homo sapiens
gccaggctgcctcggactcca

SEQ ID NO: 1762311 - DNA, 16 bp, Homo sapiens
gccaggctggagtgca

SEQ ID NO: 1762312 - DNA, 17 bp, Homo sapiens
gccaggctggtctaaaa

SEQ ID NO: 1762313 - DNA, 16 bp, Homo sapiens
gccagggaacagcccc

SEQ ID NO: 1762314 - DNA, 12 bp, Homo sapiens
gccagggaccca

SEQ ID NO: 1762315 - DNA, 12 bp, Homo sapiens
gccagggacccc

SEQ ID NO: 1762316 - DNA, 18 bp, Homo sapiens
gccagggcagaggaatgt

SEQ ID NO: 1762317 - DNA, 19 bp, Homo sapiens
gccagggccacgctccagc

SEQ ID NO: 1762318 - DNA, 17 bp, Homo sapiens
gccagggccctgcagag

SEQ ID NO: 1762319 - DNA, 17 bp, Homo sapiens
gccagggccgcggccgc

SEQ ID NO: 1762320 - DNA, 19 bp, Homo sapiens
gccagggctcaccagctgg

SEQ ID NO: 1762321 - DNA, 13 bp, Homo sapiens
gccagggctcctg

SEQ ID NO: 1762322 - DNA, 14 bp, Homo sapiens
gccagggctcctgt

SEQ ID NO: 1762323 - DNA, 17 bp, Homo sapiens
gccagggctcctgtggc

SEQ ID NO: 1762324 - DNA, 16 bp, Homo sapiens
gccagggctgccccta

SEQ ID NO: 1762325 - DNA, 13 bp, Homo sapiens
gccagggctgggg

SEQ ID NO: 1762326 - DNA, 22 bp, Homo sapiens
gccaggggggtgaggagctggg

SEQ ID NO: 1762327 - DNA, 20 bp, Homo sapiens
gccagggtagacttggagct

SEQ ID NO: 1762328 - DNA, 21 bp, Homo sapiens
gccagggtagacttggagctg

SEQ ID NO: 1762329 - DNA, 16 bp, Homo sapiens
gccagggtgagcaggg

SEQ ID NO: 1762330 - DNA, 15 bp, Homo sapiens
gccagggtgggaaga

SEQ ID NO: 1762331 - DNA, 15 bp, Homo sapiens
gccaggtaatgtgaa

SEQ ID NO: 1762332 - DNA, 14 bp, Homo sapiens
gccaggtactgcat

SEQ ID NO: 1762333 - DNA, 22 bp, Homo sapiens
gccaggtactgcattctctccc

SEQ ID NO: 1762334 - DNA, 17 bp, Homo sapiens
gccaggtccctggacca

SEQ ID NO: 1762335 - DNA, 19 bp, Homo sapiens
gccaggtccctggaccagc

SEQ ID NO: 1762336 - DNA, 19 bp, Homo sapiens
gccaggtgcaatctactgg

SEQ ID NO: 1762337 - DNA, 13 bp, Homo sapiens
gccaggtgcagtg

SEQ ID NO: 1762338 - DNA, 18 bp, Homo sapiens
gccaggtggccactccag

SEQ ID NO: 1762339 - DNA, 23 bp, Homo sapiens
gccaggttagcctttgccctgtc

SEQ ID NO: 1762340 - DNA, 23 bp, Homo sapiens
gccaggttcctgtactactgcct

SEQ ID NO: 1762341 - DNA, 15 bp, Homo sapiens
gccaggttgcagctg

SEQ ID NO: 1762342 - DNA, 18 bp, Homo sapiens
gccaggttgcagctgctc

SEQ ID NO: 1762343 - DNA, 19 bp, Homo sapiens
gccaggttgcagctgctct

SEQ ID NO: 1762344 - DNA, 20 bp, Homo sapiens
gccaggttgcagctgctctt

SEQ ID NO: 1762345 - DNA, 18 bp, Homo sapiens
gccaggttgctaagaaac

SEQ ID NO: 1762346 - DNA, 18 bp, Homo sapiens
gccagtcaagaagaaaaa

SEQ ID NO: 1762347 - DNA, 14 bp, Homo sapiens
gccagtcactgctg

SEQ ID NO: 1762348 - DNA, 16 bp, Homo sapiens
gccagtcactgctgca

SEQ ID NO: 1762349 - DNA, 17 bp, Homo sapiens
gccagtcactgctgcaa

SEQ ID NO: 1762350 - DNA, 13 bp, Homo sapiens
gccagtcagcaac

SEQ ID NO: 1762351 - DNA, 12 bp, Homo sapiens
gccagtcaggcc

SEQ ID NO: 1762352 - DNA, 20 bp, Homo sapiens
gccagtccaggctgccgtgg

SEQ ID NO: 1762353 - DNA, 14 bp, Homo sapiens
gccagtcctgcctg

SEQ ID NO: 1762354 - DNA, 16 bp, Homo sapiens
gccagtcctgcctggc

SEQ ID NO: 1762355 - DNA, 17 bp, Homo sapiens
gccagtcctgcctggcc

SEQ ID NO: 1762356 - DNA, 19 bp, Homo sapiens
gccagtcctgcctggccag

SEQ ID NO: 1762357 - DNA, 22 bp, Homo sapiens
gccagtcctgctacctcccttg

SEQ ID NO: 1762358 - DNA, 20 bp, Homo sapiens
gccagtcctggtcctggctg

SEQ ID NO: 1762359 - DNA, 21 bp, Homo sapiens
gccagtcctggtcctggctgc

SEQ ID NO: 1762360 - DNA, 13 bp, Homo sapiens
gccagtctcccag

SEQ ID NO: 1762361 - DNA, 14 bp, Homo sapiens
gccagtctgggctg

SEQ ID NO: 1762362 - DNA, 16 bp, Homo sapiens
gccagtctgggctgcc

SEQ ID NO: 1762363 - DNA, 13 bp, Homo sapiens
gccagtcttcctc

SEQ ID NO: 1762364 - DNA, 14 bp, Homo sapiens
gccagtcttcctct

SEQ ID NO: 1762365 - DNA, 22 bp, Homo sapiens
gccagtcttcctcttagcctct

SEQ ID NO: 1762366 - DNA, 17 bp, Homo sapiens
gccagtcttgcctaggc

SEQ ID NO: 1762367 - DNA, 20 bp, Homo sapiens
gccagtcttgcctaggccaa

SEQ ID NO: 1762368 - DNA, 23 bp, Homo sapiens
gccagtcttgcctaggccaaatg

SEQ ID NO: 1762369 - DNA, 13 bp, Homo sapiens
gccagtgactttt

SEQ ID NO: 1762370 - DNA, 18 bp, Homo sapiens
gccagtgactttttctga

SEQ ID NO: 1762371 - DNA, 17 bp, Homo sapiens
gccagtgcagccactgg

SEQ ID NO: 1762372 - DNA, 18 bp, Homo sapiens
gccagtgcagccactggc

SEQ ID NO: 1762373 - DNA, 10 bp, Homo sapiens
gccagtgcct

SEQ ID NO: 1762374 - DNA, 11 bp, Homo sapiens
gccagtgcctt

SEQ ID NO: 1762375 - DNA, 19 bp, Homo sapiens
gccagtgccttacctcctg

SEQ ID NO: 1762376 - DNA, 21 bp, Homo sapiens
gccagtgccttacctcctgcc

SEQ ID NO: 1762377 - DNA, 20 bp, Homo sapiens
gccagtgcggctgccaggtt

SEQ ID NO: 1762378 - DNA, 16 bp, Homo sapiens
gccagtgctccaggca

SEQ ID NO: 1762379 - DNA, 14 bp, Homo sapiens
gccagtggctggat

SEQ ID NO: 1762380 - DNA, 14 bp, Homo sapiens
gccagtggctgggg

SEQ ID NO: 1762381 - DNA, 15 bp, Homo sapiens
gccagtggctggggg

SEQ ID NO: 1762382 - DNA, 22 bp, Homo sapiens
gccagtggggtcccccctgagt

SEQ ID NO: 1762383 - DNA, 22 bp, Homo sapiens
gccagtgtccttcgaggaaccc

SEQ ID NO: 1762384 - DNA, 19 bp, Homo sapiens
gccagttttccctggaact

SEQ ID NO: 1762385 - DNA, 15 bp, Homo sapiens
gccagttttctggta

SEQ ID NO: 1762386 - DNA, 20 bp, Homo sapiens
gccataaccacatttaatgg

SEQ ID NO: 1762387 - DNA, 16 bp, Homo sapiens
gccatactttgtctga

SEQ ID NO: 1762388 - DNA, 14 bp, Homo sapiens
gccatagaggccca

SEQ ID NO: 1762389 - DNA, 15 bp, Homo sapiens
gccatagaggcccag

SEQ ID NO: 1762390 - DNA, 19 bp, Homo sapiens
gccatagaggcccaggcac

SEQ ID NO: 1762391 - DNA, 17 bp, Homo sapiens
gccatataagtttgaag

SEQ ID NO: 1762392 - DNA, 16 bp, Homo sapiens
gccatattgtgtaatt

SEQ ID NO: 1762393 - DNA, 18 bp, Homo sapiens
gccatattgtgtaattta

SEQ ID NO: 1762394 - DNA, 21 bp, Homo sapiens
gccatcaactaaagttgtact

SEQ ID NO: 1762395 - DNA, 20 bp, Homo sapiens
gccatcactagaagaaaagc

SEQ ID NO: 1762396 - DNA, 13 bp, Homo sapiens
gccatcatttctg

SEQ ID NO: 1762397 - DNA, 22 bp, Homo sapiens
gccatccccaccttcacctcgg

SEQ ID NO: 1762398 - DNA, 17 bp, Homo sapiens
gccatcccttcggagcc

SEQ ID NO: 1762399 - DNA, 18 bp, Homo sapiens
gccatcccttcggagcca

SEQ ID NO: 1762400 - DNA, 22 bp, Homo sapiens
gccatccttcaccagagcccat

SEQ ID NO: 1762401 - DNA, 18 bp, Homo sapiens
gccatctaatgcttgttt

SEQ ID NO: 1762402 - DNA, 13 bp, Homo sapiens
gccatctcaggag

SEQ ID NO: 1762403 - DNA, 21 bp, Homo sapiens
gccatctcatgaggggagagg

SEQ ID NO: 1762404 - DNA, 17 bp, Homo sapiens
gccatctgactgccaag

SEQ ID NO: 1762405 - DNA, 19 bp, Homo sapiens
gccatctgactgccaagcc

SEQ ID NO: 1762406 - DNA, 23 bp, Homo sapiens
gccatctgactgccaagccagat

SEQ ID NO: 1762407 - DNA, 15 bp, Homo sapiens
gccatctgcccaggg

SEQ ID NO: 1762408 - DNA, 17 bp, Homo sapiens
gccatctgcccaggggt

SEQ ID NO: 1762409 - DNA, 20 bp, Homo sapiens
gccatctgtacatattactg

SEQ ID NO: 1762410 - DNA, 11 bp, Homo sapiens
gccccagcttg

SEQ ID NO: 1762411 - DNA, 12 bp, Homo sapiens
gccccaggacca

SEQ ID NO: 1762412 - DNA, 16 bp, Homo sapiens
gccccaggaccagctc

SEQ ID NO: 1762413 - DNA, 23 bp, Homo sapiens
gccccaggaccagctcaggacag

SEQ ID NO: 1762414 - DNA, 20 bp, Homo sapiens
gccccaggatcactctctgc

SEQ ID NO: 1762415 - DNA, 22 bp, Homo sapiens
gccccaggatcactctctgctg

SEQ ID NO: 1762416 - DNA, 16 bp, Homo sapiens
gccccaggccctacta

SEQ ID NO: 1762417 - DNA, 17 bp, Homo sapiens
gccccaggccggagccc

SEQ ID NO: 1762418 - DNA, 19 bp, Homo sapiens
gccccaggccggagcccag

SEQ ID NO: 1762419 - DNA, 15 bp, Homo sapiens
gccccaggcctgaaa

SEQ ID NO: 1762420 - DNA, 17 bp, Homo sapiens
gccccaggctgagagcc

SEQ ID NO: 1762421 - DNA, 13 bp, Homo sapiens
gccccagggcctg

SEQ ID NO: 1762422 - DNA, 14 bp, Homo sapiens
gccccagggcctgg

SEQ ID NO: 1762423 - DNA, 14 bp, Homo sapiens
gccccaggggcagc

SEQ ID NO: 1762424 - DNA, 21 bp, Homo sapiens
gccccagggtcttccctacct

SEQ ID NO: 1762425 - DNA, 19 bp, Homo sapiens
gccccagggttggggggtg

SEQ ID NO: 1762426 - DNA, 16 bp, Homo sapiens
gccccaggtagaaact

SEQ ID NO: 1762427 - DNA, 22 bp, Homo sapiens
gccccagtagtcagaagcaggt

SEQ ID NO: 1762428 - DNA, 17 bp, Homo sapiens
gccccagtcggccccat

SEQ ID NO: 1762429 - DNA, 16 bp, Homo sapiens
gccccagtgctggaag

SEQ ID NO: 1762430 - DNA, 16 bp, Homo sapiens
gccccatcagctccag

SEQ ID NO: 1762431 - DNA, 12 bp, Homo sapiens
gccccatcctca

SEQ ID NO: 1762432 - DNA, 17 bp, Homo sapiens
gccccatcctcatccct

SEQ ID NO: 1762433 - DNA, 20 bp, Homo sapiens
gccccatctggatgtaaatc

SEQ ID NO: 1762434 - DNA, 23 bp, Homo sapiens
gccccatgcctgtccagcctggg

SEQ ID NO: 1762435 - DNA, 20 bp, Homo sapiens
gccccatgctctgccccaag

SEQ ID NO: 1762436 - DNA, 21 bp, Homo sapiens
gccccatgctctgccccaagc

SEQ ID NO: 1762437 - DNA, 24 bp, Homo sapiens
gcccccaaagatagacaggtcctg

SEQ ID NO: 1762438 - DNA, 14 bp, Homo sapiens
gcccccaataaagg

SEQ ID NO: 1762439 - DNA, 17 bp, Homo sapiens
gcccccaataaaggcag

SEQ ID NO: 1762440 - DNA, 21 bp, Homo sapiens
gcccccaataaaggcagctgc

SEQ ID NO: 1762441 - DNA, 23 bp, Homo sapiens
gcccccaataaaggcagctgcct

SEQ ID NO: 1762442 - DNA, 12 bp, Homo sapiens
gcccccacaggc

SEQ ID NO: 1762443 - DNA, 21 bp, Homo sapiens
gcccccaccactaggactctg

SEQ ID NO: 1762444 - DNA, 21 bp, Homo sapiens
gcccccaccccggggaccctg

SEQ ID NO: 1762445 - DNA, 16 bp, Homo sapiens
gcccccaccccttccc

SEQ ID NO: 1762446 - DNA, 22 bp, Homo sapiens
gcccccaccccttccccaggcc

SEQ ID NO: 1762447 - DNA, 23 bp, Homo sapiens
gcccccaccccttccccaggccc

SEQ ID NO: 1762448 - DNA, 16 bp, Homo sapiens
gcccccacttgcctct

SEQ ID NO: 1762449 - DNA, 21 bp, Homo sapiens
gcccccacttgcctcttcctt

SEQ ID NO: 1762450 - DNA, 18 bp, Homo sapiens
gcccccagcccagggctc

SEQ ID NO: 1762451 - DNA, 21 bp, Homo sapiens
gcccccagcccagggctcctg

SEQ ID NO: 1762452 - DNA, 14 bp, Homo sapiens
gcccccaggactgg

SEQ ID NO: 1762453 - DNA, 19 bp, Homo sapiens
gcccccaggattcccccag

SEQ ID NO: 1762454 - DNA, 21 bp, Homo sapiens
gcccccaggattcccccagcc

SEQ ID NO: 1762455 - DNA, 22 bp, Homo sapiens
gcccccaggattcccccagcca

SEQ ID NO: 1762456 - DNA, 17 bp, Homo sapiens
gcccccagggcctccag

SEQ ID NO: 1762457 - DNA, 18 bp, Homo sapiens
gcccccagggcctccagg

SEQ ID NO: 1762458 - DNA, 14 bp, Homo sapiens
gcccccaggggcag

SEQ ID NO: 1762459 - DNA, 15 bp, Homo sapiens
gcccccagtccccac

SEQ ID NO: 1762460 - DNA, 22 bp, Homo sapiens
gcccccagtccccacccctgcc

SEQ ID NO: 1762461 - DNA, 15 bp, Homo sapiens
gcccccatctcccca

SEQ ID NO: 1762462 - DNA, 17 bp, Homo sapiens
gcccccatctccccagg

SEQ ID NO: 1762463 - DNA, 18 bp, Homo sapiens
gcccccatctccccaggc

SEQ ID NO: 1762464 - DNA, 20 bp, Homo sapiens
gcccccatctccccaggcct

SEQ ID NO: 1762465 - DNA, 22 bp, Homo sapiens
gcccccccaacactgtgccctg

SEQ ID NO: 1762466 - DNA, 16 bp, Homo sapiens
gccccccgaggctgct

SEQ ID NO: 1762467 - DNA, 17 bp, Homo sapiens
gccccccgaggctgcta

SEQ ID NO: 1762468 - DNA, 18 bp, Homo sapiens
gccccccgcacagccacc

SEQ ID NO: 1762469 - DNA, 13 bp, Homo sapiens
gccccccgcgcgc

SEQ ID NO: 1762470 - DNA, 18 bp, Homo sapiens
gccccccgcgcgcccacc

SEQ ID NO: 1762471 - DNA, 21 bp, Homo sapiens
gccccccgcgcgcccaccctc

SEQ ID NO: 1762472 - DNA, 18 bp, Homo sapiens
gccccccgcgctcgccca

SEQ ID NO: 1762473 - DNA, 23 bp, Homo sapiens
gccccccgcgctcgcccagcagg

SEQ ID NO: 1762474 - DNA, 13 bp, Homo sapiens
gcccccctcctcc

SEQ ID NO: 1762475 - DNA, 14 bp, Homo sapiens
gcccccgcctgcca

SEQ ID NO: 1762476 - DNA, 14 bp, Homo sapiens
gcccccgcctgggc

SEQ ID NO: 1762477 - DNA, 20 bp, Homo sapiens
gcccccgcgggttctagacg

SEQ ID NO: 1762478 - DNA, 21 bp, Homo sapiens
gcccccgctcccgctcccagg

SEQ ID NO: 1762479 - DNA, 13 bp, Homo sapiens
gcccccggcggcg

SEQ ID NO: 1762480 - DNA, 17 bp, Homo sapiens
gcccccgttccagctga

SEQ ID NO: 1762481 - DNA, 18 bp, Homo sapiens
gcccccgttccagctgac

SEQ ID NO: 1762482 - DNA, 16 bp, Homo sapiens
gccccctccagctcat

SEQ ID NO: 1762483 - DNA, 15 bp, Homo sapiens
gccccctccaggaga

SEQ ID NO: 1762484 - DNA, 18 bp, Homo sapiens
gccccctcccccatgggc

SEQ ID NO: 1762485 - DNA, 15 bp, Homo sapiens
gccccctccccccag

SEQ ID NO: 1762486 - DNA, 22 bp, Homo sapiens
gccccctccgccctgccactca

SEQ ID NO: 1762487 - DNA, 20 bp, Homo sapiens
gccccctcctctagctgtgg

SEQ ID NO: 1762488 - DNA, 22 bp, Homo sapiens
gccccctcctgaaccgcacagc

SEQ ID NO: 1762489 - DNA, 20 bp, Homo sapiens
gccccctctttgtagctcct

SEQ ID NO: 1762490 - DNA, 15 bp, Homo sapiens
gccccctgcacccac

SEQ ID NO: 1762491 - DNA, 17 bp, Homo sapiens
gccccctgcacccaccc

SEQ ID NO: 1762492 - DNA, 16 bp, Homo sapiens
gccccctgcctgccat

SEQ ID NO: 1762493 - DNA, 12 bp, Homo sapiens
gccccctggatg

SEQ ID NO: 1762494 - DNA, 14 bp, Homo sapiens
gccccctggcctct

SEQ ID NO: 1762495 - DNA, 16 bp, Homo sapiens
gccccctggcctctgt

SEQ ID NO: 1762496 - DNA, 17 bp, Homo sapiens
gccccctggcctctgtg

SEQ ID NO: 1762497 - DNA, 19 bp, Homo sapiens
gccccctggcctctgtgcc

SEQ ID NO: 1762498 - DNA, 22 bp, Homo sapiens
gccccctggtggacagtcctgg

SEQ ID NO: 1762499 - DNA, 21 bp, Homo sapiens
gccccctgtacatttgtgctc

SEQ ID NO: 1762500 - DNA, 12 bp, Homo sapiens
gccccctgtggc

SEQ ID NO: 1762501 - DNA, 15 bp, Homo sapiens
gcccccttgccctcc

SEQ ID NO: 1762502 - DNA, 14 bp, Homo sapiens
gccccgagacacca

SEQ ID NO: 1762503 - DNA, 20 bp, Homo sapiens
gccccgagacaccatcctga

SEQ ID NO: 1762504 - DNA, 13 bp, Homo sapiens
gccccgccagggc

SEQ ID NO: 1762505 - DNA, 16 bp, Homo sapiens
gccccgccagggctgg

SEQ ID NO: 1762506 - DNA, 15 bp, Homo sapiens
gccccgccccgttgt

SEQ ID NO: 1762507 - DNA, 13 bp, Homo sapiens
gccccgcccctcc

SEQ ID NO: 1762508 - DNA, 23 bp, Homo sapiens
gccccgctagcggggccaggagc

SEQ ID NO: 1762509 - DNA, 18 bp, Homo sapiens
gccccgctcccacctagt

SEQ ID NO: 1762510 - DNA, 23 bp, Homo sapiens
gccccgctgggatttcttcgctg

SEQ ID NO: 1762511 - DNA, 17 bp, Homo sapiens
gccccgcttccccacag

SEQ ID NO: 1762512 - DNA, 18 bp, Homo sapiens
gccccgcttgtccagcgc

SEQ ID NO: 1762513 - DNA, 23 bp, Homo sapiens
gccccggcaactctggctccagg

SEQ ID NO: 1762514 - DNA, 14 bp, Homo sapiens
gccccggccccagc

SEQ ID NO: 1762515 - DNA, 14 bp, Homo sapiens
gccccggcctcctc

SEQ ID NO: 1762516 - DNA, 13 bp, Homo sapiens
gccccgggatatt

SEQ ID NO: 1762517 - DNA, 15 bp, Homo sapiens
gccccgggctggaga

SEQ ID NO: 1762518 - DNA, 24 bp, Homo sapiens
gccccgggcttcccttctccccag

SEQ ID NO: 1762519 - DNA, 15 bp, Homo sapiens
gccccggggctggca

SEQ ID NO: 1762520 - DNA, 19 bp, Homo sapiens
gccccggggtgagtccatt

SEQ ID NO: 1762521 - DNA, 19 bp, Homo sapiens
gccccgggtccaggagaag

SEQ ID NO: 1762522 - DNA, 21 bp, Homo sapiens
gccccgggtccccagctcccc

SEQ ID NO: 1762523 - DNA, 18 bp, Homo sapiens
gccccggtcacctagcaa

SEQ ID NO: 1762524 - DNA, 20 bp, Homo sapiens
gcccggccgctccaccagca

SEQ ID NO: 1762525 - DNA, 12 bp, Homo sapiens
gcccggccggcc

SEQ ID NO: 1762526 - DNA, 14 bp, Homo sapiens
gcccggccggcctg

SEQ ID NO: 1762527 - DNA, 15 bp, Homo sapiens
gcccggccggcctgg

SEQ ID NO: 1762528 - DNA, 18 bp, Homo sapiens
gcccggcctgctcccagc

SEQ ID NO: 1762529 - DNA, 21 bp, Homo sapiens
gcccggcgcggtggctcacgc

SEQ ID NO: 1762530 - DNA, 16 bp, Homo sapiens
gcccggctacatcagc

SEQ ID NO: 1762531 - DNA, 19 bp, Homo sapiens
gcccggctgagccccccat

SEQ ID NO: 1762532 - DNA, 22 bp, Homo sapiens
gcccggctgtgattgctgccag

SEQ ID NO: 1762533 - DNA, 13 bp, Homo sapiens
gcccgggcccaga

SEQ ID NO: 1762534 - DNA, 12 bp, Homo sapiens
gcccgggctgcc

SEQ ID NO: 1762535 - DNA, 18 bp, Homo sapiens
gcccgggctgcctgggct

SEQ ID NO: 1762536 - DNA, 15 bp, Homo sapiens
gcccggggaggaact

SEQ ID NO: 1762537 - DNA, 19 bp, Homo sapiens
gcccggtggtttgccatgt

SEQ ID NO: 1762538 - DNA, 16 bp, Homo sapiens
gcccgtaatcccagct

SEQ ID NO: 1762539 - DNA, 17 bp, Homo sapiens
gcccgtaatcccagcta

SEQ ID NO: 1762540 - DNA, 19 bp, Homo sapiens
gcccgtaatcccagctact

SEQ ID NO: 1762541 - DNA, 15 bp, Homo sapiens
gcccgtcctgcctgt

SEQ ID NO: 1762542 - DNA, 17 bp, Homo sapiens
gcccgtcgcgctggaca

SEQ ID NO: 1762543 - DNA, 16 bp, Homo sapiens
gcccgtcggagctgcc

SEQ ID NO: 1762544 - DNA, 19 bp, Homo sapiens
gcccgtcggagctgcctgc

SEQ ID NO: 1762545 - DNA, 21 bp, Homo sapiens
gcccgtcggagctgcctgcag

SEQ ID NO: 1762546 - DNA, 13 bp, Homo sapiens
gcccgtctcagtg

SEQ ID NO: 1762547 - DNA, 19 bp, Homo sapiens
gcccgtgaagcagtgcctc

SEQ ID NO: 1762548 - DNA, 20 bp, Homo sapiens
gcccgtgacatccccaccct

SEQ ID NO: 1762549 - DNA, 12 bp, Homo sapiens
gcccgtgcagta

SEQ ID NO: 1762550 - DNA, 19 bp, Homo sapiens
gcccgtgcccgcaggaact

SEQ ID NO: 1762551 - DNA, 15 bp, Homo sapiens
gcccgttagccccag

SEQ ID NO: 1762552 - DNA, 17 bp, Homo sapiens
gcccgttgaggatgagg

SEQ ID NO: 1762553 - DNA, 14 bp, Homo sapiens
gccctaagggagtg

SEQ ID NO: 1762554 - DNA, 17 bp, Homo sapiens
gccctaagtggctgcct

SEQ ID NO: 1762555 - DNA, 17 bp, Homo sapiens
gccctacagagctgtgg

SEQ ID NO: 1762556 - DNA, 20 bp, Homo sapiens
gccctaccagcgcccgctgg

SEQ ID NO: 1762557 - DNA, 14 bp, Homo sapiens
gccctactattcag

SEQ ID NO: 1762558 - DNA, 20 bp, Homo sapiens
gccctagatgcacgtggggc

SEQ ID NO: 1762559 - DNA, 13 bp, Homo sapiens
gccctagctccac

SEQ ID NO: 1762560 - DNA, 14 bp, Homo sapiens
gccctagctgaccc

SEQ ID NO: 1762561 - DNA, 17 bp, Homo sapiens
gccctaggcccctccta

SEQ ID NO: 1762562 - DNA, 13 bp, Homo sapiens
gccctatgggcct

SEQ ID NO: 1762563 - DNA, 15 bp, Homo sapiens
gccctatgggcctgc

SEQ ID NO: 1762564 - DNA, 16 bp, Homo sapiens
gccctatgggcctgcc

SEQ ID NO: 1762565 - DNA, 19 bp, Homo sapiens
gccctatgggcctgccggg

SEQ ID NO: 1762566 - DNA, 21 bp, Homo sapiens
gccctatgggcctgccgggct

SEQ ID NO: 1762567 - DNA, 13 bp, Homo sapiens
gccctcacctctg

SEQ ID NO: 1762568 - DNA, 17 bp, Homo sapiens
gccctcacctctgagga

SEQ ID NO: 1762569 - DNA, 18 bp, Homo sapiens
gccctcactccctctgca

SEQ ID NO: 1762570 - DNA, 13 bp, Homo sapiens
gccctcactcttg

SEQ ID NO: 1762571 - DNA, 15 bp, Homo sapiens
gccctcactcttgaa

SEQ ID NO: 1762572 - DNA, 16 bp, Homo sapiens
gccctcagaagaaaac

SEQ ID NO: 1762573 - DNA, 23 bp, Homo sapiens
gccctcagtagtccctgcacagt

SEQ ID NO: 1762574 - DNA, 22 bp, Homo sapiens
gccctcagtcagttcccggagc

SEQ ID NO: 1762575 - DNA, 22 bp, Homo sapiens
gccctcatggcccctctgacct

SEQ ID NO: 1762576 - DNA, 13 bp, Homo sapiens
gccctccaaagag

SEQ ID NO: 1762577 - DNA, 20 bp, Homo sapiens
gccctccacagccgcagcct

SEQ ID NO: 1762578 - DNA, 14 bp, Homo sapiens
gccctccaggcctg

SEQ ID NO: 1762579 - DNA, 15 bp, Homo sapiens
gccctccaggcctgc

SEQ ID NO: 1762580 - DNA, 17 bp, Homo sapiens
gccctccaggcctgcag

SEQ ID NO: 1762581 - DNA, 19 bp, Homo sapiens
gccctccaggcctgcaggg

SEQ ID NO: 1762582 - DNA, 13 bp, Homo sapiens
gccctcccaagtc

SEQ ID NO: 1762583 - DNA, 16 bp, Homo sapiens
gccctcccaagtccca

SEQ ID NO: 1762584 - DNA, 11 bp, Homo sapiens
gccctcccagc

SEQ ID NO: 1762585 - DNA, 12 bp, Homo sapiens
gccctcccagcc

SEQ ID NO: 1762586 - DNA, 14 bp, Homo sapiens
gccctcccagccca

SEQ ID NO: 1762587 - DNA, 23 bp, Homo sapiens
gccctcccctccggactggtgcc

SEQ ID NO: 1762588 - DNA, 15 bp, Homo sapiens
gccctcccctgctcc

SEQ ID NO: 1762589 - DNA, 14 bp, Homo sapiens
gccctccccttccc

SEQ ID NO: 1762590 - DNA, 18 bp, Homo sapiens
gccctcccgcaccttcct

SEQ ID NO: 1762591 - DNA, 20 bp, Homo sapiens
gccctcccgcaccttcctcc

SEQ ID NO: 1762592 - DNA, 16 bp, Homo sapiens
gccctccctctcccag

SEQ ID NO: 1762593 - DNA, 16 bp, Homo sapiens
gccctccctgtcctcc

SEQ ID NO: 1762594 - DNA, 21 bp, Homo sapiens
gccctccctgttccccagaga

SEQ ID NO: 1762595 - DNA, 23 bp, Homo sapiens
gccctccgccattctcaagccct

SEQ ID NO: 1762596 - DNA, 17 bp, Homo sapiens
gccctccgcctgggatc

SEQ ID NO: 1762597 - DNA, 18 bp, Homo sapiens
gccctcctcgggccgagg

SEQ ID NO: 1762598 - DNA, 23 bp, Homo sapiens
gccctcctcgggccgaggcccag

SEQ ID NO: 1762599 - DNA, 14 bp, Homo sapiens
gccctcctctccca

SEQ ID NO: 1762600 - DNA, 10 bp, Homo sapiens
gccctccttc

SEQ ID NO: 1762601 - DNA, 15 bp, Homo sapiens
gccctcctttccctt

SEQ ID NO: 1762602 - DNA, 16 bp, Homo sapiens
gccctcctttccctta

SEQ ID NO: 1762603 - DNA, 20 bp, Homo sapiens
gccctcgaaccaaggcagcc

SEQ ID NO: 1762604 - DNA, 22 bp, Homo sapiens
gccctcgaaccaaggcagcctc

SEQ ID NO: 1762605 - DNA, 15 bp, Homo sapiens
gccctcgctgcttct

SEQ ID NO: 1762606 - DNA, 18 bp, Homo sapiens
gccctcgggcgagtcact

SEQ ID NO: 1762607 - DNA, 21 bp, Homo sapiens
gccctcgtgcctgggggagag

SEQ ID NO: 1762608 - DNA, 21 bp, Homo sapiens
gccctctatttattagccaac

SEQ ID NO: 1762609 - DNA, 16 bp, Homo sapiens
gccctctccttcctta

SEQ ID NO: 1762610 - DNA, 15 bp, Homo sapiens
gccctctctctgggc

SEQ ID NO: 1762611 - DNA, 15 bp, Homo sapiens
gccctctctgctcct

SEQ ID NO: 1762612 - DNA, 13 bp, Homo sapiens
gccctctgcctgc

SEQ ID NO: 1762613 - DNA, 17 bp, Homo sapiens
gccctctgcctgcactc

SEQ ID NO: 1762614 - DNA, 20 bp, Homo sapiens
gccctctgcctgcactccct

SEQ ID NO: 1762615 - DNA, 16 bp, Homo sapiens
gccctctgctctgcct

SEQ ID NO: 1762616 - DNA, 17 bp, Homo sapiens
gccctctgctctgcctg

SEQ ID NO: 1762617 - DNA, 22 bp, Homo sapiens
gccctctgctctgcctggagtg

SEQ ID NO: 1762618 - DNA, 16 bp, Homo sapiens
gccctctgctgctgcc

SEQ ID NO: 1762619 - DNA, 13 bp, Homo sapiens
gccctctgggtcc

SEQ ID NO: 1762620 - DNA, 13 bp, Homo sapiens
gccctctgtagct

SEQ ID NO: 1762621 - DNA, 19 bp, Homo sapiens
gccctcttaagatctgact

SEQ ID NO: 1762622 - DNA, 17 bp, Homo sapiens
gccctcttgcccgcacc

SEQ ID NO: 1762623 - DNA, 20 bp, Homo sapiens
gccctcttgcgggcctggac

SEQ ID NO: 1762624 - DNA, 19 bp, Homo sapiens
gccctgaaagggcccttcc

SEQ ID NO: 1762625 - DNA, 19 bp, Homo sapiens
gccctgacttctggagatg

SEQ ID NO: 1762626 - DNA, 12 bp, Homo sapiens
gccctgagacct

SEQ ID NO: 1762627 - DNA, 15 bp, Homo sapiens
gccctgagctcggtg

SEQ ID NO: 1762628 - DNA, 17 bp, Homo sapiens
gccctgaggacctctca

SEQ ID NO: 1762629 - DNA, 22 bp, Homo sapiens
gccctgaggtgaaagggagcta

SEQ ID NO: 1762630 - DNA, 13 bp, Homo sapiens
gccctgaggtgtg

SEQ ID NO: 1762631 - DNA, 15 bp, Homo sapiens
gccctgaggtgtggg

SEQ ID NO: 1762632 - DNA, 23 bp, Homo sapiens
gccctgaggtgtgggggctgcag

SEQ ID NO: 1762633 - DNA, 22 bp, Homo sapiens
gccctgagtaatcgcttaaaga

SEQ ID NO: 1762634 - DNA, 15 bp, Homo sapiens
gccctgagtgtccca

SEQ ID NO: 1762635 - DNA, 17 bp, Homo sapiens
gccctgattgtgccagt

SEQ ID NO: 1762636 - DNA, 17 bp, Homo sapiens
gccctgcacctgtgcag

SEQ ID NO: 1762637 - DNA, 13 bp, Homo sapiens
gccctgcagaggg

SEQ ID NO: 1762638 - DNA, 18 bp, Homo sapiens
gccctgcatgctgcccag

SEQ ID NO: 1762639 - DNA, 12 bp, Homo sapiens
gcctcatccctc

SEQ ID NO: 1762640 - DNA, 16 bp, Homo sapiens
gcctcatccgaggcag

SEQ ID NO: 1762641 - DNA, 19 bp, Homo sapiens
gcctcatccgaggcagggt

SEQ ID NO: 1762642 - DNA, 22 bp, Homo sapiens
gcctcatccgaggcagggtcag

SEQ ID NO: 1762643 - DNA, 22 bp, Homo sapiens
gcctcatctataacatgcattt

SEQ ID NO: 1762644 - DNA, 15 bp, Homo sapiens
gcctcatctccttta

SEQ ID NO: 1762645 - DNA, 16 bp, Homo sapiens
gcctcatgccacacct

SEQ ID NO: 1762646 - DNA, 18 bp, Homo sapiens
gcctcatgctggagggag

SEQ ID NO: 1762647 - DNA, 13 bp, Homo sapiens
gcctcatgtggct

SEQ ID NO: 1762648 - DNA, 14 bp, Homo sapiens
gcctcatgtggctg

SEQ ID NO: 1762649 - DNA, 16 bp, Homo sapiens
gcctcatgttctgtgg

SEQ ID NO: 1762650 - DNA, 21 bp, Homo sapiens
gcctccaaaatattaacattc

SEQ ID NO: 1762651 - DNA, 18 bp, Homo sapiens
gcctccaaagtggagctg

SEQ ID NO: 1762652 - DNA, 19 bp, Homo sapiens
gcctccaaagtggagctgg

SEQ ID NO: 1762653 - DNA, 20 bp, Homo sapiens
gcctccaaagtggagctggg

SEQ ID NO: 1762654 - DNA, 17 bp, Homo sapiens
gcctccaaatgccaact

SEQ ID NO: 1762655 - DNA, 20 bp, Homo sapiens
gcctccaacgcccctgtggc

SEQ ID NO: 1762656 - DNA, 20 bp, Homo sapiens
gcctccaagcctgcctccca

SEQ ID NO: 1762657 - DNA, 15 bp, Homo sapiens
gcctccaagggtttc

SEQ ID NO: 1762658 - DNA, 21 bp, Homo sapiens
gcctccaatgcattggcctct

SEQ ID NO: 1762659 - DNA, 18 bp, Homo sapiens
gcctccacaccagctgct

SEQ ID NO: 1762660 - DNA, 12 bp, Homo sapiens
gcctccacagcg

SEQ ID NO: 1762661 - DNA, 14 bp, Homo sapiens
gcctccacagcgag

SEQ ID NO: 1762662 - DNA, 15 bp, Homo sapiens
gcctccacagcgagg

SEQ ID NO: 1762663 - DNA, 21 bp, Homo sapiens
gcctccacagcgagggcagct

SEQ ID NO: 1762664 - DNA, 12 bp, Homo sapiens
gcctccaccacc

SEQ ID NO: 1762665 - DNA, 20 bp, Homo sapiens
gcctccactcccccacctga

SEQ ID NO: 1762666 - DNA, 23 bp, Homo sapiens
gcctccactcccccacctgacaa

SEQ ID NO: 1762667 - DNA, 12 bp, Homo sapiens
gcctccactcta

SEQ ID NO: 1762668 - DNA, 21 bp, Homo sapiens
gcctccactctagttctagat

SEQ ID NO: 1762669 - DNA, 18 bp, Homo sapiens
gcctccagaagctgctcc

SEQ ID NO: 1762670 - DNA, 14 bp, Homo sapiens
gcctccagagccag

SEQ ID NO: 1762671 - DNA, 18 bp, Homo sapiens
gcctccagagccagcctg

SEQ ID NO: 1762672 - DNA, 21 bp, Homo sapiens
gcctccagagccagcctggga

SEQ ID NO: 1762673 - DNA, 22 bp, Homo sapiens
gcctccagagccagcctgggac

SEQ ID NO: 1762674 - DNA, 23 bp, Homo sapiens
gcctccagagccagcctgggact

SEQ ID NO: 1762675 - DNA, 17 bp, Homo sapiens
gcctccagaggtcctcc

SEQ ID NO: 1762676 - DNA, 20 bp, Homo sapiens
gcctccagcctctcccggct

SEQ ID NO: 1762677 - DNA, 23 bp, Homo sapiens
gcctccagcctctcccggctgcc

SEQ ID NO: 1762678 - DNA, 12 bp, Homo sapiens
gcctccaggagc

SEQ ID NO: 1762679 - DNA, 15 bp, Homo sapiens
gcctccagggcattg

SEQ ID NO: 1762680 - DNA, 18 bp, Homo sapiens
gcctccagggcattgctc

SEQ ID NO: 1762681 - DNA, 15 bp, Homo sapiens
gcctccaggtgcaga

SEQ ID NO: 1762682 - DNA, 16 bp, Homo sapiens
gcctccaggtgcagag

SEQ ID NO: 1762683 - DNA, 12 bp, Homo sapiens
gcctccaggtgt

SEQ ID NO: 1762684 - DNA, 14 bp, Homo sapiens
gcctccaggtgtgc

SEQ ID NO: 1762685 - DNA, 15 bp, Homo sapiens
gcctccatccaaggc

SEQ ID NO: 1762686 - DNA, 16 bp, Homo sapiens
gcctccatccaaggcc

SEQ ID NO: 1762687 - DNA, 14 bp, Homo sapiens
gcctccatgcccca

SEQ ID NO: 1762688 - DNA, 17 bp, Homo sapiens
gcctccatgccccagct

SEQ ID NO: 1762689 - DNA, 23 bp, Homo sapiens
gcctccattcctggagcccgagg

SEQ ID NO: 1762690 - DNA, 14 bp, Homo sapiens
gcctccatttctgt

SEQ ID NO: 1762691 - DNA, 15 bp, Homo sapiens
gcctccatttctgtc

SEQ ID NO: 1762692 - DNA, 17 bp, Homo sapiens
gcctccatttctgtctc

SEQ ID NO: 1762693 - DNA, 18 bp, Homo sapiens
gcctcccaaccccagggc

SEQ ID NO: 1762694 - DNA, 20 bp, Homo sapiens
gcctcccaaggtcctctcag

SEQ ID NO: 1762695 - DNA, 21 bp, Homo sapiens
gcctcccaaggtcctctcagt

SEQ ID NO: 1762696 - DNA, 19 bp, Homo sapiens
gcctcccacagtgctggga

SEQ ID NO: 1762697 - DNA, 22 bp, Homo sapiens
gcctcccaccagagccgggagg

SEQ ID NO: 1762698 - DNA, 12 bp, Homo sapiens
gcctcccaccgc

SEQ ID NO: 1762699 - DNA, 17 bp, Homo sapiens
gcctcccaccgcagcgt

SEQ ID NO: 1762700 - DNA, 13 bp, Homo sapiens
gcctcccacggca

SEQ ID NO: 1762701 - DNA, 14 bp, Homo sapiens
gcctcccacggcac

SEQ ID NO: 1762702 - DNA, 14 bp, Homo sapiens
gcctcccaggttca

SEQ ID NO: 1762703 - DNA, 16 bp, Homo sapiens
gcctccccacctccag

SEQ ID NO: 1762704 - DNA, 15 bp, Homo sapiens
gcctccccccagacc

SEQ ID NO: 1762705 - DNA, 21 bp, Homo sapiens
gcctcccctctccttcctgtg

SEQ ID NO: 1762706 - DNA, 14 bp, Homo sapiens
gcctcccctgccac

SEQ ID NO: 1762707 - DNA, 14 bp, Homo sapiens
gcctcccctgggca

SEQ ID NO: 1762708 - DNA, 15 bp, Homo sapiens
gcctcccctgggcag

SEQ ID NO: 1762709 - DNA, 20 bp, Homo sapiens
gcctcccctgggttaacaaa

SEQ ID NO: 1762710 - DNA, 23 bp, Homo sapiens
gcctccctagttagcatccaggc

SEQ ID NO: 1762711 - DNA, 21 bp, Homo sapiens
gcctccctctccatatctcct

SEQ ID NO: 1762712 - DNA, 23 bp, Homo sapiens
gcctccctctccatatctccttc

SEQ ID NO: 1762713 - DNA, 16 bp, Homo sapiens
gcctccctctctcttc

SEQ ID NO: 1762714 - DNA, 11 bp, Homo sapiens
gcctccctgaa

SEQ ID NO: 1762715 - DNA, 22 bp, Homo sapiens
gcctccctgaaaatgtttttct

SEQ ID NO: 1762716 - DNA, 18 bp, Homo sapiens
gcctccctgaagcctttg

SEQ ID NO: 1762717 - DNA, 16 bp, Homo sapiens
gcctccctgcagactc

SEQ ID NO: 1762718 - DNA, 17 bp, Homo sapiens
gcctccctgctgtgcca

SEQ ID NO: 1762719 - DNA, 23 bp, Homo sapiens
gcctccctgctgtgccatgctgg

SEQ ID NO: 1762720 - DNA, 13 bp, Homo sapiens
gcctccctgtctc

SEQ ID NO: 1762721 - DNA, 19 bp, Homo sapiens
gcctccctgtctccagctg

SEQ ID NO: 1762722 - DNA, 22 bp, Homo sapiens
gcctccctgtctccagctgcct

SEQ ID NO: 1762723 - DNA, 21 bp, Homo sapiens
gcctcccttccatgccccagg

SEQ ID NO: 1762724 - DNA, 20 bp, Homo sapiens
gcctcccttccgctgcgggc

SEQ ID NO: 1762725 - DNA, 14 bp, Homo sapiens
gcctcccttctcct

SEQ ID NO: 1762726 - DNA, 14 bp, Homo sapiens
gcctcccttgtggc

SEQ ID NO: 1762727 - DNA, 21 bp, Homo sapiens
gcctccgacgctgcctctcat

SEQ ID NO: 1762728 - DNA, 13 bp, Homo sapiens
gcctccgcctccc

SEQ ID NO: 1762729 - DNA, 17 bp, Homo sapiens
gcctccgctgggcttca

SEQ ID NO: 1762730 - DNA, 16 bp, Homo sapiens
gcctccggcctcccct

SEQ ID NO: 1762731 - DNA, 22 bp, Homo sapiens
gcctccgtttatgggccttgct

SEQ ID NO: 1762732 - DNA, 18 bp, Homo sapiens
gcctcctcacccccagct

SEQ ID NO: 1762733 - DNA, 12 bp, Homo sapiens
gcctcctcatcc

SEQ ID NO: 1762734 - DNA, 13 bp, Homo sapiens
gcctcctctgtcc

SEQ ID NO: 1762735 - DNA, 12 bp, Homo sapiens
gcctcctgccac

SEQ ID NO: 1762736 - DNA, 14 bp, Homo sapiens
gcctcctgccaccc

SEQ ID NO: 1762737 - DNA, 19 bp, Homo sapiens
gcctcctgccaccccttcc

SEQ ID NO: 1762738 - DNA, 17 bp, Homo sapiens
gcctcctgcctccgggc

SEQ ID NO: 1762739 - DNA, 17 bp, Homo sapiens
gcctcctgcctgcccct

SEQ ID NO: 1762740 - DNA, 12 bp, Homo sapiens
gcctcctggctc

SEQ ID NO: 1762741 - DNA, 15 bp, Homo sapiens
gcctcctggctcagg

SEQ ID NO: 1762742 - DNA, 17 bp, Homo sapiens
gcctcctggctcaggcc

SEQ ID NO: 1762743 - DNA, 18 bp, Homo sapiens
gcctcctggctcaggccc

SEQ ID NO: 1762744 - DNA, 23 bp, Homo sapiens
gcctcctgggaaggagggagctg

SEQ ID NO: 1762745 - DNA, 13 bp, Homo sapiens
gcctcctgttctg

SEQ ID NO: 1762746 - DNA, 17 bp, Homo sapiens
gcctccttggccaccag

SEQ ID NO: 1762747 - DNA, 15 bp, Homo sapiens
gcctccttgtccagg

SEQ ID NO: 1762748 - DNA, 15 bp, Homo sapiens
gcctccttgtgcaat

SEQ ID NO: 1762749 - DNA, 22 bp, Homo sapiens
gcctcgacagggcctggagccc

SEQ ID NO: 1762750 - DNA, 13 bp, Homo sapiens
gcctcgaggcacc

SEQ ID NO: 1762751 - DNA, 16 bp, Homo sapiens
gcctcgaggcaccggc

SEQ ID NO: 1762752 - DNA, 22 bp, Homo sapiens
gcctcgaggcaccggcgctgca

SEQ ID NO: 1762753 - DNA, 15 bp, Homo sapiens
gcctcgcacaggccc

SEQ ID NO: 1762754 - DNA, 16 bp, Homo sapiens
gcctgtcaccagagct

SEQ ID NO: 1762755 - DNA, 17 bp, Homo sapiens
gcctgtcaccagagctt

SEQ ID NO: 1762756 - DNA, 15 bp, Homo sapiens
gcctgtccagcctgg

SEQ ID NO: 1762757 - DNA, 19 bp, Homo sapiens
gcctgtcccttgcctctgc

SEQ ID NO: 1762758 - DNA, 16 bp, Homo sapiens
gcctgtcgtgccagtc

SEQ ID NO: 1762759 - DNA, 21 bp, Homo sapiens
gcctgtcgtgccagtcctggg

SEQ ID NO: 1762760 - DNA, 15 bp, Homo sapiens
gcctgtctccatgag

SEQ ID NO: 1762761 - DNA, 14 bp, Homo sapiens
gcctgtctctgttc

SEQ ID NO: 1762762 - DNA, 21 bp, Homo sapiens
gcctgtctctgttcagatgtg

SEQ ID NO: 1762763 - DNA, 13 bp, Homo sapiens
gcctgtctgcccc

SEQ ID NO: 1762764 - DNA, 14 bp, Homo sapiens
gcctgtctttcagc

SEQ ID NO: 1762765 - DNA, 19 bp, Homo sapiens
gcctgtctttcagcattca

SEQ ID NO: 1762766 - DNA, 12 bp, Homo sapiens
gcctgtgaagaa

SEQ ID NO: 1762767 - DNA, 21 bp, Homo sapiens
gcctgtgcagcagcccagctt

SEQ ID NO: 1762768 - DNA, 12 bp, Homo sapiens
gcctgtgcagtg

SEQ ID NO: 1762769 - DNA, 19 bp, Homo sapiens
gcctgtgcatgtatgtctt

SEQ ID NO: 1762770 - DNA, 16 bp, Homo sapiens
gcctgtgcctctggga

SEQ ID NO: 1762771 - DNA, 18 bp, Homo sapiens
gcctgtgcctctgggact

SEQ ID NO: 1762772 - DNA, 19 bp, Homo sapiens
gcctgtgcctctgggactg

SEQ ID NO: 1762773 - DNA, 18 bp, Homo sapiens
gcctgtgcgtcccagctg

SEQ ID NO: 1762774 - DNA, 16 bp, Homo sapiens
gcctgtgctcctgccc

SEQ ID NO: 1762775 - DNA, 15 bp, Homo sapiens
gcctgtgctgcatgc

SEQ ID NO: 1762776 - DNA, 23 bp, Homo sapiens
gcctgtgctgcatgcgacagcgt

SEQ ID NO: 1762777 - DNA, 14 bp, Homo sapiens
gcctgtgctgcccg

SEQ ID NO: 1762778 - DNA, 15 bp, Homo sapiens
gcctgtgctgcccgt

SEQ ID NO: 1762779 - DNA, 15 bp, Homo sapiens
gcctgtgctgggcca

SEQ ID NO: 1762780 - DNA, 14 bp, Homo sapiens
gcctgtggcacagc

SEQ ID NO: 1762781 - DNA, 18 bp, Homo sapiens
gcctgtggcacagccctg

SEQ ID NO: 1762782 - DNA, 19 bp, Homo sapiens
gcctgtggcagaaaagagg

SEQ ID NO: 1762783 - DNA, 21 bp, Homo sapiens
gcctgtggcagaaaagaggag

SEQ ID NO: 1762784 - DNA, 14 bp, Homo sapiens
gcctgtggcctgtg

SEQ ID NO: 1762785 - DNA, 17 bp, Homo sapiens
gcctgtggcctgtgtcc

SEQ ID NO: 1762786 - DNA, 18 bp, Homo sapiens
gcctgtggcctgtgtccc

SEQ ID NO: 1762787 - DNA, 17 bp, Homo sapiens
gcctgtggccttgcccg

SEQ ID NO: 1762788 - DNA, 23 bp, Homo sapiens
gcctgtggcgccgtctccagggg

SEQ ID NO: 1762789 - DNA, 20 bp, Homo sapiens
gcctgtggcttggagtggcc

SEQ ID NO: 1762790 - DNA, 13 bp, Homo sapiens
gcctgtgggtctc

SEQ ID NO: 1762791 - DNA, 19 bp, Homo sapiens
gcctgtgggtctctgaagg

SEQ ID NO: 1762792 - DNA, 19 bp, Homo sapiens
gcctgtggttacagtgcag

SEQ ID NO: 1762793 - DNA, 21 bp, Homo sapiens
gcctgtggttacagtgcagac

SEQ ID NO: 1762794 - DNA, 12 bp, Homo sapiens
gcctgtgtccag

SEQ ID NO: 1762795 - DNA, 16 bp, Homo sapiens
gcctgtgtccagcagc

SEQ ID NO: 1762796 - DNA, 17 bp, Homo sapiens
gcctgtgtccagcagct

SEQ ID NO: 1762797 - DNA, 19 bp, Homo sapiens
gcctgtgtccagcagctgc

SEQ ID NO: 1762798 - DNA, 20 bp, Homo sapiens
gcctgtgtccagcagctgcg

SEQ ID NO: 1762799 - DNA, 21 bp, Homo sapiens
gcctgtgtcccatgacccacc

SEQ ID NO: 1762800 - DNA, 14 bp, Homo sapiens
gcctgtgtgttctg

SEQ ID NO: 1762801 - DNA, 20 bp, Homo sapiens
gcctgttaggagaagctgca

SEQ ID NO: 1762802 - DNA, 15 bp, Homo sapiens
gcctgttccctagag

SEQ ID NO: 1762803 - DNA, 20 bp, Homo sapiens
gcctgttccctagagagaat

SEQ ID NO: 1762804 - DNA, 23 bp, Homo sapiens
gcctgttccctagagagaataaa

SEQ ID NO: 1762805 - DNA, 14 bp, Homo sapiens
gcctgttctgcttc

SEQ ID NO: 1762806 - DNA, 16 bp, Homo sapiens
gcctgttggcaggccc

SEQ ID NO: 1762807 - DNA, 14 bp, Homo sapiens
gcctgttggctgct

SEQ ID NO: 1762808 - DNA, 19 bp, Homo sapiens
gcctgtttcccaggcccac

SEQ ID NO: 1762809 - DNA, 22 bp, Homo sapiens
gcctgtttggcgtttcccagag

SEQ ID NO: 1762810 - DNA, 17 bp, Homo sapiens
gccttaaaaccaaagag

SEQ ID NO: 1762811 - DNA, 19 bp, Homo sapiens
gccttaaaaggggcccaag

SEQ ID NO: 1762812 - DNA, 20 bp, Homo sapiens
gccttaaaaggggcccaagc

SEQ ID NO: 1762813 - DNA, 23 bp, Homo sapiens
gccttaaagagggacaggctgaa

SEQ ID NO: 1762814 - DNA, 18 bp, Homo sapiens
gccttaacacactggcca

SEQ ID NO: 1762815 - DNA, 19 bp, Homo sapiens
gccttaacacactggccat

SEQ ID NO: 1762816 - DNA, 14 bp, Homo sapiens
gccttaactttccc

SEQ ID NO: 1762817 - DNA, 16 bp, Homo sapiens
gccttaagcagaacaa

SEQ ID NO: 1762818 - DNA, 19 bp, Homo sapiens
gccttaagcagaacaaatg

SEQ ID NO: 1762819 - DNA, 15 bp, Homo sapiens
gccttaataaatatg

SEQ ID NO: 1762820 - DNA, 19 bp, Homo sapiens
gccttaataaatatgtaat

SEQ ID NO: 1762821 - DNA, 22 bp, Homo sapiens
gccttaataaatatgtaatata

SEQ ID NO: 1762822 - DNA, 23 bp, Homo sapiens
gccttaatacttttttattttgt

SEQ ID NO: 1762823 - DNA, 17 bp, Homo sapiens
gccttaatttgcacagt

SEQ ID NO: 1762824 - DNA, 16 bp, Homo sapiens
gccttacaaagggaaa

SEQ ID NO: 1762825 - DNA, 13 bp, Homo sapiens
gccttacactgaa

SEQ ID NO: 1762826 - DNA, 14 bp, Homo sapiens
gccttacagaaaat

SEQ ID NO: 1762827 - DNA, 20 bp, Homo sapiens
gccttacagaaaattgttgt

SEQ ID NO: 1762828 - DNA, 16 bp, Homo sapiens
gccttacatcttttct

SEQ ID NO: 1762829 - DNA, 14 bp, Homo sapiens
gccttacctcctgc

SEQ ID NO: 1762830 - DNA, 15 bp, Homo sapiens
gccttacctcctgcc

SEQ ID NO: 1762831 - DNA, 20 bp, Homo sapiens
gccttacctcctgcccagga

SEQ ID NO: 1762832 - DNA, 21 bp, Homo sapiens
gccttacctcctgcccaggag

SEQ ID NO: 1762833 - DNA, 22 bp, Homo sapiens
gccttacctcctgcccaggaga

SEQ ID NO: 1762834 - DNA, 16 bp, Homo sapiens
gccttagaacctttct

SEQ ID NO: 1762835 - DNA, 17 bp, Homo sapiens
gccttagggcactgggc

SEQ ID NO: 1762836 - DNA, 22 bp, Homo sapiens
gccttagtctcagtttgtgtgt

SEQ ID NO: 1762837 - DNA, 19 bp, Homo sapiens
gccttatcgggctccagcc

SEQ ID NO: 1762838 - DNA, 16 bp, Homo sapiens
gccttatttgtctgta

SEQ ID NO: 1762839 - DNA, 14 bp, Homo sapiens
gccttattttgagt

SEQ ID NO: 1762840 - DNA, 22 bp, Homo sapiens
gccttcaaaactatagcttgca

SEQ ID NO: 1762841 - DNA, 16 bp, Homo sapiens
gccttcaaggactgtt

SEQ ID NO: 1762842 - DNA, 17 bp, Homo sapiens
gccttcactgtgctcca

SEQ ID NO: 1762843 - DNA, 19 bp, Homo sapiens
gccttcagaatgctcctga

SEQ ID NO: 1762844 - DNA, 22 bp, Homo sapiens
gccttcagacacatgctatgtt

SEQ ID NO: 1762845 - DNA, 21 bp, Homo sapiens
gccttcagcagcagctcacac

SEQ ID NO: 1762846 - DNA, 21 bp, Homo sapiens
gccttcaggcttctgtcaatt

SEQ ID NO: 1762847 - DNA, 23 bp, Homo sapiens
gccttcagggttcagcagtacag

SEQ ID NO: 1762848 - DNA, 15 bp, Homo sapiens
gccttcagtttattt

SEQ ID NO: 1762849 - DNA, 16 bp, Homo sapiens
gccttcataggcggtc

SEQ ID NO: 1762850 - DNA, 22 bp, Homo sapiens
gccttcataggcggtcatgtgt

SEQ ID NO: 1762851 - DNA, 23 bp, Homo sapiens
gccttcataggcggtcatgtgtg

SEQ ID NO: 1762852 - DNA, 21 bp, Homo sapiens
gccttccaaaacctgcttcct

SEQ ID NO: 1762853 - DNA, 22 bp, Homo sapiens
gccttccaaaacctgcttcctt

SEQ ID NO: 1762854 - DNA, 24 bp, Homo sapiens
gccttccaaaacctgcttccttca

SEQ ID NO: 1762855 - DNA, 18 bp, Homo sapiens
gccttccagcaccctgca

SEQ ID NO: 1762856 - DNA, 14 bp, Homo sapiens
gccttccagctgct

SEQ ID NO: 1762857 - DNA, 17 bp, Homo sapiens
gccttccagctgctgtc

SEQ ID NO: 1762858 - DNA, 18 bp, Homo sapiens
gccttccagctgctgtct

SEQ ID NO: 1762859 - DNA, 14 bp, Homo sapiens
gccttccaggtcag

SEQ ID NO: 1762860 - DNA, 16 bp, Homo sapiens
gccttccataattatg

SEQ ID NO: 1762861 - DNA, 18 bp, Homo sapiens
gccttccatttcccctct

SEQ ID NO: 1762862 - DNA, 21 bp, Homo sapiens
gccttcccaagttgtgcttga

SEQ ID NO: 1762863 - DNA, 16 bp, Homo sapiens
gccttccccagcctct

SEQ ID NO: 1762864 - DNA, 16 bp, Homo sapiens
gccttccccttttgcc

SEQ ID NO: 1762865 - DNA, 19 bp, Homo sapiens
gccttccccttttgcctgg

SEQ ID NO: 1762866 - DNA, 20 bp, Homo sapiens
gccttccccttttgcctggc

SEQ ID NO: 1762867 - DNA, 23 bp, Homo sapiens
gccttccctagctttagaccctg

SEQ ID NO: 1762868 - DNA, 18 bp, Homo sapiens
gcgagcccctccttctcc

SEQ ID NO: 1762869 - DNA, 19 bp, Homo sapiens
gcgagcccctccttctccc

SEQ ID NO: 1762870 - DNA, 19 bp, Homo sapiens
gcgagcccctcggctctgg

SEQ ID NO: 1762871 - DNA, 21 bp, Homo sapiens
gcgagctatgatcgcgccact

SEQ ID NO: 1762872 - DNA, 23 bp, Homo sapiens
gcgagctctcaaatccctctcca

SEQ ID NO: 1762873 - DNA, 19 bp, Homo sapiens
gcgaggcccttcctctttg

SEQ ID NO: 1762874 - DNA, 20 bp, Homo sapiens
gcgaggctcggagcaccctt

SEQ ID NO: 1762875 - DNA, 13 bp, Homo sapiens
gcgagggcagctg

SEQ ID NO: 1762876 - DNA, 17 bp, Homo sapiens
gcgagggcagctgctat

SEQ ID NO: 1762877 - DNA, 17 bp, Homo sapiens
gcgaggtcaacagagaa

SEQ ID NO: 1762878 - DNA, 18 bp, Homo sapiens
gcgaggtcaacagagaag

SEQ ID NO: 1762879 - DNA, 22 bp, Homo sapiens
gcgaggtcaacagagaaggcag

SEQ ID NO: 1762880 - DNA, 15 bp, Homo sapiens
gcgatcccacacagg

SEQ ID NO: 1762881 - DNA, 14 bp, Homo sapiens
gcgatctcagctca

SEQ ID NO: 1762882 - DNA, 13 bp, Homo sapiens
gcgatgccagcct

SEQ ID NO: 1762883 - DNA, 20 bp, Homo sapiens
gcgattctcccgcctcagcc

SEQ ID NO: 1762884 - DNA, 15 bp, Homo sapiens
gcgattttgtctacc

SEQ ID NO: 1762885 - DNA, 14 bp, Homo sapiens
gcgcaaaggtgcct

SEQ ID NO: 1762886 - DNA, 20 bp, Homo sapiens
gcgcaactggagccagcaac

SEQ ID NO: 1762887 - DNA, 17 bp, Homo sapiens
gcgcagagccctccagg

SEQ ID NO: 1762888 - DNA, 18 bp, Homo sapiens
gcgcagagccctccaggc

SEQ ID NO: 1762889 - DNA, 19 bp, Homo sapiens
gcgcaggtctcttctgggc

SEQ ID NO: 1762890 - DNA, 11 bp, Homo sapiens
gcgcaggtgcc

SEQ ID NO: 1762891 - DNA, 23 bp, Homo sapiens
gcgcaggtgccatgcctgctccc

SEQ ID NO: 1762892 - DNA, 18 bp, Homo sapiens
gcgcagtggccctgagca

SEQ ID NO: 1762893 - DNA, 18 bp, Homo sapiens
gcgcatcttgcctccagg

SEQ ID NO: 1762894 - DNA, 22 bp, Homo sapiens
gcgcatcttgcctccaggtgca

SEQ ID NO: 1762895 - DNA, 13 bp, Homo sapiens
gcgcatgtgtgca

SEQ ID NO: 1762896 - DNA, 21 bp, Homo sapiens
gcgcatgtgtgcatgtgctgt

SEQ ID NO: 1762897 - DNA, 13 bp, Homo sapiens
gcgccaggcagag

SEQ ID NO: 1762898 - DNA, 15 bp, Homo sapiens
gcgccaggcagagct

SEQ ID NO: 1762899 - DNA, 19 bp, Homo sapiens
gcgccagtccccgctagtg

SEQ ID NO: 1762900 - DNA, 13 bp, Homo sapiens
gcgcccaccctgg

SEQ ID NO: 1762901 - DNA, 15 bp, Homo sapiens
gcgcccaccctgggc

SEQ ID NO: 1762902 - DNA, 21 bp, Homo sapiens
gcgcccaccctgggctccaca

SEQ ID NO: 1762903 - DNA, 19 bp, Homo sapiens
gcgcccagggctgggagga

SEQ ID NO: 1762904 - DNA, 20 bp, Homo sapiens
gcgcccattcgtctgtccca

SEQ ID NO: 1762905 - DNA, 18 bp, Homo sapiens
gcgccccgcccccacccc

SEQ ID NO: 1762906 - DNA, 21 bp, Homo sapiens
gcgccccgcccccacccctac

SEQ ID NO: 1762907 - DNA, 14 bp, Homo sapiens
gcgcccctgcccga

SEQ ID NO: 1762908 - DNA, 17 bp, Homo sapiens
gcgccctcccccatggg

SEQ ID NO: 1762909 - DNA, 16 bp, Homo sapiens
gcgccctctctgctcc

SEQ ID NO: 1762910 - DNA, 21 bp, Homo sapiens
gcgccctctctgctccttcac

SEQ ID NO: 1762911 - DNA, 18 bp, Homo sapiens
gcgccctttccccgacgc

SEQ ID NO: 1762912 - DNA, 13 bp, Homo sapiens
gcgccgatgccac

SEQ ID NO: 1762913 - DNA, 14 bp, Homo sapiens
gcgccgatgccacc

SEQ ID NO: 1762914 - DNA, 15 bp, Homo sapiens
gcgccgatgccaccg

SEQ ID NO: 1762915 - DNA, 18 bp, Homo sapiens
gcgccgatgccaccggcc

SEQ ID NO: 1762916 - DNA, 23 bp, Homo sapiens
gcgccggcaaaactttggcactg

SEQ ID NO: 1762917 - DNA, 17 bp, Homo sapiens
gcgccggcgggcgggcc

SEQ ID NO: 1762918 - DNA, 24 bp, Homo sapiens
gcgcctacccttcccgcctccctc

SEQ ID NO: 1762919 - DNA, 17 bp, Homo sapiens
gcgcctataatcccagc

SEQ ID NO: 1762920 - DNA, 15 bp, Homo sapiens
gcgcctccagaggtc

SEQ ID NO: 1762921 - DNA, 19 bp, Homo sapiens
gcgcctcggtatctggctt

SEQ ID NO: 1762922 - DNA, 14 bp, Homo sapiens
gcgcctgccttggg

SEQ ID NO: 1762923 - DNA, 22 bp, Homo sapiens
gcgcctggcttacctatctgtg

SEQ ID NO: 1762924 - DNA, 12 bp, Homo sapiens
gcgcctgtgacc

SEQ ID NO: 1762925 - DNA, 18 bp, Homo sapiens
gcgccttctcggagctgg

SEQ ID NO: 1762926 - DNA, 22 bp, Homo sapiens
gcgccttctcggagctggccca

SEQ ID NO: 1762927 - DNA, 20 bp, Homo sapiens
gcgcgagggcctcaaaggcc

SEQ ID NO: 1762928 - DNA, 21 bp, Homo sapiens
gcgcgcatgtaatcccagcta

SEQ ID NO: 1762929 - DNA, 13 bp, Homo sapiens
gcgcgcccctgcc

SEQ ID NO: 1762930 - DNA, 12 bp, Homo sapiens
gcgcggccagcg

SEQ ID NO: 1762931 - DNA, 14 bp, Homo sapiens
gcgcgggaggcacc

SEQ ID NO: 1762932 - DNA, 17 bp, Homo sapiens
gcgcgggaggcaccagc

SEQ ID NO: 1762933 - DNA, 17 bp, Homo sapiens
gcgcggggagcccgtcg

SEQ ID NO: 1762934 - DNA, 15 bp, Homo sapiens
gcgcggtggctcacg

SEQ ID NO: 1762935 - DNA, 20 bp, Homo sapiens
gcgcggtggctcacgcctgt

SEQ ID NO: 1762936 - DNA, 23 bp, Homo sapiens
gcgcgtatcaccatacccagcta

SEQ ID NO: 1762937 - DNA, 19 bp, Homo sapiens
gcgcgtgcatgtgtgcgtg

SEQ ID NO: 1762938 - DNA, 20 bp, Homo sapiens
gcgctcagacggcggccagg

SEQ ID NO: 1762939 - DNA, 21 bp, Homo sapiens
gcgctcagacggcggccaggc

SEQ ID NO: 1762940 - DNA, 17 bp, Homo sapiens
gcgctcaggacccaggc

SEQ ID NO: 1762941 - DNA, 21 bp, Homo sapiens
gcgctcaggacccaggccctc

SEQ ID NO: 1762942 - DNA, 13 bp, Homo sapiens
gcgctcagggcca

SEQ ID NO: 1762943 - DNA, 16 bp, Homo sapiens
gcgctcagggccatgc

SEQ ID NO: 1762944 - DNA, 12 bp, Homo sapiens
gcgctcagtaaa

SEQ ID NO: 1762945 - DNA, 14 bp, Homo sapiens
gcgctcagtaaacg

SEQ ID NO: 1762946 - DNA, 15 bp, Homo sapiens
gcgctcagtaaacgg

SEQ ID NO: 1762947 - DNA, 19 bp, Homo sapiens
gcgctcatgttgagccagt

SEQ ID NO: 1762948 - DNA, 14 bp, Homo sapiens
gcgctcccactcag

SEQ ID NO: 1762949 - DNA, 20 bp, Homo sapiens
gcgctcctgccgcagagctg

SEQ ID NO: 1762950 - DNA, 16 bp, Homo sapiens
gcgctcgctcaggtga

SEQ ID NO: 1762951 - DNA, 16 bp, Homo sapiens
gcgctctagcctgggc

SEQ ID NO: 1762952 - DNA, 23 bp, Homo sapiens
gcgctctccctaccttgcctcct

SEQ ID NO: 1762953 - DNA, 12 bp, Homo sapiens
gcgctctcctgg

SEQ ID NO: 1762954 - DNA, 13 bp, Homo sapiens
gcgctctcctgga

SEQ ID NO: 1762955 - DNA, 23 bp, Homo sapiens
gcgctctgtggatgccagggccg

SEQ ID NO: 1762956 - DNA, 21 bp, Homo sapiens
gcgctgccgcaccccagagtg

SEQ ID NO: 1762957 - DNA, 13 bp, Homo sapiens
gcgctgcctggcc

SEQ ID NO: 1762958 - DNA, 21 bp, Homo sapiens
gcgctgcctggccaggccctg

SEQ ID NO: 1762959 - DNA, 12 bp, Homo sapiens
gcgctggacagc

SEQ ID NO: 1762960 - DNA, 15 bp, Homo sapiens
gcgctggcccagccg

SEQ ID NO: 1762961 - DNA, 19 bp, Homo sapiens
gcgctggcccagccggcct

SEQ ID NO: 1762962 - DNA, 21 bp, Homo sapiens
gcgctggctccctgggcagtg

SEQ ID NO: 1762963 - DNA, 18 bp, Homo sapiens
gcgctgtggactgtcctg

SEQ ID NO: 1762964 - DNA, 19 bp, Homo sapiens
gcgctgtggactgtcctga

SEQ ID NO: 1762965 - DNA, 18 bp, Homo sapiens
gcgcttcgcttggtgagt

SEQ ID NO: 1762966 - DNA, 14 bp, Homo sapiens
gcgcttctgctgaa

SEQ ID NO: 1762967 - DNA, 20 bp, Homo sapiens
gcgcttggtctttctgtgct

SEQ ID NO: 1762968 - DNA, 16 bp, Homo sapiens
gcgctttctcctgtgc

SEQ ID NO: 1762969 - DNA, 18 bp, Homo sapiens
gcgctttctcctgtgccc

SEQ ID NO: 1762970 - DNA, 21 bp, Homo sapiens
gcggaaagtgagagccagcag

SEQ ID NO: 1762971 - DNA, 15 bp, Homo sapiens
gcggaagagttacaa

SEQ ID NO: 1762972 - DNA, 13 bp, Homo sapiens
gcggaagccaaag

SEQ ID NO: 1762973 - DNA, 14 bp, Homo sapiens
gcggacgggctgtc

SEQ ID NO: 1762974 - DNA, 21 bp, Homo sapiens
gcggactcacttgatgtttcc

SEQ ID NO: 1762975 - DNA, 21 bp, Homo sapiens
gcggagcccagcctgggagcc

SEQ ID NO: 1762976 - DNA, 15 bp, Homo sapiens
gcggaggagaccagc

SEQ ID NO: 1762977 - DNA, 14 bp, Homo sapiens
gcggaggagctgcc

SEQ ID NO: 1762978 - DNA, 22 bp, Homo sapiens
gcggaggagctgcctgcttggc

SEQ ID NO: 1762979 - DNA, 18 bp, Homo sapiens
gcggaggaggagggaggc

SEQ ID NO: 1762980 - DNA, 19 bp, Homo sapiens
gcggaggggatccagccac

SEQ ID NO: 1762981 - DNA, 20 bp, Homo sapiens
gcggaggggatccagccact

SEQ ID NO: 1762982 - DNA, 18 bp, Homo sapiens
gctcagtaaacgggaaca

SEQ ID NO: 1762983 - DNA, 16 bp, Homo sapiens
gctcagtaacataact

SEQ ID NO: 1762984 - DNA, 17 bp, Homo sapiens
gctcagtaacataactg

SEQ ID NO: 1762985 - DNA, 16 bp, Homo sapiens
gctcagtaatttgagg

SEQ ID NO: 1762986 - DNA, 17 bp, Homo sapiens
gctcagtggatcacaca

SEQ ID NO: 1762987 - DNA, 19 bp, Homo sapiens
gctcagtgtttttgtgaat

SEQ ID NO: 1762988 - DNA, 23 bp, Homo sapiens
gctcatcccccctgctgcccagt

SEQ ID NO: 1762989 - DNA, 13 bp, Homo sapiens
gctcatggccctc

SEQ ID NO: 1762990 - DNA, 21 bp, Homo sapiens
gctcatggcgtaatgggcctg

SEQ ID NO: 1762991 - DNA, 23 bp, Homo sapiens
gctcatggcgtaatgggcctgcc

SEQ ID NO: 1762992 - DNA, 21 bp, Homo sapiens
gctcatgtcctgtcctggtcc

SEQ ID NO: 1762993 - DNA, 15 bp, Homo sapiens
gctcatgttgagcca

SEQ ID NO: 1762994 - DNA, 17 bp, Homo sapiens
gctcattaaactttttt

SEQ ID NO: 1762995 - DNA, 15 bp, Homo sapiens
gctcattacagttct

SEQ ID NO: 1762996 - DNA, 19 bp, Homo sapiens
gctcattacagttctttcc

SEQ ID NO: 1762997 - DNA, 20 bp, Homo sapiens
gctcattacagttctttcct

SEQ ID NO: 1762998 - DNA, 11 bp, Homo sapiens
gctcatttaag

SEQ ID NO: 1762999 - DNA, 23 bp, Homo sapiens
gctcattttgacaaagtgcctca

SEQ ID NO: 1763000 - DNA, 12 bp, Homo sapiens
gctccaacagaa

SEQ ID NO: 1763001 - DNA, 14 bp, Homo sapiens
gctccaagattcta

SEQ ID NO: 1763002 - DNA, 16 bp, Homo sapiens
gctccaagattctaga

SEQ ID NO: 1763003 - DNA, 17 bp, Homo sapiens
gctccaagattctagat

SEQ ID NO: 1763004 - DNA, 18 bp, Homo sapiens
gctccaagattctagatg

SEQ ID NO: 1763005 - DNA, 21 bp, Homo sapiens
gctccaaggggaatcagaact

SEQ ID NO: 1763006 - DNA, 16 bp, Homo sapiens
gctccacacagcagtg

SEQ ID NO: 1763007 - DNA, 19 bp, Homo sapiens
gctccacacagcagtgtcc

SEQ ID NO: 1763008 - DNA, 21 bp, Homo sapiens
gctccacaccctctcccagga

SEQ ID NO: 1763009 - DNA, 19 bp, Homo sapiens
gctccaccaagaaagcagg

SEQ ID NO: 1763010 - DNA, 13 bp, Homo sapiens
gctccacccttgg

SEQ ID NO: 1763011 - DNA, 19 bp, Homo sapiens
gctccacccttggcctgtc

SEQ ID NO: 1763012 - DNA, 22 bp, Homo sapiens
gctccacccttggcctgtctca

SEQ ID NO: 1763013 - DNA, 22 bp, Homo sapiens
gctccacctctggtggctcctc

SEQ ID NO: 1763014 - DNA, 21 bp, Homo sapiens
gctccacggtgcgtggctgtg

SEQ ID NO: 1763015 - DNA, 15 bp, Homo sapiens
gctccactctgcttc

SEQ ID NO: 1763016 - DNA, 17 bp, Homo sapiens
gctccactctgcttctc

SEQ ID NO: 1763017 - DNA, 21 bp, Homo sapiens
gctccactctgcttctctgac

SEQ ID NO: 1763018 - DNA, 23 bp, Homo sapiens
gctccactctgcttctctgactt

SEQ ID NO: 1763019 - DNA, 20 bp, Homo sapiens
gctccactcttgatctctct

SEQ ID NO: 1763020 - DNA, 22 bp, Homo sapiens
gctccactcttgatctctcttg

SEQ ID NO: 1763021 - DNA, 19 bp, Homo sapiens
gctccagaagatgccagct

SEQ ID NO: 1763022 - DNA, 20 bp, Homo sapiens
gctccagaagatgccagctt

SEQ ID NO: 1763023 - DNA, 24 bp, Homo sapiens
gctccagaagatgccagcttctct

SEQ ID NO: 1763024 - DNA, 20 bp, Homo sapiens
gctccagacctgatcctgga

SEQ ID NO: 1763025 - DNA, 20 bp, Homo sapiens
gctccagattctgatgcata

SEQ ID NO: 1763026 - DNA, 23 bp, Homo sapiens
gctccagcaacacagcctgggcc

SEQ ID NO: 1763027 - DNA, 17 bp, Homo sapiens
gctccagcatccagcct

SEQ ID NO: 1763028 - DNA, 19 bp, Homo sapiens
gctccagcatccagcctgt

SEQ ID NO: 1763029 - DNA, 14 bp, Homo sapiens
gctccagccatctc

SEQ ID NO: 1763030 - DNA, 18 bp, Homo sapiens
gctccagcgatggtgctg

SEQ ID NO: 1763031 - DNA, 22 bp, Homo sapiens
gctccagcgatggtgctgccca

SEQ ID NO: 1763032 - DNA, 21 bp, Homo sapiens
gctccagctgccccggcccct

SEQ ID NO: 1763033 - DNA, 17 bp, Homo sapiens
gctccagctttctgcca

SEQ ID NO: 1763034 - DNA, 20 bp, Homo sapiens
gctccagggaatccaagcct

SEQ ID NO: 1763035 - DNA, 22 bp, Homo sapiens
gctccagggtcaggcggagctg

SEQ ID NO: 1763036 - DNA, 17 bp, Homo sapiens
gctccagggtcttgggc

SEQ ID NO: 1763037 - DNA, 20 bp, Homo sapiens
gctccagggtcttgggctac

SEQ ID NO: 1763038 - DNA, 15 bp, Homo sapiens
gctccaggtggctct

SEQ ID NO: 1763039 - DNA, 16 bp, Homo sapiens
gctccaggtggctctg

SEQ ID NO: 1763040 - DNA, 18 bp, Homo sapiens
gctccaggtggctctgag

SEQ ID NO: 1763041 - DNA, 21 bp, Homo sapiens
gctccaggtggctctgaggtg

SEQ ID NO: 1763042 - DNA, 22 bp, Homo sapiens
gctccagtttccccatggggct

SEQ ID NO: 1763043 - DNA, 16 bp, Homo sapiens
gctccagtttgcattt

SEQ ID NO: 1763044 - DNA, 14 bp, Homo sapiens
gctccataaagtac

SEQ ID NO: 1763045 - DNA, 22 bp, Homo sapiens
gctccataccttttctcttttc

SEQ ID NO: 1763046 - DNA, 21 bp, Homo sapiens
gctccatgactggctgtctgc

SEQ ID NO: 1763047 - DNA, 20 bp, Homo sapiens
gctcccaacccccctcctgc

SEQ ID NO: 1763048 - DNA, 17 bp, Homo sapiens
gctcccaccaccagtga

SEQ ID NO: 1763049 - DNA, 14 bp, Homo sapiens
gctcccaccgcccc

SEQ ID NO: 1763050 - DNA, 17 bp, Homo sapiens
gctcccaccgcccccac

SEQ ID NO: 1763051 - DNA, 22 bp, Homo sapiens
gctcccacctagtgccccagac

SEQ ID NO: 1763052 - DNA, 13 bp, Homo sapiens
gctcccacctccc

SEQ ID NO: 1763053 - DNA, 18 bp, Homo sapiens
gctcccacctcccttccc

SEQ ID NO: 1763054 - DNA, 22 bp, Homo sapiens
gctcccacctcccttcccacct

SEQ ID NO: 1763055 - DNA, 22 bp, Homo sapiens
gctcccactcagaactctccag

SEQ ID NO: 1763056 - DNA, 13 bp, Homo sapiens
gctcccactccct

SEQ ID NO: 1763057 - DNA, 12 bp, Homo sapiens
gctcccagcagc

SEQ ID NO: 1763058 - DNA, 19 bp, Homo sapiens
gctcccagcagccctaagg

SEQ ID NO: 1763059 - DNA, 13 bp, Homo sapiens
gctcccaggccaa

SEQ ID NO: 1763060 - DNA, 19 bp, Homo sapiens
gctcccagtgggagcttcc

SEQ ID NO: 1763061 - DNA, 22 bp, Homo sapiens
gctcccatcattccttctggcc

SEQ ID NO: 1763062 - DNA, 22 bp, Homo sapiens
gctccccacaccttccagggcc

SEQ ID NO: 1763063 - DNA, 23 bp, Homo sapiens
gctccccacaccttccagggccc

SEQ ID NO: 1763064 - DNA, 19 bp, Homo sapiens
gctccccacagcgtccctg

SEQ ID NO: 1763065 - DNA, 20 bp, Homo sapiens
gctccccacagcgtccctgg

SEQ ID NO: 1763066 - DNA, 22 bp, Homo sapiens
gctccccacagcgtccctggcg

SEQ ID NO: 1763067 - DNA, 19 bp, Homo sapiens
gctccccacctacccagct

SEQ ID NO: 1763068 - DNA, 20 bp, Homo sapiens
gctccccacctacccagctg

SEQ ID NO: 1763069 - DNA, 21 bp, Homo sapiens
gctccccacgagtcacctgca

SEQ ID NO: 1763070 - DNA, 23 bp, Homo sapiens
gctccccacgagtcacctgcaag

SEQ ID NO: 1763071 - DNA, 12 bp, Homo sapiens
gctccccaggac

SEQ ID NO: 1763072 - DNA, 13 bp, Homo sapiens
gctccccaggact

SEQ ID NO: 1763073 - DNA, 16 bp, Homo sapiens
gctccccaggccaccc

SEQ ID NO: 1763074 - DNA, 17 bp, Homo sapiens
gctccccccgcccaccc

SEQ ID NO: 1763075 - DNA, 22 bp, Homo sapiens
gctccccccgcccacccacgca

SEQ ID NO: 1763076 - DNA, 13 bp, Homo sapiens
gctccccctctgc

SEQ ID NO: 1763077 - DNA, 16 bp, Homo sapiens
gctccccgcctccact

SEQ ID NO: 1763078 - DNA, 15 bp, Homo sapiens
gctcccctccacagc

SEQ ID NO: 1763079 - DNA, 21 bp, Homo sapiens
gctcccctcggagaagagctg

SEQ ID NO: 1763080 - DNA, 16 bp, Homo sapiens
gctcccctgctgaggc

SEQ ID NO: 1763081 - DNA, 12 bp, Homo sapiens
gctcccgcccgt

SEQ ID NO: 1763082 - DNA, 15 bp, Homo sapiens
gctcccgctcccagg

SEQ ID NO: 1763083 - DNA, 18 bp, Homo sapiens
gctcccggcaagcgcttc

SEQ ID NO: 1763084 - DNA, 19 bp, Homo sapiens
gctccctcccctgccctgg

SEQ ID NO: 1763085 - DNA, 20 bp, Homo sapiens
gctccctcccctgccctggt

SEQ ID NO: 1763086 - DNA, 14 bp, Homo sapiens
gctccctcctccag

SEQ ID NO: 1763087 - DNA, 19 bp, Homo sapiens
gctccctcctccaggcctg

SEQ ID NO: 1763088 - DNA, 21 bp, Homo sapiens
gctccctcctcctgtcctccc

SEQ ID NO: 1763089 - DNA, 15 bp, Homo sapiens
gctccctctcctgta

SEQ ID NO: 1763090 - DNA, 22 bp, Homo sapiens
gctccctctcctgtagccactg

SEQ ID NO: 1763091 - DNA, 13 bp, Homo sapiens
gctccctctgcct

SEQ ID NO: 1763092 - DNA, 23 bp, Homo sapiens
gctccctctgcctgaaccttcca

SEQ ID NO: 1763093 - DNA, 19 bp, Homo sapiens
gctccctggaagctggaag

SEQ ID NO: 1763094 - DNA, 23 bp, Homo sapiens
gctccctggaggcacgcaccact

SEQ ID NO: 1763095 - DNA, 19 bp, Homo sapiens
gctctggggtgggcagttt

SEQ ID NO: 1763096 - DNA, 16 bp, Homo sapiens
gctctggtccaggccc

SEQ ID NO: 1763097 - DNA, 23 bp, Homo sapiens
gctctggtggcttaagtgagcag

SEQ ID NO: 1763098 - DNA, 15 bp, Homo sapiens
gctctggttttctgg

SEQ ID NO: 1763099 - DNA, 14 bp, Homo sapiens
gctctgtgcaggga

SEQ ID NO: 1763100 - DNA, 19 bp, Homo sapiens
gctctgtgcagtcactgga

SEQ ID NO: 1763101 - DNA, 12 bp, Homo sapiens
gctctgtggcct

SEQ ID NO: 1763102 - DNA, 17 bp, Homo sapiens
gctctgtggcctgtgtc

SEQ ID NO: 1763103 - DNA, 17 bp, Homo sapiens
gctctgtgggtctctgg

SEQ ID NO: 1763104 - DNA, 20 bp, Homo sapiens
gctctgttacccaggctgga

SEQ ID NO: 1763105 - DNA, 14 bp, Homo sapiens
gctctgttcacagt

SEQ ID NO: 1763106 - DNA, 19 bp, Homo sapiens
gctctgtttcttcctttct

SEQ ID NO: 1763107 - DNA, 17 bp, Homo sapiens
gctcttaagcagcatgg

SEQ ID NO: 1763108 - DNA, 23 bp, Homo sapiens
gctcttaagcagcatggaaaaat

SEQ ID NO: 1763109 - DNA, 12 bp, Homo sapiens
gctcttaatgtt

SEQ ID NO: 1763110 - DNA, 23 bp, Homo sapiens
gctcttagcaaaaacatgtatgt

SEQ ID NO: 1763111 - DNA, 12 bp, Homo sapiens
gctcttcaggcc

SEQ ID NO: 1763112 - DNA, 15 bp, Homo sapiens
gctcttcaggcctcc

SEQ ID NO: 1763113 - DNA, 19 bp, Homo sapiens
gctcttcagtgggagaaaa

SEQ ID NO: 1763114 - DNA, 17 bp, Homo sapiens
gctcttccaaagctcct

SEQ ID NO: 1763115 - DNA, 20 bp, Homo sapiens
gctcttcccccatgtgcctg

SEQ ID NO: 1763116 - DNA, 19 bp, Homo sapiens
gctcttcctatccctctcc

SEQ ID NO: 1763117 - DNA, 15 bp, Homo sapiens
gctcttcctggacct

SEQ ID NO: 1763118 - DNA, 18 bp, Homo sapiens
gctcttcctggacctgag

SEQ ID NO: 1763119 - DNA, 20 bp, Homo sapiens
gctcttcctggacctgagtc

SEQ ID NO: 1763120 - DNA, 18 bp, Homo sapiens
gctcttcggtttctgagc

SEQ ID NO: 1763121 - DNA, 13 bp, Homo sapiens
gctcttctcaggg

SEQ ID NO: 1763122 - DNA, 12 bp, Homo sapiens
gctcttctcatt

SEQ ID NO: 1763123 - DNA, 14 bp, Homo sapiens
gctcttctcatttc

SEQ ID NO: 1763124 - DNA, 20 bp, Homo sapiens
gctcttctcatttcacccct

SEQ ID NO: 1763125 - DNA, 13 bp, Homo sapiens
gctcttctcttcc

SEQ ID NO: 1763126 - DNA, 16 bp, Homo sapiens
gctcttctttctgaga

SEQ ID NO: 1763127 - DNA, 15 bp, Homo sapiens
gctcttgaaatatgt

SEQ ID NO: 1763128 - DNA, 19 bp, Homo sapiens
gctcttgaaatattcagaa

SEQ ID NO: 1763129 - DNA, 23 bp, Homo sapiens
gctcttgcccttccctgtccctc

SEQ ID NO: 1763130 - DNA, 12 bp, Homo sapiens
gctcttgctctc

SEQ ID NO: 1763131 - DNA, 22 bp, Homo sapiens
gctcttggaaagctgatgatgt

SEQ ID NO: 1763132 - DNA, 12 bp, Homo sapiens
gctcttggaaga

SEQ ID NO: 1763133 - DNA, 18 bp, Homo sapiens
gctcttggaagagctctt

SEQ ID NO: 1763134 - DNA, 15 bp, Homo sapiens
gctcttggtacctgt

SEQ ID NO: 1763135 - DNA, 18 bp, Homo sapiens
gctcttggtacctgtggg

SEQ ID NO: 1763136 - DNA, 17 bp, Homo sapiens
gctcttggtccctggtc

SEQ ID NO: 1763137 - DNA, 20 bp, Homo sapiens
gctcttggtccctggtccct

SEQ ID NO: 1763138 - DNA, 16 bp, Homo sapiens
gctcttgtcggggtgg

SEQ ID NO: 1763139 - DNA, 19 bp, Homo sapiens
gctctttattgcagaatgt

SEQ ID NO: 1763140 - DNA, 14 bp, Homo sapiens
gctctttcagagag

SEQ ID NO: 1763141 - DNA, 15 bp, Homo sapiens
gctctttcagagagg

SEQ ID NO: 1763142 - DNA, 17 bp, Homo sapiens
gctctttcatagtataa

SEQ ID NO: 1763143 - DNA, 16 bp, Homo sapiens
gctctttccaaattaa

SEQ ID NO: 1763144 - DNA, 17 bp, Homo sapiens
gctctttccaaattaaa

SEQ ID NO: 1763145 - DNA, 14 bp, Homo sapiens
gctctttctctgcc

SEQ ID NO: 1763146 - DNA, 17 bp, Homo sapiens
gctctttctctgccagt

SEQ ID NO: 1763147 - DNA, 21 bp, Homo sapiens
gctctttctctgccagtgaca

SEQ ID NO: 1763148 - DNA, 18 bp, Homo sapiens
gctctttctgggccaagt

SEQ ID NO: 1763149 - DNA, 13 bp, Homo sapiens
gctctttggtaga

SEQ ID NO: 1763150 - DNA, 18 bp, Homo sapiens
gctctttggtagaaaagg

SEQ ID NO: 1763151 - DNA, 23 bp, Homo sapiens
gctctttgtggcagtggccaggc

SEQ ID NO: 1763152 - DNA, 20 bp, Homo sapiens
gctgaaaaatcacatcctgg

SEQ ID NO: 1763153 - DNA, 20 bp, Homo sapiens
gctgaaaacctaagtccttt

SEQ ID NO: 1763154 - DNA, 21 bp, Homo sapiens
gctgaaaaggatcgaggcatg

SEQ ID NO: 1763155 - DNA, 22 bp, Homo sapiens
gctgaaaaggatcgaggcatgg

SEQ ID NO: 1763156 - DNA, 17 bp, Homo sapiens
gctgaaaagggcactcc

SEQ ID NO: 1763157 - DNA, 19 bp, Homo sapiens
gctgaaaatgcaaagctga

SEQ ID NO: 1763158 - DNA, 21 bp, Homo sapiens
gctgaaacaactccttttact

SEQ ID NO: 1763159 - DNA, 23 bp, Homo sapiens
gctgaaagaacatggacttgtat

SEQ ID NO: 1763160 - DNA, 17 bp, Homo sapiens
gctgaaagggagcccct

SEQ ID NO: 1763161 - DNA, 15 bp, Homo sapiens
gctgaaatgctgcat

SEQ ID NO: 1763162 - DNA, 14 bp, Homo sapiens
gctgaaattctcct

SEQ ID NO: 1763163 - DNA, 15 bp, Homo sapiens
gctgaaattctcctg

SEQ ID NO: 1763164 - DNA, 21 bp, Homo sapiens
gctgaaattgcttatttttgg

SEQ ID NO: 1763165 - DNA, 23 bp, Homo sapiens
gctgaaatttggaaaggaccaaa

SEQ ID NO: 1763166 - DNA, 15 bp, Homo sapiens
gctgaaattttatat

SEQ ID NO: 1763167 - DNA, 16 bp, Homo sapiens
gctgaacacatttctt

SEQ ID NO: 1763168 - DNA, 17 bp, Homo sapiens
gctgaacggggagaaaa

SEQ ID NO: 1763169 - DNA, 22 bp, Homo sapiens
gctgaactgagcctagctacct

SEQ ID NO: 1763170 - DNA, 16 bp, Homo sapiens
gctgaagaattgaaaa

SEQ ID NO: 1763171 - DNA, 15 bp, Homo sapiens
gctgaaggcagtggc

SEQ ID NO: 1763172 - DNA, 18 bp, Homo sapiens
gctgaaggcagtggcagg

SEQ ID NO: 1763173 - DNA, 18 bp, Homo sapiens
gctgaaggctgaggcagg

SEQ ID NO: 1763174 - DNA, 15 bp, Homo sapiens
gctgaatccagatca

SEQ ID NO: 1763175 - DNA, 16 bp, Homo sapiens
gctgaatgaagctgcc

SEQ ID NO: 1763176 - DNA, 21 bp, Homo sapiens
gctgaatgaagctgccatcct

SEQ ID NO: 1763177 - DNA, 22 bp, Homo sapiens
gctgaatgccccctgcttactt

SEQ ID NO: 1763178 - DNA, 20 bp, Homo sapiens
gctgaatgggaccctgttga

SEQ ID NO: 1763179 - DNA, 17 bp, Homo sapiens
gctgaatttatatttag

SEQ ID NO: 1763180 - DNA, 13 bp, Homo sapiens
gctgaatttctaa

SEQ ID NO: 1763181 - DNA, 14 bp, Homo sapiens
gctgacaaaaatat

SEQ ID NO: 1763182 - DNA, 21 bp, Homo sapiens
gctgacaaaaatattttccta

SEQ ID NO: 1763183 - DNA, 22 bp, Homo sapiens
gctgacaaaaatattttcctag

SEQ ID NO: 1763184 - DNA, 22 bp, Homo sapiens
gctgacaaccattaaagtcaga

SEQ ID NO: 1763185 - DNA, 18 bp, Homo sapiens
gctgacaacttagctcag

SEQ ID NO: 1763186 - DNA, 21 bp, Homo sapiens
gctgacacctaccatgctgct

SEQ ID NO: 1763187 - DNA, 22 bp, Homo sapiens
gctgacacctaccatgctgctt

SEQ ID NO: 1763188 - DNA, 14 bp, Homo sapiens
gctgacagacacta

SEQ ID NO: 1763189 - DNA, 13 bp, Homo sapiens
gctgacagtcagc

SEQ ID NO: 1763190 - DNA, 19 bp, Homo sapiens
gctgacagtcagctgtggg

SEQ ID NO: 1763191 - DNA, 13 bp, Homo sapiens
gctgacatctgtg

SEQ ID NO: 1763192 - DNA, 19 bp, Homo sapiens
gctgacatctgtgtttcaa

SEQ ID NO: 1763193 - DNA, 15 bp, Homo sapiens
gctgacatgctcaca

SEQ ID NO: 1763194 - DNA, 20 bp, Homo sapiens
gctgacatgctcacacatta

SEQ ID NO: 1763195 - DNA, 13 bp, Homo sapiens
gctgaccaagaga

SEQ ID NO: 1763196 - DNA, 15 bp, Homo sapiens
gctgaccaagagaga

SEQ ID NO: 1763197 - DNA, 19 bp, Homo sapiens
gctgaccaattgtgctgcc

SEQ ID NO: 1763198 - DNA, 22 bp, Homo sapiens
gctgaccatgctcatctgctgg

SEQ ID NO: 1763199 - DNA, 19 bp, Homo sapiens
gctgaccccgagaagtgct

SEQ ID NO: 1763200 - DNA, 16 bp, Homo sapiens
gctgaccctgggcctg

SEQ ID NO: 1763201 - DNA, 18 bp, Homo sapiens
gctgaccctgggcctgga

SEQ ID NO: 1763202 - DNA, 17 bp, Homo sapiens
gctgacctcactgtcct

SEQ ID NO: 1763203 - DNA, 18 bp, Homo sapiens
gctgacctcactgtcctg

SEQ ID NO: 1763204 - DNA, 22 bp, Homo sapiens
gctgacctctgttgtcctcccc

SEQ ID NO: 1763205 - DNA, 16 bp, Homo sapiens
gctgacctgcctctca

SEQ ID NO: 1763206 - DNA, 15 bp, Homo sapiens
gctgacgtgtgaggg

SEQ ID NO: 1763207 - DNA, 20 bp, Homo sapiens
gctgactaaactttttttct

SEQ ID NO: 1763208 - DNA, 20 bp, Homo sapiens
gctgactatttgacccccac

SEQ ID NO: 1763209 - DNA, 22 bp, Homo sapiens
gctgcaccctgcgcctccagag

SEQ ID NO: 1763210 - DNA, 19 bp, Homo sapiens
gctgcacctgccagcctgg

SEQ ID NO: 1763211 - DNA, 22 bp, Homo sapiens
gctgcacctgccagcctggctt

SEQ ID NO: 1763212 - DNA, 23 bp, Homo sapiens
gctgcaccttgtaaatgctctaa

SEQ ID NO: 1763213 - DNA, 17 bp, Homo sapiens
gctgcacctttttgcat

SEQ ID NO: 1763214 - DNA, 14 bp, Homo sapiens
gctgcactcttgaa

SEQ ID NO: 1763215 - DNA, 20 bp, Homo sapiens
gctgcactgatgctgcccct

SEQ ID NO: 1763216 - DNA, 12 bp, Homo sapiens
gctgcactgtga

SEQ ID NO: 1763217 - DNA, 13 bp, Homo sapiens
gctgcactgtgaa

SEQ ID NO: 1763218 - DNA, 14 bp, Homo sapiens
gctgcactgtgaac

SEQ ID NO: 1763219 - DNA, 13 bp, Homo sapiens
gctgcagagaaac

SEQ ID NO: 1763220 - DNA, 15 bp, Homo sapiens
gctgcagaggccaga

SEQ ID NO: 1763221 - DNA, 22 bp, Homo sapiens
gctgcagaggccagaggccccc

SEQ ID NO: 1763222 - DNA, 23 bp, Homo sapiens
gctgcagcaccgaggggcctttg

SEQ ID NO: 1763223 - DNA, 21 bp, Homo sapiens
gctgcagcctccacttccctc

SEQ ID NO: 1763224 - DNA, 13 bp, Homo sapiens
gctgcagcctccc

SEQ ID NO: 1763225 - DNA, 13 bp, Homo sapiens
gctgcagcctgca

SEQ ID NO: 1763226 - DNA, 16 bp, Homo sapiens
gctgcagcctgcgcca

SEQ ID NO: 1763227 - DNA, 13 bp, Homo sapiens
gctgcagctgggc

SEQ ID NO: 1763228 - DNA, 19 bp, Homo sapiens
gctgcagctgggccccatg

SEQ ID NO: 1763229 - DNA, 12 bp, Homo sapiens
gctgcaggaaga

SEQ ID NO: 1763230 - DNA, 18 bp, Homo sapiens
gctgcaggaagaaacttt

SEQ ID NO: 1763231 - DNA, 23 bp, Homo sapiens
gctgcaggagtgtcctgcccatg

SEQ ID NO: 1763232 - DNA, 16 bp, Homo sapiens
gctgcaggggcctctg

SEQ ID NO: 1763233 - DNA, 17 bp, Homo sapiens
gctgcaggggcctctgt

SEQ ID NO: 1763234 - DNA, 21 bp, Homo sapiens
gctgcaggtacttcctcctga

SEQ ID NO: 1763235 - DNA, 22 bp, Homo sapiens
gctgcaggtacttcctcctgat

SEQ ID NO: 1763236 - DNA, 20 bp, Homo sapiens
gctgcagtcaacagttcaaa

SEQ ID NO: 1763237 - DNA, 22 bp, Homo sapiens
gctgcagtcttctctctggctc

SEQ ID NO: 1763238 - DNA, 22 bp, Homo sapiens
gctgcatggggtggggtagggc

SEQ ID NO: 1763239 - DNA, 15 bp, Homo sapiens
gctgcattagaaaaa

SEQ ID NO: 1763240 - DNA, 20 bp, Homo sapiens
gctgccaagagtgaagggaa

SEQ ID NO: 1763241 - DNA, 21 bp, Homo sapiens
gctgccaagcactcgagacca

SEQ ID NO: 1763242 - DNA, 15 bp, Homo sapiens
gctgccaaggccaga

SEQ ID NO: 1763243 - DNA, 18 bp, Homo sapiens
gctgccaaggccagagtg

SEQ ID NO: 1763244 - DNA, 19 bp, Homo sapiens
gctgccaaggtggagggaa

SEQ ID NO: 1763245 - DNA, 16 bp, Homo sapiens
gctgccaagtgctctt

SEQ ID NO: 1763246 - DNA, 17 bp, Homo sapiens
gctgccacacttcaggc

SEQ ID NO: 1763247 - DNA, 18 bp, Homo sapiens
gctgccacacttcaggct

SEQ ID NO: 1763248 - DNA, 19 bp, Homo sapiens
gctgccaccacgtctgcca

SEQ ID NO: 1763249 - DNA, 13 bp, Homo sapiens
gctgccactgggc

SEQ ID NO: 1763250 - DNA, 15 bp, Homo sapiens
gctgccactgggcac

SEQ ID NO: 1763251 - DNA, 14 bp, Homo sapiens
gctgccacttttta

SEQ ID NO: 1763252 - DNA, 10 bp, Homo sapiens
gctgccagca

SEQ ID NO: 1763253 - DNA, 18 bp, Homo sapiens
gctgccagcacagagcgt

SEQ ID NO: 1763254 - DNA, 20 bp, Homo sapiens
gctgccagtgcagccactgg

SEQ ID NO: 1763255 - DNA, 21 bp, Homo sapiens
gctgccatccttgctgcagct

SEQ ID NO: 1763256 - DNA, 12 bp, Homo sapiens
gctgccatgcca

SEQ ID NO: 1763257 - DNA, 20 bp, Homo sapiens
gctgccatgccactgccagg

SEQ ID NO: 1763258 - DNA, 21 bp, Homo sapiens
gctgccatgccactgccaggc

SEQ ID NO: 1763259 - DNA, 22 bp, Homo sapiens
gctgccatgccactgccaggca

SEQ ID NO: 1763260 - DNA, 23 bp, Homo sapiens
gctgccatgccactgccaggcac

SEQ ID NO: 1763261 - DNA, 13 bp, Homo sapiens
gctgccatgtgaa

SEQ ID NO: 1763262 - DNA, 21 bp, Homo sapiens
gctgccatgtgaagagggaga

SEQ ID NO: 1763263 - DNA, 19 bp, Homo sapiens
gctgcccagacacatgggc

SEQ ID NO: 1763264 - DNA, 17 bp, Homo sapiens
gctgcccagagttgctg

SEQ ID NO: 1763265 - DNA, 12 bp, Homo sapiens
gctgcccaggag

SEQ ID NO: 1763266 - DNA, 13 bp, Homo sapiens
gctgcccaggaga

SEQ ID NO: 1763267 - DNA, 13 bp, Homo sapiens
gctgcccagtgca

SEQ ID NO: 1763268 - DNA, 21 bp, Homo sapiens
gctgcccatcatgtggcccca

SEQ ID NO: 1763269 - DNA, 13 bp, Homo sapiens
gctgcccatccca

SEQ ID NO: 1763270 - DNA, 14 bp, Homo sapiens
gctgccccaacctg

SEQ ID NO: 1763271 - DNA, 16 bp, Homo sapiens
gctgccccacctgccg

SEQ ID NO: 1763272 - DNA, 15 bp, Homo sapiens
gctgccccagccccg

SEQ ID NO: 1763273 - DNA, 15 bp, Homo sapiens
gctgccccagctgac

SEQ ID NO: 1763274 - DNA, 20 bp, Homo sapiens
gctgccccaggccggagccc

SEQ ID NO: 1763275 - DNA, 22 bp, Homo sapiens
gctgccccaggccggagcccag

SEQ ID NO: 1763276 - DNA, 20 bp, Homo sapiens
gctgcccccaccccggggac

SEQ ID NO: 1763277 - DNA, 21 bp, Homo sapiens
gctgccccgcttccccacaga

SEQ ID NO: 1763278 - DNA, 13 bp, Homo sapiens
gctgccccggccc

SEQ ID NO: 1763279 - DNA, 22 bp, Homo sapiens
gctgccccggcccctccccctg

SEQ ID NO: 1763280 - DNA, 11 bp, Homo sapiens
gctgccccggg

SEQ ID NO: 1763281 - DNA, 18 bp, Homo sapiens
gctgccccgttccctgtc

SEQ ID NO: 1763282 - DNA, 22 bp, Homo sapiens
gctgccccgttccctgtcagag

SEQ ID NO: 1763283 - DNA, 13 bp, Homo sapiens
gctgcccctctca

SEQ ID NO: 1763284 - DNA, 16 bp, Homo sapiens
gctgcccctctcacca

SEQ ID NO: 1763285 - DNA, 23 bp, Homo sapiens
gctgccccttaaacacaggctgt

SEQ ID NO: 1763286 - DNA, 20 bp, Homo sapiens
gctgcccgctcagcccagct

SEQ ID NO: 1763287 - DNA, 20 bp, Homo sapiens
gctgcccggggtggggtgca

SEQ ID NO: 1763288 - DNA, 16 bp, Homo sapiens
gctgcccgtcttcagc

SEQ ID NO: 1763289 - DNA, 19 bp, Homo sapiens
gctgcccgtcttcagccta

SEQ ID NO: 1763290 - DNA, 19 bp, Homo sapiens
gctgccctcttaagatctg

SEQ ID NO: 1763291 - DNA, 18 bp, Homo sapiens
gctgccctgcatgctgcc

SEQ ID NO: 1763292 - DNA, 15 bp, Homo sapiens
gctgccctgccactt

SEQ ID NO: 1763293 - DNA, 19 bp, Homo sapiens
gctgccctggccctgaggt

SEQ ID NO: 1763294 - DNA, 12 bp, Homo sapiens
gctgccctggct

SEQ ID NO: 1763295 - DNA, 12 bp, Homo sapiens
gctgccctggtg

SEQ ID NO: 1763296 - DNA, 13 bp, Homo sapiens
gctgccctggtgc

SEQ ID NO: 1763297 - DNA, 17 bp, Homo sapiens
gctgccctggtgctgcc

SEQ ID NO: 1763298 - DNA, 18 bp, Homo sapiens
gctgccctggtgctgcca

SEQ ID NO: 1763299 - DNA, 21 bp, Homo sapiens
gctgcccttatgcccggcgcc

SEQ ID NO: 1763300 - DNA, 16 bp, Homo sapiens
gctgccgcaccagccc

SEQ ID NO: 1763301 - DNA, 18 bp, Homo sapiens
gctgccgcaccccagagt

SEQ ID NO: 1763302 - DNA, 22 bp, Homo sapiens
gctgccgcaccccagagtgtgg

SEQ ID NO: 1763303 - DNA, 15 bp, Homo sapiens
gctgccggctctggg

SEQ ID NO: 1763304 - DNA, 21 bp, Homo sapiens
gctgccgtgcctgtgtcctga

SEQ ID NO: 1763305 - DNA, 16 bp, Homo sapiens
gctgcctaagtggctg

SEQ ID NO: 1763306 - DNA, 17 bp, Homo sapiens
gctgcctaagtggctgc

SEQ ID NO: 1763307 - DNA, 22 bp, Homo sapiens
gctgcctcagccagtggcacag

SEQ ID NO: 1763308 - DNA, 24 bp, Homo sapiens
gctgcctcagccagtggcacagga

SEQ ID NO: 1763309 - DNA, 13 bp, Homo sapiens
gctgcctccatgg

SEQ ID NO: 1763310 - DNA, 22 bp, Homo sapiens
gctgcctccatggcagcagcca

SEQ ID NO: 1763311 - DNA, 21 bp, Homo sapiens
gctgcctcccctctccttcct

SEQ ID NO: 1763312 - DNA, 14 bp, Homo sapiens
gctgcctccctggg

SEQ ID NO: 1763313 - DNA, 21 bp, Homo sapiens
gctgcctcccttgtggcagca

SEQ ID NO: 1763314 - DNA, 21 bp, Homo sapiens
gctgcctcggactccatggct

SEQ ID NO: 1763315 - DNA, 16 bp, Homo sapiens
gctgcctctgctccct

SEQ ID NO: 1763316 - DNA, 13 bp, Homo sapiens
gctgcctctttcc

SEQ ID NO: 1763317 - DNA, 15 bp, Homo sapiens
gctgcctgagcacct

SEQ ID NO: 1763318 - DNA, 12 bp, Homo sapiens
gctgcctgcagc

SEQ ID NO: 1763319 - DNA, 16 bp, Homo sapiens
gctgcctgcagcacat

SEQ ID NO: 1763320 - DNA, 15 bp, Homo sapiens
gctgcctgcctgtct

SEQ ID NO: 1763321 - DNA, 19 bp, Homo sapiens
gctgcctgcttggcccggc

SEQ ID NO: 1763322 - DNA, 11 bp, Homo sapiens
gctgcctggcc

SEQ ID NO: 1763323 - DNA, 12 bp, Homo sapiens
gctgcctggcca

SEQ ID NO: 1763324 - DNA, 15 bp, Homo sapiens
gctggggccggagcc

SEQ ID NO: 1763325 - DNA, 18 bp, Homo sapiens
gctggggcgtggggaggg

SEQ ID NO: 1763326 - DNA, 15 bp, Homo sapiens
gctggggtacaggtt

SEQ ID NO: 1763327 - DNA, 19 bp, Homo sapiens
gctgggtactgactgagat

SEQ ID NO: 1763328 - DNA, 13 bp, Homo sapiens
gctgggtcaccag

SEQ ID NO: 1763329 - DNA, 12 bp, Homo sapiens
gctgggtcaggg

SEQ ID NO: 1763330 - DNA, 16 bp, Homo sapiens
gctgggtcagggccag

SEQ ID NO: 1763331 - DNA, 23 bp, Homo sapiens
gctgggtcagggccagactggaa

SEQ ID NO: 1763332 - DNA, 12 bp, Homo sapiens
gctgggtcagtg

SEQ ID NO: 1763333 - DNA, 20 bp, Homo sapiens
gctgggtccttgggcctggc

SEQ ID NO: 1763334 - DNA, 17 bp, Homo sapiens
gctgggtgccctctcag

SEQ ID NO: 1763335 - DNA, 17 bp, Homo sapiens
gctgggtggcccctgtc

SEQ ID NO: 1763336 - DNA, 13 bp, Homo sapiens
gctgggtgtttca

SEQ ID NO: 1763337 - DNA, 17 bp, Homo sapiens
gctgggttcccactccc

SEQ ID NO: 1763338 - DNA, 20 bp, Homo sapiens
gctgggttcccactcccggc

SEQ ID NO: 1763339 - DNA, 16 bp, Homo sapiens
gctggtaacagtggct

SEQ ID NO: 1763340 - DNA, 18 bp, Homo sapiens
gctggtaacagtggctgc

SEQ ID NO: 1763341 - DNA, 16 bp, Homo sapiens
gctggtaacagttcat

SEQ ID NO: 1763342 - DNA, 15 bp, Homo sapiens
gctggtaagagaagt

SEQ ID NO: 1763343 - DNA, 17 bp, Homo sapiens
gctggtacaacggaggc

SEQ ID NO: 1763344 - DNA, 14 bp, Homo sapiens
gctggtacctgccc

SEQ ID NO: 1763345 - DNA, 20 bp, Homo sapiens
gctggtagaaaaaggggcct

SEQ ID NO: 1763346 - DNA, 16 bp, Homo sapiens
gctggtagcagcaggc

SEQ ID NO: 1763347 - DNA, 18 bp, Homo sapiens
gctggtagcagcaggctc

SEQ ID NO: 1763348 - DNA, 13 bp, Homo sapiens
gctggtatttcta

SEQ ID NO: 1763349 - DNA, 13 bp, Homo sapiens
gctggtcactctg

SEQ ID NO: 1763350 - DNA, 16 bp, Homo sapiens
gctggtcactctgccc

SEQ ID NO: 1763351 - DNA, 18 bp, Homo sapiens
gctggtcactctgccctc

SEQ ID NO: 1763352 - DNA, 17 bp, Homo sapiens
gctggtcagtctttgct

SEQ ID NO: 1763353 - DNA, 20 bp, Homo sapiens
gctggtcagtctttgctcag

SEQ ID NO: 1763354 - DNA, 16 bp, Homo sapiens
gctggtcccctcctca

SEQ ID NO: 1763355 - DNA, 18 bp, Homo sapiens
gctggtcccctcctcagt

SEQ ID NO: 1763356 - DNA, 14 bp, Homo sapiens
gctggtccctgccc

SEQ ID NO: 1763357 - DNA, 17 bp, Homo sapiens
gctggtccctgccctcc

SEQ ID NO: 1763358 - DNA, 19 bp, Homo sapiens
gctggtccctgccctcccc

SEQ ID NO: 1763359 - DNA, 18 bp, Homo sapiens
gctggtccttatttattt

SEQ ID NO: 1763360 - DNA, 21 bp, Homo sapiens
gctggtgaacactgtgaccag

SEQ ID NO: 1763361 - DNA, 22 bp, Homo sapiens
gctggtgaacactgtgaccagg

SEQ ID NO: 1763362 - DNA, 21 bp, Homo sapiens
gctggtgccaaatagccccag

SEQ ID NO: 1763363 - DNA, 15 bp, Homo sapiens
gctggtgccagcctt

SEQ ID NO: 1763364 - DNA, 13 bp, Homo sapiens
gctggtgcccgga

SEQ ID NO: 1763365 - DNA, 12 bp, Homo sapiens
gctggtggacca

SEQ ID NO: 1763366 - DNA, 23 bp, Homo sapiens
gctggtggccctgtgcctgggcc

SEQ ID NO: 1763367 - DNA, 13 bp, Homo sapiens
gctggtggccttg

SEQ ID NO: 1763368 - DNA, 14 bp, Homo sapiens
gctggtggccttgg

SEQ ID NO: 1763369 - DNA, 18 bp, Homo sapiens
gctggtggccttgggcct

SEQ ID NO: 1763370 - DNA, 16 bp, Homo sapiens
gctggtgggaaggccg

SEQ ID NO: 1763371 - DNA, 22 bp, Homo sapiens
gctggtggttaaggccagggcc

SEQ ID NO: 1763372 - DNA, 19 bp, Homo sapiens
gctggtgtcctgaccaccc

SEQ ID NO: 1763373 - DNA, 15 bp, Homo sapiens
gctggttaatgggaa

SEQ ID NO: 1763374 - DNA, 14 bp, Homo sapiens
gctggttgctgtag

SEQ ID NO: 1763375 - DNA, 15 bp, Homo sapiens
gctggttgctgtaga

SEQ ID NO: 1763376 - DNA, 24 bp, Homo sapiens
gctggttgtcatttttgcagtaga

SEQ ID NO: 1763377 - DNA, 15 bp, Homo sapiens
gctggtttcctcatt

SEQ ID NO: 1763378 - DNA, 12 bp, Homo sapiens
gctggttttcct

SEQ ID NO: 1763379 - DNA, 23 bp, Homo sapiens
gctggttttcctaaatgcagtga

SEQ ID NO: 1763380 - DNA, 14 bp, Homo sapiens
gctgtaaataaatg

SEQ ID NO: 1763381 - DNA, 16 bp, Homo sapiens
gctgtaaataggttca

SEQ ID NO: 1763382 - DNA, 16 bp, Homo sapiens
gctgtaacgtggcact

SEQ ID NO: 1763383 - DNA, 21 bp, Homo sapiens
gctgtaactactttataacta

SEQ ID NO: 1763384 - DNA, 18 bp, Homo sapiens
gctgtaactgagagaaag

SEQ ID NO: 1763385 - DNA, 14 bp, Homo sapiens
gctgtaactgctga

SEQ ID NO: 1763386 - DNA, 16 bp, Homo sapiens
gctgtaactgctgagc

SEQ ID NO: 1763387 - DNA, 18 bp, Homo sapiens
gctgtaactgctgagcca

SEQ ID NO: 1763388 - DNA, 22 bp, Homo sapiens
gctgtaactgctgagccactcg

SEQ ID NO: 1763389 - DNA, 16 bp, Homo sapiens
gctgtaacttaaaata

SEQ ID NO: 1763390 - DNA, 15 bp, Homo sapiens
gctgtaaggctctag

SEQ ID NO: 1763391 - DNA, 12 bp, Homo sapiens
gctgtaagggca

SEQ ID NO: 1763392 - DNA, 15 bp, Homo sapiens
gctgtaatattgtaa

SEQ ID NO: 1763393 - DNA, 16 bp, Homo sapiens
gctgtaatcaagaaaa

SEQ ID NO: 1763394 - DNA, 15 bp, Homo sapiens
gctgtaatcatttgt

SEQ ID NO: 1763395 - DNA, 17 bp, Homo sapiens
gctgtaatgacaaaaga

SEQ ID NO: 1763396 - DNA, 19 bp, Homo sapiens
gctgtaccacatctgctct

SEQ ID NO: 1763397 - DNA, 21 bp, Homo sapiens
gctgtaccacatctgctctag

SEQ ID NO: 1763398 - DNA, 17 bp, Homo sapiens
gctgtacccttccacct

SEQ ID NO: 1763399 - DNA, 20 bp, Homo sapiens
gctgtacccttccacctcct

SEQ ID NO: 1763400 - DNA, 17 bp, Homo sapiens
gctgtaccctttaagat

SEQ ID NO: 1763401 - DNA, 13 bp, Homo sapiens
gctgtactataag

SEQ ID NO: 1763402 - DNA, 13 bp, Homo sapiens
gctgtactcagag

SEQ ID NO: 1763403 - DNA, 17 bp, Homo sapiens
gctgtacttcttgaata

SEQ ID NO: 1763404 - DNA, 18 bp, Homo sapiens
gctgtacttcttgaatat

SEQ ID NO: 1763405 - DNA, 20 bp, Homo sapiens
gctgtacttcttgaatataa

SEQ ID NO: 1763406 - DNA, 17 bp, Homo sapiens
gctgtagaaacacataa

SEQ ID NO: 1763407 - DNA, 18 bp, Homo sapiens
gctgtagatggtgacctg

SEQ ID NO: 1763408 - DNA, 19 bp, Homo sapiens
gctgtagatggtgacctgg

SEQ ID NO: 1763409 - DNA, 13 bp, Homo sapiens
gctgtagccatgg

SEQ ID NO: 1763410 - DNA, 15 bp, Homo sapiens
gctgtagccatggct

SEQ ID NO: 1763411 - DNA, 19 bp, Homo sapiens
gctgtagccatggctcagg

SEQ ID NO: 1763412 - DNA, 20 bp, Homo sapiens
gctgtagccatggctcaggc

SEQ ID NO: 1763413 - DNA, 22 bp, Homo sapiens
gctgtagccatggctcaggcaa

SEQ ID NO: 1763414 - DNA, 16 bp, Homo sapiens
gctgtaggagagtcgg

SEQ ID NO: 1763415 - DNA, 13 bp, Homo sapiens
gctgtaggtgtgc

SEQ ID NO: 1763416 - DNA, 14 bp, Homo sapiens
gctgtatcttgttt

SEQ ID NO: 1763417 - DNA, 13 bp, Homo sapiens
gctgtattcttct

SEQ ID NO: 1763418 - DNA, 14 bp, Homo sapiens
gctgtattgtctga

SEQ ID NO: 1763419 - DNA, 13 bp, Homo sapiens
gctgtatttatct

SEQ ID NO: 1763420 - DNA, 20 bp, Homo sapiens
gctgtatttcctgcttccct

SEQ ID NO: 1763421 - DNA, 15 bp, Homo sapiens
gctgtattttaacac

SEQ ID NO: 1763422 - DNA, 22 bp, Homo sapiens
gctgtattttaacactttgtat

SEQ ID NO: 1763423 - DNA, 22 bp, Homo sapiens
gctgtattttcttttatatctg

SEQ ID NO: 1763424 - DNA, 24 bp, Homo sapiens
gctgtattttcttttatatctgta

SEQ ID NO: 1763425 - DNA, 16 bp, Homo sapiens
gctgtcaccaaggaaa

SEQ ID NO: 1763426 - DNA, 16 bp, Homo sapiens
gctgtcactgctgctt

SEQ ID NO: 1763427 - DNA, 16 bp, Homo sapiens
gctgtcacttcttcac

SEQ ID NO: 1763428 - DNA, 18 bp, Homo sapiens
gctgtcataagaatgaat

SEQ ID NO: 1763429 - DNA, 15 bp, Homo sapiens
gctgtccaggcagct

SEQ ID NO: 1763430 - DNA, 19 bp, Homo sapiens
gctgtccaggcagctccct

SEQ ID NO: 1763431 - DNA, 15 bp, Homo sapiens
gctgtcccctctgtc

SEQ ID NO: 1763432 - DNA, 13 bp, Homo sapiens
gctgtccctcact

SEQ ID NO: 1763433 - DNA, 15 bp, Homo sapiens
gctgtccctccccct

SEQ ID NO: 1763434 - DNA, 12 bp, Homo sapiens
gctgtccctgca

SEQ ID NO: 1763435 - DNA, 16 bp, Homo sapiens
gctgtccctgcagggc

SEQ ID NO: 1763436 - DNA, 22 bp, Homo sapiens
gctgtcccttgcttgcctgcag

SEQ ID NO: 1763437 - DNA, 20 bp, Homo sapiens
gctgtcctgagccccctgca

SEQ ID NO: 1763438 - DNA, 13 bp, Homo sapiens
gctgtcctgctca

SEQ ID NO: 1763439 - DNA, 14 bp, Homo sapiens
gctgtcctgctgcc

SEQ ID NO: 1763440 - DNA, 19 bp, Homo sapiens
gcttctatgtccaacagag

SEQ ID NO: 1763441 - DNA, 15 bp, Homo sapiens
gcttctccacctccc

SEQ ID NO: 1763442 - DNA, 21 bp, Homo sapiens
gcttctccgccagcctcctct

SEQ ID NO: 1763443 - DNA, 13 bp, Homo sapiens
gcttctcctgtga

SEQ ID NO: 1763444 - DNA, 14 bp, Homo sapiens
gcttctcctgtgac

SEQ ID NO: 1763445 - DNA, 15 bp, Homo sapiens
gcttctcctgtgacc

SEQ ID NO: 1763446 - DNA, 22 bp, Homo sapiens
gcttctcggcttggatcctggg

SEQ ID NO: 1763447 - DNA, 19 bp, Homo sapiens
gcttctcggggtccagtgc

SEQ ID NO: 1763448 - DNA, 18 bp, Homo sapiens
gcttctctagctctctag

SEQ ID NO: 1763449 - DNA, 21 bp, Homo sapiens
gcttctctagctctctaggcc

SEQ ID NO: 1763450 - DNA, 16 bp, Homo sapiens
gcttctctccacagtg

SEQ ID NO: 1763451 - DNA, 18 bp, Homo sapiens
gcttctctccacagtgtt

SEQ ID NO: 1763452 - DNA, 13 bp, Homo sapiens
gcttctctctttt

SEQ ID NO: 1763453 - DNA, 17 bp, Homo sapiens
gcttctctcttttcctc

SEQ ID NO: 1763454 - DNA, 13 bp, Homo sapiens
gcttctctgactt

SEQ ID NO: 1763455 - DNA, 18 bp, Homo sapiens
gcttctctgacttctgcc

SEQ ID NO: 1763456 - DNA, 20 bp, Homo sapiens
gcttctctgacttctgcctg

SEQ ID NO: 1763457 - DNA, 21 bp, Homo sapiens
gcttctctgacttctgcctgg

SEQ ID NO: 1763458 - DNA, 18 bp, Homo sapiens
gcttctgaactcaagctg

SEQ ID NO: 1763459 - DNA, 15 bp, Homo sapiens
gcttctgatttttct

SEQ ID NO: 1763460 - DNA, 23 bp, Homo sapiens
gcttctgatttttctctttttta

SEQ ID NO: 1763461 - DNA, 15 bp, Homo sapiens
gcttctgcaccctcc

SEQ ID NO: 1763462 - DNA, 21 bp, Homo sapiens
gcttctgcaccctccaccctg

SEQ ID NO: 1763463 - DNA, 12 bp, Homo sapiens
gcttctgctgaa

SEQ ID NO: 1763464 - DNA, 14 bp, Homo sapiens
gcttctgcttttct

SEQ ID NO: 1763465 - DNA, 15 bp, Homo sapiens
gcttctgcttttctg

SEQ ID NO: 1763466 - DNA, 20 bp, Homo sapiens
gcttctgcttttctgccctg

SEQ ID NO: 1763467 - DNA, 13 bp, Homo sapiens
gcttctggagccc

SEQ ID NO: 1763468 - DNA, 17 bp, Homo sapiens
gcttctggagcccttgg

SEQ ID NO: 1763469 - DNA, 18 bp, Homo sapiens
gcttctggagcccttggg

SEQ ID NO: 1763470 - DNA, 18 bp, Homo sapiens
gcttctgtgcactagcct

SEQ ID NO: 1763471 - DNA, 22 bp, Homo sapiens
gcttctgtgcactagcctgtga

SEQ ID NO: 1763472 - DNA, 18 bp, Homo sapiens
gcttcttactattaagca

SEQ ID NO: 1763473 - DNA, 19 bp, Homo sapiens
gcttcttcagatcagtgct

SEQ ID NO: 1763474 - DNA, 15 bp, Homo sapiens
gcttcttgcctctgt

SEQ ID NO: 1763475 - DNA, 19 bp, Homo sapiens
gcttcttggagctttggaa

SEQ ID NO: 1763476 - DNA, 13 bp, Homo sapiens
gcttgaacccagg

SEQ ID NO: 1763477 - DNA, 19 bp, Homo sapiens
gcttgaacctgggaggcag

SEQ ID NO: 1763478 - DNA, 21 bp, Homo sapiens
gcttgaagatcgttagtatct

SEQ ID NO: 1763479 - DNA, 12 bp, Homo sapiens
gcttgaagccaa

SEQ ID NO: 1763480 - DNA, 14 bp, Homo sapiens
gcttgaagccaaag

SEQ ID NO: 1763481 - DNA, 20 bp, Homo sapiens
gcttgaagccaaagaaaaat

SEQ ID NO: 1763482 - DNA, 14 bp, Homo sapiens
gcttgaaggactgc

SEQ ID NO: 1763483 - DNA, 18 bp, Homo sapiens
gcttgaaggccctgctga

SEQ ID NO: 1763484 - DNA, 22 bp, Homo sapiens
gcttgaatgtccccattctata

SEQ ID NO: 1763485 - DNA, 15 bp, Homo sapiens
gcttgacaacatctg

SEQ ID NO: 1763486 - DNA, 14 bp, Homo sapiens
gcttgacctgaggc

SEQ ID NO: 1763487 - DNA, 22 bp, Homo sapiens
gcttgagaaggttactgagtga

SEQ ID NO: 1763488 - DNA, 15 bp, Homo sapiens
gcttgagccaggagg

SEQ ID NO: 1763489 - DNA, 12 bp, Homo sapiens
gcttgagcccag

SEQ ID NO: 1763490 - DNA, 18 bp, Homo sapiens
gcttgagccgggcccctg

SEQ ID NO: 1763491 - DNA, 22 bp, Homo sapiens
gcttgagccgggcccctgggct

SEQ ID NO: 1763492 - DNA, 13 bp, Homo sapiens
gcttgagcctccc

SEQ ID NO: 1763493 - DNA, 16 bp, Homo sapiens
gcttgagcctccccca

SEQ ID NO: 1763494 - DNA, 20 bp, Homo sapiens
gcttgagctcccctggagcc

SEQ ID NO: 1763495 - DNA, 23 bp, Homo sapiens
gcttgaggccaagatggctgctg

SEQ ID NO: 1763496 - DNA, 19 bp, Homo sapiens
gcttgagtttggggaatgc

SEQ ID NO: 1763497 - DNA, 22 bp, Homo sapiens
gcttgccccactctgcctgcct

SEQ ID NO: 1763498 - DNA, 14 bp, Homo sapiens
gcttgccccggccc

SEQ ID NO: 1763499 - DNA, 18 bp, Homo sapiens
gcttgccctgttaaaaga

SEQ ID NO: 1763500 - DNA, 22 bp, Homo sapiens
gcttgccgactggctgtgagac

SEQ ID NO: 1763501 - DNA, 18 bp, Homo sapiens
gcttgccgggcctgggcc

SEQ ID NO: 1763502 - DNA, 24 bp, Homo sapiens
gcttgccgggcctgggcctcctgg

SEQ ID NO: 1763503 - DNA, 22 bp, Homo sapiens
gcttgctccagattctgatgca

SEQ ID NO: 1763504 - DNA, 13 bp, Homo sapiens
gcttgctccaggg

SEQ ID NO: 1763505 - DNA, 14 bp, Homo sapiens
gcttgctccagggt

SEQ ID NO: 1763506 - DNA, 17 bp, Homo sapiens
gcttgcttgccgagcct

SEQ ID NO: 1763507 - DNA, 19 bp, Homo sapiens
gcttggaaagcatcacctc

SEQ ID NO: 1763508 - DNA, 12 bp, Homo sapiens
gcttggaagcca

SEQ ID NO: 1763509 - DNA, 17 bp, Homo sapiens
gcttggacttcctgggg

SEQ ID NO: 1763510 - DNA, 22 bp, Homo sapiens
gcttggacttcctggggccccg

SEQ ID NO: 1763511 - DNA, 21 bp, Homo sapiens
gcttggagggaagggagaaag

SEQ ID NO: 1763512 - DNA, 12 bp, Homo sapiens
gcttggcccagc

SEQ ID NO: 1763513 - DNA, 16 bp, Homo sapiens
gcttggcccggccggc

SEQ ID NO: 1763514 - DNA, 14 bp, Homo sapiens
gcttggcctgctgt

SEQ ID NO: 1763515 - DNA, 23 bp, Homo sapiens
gcttggccttatgaccagtgaga

SEQ ID NO: 1763516 - DNA, 12 bp, Homo sapiens
gcttggctggtg

SEQ ID NO: 1763517 - DNA, 22 bp, Homo sapiens
gcttggcttcctcttcttgttg

SEQ ID NO: 1763518 - DNA, 14 bp, Homo sapiens
gcttgggcccagct

SEQ ID NO: 1763519 - DNA, 19 bp, Homo sapiens
gcttgggcccagctgggct

SEQ ID NO: 1763520 - DNA, 12 bp, Homo sapiens
gcttggggaaaa

SEQ ID NO: 1763521 - DNA, 18 bp, Homo sapiens
gcttggggattgtacacg

SEQ ID NO: 1763522 - DNA, 20 bp, Homo sapiens
gcttgggtggtgggtgctgg

SEQ ID NO: 1763523 - DNA, 19 bp, Homo sapiens
gcttggtgtcttggcactg

SEQ ID NO: 1763524 - DNA, 13 bp, Homo sapiens
gcttggttggctg

SEQ ID NO: 1763525 - DNA, 14 bp, Homo sapiens
gcttgtaacaagaa

SEQ ID NO: 1763526 - DNA, 18 bp, Homo sapiens
gcttgtaatcaagccttt

SEQ ID NO: 1763527 - DNA, 13 bp, Homo sapiens
gcttgtacatttt

SEQ ID NO: 1763528 - DNA, 14 bp, Homo sapiens
gcttgtactgggac

SEQ ID NO: 1763529 - DNA, 18 bp, Homo sapiens
gcttgtagaactcactct

SEQ ID NO: 1763530 - DNA, 22 bp, Homo sapiens
gcttgtagaagtaggaggaaac

SEQ ID NO: 1763531 - DNA, 18 bp, Homo sapiens
gcttgtcactagcagctg

SEQ ID NO: 1763532 - DNA, 11 bp, Homo sapiens
gcttgtcatcc

SEQ ID NO: 1763533 - DNA, 16 bp, Homo sapiens
gcttgtcattccagag

SEQ ID NO: 1763534 - DNA, 21 bp, Homo sapiens
gcttgtccaacccgaggcccg

SEQ ID NO: 1763535 - DNA, 12 bp, Homo sapiens
gcttgtgacagt

SEQ ID NO: 1763536 - DNA, 21 bp, Homo sapiens
gcttgtggccccttttacttt

SEQ ID NO: 1763537 - DNA, 21 bp, Homo sapiens
gcttgttaatgctttctgaag

SEQ ID NO: 1763538 - DNA, 15 bp, Homo sapiens
gcttgttatttataa

SEQ ID NO: 1763539 - DNA, 17 bp, Homo sapiens
gctttaaaaccacagct

SEQ ID NO: 1763540 - DNA, 13 bp, Homo sapiens
gctttaaaataaa

SEQ ID NO: 1763541 - DNA, 14 bp, Homo sapiens
gctttaaaattctc

SEQ ID NO: 1763542 - DNA, 13 bp, Homo sapiens
gctttaaacaaat

SEQ ID NO: 1763543 - DNA, 17 bp, Homo sapiens
gctttaaacaaattcat

SEQ ID NO: 1763544 - DNA, 21 bp, Homo sapiens
gctttaacctgaaccttgagc

SEQ ID NO: 1763545 - DNA, 13 bp, Homo sapiens
gctttaagccttc

SEQ ID NO: 1763546 - DNA, 14 bp, Homo sapiens
gctttaatatgagc

SEQ ID NO: 1763547 - DNA, 20 bp, Homo sapiens
gctttaatatgagcttcaat

SEQ ID NO: 1763548 - DNA, 23 bp, Homo sapiens
gctttaatatgagcttcaatata

SEQ ID NO: 1763549 - DNA, 19 bp, Homo sapiens
gctttaatgagaatagaaa

SEQ ID NO: 1763550 - DNA, 20 bp, Homo sapiens
gctttaatgagtgcacctgc

SEQ ID NO: 1763551 - DNA, 19 bp, Homo sapiens
gctttaattccatgaatgt

SEQ ID NO: 1763552 - DNA, 15 bp, Homo sapiens
gctttaattgcttta

SEQ ID NO: 1763553 - DNA, 12 bp, Homo sapiens
gctttaattgta

SEQ ID NO: 1763554 - DNA, 16 bp, Homo sapiens
gctttaattgtataag

SEQ ID NO: 1763555 - DNA, 16 bp, Homo sapiens
ggaactctccctctgg

SEQ ID NO: 1763556 - DNA, 16 bp, Homo sapiens
ggaactctgtgcaggt

SEQ ID NO: 1763557 - DNA, 14 bp, Homo sapiens
ggaactgctgggct

SEQ ID NO: 1763558 - DNA, 15 bp, Homo sapiens
ggaactgctgggctt

SEQ ID NO: 1763559 - DNA, 12 bp, Homo sapiens
ggaactgggctg

SEQ ID NO: 1763560 - DNA, 16 bp, Homo sapiens
ggaactgggctgggcc

SEQ ID NO: 1763561 - DNA, 22 bp, Homo sapiens
ggaacttggggagttaagacct

SEQ ID NO: 1763562 - DNA, 23 bp, Homo sapiens
ggaacttggggagttaagacctg

SEQ ID NO: 1763563 - DNA, 18 bp, Homo sapiens
ggaactttgcagcatacc

SEQ ID NO: 1763564 - DNA, 17 bp, Homo sapiens
ggaagaaattcaggtac

SEQ ID NO: 1763565 - DNA, 16 bp, Homo sapiens
ggaagaacaacaaaga

SEQ ID NO: 1763566 - DNA, 13 bp, Homo sapiens
ggaagaacataga

SEQ ID NO: 1763567 - DNA, 16 bp, Homo sapiens
ggaagaactgtgataa

SEQ ID NO: 1763568 - DNA, 12 bp, Homo sapiens
ggaagaagaaat

SEQ ID NO: 1763569 - DNA, 14 bp, Homo sapiens
ggaagaagggagaa

SEQ ID NO: 1763570 - DNA, 16 bp, Homo sapiens
ggaagaatgaaagctg

SEQ ID NO: 1763571 - DNA, 14 bp, Homo sapiens
ggaagacagtggcc

SEQ ID NO: 1763572 - DNA, 19 bp, Homo sapiens
ggaagaccaaaggaaggaa

SEQ ID NO: 1763573 - DNA, 15 bp, Homo sapiens
ggaagaccaaagttt

SEQ ID NO: 1763574 - DNA, 21 bp, Homo sapiens
ggaagaccaaagtttgcaact

SEQ ID NO: 1763575 - DNA, 21 bp, Homo sapiens
ggaagaccagctttgcagtga

SEQ ID NO: 1763576 - DNA, 18 bp, Homo sapiens
ggaagactcaggagtctg

SEQ ID NO: 1763577 - DNA, 19 bp, Homo sapiens
ggaagactgtgcagaagac

SEQ ID NO: 1763578 - DNA, 16 bp, Homo sapiens
ggaagagaagaaatag

SEQ ID NO: 1763579 - DNA, 22 bp, Homo sapiens
ggaagagaagaaatagcagagc

SEQ ID NO: 1763580 - DNA, 23 bp, Homo sapiens
ggaagagaagaaatagcagagcc

SEQ ID NO: 1763581 - DNA, 23 bp, Homo sapiens
ggaagagaagagggcccagccca

SEQ ID NO: 1763582 - DNA, 16 bp, Homo sapiens
ggaagagatgtttaca

SEQ ID NO: 1763583 - DNA, 15 bp, Homo sapiens
ggaagagcagcctga

SEQ ID NO: 1763584 - DNA, 13 bp, Homo sapiens
ggaagagcaggac

SEQ ID NO: 1763585 - DNA, 23 bp, Homo sapiens
ggaagagcaggactccaggccca

SEQ ID NO: 1763586 - DNA, 17 bp, Homo sapiens
ggaagagccaaagaata

SEQ ID NO: 1763587 - DNA, 14 bp, Homo sapiens
ggaagagccacctg

SEQ ID NO: 1763588 - DNA, 15 bp, Homo sapiens
ggaagagcccagtct

SEQ ID NO: 1763589 - DNA, 22 bp, Homo sapiens
ggaagagctcccctccacagct

SEQ ID NO: 1763590 - DNA, 13 bp, Homo sapiens
ggaagaggcccac

SEQ ID NO: 1763591 - DNA, 13 bp, Homo sapiens
ggaagaggcctgt

SEQ ID NO: 1763592 - DNA, 23 bp, Homo sapiens
ggaagaggcctgtttggcctctc

SEQ ID NO: 1763593 - DNA, 15 bp, Homo sapiens
ggaagagggacagat

SEQ ID NO: 1763594 - DNA, 21 bp, Homo sapiens
ggaagagggcagtacctggga

SEQ ID NO: 1763595 - DNA, 19 bp, Homo sapiens
ggaagagttacaataaagt

SEQ ID NO: 1763596 - DNA, 13 bp, Homo sapiens
ggaagagtttttg

SEQ ID NO: 1763597 - DNA, 21 bp, Homo sapiens
ggaagataggctctgcacaga

SEQ ID NO: 1763598 - DNA, 15 bp, Homo sapiens
ggaagatcagatgca

SEQ ID NO: 1763599 - DNA, 23 bp, Homo sapiens
ggaagatggagacaccctctggg

SEQ ID NO: 1763600 - DNA, 17 bp, Homo sapiens
ggaagatggtccgtgcc

SEQ ID NO: 1763601 - DNA, 13 bp, Homo sapiens
ggaagcagccagc

SEQ ID NO: 1763602 - DNA, 15 bp, Homo sapiens
ggaagcagccagctc

SEQ ID NO: 1763603 - DNA, 19 bp, Homo sapiens
ggaagcagtgccttccata

SEQ ID NO: 1763604 - DNA, 13 bp, Homo sapiens
ggaagccaaagtt

SEQ ID NO: 1763605 - DNA, 23 bp, Homo sapiens
ggaagccaaagttttcaaactgc

SEQ ID NO: 1763606 - DNA, 16 bp, Homo sapiens
ggaagccagctttccc

SEQ ID NO: 1763607 - DNA, 15 bp, Homo sapiens
ggaagccaggctgag

SEQ ID NO: 1763608 - DNA, 20 bp, Homo sapiens
ggaagccatcccttttttta

SEQ ID NO: 1763609 - DNA, 14 bp, Homo sapiens
ggaagcccatcctg

SEQ ID NO: 1763610 - DNA, 18 bp, Homo sapiens
ggaagcccatcctgacca

SEQ ID NO: 1763611 - DNA, 14 bp, Homo sapiens
ggaagcccctgggc

SEQ ID NO: 1763612 - DNA, 15 bp, Homo sapiens
ggaagcccctgggcc

SEQ ID NO: 1763613 - DNA, 18 bp, Homo sapiens
ggaagcccctgggcccag

SEQ ID NO: 1763614 - DNA, 19 bp, Homo sapiens
ggaagccccttactatgat

SEQ ID NO: 1763615 - DNA, 23 bp, Homo sapiens
ggaagccctggatttcagaaaga

SEQ ID NO: 1763616 - DNA, 16 bp, Homo sapiens
ggaagccggcggccca

SEQ ID NO: 1763617 - DNA, 23 bp, Homo sapiens
ggaagccggggtgtaacttcctg

SEQ ID NO: 1763618 - DNA, 20 bp, Homo sapiens
ggaagccgtctgactccaga

SEQ ID NO: 1763619 - DNA, 16 bp, Homo sapiens
ggaagcctgtgccagc

SEQ ID NO: 1763620 - DNA, 12 bp, Homo sapiens
ggaagcctgtgg

SEQ ID NO: 1763621 - DNA, 20 bp, Homo sapiens
ggaagcgcgagggcctcaaa

SEQ ID NO: 1763622 - DNA, 20 bp, Homo sapiens
ggaagctcagccttctcctc

SEQ ID NO: 1763623 - DNA, 18 bp, Homo sapiens
ggaagctggccgagggtc

SEQ ID NO: 1763624 - DNA, 18 bp, Homo sapiens
ggaagctgtactcagagc

SEQ ID NO: 1763625 - DNA, 19 bp, Homo sapiens
ggaagctgtactcagagca

SEQ ID NO: 1763626 - DNA, 23 bp, Homo sapiens
ggaagctgtactcagagcagagc

SEQ ID NO: 1763627 - DNA, 20 bp, Homo sapiens
ggaagcttgagcctccccca

SEQ ID NO: 1763628 - DNA, 16 bp, Homo sapiens
ggaagctttgagttga

SEQ ID NO: 1763629 - DNA, 19 bp, Homo sapiens
ggaaggaaagaaagaagga

SEQ ID NO: 1763630 - DNA, 20 bp, Homo sapiens
ggaaggaacaaagacaggca

SEQ ID NO: 1763631 - DNA, 20 bp, Homo sapiens
ggaaggaatgtcagggccag

SEQ ID NO: 1763632 - DNA, 23 bp, Homo sapiens
ggaaggaatgtcagggccaggtg

SEQ ID NO: 1763633 - DNA, 21 bp, Homo sapiens
ggaaggagactcacctctgcc

SEQ ID NO: 1763634 - DNA, 13 bp, Homo sapiens
ggaaggagagcct

SEQ ID NO: 1763635 - DNA, 16 bp, Homo sapiens
ggaaggagagcctgct

SEQ ID NO: 1763636 - DNA, 17 bp, Homo sapiens
ggaaggagagcctgctg

SEQ ID NO: 1763637 - DNA, 21 bp, Homo sapiens
ggaaggagccagtttgccgga

SEQ ID NO: 1763638 - DNA, 19 bp, Homo sapiens
ggaaggagggagctgctca

SEQ ID NO: 1763639 - DNA, 13 bp, Homo sapiens
ggaaggagggcac

SEQ ID NO: 1763640 - DNA, 14 bp, Homo sapiens
ggaaggagggcaca

SEQ ID NO: 1763641 - DNA, 17 bp, Homo sapiens
ggaaggatctgctgagg

SEQ ID NO: 1763642 - DNA, 22 bp, Homo sapiens
ggaaggatctgctgaggcccag

SEQ ID NO: 1763643 - DNA, 18 bp, Homo sapiens
ggaaggcactacatgaaa

SEQ ID NO: 1763644 - DNA, 13 bp, Homo sapiens
ggaaggcagctgc

SEQ ID NO: 1763645 - DNA, 14 bp, Homo sapiens
ggaaggcagctgct

SEQ ID NO: 1763646 - DNA, 13 bp, Homo sapiens
ggaaggcagggca

SEQ ID NO: 1763647 - DNA, 13 bp, Homo sapiens
ggaaggccacctc

SEQ ID NO: 1763648 - DNA, 18 bp, Homo sapiens
ggaaggcctttcttctgt

SEQ ID NO: 1763649 - DNA, 22 bp, Homo sapiens
ggaaggctaagcatggcctgga

SEQ ID NO: 1763650 - DNA, 12 bp, Homo sapiens
ggaaggctggct

SEQ ID NO: 1763651 - DNA, 14 bp, Homo sapiens
ggaaggctggctgg

SEQ ID NO: 1763652 - DNA, 18 bp, Homo sapiens
ggaagggaaaaaaaatgt

SEQ ID NO: 1763653 - DNA, 23 bp, Homo sapiens
ggaagggaccaaggcaaggcagg

SEQ ID NO: 1763654 - DNA, 16 bp, Homo sapiens
ggaagggatctgagaa

SEQ ID NO: 1763655 - DNA, 14 bp, Homo sapiens
ggaagggcaaaacc

SEQ ID NO: 1763656 - DNA, 17 bp, Homo sapiens
ggaagggcatgcacggg

SEQ ID NO: 1763657 - DNA, 21 bp, Homo sapiens
ggaagggccagtctgggctgc

SEQ ID NO: 1763658 - DNA, 14 bp, Homo sapiens
ggaaggggcagcag

SEQ ID NO: 1763659 - DNA, 15 bp, Homo sapiens
ggaaggggcagcagg

SEQ ID NO: 1763660 - DNA, 16 bp, Homo sapiens
ggaaggggcagcagga

SEQ ID NO: 1763661 - DNA, 15 bp, Homo sapiens
ggaaggtagcccagc

SEQ ID NO: 1763662 - DNA, 22 bp, Homo sapiens
ggaaggtagcccagcactgtga

SEQ ID NO: 1763663 - DNA, 23 bp, Homo sapiens
ggaaggtagcccagcactgtgaa

SEQ ID NO: 1763664 - DNA, 14 bp, Homo sapiens
ggaaggtgatgggg

SEQ ID NO: 1763665 - DNA, 13 bp, Homo sapiens
ggaaggtggggcc

SEQ ID NO: 1763666 - DNA, 14 bp, Homo sapiens
ggaaggtggggccc

SEQ ID NO: 1763667 - DNA, 15 bp, Homo sapiens
ggaaggttcaggggc

SEQ ID NO: 1763668 - DNA, 16 bp, Homo sapiens
ggaagtaacagacaca

SEQ ID NO: 1763669 - DNA, 18 bp, Homo sapiens
ggaagtcatcctgccaac

SEQ ID NO: 1763670 - DNA, 15 bp, Homo sapiens
ggagaacctcaggct

SEQ ID NO: 1763671 - DNA, 17 bp, Homo sapiens
ggagaagaacaagaaat

SEQ ID NO: 1763672 - DNA, 14 bp, Homo sapiens
ggagaagacccacg

SEQ ID NO: 1763673 - DNA, 16 bp, Homo sapiens
ggagaagagtattttt

SEQ ID NO: 1763674 - DNA, 21 bp, Homo sapiens
ggagaagagtatttttaacac

SEQ ID NO: 1763675 - DNA, 18 bp, Homo sapiens
ggagaagatcgcatggca

SEQ ID NO: 1763676 - DNA, 14 bp, Homo sapiens
ggagaagcacagct

SEQ ID NO: 1763677 - DNA, 18 bp, Homo sapiens
ggagaagcatgaaaaagc

SEQ ID NO: 1763678 - DNA, 19 bp, Homo sapiens
ggagaagccacaggcctga

SEQ ID NO: 1763679 - DNA, 20 bp, Homo sapiens
ggagaagccacaggcctgag

SEQ ID NO: 1763680 - DNA, 12 bp, Homo sapiens
ggagaagccagg

SEQ ID NO: 1763681 - DNA, 15 bp, Homo sapiens
ggagaagccaggaat

SEQ ID NO: 1763682 - DNA, 19 bp, Homo sapiens
ggagaagctcctctcccca

SEQ ID NO: 1763683 - DNA, 17 bp, Homo sapiens
ggagaagctgatccagt

SEQ ID NO: 1763684 - DNA, 12 bp, Homo sapiens
ggagaaggaaga

SEQ ID NO: 1763685 - DNA, 13 bp, Homo sapiens
ggagaaggaaggg

SEQ ID NO: 1763686 - DNA, 23 bp, Homo sapiens
ggagaaggaagggcagagaatgg

SEQ ID NO: 1763687 - DNA, 16 bp, Homo sapiens
ggagaagggagggtgg

SEQ ID NO: 1763688 - DNA, 20 bp, Homo sapiens
ggagaagggagggtggccag

SEQ ID NO: 1763689 - DNA, 17 bp, Homo sapiens
ggagaaggtctccaagg

SEQ ID NO: 1763690 - DNA, 22 bp, Homo sapiens
ggagaaggtctccaagggaggg

SEQ ID NO: 1763691 - DNA, 21 bp, Homo sapiens
ggagaagtgctccctggaggc

SEQ ID NO: 1763692 - DNA, 19 bp, Homo sapiens
ggagaatcatgtttctttg

SEQ ID NO: 1763693 - DNA, 18 bp, Homo sapiens
ggagaatcctcccttccc

SEQ ID NO: 1763694 - DNA, 22 bp, Homo sapiens
ggagaatggtgtgaacccggga

SEQ ID NO: 1763695 - DNA, 22 bp, Homo sapiens
ggagaatgtcagtatgtggaag

SEQ ID NO: 1763696 - DNA, 17 bp, Homo sapiens
ggagacaccagtggtgc

SEQ ID NO: 1763697 - DNA, 16 bp, Homo sapiens
ggagacaccctctggg

SEQ ID NO: 1763698 - DNA, 13 bp, Homo sapiens
ggagacagaccac

SEQ ID NO: 1763699 - DNA, 12 bp, Homo sapiens
ggagacagcagc

SEQ ID NO: 1763700 - DNA, 18 bp, Homo sapiens
ggagacagtgatctccat

SEQ ID NO: 1763701 - DNA, 17 bp, Homo sapiens
ggagacattgctctatg

SEQ ID NO: 1763702 - DNA, 22 bp, Homo sapiens
ggagacattgctctatgtctgc

SEQ ID NO: 1763703 - DNA, 13 bp, Homo sapiens
ggagaccagctca

SEQ ID NO: 1763704 - DNA, 23 bp, Homo sapiens
ggagaccgcttcacccctgcact

SEQ ID NO: 1763705 - DNA, 20 bp, Homo sapiens
ggagaccggggtatcctggg

SEQ ID NO: 1763706 - DNA, 12 bp, Homo sapiens
ggagacctgtgc

SEQ ID NO: 1763707 - DNA, 14 bp, Homo sapiens
ggagacctgtgcta

SEQ ID NO: 1763708 - DNA, 19 bp, Homo sapiens
ggagacggtttccagggag

SEQ ID NO: 1763709 - DNA, 10 bp, Homo sapiens
ggagactaga

SEQ ID NO: 1763710 - DNA, 14 bp, Homo sapiens
ggagactagattgc

SEQ ID NO: 1763711 - DNA, 9 bp, Homo sapiens
ggagactca

SEQ ID NO: 1763712 - DNA, 13 bp, Homo sapiens
ggagactcacctc

SEQ ID NO: 1763713 - DNA, 23 bp, Homo sapiens
ggagactgataacttggggaggc

SEQ ID NO: 1763714 - DNA, 18 bp, Homo sapiens
ggagactgccccacggcc

SEQ ID NO: 1763715 - DNA, 15 bp, Homo sapiens
ggagactgcttccca

SEQ ID NO: 1763716 - DNA, 19 bp, Homo sapiens
ggagactgcttcccatcct

SEQ ID NO: 1763717 - DNA, 22 bp, Homo sapiens
ggagacttagggcaccaggggt

SEQ ID NO: 1763718 - DNA, 17 bp, Homo sapiens
ggagacttgttctagag

SEQ ID NO: 1763719 - DNA, 13 bp, Homo sapiens
ggagactttctga

SEQ ID NO: 1763720 - DNA, 15 bp, Homo sapiens
ggagagaaatatttt

SEQ ID NO: 1763721 - DNA, 14 bp, Homo sapiens
ggagagacacagcg

SEQ ID NO: 1763722 - DNA, 20 bp, Homo sapiens
ggagagacggtgttgggagc

SEQ ID NO: 1763723 - DNA, 14 bp, Homo sapiens
ggagagactgtgag

SEQ ID NO: 1763724 - DNA, 14 bp, Homo sapiens
ggagagagaagcag

SEQ ID NO: 1763725 - DNA, 15 bp, Homo sapiens
ggagagagaccccgc

SEQ ID NO: 1763726 - DNA, 15 bp, Homo sapiens
ggagagagaggctgc

SEQ ID NO: 1763727 - DNA, 20 bp, Homo sapiens
ggagagagaggctgcctcag

SEQ ID NO: 1763728 - DNA, 23 bp, Homo sapiens
ggagagagaggctgcctcagcca

SEQ ID NO: 1763729 - DNA, 15 bp, Homo sapiens
ggagagagccaggat

SEQ ID NO: 1763730 - DNA, 13 bp, Homo sapiens
ggagagcagcagc

SEQ ID NO: 1763731 - DNA, 16 bp, Homo sapiens
ggagagcagcaggtgc

SEQ ID NO: 1763732 - DNA, 21 bp, Homo sapiens
ggagagcagccagcacccacc

SEQ ID NO: 1763733 - DNA, 14 bp, Homo sapiens
ggagagccagccct

SEQ ID NO: 1763734 - DNA, 15 bp, Homo sapiens
ggagagccagccctc

SEQ ID NO: 1763735 - DNA, 11 bp, Homo sapiens
ggagagcccag

SEQ ID NO: 1763736 - DNA, 18 bp, Homo sapiens
ggagagccccatggtggg

SEQ ID NO: 1763737 - DNA, 11 bp, Homo sapiens
ggagagcctgc

SEQ ID NO: 1763738 - DNA, 13 bp, Homo sapiens
ggagagcctgctg

SEQ ID NO: 1763739 - DNA, 14 bp, Homo sapiens
ggagagcctgctgg

SEQ ID NO: 1763740 - DNA, 16 bp, Homo sapiens
ggagagcctgctggca

SEQ ID NO: 1763741 - DNA, 15 bp, Homo sapiens
ggagagcggctggag

SEQ ID NO: 1763742 - DNA, 16 bp, Homo sapiens
ggagagcggctggaga

SEQ ID NO: 1763743 - DNA, 21 bp, Homo sapiens
ggagagctgattgcagaaagg

SEQ ID NO: 1763744 - DNA, 15 bp, Homo sapiens
ggagagctggtgccc

SEQ ID NO: 1763745 - DNA, 21 bp, Homo sapiens
ggagaggcagcatgcttgggc

SEQ ID NO: 1763746 - DNA, 23 bp, Homo sapiens
ggagaggcagcatgcttgggctg

SEQ ID NO: 1763747 - DNA, 23 bp, Homo sapiens
ggagaggccaagtctaatgaaga

SEQ ID NO: 1763748 - DNA, 19 bp, Homo sapiens
ggagagggaatgtgaaatt

SEQ ID NO: 1763749 - DNA, 22 bp, Homo sapiens
ggagagggacagcccactgaga

SEQ ID NO: 1763750 - DNA, 13 bp, Homo sapiens
ggagagggaggtc

SEQ ID NO: 1763751 - DNA, 18 bp, Homo sapiens
ggagagggcctctgcctg

SEQ ID NO: 1763752 - DNA, 18 bp, Homo sapiens
ggagaggggaagggccag

SEQ ID NO: 1763753 - DNA, 14 bp, Homo sapiens
ggagaggggcagaa

SEQ ID NO: 1763754 - DNA, 14 bp, Homo sapiens
ggagagggtctgga

SEQ ID NO: 1763755 - DNA, 23 bp, Homo sapiens
ggagaggttataggtcactcctg

SEQ ID NO: 1763756 - DNA, 19 bp, Homo sapiens
ggagagtcggtctgctttg

SEQ ID NO: 1763757 - DNA, 14 bp, Homo sapiens
ggagagtgcttggg

SEQ ID NO: 1763758 - DNA, 21 bp, Homo sapiens
ggagagtggttgttgccaact

SEQ ID NO: 1763759 - DNA, 17 bp, Homo sapiens
ggagagtgtgtgggcag

SEQ ID NO: 1763760 - DNA, 22 bp, Homo sapiens
ggagagttcaagcctgtgggag

SEQ ID NO: 1763761 - DNA, 23 bp, Homo sapiens
ggagataaaagcaattctgactg

SEQ ID NO: 1763762 - DNA, 19 bp, Homo sapiens
ggagataattactgccttg

SEQ ID NO: 1763763 - DNA, 13 bp, Homo sapiens
ggagatcctcctg

SEQ ID NO: 1763764 - DNA, 14 bp, Homo sapiens
ggagatgaccaggg

SEQ ID NO: 1763765 - DNA, 16 bp, Homo sapiens
ggagatgaccagggat

SEQ ID NO: 1763766 - DNA, 12 bp, Homo sapiens
ggagatggaggg

SEQ ID NO: 1763767 - DNA, 16 bp, Homo sapiens
ggagatggagggcttg

SEQ ID NO: 1763768 - DNA, 13 bp, Homo sapiens
ggagatgggaagg

SEQ ID NO: 1763769 - DNA, 22 bp, Homo sapiens
ggagatggtcagtgtggagagg

SEQ ID NO: 1763770 - DNA, 14 bp, Homo sapiens
ggagattgcttttg

SEQ ID NO: 1763771 - DNA, 23 bp, Homo sapiens
ggagcaagaaggaaggaggcaga

SEQ ID NO: 1763772 - DNA, 16 bp, Homo sapiens
ggagcacagccctggg

SEQ ID NO: 1763773 - DNA, 16 bp, Homo sapiens
ggagcacccagagcac

SEQ ID NO: 1763774 - DNA, 23 bp, Homo sapiens
ggagcacccagagcaccccctgc

SEQ ID NO: 1763775 - DNA, 14 bp, Homo sapiens
ggagcacctgaacc

SEQ ID NO: 1763776 - DNA, 22 bp, Homo sapiens
ggagcacctgaaccccatgggc

SEQ ID NO: 1763777 - DNA, 19 bp, Homo sapiens
ggagcacgaggtctggcca

SEQ ID NO: 1763778 - DNA, 14 bp, Homo sapiens
ggagcactgttcac

SEQ ID NO: 1763779 - DNA, 21 bp, Homo sapiens
ggagcacttgcgtcctgcaga

SEQ ID NO: 1763780 - DNA, 12 bp, Homo sapiens
ggagcagaactg

SEQ ID NO: 1763781 - DNA, 14 bp, Homo sapiens
ggagcagagggcag

SEQ ID NO: 1763782 - DNA, 20 bp, Homo sapiens
ggagcagagggcaggggtgc

SEQ ID NO: 1763783 - DNA, 17 bp, Homo sapiens
ggagcagcagccactgc

SEQ ID NO: 1763784 - DNA, 13 bp, Homo sapiens
ggagcagccagag

SEQ ID NO: 1763785 - DNA, 14 bp, Homo sapiens
ggaggttgcaggga

SEQ ID NO: 1763786 - DNA, 22 bp, Homo sapiens
ggaggtttaccggttgtttaga

SEQ ID NO: 1763787 - DNA, 12 bp, Homo sapiens
ggagtagttgga

SEQ ID NO: 1763788 - DNA, 21 bp, Homo sapiens
ggagtcacacagtgttggagg

SEQ ID NO: 1763789 - DNA, 15 bp, Homo sapiens
ggagtcagccaggag

SEQ ID NO: 1763790 - DNA, 12 bp, Homo sapiens
ggagtcagggtg

SEQ ID NO: 1763791 - DNA, 21 bp, Homo sapiens
ggagtcattttgtgttgaaga

SEQ ID NO: 1763792 - DNA, 13 bp, Homo sapiens
ggagtccagctct

SEQ ID NO: 1763793 - DNA, 13 bp, Homo sapiens
ggagtcccctcac

SEQ ID NO: 1763794 - DNA, 13 bp, Homo sapiens
ggagtcccctccc

SEQ ID NO: 1763795 - DNA, 20 bp, Homo sapiens
ggagtctgaggcctgagtga

SEQ ID NO: 1763796 - DNA, 12 bp, Homo sapiens
ggagtctgagtc

SEQ ID NO: 1763797 - DNA, 18 bp, Homo sapiens
ggagtctgagtctgagtc

SEQ ID NO: 1763798 - DNA, 13 bp, Homo sapiens
ggagtctgccact

SEQ ID NO: 1763799 - DNA, 21 bp, Homo sapiens
ggagtgaaacctttagggcag

SEQ ID NO: 1763800 - DNA, 22 bp, Homo sapiens
ggagtgaaacctttagggcagc

SEQ ID NO: 1763801 - DNA, 15 bp, Homo sapiens
ggagtgaagaggggc

SEQ ID NO: 1763802 - DNA, 22 bp, Homo sapiens
ggagtgaagaggggcagccctt

SEQ ID NO: 1763803 - DNA, 15 bp, Homo sapiens
ggagtgcagggagga

SEQ ID NO: 1763804 - DNA, 18 bp, Homo sapiens
ggagtgcagggaggagag

SEQ ID NO: 1763805 - DNA, 12 bp, Homo sapiens
ggagtgcagtgg

SEQ ID NO: 1763806 - DNA, 13 bp, Homo sapiens
ggagtgccaggac

SEQ ID NO: 1763807 - DNA, 12 bp, Homo sapiens
ggagtggaggca

SEQ ID NO: 1763808 - DNA, 13 bp, Homo sapiens
ggagtggaggcat

SEQ ID NO: 1763809 - DNA, 23 bp, Homo sapiens
ggagtggggtggtgtcagaccct

SEQ ID NO: 1763810 - DNA, 20 bp, Homo sapiens
ggagtgtcctcttccctctc

SEQ ID NO: 1763811 - DNA, 21 bp, Homo sapiens
ggagtgtcggatcctgtgagt

SEQ ID NO: 1763812 - DNA, 17 bp, Homo sapiens
ggagtgtctgcagtcct

SEQ ID NO: 1763813 - DNA, 19 bp, Homo sapiens
ggagtgtgagccacctaag

SEQ ID NO: 1763814 - DNA, 12 bp, Homo sapiens
ggagtgtgcaga

SEQ ID NO: 1763815 - DNA, 15 bp, Homo sapiens
ggagtgtgggctgcc

SEQ ID NO: 1763816 - DNA, 18 bp, Homo sapiens
ggagtgtgggctgccctt

SEQ ID NO: 1763817 - DNA, 22 bp, Homo sapiens
ggagtgtgtaatttaaaattgt

SEQ ID NO: 1763818 - DNA, 15 bp, Homo sapiens
ggagtgtgtctgctg

SEQ ID NO: 1763819 - DNA, 16 bp, Homo sapiens
ggagtgtgtctgctga

SEQ ID NO: 1763820 - DNA, 23 bp, Homo sapiens
ggagttaagacctggcagctctg

SEQ ID NO: 1763821 - DNA, 15 bp, Homo sapiens
ggagttagaggccag

SEQ ID NO: 1763822 - DNA, 19 bp, Homo sapiens
ggagttagaggccagcctg

SEQ ID NO: 1763823 - DNA, 22 bp, Homo sapiens
ggagttagggagagagaagcag

SEQ ID NO: 1763824 - DNA, 18 bp, Homo sapiens
ggagttcaagactagcct

SEQ ID NO: 1763825 - DNA, 15 bp, Homo sapiens
ggagttcaccttgga

SEQ ID NO: 1763826 - DNA, 22 bp, Homo sapiens
ggagttcatggaagagttccct

SEQ ID NO: 1763827 - DNA, 13 bp, Homo sapiens
ggagttcctgctc

SEQ ID NO: 1763828 - DNA, 20 bp, Homo sapiens
ggagttcgagaccagcctgg

SEQ ID NO: 1763829 - DNA, 15 bp, Homo sapiens
ggagttcgaggctgc

SEQ ID NO: 1763830 - DNA, 21 bp, Homo sapiens
ggagttcgaggctgcagtcag

SEQ ID NO: 1763831 - DNA, 14 bp, Homo sapiens
ggagttgagtacag

SEQ ID NO: 1763832 - DNA, 19 bp, Homo sapiens
ggagttgagtcacaagagg

SEQ ID NO: 1763833 - DNA, 14 bp, Homo sapiens
ggagttgatctgga

SEQ ID NO: 1763834 - DNA, 22 bp, Homo sapiens
ggagttgatctggaacccagac

SEQ ID NO: 1763835 - DNA, 22 bp, Homo sapiens
ggagttgtcaagtctctgctgg

SEQ ID NO: 1763836 - DNA, 12 bp, Homo sapiens
ggagtttctaag

SEQ ID NO: 1763837 - DNA, 14 bp, Homo sapiens
ggagtttctaaggt

SEQ ID NO: 1763838 - DNA, 18 bp, Homo sapiens
ggagtttgagacaagccc

SEQ ID NO: 1763839 - DNA, 19 bp, Homo sapiens
ggagtttgagaccaggctg

SEQ ID NO: 1763840 - DNA, 13 bp, Homo sapiens
ggagtttgaggct

SEQ ID NO: 1763841 - DNA, 23 bp, Homo sapiens
ggagtttttttatacaatgttct

SEQ ID NO: 1763842 - DNA, 16 bp, Homo sapiens
ggataaactgagcctc

SEQ ID NO: 1763843 - DNA, 20 bp, Homo sapiens
ggataagccactctgtccct

SEQ ID NO: 1763844 - DNA, 23 bp, Homo sapiens
ggataagtttctattctgtcagt

SEQ ID NO: 1763845 - DNA, 16 bp, Homo sapiens
ggataatgaaataatc

SEQ ID NO: 1763846 - DNA, 21 bp, Homo sapiens
ggataatgaaataatcagtga

SEQ ID NO: 1763847 - DNA, 20 bp, Homo sapiens
ggataatgctgttgcctcat

SEQ ID NO: 1763848 - DNA, 15 bp, Homo sapiens
ggatacagaggagat

SEQ ID NO: 1763849 - DNA, 15 bp, Homo sapiens
ggatactggcacaga

SEQ ID NO: 1763850 - DNA, 14 bp, Homo sapiens
ggatagacttggga

SEQ ID NO: 1763851 - DNA, 18 bp, Homo sapiens
ggatagatgctggcccag

SEQ ID NO: 1763852 - DNA, 20 bp, Homo sapiens
ggatagatgctggcccaggg

SEQ ID NO: 1763853 - DNA, 21 bp, Homo sapiens
ggatagatgctggcccagggc

SEQ ID NO: 1763854 - DNA, 13 bp, Homo sapiens
ggatagatgtgtg

SEQ ID NO: 1763855 - DNA, 15 bp, Homo sapiens
ggatagatgtgtgga

SEQ ID NO: 1763856 - DNA, 22 bp, Homo sapiens
ggatagtgttctgctcctgctt

SEQ ID NO: 1763857 - DNA, 17 bp, Homo sapiens
ggatataaaatgaaaga

SEQ ID NO: 1763858 - DNA, 20 bp, Homo sapiens
ggatataaaatgaaagattt

SEQ ID NO: 1763859 - DNA, 23 bp, Homo sapiens
ggatataaaatgaaagattttta

SEQ ID NO: 1763860 - DNA, 16 bp, Homo sapiens
ggatatagttttactt

SEQ ID NO: 1763861 - DNA, 12 bp, Homo sapiens
ggatatgctgct

SEQ ID NO: 1763862 - DNA, 12 bp, Homo sapiens
ggatattataga

SEQ ID NO: 1763863 - DNA, 14 bp, Homo sapiens
ggatattatagaaa

SEQ ID NO: 1763864 - DNA, 21 bp, Homo sapiens
ggatattgccttatttgtctg

SEQ ID NO: 1763865 - DNA, 18 bp, Homo sapiens
ggatatttcaatctttta

SEQ ID NO: 1763866 - DNA, 13 bp, Homo sapiens
ggatcaattttca

SEQ ID NO: 1763867 - DNA, 18 bp, Homo sapiens
ggatcacaagatggaatt

SEQ ID NO: 1763868 - DNA, 19 bp, Homo sapiens
ggatcacacctcagtggga

SEQ ID NO: 1763869 - DNA, 20 bp, Homo sapiens
ggatcacacctcagtgggaa

SEQ ID NO: 1763870 - DNA, 21 bp, Homo sapiens
ggatcacacctcagtgggaag

SEQ ID NO: 1763871 - DNA, 22 bp, Homo sapiens
ggatcacacctcagtgggaaga

SEQ ID NO: 1763872 - DNA, 17 bp, Homo sapiens
ggatcacctgaggtcag

SEQ ID NO: 1763873 - DNA, 14 bp, Homo sapiens
ggatcactggagcc

SEQ ID NO: 1763874 - DNA, 18 bp, Homo sapiens
ggatcactggagcccagg

SEQ ID NO: 1763875 - DNA, 17 bp, Homo sapiens
ggatcacttgagcccag

SEQ ID NO: 1763876 - DNA, 17 bp, Homo sapiens
ggatcagaacagcagag

SEQ ID NO: 1763877 - DNA, 19 bp, Homo sapiens
ggatcagagcgcacaggga

SEQ ID NO: 1763878 - DNA, 19 bp, Homo sapiens
ggatcatcaacaagatttc

SEQ ID NO: 1763879 - DNA, 19 bp, Homo sapiens
ggatcatctgccgtgcctg

SEQ ID NO: 1763880 - DNA, 17 bp, Homo sapiens
ggatccaaactgatcca

SEQ ID NO: 1763881 - DNA, 22 bp, Homo sapiens
ggatccatggggggagaagtga

SEQ ID NO: 1763882 - DNA, 17 bp, Homo sapiens
ggatcccaaagcaagga

SEQ ID NO: 1763883 - DNA, 14 bp, Homo sapiens
ggatccctcctgag

SEQ ID NO: 1763884 - DNA, 17 bp, Homo sapiens
ggatccctcctgagctc

SEQ ID NO: 1763885 - DNA, 12 bp, Homo sapiens
ggatcctgctgg

SEQ ID NO: 1763886 - DNA, 13 bp, Homo sapiens
ggatcctgctggg

SEQ ID NO: 1763887 - DNA, 18 bp, Homo sapiens
ggatcgagtgtagctgtg

SEQ ID NO: 1763888 - DNA, 21 bp, Homo sapiens
ggatcgagtgtagctgtgaaa

SEQ ID NO: 1763889 - DNA, 23 bp, Homo sapiens
ggatcgagtgtagctgtgaaatc

SEQ ID NO: 1763890 - DNA, 12 bp, Homo sapiens
ggatctaccagc

SEQ ID NO: 1763891 - DNA, 21 bp, Homo sapiens
ggatctatttcatgtttttga

SEQ ID NO: 1763892 - DNA, 15 bp, Homo sapiens
ggatctcaagccagc

SEQ ID NO: 1763893 - DNA, 22 bp, Homo sapiens
ggatctcagctttgagaagcct

SEQ ID NO: 1763894 - DNA, 10 bp, Homo sapiens
ggatctcagg

SEQ ID NO: 1763895 - DNA, 22 bp, Homo sapiens
ggatctcctgctgccttttctg

SEQ ID NO: 1763896 - DNA, 23 bp, Homo sapiens
ggatctcctgctgccttttctgg

SEQ ID NO: 1763897 - DNA, 20 bp, Homo sapiens
ggatctccttcccttctctt

SEQ ID NO: 1763898 - DNA, 16 bp, Homo sapiens
ggatctctcaggagca

SEQ ID NO: 1763899 - DNA, 21 bp, Homo sapiens
ggatctctcaggagcacaggc

SEQ ID NO: 1763900 - DNA, 23 bp, Homo sapiens
ggcaggagaagaacaagaaatgg

SEQ ID NO: 1763901 - DNA, 14 bp, Homo sapiens
ggcaggagctcctg

SEQ ID NO: 1763902 - DNA, 16 bp, Homo sapiens
ggcaggaggccccagg

SEQ ID NO: 1763903 - DNA, 14 bp, Homo sapiens
ggcaggagggaggt

SEQ ID NO: 1763904 - DNA, 15 bp, Homo sapiens
ggcaggagtgccagg

SEQ ID NO: 1763905 - DNA, 19 bp, Homo sapiens
ggcaggagtgccaggacca

SEQ ID NO: 1763906 - DNA, 22 bp, Homo sapiens
ggcaggagtgccaggaccagcc

SEQ ID NO: 1763907 - DNA, 18 bp, Homo sapiens
ggcaggatctcaagccag

SEQ ID NO: 1763908 - DNA, 19 bp, Homo sapiens
ggcaggatctcaagccagc

SEQ ID NO: 1763909 - DNA, 22 bp, Homo sapiens
ggcaggcattcctgaagggaac

SEQ ID NO: 1763910 - DNA, 14 bp, Homo sapiens
ggcaggccaggctg

SEQ ID NO: 1763911 - DNA, 21 bp, Homo sapiens
ggcaggcccactccccagccc

SEQ ID NO: 1763912 - DNA, 15 bp, Homo sapiens
ggcaggcctgagaat

SEQ ID NO: 1763913 - DNA, 17 bp, Homo sapiens
ggcaggcctgagaatga

SEQ ID NO: 1763914 - DNA, 13 bp, Homo sapiens
ggcaggcctggga

SEQ ID NO: 1763915 - DNA, 15 bp, Homo sapiens
ggcaggctcactgcc

SEQ ID NO: 1763916 - DNA, 16 bp, Homo sapiens
ggcaggctcactgcca

SEQ ID NO: 1763917 - DNA, 22 bp, Homo sapiens
ggcaggctcactgccaggccag

SEQ ID NO: 1763918 - DNA, 16 bp, Homo sapiens
ggcaggctgacatctg

SEQ ID NO: 1763919 - DNA, 18 bp, Homo sapiens
ggcaggctgacatctgtg

SEQ ID NO: 1763920 - DNA, 17 bp, Homo sapiens
ggcaggctggccagtcc

SEQ ID NO: 1763921 - DNA, 13 bp, Homo sapiens
ggcaggctgggcc

SEQ ID NO: 1763922 - DNA, 14 bp, Homo sapiens
ggcaggctgggcca

SEQ ID NO: 1763923 - DNA, 17 bp, Homo sapiens
ggcaggcttggggaaaa

SEQ ID NO: 1763924 - DNA, 16 bp, Homo sapiens
ggcagggaaggacagg

SEQ ID NO: 1763925 - DNA, 14 bp, Homo sapiens
ggcagggaccacac

SEQ ID NO: 1763926 - DNA, 13 bp, Homo sapiens
ggcagggagggga

SEQ ID NO: 1763927 - DNA, 22 bp, Homo sapiens
ggcagggatgatggcagagcca

SEQ ID NO: 1763928 - DNA, 23 bp, Homo sapiens
ggcagggcaaatgacatgcactg

SEQ ID NO: 1763929 - DNA, 14 bp, Homo sapiens
ggcagggcccacgt

SEQ ID NO: 1763930 - DNA, 20 bp, Homo sapiens
ggcagggcccacgtgtatag

SEQ ID NO: 1763931 - DNA, 12 bp, Homo sapiens
ggcagggcctgg

SEQ ID NO: 1763932 - DNA, 21 bp, Homo sapiens
ggcagggcctgggcctcatgg

SEQ ID NO: 1763933 - DNA, 18 bp, Homo sapiens
ggcagggccttgcccaga

SEQ ID NO: 1763934 - DNA, 20 bp, Homo sapiens
ggcagggccttgcccagaga

SEQ ID NO: 1763935 - DNA, 21 bp, Homo sapiens
ggcagggcgggcagagggctg

SEQ ID NO: 1763936 - DNA, 22 bp, Homo sapiens
ggcagggcgggcagagggctgg

SEQ ID NO: 1763937 - DNA, 22 bp, Homo sapiens
ggcaggggacaagggaggcagt

SEQ ID NO: 1763938 - DNA, 14 bp, Homo sapiens
ggcaggggacagga

SEQ ID NO: 1763939 - DNA, 23 bp, Homo sapiens
ggcaggggagacaggagcctagc

SEQ ID NO: 1763940 - DNA, 13 bp, Homo sapiens
ggcaggggagcag

SEQ ID NO: 1763941 - DNA, 16 bp, Homo sapiens
ggcaggggcctggaga

SEQ ID NO: 1763942 - DNA, 17 bp, Homo sapiens
ggcaggggcctggagat

SEQ ID NO: 1763943 - DNA, 15 bp, Homo sapiens
ggcaggggctctgct

SEQ ID NO: 1763944 - DNA, 21 bp, Homo sapiens
ggcagggggccctgccccacc

SEQ ID NO: 1763945 - DNA, 23 bp, Homo sapiens
ggcaggggtcctgcaggtcctgg

SEQ ID NO: 1763946 - DNA, 13 bp, Homo sapiens
ggcaggggtgggg

SEQ ID NO: 1763947 - DNA, 15 bp, Homo sapiens
ggcagggtccacgcc

SEQ ID NO: 1763948 - DNA, 21 bp, Homo sapiens
ggcagggtgggatggaggaga

SEQ ID NO: 1763949 - DNA, 20 bp, Homo sapiens
ggcaggtagatcgcttgagc

SEQ ID NO: 1763950 - DNA, 21 bp, Homo sapiens
ggcaggtagatcgcttgagcc

SEQ ID NO: 1763951 - DNA, 24 bp, Homo sapiens
ggcaggtagatcgcttgagcccag

SEQ ID NO: 1763952 - DNA, 17 bp, Homo sapiens
ggcaggtcactgtcact

SEQ ID NO: 1763953 - DNA, 20 bp, Homo sapiens
ggcaggtcactgtcactgcc

SEQ ID NO: 1763954 - DNA, 18 bp, Homo sapiens
ggcaggtgagaacccaga

SEQ ID NO: 1763955 - DNA, 13 bp, Homo sapiens
ggcaggtgcagat

SEQ ID NO: 1763956 - DNA, 21 bp, Homo sapiens
ggcaggtgccatgtctgggaa

SEQ ID NO: 1763957 - DNA, 21 bp, Homo sapiens
ggcaggtgcctccaggtgtgc

SEQ ID NO: 1763958 - DNA, 19 bp, Homo sapiens
ggcaggtggactgactgtg

SEQ ID NO: 1763959 - DNA, 16 bp, Homo sapiens
ggcaggtggccacagc

SEQ ID NO: 1763960 - DNA, 18 bp, Homo sapiens
ggcaggtggccgcccctg

SEQ ID NO: 1763961 - DNA, 17 bp, Homo sapiens
ggcaggtgggagctgaa

SEQ ID NO: 1763962 - DNA, 18 bp, Homo sapiens
ggcaggtgggctgcctgc

SEQ ID NO: 1763963 - DNA, 21 bp, Homo sapiens
ggcaggtggtggcactgagcc

SEQ ID NO: 1763964 - DNA, 23 bp, Homo sapiens
ggcaggtgttgggacctgctgct

SEQ ID NO: 1763965 - DNA, 14 bp, Homo sapiens
ggcagtacctggga

SEQ ID NO: 1763966 - DNA, 23 bp, Homo sapiens
ggcagtacctgggaaaggaccca

SEQ ID NO: 1763967 - DNA, 23 bp, Homo sapiens
ggcagtagctgtggtgaggtggg

SEQ ID NO: 1763968 - DNA, 21 bp, Homo sapiens
ggcagtaggggaacctaggag

SEQ ID NO: 1763969 - DNA, 15 bp, Homo sapiens
ggcagtccgtgggac

SEQ ID NO: 1763970 - DNA, 17 bp, Homo sapiens
ggcagtcctggaggcag

SEQ ID NO: 1763971 - DNA, 15 bp, Homo sapiens
ggcagtctgaaccct

SEQ ID NO: 1763972 - DNA, 15 bp, Homo sapiens
ggcagtgactggcag

SEQ ID NO: 1763973 - DNA, 17 bp, Homo sapiens
ggcagtgactggcaggt

SEQ ID NO: 1763974 - DNA, 19 bp, Homo sapiens
ggcagtgccacccgcagat

SEQ ID NO: 1763975 - DNA, 19 bp, Homo sapiens
ggcagtgcccatgtgtaca

SEQ ID NO: 1763976 - DNA, 20 bp, Homo sapiens
ggcagtgcccatgtgtacat

SEQ ID NO: 1763977 - DNA, 13 bp, Homo sapiens
ggcagtgcccttt

SEQ ID NO: 1763978 - DNA, 18 bp, Homo sapiens
ggcagtgctgagggaccg

SEQ ID NO: 1763979 - DNA, 20 bp, Homo sapiens
ggcagtggaggctgctgtga

SEQ ID NO: 1763980 - DNA, 17 bp, Homo sapiens
ggcagtggcaggggagc

SEQ ID NO: 1763981 - DNA, 16 bp, Homo sapiens
ggcagtgtcattgagc

SEQ ID NO: 1763982 - DNA, 13 bp, Homo sapiens
ggcagttggccag

SEQ ID NO: 1763983 - DNA, 18 bp, Homo sapiens
ggcagtttaaagcacaat

SEQ ID NO: 1763984 - DNA, 13 bp, Homo sapiens
ggcatacaaaata

SEQ ID NO: 1763985 - DNA, 22 bp, Homo sapiens
ggcatacgagagcagaggtctc

SEQ ID NO: 1763986 - DNA, 22 bp, Homo sapiens
ggcatagaggcttctccgccag

SEQ ID NO: 1763987 - DNA, 15 bp, Homo sapiens
ggcatagccctcctg

SEQ ID NO: 1763988 - DNA, 13 bp, Homo sapiens
ggcatagctctgg

SEQ ID NO: 1763989 - DNA, 14 bp, Homo sapiens
ggcatatacagtga

SEQ ID NO: 1763990 - DNA, 23 bp, Homo sapiens
ggcatatcttctatatctgaaga

SEQ ID NO: 1763991 - DNA, 17 bp, Homo sapiens
ggcatatgtttctgcta

SEQ ID NO: 1763992 - DNA, 15 bp, Homo sapiens
ggcatatttttcaca

SEQ ID NO: 1763993 - DNA, 13 bp, Homo sapiens
ggcatcacagggc

SEQ ID NO: 1763994 - DNA, 14 bp, Homo sapiens
ggcatcacagggca

SEQ ID NO: 1763995 - DNA, 16 bp, Homo sapiens
ggcatcacagggcaga

SEQ ID NO: 1763996 - DNA, 17 bp, Homo sapiens
ggcatcacagggcagag

SEQ ID NO: 1763997 - DNA, 23 bp, Homo sapiens
ggcatcacagggcagagccggga

SEQ ID NO: 1763998 - DNA, 12 bp, Homo sapiens
ggcatcaggaat

SEQ ID NO: 1763999 - DNA, 16 bp, Homo sapiens
ggcatcaggcactggt

SEQ ID NO: 1764000 - DNA, 19 bp, Homo sapiens
ggcatcaggcactggtggc

SEQ ID NO: 1764001 - DNA, 13 bp, Homo sapiens
ggcatcatgcatg

SEQ ID NO: 1764002 - DNA, 17 bp, Homo sapiens
ggcatccacccagtgct

SEQ ID NO: 1764003 - DNA, 22 bp, Homo sapiens
ggcatccacccagtgctgccat

SEQ ID NO: 1764004 - DNA, 23 bp, Homo sapiens
ggcatccacccagtgctgccatg

SEQ ID NO: 1764005 - DNA, 15 bp, Homo sapiens
ggcatcccaggggac

SEQ ID NO: 1764006 - DNA, 14 bp, Homo sapiens
ggcatccctgcaga

SEQ ID NO: 1764007 - DNA, 18 bp, Homo sapiens
ggcatccttgtcttttga

SEQ ID NO: 1764008 - DNA, 22 bp, Homo sapiens
ggcatcgtagaagagatgtggc

SEQ ID NO: 1764009 - DNA, 17 bp, Homo sapiens
ggcatctacacagcctg

SEQ ID NO: 1764010 - DNA, 20 bp, Homo sapiens
ggcatctacacagcctggac

SEQ ID NO: 1764011 - DNA, 21 bp, Homo sapiens
ggcatctacacagcctggact

SEQ ID NO: 1764012 - DNA, 18 bp, Homo sapiens
ggcatctcccctagctca

SEQ ID NO: 1764013 - DNA, 17 bp, Homo sapiens
ggcatctcctgtgcatg

SEQ ID NO: 1764014 - DNA, 16 bp, Homo sapiens
ggcccagggcccagag

SEQ ID NO: 1764015 - DNA, 13 bp, Homo sapiens
ggcccagggggcc

SEQ ID NO: 1764016 - DNA, 15 bp, Homo sapiens
ggcccagggtgtttg

SEQ ID NO: 1764017 - DNA, 21 bp, Homo sapiens
ggcccagtgcatggtggccag

SEQ ID NO: 1764018 - DNA, 14 bp, Homo sapiens
ggcccagtgccact

SEQ ID NO: 1764019 - DNA, 23 bp, Homo sapiens
ggcccagtgtcaagttgtgcttg

SEQ ID NO: 1764020 - DNA, 21 bp, Homo sapiens
ggcccataatagttagccctc

SEQ ID NO: 1764021 - DNA, 22 bp, Homo sapiens
ggcccatagaaacatgacactg

SEQ ID NO: 1764022 - DNA, 23 bp, Homo sapiens
ggcccatagaaacatgacactga

SEQ ID NO: 1764023 - DNA, 24 bp, Homo sapiens
ggcccatatctgtgaaatgctggc

SEQ ID NO: 1764024 - DNA, 14 bp, Homo sapiens
ggcccatcaggcag

SEQ ID NO: 1764025 - DNA, 15 bp, Homo sapiens
ggcccatcaggcagt

SEQ ID NO: 1764026 - DNA, 13 bp, Homo sapiens
ggcccatctcagg

SEQ ID NO: 1764027 - DNA, 20 bp, Homo sapiens
ggcccatctcaggtgccact

SEQ ID NO: 1764028 - DNA, 21 bp, Homo sapiens
ggcccatctcaggtgccactc

SEQ ID NO: 1764029 - DNA, 13 bp, Homo sapiens
ggccccaccctgg

SEQ ID NO: 1764030 - DNA, 15 bp, Homo sapiens
ggccccaccctgggc

SEQ ID NO: 1764031 - DNA, 17 bp, Homo sapiens
ggccccaccctgggccc

SEQ ID NO: 1764032 - DNA, 12 bp, Homo sapiens
ggccccaccggc

SEQ ID NO: 1764033 - DNA, 16 bp, Homo sapiens
ggccccaccggccagg

SEQ ID NO: 1764034 - DNA, 21 bp, Homo sapiens
ggccccacctacttgtgactg

SEQ ID NO: 1764035 - DNA, 11 bp, Homo sapiens
ggccccacttt

SEQ ID NO: 1764036 - DNA, 19 bp, Homo sapiens
ggccccagacgcatagact

SEQ ID NO: 1764037 - DNA, 15 bp, Homo sapiens
ggccccagaggccct

SEQ ID NO: 1764038 - DNA, 18 bp, Homo sapiens
ggccccagaggccctgga

SEQ ID NO: 1764039 - DNA, 13 bp, Homo sapiens
ggccccagatctg

SEQ ID NO: 1764040 - DNA, 15 bp, Homo sapiens
ggccccagatctgcc

SEQ ID NO: 1764041 - DNA, 11 bp, Homo sapiens
ggccccagcca

SEQ ID NO: 1764042 - DNA, 13 bp, Homo sapiens
ggccccagccctg

SEQ ID NO: 1764043 - DNA, 16 bp, Homo sapiens
ggccccagccctgctg

SEQ ID NO: 1764044 - DNA, 12 bp, Homo sapiens
ggccccaggctg

SEQ ID NO: 1764045 - DNA, 13 bp, Homo sapiens
ggccccaggggca

SEQ ID NO: 1764046 - DNA, 16 bp, Homo sapiens
ggccccaggggcagca

SEQ ID NO: 1764047 - DNA, 20 bp, Homo sapiens
ggccccaggggcagcaaggc

SEQ ID NO: 1764048 - DNA, 20 bp, Homo sapiens
ggccccatcctcatccctga

SEQ ID NO: 1764049 - DNA, 20 bp, Homo sapiens
ggccccatctggatgtaaat

SEQ ID NO: 1764050 - DNA, 17 bp, Homo sapiens
ggccccatgctctgccc

SEQ ID NO: 1764051 - DNA, 21 bp, Homo sapiens
ggcccccaaattgccttcagc

SEQ ID NO: 1764052 - DNA, 20 bp, Homo sapiens
ggcccccaacctcagggctc

SEQ ID NO: 1764053 - DNA, 23 bp, Homo sapiens
ggcccccaacctcagggctccca

SEQ ID NO: 1764054 - DNA, 17 bp, Homo sapiens
ggcccccaataaaggca

SEQ ID NO: 1764055 - DNA, 18 bp, Homo sapiens
ggcccccaataaaggcag

SEQ ID NO: 1764056 - DNA, 23 bp, Homo sapiens
ggcccccaataaaggcagctgcc

SEQ ID NO: 1764057 - DNA, 18 bp, Homo sapiens
ggcccccacttgcctctt

SEQ ID NO: 1764058 - DNA, 14 bp, Homo sapiens
ggcccccagcccag

SEQ ID NO: 1764059 - DNA, 20 bp, Homo sapiens
ggcccccaggattcccccag

SEQ ID NO: 1764060 - DNA, 13 bp, Homo sapiens
ggcccccaggggc

SEQ ID NO: 1764061 - DNA, 20 bp, Homo sapiens
ggcccccaggggcaggactg

SEQ ID NO: 1764062 - DNA, 22 bp, Homo sapiens
ggcccccattatcctaggggtg

SEQ ID NO: 1764063 - DNA, 13 bp, Homo sapiens
ggccccgccaggg

SEQ ID NO: 1764064 - DNA, 14 bp, Homo sapiens
ggccccgccagggc

SEQ ID NO: 1764065 - DNA, 18 bp, Homo sapiens
ggccccgccagggctggg

SEQ ID NO: 1764066 - DNA, 21 bp, Homo sapiens
ggccccgccagggctggggac

SEQ ID NO: 1764067 - DNA, 16 bp, Homo sapiens
ggccccggccccagcc

SEQ ID NO: 1764068 - DNA, 22 bp, Homo sapiens
ggccccgggctctggccaccct

SEQ ID NO: 1764069 - DNA, 17 bp, Homo sapiens
ggccccgggctggagaa

SEQ ID NO: 1764070 - DNA, 18 bp, Homo sapiens
ggccccgggctggagaaa

SEQ ID NO: 1764071 - DNA, 13 bp, Homo sapiens
ggccccggggctg

SEQ ID NO: 1764072 - DNA, 18 bp, Homo sapiens
ggccccggggctggcaag

SEQ ID NO: 1764073 - DNA, 15 bp, Homo sapiens
ggcccctcacctggt

SEQ ID NO: 1764074 - DNA, 14 bp, Homo sapiens
ggcccctccagacc

SEQ ID NO: 1764075 - DNA, 20 bp, Homo sapiens
ggcccctccagaccctgcct

SEQ ID NO: 1764076 - DNA, 14 bp, Homo sapiens
ggcccctccagcac

SEQ ID NO: 1764077 - DNA, 13 bp, Homo sapiens
ggcccctccatcc

SEQ ID NO: 1764078 - DNA, 14 bp, Homo sapiens
ggcccctccctctg

SEQ ID NO: 1764079 - DNA, 21 bp, Homo sapiens
ggcccctcctagacccaggtg

SEQ ID NO: 1764080 - DNA, 14 bp, Homo sapiens
ggcccctctgacct

SEQ ID NO: 1764081 - DNA, 15 bp, Homo sapiens
ggcccctctgcccag

SEQ ID NO: 1764082 - DNA, 17 bp, Homo sapiens
ggcccctctgcccagct

SEQ ID NO: 1764083 - DNA, 12 bp, Homo sapiens
ggcccctctgct

SEQ ID NO: 1764084 - DNA, 15 bp, Homo sapiens
ggcccctgaggactg

SEQ ID NO: 1764085 - DNA, 21 bp, Homo sapiens
ggcccctgaggagctttgtgt

SEQ ID NO: 1764086 - DNA, 14 bp, Homo sapiens
ggcccctgccttgg

SEQ ID NO: 1764087 - DNA, 16 bp, Homo sapiens
ggcccctggcccagag

SEQ ID NO: 1764088 - DNA, 15 bp, Homo sapiens
ggcccctggcccagc

SEQ ID NO: 1764089 - DNA, 17 bp, Homo sapiens
ggcccctggcccagcgg

SEQ ID NO: 1764090 - DNA, 18 bp, Homo sapiens
ggcccctggcccagcggc

SEQ ID NO: 1764091 - DNA, 20 bp, Homo sapiens
ggcccctggcccagcggccc

SEQ ID NO: 1764092 - DNA, 12 bp, Homo sapiens
ggcccctgggct

SEQ ID NO: 1764093 - DNA, 14 bp, Homo sapiens
ggcccctgggctct

SEQ ID NO: 1764094 - DNA, 15 bp, Homo sapiens
ggcccctgggctctc

SEQ ID NO: 1764095 - DNA, 19 bp, Homo sapiens
ggcccctgggctctcaccc

SEQ ID NO: 1764096 - DNA, 21 bp, Homo sapiens
ggcccctgggctctcacccag

SEQ ID NO: 1764097 - DNA, 21 bp, Homo sapiens
ggcccctgggcttggcctgct

SEQ ID NO: 1764098 - DNA, 22 bp, Homo sapiens
ggcccctgggcttggcctgctg

SEQ ID NO: 1764099 - DNA, 23 bp, Homo sapiens
ggcccctgggcttggcctgctgt

SEQ ID NO: 1764100 - DNA, 13 bp, Homo sapiens
ggcccctgtgtga

SEQ ID NO: 1764101 - DNA, 13 bp, Homo sapiens
ggcccgacatggc

SEQ ID NO: 1764102 - DNA, 21 bp, Homo sapiens
ggcccgcagtgctgggaccag

SEQ ID NO: 1764103 - DNA, 23 bp, Homo sapiens
ggcccgcagtgctgggaccagag

SEQ ID NO: 1764104 - DNA, 14 bp, Homo sapiens
ggcccgcccctcgc

SEQ ID NO: 1764105 - DNA, 21 bp, Homo sapiens
ggcccggagtaatcaggcagc

SEQ ID NO: 1764106 - DNA, 22 bp, Homo sapiens
ggcccggagtaatcaggcagcc

SEQ ID NO: 1764107 - DNA, 14 bp, Homo sapiens
ggcccggcagggcg

SEQ ID NO: 1764108 - DNA, 18 bp, Homo sapiens
ggcccggcagggcgggca

SEQ ID NO: 1764109 - DNA, 14 bp, Homo sapiens
ggcccggccacacc

SEQ ID NO: 1764110 - DNA, 13 bp, Homo sapiens
ggcccggccagcg

SEQ ID NO: 1764111 - DNA, 16 bp, Homo sapiens
ggcccggccagcgggc

SEQ ID NO: 1764112 - DNA, 20 bp, Homo sapiens
ggcccggccagcgggcacag

SEQ ID NO: 1764113 - DNA, 15 bp, Homo sapiens
ggcccggccggcctg

SEQ ID NO: 1764114 - DNA, 15 bp, Homo sapiens
ggcccggctgagccc

SEQ ID NO: 1764115 - DNA, 14 bp, Homo sapiens
ggcccggtgcagct

SEQ ID NO: 1764116 - DNA, 15 bp, Homo sapiens
ggcccgtcatgttcc

SEQ ID NO: 1764117 - DNA, 14 bp, Homo sapiens
ggcccgtcggagct

SEQ ID NO: 1764118 - DNA, 22 bp, Homo sapiens
ggcccgtcggagctgcctgcag

SEQ ID NO: 1764119 - DNA, 23 bp, Homo sapiens
ggcccgtcggagctgcctgcagc

SEQ ID NO: 1764120 - DNA, 20 bp, Homo sapiens
ggcccgttgaggatgaggcc

SEQ ID NO: 1764121 - DNA, 22 bp, Homo sapiens
ggcccgttgaggatgaggccgc

SEQ ID NO: 1764122 - DNA, 21 bp, Homo sapiens
ggccctaccagcgcccgctgg

SEQ ID NO: 1764123 - DNA, 22 bp, Homo sapiens
ggccctaccagcgcccgctggg

SEQ ID NO: 1764124 - DNA, 17 bp, Homo sapiens
ggccctaggcccctcct

SEQ ID NO: 1764125 - DNA, 18 bp, Homo sapiens
ggccctaggcccctccta

SEQ ID NO: 1764126 - DNA, 20 bp, Homo sapiens
ggccctcacccctgccctgg

SEQ ID NO: 1764127 - DNA, 23 bp, Homo sapiens
ggccctcactcaagaccaggctg

SEQ ID NO: 1764128 - DNA, 19 bp, Homo sapiens
ggccctccctgttccccag

SEQ ID NO: 1764129 - DNA, 13 bp, Homo sapiens
ggcggtggctgcc

SEQ ID NO: 1764130 - DNA, 13 bp, Homo sapiens
ggcgtcagagaga

SEQ ID NO: 1764131 - DNA, 17 bp, Homo sapiens
ggcgtcagagagacccg

SEQ ID NO: 1764132 - DNA, 23 bp, Homo sapiens
ggcgtcagagagacccgggaagg

SEQ ID NO: 1764133 - DNA, 17 bp, Homo sapiens
ggcgtccaggccgcgcc

SEQ ID NO: 1764134 - DNA, 14 bp, Homo sapiens
ggcgtctgtgtgcg

SEQ ID NO: 1764135 - DNA, 15 bp, Homo sapiens
ggcgtcttgcccagc

SEQ ID NO: 1764136 - DNA, 15 bp, Homo sapiens
ggcgtgactcaccca

SEQ ID NO: 1764137 - DNA, 18 bp, Homo sapiens
ggcgtgcccccctcctcc

SEQ ID NO: 1764138 - DNA, 14 bp, Homo sapiens
ggcgtggaggagga

SEQ ID NO: 1764139 - DNA, 17 bp, Homo sapiens
ggcgtggagggaggccc

SEQ ID NO: 1764140 - DNA, 22 bp, Homo sapiens
ggcgtggtgtgtccctggacac

SEQ ID NO: 1764141 - DNA, 23 bp, Homo sapiens
ggcgtggtgtgtccctggacaca

SEQ ID NO: 1764142 - DNA, 14 bp, Homo sapiens
ggcgtgtgcatagc

SEQ ID NO: 1764143 - DNA, 20 bp, Homo sapiens
ggcgtgtgcatagcgtcctg

SEQ ID NO: 1764144 - DNA, 14 bp, Homo sapiens
ggcgtgtgtgacac

SEQ ID NO: 1764145 - DNA, 18 bp, Homo sapiens
ggcgttagtgggcaggtg

SEQ ID NO: 1764146 - DNA, 18 bp, Homo sapiens
ggcgttctgctgcccctg

SEQ ID NO: 1764147 - DNA, 17 bp, Homo sapiens
ggctaactatatttgct

SEQ ID NO: 1764148 - DNA, 19 bp, Homo sapiens
ggctaagagctagcgctgc

SEQ ID NO: 1764149 - DNA, 22 bp, Homo sapiens
ggctaaggaagtatcagcacta

SEQ ID NO: 1764150 - DNA, 19 bp, Homo sapiens
ggctaattatatattttgt

SEQ ID NO: 1764151 - DNA, 12 bp, Homo sapiens
ggctacatcagc

SEQ ID NO: 1764152 - DNA, 16 bp, Homo sapiens
ggctacatcagccttc

SEQ ID NO: 1764153 - DNA, 13 bp, Homo sapiens
ggctacatcccag

SEQ ID NO: 1764154 - DNA, 22 bp, Homo sapiens
ggctacatcccagcctgtggtt

SEQ ID NO: 1764155 - DNA, 15 bp, Homo sapiens
ggctaccatctgcat

SEQ ID NO: 1764156 - DNA, 17 bp, Homo sapiens
ggctaccgaagtaaact

SEQ ID NO: 1764157 - DNA, 19 bp, Homo sapiens
ggctacctcacctgggcag

SEQ ID NO: 1764158 - DNA, 14 bp, Homo sapiens
ggctacgttttggt

SEQ ID NO: 1764159 - DNA, 16 bp, Homo sapiens
ggctactcagcagccc

SEQ ID NO: 1764160 - DNA, 20 bp, Homo sapiens
ggctactcagcagccctcct

SEQ ID NO: 1764161 - DNA, 15 bp, Homo sapiens
ggctactggcagctc

SEQ ID NO: 1764162 - DNA, 16 bp, Homo sapiens
ggctactggcagctcc

SEQ ID NO: 1764163 - DNA, 14 bp, Homo sapiens
ggctacttcccttc

SEQ ID NO: 1764164 - DNA, 16 bp, Homo sapiens
ggctacttcccttcct

SEQ ID NO: 1764165 - DNA, 15 bp, Homo sapiens
ggctagacaggaacc

SEQ ID NO: 1764166 - DNA, 13 bp, Homo sapiens
ggctagagccgag

SEQ ID NO: 1764167 - DNA, 14 bp, Homo sapiens
ggctagagccgagg

SEQ ID NO: 1764168 - DNA, 12 bp, Homo sapiens
ggctagaggcat

SEQ ID NO: 1764169 - DNA, 16 bp, Homo sapiens
ggctagaggccagccc

SEQ ID NO: 1764170 - DNA, 15 bp, Homo sapiens
ggctagtcagagaga

SEQ ID NO: 1764171 - DNA, 20 bp, Homo sapiens
ggctagtcttgaatttctga

SEQ ID NO: 1764172 - DNA, 23 bp, Homo sapiens
ggctagtgacttgtgtcccatga

SEQ ID NO: 1764173 - DNA, 19 bp, Homo sapiens
ggctatagctacaggaagc

SEQ ID NO: 1764174 - DNA, 17 bp, Homo sapiens
ggctatggagggtcctc

SEQ ID NO: 1764175 - DNA, 18 bp, Homo sapiens
ggctatggcaagggggtg

SEQ ID NO: 1764176 - DNA, 17 bp, Homo sapiens
ggctatgtataaaatac

SEQ ID NO: 1764177 - DNA, 13 bp, Homo sapiens
ggctattcacaac

SEQ ID NO: 1764178 - DNA, 16 bp, Homo sapiens
ggctatttgtaaatct

SEQ ID NO: 1764179 - DNA, 17 bp, Homo sapiens
ggctatttgtgtgtatg

SEQ ID NO: 1764180 - DNA, 17 bp, Homo sapiens
ggctcaaagcccttcct

SEQ ID NO: 1764181 - DNA, 20 bp, Homo sapiens
ggctcacaaggcccaggaga

SEQ ID NO: 1764182 - DNA, 14 bp, Homo sapiens
ggctcaccagctgg

SEQ ID NO: 1764183 - DNA, 17 bp, Homo sapiens
ggctcacgcctgtaatc

SEQ ID NO: 1764184 - DNA, 18 bp, Homo sapiens
ggctcactactgaacaca

SEQ ID NO: 1764185 - DNA, 20 bp, Homo sapiens
ggctcactgcaacctccgcc

SEQ ID NO: 1764186 - DNA, 13 bp, Homo sapiens
ggctcactgccag

SEQ ID NO: 1764187 - DNA, 14 bp, Homo sapiens
ggctcactgccagg

SEQ ID NO: 1764188 - DNA, 15 bp, Homo sapiens
ggctcactgccaggc

SEQ ID NO: 1764189 - DNA, 15 bp, Homo sapiens
ggctcactggcaggt

SEQ ID NO: 1764190 - DNA, 18 bp, Homo sapiens
ggctcagccacagcctga

SEQ ID NO: 1764191 - DNA, 10 bp, Homo sapiens
ggctcagcct

SEQ ID NO: 1764192 - DNA, 20 bp, Homo sapiens
ggctcagcctggtgggcctc

SEQ ID NO: 1764193 - DNA, 14 bp, Homo sapiens
ggctcagtctcagg

SEQ ID NO: 1764194 - DNA, 13 bp, Homo sapiens
ggctcagtgcctt

SEQ ID NO: 1764195 - DNA, 12 bp, Homo sapiens
ggctcatgcctg

SEQ ID NO: 1764196 - DNA, 14 bp, Homo sapiens
ggctcattcttttc

SEQ ID NO: 1764197 - DNA, 13 bp, Homo sapiens
ggctccaactcct

SEQ ID NO: 1764198 - DNA, 23 bp, Homo sapiens
ggctccaactcctttcagccaca

SEQ ID NO: 1764199 - DNA, 12 bp, Homo sapiens
ggctccacacag

SEQ ID NO: 1764200 - DNA, 15 bp, Homo sapiens
ggctccagcatccag

SEQ ID NO: 1764201 - DNA, 18 bp, Homo sapiens
ggctccagcatccagcct

SEQ ID NO: 1764202 - DNA, 19 bp, Homo sapiens
ggctccagcatccagcctg

SEQ ID NO: 1764203 - DNA, 21 bp, Homo sapiens
ggctccagcatccagcctgtg

SEQ ID NO: 1764204 - DNA, 23 bp, Homo sapiens
ggctccagcccctcttggagaag

SEQ ID NO: 1764205 - DNA, 22 bp, Homo sapiens
ggctccatgcacctcccttccc

SEQ ID NO: 1764206 - DNA, 12 bp, Homo sapiens
ggctcccaaggt

SEQ ID NO: 1764207 - DNA, 17 bp, Homo sapiens
ggctcccaatcagcttt

SEQ ID NO: 1764208 - DNA, 23 bp, Homo sapiens
ggctcccaatcagcttttgttct

SEQ ID NO: 1764209 - DNA, 15 bp, Homo sapiens
ggctcccacagagac

SEQ ID NO: 1764210 - DNA, 13 bp, Homo sapiens
ggctcccaggaca

SEQ ID NO: 1764211 - DNA, 12 bp, Homo sapiens
ggctcccagggg

SEQ ID NO: 1764212 - DNA, 23 bp, Homo sapiens
ggctccccacgagtcacctgcaa

SEQ ID NO: 1764213 - DNA, 17 bp, Homo sapiens
ggctccccatgtgtcct

SEQ ID NO: 1764214 - DNA, 22 bp, Homo sapiens
ggctccccatgtgtcctggttc

SEQ ID NO: 1764215 - DNA, 15 bp, Homo sapiens
ggctccccctctgct

SEQ ID NO: 1764216 - DNA, 17 bp, Homo sapiens
ggctccccctctgcttc

SEQ ID NO: 1764217 - DNA, 17 bp, Homo sapiens
ggctccccgcctccact

SEQ ID NO: 1764218 - DNA, 18 bp, Homo sapiens
ggctcccctcccagggga

SEQ ID NO: 1764219 - DNA, 23 bp, Homo sapiens
ggctcccctcccaggggagccag

SEQ ID NO: 1764220 - DNA, 19 bp, Homo sapiens
ggctcccggggcagggcag

SEQ ID NO: 1764221 - DNA, 12 bp, Homo sapiens
ggctccctcctc

SEQ ID NO: 1764222 - DNA, 14 bp, Homo sapiens
ggctccctgggcag

SEQ ID NO: 1764223 - DNA, 21 bp, Homo sapiens
ggctcccttcatctccaggga

SEQ ID NO: 1764224 - DNA, 12 bp, Homo sapiens
ggctcctgaggg

SEQ ID NO: 1764225 - DNA, 13 bp, Homo sapiens
ggctcctgagtgt

SEQ ID NO: 1764226 - DNA, 13 bp, Homo sapiens
ggctcctggctgc

SEQ ID NO: 1764227 - DNA, 16 bp, Homo sapiens
ggctcctggctgccag

SEQ ID NO: 1764228 - DNA, 15 bp, Homo sapiens
ggctcctggctgtgc

SEQ ID NO: 1764229 - DNA, 16 bp, Homo sapiens
ggctcctggctgtgcc

SEQ ID NO: 1764230 - DNA, 18 bp, Homo sapiens
ggctcctggctgtgccca

SEQ ID NO: 1764231 - DNA, 19 bp, Homo sapiens
ggctcctggctgtgcccag

SEQ ID NO: 1764232 - DNA, 15 bp, Homo sapiens
ggctccttcccctgc

SEQ ID NO: 1764233 - DNA, 17 bp, Homo sapiens
ggctccttcccctgcac

SEQ ID NO: 1764234 - DNA, 21 bp, Homo sapiens
ggctccttcccctgcacctgg

SEQ ID NO: 1764235 - DNA, 20 bp, Homo sapiens
ggctcctttctccagccagc

SEQ ID NO: 1764236 - DNA, 21 bp, Homo sapiens
ggctcctttctccagccagca

SEQ ID NO: 1764237 - DNA, 21 bp, Homo sapiens
ggctcgagcagtcctgcctca

SEQ ID NO: 1764238 - DNA, 17 bp, Homo sapiens
ggctcggacccacccca

SEQ ID NO: 1764239 - DNA, 19 bp, Homo sapiens
ggctcggggtaaaaagtgg

SEQ ID NO: 1764240 - DNA, 19 bp, Homo sapiens
ggctcgtggactgagtggg

SEQ ID NO: 1764241 - DNA, 15 bp, Homo sapiens
ggctcgttctcttct

SEQ ID NO: 1764242 - DNA, 17 bp, Homo sapiens
ggctctaattcacagtg

SEQ ID NO: 1764243 - DNA, 19 bp, Homo sapiens
ggctctaattcacagtgct

SEQ ID NO: 1764244 - DNA, 23 bp, Homo sapiens
ggctctatgagtctagatgttta

SEQ ID NO: 1764245 - DNA, 21 bp, Homo sapiens
gggaacagtaaagaaagcaga

SEQ ID NO: 1764246 - DNA, 18 bp, Homo sapiens
gggaacatggctggcctg

SEQ ID NO: 1764247 - DNA, 18 bp, Homo sapiens
gggaaccccgcagcccgt

SEQ ID NO: 1764248 - DNA, 21 bp, Homo sapiens
gggaacctagtactctctgct

SEQ ID NO: 1764249 - DNA, 14 bp, Homo sapiens
gggaactccactct

SEQ ID NO: 1764250 - DNA, 18 bp, Homo sapiens
gggaactccactctcctt

SEQ ID NO: 1764251 - DNA, 17 bp, Homo sapiens
gggaactctccctctgg

SEQ ID NO: 1764252 - DNA, 13 bp, Homo sapiens
gggaactctgaca

SEQ ID NO: 1764253 - DNA, 14 bp, Homo sapiens
gggaactctgacaa

SEQ ID NO: 1764254 - DNA, 21 bp, Homo sapiens
gggaactctgacaagggctga

SEQ ID NO: 1764255 - DNA, 18 bp, Homo sapiens
gggaactttctggactcc

SEQ ID NO: 1764256 - DNA, 20 bp, Homo sapiens
gggaagagaagagggcccag

SEQ ID NO: 1764257 - DNA, 17 bp, Homo sapiens
gggaagagctcccctcc

SEQ ID NO: 1764258 - DNA, 16 bp, Homo sapiens
gggaagagcttagaaa

SEQ ID NO: 1764259 - DNA, 19 bp, Homo sapiens
gggaagaggatgagcagag

SEQ ID NO: 1764260 - DNA, 13 bp, Homo sapiens
gggaagcagccag

SEQ ID NO: 1764261 - DNA, 14 bp, Homo sapiens
gggaagcccagctc

SEQ ID NO: 1764262 - DNA, 12 bp, Homo sapiens
gggaagccctgg

SEQ ID NO: 1764263 - DNA, 20 bp, Homo sapiens
gggaagcctgtgccagcacc

SEQ ID NO: 1764264 - DNA, 15 bp, Homo sapiens
gggaagctggcctga

SEQ ID NO: 1764265 - DNA, 22 bp, Homo sapiens
gggaagctgtactcagagcaga

SEQ ID NO: 1764266 - DNA, 18 bp, Homo sapiens
gggaagcttgagcctccc

SEQ ID NO: 1764267 - DNA, 12 bp, Homo sapiens
gggaaggaaaaa

SEQ ID NO: 1764268 - DNA, 13 bp, Homo sapiens
gggaaggagccag

SEQ ID NO: 1764269 - DNA, 15 bp, Homo sapiens
gggaaggccacctcc

SEQ ID NO: 1764270 - DNA, 22 bp, Homo sapiens
gggaaggccggcagcgggcgga

SEQ ID NO: 1764271 - DNA, 13 bp, Homo sapiens
gggaaggcctgac

SEQ ID NO: 1764272 - DNA, 13 bp, Homo sapiens
gggaagggagagc

SEQ ID NO: 1764273 - DNA, 18 bp, Homo sapiens
gggaagggagagggcctc

SEQ ID NO: 1764274 - DNA, 15 bp, Homo sapiens
gggaagggcatgcac

SEQ ID NO: 1764275 - DNA, 16 bp, Homo sapiens
gggaagggccagtctg

SEQ ID NO: 1764276 - DNA, 16 bp, Homo sapiens
gggaagggcctgccca

SEQ ID NO: 1764277 - DNA, 14 bp, Homo sapiens
gggaaggggcggtg

SEQ ID NO: 1764278 - DNA, 15 bp, Homo sapiens
gggaaggtgctgaat

SEQ ID NO: 1764279 - DNA, 21 bp, Homo sapiens
gggaaggtggggccctgcccc

SEQ ID NO: 1764280 - DNA, 15 bp, Homo sapiens
gggaagtgaggccca

SEQ ID NO: 1764281 - DNA, 16 bp, Homo sapiens
gggaagtgaggcccaa

SEQ ID NO: 1764282 - DNA, 17 bp, Homo sapiens
gggaatagggagacagg

SEQ ID NO: 1764283 - DNA, 12 bp, Homo sapiens
gggaatatttta

SEQ ID NO: 1764284 - DNA, 22 bp, Homo sapiens
gggaatctaagagagctgccat

SEQ ID NO: 1764285 - DNA, 14 bp, Homo sapiens
gggaatctggatta

SEQ ID NO: 1764286 - DNA, 13 bp, Homo sapiens
gggaatgggagag

SEQ ID NO: 1764287 - DNA, 21 bp, Homo sapiens
gggaatgtaactgctgaaaac

SEQ ID NO: 1764288 - DNA, 22 bp, Homo sapiens
gggaattaaaaagaagatgaat

SEQ ID NO: 1764289 - DNA, 16 bp, Homo sapiens
gggaattccctccccc

SEQ ID NO: 1764290 - DNA, 17 bp, Homo sapiens
gggaattccctccccct

SEQ ID NO: 1764291 - DNA, 18 bp, Homo sapiens
gggaattccctccccctc

SEQ ID NO: 1764292 - DNA, 13 bp, Homo sapiens
gggaatttcctct

SEQ ID NO: 1764293 - DNA, 22 bp, Homo sapiens
gggacaaagaggcctttaacca

SEQ ID NO: 1764294 - DNA, 16 bp, Homo sapiens
gggacaagcagtccct

SEQ ID NO: 1764295 - DNA, 13 bp, Homo sapiens
gggacaagggatt

SEQ ID NO: 1764296 - DNA, 14 bp, Homo sapiens
gggacaccagagct

SEQ ID NO: 1764297 - DNA, 16 bp, Homo sapiens
gggacacctgggagaa

SEQ ID NO: 1764298 - DNA, 14 bp, Homo sapiens
gggacacgggcagc

SEQ ID NO: 1764299 - DNA, 16 bp, Homo sapiens
gggacacggtgtccac

SEQ ID NO: 1764300 - DNA, 15 bp, Homo sapiens
gggacagacctggac

SEQ ID NO: 1764301 - DNA, 18 bp, Homo sapiens
gggacagaggccccagcc

SEQ ID NO: 1764302 - DNA, 21 bp, Homo sapiens
gggacagaggccccagcctcc

SEQ ID NO: 1764303 - DNA, 20 bp, Homo sapiens
gggacagcaagtgagcagag

SEQ ID NO: 1764304 - DNA, 14 bp, Homo sapiens
gggacagcagcctc

SEQ ID NO: 1764305 - DNA, 16 bp, Homo sapiens
gggacagcccagagcc

SEQ ID NO: 1764306 - DNA, 21 bp, Homo sapiens
gggacagcccagagcctggct

SEQ ID NO: 1764307 - DNA, 20 bp, Homo sapiens
gggacagctgctgggaccca

SEQ ID NO: 1764308 - DNA, 12 bp, Homo sapiens
gggacagctggc

SEQ ID NO: 1764309 - DNA, 13 bp, Homo sapiens
gggacagctggct

SEQ ID NO: 1764310 - DNA, 14 bp, Homo sapiens
gggacagctggctg

SEQ ID NO: 1764311 - DNA, 15 bp, Homo sapiens
gggacagctggctgg

SEQ ID NO: 1764312 - DNA, 11 bp, Homo sapiens
gggacagctgt

SEQ ID NO: 1764313 - DNA, 20 bp, Homo sapiens
gggacagcttcctcacaccc

SEQ ID NO: 1764314 - DNA, 19 bp, Homo sapiens
gggacaggctgaagagagg

SEQ ID NO: 1764315 - DNA, 17 bp, Homo sapiens
gggacatgccctgtgtg

SEQ ID NO: 1764316 - DNA, 17 bp, Homo sapiens
gggacattgctctctgg

SEQ ID NO: 1764317 - DNA, 21 bp, Homo sapiens
gggacattgttctttccggcc

SEQ ID NO: 1764318 - DNA, 16 bp, Homo sapiens
gggaccaactgggccc

SEQ ID NO: 1764319 - DNA, 18 bp, Homo sapiens
gggaccaattctggacag

SEQ ID NO: 1764320 - DNA, 22 bp, Homo sapiens
gggaccaattctggacagacag

SEQ ID NO: 1764321 - DNA, 15 bp, Homo sapiens
gggaccacagctgct

SEQ ID NO: 1764322 - DNA, 21 bp, Homo sapiens
gggaccactgggtacaagaga

SEQ ID NO: 1764323 - DNA, 22 bp, Homo sapiens
gggaccactgggtacaagagat

SEQ ID NO: 1764324 - DNA, 17 bp, Homo sapiens
gggaccactgggtgaga

SEQ ID NO: 1764325 - DNA, 22 bp, Homo sapiens
gggaccactgggtgagagagga

SEQ ID NO: 1764326 - DNA, 15 bp, Homo sapiens
gggaccagagccaga

SEQ ID NO: 1764327 - DNA, 16 bp, Homo sapiens
gggaccagagccagat

SEQ ID NO: 1764328 - DNA, 12 bp, Homo sapiens
gggaccaggagc

SEQ ID NO: 1764329 - DNA, 12 bp, Homo sapiens
gggaccagggcc

SEQ ID NO: 1764330 - DNA, 20 bp, Homo sapiens
gggaccagggccaccgcagg

SEQ ID NO: 1764331 - DNA, 16 bp, Homo sapiens
gggaccattgacctca

SEQ ID NO: 1764332 - DNA, 17 bp, Homo sapiens
gggaccattgacctcag

SEQ ID NO: 1764333 - DNA, 14 bp, Homo sapiens
gggacccagctact

SEQ ID NO: 1764334 - DNA, 21 bp, Homo sapiens
gggacccaggtgtgcctgtgc

SEQ ID NO: 1764335 - DNA, 23 bp, Homo sapiens
gggacccaggtgtgcctgtgctc

SEQ ID NO: 1764336 - DNA, 18 bp, Homo sapiens
gggaccccacttcagaag

SEQ ID NO: 1764337 - DNA, 13 bp, Homo sapiens
gggaccccccccc

SEQ ID NO: 1764338 - DNA, 18 bp, Homo sapiens
gggaccccctggccctgc

SEQ ID NO: 1764339 - DNA, 14 bp, Homo sapiens
gggacccctcccaa

SEQ ID NO: 1764340 - DNA, 19 bp, Homo sapiens
gggacccggggtctcctgg

SEQ ID NO: 1764341 - DNA, 16 bp, Homo sapiens
gggaccctttccttcc

SEQ ID NO: 1764342 - DNA, 17 bp, Homo sapiens
gggaccgagcccagcag

SEQ ID NO: 1764343 - DNA, 18 bp, Homo sapiens
gggaccggtacagaaagg

SEQ ID NO: 1764344 - DNA, 13 bp, Homo sapiens
gggaccggtgctg

SEQ ID NO: 1764345 - DNA, 12 bp, Homo sapiens
gggacctgagag

SEQ ID NO: 1764346 - DNA, 17 bp, Homo sapiens
gggacctgccaggcagg

SEQ ID NO: 1764347 - DNA, 19 bp, Homo sapiens
gggacctgccaggcagggg

SEQ ID NO: 1764348 - DNA, 13 bp, Homo sapiens
gggacctgctgct

SEQ ID NO: 1764349 - DNA, 18 bp, Homo sapiens
gggacctggtaccctcct

SEQ ID NO: 1764350 - DNA, 20 bp, Homo sapiens
gggacgctccgctgccgtgc

SEQ ID NO: 1764351 - DNA, 18 bp, Homo sapiens
gggactaggacctgagcc

SEQ ID NO: 1764352 - DNA, 19 bp, Homo sapiens
gggactagtgagtcagcac

SEQ ID NO: 1764353 - DNA, 21 bp, Homo sapiens
gggactagtgagtcagcacct

SEQ ID NO: 1764354 - DNA, 12 bp, Homo sapiens
gggactcagccc

SEQ ID NO: 1764355 - DNA, 18 bp, Homo sapiens
gggactcagcgtcccctg

SEQ ID NO: 1764356 - DNA, 15 bp, Homo sapiens
gggactcagggaccg

SEQ ID NO: 1764357 - DNA, 13 bp, Homo sapiens
gggactctcctcc

SEQ ID NO: 1764358 - DNA, 21 bp, Homo sapiens
gggactctcctcctcccctcc

SEQ ID NO: 1764359 - DNA, 16 bp, Homo sapiens
gggactgatgtcatct

SEQ ID NO: 1764360 - DNA, 17 bp, Homo sapiens
gggactgccaggctgtt

SEQ ID NO: 1764361 - DNA, 23 bp, Homo sapiens
gggccacacctgagcgctgtgga

SEQ ID NO: 1764362 - DNA, 14 bp, Homo sapiens
gggccaccaaagct

SEQ ID NO: 1764363 - DNA, 16 bp, Homo sapiens
gggccaccaaagctgc

SEQ ID NO: 1764364 - DNA, 17 bp, Homo sapiens
gggccaccaaagctgcc

SEQ ID NO: 1764365 - DNA, 12 bp, Homo sapiens
gggccaccacct

SEQ ID NO: 1764366 - DNA, 18 bp, Homo sapiens
gggccaccacctttggct

SEQ ID NO: 1764367 - DNA, 20 bp, Homo sapiens
gggccacccaaatgtgtaca

SEQ ID NO: 1764368 - DNA, 13 bp, Homo sapiens
gggccacccctcc

SEQ ID NO: 1764369 - DNA, 16 bp, Homo sapiens
gggccacctcctcccc

SEQ ID NO: 1764370 - DNA, 19 bp, Homo sapiens
gggccacgtgccaggcccg

SEQ ID NO: 1764371 - DNA, 21 bp, Homo sapiens
gggccactttttttttatact

SEQ ID NO: 1764372 - DNA, 21 bp, Homo sapiens
gggccagaaggagggcagagc

SEQ ID NO: 1764373 - DNA, 12 bp, Homo sapiens
gggccagagcca

SEQ ID NO: 1764374 - DNA, 13 bp, Homo sapiens
gggccagagccag

SEQ ID NO: 1764375 - DNA, 11 bp, Homo sapiens
gggccagagct

SEQ ID NO: 1764376 - DNA, 12 bp, Homo sapiens
gggccagcactg

SEQ ID NO: 1764377 - DNA, 12 bp, Homo sapiens
gggccagccagg

SEQ ID NO: 1764378 - DNA, 18 bp, Homo sapiens
gggccagccaggcgggct

SEQ ID NO: 1764379 - DNA, 13 bp, Homo sapiens
gggccaggcactg

SEQ ID NO: 1764380 - DNA, 20 bp, Homo sapiens
gggccagggacccaggtgtg

SEQ ID NO: 1764381 - DNA, 13 bp, Homo sapiens
gggccagggccct

SEQ ID NO: 1764382 - DNA, 13 bp, Homo sapiens
gggccagggctgc

SEQ ID NO: 1764383 - DNA, 17 bp, Homo sapiens
gggccaggtgcagacct

SEQ ID NO: 1764384 - DNA, 19 bp, Homo sapiens
gggccagtcctgcctggcc

SEQ ID NO: 1764385 - DNA, 22 bp, Homo sapiens
gggccagtcctgcctggccagg

SEQ ID NO: 1764386 - DNA, 16 bp, Homo sapiens
gggccagtctgggctg

SEQ ID NO: 1764387 - DNA, 19 bp, Homo sapiens
gggccatctgactgccaag

SEQ ID NO: 1764388 - DNA, 21 bp, Homo sapiens
gggccatctgactgccaagcc

SEQ ID NO: 1764389 - DNA, 22 bp, Homo sapiens
gggccatctgactgccaagcca

SEQ ID NO: 1764390 - DNA, 23 bp, Homo sapiens
gggccatctgactgccaagccag

SEQ ID NO: 1764391 - DNA, 24 bp, Homo sapiens
gggccatctgactgccaagccaga

SEQ ID NO: 1764392 - DNA, 19 bp, Homo sapiens
gggccatgctgaggcctgg

SEQ ID NO: 1764393 - DNA, 21 bp, Homo sapiens
gggccatgctgaggcctgggc

SEQ ID NO: 1764394 - DNA, 13 bp, Homo sapiens
gggccatggctca

SEQ ID NO: 1764395 - DNA, 19 bp, Homo sapiens
gggccatggctcagggtgg

SEQ ID NO: 1764396 - DNA, 16 bp, Homo sapiens
gggccatgtccaaaga

SEQ ID NO: 1764397 - DNA, 13 bp, Homo sapiens
gggcccaaaggcc

SEQ ID NO: 1764398 - DNA, 18 bp, Homo sapiens
gggcccaagacagatgcc

SEQ ID NO: 1764399 - DNA, 15 bp, Homo sapiens
gggcccacacctggt

SEQ ID NO: 1764400 - DNA, 13 bp, Homo sapiens
gggcccacccaca

SEQ ID NO: 1764401 - DNA, 22 bp, Homo sapiens
gggcccacctggccacctgagg

SEQ ID NO: 1764402 - DNA, 11 bp, Homo sapiens
gggcccagacc

SEQ ID NO: 1764403 - DNA, 16 bp, Homo sapiens
gggcccagaccctggg

SEQ ID NO: 1764404 - DNA, 11 bp, Homo sapiens
gggcccagagc

SEQ ID NO: 1764405 - DNA, 17 bp, Homo sapiens
gggcccagagcccagct

SEQ ID NO: 1764406 - DNA, 19 bp, Homo sapiens
gggcccagagcccagctcc

SEQ ID NO: 1764407 - DNA, 13 bp, Homo sapiens
gggcccagcccag

SEQ ID NO: 1764408 - DNA, 14 bp, Homo sapiens
gggcccagcgctct

SEQ ID NO: 1764409 - DNA, 23 bp, Homo sapiens
gggcccagcgctctcctggacgc

SEQ ID NO: 1764410 - DNA, 12 bp, Homo sapiens
gggcccagctgg

SEQ ID NO: 1764411 - DNA, 15 bp, Homo sapiens
gggcccagctgggct

SEQ ID NO: 1764412 - DNA, 16 bp, Homo sapiens
gggcccagctgggctc

SEQ ID NO: 1764413 - DNA, 16 bp, Homo sapiens
gggcccaggaccagct

SEQ ID NO: 1764414 - DNA, 18 bp, Homo sapiens
gggcccaggaccagctgg

SEQ ID NO: 1764415 - DNA, 24 bp, Homo sapiens
gggcccaggaccagctggggcgtg

SEQ ID NO: 1764416 - DNA, 14 bp, Homo sapiens
gggcccaggcaaat

SEQ ID NO: 1764417 - DNA, 12 bp, Homo sapiens
gggcccaggcag

SEQ ID NO: 1764418 - DNA, 13 bp, Homo sapiens
gggcccaggcagg

SEQ ID NO: 1764419 - DNA, 17 bp, Homo sapiens
gggcccaggggctgtgg

SEQ ID NO: 1764420 - DNA, 12 bp, Homo sapiens
gggcccaggttc

SEQ ID NO: 1764421 - DNA, 19 bp, Homo sapiens
gggccccagatctgcctgg

SEQ ID NO: 1764422 - DNA, 24 bp, Homo sapiens
gggccccagatctgcctgggcctg

SEQ ID NO: 1764423 - DNA, 17 bp, Homo sapiens
gggccccaggggcagca

SEQ ID NO: 1764424 - DNA, 13 bp, Homo sapiens
gggccccatgctc

SEQ ID NO: 1764425 - DNA, 16 bp, Homo sapiens
gggccccatgctctgc

SEQ ID NO: 1764426 - DNA, 13 bp, Homo sapiens
gggcccccacagg

SEQ ID NO: 1764427 - DNA, 12 bp, Homo sapiens
gggccccccaac

SEQ ID NO: 1764428 - DNA, 15 bp, Homo sapiens
gggcccccggccacg

SEQ ID NO: 1764429 - DNA, 23 bp, Homo sapiens
gggccccgaatgtcactggtgga

SEQ ID NO: 1764430 - DNA, 16 bp, Homo sapiens
gggccccgccagggct

SEQ ID NO: 1764431 - DNA, 21 bp, Homo sapiens
gggccccgccagggctgggga

SEQ ID NO: 1764432 - DNA, 15 bp, Homo sapiens
gggccccgggctgga

SEQ ID NO: 1764433 - DNA, 16 bp, Homo sapiens
gggccccggggctggc

SEQ ID NO: 1764434 - DNA, 18 bp, Homo sapiens
gggccccggggctggcaa

SEQ ID NO: 1764435 - DNA, 22 bp, Homo sapiens
gggcccctcacctggtacctgg

SEQ ID NO: 1764436 - DNA, 13 bp, Homo sapiens
gggcccctccctc

SEQ ID NO: 1764437 - DNA, 19 bp, Homo sapiens
gggcccctccctctgcccc

SEQ ID NO: 1764438 - DNA, 12 bp, Homo sapiens
gggcccctctgc

SEQ ID NO: 1764439 - DNA, 14 bp, Homo sapiens
gggcccctgaggag

SEQ ID NO: 1764440 - DNA, 21 bp, Homo sapiens
gggcccctgggcttggcctgc

SEQ ID NO: 1764441 - DNA, 18 bp, Homo sapiens
gggcccgacatggctccg

SEQ ID NO: 1764442 - DNA, 19 bp, Homo sapiens
gggcccgcagtgctgggac

SEQ ID NO: 1764443 - DNA, 22 bp, Homo sapiens
gggcccggagtaatcaggcagc

SEQ ID NO: 1764444 - DNA, 21 bp, Homo sapiens
gggccctatgtctcaggagtg

SEQ ID NO: 1764445 - DNA, 21 bp, Homo sapiens
gggccctccgaccacttccag

SEQ ID NO: 1764446 - DNA, 12 bp, Homo sapiens
gggccctctgta

SEQ ID NO: 1764447 - DNA, 15 bp, Homo sapiens
gggccctctgtagct

SEQ ID NO: 1764448 - DNA, 17 bp, Homo sapiens
gggccctctttccctgc

SEQ ID NO: 1764449 - DNA, 22 bp, Homo sapiens
gggccctgagctcggtggaccc

SEQ ID NO: 1764450 - DNA, 18 bp, Homo sapiens
gggccctgcattggcctg

SEQ ID NO: 1764451 - DNA, 21 bp, Homo sapiens
gggccctgccccaccccatcc

SEQ ID NO: 1764452 - DNA, 11 bp, Homo sapiens
gggccctggca

SEQ ID NO: 1764453 - DNA, 13 bp, Homo sapiens
gggccctgggctg

SEQ ID NO: 1764454 - DNA, 14 bp, Homo sapiens
gggccctgggctgg

SEQ ID NO: 1764455 - DNA, 18 bp, Homo sapiens
gggccctgtggagtccag

SEQ ID NO: 1764456 - DNA, 23 bp, Homo sapiens
gggccctgtggagtccagctcta

SEQ ID NO: 1764457 - DNA, 12 bp, Homo sapiens
gggcccttcccc

SEQ ID NO: 1764458 - DNA, 15 bp, Homo sapiens
gggcccttggggcct

SEQ ID NO: 1764459 - DNA, 13 bp, Homo sapiens
gggccgaccagag

SEQ ID NO: 1764460 - DNA, 15 bp, Homo sapiens
gggccgaggcccagc

SEQ ID NO: 1764461 - DNA, 19 bp, Homo sapiens
gggccgaggcccagcgggc

SEQ ID NO: 1764462 - DNA, 21 bp, Homo sapiens
gggccgaggcccagcgggcag

SEQ ID NO: 1764463 - DNA, 22 bp, Homo sapiens
gggccgaggcccagcgggcaga

SEQ ID NO: 1764464 - DNA, 19 bp, Homo sapiens
gggccgccacggcctggct

SEQ ID NO: 1764465 - DNA, 20 bp, Homo sapiens
gggccgcccgggcccagagg

SEQ ID NO: 1764466 - DNA, 17 bp, Homo sapiens
gggccgccgcctctttc

SEQ ID NO: 1764467 - DNA, 14 bp, Homo sapiens
gggccgcgagaggc

SEQ ID NO: 1764468 - DNA, 12 bp, Homo sapiens
gggccgctgcca

SEQ ID NO: 1764469 - DNA, 19 bp, Homo sapiens
gggccggacgcaggtgctg

SEQ ID NO: 1764470 - DNA, 12 bp, Homo sapiens
gggccggccctg

SEQ ID NO: 1764471 - DNA, 18 bp, Homo sapiens
gggccggctgagtggcag

SEQ ID NO: 1764472 - DNA, 20 bp, Homo sapiens
gggccgggcgcggtggctca

SEQ ID NO: 1764473 - DNA, 22 bp, Homo sapiens
gggccggggggaaagaaaagga

SEQ ID NO: 1764474 - DNA, 18 bp, Homo sapiens
gggccgtaccccaccctc

SEQ ID NO: 1764475 - DNA, 22 bp, Homo sapiens
gggccgtaccccaccctcagca

SEQ ID NO: 1764476 - DNA, 11 bp, Homo sapiens
gggtacatgtg

SEQ ID NO: 1764477 - DNA, 23 bp, Homo sapiens
gggtaccttgaacactgggggag

SEQ ID NO: 1764478 - DNA, 21 bp, Homo sapiens
gggtactgactgagataagaa

SEQ ID NO: 1764479 - DNA, 14 bp, Homo sapiens
gggtagagctgatc

SEQ ID NO: 1764480 - DNA, 14 bp, Homo sapiens
gggtagcagctgga

SEQ ID NO: 1764481 - DNA, 20 bp, Homo sapiens
gggtatccaagttggactgg

SEQ ID NO: 1764482 - DNA, 13 bp, Homo sapiens
gggtatcccctgc

SEQ ID NO: 1764483 - DNA, 10 bp, Homo sapiens
gggtatcctg

SEQ ID NO: 1764484 - DNA, 22 bp, Homo sapiens
gggtatgtttaatctgttatgt

SEQ ID NO: 1764485 - DNA, 22 bp, Homo sapiens
gggtattcccactcaccagccc

SEQ ID NO: 1764486 - DNA, 23 bp, Homo sapiens
gggtattcccactcaccagccct

SEQ ID NO: 1764487 - DNA, 17 bp, Homo sapiens
gggtcaacttgacacca

SEQ ID NO: 1764488 - DNA, 19 bp, Homo sapiens
gggtcaagaaacagccagc

SEQ ID NO: 1764489 - DNA, 12 bp, Homo sapiens
gggtcaagcctc

SEQ ID NO: 1764490 - DNA, 12 bp, Homo sapiens
gggtcacaggaa

SEQ ID NO: 1764491 - DNA, 12 bp, Homo sapiens
gggtcagcccag

SEQ ID NO: 1764492 - DNA, 15 bp, Homo sapiens
gggtcagcccagcac

SEQ ID NO: 1764493 - DNA, 21 bp, Homo sapiens
gggtcaggcggggtgctgtgg

SEQ ID NO: 1764494 - DNA, 12 bp, Homo sapiens
gggtcaggctcc

SEQ ID NO: 1764495 - DNA, 21 bp, Homo sapiens
gggtcagggccagactggaag

SEQ ID NO: 1764496 - DNA, 12 bp, Homo sapiens
gggtcagggggg

SEQ ID NO: 1764497 - DNA, 19 bp, Homo sapiens
gggtcagtgcagcagagga

SEQ ID NO: 1764498 - DNA, 15 bp, Homo sapiens
gggtcatcagggagg

SEQ ID NO: 1764499 - DNA, 21 bp, Homo sapiens
gggtcatcctgtgctcggagg

SEQ ID NO: 1764500 - DNA, 21 bp, Homo sapiens
gggtcatctgtacctctgcct

SEQ ID NO: 1764501 - DNA, 20 bp, Homo sapiens
gggtccaggagaagtgctcc

SEQ ID NO: 1764502 - DNA, 11 bp, Homo sapiens
gggtccaggcc

SEQ ID NO: 1764503 - DNA, 14 bp, Homo sapiens
gggtccaggcccgt

SEQ ID NO: 1764504 - DNA, 12 bp, Homo sapiens
gggtccagtctg

SEQ ID NO: 1764505 - DNA, 14 bp, Homo sapiens
gggtccagtctgtg

SEQ ID NO: 1764506 - DNA, 16 bp, Homo sapiens
gggtcccagccacccc

SEQ ID NO: 1764507 - DNA, 13 bp, Homo sapiens
gggtccccagctc

SEQ ID NO: 1764508 - DNA, 14 bp, Homo sapiens
gggtcccggccgcg

SEQ ID NO: 1764509 - DNA, 23 bp, Homo sapiens
gggtccctcctctcacctctccc

SEQ ID NO: 1764510 - DNA, 21 bp, Homo sapiens
gggtccgcaccagctgctctg

SEQ ID NO: 1764511 - DNA, 14 bp, Homo sapiens
gggtcctcctgtgc

SEQ ID NO: 1764512 - DNA, 13 bp, Homo sapiens
gggtcctctctga

SEQ ID NO: 1764513 - DNA, 23 bp, Homo sapiens
gggtcctctctgagtcaaatcca

SEQ ID NO: 1764514 - DNA, 13 bp, Homo sapiens
gggtcctcttctg

SEQ ID NO: 1764515 - DNA, 23 bp, Homo sapiens
gggtcctgggcaggtgggagctg

SEQ ID NO: 1764516 - DNA, 19 bp, Homo sapiens
gggtccttgatgccagagg

SEQ ID NO: 1764517 - DNA, 20 bp, Homo sapiens
gggtccttgatgccagaggg

SEQ ID NO: 1764518 - DNA, 22 bp, Homo sapiens
gggtccttgatgccagagggcc

SEQ ID NO: 1764519 - DNA, 23 bp, Homo sapiens
gggtccttgggcctggccagtct

SEQ ID NO: 1764520 - DNA, 16 bp, Homo sapiens
gggtcgaaagctctag

SEQ ID NO: 1764521 - DNA, 14 bp, Homo sapiens
gggtctagggagag

SEQ ID NO: 1764522 - DNA, 20 bp, Homo sapiens
gggtctccctctcctgccta

SEQ ID NO: 1764523 - DNA, 13 bp, Homo sapiens
gggtctccctggc

SEQ ID NO: 1764524 - DNA, 18 bp, Homo sapiens
gggtctccctggctccct

SEQ ID NO: 1764525 - DNA, 12 bp, Homo sapiens
gggtctcctccc

SEQ ID NO: 1764526 - DNA, 21 bp, Homo sapiens
gggtctcctcccagcggcctc

SEQ ID NO: 1764527 - DNA, 19 bp, Homo sapiens
gggtctcctggaccttgac

SEQ ID NO: 1764528 - DNA, 18 bp, Homo sapiens
gggtctcgaactcctggc

SEQ ID NO: 1764529 - DNA, 22 bp, Homo sapiens
gggtctcggatgacaccctggc

SEQ ID NO: 1764530 - DNA, 22 bp, Homo sapiens
gggtctctcactgttgcagtgg

SEQ ID NO: 1764531 - DNA, 22 bp, Homo sapiens
gggtctctgaagggaccccccc

SEQ ID NO: 1764532 - DNA, 12 bp, Homo sapiens
gggtctctggaa

SEQ ID NO: 1764533 - DNA, 21 bp, Homo sapiens
gggtctgctctttctctgcca

SEQ ID NO: 1764534 - DNA, 23 bp, Homo sapiens
gggtctgggcggcgggcggctgg

SEQ ID NO: 1764535 - DNA, 17 bp, Homo sapiens
gggtctgtgctgtgcct

SEQ ID NO: 1764536 - DNA, 19 bp, Homo sapiens
gggtctgtgctgtgcctgc

SEQ ID NO: 1764537 - DNA, 17 bp, Homo sapiens
gggtcttgggctactgg

SEQ ID NO: 1764538 - DNA, 18 bp, Homo sapiens
gggtcttgggttcctgta

SEQ ID NO: 1764539 - DNA, 22 bp, Homo sapiens
gggtctttgtggtagcttatct

SEQ ID NO: 1764540 - DNA, 18 bp, Homo sapiens
gggtgaaacttaaaaaaa

SEQ ID NO: 1764541 - DNA, 19 bp, Homo sapiens
gggtgaagagaaccgagca

SEQ ID NO: 1764542 - DNA, 18 bp, Homo sapiens
gggtgacagagtgagtga

SEQ ID NO: 1764543 - DNA, 18 bp, Homo sapiens
gggtgacagtgccttctc

SEQ ID NO: 1764544 - DNA, 13 bp, Homo sapiens
gggtgaccaggtc

SEQ ID NO: 1764545 - DNA, 14 bp, Homo sapiens
gggtgacgcccagc

SEQ ID NO: 1764546 - DNA, 13 bp, Homo sapiens
gggtgagccaagg

SEQ ID NO: 1764547 - DNA, 16 bp, Homo sapiens
gggtgagggagttagg

SEQ ID NO: 1764548 - DNA, 21 bp, Homo sapiens
gggtgagggagttagggagag

SEQ ID NO: 1764549 - DNA, 15 bp, Homo sapiens
gggtgattcctccca

SEQ ID NO: 1764550 - DNA, 19 bp, Homo sapiens
gggtgcacccactcaccag

SEQ ID NO: 1764551 - DNA, 23 bp, Homo sapiens
gggtgcacccactcaccagggtc

SEQ ID NO: 1764552 - DNA, 19 bp, Homo sapiens
gggtgcagccctcttgccc

SEQ ID NO: 1764553 - DNA, 23 bp, Homo sapiens
gggtgcccgtaatcccagctact

SEQ ID NO: 1764554 - DNA, 11 bp, Homo sapiens
gggtgccctga

SEQ ID NO: 1764555 - DNA, 14 bp, Homo sapiens
gggtgcccttttcc

SEQ ID NO: 1764556 - DNA, 13 bp, Homo sapiens
gggtgctgctctc

SEQ ID NO: 1764557 - DNA, 20 bp, Homo sapiens
gggtgctgctggtaacagtg

SEQ ID NO: 1764558 - DNA, 18 bp, Homo sapiens
gggtgctggcccccagga

SEQ ID NO: 1764559 - DNA, 23 bp, Homo sapiens
gggtggagactgcttcccatcct

SEQ ID NO: 1764560 - DNA, 17 bp, Homo sapiens
gggtggatcacgaggtc

SEQ ID NO: 1764561 - DNA, 20 bp, Homo sapiens
gggtggcacctcctgagaag

SEQ ID NO: 1764562 - DNA, 16 bp, Homo sapiens
gggtggctagtcagag

SEQ ID NO: 1764563 - DNA, 15 bp, Homo sapiens
gggtgggaagaaaga

SEQ ID NO: 1764564 - DNA, 19 bp, Homo sapiens
gggtgggagagcccagcca

SEQ ID NO: 1764565 - DNA, 17 bp, Homo sapiens
gggtgggatggaggaga

SEQ ID NO: 1764566 - DNA, 15 bp, Homo sapiens
gggtgggcagttttt

SEQ ID NO: 1764567 - DNA, 23 bp, Homo sapiens
gggtgggcctggcctgagctggg

SEQ ID NO: 1764568 - DNA, 14 bp, Homo sapiens
gggtggggctgctc

SEQ ID NO: 1764569 - DNA, 13 bp, Homo sapiens
gggtgggggtgct

SEQ ID NO: 1764570 - DNA, 14 bp, Homo sapiens
gggtggtgctggga

SEQ ID NO: 1764571 - DNA, 15 bp, Homo sapiens
gggtggtggcctggt

SEQ ID NO: 1764572 - DNA, 19 bp, Homo sapiens
gggtggtggggaggggcgc

SEQ ID NO: 1764573 - DNA, 18 bp, Homo sapiens
gggtgtaacaggtctcct

SEQ ID NO: 1764574 - DNA, 15 bp, Homo sapiens
gggtgtaacttcctg

SEQ ID NO: 1764575 - DNA, 23 bp, Homo sapiens
gggtgtaacttcctgctgcaccc

SEQ ID NO: 1764576 - DNA, 15 bp, Homo sapiens
gggtgtattctctgt

SEQ ID NO: 1764577 - DNA, 24 bp, Homo sapiens
gggtgtcaaacattcgtgagctgg

SEQ ID NO: 1764578 - DNA, 15 bp, Homo sapiens
gggtgtcttgggcag

SEQ ID NO: 1764579 - DNA, 13 bp, Homo sapiens
gggtgtgcccttg

SEQ ID NO: 1764580 - DNA, 16 bp, Homo sapiens
gggtgtggccctgcca

SEQ ID NO: 1764581 - DNA, 11 bp, Homo sapiens
gggtgtgggtt

SEQ ID NO: 1764582 - DNA, 21 bp, Homo sapiens
gggttaaatattttgctaact

SEQ ID NO: 1764583 - DNA, 13 bp, Homo sapiens
gggttaacaaatg

SEQ ID NO: 1764584 - DNA, 21 bp, Homo sapiens
gggttaacttggtcagagcca

SEQ ID NO: 1764585 - DNA, 15 bp, Homo sapiens
gggttaaggcctgaa

SEQ ID NO: 1764586 - DNA, 16 bp, Homo sapiens
gggttacaaactgcaa

SEQ ID NO: 1764587 - DNA, 21 bp, Homo sapiens
gggttatttttattaaatgta

SEQ ID NO: 1764588 - DNA, 16 bp, Homo sapiens
gggttcaaaatgtctg

SEQ ID NO: 1764589 - DNA, 17 bp, Homo sapiens
gggttcacacagcccag

SEQ ID NO: 1764590 - DNA, 13 bp, Homo sapiens
gggttcagcccct

SEQ ID NO: 1764591 - DNA, 21 bp, Homo sapiens
ggtccggtgttctaagatgtg

SEQ ID NO: 1764592 - DNA, 14 bp, Homo sapiens
ggtccgtctgagtg

SEQ ID NO: 1764593 - DNA, 20 bp, Homo sapiens
ggtccgtgcccaggcccttg

SEQ ID NO: 1764594 - DNA, 13 bp, Homo sapiens
ggtcctccctccc

SEQ ID NO: 1764595 - DNA, 18 bp, Homo sapiens
ggtcctccctcccaagga

SEQ ID NO: 1764596 - DNA, 13 bp, Homo sapiens
ggtcctcctgtgc

SEQ ID NO: 1764597 - DNA, 23 bp, Homo sapiens
ggtcctcgggatgccgttctgtt

SEQ ID NO: 1764598 - DNA, 23 bp, Homo sapiens
ggtcctctagcccactccctgcc

SEQ ID NO: 1764599 - DNA, 18 bp, Homo sapiens
ggtcctctctgagtcaaa

SEQ ID NO: 1764600 - DNA, 19 bp, Homo sapiens
ggtcctctctgagtcaaat

SEQ ID NO: 1764601 - DNA, 20 bp, Homo sapiens
ggtcctgctccgctgcctgg

SEQ ID NO: 1764602 - DNA, 22 bp, Homo sapiens
ggtcctggccttgtgtcactgg

SEQ ID NO: 1764603 - DNA, 16 bp, Homo sapiens
ggtcctggctgcactc

SEQ ID NO: 1764604 - DNA, 23 bp, Homo sapiens
ggtcctggtgggtcagcccagca

SEQ ID NO: 1764605 - DNA, 20 bp, Homo sapiens
ggtcctgttaacgtcatctc

SEQ ID NO: 1764606 - DNA, 15 bp, Homo sapiens
ggtccttatttattt

SEQ ID NO: 1764607 - DNA, 23 bp, Homo sapiens
ggtccttcactggcgccttctcg

SEQ ID NO: 1764608 - DNA, 15 bp, Homo sapiens
ggtccttccaggccc

SEQ ID NO: 1764609 - DNA, 19 bp, Homo sapiens
ggtccttgatgccagaggg

SEQ ID NO: 1764610 - DNA, 20 bp, Homo sapiens
ggtccttgatgccagagggc

SEQ ID NO: 1764611 - DNA, 15 bp, Homo sapiens
ggtccttgggcctgg

SEQ ID NO: 1764612 - DNA, 16 bp, Homo sapiens
ggtcctttctggaagt

SEQ ID NO: 1764613 - DNA, 16 bp, Homo sapiens
ggtcgaggagtaacaa

SEQ ID NO: 1764614 - DNA, 22 bp, Homo sapiens
ggtcgaggagtaacaatacaaa

SEQ ID NO: 1764615 - DNA, 15 bp, Homo sapiens
ggtcggaacccaagc

SEQ ID NO: 1764616 - DNA, 15 bp, Homo sapiens
ggtcgggcagccagc

SEQ ID NO: 1764617 - DNA, 18 bp, Homo sapiens
ggtcgggcagccagcaga

SEQ ID NO: 1764618 - DNA, 20 bp, Homo sapiens
ggtcggtaggttcagccaag

SEQ ID NO: 1764619 - DNA, 14 bp, Homo sapiens
ggtctactctagaa

SEQ ID NO: 1764620 - DNA, 14 bp, Homo sapiens
ggtctagggagaga

SEQ ID NO: 1764621 - DNA, 15 bp, Homo sapiens
ggtctatgttcccca

SEQ ID NO: 1764622 - DNA, 23 bp, Homo sapiens
ggtctattgtcgctatgtgactt

SEQ ID NO: 1764623 - DNA, 17 bp, Homo sapiens
ggtctcaaactcctgac

SEQ ID NO: 1764624 - DNA, 21 bp, Homo sapiens
ggtctcaaactcctgggctca

SEQ ID NO: 1764625 - DNA, 13 bp, Homo sapiens
ggtctcacccatg

SEQ ID NO: 1764626 - DNA, 19 bp, Homo sapiens
ggtctcaccggctctcacc

SEQ ID NO: 1764627 - DNA, 21 bp, Homo sapiens
ggtctcaccggctctcacctg

SEQ ID NO: 1764628 - DNA, 15 bp, Homo sapiens
ggtctccaaactgat

SEQ ID NO: 1764629 - DNA, 21 bp, Homo sapiens
ggtctccatatcagctctctg

SEQ ID NO: 1764630 - DNA, 19 bp, Homo sapiens
ggtctccctctcctgccta

SEQ ID NO: 1764631 - DNA, 12 bp, Homo sapiens
ggtctccctggc

SEQ ID NO: 1764632 - DNA, 16 bp, Homo sapiens
ggtctccctggctccc

SEQ ID NO: 1764633 - DNA, 17 bp, Homo sapiens
ggtctccctggctccct

SEQ ID NO: 1764634 - DNA, 24 bp, Homo sapiens
ggtctccctggctccctcctccag

SEQ ID NO: 1764635 - DNA, 20 bp, Homo sapiens
ggtctcccttctctacactc

SEQ ID NO: 1764636 - DNA, 14 bp, Homo sapiens
ggtctcctcagggt

SEQ ID NO: 1764637 - DNA, 21 bp, Homo sapiens
ggtctcctcagggtggggggt

SEQ ID NO: 1764638 - DNA, 12 bp, Homo sapiens
ggtctcctccca

SEQ ID NO: 1764639 - DNA, 23 bp, Homo sapiens
ggtctcctgactggtgctgcagc

SEQ ID NO: 1764640 - DNA, 18 bp, Homo sapiens
ggtctccttactctgagc

SEQ ID NO: 1764641 - DNA, 19 bp, Homo sapiens
ggtctccttactctgagcc

SEQ ID NO: 1764642 - DNA, 20 bp, Homo sapiens
ggtctccttactctgagccc

SEQ ID NO: 1764643 - DNA, 22 bp, Homo sapiens
ggtctccttactctgagcccag

SEQ ID NO: 1764644 - DNA, 16 bp, Homo sapiens
ggtctccttgggccct

SEQ ID NO: 1764645 - DNA, 16 bp, Homo sapiens
ggtctcgatctcctga

SEQ ID NO: 1764646 - DNA, 21 bp, Homo sapiens
ggtctcgcagcctgaagcctg

SEQ ID NO: 1764647 - DNA, 14 bp, Homo sapiens
ggtctctccactgc

SEQ ID NO: 1764648 - DNA, 22 bp, Homo sapiens
ggtctctctccaggtcagcctg

SEQ ID NO: 1764649 - DNA, 23 bp, Homo sapiens
ggtctctctccaggtcagcctgg

SEQ ID NO: 1764650 - DNA, 15 bp, Homo sapiens
ggtctctgaagggac

SEQ ID NO: 1764651 - DNA, 14 bp, Homo sapiens
ggtctctgccccag

SEQ ID NO: 1764652 - DNA, 15 bp, Homo sapiens
ggtctctgccccagc

SEQ ID NO: 1764653 - DNA, 19 bp, Homo sapiens
ggtctctgccccagcctgt

SEQ ID NO: 1764654 - DNA, 20 bp, Homo sapiens
ggtctcttctgaataaagca

SEQ ID NO: 1764655 - DNA, 19 bp, Homo sapiens
ggtctcttctgggcgtctg

SEQ ID NO: 1764656 - DNA, 20 bp, Homo sapiens
ggtctcttcttggggcccag

SEQ ID NO: 1764657 - DNA, 12 bp, Homo sapiens
ggtctgaaatgg

SEQ ID NO: 1764658 - DNA, 22 bp, Homo sapiens
ggtctgaaggaatagccagaga

SEQ ID NO: 1764659 - DNA, 15 bp, Homo sapiens
ggtctgacagtcctt

SEQ ID NO: 1764660 - DNA, 20 bp, Homo sapiens
ggtctgagtctatgttcaaa

SEQ ID NO: 1764661 - DNA, 15 bp, Homo sapiens
ggtctgatattaatc

SEQ ID NO: 1764662 - DNA, 16 bp, Homo sapiens
ggtctgatattaatca

SEQ ID NO: 1764663 - DNA, 14 bp, Homo sapiens
ggtctgattggctg

SEQ ID NO: 1764664 - DNA, 16 bp, Homo sapiens
ggtctgattggctgct

SEQ ID NO: 1764665 - DNA, 17 bp, Homo sapiens
ggtctgcaagggcccag

SEQ ID NO: 1764666 - DNA, 20 bp, Homo sapiens
ggtctgcaagggcccagagt

SEQ ID NO: 1764667 - DNA, 18 bp, Homo sapiens
ggtctgctctttctctgc

SEQ ID NO: 1764668 - DNA, 22 bp, Homo sapiens
ggtctgctctttctctgccagt

SEQ ID NO: 1764669 - DNA, 24 bp, Homo sapiens
ggtctgcttaaagcttccctctca

SEQ ID NO: 1764670 - DNA, 18 bp, Homo sapiens
ggtctggctgagcccctg

SEQ ID NO: 1764671 - DNA, 12 bp, Homo sapiens
ggtctgtctgga

SEQ ID NO: 1764672 - DNA, 16 bp, Homo sapiens
ggtctgtgctgtgcct

SEQ ID NO: 1764673 - DNA, 23 bp, Homo sapiens
ggtctgtgtaacatccaagccag

SEQ ID NO: 1764674 - DNA, 11 bp, Homo sapiens
ggtctgtgtgt

SEQ ID NO: 1764675 - DNA, 17 bp, Homo sapiens
ggtctgttctgtttcaa

SEQ ID NO: 1764676 - DNA, 20 bp, Homo sapiens
ggtctgttggcaggctggcc

SEQ ID NO: 1764677 - DNA, 21 bp, Homo sapiens
ggtctgtttgtctgaacaaag

SEQ ID NO: 1764678 - DNA, 16 bp, Homo sapiens
ggtcttgcagtggctt

SEQ ID NO: 1764679 - DNA, 21 bp, Homo sapiens
ggtcttgggctactggcagct

SEQ ID NO: 1764680 - DNA, 14 bp, Homo sapiens
ggtcttgggttcct

SEQ ID NO: 1764681 - DNA, 17 bp, Homo sapiens
ggtctttttatgcattt

SEQ ID NO: 1764682 - DNA, 21 bp, Homo sapiens
ggtgaaaataagacaaaaata

SEQ ID NO: 1764683 - DNA, 13 bp, Homo sapiens
ggtgaaagggagc

SEQ ID NO: 1764684 - DNA, 15 bp, Homo sapiens
ggtgaacagctggtg

SEQ ID NO: 1764685 - DNA, 17 bp, Homo sapiens
ggtgaactgcaaagctt

SEQ ID NO: 1764686 - DNA, 21 bp, Homo sapiens
ggtgaaggaggtcaggcccca

SEQ ID NO: 1764687 - DNA, 15 bp, Homo sapiens
ggtgaaggatccagg

SEQ ID NO: 1764688 - DNA, 13 bp, Homo sapiens
ggtgaagggaagt

SEQ ID NO: 1764689 - DNA, 20 bp, Homo sapiens
ggtgaagggaagtggggagt

SEQ ID NO: 1764690 - DNA, 19 bp, Homo sapiens
ggtgaattttcaaggcctt

SEQ ID NO: 1764691 - DNA, 17 bp, Homo sapiens
ggtgacacctccccctt

SEQ ID NO: 1764692 - DNA, 14 bp, Homo sapiens
ggtgacagagtgag

SEQ ID NO: 1764693 - DNA, 13 bp, Homo sapiens
ggtgacagtgaga

SEQ ID NO: 1764694 - DNA, 18 bp, Homo sapiens
ggtgacagtgccttctct

SEQ ID NO: 1764695 - DNA, 18 bp, Homo sapiens
ggtgacatcggaaaaata

SEQ ID NO: 1764696 - DNA, 14 bp, Homo sapiens
ggtgaccaggtcct

SEQ ID NO: 1764697 - DNA, 13 bp, Homo sapiens
ggtgacgcccagc

SEQ ID NO: 1764698 - DNA, 16 bp, Homo sapiens
ggtgacgcccagctcc

SEQ ID NO: 1764699 - DNA, 13 bp, Homo sapiens
ggtgactctgtcc

SEQ ID NO: 1764700 - DNA, 13 bp, Homo sapiens
ggtgagaacccag

SEQ ID NO: 1764701 - DNA, 20 bp, Homo sapiens
ggtgagccaaggacagggct

SEQ ID NO: 1764702 - DNA, 12 bp, Homo sapiens
ggtgagccagtg

SEQ ID NO: 1764703 - DNA, 21 bp, Homo sapiens
ggtgagcctagccctgggaca

SEQ ID NO: 1764704 - DNA, 11 bp, Homo sapiens
ggtgagctggg

SEQ ID NO: 1764705 - DNA, 18 bp, Homo sapiens
ggttaatgttgatttaaa

SEQ ID NO: 1764706 - DNA, 17 bp, Homo sapiens
ggttaatttttcctgca

SEQ ID NO: 1764707 - DNA, 15 bp, Homo sapiens
ggttacaaactgcaa

SEQ ID NO: 1764708 - DNA, 22 bp, Homo sapiens
ggttaccactcttttgctgtgc

SEQ ID NO: 1764709 - DNA, 14 bp, Homo sapiens
ggttacgaagacaa

SEQ ID NO: 1764710 - DNA, 13 bp, Homo sapiens
ggttactgagtga

SEQ ID NO: 1764711 - DNA, 15 bp, Homo sapiens
ggttagaaaggcagc

SEQ ID NO: 1764712 - DNA, 21 bp, Homo sapiens
ggttagacgccttccaggtca

SEQ ID NO: 1764713 - DNA, 13 bp, Homo sapiens
ggttagatgttgc

SEQ ID NO: 1764714 - DNA, 20 bp, Homo sapiens
ggttaggagttcgagaccag

SEQ ID NO: 1764715 - DNA, 16 bp, Homo sapiens
ggttaggatttaacag

SEQ ID NO: 1764716 - DNA, 16 bp, Homo sapiens
ggttatctgcctggcc

SEQ ID NO: 1764717 - DNA, 13 bp, Homo sapiens
ggttattggactc

SEQ ID NO: 1764718 - DNA, 12 bp, Homo sapiens
ggttatttaaaa

SEQ ID NO: 1764719 - DNA, 18 bp, Homo sapiens
ggttatttttattaaatg

SEQ ID NO: 1764720 - DNA, 16 bp, Homo sapiens
ggttatttttctcttg

SEQ ID NO: 1764721 - DNA, 23 bp, Homo sapiens
ggttcaacaaagaaacaaagatg

SEQ ID NO: 1764722 - DNA, 17 bp, Homo sapiens
ggttcaagcccaggctt

SEQ ID NO: 1764723 - DNA, 15 bp, Homo sapiens
ggttcaccagcctct

SEQ ID NO: 1764724 - DNA, 18 bp, Homo sapiens
ggttcacctgtgactcct

SEQ ID NO: 1764725 - DNA, 21 bp, Homo sapiens
ggttcacgcctgtaatcccag

SEQ ID NO: 1764726 - DNA, 16 bp, Homo sapiens
ggttcagaaatgctgc

SEQ ID NO: 1764727 - DNA, 16 bp, Homo sapiens
ggttcagagactcagg

SEQ ID NO: 1764728 - DNA, 18 bp, Homo sapiens
ggttcagcccctcctctg

SEQ ID NO: 1764729 - DNA, 12 bp, Homo sapiens
ggttcaggacca

SEQ ID NO: 1764730 - DNA, 22 bp, Homo sapiens
ggttcatcagtgttaaaaaatt

SEQ ID NO: 1764731 - DNA, 14 bp, Homo sapiens
ggttccatgcctga

SEQ ID NO: 1764732 - DNA, 18 bp, Homo sapiens
ggttccatgcctgagggt

SEQ ID NO: 1764733 - DNA, 18 bp, Homo sapiens
ggttccatttttcctctg

SEQ ID NO: 1764734 - DNA, 17 bp, Homo sapiens
ggttcccaataaaagtg

SEQ ID NO: 1764735 - DNA, 20 bp, Homo sapiens
ggttccccaagggccctggc

SEQ ID NO: 1764736 - DNA, 14 bp, Homo sapiens
ggttccccacacag

SEQ ID NO: 1764737 - DNA, 16 bp, Homo sapiens
ggttccccacacaggg

SEQ ID NO: 1764738 - DNA, 17 bp, Homo sapiens
ggttccctttccttcca

SEQ ID NO: 1764739 - DNA, 23 bp, Homo sapiens
ggttccgccaggcgctgcagggc

SEQ ID NO: 1764740 - DNA, 20 bp, Homo sapiens
ggttcctgctgtcctggtgg

SEQ ID NO: 1764741 - DNA, 21 bp, Homo sapiens
ggttcctggttgttcctgcat

SEQ ID NO: 1764742 - DNA, 15 bp, Homo sapiens
ggttccttccctggg

SEQ ID NO: 1764743 - DNA, 22 bp, Homo sapiens
ggttctaaagttctaagattct

SEQ ID NO: 1764744 - DNA, 23 bp, Homo sapiens
ggttctacagccttgtccccctc

SEQ ID NO: 1764745 - DNA, 18 bp, Homo sapiens
ggttctaggcatctctgt

SEQ ID NO: 1764746 - DNA, 14 bp, Homo sapiens
ggttctcagacctc

SEQ ID NO: 1764747 - DNA, 18 bp, Homo sapiens
ggttctcaggtgttgcca

SEQ ID NO: 1764748 - DNA, 13 bp, Homo sapiens
ggttctcatttgg

SEQ ID NO: 1764749 - DNA, 23 bp, Homo sapiens
ggttctcatttggtctgccagaa

SEQ ID NO: 1764750 - DNA, 20 bp, Homo sapiens
ggttctgcagcggcagagca

SEQ ID NO: 1764751 - DNA, 17 bp, Homo sapiens
ggttctgccctgcctga

SEQ ID NO: 1764752 - DNA, 12 bp, Homo sapiens
ggttctggctgc

SEQ ID NO: 1764753 - DNA, 16 bp, Homo sapiens
ggttcttagtgtcact

SEQ ID NO: 1764754 - DNA, 13 bp, Homo sapiens
ggttcttcccctc

SEQ ID NO: 1764755 - DNA, 13 bp, Homo sapiens
ggttgaaagacat

SEQ ID NO: 1764756 - DNA, 17 bp, Homo sapiens
ggttgaaagacatcaat

SEQ ID NO: 1764757 - DNA, 16 bp, Homo sapiens
ggttgaactctggtgg

SEQ ID NO: 1764758 - DNA, 22 bp, Homo sapiens
ggttgaactctggtggcacagg

SEQ ID NO: 1764759 - DNA, 20 bp, Homo sapiens
ggttgaggtgcgctcacctc

SEQ ID NO: 1764760 - DNA, 18 bp, Homo sapiens
ggttgcagtgagccaaga

SEQ ID NO: 1764761 - DNA, 21 bp, Homo sapiens
ggttgcgtcctgacggcgccc

SEQ ID NO: 1764762 - DNA, 11 bp, Homo sapiens
ggttgctgtag

SEQ ID NO: 1764763 - DNA, 15 bp, Homo sapiens
ggttggacagccccc

SEQ ID NO: 1764764 - DNA, 16 bp, Homo sapiens
ggttggacagccccct

SEQ ID NO: 1764765 - DNA, 21 bp, Homo sapiens
ggttggccgtggtccagctct

SEQ ID NO: 1764766 - DNA, 23 bp, Homo sapiens
ggttggccgtggtccagctcttg

SEQ ID NO: 1764767 - DNA, 13 bp, Homo sapiens
ggttggctcccgc

SEQ ID NO: 1764768 - DNA, 19 bp, Homo sapiens
ggttgggagaatgtcagta

SEQ ID NO: 1764769 - DNA, 15 bp, Homo sapiens
ggttgggggctcctg

SEQ ID NO: 1764770 - DNA, 13 bp, Homo sapiens
ggttggtagggtg

SEQ ID NO: 1764771 - DNA, 15 bp, Homo sapiens
ggttggttttatttg

SEQ ID NO: 1764772 - DNA, 20 bp, Homo sapiens
ggttgtaaatgctcgtgtga

SEQ ID NO: 1764773 - DNA, 13 bp, Homo sapiens
ggttgtgcagggt

SEQ ID NO: 1764774 - DNA, 21 bp, Homo sapiens
ggttgttgcaccatctgcttg

SEQ ID NO: 1764775 - DNA, 14 bp, Homo sapiens
ggttgttgccaggt

SEQ ID NO: 1764776 - DNA, 21 bp, Homo sapiens
ggttgttgccaggttgcagct

SEQ ID NO: 1764777 - DNA, 16 bp, Homo sapiens
ggttgtttagaaacag

SEQ ID NO: 1764778 - DNA, 17 bp, Homo sapiens
ggttgtttttgttcttt

SEQ ID NO: 1764779 - DNA, 20 bp, Homo sapiens
ggttgttttttcctttgctc

SEQ ID NO: 1764780 - DNA, 18 bp, Homo sapiens
ggtttactcactgctgca

SEQ ID NO: 1764781 - DNA, 19 bp, Homo sapiens
ggtttactgtgaagagaat

SEQ ID NO: 1764782 - DNA, 14 bp, Homo sapiens
ggtttatgactctt

SEQ ID NO: 1764783 - DNA, 20 bp, Homo sapiens
ggtttatgtagtcagttgca

SEQ ID NO: 1764784 - DNA, 19 bp, Homo sapiens
ggtttcagatgtgcaataa

SEQ ID NO: 1764785 - DNA, 19 bp, Homo sapiens
ggtttccccagggaaggaa

SEQ ID NO: 1764786 - DNA, 21 bp, Homo sapiens
ggtttctcgcataggaccttt

SEQ ID NO: 1764787 - DNA, 12 bp, Homo sapiens
ggtttctctgtg

SEQ ID NO: 1764788 - DNA, 19 bp, Homo sapiens
ggtttgaaagatgcagtgg

SEQ ID NO: 1764789 - DNA, 13 bp, Homo sapiens
ggtttgacaattt

SEQ ID NO: 1764790 - DNA, 16 bp, Homo sapiens
ggtttgacaattttgt

SEQ ID NO: 1764791 - DNA, 21 bp, Homo sapiens
ggtttgccaaaattcatttct

SEQ ID NO: 1764792 - DNA, 13 bp, Homo sapiens
ggtttgccagtga

SEQ ID NO: 1764793 - DNA, 23 bp, Homo sapiens
ggtttgcgggggtctgagtctat

SEQ ID NO: 1764794 - DNA, 16 bp, Homo sapiens
ggtttggaatattaaa

SEQ ID NO: 1764795 - DNA, 13 bp, Homo sapiens
ggtttgtatgaga

SEQ ID NO: 1764796 - DNA, 19 bp, Homo sapiens
ggtttgtgtttgattggct

SEQ ID NO: 1764797 - DNA, 21 bp, Homo sapiens
ggtttgtgtttgattggcttt

SEQ ID NO: 1764798 - DNA, 22 bp, Homo sapiens
ggtttgtttagaagaagtgtgt

SEQ ID NO: 1764799 - DNA, 18 bp, Homo sapiens
ggttttagacccatagca

SEQ ID NO: 1764800 - DNA, 23 bp, Homo sapiens
ggttttataaaccacttgagcct

SEQ ID NO: 1764801 - DNA, 16 bp, Homo sapiens
ggttttatactgaagg

SEQ ID NO: 1764802 - DNA, 18 bp, Homo sapiens
ggttttcccctccctggg

SEQ ID NO: 1764803 - DNA, 22 bp, Homo sapiens
ggttttctggtggggctgtcct

SEQ ID NO: 1764804 - DNA, 15 bp, Homo sapiens
ggttttctgttactt

SEQ ID NO: 1764805 - DNA, 17 bp, Homo sapiens
ggttttgcaataacttc

SEQ ID NO: 1764806 - DNA, 15 bp, Homo sapiens
ggttttggagtcagt

SEQ ID NO: 1764807 - DNA, 17 bp, Homo sapiens
ggttttggagtcagtag

SEQ ID NO: 1764808 - DNA, 20 bp, Homo sapiens
ggttttgtaagatgctgggt

SEQ ID NO: 1764809 - DNA, 17 bp, Homo sapiens
ggttttgtgccatctgt

SEQ ID NO: 1764810 - DNA, 19 bp, Homo sapiens
ggtttttaaaaaatgtttt

SEQ ID NO: 1764811 - DNA, 19 bp, Homo sapiens
ggtttttactgctctgaga

SEQ ID NO: 1764812 - DNA, 20 bp, Homo sapiens
ggtttttactgctctgagaa

SEQ ID NO: 1764813 - DNA, 12 bp, Homo sapiens
ggtttttagaga

SEQ ID NO: 1764814 - DNA, 22 bp, Homo sapiens
ggtttttagagaatgtgtttca

SEQ ID NO: 1764815 - DNA, 12 bp, Homo sapiens
ggtttttccctg

SEQ ID NO: 1764816 - DNA, 14 bp, Homo sapiens
ggttttttagttga

SEQ ID NO: 1764817 - DNA, 20 bp, Homo sapiens
ggtttttttctttggctgca

SEQ ID NO: 1764818 - DNA, 22 bp, Homo sapiens
ggtttttttctttggctgcagg

SEQ ID NO: 1764819 - DNA, 15 bp, Homo sapiens
gtaaaaaatggaaaa

SEQ ID NO: 1764820 - DNA, 12 bp, Homo sapiens
gtaatttaactt

SEQ ID NO: 1764821 - DNA, 16 bp, Homo sapiens
gtaatttaagtgacac

SEQ ID NO: 1764822 - DNA, 17 bp, Homo sapiens
gtaatttatattccatt

SEQ ID NO: 1764823 - DNA, 18 bp, Homo sapiens
gtaatttatattccattt

SEQ ID NO: 1764824 - DNA, 22 bp, Homo sapiens
gtaatttatattccatttacat

SEQ ID NO: 1764825 - DNA, 11 bp, Homo sapiens
gtaatttatgc

SEQ ID NO: 1764826 - DNA, 15 bp, Homo sapiens
gtaatttattgtctg

SEQ ID NO: 1764827 - DNA, 11 bp, Homo sapiens
gtaatttattt

SEQ ID NO: 1764828 - DNA, 15 bp, Homo sapiens
gtaatttcgccttaa

SEQ ID NO: 1764829 - DNA, 16 bp, Homo sapiens
gtaatttgaggacaac

SEQ ID NO: 1764830 - DNA, 15 bp, Homo sapiens
gtaatttgtaaaatg

SEQ ID NO: 1764831 - DNA, 13 bp, Homo sapiens
gtaatttttgctc

SEQ ID NO: 1764832 - DNA, 23 bp, Homo sapiens
gtaatttttgctccaatatccat

SEQ ID NO: 1764833 - DNA, 14 bp, Homo sapiens
gtaatttttgtaca

SEQ ID NO: 1764834 - DNA, 15 bp, Homo sapiens
gtaatttttgtacat

SEQ ID NO: 1764835 - DNA, 12 bp, Homo sapiens
gtacaaaataaa

SEQ ID NO: 1764836 - DNA, 14 bp, Homo sapiens
gtacaaaataaaca

SEQ ID NO: 1764837 - DNA, 12 bp, Homo sapiens
gtacaaaattaa

SEQ ID NO: 1764838 - DNA, 14 bp, Homo sapiens
gtacaaaattaagc

SEQ ID NO: 1764839 - DNA, 15 bp, Homo sapiens
gtacaaacagtattt

SEQ ID NO: 1764840 - DNA, 20 bp, Homo sapiens
gtacaaacagtatttctggt

SEQ ID NO: 1764841 - DNA, 13 bp, Homo sapiens
gtacaaataaacc

SEQ ID NO: 1764842 - DNA, 14 bp, Homo sapiens
gtacaacggaggcc

SEQ ID NO: 1764843 - DNA, 15 bp, Homo sapiens
gtacaacggaggcct

SEQ ID NO: 1764844 - DNA, 15 bp, Homo sapiens
gtacaagatctcagg

SEQ ID NO: 1764845 - DNA, 15 bp, Homo sapiens
gtacaaggtaattgt

SEQ ID NO: 1764846 - DNA, 22 bp, Homo sapiens
gtacaataagtgtttttgtatt

SEQ ID NO: 1764847 - DNA, 20 bp, Homo sapiens
gtacaataatctctatttga

SEQ ID NO: 1764848 - DNA, 15 bp, Homo sapiens
gtacaataatgtact

SEQ ID NO: 1764849 - DNA, 19 bp, Homo sapiens
gtacaataatgtactcaca

SEQ ID NO: 1764850 - DNA, 14 bp, Homo sapiens
gtacaatacaatgt

SEQ ID NO: 1764851 - DNA, 14 bp, Homo sapiens
gtacaatggtttat

SEQ ID NO: 1764852 - DNA, 17 bp, Homo sapiens
gtacaatggtttattcc

SEQ ID NO: 1764853 - DNA, 23 bp, Homo sapiens
gtacaatggtttattcccaagta

SEQ ID NO: 1764854 - DNA, 14 bp, Homo sapiens
gtacaattatgtct

SEQ ID NO: 1764855 - DNA, 13 bp, Homo sapiens
gtacaattttaaa

SEQ ID NO: 1764856 - DNA, 23 bp, Homo sapiens
gtacacacaaaaaccttggcata

SEQ ID NO: 1764857 - DNA, 12 bp, Homo sapiens
gtacacaccaga

SEQ ID NO: 1764858 - DNA, 20 bp, Homo sapiens
gtacacccaattttaaaaaa

SEQ ID NO: 1764859 - DNA, 14 bp, Homo sapiens
gtacacgtgtcctg

SEQ ID NO: 1764860 - DNA, 23 bp, Homo sapiens
gtacactaccaaacactcagtcc

SEQ ID NO: 1764861 - DNA, 16 bp, Homo sapiens
gtacactgacttgaga

SEQ ID NO: 1764862 - DNA, 13 bp, Homo sapiens
gtacagaaagctg

SEQ ID NO: 1764863 - DNA, 15 bp, Homo sapiens
gtacagaatttgaat

SEQ ID NO: 1764864 - DNA, 12 bp, Homo sapiens
gtacagactgtt

SEQ ID NO: 1764865 - DNA, 19 bp, Homo sapiens
gtacagatgaatgataaac

SEQ ID NO: 1764866 - DNA, 14 bp, Homo sapiens
gtacaggagaggca

SEQ ID NO: 1764867 - DNA, 16 bp, Homo sapiens
gtacaggagaggcagc

SEQ ID NO: 1764868 - DNA, 20 bp, Homo sapiens
gtacaggtcacccatcagga

SEQ ID NO: 1764869 - DNA, 15 bp, Homo sapiens
gtacagtaccttgtt

SEQ ID NO: 1764870 - DNA, 14 bp, Homo sapiens
gtacagtctgtcat

SEQ ID NO: 1764871 - DNA, 17 bp, Homo sapiens
gtacagtgaattgtctt

SEQ ID NO: 1764872 - DNA, 18 bp, Homo sapiens
gtacagtgaattgtcttt

SEQ ID NO: 1764873 - DNA, 19 bp, Homo sapiens
gtacagtgaattgtctttt

SEQ ID NO: 1764874 - DNA, 16 bp, Homo sapiens
gtacataaaagaattt

SEQ ID NO: 1764875 - DNA, 19 bp, Homo sapiens
gtacataccctggccgccc

SEQ ID NO: 1764876 - DNA, 22 bp, Homo sapiens
gtacataccctggccgccccct

SEQ ID NO: 1764877 - DNA, 17 bp, Homo sapiens
gtacatacgatttaagg

SEQ ID NO: 1764878 - DNA, 14 bp, Homo sapiens
gtacatctggcctt

SEQ ID NO: 1764879 - DNA, 16 bp, Homo sapiens
gtacatggcagagttt

SEQ ID NO: 1764880 - DNA, 20 bp, Homo sapiens
gtacatgtgtagcctgtgca

SEQ ID NO: 1764881 - DNA, 18 bp, Homo sapiens
gtacatgttcgggtgtgg

SEQ ID NO: 1764882 - DNA, 21 bp, Homo sapiens
gtacatgttcgggtgtgggtt

SEQ ID NO: 1764883 - DNA, 18 bp, Homo sapiens
gtacattcaatgtttatg

SEQ ID NO: 1764884 - DNA, 21 bp, Homo sapiens
gtacattctgcctagagtgta

SEQ ID NO: 1764885 - DNA, 22 bp, Homo sapiens
gtacattcttccatcatcactg

SEQ ID NO: 1764886 - DNA, 23 bp, Homo sapiens
gtacattcttccatcatcactgt

SEQ ID NO: 1764887 - DNA, 14 bp, Homo sapiens
gtacattgtgagct

SEQ ID NO: 1764888 - DNA, 18 bp, Homo sapiens
gtacattgtgagctctgg

SEQ ID NO: 1764889 - DNA, 14 bp, Homo sapiens
gtacatttaaattt

SEQ ID NO: 1764890 - DNA, 18 bp, Homo sapiens
gtacatttcaccatggcc

SEQ ID NO: 1764891 - DNA, 18 bp, Homo sapiens
gtacatttctaagtcaaa

SEQ ID NO: 1764892 - DNA, 17 bp, Homo sapiens
gtacatttctctgagca

SEQ ID NO: 1764893 - DNA, 15 bp, Homo sapiens
gtacatttggagaca

SEQ ID NO: 1764894 - DNA, 19 bp, Homo sapiens
gtacattttttgaaatgct

SEQ ID NO: 1764895 - DNA, 17 bp, Homo sapiens
gtaccaaacaaggaagc

SEQ ID NO: 1764896 - DNA, 21 bp, Homo sapiens
gtaccaaacaaggaagccaaa

SEQ ID NO: 1764897 - DNA, 16 bp, Homo sapiens
gtaccactacttagag

SEQ ID NO: 1764898 - DNA, 23 bp, Homo sapiens
gtaccactacttagagatatgta

SEQ ID NO: 1764899 - DNA, 17 bp, Homo sapiens
gtaccagctgcgcttgc

SEQ ID NO: 1764900 - DNA, 11 bp, Homo sapiens
gtaccagttaa

SEQ ID NO: 1764901 - DNA, 14 bp, Homo sapiens
gtaccatagaaaaa

SEQ ID NO: 1764902 - DNA, 14 bp, Homo sapiens
gtaccatgaatatt

SEQ ID NO: 1764903 - DNA, 18 bp, Homo sapiens
gtacccagccatctgccc

SEQ ID NO: 1764904 - DNA, 13 bp, Homo sapiens
gtacccagctcct

SEQ ID NO: 1764905 - DNA, 24 bp, Homo sapiens
gtacccagctccttttgtccccag

SEQ ID NO: 1764906 - DNA, 22 bp, Homo sapiens
gtacccaggctttagcattatt

SEQ ID NO: 1764907 - DNA, 17 bp, Homo sapiens
gtacccatctagtactt

SEQ ID NO: 1764908 - DNA, 14 bp, Homo sapiens
gtaccccaccctca

SEQ ID NO: 1764909 - DNA, 22 bp, Homo sapiens
gtaccccaccctcagcacccct

SEQ ID NO: 1764910 - DNA, 22 bp, Homo sapiens
gtaccccactgggccagccctg

SEQ ID NO: 1764911 - DNA, 20 bp, Homo sapiens
gtaccccagcctcgttggag

SEQ ID NO: 1764912 - DNA, 22 bp, Homo sapiens
gtaccccctcaaaccctgccct

SEQ ID NO: 1764913 - DNA, 22 bp, Homo sapiens
gtacccctaaaatcccaccaga

SEQ ID NO: 1764914 - DNA, 15 bp, Homo sapiens
gtaccctctggaggg

SEQ ID NO: 1764915 - DNA, 22 bp, Homo sapiens
gtaccgcccggcagccccttct

SEQ ID NO: 1764916 - DNA, 16 bp, Homo sapiens
gtacctagctgtaatg

SEQ ID NO: 1764917 - DNA, 19 bp, Homo sapiens
gtacctcaagccccatttc

SEQ ID NO: 1764918 - DNA, 13 bp, Homo sapiens
gtacctcctctca

SEQ ID NO: 1764919 - DNA, 16 bp, Homo sapiens
gtacctcctctcagtg

SEQ ID NO: 1764920 - DNA, 13 bp, Homo sapiens
gtacctcgggtgg

SEQ ID NO: 1764921 - DNA, 13 bp, Homo sapiens
gtacctctagaat

SEQ ID NO: 1764922 - DNA, 16 bp, Homo sapiens
gtacctgcaaaaatga

SEQ ID NO: 1764923 - DNA, 15 bp, Homo sapiens
gtacctgcaagcaga

SEQ ID NO: 1764924 - DNA, 18 bp, Homo sapiens
gtacctgcaagcagaact

SEQ ID NO: 1764925 - DNA, 22 bp, Homo sapiens
gtacctgggaaaggacccaccc

SEQ ID NO: 1764926 - DNA, 18 bp, Homo sapiens
gtaccttgaacactgggg

SEQ ID NO: 1764927 - DNA, 11 bp, Homo sapiens
gtaccttgctt

SEQ ID NO: 1764928 - DNA, 13 bp, Homo sapiens
gtaccttgcttct

SEQ ID NO: 1764929 - DNA, 21 bp, Homo sapiens
gtaccttttgaggagccccag

SEQ ID NO: 1764930 - DNA, 23 bp, Homo sapiens
gtaccttttgaggagccccagct

SEQ ID NO: 1764931 - DNA, 23 bp, Homo sapiens
gtacgaacctacagttttaactg

SEQ ID NO: 1764932 - DNA, 15 bp, Homo sapiens
gtacgatgacagtgt

SEQ ID NO: 1764933 - DNA, 14 bp, Homo sapiens
gtacgattatactt

SEQ ID NO: 1764934 - DNA, 13 bp, Homo sapiens
gtacgcccaggac

SEQ ID NO: 1764935 - DNA, 14 bp, Homo sapiens
gtacgcccaggaca

SEQ ID NO: 1764936 - DNA, 18 bp, Homo sapiens
gtagccaaggtgggctga

SEQ ID NO: 1764937 - DNA, 22 bp, Homo sapiens
gtagccactggcatagccctcc

SEQ ID NO: 1764938 - DNA, 14 bp, Homo sapiens
gtagccagctgtgc

SEQ ID NO: 1764939 - DNA, 22 bp, Homo sapiens
gtagccaggtactgcattctct

SEQ ID NO: 1764940 - DNA, 23 bp, Homo sapiens
gtagccatcccatgaacacactg

SEQ ID NO: 1764941 - DNA, 22 bp, Homo sapiens
gtagccatggctcaggcaagcc

SEQ ID NO: 1764942 - DNA, 17 bp, Homo sapiens
gtagcccagcactgtga

SEQ ID NO: 1764943 - DNA, 16 bp, Homo sapiens
gtagccccctggcctc

SEQ ID NO: 1764944 - DNA, 18 bp, Homo sapiens
gtagccccttttctttgg

SEQ ID NO: 1764945 - DNA, 13 bp, Homo sapiens
gtagccgccctga

SEQ ID NO: 1764946 - DNA, 16 bp, Homo sapiens
gtagccgccctgagag

SEQ ID NO: 1764947 - DNA, 14 bp, Homo sapiens
gtagcctaaagggc

SEQ ID NO: 1764948 - DNA, 15 bp, Homo sapiens
gtagcctaaagggca

SEQ ID NO: 1764949 - DNA, 17 bp, Homo sapiens
gtagcctaaagggcagg

SEQ ID NO: 1764950 - DNA, 14 bp, Homo sapiens
gtagccttcctcca

SEQ ID NO: 1764951 - DNA, 15 bp, Homo sapiens
gtagccttgcccgga

SEQ ID NO: 1764952 - DNA, 23 bp, Homo sapiens
gtagccttgcccggattctggga

SEQ ID NO: 1764953 - DNA, 11 bp, Homo sapiens
gtagccttttt

SEQ ID NO: 1764954 - DNA, 18 bp, Homo sapiens
gtagcctttttgtataaa

SEQ ID NO: 1764955 - DNA, 19 bp, Homo sapiens
gtagcgaactgcactgctg

SEQ ID NO: 1764956 - DNA, 21 bp, Homo sapiens
gtagcggaaaagttgtcttaa

SEQ ID NO: 1764957 - DNA, 21 bp, Homo sapiens
gtagctagaatatcctatact

SEQ ID NO: 1764958 - DNA, 21 bp, Homo sapiens
gtagctagtagcaatgtgcct

SEQ ID NO: 1764959 - DNA, 10 bp, Homo sapiens
gtagctcagt

SEQ ID NO: 1764960 - DNA, 18 bp, Homo sapiens
gtagctccctcctcccat

SEQ ID NO: 1764961 - DNA, 20 bp, Homo sapiens
gtagctccctcctcccatct

SEQ ID NO: 1764962 - DNA, 22 bp, Homo sapiens
gtagctctaggagggctggcaa

SEQ ID NO: 1764963 - DNA, 16 bp, Homo sapiens
gtagctgaacctgtct

SEQ ID NO: 1764964 - DNA, 18 bp, Homo sapiens
gtagctggcgcccatcct

SEQ ID NO: 1764965 - DNA, 21 bp, Homo sapiens
gtagctgggactacaggcgcc

SEQ ID NO: 1764966 - DNA, 18 bp, Homo sapiens
gtagctgggatgacaggc

SEQ ID NO: 1764967 - DNA, 12 bp, Homo sapiens
gtagctgtcctc

SEQ ID NO: 1764968 - DNA, 18 bp, Homo sapiens
gtagctgtggtgaggtgg

SEQ ID NO: 1764969 - DNA, 14 bp, Homo sapiens
gtagctttcctggt

SEQ ID NO: 1764970 - DNA, 23 bp, Homo sapiens
gtaggaaagtcacccaaacactt

SEQ ID NO: 1764971 - DNA, 21 bp, Homo sapiens
gtaggaacggtaaatttctgt

SEQ ID NO: 1764972 - DNA, 12 bp, Homo sapiens
gtaggaatcctt

SEQ ID NO: 1764973 - DNA, 21 bp, Homo sapiens
gtaggaatcctttgagaatgt

SEQ ID NO: 1764974 - DNA, 20 bp, Homo sapiens
gtaggagcactggggtgggg

SEQ ID NO: 1764975 - DNA, 22 bp, Homo sapiens
gtaggagctgccttggctcaga

SEQ ID NO: 1764976 - DNA, 15 bp, Homo sapiens
gtaggagttctattt

SEQ ID NO: 1764977 - DNA, 15 bp, Homo sapiens
gtaggatgaaaagat

SEQ ID NO: 1764978 - DNA, 17 bp, Homo sapiens
gtaggattcaagtctgc

SEQ ID NO: 1764979 - DNA, 16 bp, Homo sapiens
gtaggcagccacggcc

SEQ ID NO: 1764980 - DNA, 17 bp, Homo sapiens
gtaggcccttgtcctgc

SEQ ID NO: 1764981 - DNA, 19 bp, Homo sapiens
gtaggctgtattttctttt

SEQ ID NO: 1764982 - DNA, 16 bp, Homo sapiens
gtagggaaaccttgga

SEQ ID NO: 1764983 - DNA, 17 bp, Homo sapiens
gtagggaaaccttggag

SEQ ID NO: 1764984 - DNA, 15 bp, Homo sapiens
gtagggaggtcagtg

SEQ ID NO: 1764985 - DNA, 23 bp, Homo sapiens
gtagggatgcggatcctgctggg

SEQ ID NO: 1764986 - DNA, 12 bp, Homo sapiens
gtagggctgact

SEQ ID NO: 1764987 - DNA, 22 bp, Homo sapiens
gtaggggagggcaggcttgggg

SEQ ID NO: 1764988 - DNA, 14 bp, Homo sapiens
gtaggggcagggag

SEQ ID NO: 1764989 - DNA, 16 bp, Homo sapiens
gtaggggccgtgtccc

SEQ ID NO: 1764990 - DNA, 13 bp, Homo sapiens
gtaggtaaatcta

SEQ ID NO: 1764991 - DNA, 15 bp, Homo sapiens
gtaggtccaagggcc

SEQ ID NO: 1764992 - DNA, 20 bp, Homo sapiens
gtaggtcccggccagctctg

SEQ ID NO: 1764993 - DNA, 21 bp, Homo sapiens
gtaggtcccggccagctctgg

SEQ ID NO: 1764994 - DNA, 18 bp, Homo sapiens
gtaggtggcttgagctag

SEQ ID NO: 1764995 - DNA, 20 bp, Homo sapiens
gtaggtgtctgccttcacaa

SEQ ID NO: 1764996 - DNA, 15 bp, Homo sapiens
gtaggttcagccaag

SEQ ID NO: 1764997 - DNA, 14 bp, Homo sapiens
gtaggttgtctaaa

SEQ ID NO: 1764998 - DNA, 13 bp, Homo sapiens
gtagtaaaagtgg

SEQ ID NO: 1764999 - DNA, 13 bp, Homo sapiens
gtagtaacactaa

SEQ ID NO: 1765000 - DNA, 15 bp, Homo sapiens
gtagtaacactaata

SEQ ID NO: 1765001 - DNA, 22 bp, Homo sapiens
gtagtactcctgcaaaatttta

SEQ ID NO: 1765002 - DNA, 18 bp, Homo sapiens
gtagtataatttcaagga

SEQ ID NO: 1765003 - DNA, 20 bp, Homo sapiens
gtagtatctcgtaatagctt

SEQ ID NO: 1765004 - DNA, 23 bp, Homo sapiens
gtagtcccagctacttgggaggc

SEQ ID NO: 1765005 - DNA, 19 bp, Homo sapiens
gtagtctttttataggttt

SEQ ID NO: 1765006 - DNA, 17 bp, Homo sapiens
gtagtggaagagcagcc

SEQ ID NO: 1765007 - DNA, 21 bp, Homo sapiens
gtagtggaagagcagcctgat

SEQ ID NO: 1765008 - DNA, 18 bp, Homo sapiens
gtagtggccccctcctcc

SEQ ID NO: 1765009 - DNA, 15 bp, Homo sapiens
gtagtgtagctgtgt

SEQ ID NO: 1765010 - DNA, 16 bp, Homo sapiens
gtagtgtcatcactct

SEQ ID NO: 1765011 - DNA, 13 bp, Homo sapiens
gtagttaaataac

SEQ ID NO: 1765012 - DNA, 23 bp, Homo sapiens
gtagttccctgaaaacccagaga

SEQ ID NO: 1765013 - DNA, 13 bp, Homo sapiens
gtagttctaagac

SEQ ID NO: 1765014 - DNA, 17 bp, Homo sapiens
gtagttctgtgcctccc

SEQ ID NO: 1765015 - DNA, 21 bp, Homo sapiens
gtagttgagttggaacaacat

SEQ ID NO: 1765016 - DNA, 11 bp, Homo sapiens
gtagttgcagc

SEQ ID NO: 1765017 - DNA, 12 bp, Homo sapiens
gtagttgtcttt

SEQ ID NO: 1765018 - DNA, 18 bp, Homo sapiens
gtagtttatgatgcaaat

SEQ ID NO: 1765019 - DNA, 21 bp, Homo sapiens
gtagtttatggcagaagggaa

SEQ ID NO: 1765020 - DNA, 19 bp, Homo sapiens
gtagtttttcagctagttt

SEQ ID NO: 1765021 - DNA, 16 bp, Homo sapiens
gtataaaaataaaaaa

SEQ ID NO: 1765022 - DNA, 23 bp, Homo sapiens
gtataaaaataaaaaagatccca

SEQ ID NO: 1765023 - DNA, 19 bp, Homo sapiens
gtataaaaattatcaaaaa

SEQ ID NO: 1765024 - DNA, 14 bp, Homo sapiens
gtataaaatacata

SEQ ID NO: 1765025 - DNA, 18 bp, Homo sapiens
gtataaaatacatagtga

SEQ ID NO: 1765026 - DNA, 13 bp, Homo sapiens
gtataaaatctga

SEQ ID NO: 1765027 - DNA, 17 bp, Homo sapiens
gtataaaatctgaattt

SEQ ID NO: 1765028 - DNA, 22 bp, Homo sapiens
gtataaaatctgaattttgcaa

SEQ ID NO: 1765029 - DNA, 13 bp, Homo sapiens
gtataaagattgt

SEQ ID NO: 1765030 - DNA, 16 bp, Homo sapiens
gtataaagctcagaag

SEQ ID NO: 1765031 - DNA, 14 bp, Homo sapiens
gtataaataataaa

SEQ ID NO: 1765032 - DNA, 19 bp, Homo sapiens
gtataaataataaagaact

SEQ ID NO: 1765033 - DNA, 20 bp, Homo sapiens
gtataacaactatttacata

SEQ ID NO: 1765034 - DNA, 19 bp, Homo sapiens
gtataacaagccaaacatt

SEQ ID NO: 1765035 - DNA, 20 bp, Homo sapiens
gtataacaagccaaacattc

SEQ ID NO: 1765036 - DNA, 22 bp, Homo sapiens
gtataacaagccaaacattctt

SEQ ID NO: 1765037 - DNA, 20 bp, Homo sapiens
gtataacacaatatgaatac

SEQ ID NO: 1765038 - DNA, 18 bp, Homo sapiens
gtataagatcctagatcc

SEQ ID NO: 1765039 - DNA, 14 bp, Homo sapiens
gtataagtcaagca

SEQ ID NO: 1765040 - DNA, 12 bp, Homo sapiens
gtataagttatt

SEQ ID NO: 1765041 - DNA, 14 bp, Homo sapiens
gtataataaaatta

SEQ ID NO: 1765042 - DNA, 13 bp, Homo sapiens
gtataatattgaa

SEQ ID NO: 1765043 - DNA, 15 bp, Homo sapiens
gtataatattgaaaa

SEQ ID NO: 1765044 - DNA, 13 bp, Homo sapiens
gtataatgtttat

SEQ ID NO: 1765045 - DNA, 20 bp, Homo sapiens
gtataattggatttcctaat

SEQ ID NO: 1765046 - DNA, 12 bp, Homo sapiens
gtataattgtgt

SEQ ID NO: 1765047 - DNA, 21 bp, Homo sapiens
gtataattgtgtgatatttca

SEQ ID NO: 1765048 - DNA, 12 bp, Homo sapiens
gtatacatgcca

SEQ ID NO: 1765049 - DNA, 21 bp, Homo sapiens
gtatacattttgttatagaat

SEQ ID NO: 1765050 - DNA, 15 bp, Homo sapiens
gtatacctcctatat

SEQ ID NO: 1765051 - DNA, 17 bp, Homo sapiens
gtcaacttcaacattta

SEQ ID NO: 1765052 - DNA, 18 bp, Homo sapiens
gtcaagaaacagccagca

SEQ ID NO: 1765053 - DNA, 15 bp, Homo sapiens
gtcaagaagaaaaag

SEQ ID NO: 1765054 - DNA, 20 bp, Homo sapiens
gtcaagacagggaaggatga

SEQ ID NO: 1765055 - DNA, 13 bp, Homo sapiens
gtcaagacatttg

SEQ ID NO: 1765056 - DNA, 14 bp, Homo sapiens
gtcaagacatttgc

SEQ ID NO: 1765057 - DNA, 16 bp, Homo sapiens
gtcaagagcatgcaca

SEQ ID NO: 1765058 - DNA, 14 bp, Homo sapiens
gtcaagcacatgta

SEQ ID NO: 1765059 - DNA, 23 bp, Homo sapiens
gtcaagcacatgtaataaattca

SEQ ID NO: 1765060 - DNA, 13 bp, Homo sapiens
gtcaagcccagaa

SEQ ID NO: 1765061 - DNA, 14 bp, Homo sapiens
gtcaagctgctctg

SEQ ID NO: 1765062 - DNA, 17 bp, Homo sapiens
gtcaagctgctctgagc

SEQ ID NO: 1765063 - DNA, 18 bp, Homo sapiens
gtcaagctgctctgagcc

SEQ ID NO: 1765064 - DNA, 22 bp, Homo sapiens
gtcaagctgctctgagccacag

SEQ ID NO: 1765065 - DNA, 23 bp, Homo sapiens
gtcaagctgctctgagccacagt

SEQ ID NO: 1765066 - DNA, 14 bp, Homo sapiens
gtcaagtaagaaga

SEQ ID NO: 1765067 - DNA, 17 bp, Homo sapiens
gtcaagtctctgctggc

SEQ ID NO: 1765068 - DNA, 21 bp, Homo sapiens
gtcaagtctctgctggcccag

SEQ ID NO: 1765069 - DNA, 12 bp, Homo sapiens
gtcaagttccca

SEQ ID NO: 1765070 - DNA, 16 bp, Homo sapiens
gtcaagttcccaactg

SEQ ID NO: 1765071 - DNA, 17 bp, Homo sapiens
gtcaataaacaacagct

SEQ ID NO: 1765072 - DNA, 21 bp, Homo sapiens
gtcaataaacttagaggaaaa

SEQ ID NO: 1765073 - DNA, 21 bp, Homo sapiens
gtcaataacactgtattttaa

SEQ ID NO: 1765074 - DNA, 22 bp, Homo sapiens
gtcaatattaaatacagacact

SEQ ID NO: 1765075 - DNA, 22 bp, Homo sapiens
gtcaatcccctcattcaggaaa

SEQ ID NO: 1765076 - DNA, 18 bp, Homo sapiens
gtcaattcataaaaacaa

SEQ ID NO: 1765077 - DNA, 17 bp, Homo sapiens
gtcaatttctgtgttgc

SEQ ID NO: 1765078 - DNA, 13 bp, Homo sapiens
gtcacaaattgat

SEQ ID NO: 1765079 - DNA, 17 bp, Homo sapiens
gtcacaagagcccagca

SEQ ID NO: 1765080 - DNA, 18 bp, Homo sapiens
gtcacacgcttttgaatt

SEQ ID NO: 1765081 - DNA, 16 bp, Homo sapiens
gtcacactgtggccag

SEQ ID NO: 1765082 - DNA, 17 bp, Homo sapiens
gtcacagcatggaggag

SEQ ID NO: 1765083 - DNA, 17 bp, Homo sapiens
gtcacagctgcagctgg

SEQ ID NO: 1765084 - DNA, 21 bp, Homo sapiens
gtcacagctgcagctgggccc

SEQ ID NO: 1765085 - DNA, 17 bp, Homo sapiens
gtcacaggaagaaagca

SEQ ID NO: 1765086 - DNA, 18 bp, Homo sapiens
gtcacagggcctggggag

SEQ ID NO: 1765087 - DNA, 14 bp, Homo sapiens
gtcacataaaactt

SEQ ID NO: 1765088 - DNA, 15 bp, Homo sapiens
gtcacataaatggat

SEQ ID NO: 1765089 - DNA, 16 bp, Homo sapiens
gtcacatcagtgagga

SEQ ID NO: 1765090 - DNA, 17 bp, Homo sapiens
gtcacatcagtgaggag

SEQ ID NO: 1765091 - DNA, 19 bp, Homo sapiens
gtcacatcagtgaggaggg

SEQ ID NO: 1765092 - DNA, 23 bp, Homo sapiens
gtcacatcagtgaggagggatgt

SEQ ID NO: 1765093 - DNA, 15 bp, Homo sapiens
gtcacatccatccct

SEQ ID NO: 1765094 - DNA, 20 bp, Homo sapiens
gtcacatggggcctggccca

SEQ ID NO: 1765095 - DNA, 20 bp, Homo sapiens
gtcacattgatgtaaggact

SEQ ID NO: 1765096 - DNA, 14 bp, Homo sapiens
gtcaccaaatttgt

SEQ ID NO: 1765097 - DNA, 13 bp, Homo sapiens
gtcaccaaggaaa

SEQ ID NO: 1765098 - DNA, 16 bp, Homo sapiens
gtcaccaccttcccag

SEQ ID NO: 1765099 - DNA, 17 bp, Homo sapiens
gtcaccacgactggcca

SEQ ID NO: 1765100 - DNA, 17 bp, Homo sapiens
gtcaccacgtgcagtat

SEQ ID NO: 1765101 - DNA, 13 bp, Homo sapiens
gtcaccagctgct

SEQ ID NO: 1765102 - DNA, 17 bp, Homo sapiens
gtcaccagctgctgtgc

SEQ ID NO: 1765103 - DNA, 23 bp, Homo sapiens
gtcaccaggaatgttaaagtcag

SEQ ID NO: 1765104 - DNA, 13 bp, Homo sapiens
gtcaccaggggag

SEQ ID NO: 1765105 - DNA, 17 bp, Homo sapiens
gtcaccaggggaggagc

SEQ ID NO: 1765106 - DNA, 22 bp, Homo sapiens
gtcacccaaacacttctgcttt

SEQ ID NO: 1765107 - DNA, 15 bp, Homo sapiens
gtcacccctccagga

SEQ ID NO: 1765108 - DNA, 20 bp, Homo sapiens
gtcacccctccaggaatgat

SEQ ID NO: 1765109 - DNA, 16 bp, Homo sapiens
gtcacctagcaagctg

SEQ ID NO: 1765110 - DNA, 19 bp, Homo sapiens
gtcacctagcaagctgccg

SEQ ID NO: 1765111 - DNA, 14 bp, Homo sapiens
gtcacctcctccac

SEQ ID NO: 1765112 - DNA, 15 bp, Homo sapiens
gtcacctcctccact

SEQ ID NO: 1765113 - DNA, 20 bp, Homo sapiens
gtcacctctctctgaggaca

SEQ ID NO: 1765114 - DNA, 18 bp, Homo sapiens
gtcacctgcaagccccag

SEQ ID NO: 1765115 - DNA, 24 bp, Homo sapiens
gtcacctgcaagccccagggcctg

SEQ ID NO: 1765116 - DNA, 12 bp, Homo sapiens
gtcacctgctgg

SEQ ID NO: 1765117 - DNA, 22 bp, Homo sapiens
gtcacgaggtccagacccactc

SEQ ID NO: 1765118 - DNA, 17 bp, Homo sapiens
gtcacgctcatgtcctg

SEQ ID NO: 1765119 - DNA, 23 bp, Homo sapiens
gtcactacgtgactgtggcacac

SEQ ID NO: 1765120 - DNA, 22 bp, Homo sapiens
gtcactactcacagtctcttta

SEQ ID NO: 1765121 - DNA, 13 bp, Homo sapiens
gtcactagcagct

SEQ ID NO: 1765122 - DNA, 15 bp, Homo sapiens
gtcactagcagctgc

SEQ ID NO: 1765123 - DNA, 15 bp, Homo sapiens
gtcactcaaatgaat

SEQ ID NO: 1765124 - DNA, 20 bp, Homo sapiens
gtcactcaaatgaatttgct

SEQ ID NO: 1765125 - DNA, 20 bp, Homo sapiens
gtcactcattaatgaatcac

SEQ ID NO: 1765126 - DNA, 19 bp, Homo sapiens
gtcactcattgctgagcct

SEQ ID NO: 1765127 - DNA, 24 bp, Homo sapiens
gtcactcattgctgagcctctgct

SEQ ID NO: 1765128 - DNA, 16 bp, Homo sapiens
gtcactccaccatccc

SEQ ID NO: 1765129 - DNA, 22 bp, Homo sapiens
gtcactccagtgctcagctgtg

SEQ ID NO: 1765130 - DNA, 19 bp, Homo sapiens
gtcactccctctgccttca

SEQ ID NO: 1765131 - DNA, 16 bp, Homo sapiens
gtcactcctctctagg

SEQ ID NO: 1765132 - DNA, 12 bp, Homo sapiens
gtcactcctggg

SEQ ID NO: 1765133 - DNA, 15 bp, Homo sapiens
gtcactctgccctct

SEQ ID NO: 1765134 - DNA, 18 bp, Homo sapiens
gtcactctgccctctgct

SEQ ID NO: 1765135 - DNA, 20 bp, Homo sapiens
gtcactctgccctctgctgc

SEQ ID NO: 1765136 - DNA, 14 bp, Homo sapiens
gtcactgagctgtg

SEQ ID NO: 1765137 - DNA, 22 bp, Homo sapiens
gtcactgatgtacaattaaaaa

SEQ ID NO: 1765138 - DNA, 23 bp, Homo sapiens
gtcactgcctgcagaggtctgtg

SEQ ID NO: 1765139 - DNA, 18 bp, Homo sapiens
gtcactggaaaggggaga

SEQ ID NO: 1765140 - DNA, 20 bp, Homo sapiens
gtcactggaaaggggagagc

SEQ ID NO: 1765141 - DNA, 19 bp, Homo sapiens
gtcactggaccactgggca

SEQ ID NO: 1765142 - DNA, 23 bp, Homo sapiens
gtcactggaggttgaagccaagt

SEQ ID NO: 1765143 - DNA, 19 bp, Homo sapiens
gtcactggcagcctgcacc

SEQ ID NO: 1765144 - DNA, 12 bp, Homo sapiens
gtcactgtcact

SEQ ID NO: 1765145 - DNA, 14 bp, Homo sapiens
gtcactgtcactgc

SEQ ID NO: 1765146 - DNA, 20 bp, Homo sapiens
gtcacttacctagatttaca

SEQ ID NO: 1765147 - DNA, 16 bp, Homo sapiens
gtcacttccagtgttg

SEQ ID NO: 1765148 - DNA, 24 bp, Homo sapiens
gtcacttcgcgtgccctcgctgct

SEQ ID NO: 1765149 - DNA, 20 bp, Homo sapiens
gtcagaaaagagccactttc

SEQ ID NO: 1765150 - DNA, 22 bp, Homo sapiens
gtcagaaccagagggcatgctg

SEQ ID NO: 1765151 - DNA, 15 bp, Homo sapiens
gtcagaagcaggttc

SEQ ID NO: 1765152 - DNA, 17 bp, Homo sapiens
gtcagaagcaggttctt

SEQ ID NO: 1765153 - DNA, 13 bp, Homo sapiens
gtcagaatcagaa

SEQ ID NO: 1765154 - DNA, 18 bp, Homo sapiens
gtcagacagaacttgaat

SEQ ID NO: 1765155 - DNA, 14 bp, Homo sapiens
gtcagaccctggag

SEQ ID NO: 1765156 - DNA, 16 bp, Homo sapiens
gtcagaccctggaggc

SEQ ID NO: 1765157 - DNA, 16 bp, Homo sapiens
gtcagactgctgggac

SEQ ID NO: 1765158 - DNA, 24 bp, Homo sapiens
gtcagactgctgggactggccagg

SEQ ID NO: 1765159 - DNA, 14 bp, Homo sapiens
gtcagactggctgg

SEQ ID NO: 1765160 - DNA, 19 bp, Homo sapiens
gtcagacttccaaatcctg

SEQ ID NO: 1765161 - DNA, 15 bp, Homo sapiens
gtcagactttaaaga

SEQ ID NO: 1765162 - DNA, 16 bp, Homo sapiens
gtcagagaaaatgaga

SEQ ID NO: 1765163 - DNA, 20 bp, Homo sapiens
gtcagagagacctcatcctg

SEQ ID NO: 1765164 - DNA, 17 bp, Homo sapiens
gtcagagcccagcccag

SEQ ID NO: 1765165 - DNA, 14 bp, Homo sapiens
gtcccagccacccc

SEQ ID NO: 1765166 - DNA, 16 bp, Homo sapiens
gtcccagccaccccgg

SEQ ID NO: 1765167 - DNA, 21 bp, Homo sapiens
gtcccagccaccccgggctct

SEQ ID NO: 1765168 - DNA, 12 bp, Homo sapiens
gtcccagccacg

SEQ ID NO: 1765169 - DNA, 15 bp, Homo sapiens
gtcccagcctggggc

SEQ ID NO: 1765170 - DNA, 23 bp, Homo sapiens
gtcccagcctggggctccctctc

SEQ ID NO: 1765171 - DNA, 18 bp, Homo sapiens
gtcccagctgaaggcagt

SEQ ID NO: 1765172 - DNA, 14 bp, Homo sapiens
gtcccaggccaccc

SEQ ID NO: 1765173 - DNA, 18 bp, Homo sapiens
gtcccaggggcagccaca

SEQ ID NO: 1765174 - DNA, 19 bp, Homo sapiens
gtcccaggggcagccacac

SEQ ID NO: 1765175 - DNA, 16 bp, Homo sapiens
gtcccagtcagaaata

SEQ ID NO: 1765176 - DNA, 14 bp, Homo sapiens
gtcccagtgggagg

SEQ ID NO: 1765177 - DNA, 21 bp, Homo sapiens
gtcccagtgggaggggcaggc

SEQ ID NO: 1765178 - DNA, 16 bp, Homo sapiens
gtcccatccaggcagt

SEQ ID NO: 1765179 - DNA, 17 bp, Homo sapiens
gtcccatccaggcagtc

SEQ ID NO: 1765180 - DNA, 23 bp, Homo sapiens
gtcccatcctctaaagcagaggc

SEQ ID NO: 1765181 - DNA, 16 bp, Homo sapiens
gtcccatgacccaccc

SEQ ID NO: 1765182 - DNA, 22 bp, Homo sapiens
gtcccatgacccacccctgtgc

SEQ ID NO: 1765183 - DNA, 16 bp, Homo sapiens
gtcccatggctgaagc

SEQ ID NO: 1765184 - DNA, 22 bp, Homo sapiens
gtcccatggctgaagctggagc

SEQ ID NO: 1765185 - DNA, 23 bp, Homo sapiens
gtcccatggggaaaccctggagc

SEQ ID NO: 1765186 - DNA, 13 bp, Homo sapiens
gtcccatgtggtg

SEQ ID NO: 1765187 - DNA, 21 bp, Homo sapiens
gtcccattctagatcctgcac

SEQ ID NO: 1765188 - DNA, 20 bp, Homo sapiens
gtcccatttccttggaggcc

SEQ ID NO: 1765189 - DNA, 19 bp, Homo sapiens
gtcccatttttctcttgcc

SEQ ID NO: 1765190 - DNA, 16 bp, Homo sapiens
gtccccaacgtcccct

SEQ ID NO: 1765191 - DNA, 22 bp, Homo sapiens
gtccccaacgtcccctccgccg

SEQ ID NO: 1765192 - DNA, 21 bp, Homo sapiens
gtccccaaggcctctctctgc

SEQ ID NO: 1765193 - DNA, 15 bp, Homo sapiens
gtccccacccctgcc

SEQ ID NO: 1765194 - DNA, 16 bp, Homo sapiens
gtccccacccctgccc

SEQ ID NO: 1765195 - DNA, 17 bp, Homo sapiens
gtccccacccctgcccc

SEQ ID NO: 1765196 - DNA, 16 bp, Homo sapiens
gtccccacccgcctgc

SEQ ID NO: 1765197 - DNA, 18 bp, Homo sapiens
gtccccacccgcctgcag

SEQ ID NO: 1765198 - DNA, 18 bp, Homo sapiens
gtccccaccctccactca

SEQ ID NO: 1765199 - DNA, 16 bp, Homo sapiens
gtccccactcccttgg

SEQ ID NO: 1765200 - DNA, 16 bp, Homo sapiens
gtccccagctccccag

SEQ ID NO: 1765201 - DNA, 21 bp, Homo sapiens
gtccccataagacaaacactg

SEQ ID NO: 1765202 - DNA, 20 bp, Homo sapiens
gtccccatccagcgagagag

SEQ ID NO: 1765203 - DNA, 21 bp, Homo sapiens
gtcccccaaagggcctcctca

SEQ ID NO: 1765204 - DNA, 16 bp, Homo sapiens
gtcccccaacttgaga

SEQ ID NO: 1765205 - DNA, 17 bp, Homo sapiens
gtcccccatgccaccac

SEQ ID NO: 1765206 - DNA, 19 bp, Homo sapiens
gtcccccatgccaccaccc

SEQ ID NO: 1765207 - DNA, 13 bp, Homo sapiens
gtccccccaccct

SEQ ID NO: 1765208 - DNA, 22 bp, Homo sapiens
gtccccccaccctcattctact

SEQ ID NO: 1765209 - DNA, 20 bp, Homo sapiens
gtcccccgactgcctgtctc

SEQ ID NO: 1765210 - DNA, 13 bp, Homo sapiens
gtccccctcagca

SEQ ID NO: 1765211 - DNA, 20 bp, Homo sapiens
gtccccgaggagctgggccc

SEQ ID NO: 1765212 - DNA, 13 bp, Homo sapiens
gtccccgcagccc

SEQ ID NO: 1765213 - DNA, 14 bp, Homo sapiens
gtccccgctgctgt

SEQ ID NO: 1765214 - DNA, 15 bp, Homo sapiens
gtccccgtgccccgc

SEQ ID NO: 1765215 - DNA, 22 bp, Homo sapiens
gtccccgtgccccgcctccccg

SEQ ID NO: 1765216 - DNA, 15 bp, Homo sapiens
gtcccctaaggaaat

SEQ ID NO: 1765217 - DNA, 16 bp, Homo sapiens
gtcccctactccctct

SEQ ID NO: 1765218 - DNA, 12 bp, Homo sapiens
gtcccctcacct

SEQ ID NO: 1765219 - DNA, 15 bp, Homo sapiens
gtcccctccaggaag

SEQ ID NO: 1765220 - DNA, 16 bp, Homo sapiens
gtcccctccaggaaga

SEQ ID NO: 1765221 - DNA, 12 bp, Homo sapiens
gtcccctcccat

SEQ ID NO: 1765222 - DNA, 14 bp, Homo sapiens
gtcccctcccatct

SEQ ID NO: 1765223 - DNA, 17 bp, Homo sapiens
gtcccctcccatctggg

SEQ ID NO: 1765224 - DNA, 16 bp, Homo sapiens
gtcccctccccggccc

SEQ ID NO: 1765225 - DNA, 12 bp, Homo sapiens
gtcccctccgcc

SEQ ID NO: 1765226 - DNA, 15 bp, Homo sapiens
gtcccctctgtgctt

SEQ ID NO: 1765227 - DNA, 16 bp, Homo sapiens
gtcccctctgtgcttc

SEQ ID NO: 1765228 - DNA, 13 bp, Homo sapiens
gtcccctgcccca

SEQ ID NO: 1765229 - DNA, 14 bp, Homo sapiens
gtcccctgccccag

SEQ ID NO: 1765230 - DNA, 19 bp, Homo sapiens
gtcccctgccccagaggtc

SEQ ID NO: 1765231 - DNA, 17 bp, Homo sapiens
gtccccttctctcatct

SEQ ID NO: 1765232 - DNA, 20 bp, Homo sapiens
gtccccttctctcatctctt

SEQ ID NO: 1765233 - DNA, 22 bp, Homo sapiens
gtccccttctgtgtttctggag

SEQ ID NO: 1765234 - DNA, 23 bp, Homo sapiens
gtccccttctgtgtttctggagt

SEQ ID NO: 1765235 - DNA, 14 bp, Homo sapiens
gtcccctttcctct

SEQ ID NO: 1765236 - DNA, 22 bp, Homo sapiens
gtcccctttgtattccttaaat

SEQ ID NO: 1765237 - DNA, 15 bp, Homo sapiens
gtcccgaatccacag

SEQ ID NO: 1765238 - DNA, 17 bp, Homo sapiens
gtcccgcggtgctgact

SEQ ID NO: 1765239 - DNA, 13 bp, Homo sapiens
gtcccggccagct

SEQ ID NO: 1765240 - DNA, 21 bp, Homo sapiens
gtcccggggccagcacttcca

SEQ ID NO: 1765241 - DNA, 22 bp, Homo sapiens
gtcccggttcagacccctgcct

SEQ ID NO: 1765242 - DNA, 23 bp, Homo sapiens
gtccctaagcatgtgtcccagga

SEQ ID NO: 1765243 - DNA, 22 bp, Homo sapiens
gtccctaattctcttcgctgtg

SEQ ID NO: 1765244 - DNA, 15 bp, Homo sapiens
gtccctagcagccca

SEQ ID NO: 1765245 - DNA, 18 bp, Homo sapiens
gtccctagcagcccaccc

SEQ ID NO: 1765246 - DNA, 21 bp, Homo sapiens
gtccctagcagcccaccctgc

SEQ ID NO: 1765247 - DNA, 15 bp, Homo sapiens
gtccctatgcatatc

SEQ ID NO: 1765248 - DNA, 20 bp, Homo sapiens
gtccctccaggcccatctca

SEQ ID NO: 1765249 - DNA, 15 bp, Homo sapiens
gtccctcccaggtcg

SEQ ID NO: 1765250 - DNA, 19 bp, Homo sapiens
gtccctcccccgcttcctc

SEQ ID NO: 1765251 - DNA, 18 bp, Homo sapiens
gtccctcctctcacctct

SEQ ID NO: 1765252 - DNA, 20 bp, Homo sapiens
gtccctcgccgtccctccca

SEQ ID NO: 1765253 - DNA, 21 bp, Homo sapiens
gtccctcgccgtccctcccag

SEQ ID NO: 1765254 - DNA, 16 bp, Homo sapiens
gtccctcgtccacagg

SEQ ID NO: 1765255 - DNA, 16 bp, Homo sapiens
gtccctctcagtgcct

SEQ ID NO: 1765256 - DNA, 23 bp, Homo sapiens
gtccctgcacagtgacttctgag

SEQ ID NO: 1765257 - DNA, 13 bp, Homo sapiens
gtccctgcagggc

SEQ ID NO: 1765258 - DNA, 16 bp, Homo sapiens
gtccctgcagggccat

SEQ ID NO: 1765259 - DNA, 15 bp, Homo sapiens
gtccctgccctcccc

SEQ ID NO: 1765260 - DNA, 16 bp, Homo sapiens
gtccctgccctcccct

SEQ ID NO: 1765261 - DNA, 17 bp, Homo sapiens
gtccctgccctcccctg

SEQ ID NO: 1765262 - DNA, 19 bp, Homo sapiens
gtccctgccctcccctgct

SEQ ID NO: 1765263 - DNA, 13 bp, Homo sapiens
gtccctgccttca

SEQ ID NO: 1765264 - DNA, 20 bp, Homo sapiens
gtccctgccttcactgtgct

SEQ ID NO: 1765265 - DNA, 15 bp, Homo sapiens
gtccctggacacagc

SEQ ID NO: 1765266 - DNA, 12 bp, Homo sapiens
gtccctggacca

SEQ ID NO: 1765267 - DNA, 18 bp, Homo sapiens
gtccctggaccagcctcc

SEQ ID NO: 1765268 - DNA, 12 bp, Homo sapiens
gtccctggtccc

SEQ ID NO: 1765269 - DNA, 16 bp, Homo sapiens
gtccctggtccctcgt

SEQ ID NO: 1765270 - DNA, 20 bp, Homo sapiens
gtccctggtccttcactggc

SEQ ID NO: 1765271 - DNA, 18 bp, Homo sapiens
gtccctgtagctcagtca

SEQ ID NO: 1765272 - DNA, 18 bp, Homo sapiens
gtccctgtcatttgaacc

SEQ ID NO: 1765273 - DNA, 18 bp, Homo sapiens
gtccctgttttctgagcc

SEQ ID NO: 1765274 - DNA, 15 bp, Homo sapiens
gtcccttagccccga

SEQ ID NO: 1765275 - DNA, 14 bp, Homo sapiens
gtcccttcccctcc

SEQ ID NO: 1765276 - DNA, 17 bp, Homo sapiens
gtcccttcccctccctg

SEQ ID NO: 1765277 - DNA, 18 bp, Homo sapiens
gtcccttcccctccctgg

SEQ ID NO: 1765278 - DNA, 22 bp, Homo sapiens
gtcccttcccctccctggctcc

SEQ ID NO: 1765279 - DNA, 21 bp, Homo sapiens
gtcccttgaaggaagagggac

SEQ ID NO: 1765280 - DNA, 16 bp, Homo sapiens
gtggaggctgctgtga

SEQ ID NO: 1765281 - DNA, 13 bp, Homo sapiens
gtggaggcttcct

SEQ ID NO: 1765282 - DNA, 23 bp, Homo sapiens
gtggagggaaggataaagccact

SEQ ID NO: 1765283 - DNA, 12 bp, Homo sapiens
gtggagggaggc

SEQ ID NO: 1765284 - DNA, 15 bp, Homo sapiens
gtggagggaggcccc

SEQ ID NO: 1765285 - DNA, 14 bp, Homo sapiens
gtggagggcacagc

SEQ ID NO: 1765286 - DNA, 15 bp, Homo sapiens
gtggaggggtgtggc

SEQ ID NO: 1765287 - DNA, 16 bp, Homo sapiens
gtggaggggtgtggca

SEQ ID NO: 1765288 - DNA, 23 bp, Homo sapiens
gtggaggggtgtggcagtggttt

SEQ ID NO: 1765289 - DNA, 13 bp, Homo sapiens
gtggagtccagct

SEQ ID NO: 1765290 - DNA, 13 bp, Homo sapiens
gtggagtctgagt

SEQ ID NO: 1765291 - DNA, 17 bp, Homo sapiens
gtggatacctggttgag

SEQ ID NO: 1765292 - DNA, 16 bp, Homo sapiens
gtggatatttgtataa

SEQ ID NO: 1765293 - DNA, 23 bp, Homo sapiens
gtggatcacacctcagtgggaag

SEQ ID NO: 1765294 - DNA, 15 bp, Homo sapiens
gtggatcacagaggc

SEQ ID NO: 1765295 - DNA, 19 bp, Homo sapiens
gtggatcacctgaggtcag

SEQ ID NO: 1765296 - DNA, 21 bp, Homo sapiens
gtggatcacgaggtcaggaga

SEQ ID NO: 1765297 - DNA, 21 bp, Homo sapiens
gtggatcagagatgcaccacc

SEQ ID NO: 1765298 - DNA, 19 bp, Homo sapiens
gtggatcatgaggtcagga

SEQ ID NO: 1765299 - DNA, 19 bp, Homo sapiens
gtggatccaaactgatcca

SEQ ID NO: 1765300 - DNA, 20 bp, Homo sapiens
gtggatcgagtgtagctgtg

SEQ ID NO: 1765301 - DNA, 23 bp, Homo sapiens
gtggatcgagtgtagctgtgaaa

SEQ ID NO: 1765302 - DNA, 22 bp, Homo sapiens
gtggatctccttcccttctctt

SEQ ID NO: 1765303 - DNA, 16 bp, Homo sapiens
gtggatgaggagacag

SEQ ID NO: 1765304 - DNA, 15 bp, Homo sapiens
gtggatgatgtttcg

SEQ ID NO: 1765305 - DNA, 17 bp, Homo sapiens
gtggatgctccagggca

SEQ ID NO: 1765306 - DNA, 18 bp, Homo sapiens
gtggatgctccagggcag

SEQ ID NO: 1765307 - DNA, 20 bp, Homo sapiens
gtggatgctccagggcagcc

SEQ ID NO: 1765308 - DNA, 22 bp, Homo sapiens
gtggatggccccagcacagctt

SEQ ID NO: 1765309 - DNA, 12 bp, Homo sapiens
gtggatgggcaa

SEQ ID NO: 1765310 - DNA, 16 bp, Homo sapiens
gtggatgttatgaaca

SEQ ID NO: 1765311 - DNA, 22 bp, Homo sapiens
gtggattataaaaaatgtaaca

SEQ ID NO: 1765312 - DNA, 16 bp, Homo sapiens
gtggattctccctggg

SEQ ID NO: 1765313 - DNA, 18 bp, Homo sapiens
gtggattctgaggccctg

SEQ ID NO: 1765314 - DNA, 19 bp, Homo sapiens
gtggattgcacgtggcctc

SEQ ID NO: 1765315 - DNA, 21 bp, Homo sapiens
gtggattttggttttgttccc

SEQ ID NO: 1765316 - DNA, 16 bp, Homo sapiens
gtggcaaagtgctgta

SEQ ID NO: 1765317 - DNA, 16 bp, Homo sapiens
gtggcaatctgtgggc

SEQ ID NO: 1765318 - DNA, 12 bp, Homo sapiens
gtggcaattagt

SEQ ID NO: 1765319 - DNA, 22 bp, Homo sapiens
gtggcacacacctgtagtccca

SEQ ID NO: 1765320 - DNA, 13 bp, Homo sapiens
gtggcacagccct

SEQ ID NO: 1765321 - DNA, 15 bp, Homo sapiens
gtggcacagccctga

SEQ ID NO: 1765322 - DNA, 16 bp, Homo sapiens
gtggcacagccctgag

SEQ ID NO: 1765323 - DNA, 13 bp, Homo sapiens
gtggcacctcctg

SEQ ID NO: 1765324 - DNA, 16 bp, Homo sapiens
gtggcacctcttccga

SEQ ID NO: 1765325 - DNA, 23 bp, Homo sapiens
gtggcactcaactctgagcccat

SEQ ID NO: 1765326 - DNA, 15 bp, Homo sapiens
gtggcactgagcccc

SEQ ID NO: 1765327 - DNA, 16 bp, Homo sapiens
gtggcactgagccccc

SEQ ID NO: 1765328 - DNA, 19 bp, Homo sapiens
gtggcacttgcctgggtca

SEQ ID NO: 1765329 - DNA, 14 bp, Homo sapiens
gtggcagaaaagag

SEQ ID NO: 1765330 - DNA, 19 bp, Homo sapiens
gtggcagaaaagaggagac

SEQ ID NO: 1765331 - DNA, 14 bp, Homo sapiens
gtggcagccatgcc

SEQ ID NO: 1765332 - DNA, 16 bp, Homo sapiens
gtggcagccatgcctc

SEQ ID NO: 1765333 - DNA, 13 bp, Homo sapiens
gtggcagccctgt

SEQ ID NO: 1765334 - DNA, 21 bp, Homo sapiens
gtggcagccgtcccaggccac

SEQ ID NO: 1765335 - DNA, 17 bp, Homo sapiens
gtggcagctataggaaa

SEQ ID NO: 1765336 - DNA, 15 bp, Homo sapiens
gtggcagctgcccct

SEQ ID NO: 1765337 - DNA, 20 bp, Homo sapiens
gtggcagctggggagcagct

SEQ ID NO: 1765338 - DNA, 19 bp, Homo sapiens
gtggcaggtcactgtcact

SEQ ID NO: 1765339 - DNA, 21 bp, Homo sapiens
gtggcaggtcactgtcactgc

SEQ ID NO: 1765340 - DNA, 22 bp, Homo sapiens
gtggcaggtcactgtcactgcc

SEQ ID NO: 1765341 - DNA, 18 bp, Homo sapiens
gtggcatctttgccttgg

SEQ ID NO: 1765342 - DNA, 20 bp, Homo sapiens
gtggcatctttgccttgggc

SEQ ID NO: 1765343 - DNA, 19 bp, Homo sapiens
gtggcatgcatggaggact

SEQ ID NO: 1765344 - DNA, 23 bp, Homo sapiens
gtggcatgcatggaggactctcc

SEQ ID NO: 1765345 - DNA, 15 bp, Homo sapiens
gtggcatgtggcctg

SEQ ID NO: 1765346 - DNA, 19 bp, Homo sapiens
gtggcatgtggcctgtggc

SEQ ID NO: 1765347 - DNA, 14 bp, Homo sapiens
gtggcatgttttga

SEQ ID NO: 1765348 - DNA, 14 bp, Homo sapiens
gtggccacagcccc

SEQ ID NO: 1765349 - DNA, 19 bp, Homo sapiens
gtggccacagcccccttgc

SEQ ID NO: 1765350 - DNA, 20 bp, Homo sapiens
gtggccacagcccccttgcc

SEQ ID NO: 1765351 - DNA, 20 bp, Homo sapiens
gtggccacgggggcagtgtg

SEQ ID NO: 1765352 - DNA, 21 bp, Homo sapiens
gtggccacgggggcagtgtga

SEQ ID NO: 1765353 - DNA, 12 bp, Homo sapiens
gtggccagagct

SEQ ID NO: 1765354 - DNA, 13 bp, Homo sapiens
gtggccagagctg

SEQ ID NO: 1765355 - DNA, 14 bp, Homo sapiens
gtggccagagctgg

SEQ ID NO: 1765356 - DNA, 13 bp, Homo sapiens
gtggccagcccgg

SEQ ID NO: 1765357 - DNA, 16 bp, Homo sapiens
gtggccatggcctctg

SEQ ID NO: 1765358 - DNA, 19 bp, Homo sapiens
gtggccatggcctctgcaa

SEQ ID NO: 1765359 - DNA, 15 bp, Homo sapiens
gtggccccaccctgg

SEQ ID NO: 1765360 - DNA, 21 bp, Homo sapiens
gtggccccaccctgggccctg

SEQ ID NO: 1765361 - DNA, 23 bp, Homo sapiens
gtggccccaccctgggccctggg

SEQ ID NO: 1765362 - DNA, 22 bp, Homo sapiens
gtggcccctgctgtctctctgg

SEQ ID NO: 1765363 - DNA, 18 bp, Homo sapiens
gtggcccgacagcctggc

SEQ ID NO: 1765364 - DNA, 13 bp, Homo sapiens
gtggccctgccat

SEQ ID NO: 1765365 - DNA, 17 bp, Homo sapiens
gtggccctgccatcttc

SEQ ID NO: 1765366 - DNA, 22 bp, Homo sapiens
gtggccctgccatcttcccagc

SEQ ID NO: 1765367 - DNA, 18 bp, Homo sapiens
gtggccctgccctctcct

SEQ ID NO: 1765368 - DNA, 16 bp, Homo sapiens
gtggccctggcctgct

SEQ ID NO: 1765369 - DNA, 18 bp, Homo sapiens
gtggccctggcctgctgg

SEQ ID NO: 1765370 - DNA, 14 bp, Homo sapiens
gtggccctgtgcct

SEQ ID NO: 1765371 - DNA, 22 bp, Homo sapiens
gtggccgcccacccgcccgagg

SEQ ID NO: 1765372 - DNA, 15 bp, Homo sapiens
gtggccgcccctgag

SEQ ID NO: 1765373 - DNA, 23 bp, Homo sapiens
gtggccgcctggcaggtggaact

SEQ ID NO: 1765374 - DNA, 20 bp, Homo sapiens
gtggccgtctcctccctcag

SEQ ID NO: 1765375 - DNA, 12 bp, Homo sapiens
gtggcctcagaa

SEQ ID NO: 1765376 - DNA, 13 bp, Homo sapiens
gtggcctccctgc

SEQ ID NO: 1765377 - DNA, 15 bp, Homo sapiens
gtggcctccctgctg

SEQ ID NO: 1765378 - DNA, 18 bp, Homo sapiens
gtggcctccgcagtgtct

SEQ ID NO: 1765379 - DNA, 15 bp, Homo sapiens
gtggcctctgcctgg

SEQ ID NO: 1765380 - DNA, 13 bp, Homo sapiens
gtggcctctgtgg

SEQ ID NO: 1765381 - DNA, 20 bp, Homo sapiens
gtggcctgcgtcttttttct

SEQ ID NO: 1765382 - DNA, 14 bp, Homo sapiens
gtggcctggtccct

SEQ ID NO: 1765383 - DNA, 15 bp, Homo sapiens
gtggcctgtgtccag

SEQ ID NO: 1765384 - DNA, 19 bp, Homo sapiens
gtggcctgttccctagaga

SEQ ID NO: 1765385 - DNA, 19 bp, Homo sapiens
gtggccttccccagcctct

SEQ ID NO: 1765386 - DNA, 23 bp, Homo sapiens
gtggccttccccttttgcctggc

SEQ ID NO: 1765387 - DNA, 24 bp, Homo sapiens
gtggccttccccttttgcctggct

SEQ ID NO: 1765388 - DNA, 20 bp, Homo sapiens
gtggcgactctatagactct

SEQ ID NO: 1765389 - DNA, 21 bp, Homo sapiens
gtggcgcaggtgccatgcctg

SEQ ID NO: 1765390 - DNA, 17 bp, Homo sapiens
gtggcgccgtctccagg

SEQ ID NO: 1765391 - DNA, 21 bp, Homo sapiens
gtggcgccgtctccaggggct

SEQ ID NO: 1765392 - DNA, 15 bp, Homo sapiens
gtggcggccccagca

SEQ ID NO: 1765393 - DNA, 14 bp, Homo sapiens
gtggcgggcacctg

SEQ ID NO: 1765394 - DNA, 22 bp, Homo sapiens
gtgtatttttcaggtaggccct

SEQ ID NO: 1765395 - DNA, 16 bp, Homo sapiens
gtgtcaagacatttct

SEQ ID NO: 1765396 - DNA, 18 bp, Homo sapiens
gtgtcagaataggaaaac

SEQ ID NO: 1765397 - DNA, 20 bp, Homo sapiens
gtgtcagagcccagcccagg

SEQ ID NO: 1765398 - DNA, 14 bp, Homo sapiens
gtgtcagctgaggc

SEQ ID NO: 1765399 - DNA, 16 bp, Homo sapiens
gtgtcagctgaggctg

SEQ ID NO: 1765400 - DNA, 18 bp, Homo sapiens
gtgtcagctgaggctggg

SEQ ID NO: 1765401 - DNA, 12 bp, Homo sapiens
gtgtcaggcccg

SEQ ID NO: 1765402 - DNA, 12 bp, Homo sapiens
gtgtcaggccct

SEQ ID NO: 1765403 - DNA, 18 bp, Homo sapiens
gtgtcaggccctctgcct

SEQ ID NO: 1765404 - DNA, 23 bp, Homo sapiens
gtgtcaggccctctgcctgcact

SEQ ID NO: 1765405 - DNA, 14 bp, Homo sapiens
gtgtcataccagaa

SEQ ID NO: 1765406 - DNA, 23 bp, Homo sapiens
gtgtccaagggccgtgcccttgc

SEQ ID NO: 1765407 - DNA, 21 bp, Homo sapiens
gtgtccagagacatgggcctc

SEQ ID NO: 1765408 - DNA, 22 bp, Homo sapiens
gtgtccagagacatgggcctcc

SEQ ID NO: 1765409 - DNA, 12 bp, Homo sapiens
gtgtccagcaca

SEQ ID NO: 1765410 - DNA, 19 bp, Homo sapiens
gtgtccagcagctgcgggt

SEQ ID NO: 1765411 - DNA, 13 bp, Homo sapiens
gtgtccagcttcc

SEQ ID NO: 1765412 - DNA, 19 bp, Homo sapiens
gtgtccagcttccaaagcc

SEQ ID NO: 1765413 - DNA, 13 bp, Homo sapiens
gtgtccatcccag

SEQ ID NO: 1765414 - DNA, 20 bp, Homo sapiens
gtgtccatgcgctcagggcc

SEQ ID NO: 1765415 - DNA, 18 bp, Homo sapiens
gtgtcccaaggagctgat

SEQ ID NO: 1765416 - DNA, 14 bp, Homo sapiens
gtgtcccaggcagg

SEQ ID NO: 1765417 - DNA, 22 bp, Homo sapiens
gtgtccccaacgtcccctccgc

SEQ ID NO: 1765418 - DNA, 19 bp, Homo sapiens
gtgtccccgatgctgacct

SEQ ID NO: 1765419 - DNA, 21 bp, Homo sapiens
gtgtccccgctgctgtgcaac

SEQ ID NO: 1765420 - DNA, 12 bp, Homo sapiens
gtgtcccctgcc

SEQ ID NO: 1765421 - DNA, 14 bp, Homo sapiens
gtgtccctggacac

SEQ ID NO: 1765422 - DNA, 21 bp, Homo sapiens
gtgtccctggacacagctctt

SEQ ID NO: 1765423 - DNA, 19 bp, Homo sapiens
gtgtccgtccacccttcca

SEQ ID NO: 1765424 - DNA, 21 bp, Homo sapiens
gtgtcctccaccatgcactca

SEQ ID NO: 1765425 - DNA, 16 bp, Homo sapiens
gtgtcctccaggagct

SEQ ID NO: 1765426 - DNA, 20 bp, Homo sapiens
gtgtcctgaaacgctccttt

SEQ ID NO: 1765427 - DNA, 14 bp, Homo sapiens
gtgtcctgaagctg

SEQ ID NO: 1765428 - DNA, 17 bp, Homo sapiens
gtgtcctgaccaccctc

SEQ ID NO: 1765429 - DNA, 18 bp, Homo sapiens
gtgtcctgaccaccctcc

SEQ ID NO: 1765430 - DNA, 17 bp, Homo sapiens
gtgtcctgcctgtctgc

SEQ ID NO: 1765431 - DNA, 22 bp, Homo sapiens
gtgtcctggtaattcctctcca

SEQ ID NO: 1765432 - DNA, 13 bp, Homo sapiens
gtgtcctggtgct

SEQ ID NO: 1765433 - DNA, 21 bp, Homo sapiens
gtgtcctgtagttgcgtggac

SEQ ID NO: 1765434 - DNA, 16 bp, Homo sapiens
gtgtcctgtcctttct

SEQ ID NO: 1765435 - DNA, 15 bp, Homo sapiens
gtgtcgtagccaagg

SEQ ID NO: 1765436 - DNA, 20 bp, Homo sapiens
gtgtctcagcctctgccagc

SEQ ID NO: 1765437 - DNA, 22 bp, Homo sapiens
gtgtctccttaagctgcagaga

SEQ ID NO: 1765438 - DNA, 12 bp, Homo sapiens
gtgtctctccca

SEQ ID NO: 1765439 - DNA, 14 bp, Homo sapiens
gtgtctctgccatg

SEQ ID NO: 1765440 - DNA, 17 bp, Homo sapiens
gtgtctgcagtcctggt

SEQ ID NO: 1765441 - DNA, 23 bp, Homo sapiens
gtgtctgcattgttattgtggaa

SEQ ID NO: 1765442 - DNA, 14 bp, Homo sapiens
gtgtctgccccctc

SEQ ID NO: 1765443 - DNA, 13 bp, Homo sapiens
gtgtctgtacacg

SEQ ID NO: 1765444 - DNA, 21 bp, Homo sapiens
gtgtctgtgccctccaaagag

SEQ ID NO: 1765445 - DNA, 15 bp, Homo sapiens
gtgtctgttgcttgt

SEQ ID NO: 1765446 - DNA, 22 bp, Homo sapiens
gtgtcttaattaaaagaatatt

SEQ ID NO: 1765447 - DNA, 19 bp, Homo sapiens
gtgtcttaattattatttg

SEQ ID NO: 1765448 - DNA, 18 bp, Homo sapiens
gtgtcttggagtgcattt

SEQ ID NO: 1765449 - DNA, 23 bp, Homo sapiens
gtgtcttgggcagagctggctct

SEQ ID NO: 1765450 - DNA, 17 bp, Homo sapiens
gtgtcttttccactcct

SEQ ID NO: 1765451 - DNA, 14 bp, Homo sapiens
gtgtcttttgacat

SEQ ID NO: 1765452 - DNA, 17 bp, Homo sapiens
gtgtgaaaaaagaaaat

SEQ ID NO: 1765453 - DNA, 17 bp, Homo sapiens
gtgtgaactattgagaa

SEQ ID NO: 1765454 - DNA, 19 bp, Homo sapiens
gtgtgactctagcaaggct

SEQ ID NO: 1765455 - DNA, 20 bp, Homo sapiens
gtgtgactctagcaaggctc

SEQ ID NO: 1765456 - DNA, 21 bp, Homo sapiens
gtgtgagaagtgaatgctggg

SEQ ID NO: 1765457 - DNA, 22 bp, Homo sapiens
gtgtgagaagtgaatgctggga

SEQ ID NO: 1765458 - DNA, 23 bp, Homo sapiens
gtgtgagaccccaaagactctgg

SEQ ID NO: 1765459 - DNA, 20 bp, Homo sapiens
gtgtgagacttaaaacatgg

SEQ ID NO: 1765460 - DNA, 15 bp, Homo sapiens
gtgtgagagagactg

SEQ ID NO: 1765461 - DNA, 20 bp, Homo sapiens
gtgtgagccagagggagctg

SEQ ID NO: 1765462 - DNA, 17 bp, Homo sapiens
gtgtgagctcttccctt

SEQ ID NO: 1765463 - DNA, 17 bp, Homo sapiens
gtgtgagtgcatgtact

SEQ ID NO: 1765464 - DNA, 19 bp, Homo sapiens
gtgtgagtggcagccatgc

SEQ ID NO: 1765465 - DNA, 20 bp, Homo sapiens
gtgtgagtggcagccatgcc

SEQ ID NO: 1765466 - DNA, 22 bp, Homo sapiens
gtgtgatatttcagaaatacag

SEQ ID NO: 1765467 - DNA, 17 bp, Homo sapiens
gtgtgatcccaagtgcc

SEQ ID NO: 1765468 - DNA, 18 bp, Homo sapiens
gtgtgatccggtttcttt

SEQ ID NO: 1765469 - DNA, 22 bp, Homo sapiens
gtgtgattggcttaaatccagt

SEQ ID NO: 1765470 - DNA, 14 bp, Homo sapiens
gtgtgatttcctaa

SEQ ID NO: 1765471 - DNA, 17 bp, Homo sapiens
gtgtgatttcctaaaca

SEQ ID NO: 1765472 - DNA, 22 bp, Homo sapiens
gtgtgatttcctaaacataatt

SEQ ID NO: 1765473 - DNA, 16 bp, Homo sapiens
gtgtgcaacagacaag

SEQ ID NO: 1765474 - DNA, 17 bp, Homo sapiens
gtgtgcaagggcagtga

SEQ ID NO: 1765475 - DNA, 20 bp, Homo sapiens
gtgtgcacaaatatttattt

SEQ ID NO: 1765476 - DNA, 14 bp, Homo sapiens
gtgtgcacacccat

SEQ ID NO: 1765477 - DNA, 22 bp, Homo sapiens
gtgtgcacgcctgcaggctgga

SEQ ID NO: 1765478 - DNA, 23 bp, Homo sapiens
gtgtgcagacagccatgcgtggc

SEQ ID NO: 1765479 - DNA, 12 bp, Homo sapiens
gtgtgcataata

SEQ ID NO: 1765480 - DNA, 20 bp, Homo sapiens
gtgtgcatagcgtcctgccc

SEQ ID NO: 1765481 - DNA, 23 bp, Homo sapiens
gtgtgcatagcgtcctgccctgc

SEQ ID NO: 1765482 - DNA, 12 bp, Homo sapiens
gtgtgcatgtgt

SEQ ID NO: 1765483 - DNA, 20 bp, Homo sapiens
gtgtgcccagcacctggagg

SEQ ID NO: 1765484 - DNA, 18 bp, Homo sapiens
gtgtgccccactccagcc

SEQ ID NO: 1765485 - DNA, 21 bp, Homo sapiens
gtgtgccccactccagcctgg

SEQ ID NO: 1765486 - DNA, 14 bp, Homo sapiens
gtgtgcctgcagcc

SEQ ID NO: 1765487 - DNA, 18 bp, Homo sapiens
gtgtgcctgcagccccgc

SEQ ID NO: 1765488 - DNA, 20 bp, Homo sapiens
gtgtgcctgtgctcctgccc

SEQ ID NO: 1765489 - DNA, 13 bp, Homo sapiens
gtgtgcgctgcct

SEQ ID NO: 1765490 - DNA, 17 bp, Homo sapiens
gtgtgcgctgcctggcc

SEQ ID NO: 1765491 - DNA, 18 bp, Homo sapiens
gtgtgcgctgcctggcca

SEQ ID NO: 1765492 - DNA, 18 bp, Homo sapiens
gtgtgcgtgcgtgtgcgt

SEQ ID NO: 1765493 - DNA, 18 bp, Homo sapiens
gtgtgctcctctccttac

SEQ ID NO: 1765494 - DNA, 22 bp, Homo sapiens
gtgtgctctccccggcaggcct

SEQ ID NO: 1765495 - DNA, 22 bp, Homo sapiens
gtgtgctgacaacttagctcag

SEQ ID NO: 1765496 - DNA, 19 bp, Homo sapiens
gtgtgctgggagctccact

SEQ ID NO: 1765497 - DNA, 16 bp, Homo sapiens
gtgtgctttttttgtg

SEQ ID NO: 1765498 - DNA, 20 bp, Homo sapiens
gtgtggaaggcacccgccct

SEQ ID NO: 1765499 - DNA, 21 bp, Homo sapiens
gtgtggaagttattaacttta

SEQ ID NO: 1765500 - DNA, 16 bp, Homo sapiens
gtgtggactgtgatgc

SEQ ID NO: 1765501 - DNA, 23 bp, Homo sapiens
gtgtggagaagccacaggcctga

SEQ ID NO: 1765502 - DNA, 15 bp, Homo sapiens
gtgtggagcagagct

SEQ ID NO: 1765503 - DNA, 12 bp, Homo sapiens
gtgtggcagtgg

SEQ ID NO: 1765504 - DNA, 11 bp, Homo sapiens
gtgtggccagc

SEQ ID NO: 1765505 - DNA, 11 bp, Homo sapiens
gtgtggctcct

SEQ ID NO: 1765506 - DNA, 13 bp, Homo sapiens
gtgtggctcctgg

SEQ ID NO: 1765507 - DNA, 13 bp, Homo sapiens
gtgtggctgctcc

SEQ ID NO: 1765508 - DNA, 17 bp, Homo sapiens
gttcatcttgcagcatt

SEQ ID NO: 1765509 - DNA, 14 bp, Homo sapiens
gttcatgcagacaa

SEQ ID NO: 1765510 - DNA, 21 bp, Homo sapiens
gttcatgcagacaaagccctg

SEQ ID NO: 1765511 - DNA, 23 bp, Homo sapiens
gttcatgcagacaaagccctgtc

SEQ ID NO: 1765512 - DNA, 16 bp, Homo sapiens
gttcatgcagctgtgg

SEQ ID NO: 1765513 - DNA, 13 bp, Homo sapiens
gttcatgtctgaa

SEQ ID NO: 1765514 - DNA, 17 bp, Homo sapiens
gttcatgttcatatgta

SEQ ID NO: 1765515 - DNA, 18 bp, Homo sapiens
gttcatgtttgtaaatta

SEQ ID NO: 1765516 - DNA, 20 bp, Homo sapiens
gttcattaaagcatgaatgg

SEQ ID NO: 1765517 - DNA, 20 bp, Homo sapiens
gttcattcaagctatttaat

SEQ ID NO: 1765518 - DNA, 12 bp, Homo sapiens
gttcatttcatt

SEQ ID NO: 1765519 - DNA, 12 bp, Homo sapiens
gttcatttccac

SEQ ID NO: 1765520 - DNA, 21 bp, Homo sapiens
gttcatttggtgttcctggaa

SEQ ID NO: 1765521 - DNA, 15 bp, Homo sapiens
gttcatttgtttgtt

SEQ ID NO: 1765522 - DNA, 17 bp, Homo sapiens
gttcattttagtgactg

SEQ ID NO: 1765523 - DNA, 20 bp, Homo sapiens
gttcattttgagtattttta

SEQ ID NO: 1765524 - DNA, 21 bp, Homo sapiens
gttccaaagtcacaggaagaa

SEQ ID NO: 1765525 - DNA, 16 bp, Homo sapiens
gttccaacctcctgct

SEQ ID NO: 1765526 - DNA, 16 bp, Homo sapiens
gttccaagagtctaaa

SEQ ID NO: 1765527 - DNA, 22 bp, Homo sapiens
gttccacttgtttgcactgtgt

SEQ ID NO: 1765528 - DNA, 14 bp, Homo sapiens
gttccagaaagtaa

SEQ ID NO: 1765529 - DNA, 17 bp, Homo sapiens
gttccagaacagccctc

SEQ ID NO: 1765530 - DNA, 17 bp, Homo sapiens
gttccagtggcggcacg

SEQ ID NO: 1765531 - DNA, 14 bp, Homo sapiens
gttccagtttctcc

SEQ ID NO: 1765532 - DNA, 17 bp, Homo sapiens
gttccagtttctccttg

SEQ ID NO: 1765533 - DNA, 20 bp, Homo sapiens
gttccagtttctccttgaaa

SEQ ID NO: 1765534 - DNA, 20 bp, Homo sapiens
gttccatgagttatcatgaa

SEQ ID NO: 1765535 - DNA, 21 bp, Homo sapiens
gttccattgaagccgactctg

SEQ ID NO: 1765536 - DNA, 18 bp, Homo sapiens
gttccattttatgcagaa

SEQ ID NO: 1765537 - DNA, 18 bp, Homo sapiens
gttccatttttcctctgt

SEQ ID NO: 1765538 - DNA, 16 bp, Homo sapiens
gttcccaataaaagtg

SEQ ID NO: 1765539 - DNA, 13 bp, Homo sapiens
gttcccactcccg

SEQ ID NO: 1765540 - DNA, 16 bp, Homo sapiens
gttcccactcccggcc

SEQ ID NO: 1765541 - DNA, 21 bp, Homo sapiens
gttcccagatggctggaaggg

SEQ ID NO: 1765542 - DNA, 13 bp, Homo sapiens
gttcccagctccc

SEQ ID NO: 1765543 - DNA, 17 bp, Homo sapiens
gttcccatgtagccccc

SEQ ID NO: 1765544 - DNA, 19 bp, Homo sapiens
gttcccatgtagccccctg

SEQ ID NO: 1765545 - DNA, 16 bp, Homo sapiens
gttccccacacagggc

SEQ ID NO: 1765546 - DNA, 22 bp, Homo sapiens
gttccccacacagggcactgac

SEQ ID NO: 1765547 - DNA, 22 bp, Homo sapiens
gttccccatccctgtcattttt

SEQ ID NO: 1765548 - DNA, 12 bp, Homo sapiens
gttcccccagca

SEQ ID NO: 1765549 - DNA, 17 bp, Homo sapiens
gttcccctcacccaaaa

SEQ ID NO: 1765550 - DNA, 22 bp, Homo sapiens
gttcccctcctccactctcccc

SEQ ID NO: 1765551 - DNA, 17 bp, Homo sapiens
gttcccctgttcactct

SEQ ID NO: 1765552 - DNA, 18 bp, Homo sapiens
gttcccctgttcactcta

SEQ ID NO: 1765553 - DNA, 18 bp, Homo sapiens
gttcccggagcacagccc

SEQ ID NO: 1765554 - DNA, 23 bp, Homo sapiens
gttcccggagcacagccctggga

SEQ ID NO: 1765555 - DNA, 19 bp, Homo sapiens
gttcccgtttctccaccta

SEQ ID NO: 1765556 - DNA, 16 bp, Homo sapiens
gttccctagagagaat

SEQ ID NO: 1765557 - DNA, 21 bp, Homo sapiens
gttccctagagagaataaatt

SEQ ID NO: 1765558 - DNA, 22 bp, Homo sapiens
gttccctagagagaataaattg

SEQ ID NO: 1765559 - DNA, 23 bp, Homo sapiens
gttccctgagaaacccaccagcc

SEQ ID NO: 1765560 - DNA, 13 bp, Homo sapiens
gttccctgcaccc

SEQ ID NO: 1765561 - DNA, 15 bp, Homo sapiens
gttcccttcctcttc

SEQ ID NO: 1765562 - DNA, 22 bp, Homo sapiens
gttcccttgaaactttgggaaa

SEQ ID NO: 1765563 - DNA, 14 bp, Homo sapiens
gttcccttggcctc

SEQ ID NO: 1765564 - DNA, 17 bp, Homo sapiens
gttcctaacaggatgaa

SEQ ID NO: 1765565 - DNA, 20 bp, Homo sapiens
gttcctaggcattgcaggac

SEQ ID NO: 1765566 - DNA, 13 bp, Homo sapiens
gttcctcgccctg

SEQ ID NO: 1765567 - DNA, 15 bp, Homo sapiens
gttcctcgccctggg

SEQ ID NO: 1765568 - DNA, 21 bp, Homo sapiens
gttcctcggtgggccagagct

SEQ ID NO: 1765569 - DNA, 16 bp, Homo sapiens
gttcctctatactttg

SEQ ID NO: 1765570 - DNA, 22 bp, Homo sapiens
gttcctctatactttgttctgt

SEQ ID NO: 1765571 - DNA, 16 bp, Homo sapiens
gttcctgatgacccag

SEQ ID NO: 1765572 - DNA, 16 bp, Homo sapiens
gttcctgctgtatttc

SEQ ID NO: 1765573 - DNA, 17 bp, Homo sapiens
gttcctgctgtcctggt

SEQ ID NO: 1765574 - DNA, 18 bp, Homo sapiens
gttcctggaagcaggtgc

SEQ ID NO: 1765575 - DNA, 17 bp, Homo sapiens
gttcctggccttctgaa

SEQ ID NO: 1765576 - DNA, 21 bp, Homo sapiens
gttcctggctgatgatccaga

SEQ ID NO: 1765577 - DNA, 18 bp, Homo sapiens
gttcctgtactactgcct

SEQ ID NO: 1765578 - DNA, 20 bp, Homo sapiens
gttcctgtactactgccttg

SEQ ID NO: 1765579 - DNA, 14 bp, Homo sapiens
gttccttctctggg

SEQ ID NO: 1765580 - DNA, 23 bp, Homo sapiens
gttccttgatctgtatatacaat

SEQ ID NO: 1765581 - DNA, 15 bp, Homo sapiens
gttccttgccttaat

SEQ ID NO: 1765582 - DNA, 16 bp, Homo sapiens
gttccttgctagccct

SEQ ID NO: 1765583 - DNA, 12 bp, Homo sapiens
gttcctttttca

SEQ ID NO: 1765584 - DNA, 18 bp, Homo sapiens
gttcgagaccagcctggc

SEQ ID NO: 1765585 - DNA, 21 bp, Homo sapiens
gttcgatgcctgcatgctgaa

SEQ ID NO: 1765586 - DNA, 18 bp, Homo sapiens
gttcggatttggggtgga

SEQ ID NO: 1765587 - DNA, 17 bp, Homo sapiens
gttcgtttccatcatgt

SEQ ID NO: 1765588 - DNA, 19 bp, Homo sapiens
gttctaaaaattgtgatca

SEQ ID NO: 1765589 - DNA, 20 bp, Homo sapiens
gttctaaagatggaaaaacc

SEQ ID NO: 1765590 - DNA, 10 bp, Homo sapiens
gttctaaagc

SEQ ID NO: 1765591 - DNA, 12 bp, Homo sapiens
gttctaaagctc

SEQ ID NO: 1765592 - DNA, 16 bp, Homo sapiens
gttctaaagctctgac

SEQ ID NO: 1765593 - DNA, 16 bp, Homo sapiens
gttctaaagttctaag

SEQ ID NO: 1765594 - DNA, 17 bp, Homo sapiens
gttctaaagttctaaga

SEQ ID NO: 1765595 - DNA, 15 bp, Homo sapiens
gttctaagactcaaa

SEQ ID NO: 1765596 - DNA, 20 bp, Homo sapiens
gttctaagactcaaatgttc

SEQ ID NO: 1765597 - DNA, 13 bp, Homo sapiens
gttctaagatgtg

SEQ ID NO: 1765598 - DNA, 15 bp, Homo sapiens
gttctaagattctaa

SEQ ID NO: 1765599 - DNA, 20 bp, Homo sapiens
gttctaagattctaatgatg

SEQ ID NO: 1765600 - DNA, 22 bp, Homo sapiens
gttctaaggcctaggattctaa

SEQ ID NO: 1765601 - DNA, 23 bp, Homo sapiens
gttctaaggcctaggattctaaa

SEQ ID NO: 1765602 - DNA, 12 bp, Homo sapiens
gttctaaggctc

SEQ ID NO: 1765603 - DNA, 16 bp, Homo sapiens
gttctaaggctctgag

SEQ ID NO: 1765604 - DNA, 22 bp, Homo sapiens
gttctaagtttctaagattcta

SEQ ID NO: 1765605 - DNA, 17 bp, Homo sapiens
gttctaccaggcaaatt

SEQ ID NO: 1765606 - DNA, 19 bp, Homo sapiens
gttctaccgtggatttgta

SEQ ID NO: 1765607 - DNA, 20 bp, Homo sapiens
gttctaccgtggatttgtac

SEQ ID NO: 1765608 - DNA, 17 bp, Homo sapiens
gttctagacgcccctcc

SEQ ID NO: 1765609 - DNA, 18 bp, Homo sapiens
gttctagcatggcatatt

SEQ ID NO: 1765610 - DNA, 14 bp, Homo sapiens
gttctaggtttcaa

SEQ ID NO: 1765611 - DNA, 16 bp, Homo sapiens
gttctaggtttcaaag

SEQ ID NO: 1765612 - DNA, 22 bp, Homo sapiens
gttctaggtttcaaagatgctg

SEQ ID NO: 1765613 - DNA, 14 bp, Homo sapiens
gttctagtctcctt

SEQ ID NO: 1765614 - DNA, 21 bp, Homo sapiens
gttctagtctcctttgcactg

SEQ ID NO: 1765615 - DNA, 15 bp, Homo sapiens
gttctagtttgcatt

SEQ ID NO: 1765616 - DNA, 20 bp, Homo sapiens
gttctatccttttgcctgca

SEQ ID NO: 1765617 - DNA, 23 bp, Homo sapiens
gttctatgctaaactgtgaaaaa

SEQ ID NO: 1765618 - DNA, 22 bp, Homo sapiens
gttctattaatcacctctctgt

SEQ ID NO: 1765619 - DNA, 23 bp, Homo sapiens
gttctatttaacaactgggtcat

SEQ ID NO: 1765620 - DNA, 22 bp, Homo sapiens
gttctatttgctttaatgagaa

SEQ ID NO: 1765621 - DNA, 18 bp, Homo sapiens
gttctattttactgtctt

SEQ ID NO: 1765622 - DNA, 19 bp, Homo sapiens
gtttcaaagatgctgtgag

SEQ ID NO: 1765623 - DNA, 20 bp, Homo sapiens
gtttcaaagatgctgtgagt

SEQ ID NO: 1765624 - DNA, 14 bp, Homo sapiens
gtttcaaagtgata

SEQ ID NO: 1765625 - DNA, 14 bp, Homo sapiens
gtttcacagaaaat

SEQ ID NO: 1765626 - DNA, 19 bp, Homo sapiens
gtttcaccagtgttttacc

SEQ ID NO: 1765627 - DNA, 18 bp, Homo sapiens
gtttcactgtactgcatg

SEQ ID NO: 1765628 - DNA, 12 bp, Homo sapiens
gtttcagacagg

SEQ ID NO: 1765629 - DNA, 18 bp, Homo sapiens
gtttcagcgactccgttg

SEQ ID NO: 1765630 - DNA, 10 bp, Homo sapiens
gtttcagttg

SEQ ID NO: 1765631 - DNA, 15 bp, Homo sapiens
gtttcagtttgttgg

SEQ ID NO: 1765632 - DNA, 21 bp, Homo sapiens
gtttcagtttgttggaaagta

SEQ ID NO: 1765633 - DNA, 22 bp, Homo sapiens
gtttcataatgcagaagtattc

SEQ ID NO: 1765634 - DNA, 17 bp, Homo sapiens
gtttcatgttagttacc

SEQ ID NO: 1765635 - DNA, 11 bp, Homo sapiens
gtttcattgac

SEQ ID NO: 1765636 - DNA, 20 bp, Homo sapiens
gtttccaacttgtctgggaa

SEQ ID NO: 1765637 - DNA, 19 bp, Homo sapiens
gtttccagacttccttgag

SEQ ID NO: 1765638 - DNA, 17 bp, Homo sapiens
gtttccagagtttgtca

SEQ ID NO: 1765639 - DNA, 13 bp, Homo sapiens
gtttccagctgcc

SEQ ID NO: 1765640 - DNA, 14 bp, Homo sapiens
gtttccagctgcca

SEQ ID NO: 1765641 - DNA, 16 bp, Homo sapiens
gtttccagcttgcatt

SEQ ID NO: 1765642 - DNA, 20 bp, Homo sapiens
gtttcccataattttcttca

SEQ ID NO: 1765643 - DNA, 21 bp, Homo sapiens
gtttcccataattttcttcat

SEQ ID NO: 1765644 - DNA, 21 bp, Homo sapiens
gtttcccctagcttactgata

SEQ ID NO: 1765645 - DNA, 19 bp, Homo sapiens
gtttcccggttcaggacca

SEQ ID NO: 1765646 - DNA, 18 bp, Homo sapiens
gtttcccttgctttgttt

SEQ ID NO: 1765647 - DNA, 16 bp, Homo sapiens
gtttccgcccccgccc

SEQ ID NO: 1765648 - DNA, 20 bp, Homo sapiens
gtttcctatgacattactgt

SEQ ID NO: 1765649 - DNA, 20 bp, Homo sapiens
gtttcctcattcctgaaaga

SEQ ID NO: 1765650 - DNA, 22 bp, Homo sapiens
gtttcctctagttctttgttca

SEQ ID NO: 1765651 - DNA, 13 bp, Homo sapiens
gtttccttttgga

SEQ ID NO: 1765652 - DNA, 15 bp, Homo sapiens
gtttcgactggtcca

SEQ ID NO: 1765653 - DNA, 15 bp, Homo sapiens
gtttcgtggggaggt

SEQ ID NO: 1765654 - DNA, 15 bp, Homo sapiens
gtttcgttatattaa

SEQ ID NO: 1765655 - DNA, 17 bp, Homo sapiens
gtttctaagattctaaa

SEQ ID NO: 1765656 - DNA, 19 bp, Homo sapiens
gtttctaagattctaaagg

SEQ ID NO: 1765657 - DNA, 21 bp, Homo sapiens
gtttctaagattctaaaggtc

SEQ ID NO: 1765658 - DNA, 15 bp, Homo sapiens
gtttctacattcaga

SEQ ID NO: 1765659 - DNA, 15 bp, Homo sapiens
gtttctagaggcctc

SEQ ID NO: 1765660 - DNA, 23 bp, Homo sapiens
gtttctagctagaaatatgattt

SEQ ID NO: 1765661 - DNA, 19 bp, Homo sapiens
gtttctatactgtttgtaa

SEQ ID NO: 1765662 - DNA, 16 bp, Homo sapiens
gtttctattctgtcag

SEQ ID NO: 1765663 - DNA, 21 bp, Homo sapiens
gtttctcaaaagaggttactt

SEQ ID NO: 1765664 - DNA, 13 bp, Homo sapiens
gtttctcaaatct

SEQ ID NO: 1765665 - DNA, 16 bp, Homo sapiens
gtttctcaaatctgct

SEQ ID NO: 1765666 - DNA, 16 bp, Homo sapiens
gtttctcagaatccaa

SEQ ID NO: 1765667 - DNA, 20 bp, Homo sapiens
gtttctcagaatccaaagat

SEQ ID NO: 1765668 - DNA, 15 bp, Homo sapiens
gtttctcattaaagt

SEQ ID NO: 1765669 - DNA, 15 bp, Homo sapiens
gtttctccccctggg

SEQ ID NO: 1765670 - DNA, 14 bp, Homo sapiens
gtttctccttttcc

SEQ ID NO: 1765671 - DNA, 15 bp, Homo sapiens
gtttctccttttcct

SEQ ID NO: 1765672 - DNA, 23 bp, Homo sapiens
gtttctctgccgctacctccctc

SEQ ID NO: 1765673 - DNA, 17 bp, Homo sapiens
gtttctctgtgctctga

SEQ ID NO: 1765674 - DNA, 18 bp, Homo sapiens
gtttctcttgagctggcc

SEQ ID NO: 1765675 - DNA, 14 bp, Homo sapiens
gtttctctttcctt

SEQ ID NO: 1765676 - DNA, 21 bp, Homo sapiens
gtttctctttccttggctccc

SEQ ID NO: 1765677 - DNA, 19 bp, Homo sapiens
gtttctgaaaattccagaa

SEQ ID NO: 1765678 - DNA, 12 bp, Homo sapiens
gtttctgactct

SEQ ID NO: 1765679 - DNA, 22 bp, Homo sapiens
gtttctgaggctttatgataat

SEQ ID NO: 1765680 - DNA, 21 bp, Homo sapiens
gtttctgatttgctgctcttc

SEQ ID NO: 1765681 - DNA, 20 bp, Homo sapiens
gtttctggacattctctttg

SEQ ID NO: 1765682 - DNA, 20 bp, Homo sapiens
gtttctggagtgattctaga

SEQ ID NO: 1765683 - DNA, 14 bp, Homo sapiens
gtttctggatttca

SEQ ID NO: 1765684 - DNA, 18 bp, Homo sapiens
gtttctggtgccatttct

SEQ ID NO: 1765685 - DNA, 13 bp, Homo sapiens
gtttctgtctgta

SEQ ID NO: 1765686 - DNA, 17 bp, Homo sapiens
gtttcttaagggcacac

SEQ ID NO: 1765687 - DNA, 18 bp, Homo sapiens
gtttcttcaagagctgag

SEQ ID NO: 1765688 - DNA, 12 bp, Homo sapiens
gtttcttcattt

SEQ ID NO: 1765689 - DNA, 18 bp, Homo sapiens
gtttcttcatttctctgc

SEQ ID NO: 1765690 - DNA, 14 bp, Homo sapiens
gtttcttcctttct

SEQ ID NO: 1765691 - DNA, 13 bp, Homo sapiens
gtttcttcttgtg

SEQ ID NO: 1765692 - DNA, 19 bp, Homo sapiens
gtttcttgcttggaagcca

SEQ ID NO: 1765693 - DNA, 14 bp, Homo sapiens
gtttctttacttct

SEQ ID NO: 1765694 - DNA, 23 bp, Homo sapiens
gtttcttttcacattaggctgtt

SEQ ID NO: 1765695 - DNA, 14 bp, Homo sapiens
gtttcttttgtttg

SEQ ID NO: 1765696 - DNA, 18 bp, Homo sapiens
gtttcttttgtttggtaa

SEQ ID NO: 1765697 - DNA, 15 bp, Homo sapiens
gtttctttttacagc

SEQ ID NO: 1765698 - DNA, 15 bp, Homo sapiens
gtttgaaagattatg

SEQ ID NO: 1765699 - DNA, 21 bp, Homo sapiens
gtttgaacacgaaagaaatgt

SEQ ID NO: 1765700 - DNA, 17 bp, Homo sapiens
gtttgaaggaaacagtt

SEQ ID NO: 1765701 - DNA, 14 bp, Homo sapiens
gtttgaattaggct

SEQ ID NO: 1765702 - DNA, 13 bp, Homo sapiens
gtttgacctcaca

SEQ ID NO: 1765703 - DNA, 21 bp, Homo sapiens
gtttgacctcacagtgaccct

SEQ ID NO: 1765704 - DNA, 15 bp, Homo sapiens
gtttgagaccagcct

SEQ ID NO: 1765705 - DNA, 16 bp, Homo sapiens
gtttgagaccaggctg

SEQ ID NO: 1765706 - DNA, 13 bp, Homo sapiens
gtttgagctcaga

SEQ ID NO: 1765707 - DNA, 18 bp, Homo sapiens
gtttgagctgccttccct

SEQ ID NO: 1765708 - DNA, 14 bp, Homo sapiens
gtttgattattatg

SEQ ID NO: 1765709 - DNA, 15 bp, Homo sapiens
gtttgcaccgcctgc

SEQ ID NO: 1765710 - DNA, 15 bp, Homo sapiens
gtttgcacctgtccc

SEQ ID NO: 1765711 - DNA, 17 bp, Homo sapiens
gtttgcactcaaatctt

SEQ ID NO: 1765712 - DNA, 20 bp, Homo sapiens
gtttgcactccacacatctt

SEQ ID NO: 1765713 - DNA, 22 bp, Homo sapiens
gtttgcactgtatgctggacgg

SEQ ID NO: 1765714 - DNA, 15 bp, Homo sapiens
gtttgcacttcctct

SEQ ID NO: 1765715 - DNA, 14 bp, Homo sapiens
gtttgccatacttt

SEQ ID NO: 1765716 - DNA, 22 bp, Homo sapiens
gtttgccatactttgtctgaaa

SEQ ID NO: 1765717 - DNA, 12 bp, Homo sapiens
gtttgcctgtga

SEQ ID NO: 1765718 - DNA, 21 bp, Homo sapiens
gtttgctcaaaattgcttcta

SEQ ID NO: 1765719 - DNA, 12 bp, Homo sapiens
gtttgctgctat

SEQ ID NO: 1765720 - DNA, 20 bp, Homo sapiens
gtttgctttgtatgcacttt

SEQ ID NO: 1765721 - DNA, 20 bp, Homo sapiens
gtttggaaaaaactctgaag

SEQ ID NO: 1765722 - DNA, 21 bp, Homo sapiens
gtttggaaaccacagtcagtg

SEQ ID NO: 1765723 - DNA, 16 bp, Homo sapiens
gtttggaatattaaaa

SEQ ID NO: 1765724 - DNA, 18 bp, Homo sapiens
gtttggaccccagctggg

SEQ ID NO: 1765725 - DNA, 14 bp, Homo sapiens
gtttggactgattt

SEQ ID NO: 1765726 - DNA, 15 bp, Homo sapiens
gtttggaggcccctg

SEQ ID NO: 1765727 - DNA, 20 bp, Homo sapiens
gtttggatgggagtgagaca

SEQ ID NO: 1765728 - DNA, 18 bp, Homo sapiens
gtttggattcttatgtag

SEQ ID NO: 1765729 - DNA, 11 bp, Homo sapiens
gtttggccctg

SEQ ID NO: 1765730 - DNA, 15 bp, Homo sapiens
gtttggccctggagc

SEQ ID NO: 1765731 - DNA, 19 bp, Homo sapiens
gtttggccctggagccagg

SEQ ID NO: 1765732 - DNA, 17 bp, Homo sapiens
gtttggctataagtgct

SEQ ID NO: 1765733 - DNA, 16 bp, Homo sapiens
gtttggcttcctcctg

SEQ ID NO: 1765734 - DNA, 23 bp, Homo sapiens
gtttgggaagagcttagaaactg

SEQ ID NO: 1765735 - DNA, 14 bp, Homo sapiens
gtttggggagaaat

SEQ ID NO: 1765736 - DNA, 15 bp, Homo sapiens
gtttggggagcagag

SEQ ID NO: 1765737 - DNA, 22 bp, Homo sapiens
taaaatggaaaattttctcctt

SEQ ID NO: 1765738 - DNA, 14 bp, Homo sapiens
taaaatgtacatgt

SEQ ID NO: 1765739 - DNA, 15 bp, Homo sapiens
taaaatgtacatgta

SEQ ID NO: 1765740 - DNA, 18 bp, Homo sapiens
taaaatgtgggattatgg

SEQ ID NO: 1765741 - DNA, 17 bp, Homo sapiens
taaaatgtgtacagtga

SEQ ID NO: 1765742 - DNA, 17 bp, Homo sapiens
taaaatgtgtatttttc

SEQ ID NO: 1765743 - DNA, 20 bp, Homo sapiens
taaaatgtgtatttttcaag

SEQ ID NO: 1765744 - DNA, 17 bp, Homo sapiens
taaaatgtttactgtaa

SEQ ID NO: 1765745 - DNA, 12 bp, Homo sapiens
taaaatgtttca

SEQ ID NO: 1765746 - DNA, 22 bp, Homo sapiens
taaaatgtttcattatgcactt

SEQ ID NO: 1765747 - DNA, 14 bp, Homo sapiens
taaaattaacaaat

SEQ ID NO: 1765748 - DNA, 14 bp, Homo sapiens
taaaattaagttga

SEQ ID NO: 1765749 - DNA, 17 bp, Homo sapiens
taaaattaagttgaaaa

SEQ ID NO: 1765750 - DNA, 15 bp, Homo sapiens
taaaattaatgcaga

SEQ ID NO: 1765751 - DNA, 13 bp, Homo sapiens
taaaattagtctt

SEQ ID NO: 1765752 - DNA, 18 bp, Homo sapiens
taaaattatatagctgct

SEQ ID NO: 1765753 - DNA, 22 bp, Homo sapiens
taaaattatgagattggttttc

SEQ ID NO: 1765754 - DNA, 18 bp, Homo sapiens
taaaattcaaaagtattg

SEQ ID NO: 1765755 - DNA, 18 bp, Homo sapiens
taaaattcaacaaatgat

SEQ ID NO: 1765756 - DNA, 17 bp, Homo sapiens
taaaattcgctttctaa

SEQ ID NO: 1765757 - DNA, 21 bp, Homo sapiens
taaaattctagtctctgattt

SEQ ID NO: 1765758 - DNA, 22 bp, Homo sapiens
taaaattctgatgtttctgtga

SEQ ID NO: 1765759 - DNA, 23 bp, Homo sapiens
taaaattctgatgtttctgtgaa

SEQ ID NO: 1765760 - DNA, 23 bp, Homo sapiens
taaaattgagtttgtagaacttt

SEQ ID NO: 1765761 - DNA, 16 bp, Homo sapiens
taaaattgatattata

SEQ ID NO: 1765762 - DNA, 14 bp, Homo sapiens
taaaattgcacttt

SEQ ID NO: 1765763 - DNA, 23 bp, Homo sapiens
taaaattgctatgttactatttt

SEQ ID NO: 1765764 - DNA, 16 bp, Homo sapiens
taaaattgtgatgtgt

SEQ ID NO: 1765765 - DNA, 15 bp, Homo sapiens
taaaattgttcctga

SEQ ID NO: 1765766 - DNA, 14 bp, Homo sapiens
taaaatttaaaatt

SEQ ID NO: 1765767 - DNA, 17 bp, Homo sapiens
taaaatttaagtatctt

SEQ ID NO: 1765768 - DNA, 14 bp, Homo sapiens
taaaatttacattt

SEQ ID NO: 1765769 - DNA, 16 bp, Homo sapiens
taaaatttatttatat

SEQ ID NO: 1765770 - DNA, 23 bp, Homo sapiens
taaaatttcgttgtccaatttgt

SEQ ID NO: 1765771 - DNA, 21 bp, Homo sapiens
taaaatttgtaatatttttgt

SEQ ID NO: 1765772 - DNA, 19 bp, Homo sapiens
taaaattttgcttttaatt

SEQ ID NO: 1765773 - DNA, 19 bp, Homo sapiens
taaaattttgtatgttaaa

SEQ ID NO: 1765774 - DNA, 23 bp, Homo sapiens
taaacaaagtttcagagtatatt

SEQ ID NO: 1765775 - DNA, 12 bp, Homo sapiens
taaacaaatgat

SEQ ID NO: 1765776 - DNA, 15 bp, Homo sapiens
taaacaaatgatttc

SEQ ID NO: 1765777 - DNA, 17 bp, Homo sapiens
taaacaaattcatattc

SEQ ID NO: 1765778 - DNA, 22 bp, Homo sapiens
taaacaaattcatattctgtct

SEQ ID NO: 1765779 - DNA, 18 bp, Homo sapiens
taaacaagtaagaaaaat

SEQ ID NO: 1765780 - DNA, 21 bp, Homo sapiens
taaacaataaaaacaactttc

SEQ ID NO: 1765781 - DNA, 23 bp, Homo sapiens
taaacaatgaagtgaaaaagttt

SEQ ID NO: 1765782 - DNA, 15 bp, Homo sapiens
taaacaatgtataaa

SEQ ID NO: 1765783 - DNA, 20 bp, Homo sapiens
taaacaatgtataaagattg

SEQ ID NO: 1765784 - DNA, 18 bp, Homo sapiens
taaacacaagaaggaatc

SEQ ID NO: 1765785 - DNA, 18 bp, Homo sapiens
taaacacacagatacaca

SEQ ID NO: 1765786 - DNA, 17 bp, Homo sapiens
taaacacagggaaagca

SEQ ID NO: 1765787 - DNA, 18 bp, Homo sapiens
taaacacccttcacatac

SEQ ID NO: 1765788 - DNA, 15 bp, Homo sapiens
taaacacgtgtctat

SEQ ID NO: 1765789 - DNA, 16 bp, Homo sapiens
taaacacgtgtctata

SEQ ID NO: 1765790 - DNA, 16 bp, Homo sapiens
taaacactacacattt

SEQ ID NO: 1765791 - DNA, 20 bp, Homo sapiens
taaacactacacatttgaaa

SEQ ID NO: 1765792 - DNA, 16 bp, Homo sapiens
taaacactcaccttct

SEQ ID NO: 1765793 - DNA, 16 bp, Homo sapiens
taaacactgtaatctt

SEQ ID NO: 1765794 - DNA, 14 bp, Homo sapiens
taaacactgtttta

SEQ ID NO: 1765795 - DNA, 22 bp, Homo sapiens
taaacacttatcttctggatta

SEQ ID NO: 1765796 - DNA, 12 bp, Homo sapiens
taaacagaagca

SEQ ID NO: 1765797 - DNA, 16 bp, Homo sapiens
taaacagacaaaaaca

SEQ ID NO: 1765798 - DNA, 16 bp, Homo sapiens
taaacagactgttaat

SEQ ID NO: 1765799 - DNA, 18 bp, Homo sapiens
taaacagcaactacagaa

SEQ ID NO: 1765800 - DNA, 17 bp, Homo sapiens
taaacagcacacctgtg

SEQ ID NO: 1765801 - DNA, 18 bp, Homo sapiens
taaacagcacacctgtgt

SEQ ID NO: 1765802 - DNA, 21 bp, Homo sapiens
taaacagcacacctgtgtcca

SEQ ID NO: 1765803 - DNA, 17 bp, Homo sapiens
taaacaggaattttatt

SEQ ID NO: 1765804 - DNA, 22 bp, Homo sapiens
taaacaggaattttattttgct

SEQ ID NO: 1765805 - DNA, 13 bp, Homo sapiens
taaacaggcccag

SEQ ID NO: 1765806 - DNA, 15 bp, Homo sapiens
taaacaggcccagca

SEQ ID NO: 1765807 - DNA, 21 bp, Homo sapiens
taaacaggtatttttttaaat

SEQ ID NO: 1765808 - DNA, 22 bp, Homo sapiens
taaacaggtatttttttaaatc

SEQ ID NO: 1765809 - DNA, 17 bp, Homo sapiens
taaacagtaagatatct

SEQ ID NO: 1765810 - DNA, 16 bp, Homo sapiens
taaacagtatattctt

SEQ ID NO: 1765811 - DNA, 13 bp, Homo sapiens
taaacagtgcctg

SEQ ID NO: 1765812 - DNA, 13 bp, Homo sapiens
taaacataattgt

SEQ ID NO: 1765813 - DNA, 14 bp, Homo sapiens
taaacataattgtg

SEQ ID NO: 1765814 - DNA, 17 bp, Homo sapiens
taaacataattgtggat

SEQ ID NO: 1765815 - DNA, 23 bp, Homo sapiens
taaacataattgtggattataaa

SEQ ID NO: 1765816 - DNA, 18 bp, Homo sapiens
taaacatcagcaagactt

SEQ ID NO: 1765817 - DNA, 15 bp, Homo sapiens
taaacatcagtttct

SEQ ID NO: 1765818 - DNA, 17 bp, Homo sapiens
taaacatccttcaagaa

SEQ ID NO: 1765819 - DNA, 19 bp, Homo sapiens
taaacattaagtaaatgct

SEQ ID NO: 1765820 - DNA, 18 bp, Homo sapiens
taaacattgaagtaatga

SEQ ID NO: 1765821 - DNA, 12 bp, Homo sapiens
taaacatttttt

SEQ ID NO: 1765822 - DNA, 17 bp, Homo sapiens
taaacattttttaagaa

SEQ ID NO: 1765823 - DNA, 17 bp, Homo sapiens
taaacattttttcttca

SEQ ID NO: 1765824 - DNA, 15 bp, Homo sapiens
taaaccaaggactga

SEQ ID NO: 1765825 - DNA, 17 bp, Homo sapiens
taaaccaaggactgagc

SEQ ID NO: 1765826 - DNA, 20 bp, Homo sapiens
taaaccactgaaaaaatata

SEQ ID NO: 1765827 - DNA, 22 bp, Homo sapiens
taaaccatttttgctgaattca

SEQ ID NO: 1765828 - DNA, 17 bp, Homo sapiens
taaacccagatggtttc

SEQ ID NO: 1765829 - DNA, 17 bp, Homo sapiens
taaacccatacaatgta

SEQ ID NO: 1765830 - DNA, 23 bp, Homo sapiens
taaacccatattgtaaaacaggt

SEQ ID NO: 1765831 - DNA, 11 bp, Homo sapiens
taaacctacct

SEQ ID NO: 1765832 - DNA, 21 bp, Homo sapiens
taaacctaggacttccgagct

SEQ ID NO: 1765833 - DNA, 13 bp, Homo sapiens
taaacctcctgcc

SEQ ID NO: 1765834 - DNA, 13 bp, Homo sapiens
taaacctgaggca

SEQ ID NO: 1765835 - DNA, 14 bp, Homo sapiens
taaacctgaggcag

SEQ ID NO: 1765836 - DNA, 15 bp, Homo sapiens
taaacctgaggcagg

SEQ ID NO: 1765837 - DNA, 16 bp, Homo sapiens
taaacgaccaaactca

SEQ ID NO: 1765838 - DNA, 22 bp, Homo sapiens
taaacggtttttattaaagatg

SEQ ID NO: 1765839 - DNA, 17 bp, Homo sapiens
taaacgtgatgatcagc

SEQ ID NO: 1765840 - DNA, 17 bp, Homo sapiens
taaacgtgcagactatg

SEQ ID NO: 1765841 - DNA, 19 bp, Homo sapiens
taaacgtggtcaccttcga

SEQ ID NO: 1765842 - DNA, 14 bp, Homo sapiens
taaactaaatgtgc

SEQ ID NO: 1765843 - DNA, 14 bp, Homo sapiens
taaactaagagaaa

SEQ ID NO: 1765844 - DNA, 16 bp, Homo sapiens
taaactaagagaaact

SEQ ID NO: 1765845 - DNA, 23 bp, Homo sapiens
taaactaatacgtgccagatata

SEQ ID NO: 1765846 - DNA, 19 bp, Homo sapiens
taaactacaaagtaaaatg

SEQ ID NO: 1765847 - DNA, 13 bp, Homo sapiens
taaactagtttcc

SEQ ID NO: 1765848 - DNA, 14 bp, Homo sapiens
taaactagtttcca

SEQ ID NO: 1765849 - DNA, 23 bp, Homo sapiens
taaactatttatatcacacaata

SEQ ID NO: 1765850 - DNA, 21 bp, Homo sapiens
taaactcaaaatatttgtaca

SEQ ID NO: 1765851 - DNA, 18 bp, Homo sapiens
taaactcagatctgatca

SEQ ID NO: 1765852 - DNA, 16 bp, Homo sapiens
taaatctttttgcttc

SEQ ID NO: 1765853 - DNA, 18 bp, Homo sapiens
taaatctttttgcttcta

SEQ ID NO: 1765854 - DNA, 24 bp, Homo sapiens
taaatctttttgcttctactttca

SEQ ID NO: 1765855 - DNA, 22 bp, Homo sapiens
taaatgaaagaaaattgagttg

SEQ ID NO: 1765856 - DNA, 22 bp, Homo sapiens
taaatgaagcagctttaaacaa

SEQ ID NO: 1765857 - DNA, 14 bp, Homo sapiens
taaatgagctgttg

SEQ ID NO: 1765858 - DNA, 13 bp, Homo sapiens
taaatgagctttc

SEQ ID NO: 1765859 - DNA, 16 bp, Homo sapiens
taaatgcagttacaaa

SEQ ID NO: 1765860 - DNA, 17 bp, Homo sapiens
taaatgcagttacaaat

SEQ ID NO: 1765861 - DNA, 21 bp, Homo sapiens
taaatgcagttacaaattata

SEQ ID NO: 1765862 - DNA, 18 bp, Homo sapiens
taaatgcagttttaagaa

SEQ ID NO: 1765863 - DNA, 15 bp, Homo sapiens
taaatgcataattta

SEQ ID NO: 1765864 - DNA, 21 bp, Homo sapiens
taaatgcatatcctgagccat

SEQ ID NO: 1765865 - DNA, 16 bp, Homo sapiens
taaatgcatattaaat

SEQ ID NO: 1765866 - DNA, 14 bp, Homo sapiens
taaatgccagagcc

SEQ ID NO: 1765867 - DNA, 15 bp, Homo sapiens
taaatgccatagaaa

SEQ ID NO: 1765868 - DNA, 22 bp, Homo sapiens
taaatgccctcttctcgtgcct

SEQ ID NO: 1765869 - DNA, 17 bp, Homo sapiens
taaatgcctcttaaatt

SEQ ID NO: 1765870 - DNA, 21 bp, Homo sapiens
taaatgcctcttaaattatat

SEQ ID NO: 1765871 - DNA, 23 bp, Homo sapiens
taaatgccttgcttgtatgatcg

SEQ ID NO: 1765872 - DNA, 14 bp, Homo sapiens
taaatgccttgtat

SEQ ID NO: 1765873 - DNA, 23 bp, Homo sapiens
taaatgctctaactggacatgaa

SEQ ID NO: 1765874 - DNA, 16 bp, Homo sapiens
taaatgcttttctaat

SEQ ID NO: 1765875 - DNA, 21 bp, Homo sapiens
taaatggattaattactaatt

SEQ ID NO: 1765876 - DNA, 12 bp, Homo sapiens
taaatggcctca

SEQ ID NO: 1765877 - DNA, 19 bp, Homo sapiens
taaatggcttcttctagaa

SEQ ID NO: 1765878 - DNA, 22 bp, Homo sapiens
taaatgggactggagtccctgt

SEQ ID NO: 1765879 - DNA, 14 bp, Homo sapiens
taaatggggcccat

SEQ ID NO: 1765880 - DNA, 17 bp, Homo sapiens
taaatggggctcacaaa

SEQ ID NO: 1765881 - DNA, 22 bp, Homo sapiens
taaatgggtcatgacaagatgg

SEQ ID NO: 1765882 - DNA, 19 bp, Homo sapiens
taaatggtaataagcactg

SEQ ID NO: 1765883 - DNA, 17 bp, Homo sapiens
taaatggtcgcccagga

SEQ ID NO: 1765884 - DNA, 17 bp, Homo sapiens
taaatgtaaaatttgga

SEQ ID NO: 1765885 - DNA, 17 bp, Homo sapiens
taaatgtacctgatgta

SEQ ID NO: 1765886 - DNA, 12 bp, Homo sapiens
taaatgtactgg

SEQ ID NO: 1765887 - DNA, 14 bp, Homo sapiens
taaatgtactggta

SEQ ID NO: 1765888 - DNA, 19 bp, Homo sapiens
taaatgtagacagatattt

SEQ ID NO: 1765889 - DNA, 19 bp, Homo sapiens
taaatgtataaatatacag

SEQ ID NO: 1765890 - DNA, 20 bp, Homo sapiens
taaatgtattttaaaataaa

SEQ ID NO: 1765891 - DNA, 19 bp, Homo sapiens
taaatgtgcaatagaaggt

SEQ ID NO: 1765892 - DNA, 22 bp, Homo sapiens
taaatgtgcaatagaaggtgat

SEQ ID NO: 1765893 - DNA, 16 bp, Homo sapiens
taaatgttacctctga

SEQ ID NO: 1765894 - DNA, 15 bp, Homo sapiens
taaatgttattactt

SEQ ID NO: 1765895 - DNA, 15 bp, Homo sapiens
taaatgttgaaagat

SEQ ID NO: 1765896 - DNA, 20 bp, Homo sapiens
taaatgttgaaagatcaaaa

SEQ ID NO: 1765897 - DNA, 13 bp, Homo sapiens
taaatgtttaaca

SEQ ID NO: 1765898 - DNA, 21 bp, Homo sapiens
taaatgtttcttttaaagacc

SEQ ID NO: 1765899 - DNA, 13 bp, Homo sapiens
taaatgtttgtta

SEQ ID NO: 1765900 - DNA, 15 bp, Homo sapiens
taaattaaacatttt

SEQ ID NO: 1765901 - DNA, 21 bp, Homo sapiens
taaattaactcaccagattta

SEQ ID NO: 1765902 - DNA, 17 bp, Homo sapiens
taaattaattgaatcta

SEQ ID NO: 1765903 - DNA, 13 bp, Homo sapiens
taaattacaattt

SEQ ID NO: 1765904 - DNA, 14 bp, Homo sapiens
taaattacaatttt

SEQ ID NO: 1765905 - DNA, 21 bp, Homo sapiens
taaattacagtaatcccattt

SEQ ID NO: 1765906 - DNA, 15 bp, Homo sapiens
taaattacatttgta

SEQ ID NO: 1765907 - DNA, 21 bp, Homo sapiens
taaattactatctgttgaaaa

SEQ ID NO: 1765908 - DNA, 11 bp, Homo sapiens
taaattagaat

SEQ ID NO: 1765909 - DNA, 20 bp, Homo sapiens
taaattagaatgaatttatc

SEQ ID NO: 1765910 - DNA, 21 bp, Homo sapiens
taaattaggaataaataaaaa

SEQ ID NO: 1765911 - DNA, 14 bp, Homo sapiens
taaattatatattt

SEQ ID NO: 1765912 - DNA, 14 bp, Homo sapiens
taaattatggcatt

SEQ ID NO: 1765913 - DNA, 18 bp, Homo sapiens
taaattatggcatttcta

SEQ ID NO: 1765914 - DNA, 19 bp, Homo sapiens
taaattatgtaatgcaaaa

SEQ ID NO: 1765915 - DNA, 16 bp, Homo sapiens
taaattattagcattt

SEQ ID NO: 1765916 - DNA, 13 bp, Homo sapiens
taaattatttatg

SEQ ID NO: 1765917 - DNA, 20 bp, Homo sapiens
taaattcaaccactgtaaaa

SEQ ID NO: 1765918 - DNA, 16 bp, Homo sapiens
taaattcaactttgta

SEQ ID NO: 1765919 - DNA, 17 bp, Homo sapiens
taaattcacaatagaaa

SEQ ID NO: 1765920 - DNA, 10 bp, Homo sapiens
taaattcaga

SEQ ID NO: 1765921 - DNA, 15 bp, Homo sapiens
taaattcagacaaca

SEQ ID NO: 1765922 - DNA, 20 bp, Homo sapiens
taaattcagatatatttttc

SEQ ID NO: 1765923 - DNA, 16 bp, Homo sapiens
taaattcatttctaga

SEQ ID NO: 1765924 - DNA, 21 bp, Homo sapiens
taaattcatttctagactcaa

SEQ ID NO: 1765925 - DNA, 14 bp, Homo sapiens
taaattcttactct

SEQ ID NO: 1765926 - DNA, 13 bp, Homo sapiens
taaattgattttt

SEQ ID NO: 1765927 - DNA, 21 bp, Homo sapiens
taaattgatttttataaatac

SEQ ID NO: 1765928 - DNA, 22 bp, Homo sapiens
taaattgatttttataaatact

SEQ ID NO: 1765929 - DNA, 19 bp, Homo sapiens
taaattgcatcactgtatc

SEQ ID NO: 1765930 - DNA, 24 bp, Homo sapiens
taaattgctcacagttattacata

SEQ ID NO: 1765931 - DNA, 11 bp, Homo sapiens
taaattggatt

SEQ ID NO: 1765932 - DNA, 15 bp, Homo sapiens
taaattggattattt

SEQ ID NO: 1765933 - DNA, 20 bp, Homo sapiens
taaattgggcttcaatcact

SEQ ID NO: 1765934 - DNA, 23 bp, Homo sapiens
taaattgtttggcttcctcctga

SEQ ID NO: 1765935 - DNA, 16 bp, Homo sapiens
taaatttaataaatat

SEQ ID NO: 1765936 - DNA, 16 bp, Homo sapiens
taaatttaatatactg

SEQ ID NO: 1765937 - DNA, 14 bp, Homo sapiens
taaatttaatgctg

SEQ ID NO: 1765938 - DNA, 15 bp, Homo sapiens
taaatttaatgctgc

SEQ ID NO: 1765939 - DNA, 13 bp, Homo sapiens
taaatttatgtga

SEQ ID NO: 1765940 - DNA, 17 bp, Homo sapiens
taaatttatttcaaaaa

SEQ ID NO: 1765941 - DNA, 18 bp, Homo sapiens
taaatttatttgaaaatg

SEQ ID NO: 1765942 - DNA, 14 bp, Homo sapiens
taaatttcaaatgc

SEQ ID NO: 1765943 - DNA, 17 bp, Homo sapiens
taaatttgacttttctg

SEQ ID NO: 1765944 - DNA, 19 bp, Homo sapiens
taaatttgacttttctgta

SEQ ID NO: 1765945 - DNA, 17 bp, Homo sapiens
taaatttgtaactttgc

SEQ ID NO: 1765946 - DNA, 20 bp, Homo sapiens
taaatttgtactatttaact

SEQ ID NO: 1765947 - DNA, 21 bp, Homo sapiens
taaatttgtactatttaactg

SEQ ID NO: 1765948 - DNA, 14 bp, Homo sapiens
taaatttgttcttt

SEQ ID NO: 1765949 - DNA, 13 bp, Homo sapiens
taaattttaaaaa

SEQ ID NO: 1765950 - DNA, 14 bp, Homo sapiens
taaattttaaagcc

SEQ ID NO: 1765951 - DNA, 14 bp, Homo sapiens
taaattttaatgta

SEQ ID NO: 1765952 - DNA, 15 bp, Homo sapiens
taaattttaatgtaa

SEQ ID NO: 1765953 - DNA, 16 bp, Homo sapiens
taaattttaatgtaaa

SEQ ID NO: 1765954 - DNA, 23 bp, Homo sapiens
taaattttaatgtaaaattcata

SEQ ID NO: 1765955 - DNA, 15 bp, Homo sapiens
taaattttaatttat

SEQ ID NO: 1765956 - DNA, 22 bp, Homo sapiens
taaattttatgtcatagaaata

SEQ ID NO: 1765957 - DNA, 16 bp, Homo sapiens
taaattttgagttcta

SEQ ID NO: 1765958 - DNA, 17 bp, Homo sapiens
taaatttttataataat

SEQ ID NO: 1765959 - DNA, 18 bp, Homo sapiens
taacaaaaactacacata

SEQ ID NO: 1765960 - DNA, 19 bp, Homo sapiens
taacaaaagattaatcttt

SEQ ID NO: 1765961 - DNA, 17 bp, Homo sapiens
taacaaaagatttgttt

SEQ ID NO: 1765962 - DNA, 21 bp, Homo sapiens
taacaaaataaggttatatga

SEQ ID NO: 1765963 - DNA, 21 bp, Homo sapiens
taacaaaatcaagcctgattc

SEQ ID NO: 1765964 - DNA, 18 bp, Homo sapiens
taacaaaccaacatcttt

SEQ ID NO: 1765965 - DNA, 20 bp, Homo sapiens
taacaaatttctttgtttaa

SEQ ID NO: 1765966 - DNA, 17 bp, Homo sapiens
taacaaccttttacatt

SEQ ID NO: 1765967 - DNA, 14 bp, Homo sapiens
taagattctgattt

SEQ ID NO: 1765968 - DNA, 19 bp, Homo sapiens
taagatttagagatgaatt

SEQ ID NO: 1765969 - DNA, 15 bp, Homo sapiens
taagcaaaagaaaaa

SEQ ID NO: 1765970 - DNA, 21 bp, Homo sapiens
taagcaaaggctctgaaataa

SEQ ID NO: 1765971 - DNA, 17 bp, Homo sapiens
taagcaaaggggacagc

SEQ ID NO: 1765972 - DNA, 22 bp, Homo sapiens
taagcaaaggggacagctgtgt

SEQ ID NO: 1765973 - DNA, 18 bp, Homo sapiens
taagcaaatgttaaaagt

SEQ ID NO: 1765974 - DNA, 19 bp, Homo sapiens
taagcaaatgttaaaagtt

SEQ ID NO: 1765975 - DNA, 13 bp, Homo sapiens
taagcaagagaga

SEQ ID NO: 1765976 - DNA, 17 bp, Homo sapiens
taagcagaacaaatgtg

SEQ ID NO: 1765977 - DNA, 22 bp, Homo sapiens
taagcagatggaatgctgtgtt

SEQ ID NO: 1765978 - DNA, 21 bp, Homo sapiens
taagcagatttaacaattcca

SEQ ID NO: 1765979 - DNA, 14 bp, Homo sapiens
taagcagcatttca

SEQ ID NO: 1765980 - DNA, 15 bp, Homo sapiens
taagcagtaaaaact

SEQ ID NO: 1765981 - DNA, 22 bp, Homo sapiens
taagcagttatggtgatgactt

SEQ ID NO: 1765982 - DNA, 14 bp, Homo sapiens
taagcagttttgta

SEQ ID NO: 1765983 - DNA, 17 bp, Homo sapiens
taagcatactttgtaaa

SEQ ID NO: 1765984 - DNA, 12 bp, Homo sapiens
taagcatttatt

SEQ ID NO: 1765985 - DNA, 16 bp, Homo sapiens
taagccaaaaggattc

SEQ ID NO: 1765986 - DNA, 19 bp, Homo sapiens
taagccaaactcaggccca

SEQ ID NO: 1765987 - DNA, 22 bp, Homo sapiens
taagccaaactcaggcccagaa

SEQ ID NO: 1765988 - DNA, 12 bp, Homo sapiens
taagccaaagaa

SEQ ID NO: 1765989 - DNA, 15 bp, Homo sapiens
taagccaaagaaaca

SEQ ID NO: 1765990 - DNA, 14 bp, Homo sapiens
taagccagagcctg

SEQ ID NO: 1765991 - DNA, 16 bp, Homo sapiens
taagccagagcctggg

SEQ ID NO: 1765992 - DNA, 18 bp, Homo sapiens
taagcccagtgcactgaa

SEQ ID NO: 1765993 - DNA, 15 bp, Homo sapiens
taagcccccagggcc

SEQ ID NO: 1765994 - DNA, 19 bp, Homo sapiens
taagccctcgaaccaaggc

SEQ ID NO: 1765995 - DNA, 20 bp, Homo sapiens
taagccctcgaaccaaggca

SEQ ID NO: 1765996 - DNA, 22 bp, Homo sapiens
taagccctcgaaccaaggcagc

SEQ ID NO: 1765997 - DNA, 16 bp, Homo sapiens
taagccctgccccggg

SEQ ID NO: 1765998 - DNA, 11 bp, Homo sapiens
taagccctgtc

SEQ ID NO: 1765999 - DNA, 16 bp, Homo sapiens
taagccctgtcgagac

SEQ ID NO: 1766000 - DNA, 19 bp, Homo sapiens
taagccctttgctctggag

SEQ ID NO: 1766001 - DNA, 19 bp, Homo sapiens
taagcctccatttagttct

SEQ ID NO: 1766002 - DNA, 20 bp, Homo sapiens
taagcctccatttagttctt

SEQ ID NO: 1766003 - DNA, 14 bp, Homo sapiens
taagccttcaaaac

SEQ ID NO: 1766004 - DNA, 16 bp, Homo sapiens
taagcctttccataag

SEQ ID NO: 1766005 - DNA, 21 bp, Homo sapiens
taagctaaagaggctgaaaga

SEQ ID NO: 1766006 - DNA, 23 bp, Homo sapiens
taagctaggatgttgctcagaag

SEQ ID NO: 1766007 - DNA, 14 bp, Homo sapiens
taagctattcagta

SEQ ID NO: 1766008 - DNA, 12 bp, Homo sapiens
taagctcagaat

SEQ ID NO: 1766009 - DNA, 18 bp, Homo sapiens
taagctgatattatttct

SEQ ID NO: 1766010 - DNA, 20 bp, Homo sapiens
taagctgatattatttcttc

SEQ ID NO: 1766011 - DNA, 18 bp, Homo sapiens
taagctggctctgtttga

SEQ ID NO: 1766012 - DNA, 20 bp, Homo sapiens
taagctggctctgtttgatg

SEQ ID NO: 1766013 - DNA, 22 bp, Homo sapiens
taagctgtgtctgcccaatgaa

SEQ ID NO: 1766014 - DNA, 17 bp, Homo sapiens
taagcttcagttgcttg

SEQ ID NO: 1766015 - DNA, 16 bp, Homo sapiens
taagcttccattttaa

SEQ ID NO: 1766016 - DNA, 23 bp, Homo sapiens
taagcttccattttaattttaaa

SEQ ID NO: 1766017 - DNA, 17 bp, Homo sapiens
taaggaaaaaaagacaa

SEQ ID NO: 1766018 - DNA, 16 bp, Homo sapiens
taaggaaagcaataaa

SEQ ID NO: 1766019 - DNA, 19 bp, Homo sapiens
taaggaatgtagctggttt

SEQ ID NO: 1766020 - DNA, 14 bp, Homo sapiens
taaggacacactaa

SEQ ID NO: 1766021 - DNA, 15 bp, Homo sapiens
taaggacagcagctg

SEQ ID NO: 1766022 - DNA, 17 bp, Homo sapiens
taaggacagcagctggt

SEQ ID NO: 1766023 - DNA, 22 bp, Homo sapiens
taaggacagcagctggtgcccc

SEQ ID NO: 1766024 - DNA, 22 bp, Homo sapiens
taaggacctgaaattccaaagt

SEQ ID NO: 1766025 - DNA, 14 bp, Homo sapiens
taaggagctggggg

SEQ ID NO: 1766026 - DNA, 19 bp, Homo sapiens
taaggaggaggagggagaa

SEQ ID NO: 1766027 - DNA, 19 bp, Homo sapiens
taaggagggacatgatggg

SEQ ID NO: 1766028 - DNA, 15 bp, Homo sapiens
taaggataaatcata

SEQ ID NO: 1766029 - DNA, 17 bp, Homo sapiens
taaggatactttacatg

SEQ ID NO: 1766030 - DNA, 17 bp, Homo sapiens
taaggatccggaaagaa

SEQ ID NO: 1766031 - DNA, 18 bp, Homo sapiens
taaggatccggaaagaag

SEQ ID NO: 1766032 - DNA, 13 bp, Homo sapiens
taaggatggatgg

SEQ ID NO: 1766033 - DNA, 17 bp, Homo sapiens
taaggatggatggcacc

SEQ ID NO: 1766034 - DNA, 19 bp, Homo sapiens
taaggatggatggcaccct

SEQ ID NO: 1766035 - DNA, 20 bp, Homo sapiens
taaggatggatggcaccctg

SEQ ID NO: 1766036 - DNA, 22 bp, Homo sapiens
taaggatggatggcaccctgga

SEQ ID NO: 1766037 - DNA, 15 bp, Homo sapiens
taaggattgtgatat

SEQ ID NO: 1766038 - DNA, 12 bp, Homo sapiens
taaggcatgtta

SEQ ID NO: 1766039 - DNA, 22 bp, Homo sapiens
taaggccaagtacactgagagc

SEQ ID NO: 1766040 - DNA, 17 bp, Homo sapiens
taaggccagggcctctc

SEQ ID NO: 1766041 - DNA, 18 bp, Homo sapiens
taaggccagggcctctcc

SEQ ID NO: 1766042 - DNA, 16 bp, Homo sapiens
taaggcctaggattct

SEQ ID NO: 1766043 - DNA, 20 bp, Homo sapiens
taaggcctaggattctaaaa

SEQ ID NO: 1766044 - DNA, 14 bp, Homo sapiens
taaggcctgaatca

SEQ ID NO: 1766045 - DNA, 22 bp, Homo sapiens
taaggctctgagagtctagatt

SEQ ID NO: 1766046 - DNA, 24 bp, Homo sapiens
taaggctctgagagtctagattct

SEQ ID NO: 1766047 - DNA, 18 bp, Homo sapiens
taaggctctgtgccttgg

SEQ ID NO: 1766048 - DNA, 20 bp, Homo sapiens
taagggaaaaatcaagtatt

SEQ ID NO: 1766049 - DNA, 18 bp, Homo sapiens
taagggactgatgtttgt

SEQ ID NO: 1766050 - DNA, 21 bp, Homo sapiens
taagggagagctgagccagtt

SEQ ID NO: 1766051 - DNA, 14 bp, Homo sapiens
taagggcacacaca

SEQ ID NO: 1766052 - DNA, 14 bp, Homo sapiens
taagggcagtgccc

SEQ ID NO: 1766053 - DNA, 20 bp, Homo sapiens
taaggggaagaatgaaagct

SEQ ID NO: 1766054 - DNA, 19 bp, Homo sapiens
taaggggaggaaccagagt

SEQ ID NO: 1766055 - DNA, 17 bp, Homo sapiens
taagggggtccctgtgc

SEQ ID NO: 1766056 - DNA, 18 bp, Homo sapiens
taagggggtccctgtgct

SEQ ID NO: 1766057 - DNA, 22 bp, Homo sapiens
taaggggtgggtcagaacatgt

SEQ ID NO: 1766058 - DNA, 17 bp, Homo sapiens
taagggtcgaaagctct

SEQ ID NO: 1766059 - DNA, 16 bp, Homo sapiens
taagggttgaaggcag

SEQ ID NO: 1766060 - DNA, 13 bp, Homo sapiens
taagggttttaga

SEQ ID NO: 1766061 - DNA, 15 bp, Homo sapiens
taaggtcaagggaaa

SEQ ID NO: 1766062 - DNA, 18 bp, Homo sapiens
taaggtccggtgttctaa

SEQ ID NO: 1766063 - DNA, 13 bp, Homo sapiens
taaggtctcatgc

SEQ ID NO: 1766064 - DNA, 19 bp, Homo sapiens
taaggtctgtttgctgttg

SEQ ID NO: 1766065 - DNA, 18 bp, Homo sapiens
taaggtgcctcagttttc

SEQ ID NO: 1766066 - DNA, 18 bp, Homo sapiens
taaggtgggagaattgct

SEQ ID NO: 1766067 - DNA, 14 bp, Homo sapiens
taaggttatatgag

SEQ ID NO: 1766068 - DNA, 20 bp, Homo sapiens
taaggttatgcactgcctgc

SEQ ID NO: 1766069 - DNA, 15 bp, Homo sapiens
taaggttctaaggcc

SEQ ID NO: 1766070 - DNA, 15 bp, Homo sapiens
taaggttgtgcaggg

SEQ ID NO: 1766071 - DNA, 22 bp, Homo sapiens
taaggtttcgtttctgtataca

SEQ ID NO: 1766072 - DNA, 15 bp, Homo sapiens
taaggtttgttttca

SEQ ID NO: 1766073 - DNA, 13 bp, Homo sapiens
taagtaaaaccac

SEQ ID NO: 1766074 - DNA, 13 bp, Homo sapiens
taagtaagacttt

SEQ ID NO: 1766075 - DNA, 17 bp, Homo sapiens
taagtaccactcaggcc

SEQ ID NO: 1766076 - DNA, 18 bp, Homo sapiens
taagtaccactcaggcca

SEQ ID NO: 1766077 - DNA, 20 bp, Homo sapiens
taagtagtaaatcagaaagt

SEQ ID NO: 1766078 - DNA, 16 bp, Homo sapiens
taagtagttggtttgt

SEQ ID NO: 1766079 - DNA, 18 bp, Homo sapiens
taagtagttggtttgtat

SEQ ID NO: 1766080 - DNA, 20 bp, Homo sapiens
taagtagttggtttgtatga

SEQ ID NO: 1766081 - DNA, 13 bp, Homo sapiens
taagtatatagta

SEQ ID NO: 1766082 - DNA, 21 bp, Homo sapiens
taattcagcactgatttcaca

SEQ ID NO: 1766083 - DNA, 22 bp, Homo sapiens
taattcagcactgatttcacaa

SEQ ID NO: 1766084 - DNA, 19 bp, Homo sapiens
taattcaggtttttccttt

SEQ ID NO: 1766085 - DNA, 18 bp, Homo sapiens
taattcagtctcagctgc

SEQ ID NO: 1766086 - DNA, 12 bp, Homo sapiens
taattcatttgt

SEQ ID NO: 1766087 - DNA, 13 bp, Homo sapiens
taattcatttgta

SEQ ID NO: 1766088 - DNA, 19 bp, Homo sapiens
taattccacaggtcatcag

SEQ ID NO: 1766089 - DNA, 17 bp, Homo sapiens
taattcccattttgcaa

SEQ ID NO: 1766090 - DNA, 23 bp, Homo sapiens
taattcccattttgcaaaatttc

SEQ ID NO: 1766091 - DNA, 14 bp, Homo sapiens
taattcctgatctt

SEQ ID NO: 1766092 - DNA, 22 bp, Homo sapiens
taattccttctgcctaacttgt

SEQ ID NO: 1766093 - DNA, 17 bp, Homo sapiens
taattctcatttgttct

SEQ ID NO: 1766094 - DNA, 16 bp, Homo sapiens
taattctctttcaaag

SEQ ID NO: 1766095 - DNA, 12 bp, Homo sapiens
taattctgaacc

SEQ ID NO: 1766096 - DNA, 17 bp, Homo sapiens
taattctgagttttgtg

SEQ ID NO: 1766097 - DNA, 18 bp, Homo sapiens
taattctgattagagata

SEQ ID NO: 1766098 - DNA, 13 bp, Homo sapiens
taattctgtaaat

SEQ ID NO: 1766099 - DNA, 15 bp, Homo sapiens
taattctgtactgat

SEQ ID NO: 1766100 - DNA, 17 bp, Homo sapiens
taattcttcacctttgt

SEQ ID NO: 1766101 - DNA, 13 bp, Homo sapiens
taattctttctgt

SEQ ID NO: 1766102 - DNA, 16 bp, Homo sapiens
taattctttctgtctc

SEQ ID NO: 1766103 - DNA, 19 bp, Homo sapiens
taattctttgttctgtttt

SEQ ID NO: 1766104 - DNA, 19 bp, Homo sapiens
taattgatttcaagacctt

SEQ ID NO: 1766105 - DNA, 13 bp, Homo sapiens
taattgcatcagt

SEQ ID NO: 1766106 - DNA, 21 bp, Homo sapiens
taattgcatcagttcattgac

SEQ ID NO: 1766107 - DNA, 20 bp, Homo sapiens
taattgcctacaataaaaag

SEQ ID NO: 1766108 - DNA, 14 bp, Homo sapiens
taattgctgtgtgt

SEQ ID NO: 1766109 - DNA, 16 bp, Homo sapiens
taattgcttacatttt

SEQ ID NO: 1766110 - DNA, 23 bp, Homo sapiens
taattgcttacatttttacaata

SEQ ID NO: 1766111 - DNA, 20 bp, Homo sapiens
taattgctttaaatcttaag

SEQ ID NO: 1766112 - DNA, 14 bp, Homo sapiens
taattggactttta

SEQ ID NO: 1766113 - DNA, 15 bp, Homo sapiens
taattggatttccta

SEQ ID NO: 1766114 - DNA, 23 bp, Homo sapiens
taattggtacttttaaaaacata

SEQ ID NO: 1766115 - DNA, 20 bp, Homo sapiens
taattggttatcatgggaaa

SEQ ID NO: 1766116 - DNA, 18 bp, Homo sapiens
taattgtaagtgaaatta

SEQ ID NO: 1766117 - DNA, 15 bp, Homo sapiens
taattgtactaatct

SEQ ID NO: 1766118 - DNA, 12 bp, Homo sapiens
taattgtcatta

SEQ ID NO: 1766119 - DNA, 23 bp, Homo sapiens
taattgtgaccaatacatttgta

SEQ ID NO: 1766120 - DNA, 22 bp, Homo sapiens
taattgtgattagacagaacac

SEQ ID NO: 1766121 - DNA, 23 bp, Homo sapiens
taattgtgattagacagaacacc

SEQ ID NO: 1766122 - DNA, 17 bp, Homo sapiens
taattgtggctttatga

SEQ ID NO: 1766123 - DNA, 13 bp, Homo sapiens
taattgtgtaaaa

SEQ ID NO: 1766124 - DNA, 22 bp, Homo sapiens
taattgtgtaaaaaatggaaaa

SEQ ID NO: 1766125 - DNA, 12 bp, Homo sapiens
taattgtgtata

SEQ ID NO: 1766126 - DNA, 13 bp, Homo sapiens
taattgtgtatat

SEQ ID NO: 1766127 - DNA, 20 bp, Homo sapiens
taattgtgtgatatttcaga

SEQ ID NO: 1766128 - DNA, 14 bp, Homo sapiens
taattgtgtggatt

SEQ ID NO: 1766129 - DNA, 17 bp, Homo sapiens
taattgttctcagaatc

SEQ ID NO: 1766130 - DNA, 17 bp, Homo sapiens
taattgttttggaataa

SEQ ID NO: 1766131 - DNA, 18 bp, Homo sapiens
taattgttttggaataaa

SEQ ID NO: 1766132 - DNA, 19 bp, Homo sapiens
taattgttttttaaagcaa

SEQ ID NO: 1766133 - DNA, 23 bp, Homo sapiens
taatttaaacatttgttcctgga

SEQ ID NO: 1766134 - DNA, 15 bp, Homo sapiens
taatttaaactgtgt

SEQ ID NO: 1766135 - DNA, 22 bp, Homo sapiens
taatttaaggtctgtttgctgt

SEQ ID NO: 1766136 - DNA, 20 bp, Homo sapiens
taatttaagtgacacagaca

SEQ ID NO: 1766137 - DNA, 14 bp, Homo sapiens
taatttaatgcatg

SEQ ID NO: 1766138 - DNA, 16 bp, Homo sapiens
taatttacaagatatt

SEQ ID NO: 1766139 - DNA, 21 bp, Homo sapiens
taatttacctaagattacaaa

SEQ ID NO: 1766140 - DNA, 21 bp, Homo sapiens
taatttagtggatggaatatc

SEQ ID NO: 1766141 - DNA, 23 bp, Homo sapiens
taatttagtggatggaatatcag

SEQ ID NO: 1766142 - DNA, 16 bp, Homo sapiens
taatttataaaaaggt

SEQ ID NO: 1766143 - DNA, 16 bp, Homo sapiens
taatttatattccatt

SEQ ID NO: 1766144 - DNA, 20 bp, Homo sapiens
taatttattgtctgtctaca

SEQ ID NO: 1766145 - DNA, 20 bp, Homo sapiens
taatttattgtttttccttg

SEQ ID NO: 1766146 - DNA, 13 bp, Homo sapiens
taatttatttgtt

SEQ ID NO: 1766147 - DNA, 21 bp, Homo sapiens
taatttcaaaaatataactta

SEQ ID NO: 1766148 - DNA, 22 bp, Homo sapiens
taatttcacttaataattttta

SEQ ID NO: 1766149 - DNA, 13 bp, Homo sapiens
taatttcaggaaa

SEQ ID NO: 1766150 - DNA, 14 bp, Homo sapiens
taatttcaggaaaa

SEQ ID NO: 1766151 - DNA, 21 bp, Homo sapiens
taatttcaggaaaatgtattg

SEQ ID NO: 1766152 - DNA, 11 bp, Homo sapiens
taatttcagtg

SEQ ID NO: 1766153 - DNA, 13 bp, Homo sapiens
taatttcatacta

SEQ ID NO: 1766154 - DNA, 15 bp, Homo sapiens
taatttcatgtgtat

SEQ ID NO: 1766155 - DNA, 18 bp, Homo sapiens
taatttccaggaaaaaat

SEQ ID NO: 1766156 - DNA, 13 bp, Homo sapiens
taatttccttttt

SEQ ID NO: 1766157 - DNA, 20 bp, Homo sapiens
taatttcctttttgacactg

SEQ ID NO: 1766158 - DNA, 13 bp, Homo sapiens
taatttcgcctta

SEQ ID NO: 1766159 - DNA, 16 bp, Homo sapiens
taatttcgccttaaac

SEQ ID NO: 1766160 - DNA, 17 bp, Homo sapiens
taatttcgccttaaact

SEQ ID NO: 1766161 - DNA, 22 bp, Homo sapiens
taatttctactctgtcttaaat

SEQ ID NO: 1766162 - DNA, 13 bp, Homo sapiens
taatttctcctcc

SEQ ID NO: 1766163 - DNA, 19 bp, Homo sapiens
taatttctcctcccttcct

SEQ ID NO: 1766164 - DNA, 23 bp, Homo sapiens
taatttctgataaagttccttaa

SEQ ID NO: 1766165 - DNA, 20 bp, Homo sapiens
taatttgaatgtggttactt

SEQ ID NO: 1766166 - DNA, 22 bp, Homo sapiens
taatttgaggacaaccattcca

SEQ ID NO: 1766167 - DNA, 12 bp, Homo sapiens
taatttgatctt

SEQ ID NO: 1766168 - DNA, 20 bp, Homo sapiens
taatttgatgaggtattttt

SEQ ID NO: 1766169 - DNA, 17 bp, Homo sapiens
taatttggagcacaaaa

SEQ ID NO: 1766170 - DNA, 13 bp, Homo sapiens
taatttgtacaat

SEQ ID NO: 1766171 - DNA, 15 bp, Homo sapiens
taatttgtgtgtttt

SEQ ID NO: 1766172 - DNA, 15 bp, Homo sapiens
taattttaaaagtct

SEQ ID NO: 1766173 - DNA, 14 bp, Homo sapiens
taattttaaagtgc

SEQ ID NO: 1766174 - DNA, 23 bp, Homo sapiens
taattttaaccaaaacatgtctc

SEQ ID NO: 1766175 - DNA, 21 bp, Homo sapiens
taattttagagaaactttgag

SEQ ID NO: 1766176 - DNA, 16 bp, Homo sapiens
taattttagtttttca

SEQ ID NO: 1766177 - DNA, 16 bp, Homo sapiens
taattttattcaagaa

SEQ ID NO: 1766178 - DNA, 17 bp, Homo sapiens
taattttattgcaaagt

SEQ ID NO: 1766179 - DNA, 14 bp, Homo sapiens
taattttattttgt

SEQ ID NO: 1766180 - DNA, 17 bp, Homo sapiens
taattttcctttgtcat

SEQ ID NO: 1766181 - DNA, 22 bp, Homo sapiens
taattttctctttgtatgtctg

SEQ ID NO: 1766182 - DNA, 21 bp, Homo sapiens
taattttgacactatatctgt

SEQ ID NO: 1766183 - DNA, 16 bp, Homo sapiens
taattttgatatacat

SEQ ID NO: 1766184 - DNA, 13 bp, Homo sapiens
taattttgctaac

SEQ ID NO: 1766185 - DNA, 15 bp, Homo sapiens
taattttgctaactg

SEQ ID NO: 1766186 - DNA, 16 bp, Homo sapiens
taattttgctaactgg

SEQ ID NO: 1766187 - DNA, 20 bp, Homo sapiens
taattttgctaactgggtta

SEQ ID NO: 1766188 - DNA, 15 bp, Homo sapiens
taattttggaataat

SEQ ID NO: 1766189 - DNA, 19 bp, Homo sapiens
taattttggaataatttct

SEQ ID NO: 1766190 - DNA, 20 bp, Homo sapiens
taattttggaataatttcta

SEQ ID NO: 1766191 - DNA, 21 bp, Homo sapiens
taattttggaataatttctat

SEQ ID NO: 1766192 - DNA, 13 bp, Homo sapiens
taattttgtgcat

SEQ ID NO: 1766193 - DNA, 16 bp, Homo sapiens
taattttgtgcattct

SEQ ID NO: 1766194 - DNA, 19 bp, Homo sapiens
taattttgtgcattctttg

SEQ ID NO: 1766195 - DNA, 19 bp, Homo sapiens
taatttttaaatgcagtta

SEQ ID NO: 1766196 - DNA, 19 bp, Homo sapiens
taatttttaatgatgacaa

SEQ ID NO: 1766197 - DNA, 20 bp, Homo sapiens
tacattgtacgaagagtatt

SEQ ID NO: 1766198 - DNA, 17 bp, Homo sapiens
tacattgtcatttatat

SEQ ID NO: 1766199 - DNA, 18 bp, Homo sapiens
tacattgtcatttatata

SEQ ID NO: 1766200 - DNA, 16 bp, Homo sapiens
tacattgtcctgtagc

SEQ ID NO: 1766201 - DNA, 12 bp, Homo sapiens
tacattgtcttg

SEQ ID NO: 1766202 - DNA, 15 bp, Homo sapiens
tacattgtgagctct

SEQ ID NO: 1766203 - DNA, 23 bp, Homo sapiens
tacattgtgggatgttcagcact

SEQ ID NO: 1766204 - DNA, 15 bp, Homo sapiens
tacattgtgtgaaaa

SEQ ID NO: 1766205 - DNA, 21 bp, Homo sapiens
tacatttaaaattgctatgtt

SEQ ID NO: 1766206 - DNA, 14 bp, Homo sapiens
tacatttaaatttt

SEQ ID NO: 1766207 - DNA, 16 bp, Homo sapiens
tacatttaataaaact

SEQ ID NO: 1766208 - DNA, 18 bp, Homo sapiens
tacatttaatacagataa

SEQ ID NO: 1766209 - DNA, 15 bp, Homo sapiens
tacatttaatacagc

SEQ ID NO: 1766210 - DNA, 19 bp, Homo sapiens
tacatttataatgtttgct

SEQ ID NO: 1766211 - DNA, 14 bp, Homo sapiens
tacatttatttatc

SEQ ID NO: 1766212 - DNA, 21 bp, Homo sapiens
tacatttccaaattcacaagt

SEQ ID NO: 1766213 - DNA, 22 bp, Homo sapiens
tacatttcttagactacattta

SEQ ID NO: 1766214 - DNA, 22 bp, Homo sapiens
tacatttgagggcccagccagg

SEQ ID NO: 1766215 - DNA, 16 bp, Homo sapiens
tacatttgcagatgtt

SEQ ID NO: 1766216 - DNA, 19 bp, Homo sapiens
tacatttgggagtttttat

SEQ ID NO: 1766217 - DNA, 21 bp, Homo sapiens
tacatttgggagtttttatga

SEQ ID NO: 1766218 - DNA, 17 bp, Homo sapiens
tacatttgtaatttaag

SEQ ID NO: 1766219 - DNA, 14 bp, Homo sapiens
tacatttgtatttt

SEQ ID NO: 1766220 - DNA, 19 bp, Homo sapiens
tacatttgtattttgtgat

SEQ ID NO: 1766221 - DNA, 23 bp, Homo sapiens
tacatttgtattttgtgatgaat

SEQ ID NO: 1766222 - DNA, 15 bp, Homo sapiens
tacatttgtttgtat

SEQ ID NO: 1766223 - DNA, 17 bp, Homo sapiens
tacattttagtttctaa

SEQ ID NO: 1766224 - DNA, 20 bp, Homo sapiens
tacattttatatttttgtac

SEQ ID NO: 1766225 - DNA, 23 bp, Homo sapiens
tacattttattaagctttttgga

SEQ ID NO: 1766226 - DNA, 20 bp, Homo sapiens
tacattttctaaataaaaat

SEQ ID NO: 1766227 - DNA, 21 bp, Homo sapiens
tacattttctaaataaaaata

SEQ ID NO: 1766228 - DNA, 23 bp, Homo sapiens
tacattttctaaataaaaatatg

SEQ ID NO: 1766229 - DNA, 17 bp, Homo sapiens
tacattttgtggctttt

SEQ ID NO: 1766230 - DNA, 14 bp, Homo sapiens
tacatttttacaat

SEQ ID NO: 1766231 - DNA, 15 bp, Homo sapiens
tacatttttacaata

SEQ ID NO: 1766232 - DNA, 17 bp, Homo sapiens
tacatttttacaataaa

SEQ ID NO: 1766233 - DNA, 21 bp, Homo sapiens
tacatttttacaataaataat

SEQ ID NO: 1766234 - DNA, 15 bp, Homo sapiens
tacattttttaagct

SEQ ID NO: 1766235 - DNA, 13 bp, Homo sapiens
taccaaaaattag

SEQ ID NO: 1766236 - DNA, 16 bp, Homo sapiens
taccaaagactatttc

SEQ ID NO: 1766237 - DNA, 18 bp, Homo sapiens
taccaaatagcttctgtt

SEQ ID NO: 1766238 - DNA, 13 bp, Homo sapiens
taccaaattaaaa

SEQ ID NO: 1766239 - DNA, 18 bp, Homo sapiens
taccaaggtcttcttaat

SEQ ID NO: 1766240 - DNA, 20 bp, Homo sapiens
taccaagtatagcctatggc

SEQ ID NO: 1766241 - DNA, 13 bp, Homo sapiens
taccaataaagtg

SEQ ID NO: 1766242 - DNA, 17 bp, Homo sapiens
taccaataaagtgaccc

SEQ ID NO: 1766243 - DNA, 19 bp, Homo sapiens
taccaatcattttaattat

SEQ ID NO: 1766244 - DNA, 20 bp, Homo sapiens
taccaatcattttaattatt

SEQ ID NO: 1766245 - DNA, 18 bp, Homo sapiens
taccaatgctgttgtaaa

SEQ ID NO: 1766246 - DNA, 23 bp, Homo sapiens
taccaattacccataaacagcac

SEQ ID NO: 1766247 - DNA, 17 bp, Homo sapiens
taccacaaaccctgctg

SEQ ID NO: 1766248 - DNA, 20 bp, Homo sapiens
taccacatctgctctaggga

SEQ ID NO: 1766249 - DNA, 16 bp, Homo sapiens
taccaccgaatcccta

SEQ ID NO: 1766250 - DNA, 20 bp, Homo sapiens
taccaccgtctgtctcagag

SEQ ID NO: 1766251 - DNA, 22 bp, Homo sapiens
taccactacttagagatatgta

SEQ ID NO: 1766252 - DNA, 22 bp, Homo sapiens
taccactggtacttcctttctc

SEQ ID NO: 1766253 - DNA, 12 bp, Homo sapiens
taccactggtta

SEQ ID NO: 1766254 - DNA, 15 bp, Homo sapiens
taccacttcctgagg

SEQ ID NO: 1766255 - DNA, 19 bp, Homo sapiens
taccacttgaatttattga

SEQ ID NO: 1766256 - DNA, 12 bp, Homo sapiens
taccactttttt

SEQ ID NO: 1766257 - DNA, 19 bp, Homo sapiens
taccagaaagctctacatt

SEQ ID NO: 1766258 - DNA, 21 bp, Homo sapiens
taccagacggttcaccagcct

SEQ ID NO: 1766259 - DNA, 22 bp, Homo sapiens
taccagacggttcaccagcctc

SEQ ID NO: 1766260 - DNA, 11 bp, Homo sapiens
taccagccagc

SEQ ID NO: 1766261 - DNA, 15 bp, Homo sapiens
taccagccagcctca

SEQ ID NO: 1766262 - DNA, 13 bp, Homo sapiens
taccagctgcgct

SEQ ID NO: 1766263 - DNA, 17 bp, Homo sapiens
taccaggcaaattcact

SEQ ID NO: 1766264 - DNA, 17 bp, Homo sapiens
taccaggcaacctccca

SEQ ID NO: 1766265 - DNA, 14 bp, Homo sapiens
taccaggtgttcta

SEQ ID NO: 1766266 - DNA, 14 bp, Homo sapiens
taccaggttgaaag

SEQ ID NO: 1766267 - DNA, 12 bp, Homo sapiens
taccagttgcct

SEQ ID NO: 1766268 - DNA, 14 bp, Homo sapiens
taccagttgccttt

SEQ ID NO: 1766269 - DNA, 20 bp, Homo sapiens
taccatagaaaaatgtataa

SEQ ID NO: 1766270 - DNA, 12 bp, Homo sapiens
taccatcatctc

SEQ ID NO: 1766271 - DNA, 12 bp, Homo sapiens
taccatctgcat

SEQ ID NO: 1766272 - DNA, 14 bp, Homo sapiens
taccatctgcatgg

SEQ ID NO: 1766273 - DNA, 20 bp, Homo sapiens
taccatctgtcttgccagcc

SEQ ID NO: 1766274 - DNA, 23 bp, Homo sapiens
taccatctgtcttgccagccaga

SEQ ID NO: 1766275 - DNA, 22 bp, Homo sapiens
taccatgctgctttttggcaca

SEQ ID NO: 1766276 - DNA, 19 bp, Homo sapiens
taccattaaaactgctttt

SEQ ID NO: 1766277 - DNA, 14 bp, Homo sapiens
taccattaattaca

SEQ ID NO: 1766278 - DNA, 22 bp, Homo sapiens
taccattaattacatacagatt

SEQ ID NO: 1766279 - DNA, 17 bp, Homo sapiens
taccattcacaataaaa

SEQ ID NO: 1766280 - DNA, 12 bp, Homo sapiens
taccatttcaga

SEQ ID NO: 1766281 - DNA, 23 bp, Homo sapiens
taccatttgtaataaagtatata

SEQ ID NO: 1766282 - DNA, 12 bp, Homo sapiens
taccatttgtgt

SEQ ID NO: 1766283 - DNA, 20 bp, Homo sapiens
taccattttttaaggaaaca

SEQ ID NO: 1766284 - DNA, 15 bp, Homo sapiens
tacccaaactgcttt

SEQ ID NO: 1766285 - DNA, 21 bp, Homo sapiens
tacccaaccactcaaattaat

SEQ ID NO: 1766286 - DNA, 14 bp, Homo sapiens
tacccaagctgtgg

SEQ ID NO: 1766287 - DNA, 12 bp, Homo sapiens
tacccacccaga

SEQ ID NO: 1766288 - DNA, 13 bp, Homo sapiens
tacccactgccat

SEQ ID NO: 1766289 - DNA, 19 bp, Homo sapiens
tacccagattgtgtacata

SEQ ID NO: 1766290 - DNA, 16 bp, Homo sapiens
tacccagccatctgcc

SEQ ID NO: 1766291 - DNA, 17 bp, Homo sapiens
tacccagccatctgccc

SEQ ID NO: 1766292 - DNA, 18 bp, Homo sapiens
tacccagccatctgccca

SEQ ID NO: 1766293 - DNA, 20 bp, Homo sapiens
tacccaggctggagtgcagt

SEQ ID NO: 1766294 - DNA, 15 bp, Homo sapiens
tacccagggccagcc

SEQ ID NO: 1766295 - DNA, 12 bp, Homo sapiens
tacccataaaca

SEQ ID NO: 1766296 - DNA, 20 bp, Homo sapiens
tacccataaacagcacacct

SEQ ID NO: 1766297 - DNA, 14 bp, Homo sapiens
tacccatgcacagt

SEQ ID NO: 1766298 - DNA, 17 bp, Homo sapiens
tacccatgcacagtaca

SEQ ID NO: 1766299 - DNA, 21 bp, Homo sapiens
tacccattcgtggtgatcaat

SEQ ID NO: 1766300 - DNA, 17 bp, Homo sapiens
tacccattgttcccttc

SEQ ID NO: 1766301 - DNA, 14 bp, Homo sapiens
taccccaaggccag

SEQ ID NO: 1766302 - DNA, 15 bp, Homo sapiens
taccccaccctcagc

SEQ ID NO: 1766303 - DNA, 12 bp, Homo sapiens
taccccagccag

SEQ ID NO: 1766304 - DNA, 13 bp, Homo sapiens
taccccagccagg

SEQ ID NO: 1766305 - DNA, 20 bp, Homo sapiens
taccccctcaaaccctgccc

SEQ ID NO: 1766306 - DNA, 13 bp, Homo sapiens
taccccctccttc

SEQ ID NO: 1766307 - DNA, 17 bp, Homo sapiens
taccccctccttcagac

SEQ ID NO: 1766308 - DNA, 18 bp, Homo sapiens
taccccctccttcagaca

SEQ ID NO: 1766309 - DNA, 20 bp, Homo sapiens
tacccctatacctgagcctc

SEQ ID NO: 1766310 - DNA, 18 bp, Homo sapiens
tacccctttctggctctc

SEQ ID NO: 1766311 - DNA, 16 bp, Homo sapiens
tacccgagcccagcta

SEQ ID NO: 1766312 - DNA, 13 bp, Homo sapiens
tactcttctaaaa

SEQ ID NO: 1766313 - DNA, 20 bp, Homo sapiens
tactcttctaaaacttgagt

SEQ ID NO: 1766314 - DNA, 18 bp, Homo sapiens
tactcttcttgaaatttt

SEQ ID NO: 1766315 - DNA, 12 bp, Homo sapiens
tactctttccta

SEQ ID NO: 1766316 - DNA, 14 bp, Homo sapiens
tactctttgtgggg

SEQ ID NO: 1766317 - DNA, 20 bp, Homo sapiens
tactgaaaatacaaaaatta

SEQ ID NO: 1766318 - DNA, 14 bp, Homo sapiens
tactgaaacagatt

SEQ ID NO: 1766319 - DNA, 13 bp, Homo sapiens
tactgaaagcctt

SEQ ID NO: 1766320 - DNA, 20 bp, Homo sapiens
tactgaacacatgtgtatga

SEQ ID NO: 1766321 - DNA, 14 bp, Homo sapiens
tactgaagtggctg

SEQ ID NO: 1766322 - DNA, 15 bp, Homo sapiens
tactgaataatatca

SEQ ID NO: 1766323 - DNA, 20 bp, Homo sapiens
tactgaataatgctaccagg

SEQ ID NO: 1766324 - DNA, 19 bp, Homo sapiens
tactgaatgaagcagtatt

SEQ ID NO: 1766325 - DNA, 21 bp, Homo sapiens
tactgaatgaagcagtatttt

SEQ ID NO: 1766326 - DNA, 14 bp, Homo sapiens
tactgacagggagc

SEQ ID NO: 1766327 - DNA, 18 bp, Homo sapiens
tactgacagggagcagcc

SEQ ID NO: 1766328 - DNA, 13 bp, Homo sapiens
tactgacatgtgg

SEQ ID NO: 1766329 - DNA, 14 bp, Homo sapiens
tactgacatttctt

SEQ ID NO: 1766330 - DNA, 13 bp, Homo sapiens
tactgacccaact

SEQ ID NO: 1766331 - DNA, 17 bp, Homo sapiens
tactgacccaactgggg

SEQ ID NO: 1766332 - DNA, 22 bp, Homo sapiens
tactgacccaggaccatcctgg

SEQ ID NO: 1766333 - DNA, 22 bp, Homo sapiens
tactgacttcagtgggactcgg

SEQ ID NO: 1766334 - DNA, 16 bp, Homo sapiens
tactgactttctgatt

SEQ ID NO: 1766335 - DNA, 20 bp, Homo sapiens
tactgagaaaagcctctcca

SEQ ID NO: 1766336 - DNA, 14 bp, Homo sapiens
tactgagacttgga

SEQ ID NO: 1766337 - DNA, 15 bp, Homo sapiens
tactgagccttgtaa

SEQ ID NO: 1766338 - DNA, 14 bp, Homo sapiens
tactgagcttctct

SEQ ID NO: 1766339 - DNA, 14 bp, Homo sapiens
tactgatatatttt

SEQ ID NO: 1766340 - DNA, 17 bp, Homo sapiens
tactgatgttcctttgg

SEQ ID NO: 1766341 - DNA, 14 bp, Homo sapiens
tactgattcaagaa

SEQ ID NO: 1766342 - DNA, 22 bp, Homo sapiens
tactgattcaagaacaagcaat

SEQ ID NO: 1766343 - DNA, 22 bp, Homo sapiens
tactgattcaattataattgta

SEQ ID NO: 1766344 - DNA, 15 bp, Homo sapiens
tactgattgtttcat

SEQ ID NO: 1766345 - DNA, 16 bp, Homo sapiens
tactgcaaaaagaaaa

SEQ ID NO: 1766346 - DNA, 17 bp, Homo sapiens
tactgcacagtggcaca

SEQ ID NO: 1766347 - DNA, 16 bp, Homo sapiens
tactgcactccagcct

SEQ ID NO: 1766348 - DNA, 15 bp, Homo sapiens
tactgcactttcccc

SEQ ID NO: 1766349 - DNA, 17 bp, Homo sapiens
tactgcagaatacagta

SEQ ID NO: 1766350 - DNA, 22 bp, Homo sapiens
tactgcagaatacagtaagctg

SEQ ID NO: 1766351 - DNA, 20 bp, Homo sapiens
tactgcagcctttgcctccc

SEQ ID NO: 1766352 - DNA, 18 bp, Homo sapiens
tactgcatactttttaaa

SEQ ID NO: 1766353 - DNA, 22 bp, Homo sapiens
tactgcattctctcccatcctg

SEQ ID NO: 1766354 - DNA, 18 bp, Homo sapiens
tactgcgactttctgcct

SEQ ID NO: 1766355 - DNA, 11 bp, Homo sapiens
tactgctctga

SEQ ID NO: 1766356 - DNA, 12 bp, Homo sapiens
tactgctctgag

SEQ ID NO: 1766357 - DNA, 16 bp, Homo sapiens
tactgctgattcttgt

SEQ ID NO: 1766358 - DNA, 14 bp, Homo sapiens
tactgctggactgt

SEQ ID NO: 1766359 - DNA, 22 bp, Homo sapiens
tactgcttggatccatacaaaa

SEQ ID NO: 1766360 - DNA, 16 bp, Homo sapiens
tactgctttgcaaaga

SEQ ID NO: 1766361 - DNA, 16 bp, Homo sapiens
tactggaattcttctg

SEQ ID NO: 1766362 - DNA, 18 bp, Homo sapiens
tactggaattcttctgca

SEQ ID NO: 1766363 - DNA, 23 bp, Homo sapiens
tactggaattcttctgcaacatt

SEQ ID NO: 1766364 - DNA, 17 bp, Homo sapiens
tactggacaaaatcaat

SEQ ID NO: 1766365 - DNA, 19 bp, Homo sapiens
tactggcagctcctctcct

SEQ ID NO: 1766366 - DNA, 18 bp, Homo sapiens
tactggtaattgtacaat

SEQ ID NO: 1766367 - DNA, 13 bp, Homo sapiens
tactggtccaaaa

SEQ ID NO: 1766368 - DNA, 23 bp, Homo sapiens
tactggtccaaaagattgctgaa

SEQ ID NO: 1766369 - DNA, 23 bp, Homo sapiens
tactggttatagttgatatgtaa

SEQ ID NO: 1766370 - DNA, 23 bp, Homo sapiens
tactgtaaaatgcaaaaaatctt

SEQ ID NO: 1766371 - DNA, 21 bp, Homo sapiens
tactgtaaatgccttgcttgt

SEQ ID NO: 1766372 - DNA, 12 bp, Homo sapiens
tactgtaaattt

SEQ ID NO: 1766373 - DNA, 18 bp, Homo sapiens
tactgtactttgccattt

SEQ ID NO: 1766374 - DNA, 22 bp, Homo sapiens
tactgtactttgccatttttct

SEQ ID NO: 1766375 - DNA, 21 bp, Homo sapiens
tactgtagaaagatcgtttaa

SEQ ID NO: 1766376 - DNA, 15 bp, Homo sapiens
tactgtatataaact

SEQ ID NO: 1766377 - DNA, 15 bp, Homo sapiens
tactgtatattcagg

SEQ ID NO: 1766378 - DNA, 14 bp, Homo sapiens
tactgtatttaaga

SEQ ID NO: 1766379 - DNA, 11 bp, Homo sapiens
tactgtcaata

SEQ ID NO: 1766380 - DNA, 13 bp, Homo sapiens
tactgtcaataaa

SEQ ID NO: 1766381 - DNA, 14 bp, Homo sapiens
tactgtcaataaac

SEQ ID NO: 1766382 - DNA, 15 bp, Homo sapiens
tactgtcagagaata

SEQ ID NO: 1766383 - DNA, 16 bp, Homo sapiens
tactgtcagagaatat

SEQ ID NO: 1766384 - DNA, 23 bp, Homo sapiens
tactgtccctctcagtgccttct

SEQ ID NO: 1766385 - DNA, 18 bp, Homo sapiens
tactgtctaagcagtttt

SEQ ID NO: 1766386 - DNA, 24 bp, Homo sapiens
tactgtctgcttctctctctctca

SEQ ID NO: 1766387 - DNA, 15 bp, Homo sapiens
tactgtcttactatt

SEQ ID NO: 1766388 - DNA, 16 bp, Homo sapiens
tactgtctttattctt

SEQ ID NO: 1766389 - DNA, 14 bp, Homo sapiens
tactgtgaagagaa

SEQ ID NO: 1766390 - DNA, 17 bp, Homo sapiens
tactgtgagcttacatt

SEQ ID NO: 1766391 - DNA, 12 bp, Homo sapiens
tactgtgatttc

SEQ ID NO: 1766392 - DNA, 15 bp, Homo sapiens
tactgtgatttctgg

SEQ ID NO: 1766393 - DNA, 14 bp, Homo sapiens
tactgtgtaattag

SEQ ID NO: 1766394 - DNA, 19 bp, Homo sapiens
tactgtgtctcatggattt

SEQ ID NO: 1766395 - DNA, 18 bp, Homo sapiens
tactgtgttttataaaat

SEQ ID NO: 1766396 - DNA, 18 bp, Homo sapiens
tactgttactgggccctg

SEQ ID NO: 1766397 - DNA, 13 bp, Homo sapiens
tactgttattctt

SEQ ID NO: 1766398 - DNA, 14 bp, Homo sapiens
tactgttattcttt

SEQ ID NO: 1766399 - DNA, 23 bp, Homo sapiens
tactgttcggaaggggttcctca

SEQ ID NO: 1766400 - DNA, 12 bp, Homo sapiens
tactgttctaaa

SEQ ID NO: 1766401 - DNA, 10 bp, Homo sapiens
tactgttgaa

SEQ ID NO: 1766402 - DNA, 21 bp, Homo sapiens
tactgttgcatttacttttaa

SEQ ID NO: 1766403 - DNA, 17 bp, Homo sapiens
tactgttgtaagaattc

SEQ ID NO: 1766404 - DNA, 22 bp, Homo sapiens
tactgttgtaagaattctgatt

SEQ ID NO: 1766405 - DNA, 12 bp, Homo sapiens
tactgtttgtaa

SEQ ID NO: 1766406 - DNA, 17 bp, Homo sapiens
tactgtttgtaatatac

SEQ ID NO: 1766407 - DNA, 20 bp, Homo sapiens
tactgtttgtaatatacagt

SEQ ID NO: 1766408 - DNA, 14 bp, Homo sapiens
tactgttttgggcc

SEQ ID NO: 1766409 - DNA, 15 bp, Homo sapiens
tactgttttgggcct

SEQ ID NO: 1766410 - DNA, 15 bp, Homo sapiens
tactgttttgtatca

SEQ ID NO: 1766411 - DNA, 14 bp, Homo sapiens
tacttaaagattta

SEQ ID NO: 1766412 - DNA, 14 bp, Homo sapiens
tacttaaatggtaa

SEQ ID NO: 1766413 - DNA, 22 bp, Homo sapiens
tacttacctaaacagatataaa

SEQ ID NO: 1766414 - DNA, 16 bp, Homo sapiens
tacttactataatttg

SEQ ID NO: 1766415 - DNA, 15 bp, Homo sapiens
tacttagagatatgt

SEQ ID NO: 1766416 - DNA, 18 bp, Homo sapiens
tacttagctgtactataa

SEQ ID NO: 1766417 - DNA, 20 bp, Homo sapiens
tacttaggttattttgcttt

SEQ ID NO: 1766418 - DNA, 15 bp, Homo sapiens
tacttagtggtatgt

SEQ ID NO: 1766419 - DNA, 19 bp, Homo sapiens
tacttagtggtatgtctct

SEQ ID NO: 1766420 - DNA, 19 bp, Homo sapiens
tacttatttttgacagtgt

SEQ ID NO: 1766421 - DNA, 21 bp, Homo sapiens
tacttcaagttaaagtgaata

SEQ ID NO: 1766422 - DNA, 14 bp, Homo sapiens
tacttcactgtcag

SEQ ID NO: 1766423 - DNA, 19 bp, Homo sapiens
tacttcactgtcaggaaga

SEQ ID NO: 1766424 - DNA, 19 bp, Homo sapiens
tacttcactgtcatcttca

SEQ ID NO: 1766425 - DNA, 14 bp, Homo sapiens
tacttccaagaaaa

SEQ ID NO: 1766426 - DNA, 18 bp, Homo sapiens
tacttccccagctctcag

SEQ ID NO: 1766427 - DNA, 20 bp, Homo sapiens
tagatgtatttttgatgtat

SEQ ID NO: 1766428 - DNA, 21 bp, Homo sapiens
tagatgtctaggtacttcagg

SEQ ID NO: 1766429 - DNA, 16 bp, Homo sapiens
tagatgttcttttcta

SEQ ID NO: 1766430 - DNA, 21 bp, Homo sapiens
tagatgttcttttctatttat

SEQ ID NO: 1766431 - DNA, 14 bp, Homo sapiens
tagatgtttaacaa

SEQ ID NO: 1766432 - DNA, 18 bp, Homo sapiens
tagattaagagatgggtt

SEQ ID NO: 1766433 - DNA, 15 bp, Homo sapiens
tagattaatggcact

SEQ ID NO: 1766434 - DNA, 17 bp, Homo sapiens
tagattaggtagacttt

SEQ ID NO: 1766435 - DNA, 15 bp, Homo sapiens
tagattatgtctttc

SEQ ID NO: 1766436 - DNA, 16 bp, Homo sapiens
tagattcaaaggttct

SEQ ID NO: 1766437 - DNA, 18 bp, Homo sapiens
tagattcaaaggttctag

SEQ ID NO: 1766438 - DNA, 20 bp, Homo sapiens
tagattccattggtccaaga

SEQ ID NO: 1766439 - DNA, 23 bp, Homo sapiens
tagattctctggctgtaaggctc

SEQ ID NO: 1766440 - DNA, 23 bp, Homo sapiens
tagattctctgtgtctaagattc

SEQ ID NO: 1766441 - DNA, 23 bp, Homo sapiens
tagattctcttgtataagatcct

SEQ ID NO: 1766442 - DNA, 16 bp, Homo sapiens
tagattgttaaaataa

SEQ ID NO: 1766443 - DNA, 11 bp, Homo sapiens
tagatttatgg

SEQ ID NO: 1766444 - DNA, 19 bp, Homo sapiens
tagatttctggcatatgtt

SEQ ID NO: 1766445 - DNA, 11 bp, Homo sapiens
tagatttgtcc

SEQ ID NO: 1766446 - DNA, 17 bp, Homo sapiens
tagatttgtccttttat

SEQ ID NO: 1766447 - DNA, 16 bp, Homo sapiens
tagattttaatttatt

SEQ ID NO: 1766448 - DNA, 18 bp, Homo sapiens
tagattttaatttatttg

SEQ ID NO: 1766449 - DNA, 16 bp, Homo sapiens
tagattttattttact

SEQ ID NO: 1766450 - DNA, 15 bp, Homo sapiens
tagattttgtgttta

SEQ ID NO: 1766451 - DNA, 14 bp, Homo sapiens
tagcaaactttgta

SEQ ID NO: 1766452 - DNA, 23 bp, Homo sapiens
tagcaaagcaaaaggctgagaag

SEQ ID NO: 1766453 - DNA, 12 bp, Homo sapiens
tagcaaatatgc

SEQ ID NO: 1766454 - DNA, 17 bp, Homo sapiens
tagcaaatgttttgaca

SEQ ID NO: 1766455 - DNA, 20 bp, Homo sapiens
tagcaactgctggtgatttt

SEQ ID NO: 1766456 - DNA, 17 bp, Homo sapiens
tagcaagaagattctaa

SEQ ID NO: 1766457 - DNA, 18 bp, Homo sapiens
tagcaagaagattctaaa

SEQ ID NO: 1766458 - DNA, 24 bp, Homo sapiens
tagcaagattgcttaaaatagcaa

SEQ ID NO: 1766459 - DNA, 15 bp, Homo sapiens
tagcaagcttttgct

SEQ ID NO: 1766460 - DNA, 16 bp, Homo sapiens
tagcaagcttttgctc

SEQ ID NO: 1766461 - DNA, 15 bp, Homo sapiens
tagcaataaatgctt

SEQ ID NO: 1766462 - DNA, 23 bp, Homo sapiens
tagcaataaatgcttttctaatg

SEQ ID NO: 1766463 - DNA, 19 bp, Homo sapiens
tagcaataggctgtaatca

SEQ ID NO: 1766464 - DNA, 21 bp, Homo sapiens
tagcaatccatgttagttttt

SEQ ID NO: 1766465 - DNA, 17 bp, Homo sapiens
tagcaatgtgccttgat

SEQ ID NO: 1766466 - DNA, 15 bp, Homo sapiens
tagcaattttctttg

SEQ ID NO: 1766467 - DNA, 17 bp, Homo sapiens
tagcacacttttccaca

SEQ ID NO: 1766468 - DNA, 19 bp, Homo sapiens
tagcacagcactttggttt

SEQ ID NO: 1766469 - DNA, 22 bp, Homo sapiens
tagcacatacacccccttgtag

SEQ ID NO: 1766470 - DNA, 15 bp, Homo sapiens
tagcacatggtttaa

SEQ ID NO: 1766471 - DNA, 22 bp, Homo sapiens
tagcacatggtttaaatatgaa

SEQ ID NO: 1766472 - DNA, 19 bp, Homo sapiens
tagcactgacagatttcca

SEQ ID NO: 1766473 - DNA, 12 bp, Homo sapiens
tagcagagagcc

SEQ ID NO: 1766474 - DNA, 13 bp, Homo sapiens
tagcagagagcca

SEQ ID NO: 1766475 - DNA, 11 bp, Homo sapiens
tagcagagcct

SEQ ID NO: 1766476 - DNA, 22 bp, Homo sapiens
tagcagagtgaggatgtgtttt

SEQ ID NO: 1766477 - DNA, 13 bp, Homo sapiens
tagcagagttaaa

SEQ ID NO: 1766478 - DNA, 14 bp, Homo sapiens
tagcagagttaaat

SEQ ID NO: 1766479 - DNA, 14 bp, Homo sapiens
tagcagatggagta

SEQ ID NO: 1766480 - DNA, 12 bp, Homo sapiens
tagcagcaggct

SEQ ID NO: 1766481 - DNA, 14 bp, Homo sapiens
tagcagcaggctca

SEQ ID NO: 1766482 - DNA, 16 bp, Homo sapiens
tagcagcccaccctgc

SEQ ID NO: 1766483 - DNA, 12 bp, Homo sapiens
tagcagcctggg

SEQ ID NO: 1766484 - DNA, 14 bp, Homo sapiens
tagcagctatctct

SEQ ID NO: 1766485 - DNA, 16 bp, Homo sapiens
tagcagggatgttcct

SEQ ID NO: 1766486 - DNA, 22 bp, Homo sapiens
tagcaggggaattccctccccc

SEQ ID NO: 1766487 - DNA, 16 bp, Homo sapiens
tagcagtaaaagatga

SEQ ID NO: 1766488 - DNA, 22 bp, Homo sapiens
tagcagtttagaatggaggaag

SEQ ID NO: 1766489 - DNA, 18 bp, Homo sapiens
tagcatatgacaaatgtt

SEQ ID NO: 1766490 - DNA, 19 bp, Homo sapiens
tagcatatgacaaatgttt

SEQ ID NO: 1766491 - DNA, 14 bp, Homo sapiens
tagcatccaggctg

SEQ ID NO: 1766492 - DNA, 14 bp, Homo sapiens
tagcatcctgatta

SEQ ID NO: 1766493 - DNA, 15 bp, Homo sapiens
tagcatcctgattat

SEQ ID NO: 1766494 - DNA, 20 bp, Homo sapiens
tagcatcctgattattgaat

SEQ ID NO: 1766495 - DNA, 19 bp, Homo sapiens
tagcatgcttcctttctct

SEQ ID NO: 1766496 - DNA, 15 bp, Homo sapiens
tagcatggcatattt

SEQ ID NO: 1766497 - DNA, 18 bp, Homo sapiens
tagcatggcatatttttc

SEQ ID NO: 1766498 - DNA, 21 bp, Homo sapiens
tagcatggcatatttttcaca

SEQ ID NO: 1766499 - DNA, 21 bp, Homo sapiens
tagcatggggcccctggccca

SEQ ID NO: 1766500 - DNA, 12 bp, Homo sapiens
tagcatgtaatg

SEQ ID NO: 1766501 - DNA, 14 bp, Homo sapiens
tagcattctttgga

SEQ ID NO: 1766502 - DNA, 12 bp, Homo sapiens
tagcattgttat

SEQ ID NO: 1766503 - DNA, 15 bp, Homo sapiens
tagcatttttatgca

SEQ ID NO: 1766504 - DNA, 20 bp, Homo sapiens
tagcatttttatgcagacag

SEQ ID NO: 1766505 - DNA, 21 bp, Homo sapiens
tagcatttttatgcagacagt

SEQ ID NO: 1766506 - DNA, 20 bp, Homo sapiens
tagccaactgtttccctgct

SEQ ID NO: 1766507 - DNA, 21 bp, Homo sapiens
tagccaactgtttccctgctg

SEQ ID NO: 1766508 - DNA, 20 bp, Homo sapiens
tagccacaaaattgggaaag

SEQ ID NO: 1766509 - DNA, 14 bp, Homo sapiens
tagccacctcccac

SEQ ID NO: 1766510 - DNA, 16 bp, Homo sapiens
tagccactcctgccag

SEQ ID NO: 1766511 - DNA, 22 bp, Homo sapiens
tagccactggcatagccctcct

SEQ ID NO: 1766512 - DNA, 21 bp, Homo sapiens
tagccagacaaaatttgagaa

SEQ ID NO: 1766513 - DNA, 18 bp, Homo sapiens
tagccagagaggagcacc

SEQ ID NO: 1766514 - DNA, 15 bp, Homo sapiens
tagccagatttgtct

SEQ ID NO: 1766515 - DNA, 20 bp, Homo sapiens
tagccagcattcagcacaca

SEQ ID NO: 1766516 - DNA, 18 bp, Homo sapiens
tagccaggagtctgtgct

SEQ ID NO: 1766517 - DNA, 23 bp, Homo sapiens
tagccagtgctccaggcacccag

SEQ ID NO: 1766518 - DNA, 15 bp, Homo sapiens
tagccagttcaaagt

SEQ ID NO: 1766519 - DNA, 22 bp, Homo sapiens
tagccagttcaaagtgtatatt

SEQ ID NO: 1766520 - DNA, 23 bp, Homo sapiens
tagccatgatttgtcccagcctg

SEQ ID NO: 1766521 - DNA, 17 bp, Homo sapiens
tagcccaagaggtctga

SEQ ID NO: 1766522 - DNA, 16 bp, Homo sapiens
tagcccacccccctcc

SEQ ID NO: 1766523 - DNA, 16 bp, Homo sapiens
tagcccagcactgtga

SEQ ID NO: 1766524 - DNA, 14 bp, Homo sapiens
tagcccagtgtttt

SEQ ID NO: 1766525 - DNA, 22 bp, Homo sapiens
tagcccatggacttcacataag

SEQ ID NO: 1766526 - DNA, 18 bp, Homo sapiens
tagccccctggcctctgt

SEQ ID NO: 1766527 - DNA, 23 bp, Homo sapiens
tagccccgagacaccatcctgag

SEQ ID NO: 1766528 - DNA, 23 bp, Homo sapiens
tagcccgacagttctgaactgga

SEQ ID NO: 1766529 - DNA, 18 bp, Homo sapiens
tagccctgcggagccggc

SEQ ID NO: 1766530 - DNA, 14 bp, Homo sapiens
tagcccttcagatt

SEQ ID NO: 1766531 - DNA, 13 bp, Homo sapiens
tagccgacctcag

SEQ ID NO: 1766532 - DNA, 16 bp, Homo sapiens
tagccgacctcagcct

SEQ ID NO: 1766533 - DNA, 15 bp, Homo sapiens
tagccgatggaaaat

SEQ ID NO: 1766534 - DNA, 14 bp, Homo sapiens
tagccgcaccctgc

SEQ ID NO: 1766535 - DNA, 16 bp, Homo sapiens
tagccgtccatggcac

SEQ ID NO: 1766536 - DNA, 18 bp, Homo sapiens
tagccgtccatggcacca

SEQ ID NO: 1766537 - DNA, 19 bp, Homo sapiens
tagccgtccatggcaccag

SEQ ID NO: 1766538 - DNA, 19 bp, Homo sapiens
tagcctaagatatacttgt

SEQ ID NO: 1766539 - DNA, 22 bp, Homo sapiens
tagcctaagatatacttgtttt

SEQ ID NO: 1766540 - DNA, 21 bp, Homo sapiens
tagcctaaggctcctgttttg

SEQ ID NO: 1766541 - DNA, 15 bp, Homo sapiens
tagcctaatttacca

SEQ ID NO: 1766542 - DNA, 15 bp, Homo sapiens
taggttactacctat

SEQ ID NO: 1766543 - DNA, 14 bp, Homo sapiens
taggttcagccaag

SEQ ID NO: 1766544 - DNA, 15 bp, Homo sapiens
taggttctaaagttc

SEQ ID NO: 1766545 - DNA, 16 bp, Homo sapiens
taggttctaaagttct

SEQ ID NO: 1766546 - DNA, 18 bp, Homo sapiens
taggttctaaagttctaa

SEQ ID NO: 1766547 - DNA, 15 bp, Homo sapiens
taggttctgttttgt

SEQ ID NO: 1766548 - DNA, 15 bp, Homo sapiens
taggttgtctaaaaa

SEQ ID NO: 1766549 - DNA, 13 bp, Homo sapiens
taggtttactgtg

SEQ ID NO: 1766550 - DNA, 19 bp, Homo sapiens
taggtttactgtgaagaga

SEQ ID NO: 1766551 - DNA, 14 bp, Homo sapiens
taggttttaaatct

SEQ ID NO: 1766552 - DNA, 16 bp, Homo sapiens
taggttttaaatctgc

SEQ ID NO: 1766553 - DNA, 19 bp, Homo sapiens
taggttttaaatctgcttt

SEQ ID NO: 1766554 - DNA, 21 bp, Homo sapiens
tagtaaaagtggtctctgctg

SEQ ID NO: 1766555 - DNA, 21 bp, Homo sapiens
tagtaaacattaagtaaatgc

SEQ ID NO: 1766556 - DNA, 16 bp, Homo sapiens
tagtaaatcagaaagt

SEQ ID NO: 1766557 - DNA, 14 bp, Homo sapiens
tagtaacactaata

SEQ ID NO: 1766558 - DNA, 15 bp, Homo sapiens
tagtaacactaatat

SEQ ID NO: 1766559 - DNA, 11 bp, Homo sapiens
tagtaagaata

SEQ ID NO: 1766560 - DNA, 16 bp, Homo sapiens
tagtaagatgcactga

SEQ ID NO: 1766561 - DNA, 16 bp, Homo sapiens
tagtaagcatagaaac

SEQ ID NO: 1766562 - DNA, 17 bp, Homo sapiens
tagtaagtatttccata

SEQ ID NO: 1766563 - DNA, 18 bp, Homo sapiens
tagtaataccaaagacta

SEQ ID NO: 1766564 - DNA, 14 bp, Homo sapiens
tagtaatagagcaa

SEQ ID NO: 1766565 - DNA, 20 bp, Homo sapiens
tagtaatagagcaaaattga

SEQ ID NO: 1766566 - DNA, 13 bp, Homo sapiens
tagtaatatattt

SEQ ID NO: 1766567 - DNA, 16 bp, Homo sapiens
tagtaatatatttaaa

SEQ ID NO: 1766568 - DNA, 15 bp, Homo sapiens
tagtaatcacagttg

SEQ ID NO: 1766569 - DNA, 15 bp, Homo sapiens
tagtaatgttttata

SEQ ID NO: 1766570 - DNA, 18 bp, Homo sapiens
tagtaatgttttttagaa

SEQ ID NO: 1766571 - DNA, 24 bp, Homo sapiens
tagtaatttattgtctgtctacat

SEQ ID NO: 1766572 - DNA, 21 bp, Homo sapiens
tagtaatttctttttttcctt

SEQ ID NO: 1766573 - DNA, 16 bp, Homo sapiens
tagtaccaatcatttt

SEQ ID NO: 1766574 - DNA, 12 bp, Homo sapiens
tagtactcaatg

SEQ ID NO: 1766575 - DNA, 14 bp, Homo sapiens
tagtactctctgct

SEQ ID NO: 1766576 - DNA, 19 bp, Homo sapiens
tagtagaaattttacaata

SEQ ID NO: 1766577 - DNA, 20 bp, Homo sapiens
tagtagaaattttacaatag

SEQ ID NO: 1766578 - DNA, 16 bp, Homo sapiens
tagtagttaaataact

SEQ ID NO: 1766579 - DNA, 20 bp, Homo sapiens
tagtagttaaataactgtgt

SEQ ID NO: 1766580 - DNA, 13 bp, Homo sapiens
tagtatatttata

SEQ ID NO: 1766581 - DNA, 16 bp, Homo sapiens
tagtatatttatactc

SEQ ID NO: 1766582 - DNA, 14 bp, Homo sapiens
tagtatctaacatg

SEQ ID NO: 1766583 - DNA, 20 bp, Homo sapiens
tagtatcttcaaactttcac

SEQ ID NO: 1766584 - DNA, 23 bp, Homo sapiens
tagtatgaaattatataagtatt

SEQ ID NO: 1766585 - DNA, 16 bp, Homo sapiens
tagtatggttcaagat

SEQ ID NO: 1766586 - DNA, 20 bp, Homo sapiens
tagtatgtctgtttttgtat

SEQ ID NO: 1766587 - DNA, 23 bp, Homo sapiens
tagtatgtctgtttttgtatctt

SEQ ID NO: 1766588 - DNA, 18 bp, Homo sapiens
tagtattaaaagttgcat

SEQ ID NO: 1766589 - DNA, 19 bp, Homo sapiens
tagtattaaaagttgcatt

SEQ ID NO: 1766590 - DNA, 15 bp, Homo sapiens
tagtattacaccacc

SEQ ID NO: 1766591 - DNA, 22 bp, Homo sapiens
tagtattcctaacctgtcagaa

SEQ ID NO: 1766592 - DNA, 13 bp, Homo sapiens
tagtatttcagtg

SEQ ID NO: 1766593 - DNA, 15 bp, Homo sapiens
tagtcaactgctgtt

SEQ ID NO: 1766594 - DNA, 18 bp, Homo sapiens
tagtcaactgctgtttta

SEQ ID NO: 1766595 - DNA, 23 bp, Homo sapiens
tagtcaagttggacttgttttaa

SEQ ID NO: 1766596 - DNA, 15 bp, Homo sapiens
tagtcaataagaaaa

SEQ ID NO: 1766597 - DNA, 23 bp, Homo sapiens
tagtcacatggcctatgcacata

SEQ ID NO: 1766598 - DNA, 18 bp, Homo sapiens
tagtcaccgacagcggcc

SEQ ID NO: 1766599 - DNA, 19 bp, Homo sapiens
tagtcagaagcaggttctt

SEQ ID NO: 1766600 - DNA, 22 bp, Homo sapiens
tagtcagaagcaggttcttgat

SEQ ID NO: 1766601 - DNA, 16 bp, Homo sapiens
tagtcagctgcctttt

SEQ ID NO: 1766602 - DNA, 18 bp, Homo sapiens
tagtcattccaaatatga

SEQ ID NO: 1766603 - DNA, 21 bp, Homo sapiens
tagtccaaaaagctcctgggg

SEQ ID NO: 1766604 - DNA, 13 bp, Homo sapiens
tagtccaaaatta

SEQ ID NO: 1766605 - DNA, 21 bp, Homo sapiens
tagtccaaatgtgatcaactg

SEQ ID NO: 1766606 - DNA, 14 bp, Homo sapiens
tagtcccagctact

SEQ ID NO: 1766607 - DNA, 15 bp, Homo sapiens
tagtcccagctactc

SEQ ID NO: 1766608 - DNA, 20 bp, Homo sapiens
tagtcccagctactcaggag

SEQ ID NO: 1766609 - DNA, 20 bp, Homo sapiens
tagtccccaaggcctctctc

SEQ ID NO: 1766610 - DNA, 21 bp, Homo sapiens
tagtccccctgttttctgttt

SEQ ID NO: 1766611 - DNA, 14 bp, Homo sapiens
tagtcccttcccct

SEQ ID NO: 1766612 - DNA, 15 bp, Homo sapiens
tagtcccttcccctc

SEQ ID NO: 1766613 - DNA, 16 bp, Homo sapiens
tagtcccttcccctcc

SEQ ID NO: 1766614 - DNA, 22 bp, Homo sapiens
tagtcccttcccctccctggct

SEQ ID NO: 1766615 - DNA, 22 bp, Homo sapiens
tagtcctattctattgcagtta

SEQ ID NO: 1766616 - DNA, 11 bp, Homo sapiens
tagtcctgtga

SEQ ID NO: 1766617 - DNA, 17 bp, Homo sapiens
tagtctaagactatata

SEQ ID NO: 1766618 - DNA, 22 bp, Homo sapiens
tagtctcagtttgtgtgtctta

SEQ ID NO: 1766619 - DNA, 17 bp, Homo sapiens
tagtctcctttgcactg

SEQ ID NO: 1766620 - DNA, 14 bp, Homo sapiens
tagtctgaaactgg

SEQ ID NO: 1766621 - DNA, 17 bp, Homo sapiens
tagtctgaaactggctt

SEQ ID NO: 1766622 - DNA, 20 bp, Homo sapiens
tagtctgaggccccttaact

SEQ ID NO: 1766623 - DNA, 21 bp, Homo sapiens
tagtctgattttaatgaaatc

SEQ ID NO: 1766624 - DNA, 12 bp, Homo sapiens
tagtctggtttc

SEQ ID NO: 1766625 - DNA, 13 bp, Homo sapiens
tagtctggtttct

SEQ ID NO: 1766626 - DNA, 14 bp, Homo sapiens
tagtctgtaataca

SEQ ID NO: 1766627 - DNA, 22 bp, Homo sapiens
tagtcttcagtttcattttcct

SEQ ID NO: 1766628 - DNA, 22 bp, Homo sapiens
tagtcttccacaaaaaatactt

SEQ ID NO: 1766629 - DNA, 22 bp, Homo sapiens
tagtcttctcaaattagaaagt

SEQ ID NO: 1766630 - DNA, 19 bp, Homo sapiens
tagtcttgaaatgaaaggg

SEQ ID NO: 1766631 - DNA, 20 bp, Homo sapiens
tagtcttgaaatgaaaggga

SEQ ID NO: 1766632 - DNA, 19 bp, Homo sapiens
tagtctttttataggtttt

SEQ ID NO: 1766633 - DNA, 20 bp, Homo sapiens
tagtgaaaattgtttagtga

SEQ ID NO: 1766634 - DNA, 15 bp, Homo sapiens
tagtgaagttgtgca

SEQ ID NO: 1766635 - DNA, 18 bp, Homo sapiens
tagtgaatactgctacag

SEQ ID NO: 1766636 - DNA, 15 bp, Homo sapiens
tagtgagacccctgt

SEQ ID NO: 1766637 - DNA, 18 bp, Homo sapiens
tagtgagacccctgtctc

SEQ ID NO: 1766638 - DNA, 19 bp, Homo sapiens
tagtgaggaagacaagcat

SEQ ID NO: 1766639 - DNA, 18 bp, Homo sapiens
tagtgatacactgtatct

SEQ ID NO: 1766640 - DNA, 21 bp, Homo sapiens
tagtgatacactgtatctaaa

SEQ ID NO: 1766641 - DNA, 14 bp, Homo sapiens
tagtgatggttccc

SEQ ID NO: 1766642 - DNA, 13 bp, Homo sapiens
tagtgattctgat

SEQ ID NO: 1766643 - DNA, 18 bp, Homo sapiens
tagtgattctgatttcag

SEQ ID NO: 1766644 - DNA, 20 bp, Homo sapiens
tagtgattctgatttcagtt

SEQ ID NO: 1766645 - DNA, 16 bp, Homo sapiens
tagtgcagctgaaatt

SEQ ID NO: 1766646 - DNA, 18 bp, Homo sapiens
tagtgcagctgaaattga

SEQ ID NO: 1766647 - DNA, 20 bp, Homo sapiens
tagtgcagctgaaattgaaa

SEQ ID NO: 1766648 - DNA, 23 bp, Homo sapiens
tagtgcatttttaaacttgaaat

SEQ ID NO: 1766649 - DNA, 20 bp, Homo sapiens
tagtgccagaattttaggaa

SEQ ID NO: 1766650 - DNA, 23 bp, Homo sapiens
tagtgccctccacagccgcagcc

SEQ ID NO: 1766651 - DNA, 23 bp, Homo sapiens
tagtgccgtagggagtacctgct

SEQ ID NO: 1766652 - DNA, 15 bp, Homo sapiens
tagtgctatgtgtga

SEQ ID NO: 1766653 - DNA, 16 bp, Homo sapiens
tagtgctattctgtgt

SEQ ID NO: 1766654 - DNA, 18 bp, Homo sapiens
tagtgctattctgtgttg

SEQ ID NO: 1766655 - DNA, 18 bp, Homo sapiens
tagtgctggtcagagaga

SEQ ID NO: 1766656 - DNA, 17 bp, Homo sapiens
tatacatagaaactttg

SEQ ID NO: 1766657 - DNA, 16 bp, Homo sapiens
tatacatagcatgaca

SEQ ID NO: 1766658 - DNA, 21 bp, Homo sapiens
tatacatatgagaatatacct

SEQ ID NO: 1766659 - DNA, 16 bp, Homo sapiens
tatacatattgtatat

SEQ ID NO: 1766660 - DNA, 15 bp, Homo sapiens
tatacatgccagtga

SEQ ID NO: 1766661 - DNA, 13 bp, Homo sapiens
tatacatggaatc

SEQ ID NO: 1766662 - DNA, 14 bp, Homo sapiens
tatacatggaatcg

SEQ ID NO: 1766663 - DNA, 15 bp, Homo sapiens
tatacatgtgataca

SEQ ID NO: 1766664 - DNA, 16 bp, Homo sapiens
tatacatgtgtacata

SEQ ID NO: 1766665 - DNA, 17 bp, Homo sapiens
tatacatgtgtacatat

SEQ ID NO: 1766666 - DNA, 22 bp, Homo sapiens
tatacatgtgtacatatatgta

SEQ ID NO: 1766667 - DNA, 17 bp, Homo sapiens
tatacatgtttatgtaa

SEQ ID NO: 1766668 - DNA, 18 bp, Homo sapiens
tatacatgtttatgtaaa

SEQ ID NO: 1766669 - DNA, 19 bp, Homo sapiens
tatacatgtttatgtaaac

SEQ ID NO: 1766670 - DNA, 17 bp, Homo sapiens
tatacatgtttttctat

SEQ ID NO: 1766671 - DNA, 13 bp, Homo sapiens
tatacattttcta

SEQ ID NO: 1766672 - DNA, 17 bp, Homo sapiens
tatacattttctaaata

SEQ ID NO: 1766673 - DNA, 19 bp, Homo sapiens
tatacattttctaaataaa

SEQ ID NO: 1766674 - DNA, 12 bp, Homo sapiens
tataccaataaa

SEQ ID NO: 1766675 - DNA, 18 bp, Homo sapiens
tataccatttcctcagct

SEQ ID NO: 1766676 - DNA, 15 bp, Homo sapiens
tatacccacccagaa

SEQ ID NO: 1766677 - DNA, 15 bp, Homo sapiens
tatacccagtgagga

SEQ ID NO: 1766678 - DNA, 13 bp, Homo sapiens
tatacctgagcct

SEQ ID NO: 1766679 - DNA, 14 bp, Homo sapiens
tatacctgagcctc

SEQ ID NO: 1766680 - DNA, 21 bp, Homo sapiens
tatacctgagcctcaaccttc

SEQ ID NO: 1766681 - DNA, 12 bp, Homo sapiens
tatacctgattt

SEQ ID NO: 1766682 - DNA, 20 bp, Homo sapiens
tatacctggcttttacttta

SEQ ID NO: 1766683 - DNA, 15 bp, Homo sapiens
tatacctggtttact

SEQ ID NO: 1766684 - DNA, 19 bp, Homo sapiens
tatacctgtttaaattgct

SEQ ID NO: 1766685 - DNA, 22 bp, Homo sapiens
tataccttatttatttttgtgt

SEQ ID NO: 1766686 - DNA, 19 bp, Homo sapiens
tatacgtataaatatcagt

SEQ ID NO: 1766687 - DNA, 20 bp, Homo sapiens
tatacgtataaatatcagta

SEQ ID NO: 1766688 - DNA, 19 bp, Homo sapiens
tatactaagatgttcactg

SEQ ID NO: 1766689 - DNA, 20 bp, Homo sapiens
tatactagggagccatttga

SEQ ID NO: 1766690 - DNA, 22 bp, Homo sapiens
tatactagggagccatttgaga

SEQ ID NO: 1766691 - DNA, 16 bp, Homo sapiens
tatactatatttatgg

SEQ ID NO: 1766692 - DNA, 16 bp, Homo sapiens
tatactccatacataa

SEQ ID NO: 1766693 - DNA, 20 bp, Homo sapiens
tatactgaaggaaaaacaca

SEQ ID NO: 1766694 - DNA, 22 bp, Homo sapiens
tatactgaagtcttttctgtca

SEQ ID NO: 1766695 - DNA, 12 bp, Homo sapiens
tatactgcatac

SEQ ID NO: 1766696 - DNA, 13 bp, Homo sapiens
tatactgcatatc

SEQ ID NO: 1766697 - DNA, 18 bp, Homo sapiens
tatactgctatttacact

SEQ ID NO: 1766698 - DNA, 16 bp, Homo sapiens
tatactgggttcttgt

SEQ ID NO: 1766699 - DNA, 24 bp, Homo sapiens
tatactggttatagttgatatgta

SEQ ID NO: 1766700 - DNA, 18 bp, Homo sapiens
tatactgtgtgcttgttt

SEQ ID NO: 1766701 - DNA, 18 bp, Homo sapiens
tatacttattttattttt

SEQ ID NO: 1766702 - DNA, 13 bp, Homo sapiens
tatactttgttct

SEQ ID NO: 1766703 - DNA, 21 bp, Homo sapiens
tatactttgttctgttgtctg

SEQ ID NO: 1766704 - DNA, 14 bp, Homo sapiens
tatagaaactctca

SEQ ID NO: 1766705 - DNA, 13 bp, Homo sapiens
tatagaaagctat

SEQ ID NO: 1766706 - DNA, 24 bp, Homo sapiens
tatagaaagctatataagacaaga

SEQ ID NO: 1766707 - DNA, 13 bp, Homo sapiens
tatagaaagctgt

SEQ ID NO: 1766708 - DNA, 18 bp, Homo sapiens
tatagaaggaatttgtac

SEQ ID NO: 1766709 - DNA, 17 bp, Homo sapiens
tatagaagtctggaaaa

SEQ ID NO: 1766710 - DNA, 21 bp, Homo sapiens
tatagaatatttattacctct

SEQ ID NO: 1766711 - DNA, 18 bp, Homo sapiens
tatagacaaaagaataag

SEQ ID NO: 1766712 - DNA, 17 bp, Homo sapiens
tatagacattctcacat

SEQ ID NO: 1766713 - DNA, 14 bp, Homo sapiens
tatagaccaaagca

SEQ ID NO: 1766714 - DNA, 20 bp, Homo sapiens
tatagacggtgctcactccc

SEQ ID NO: 1766715 - DNA, 21 bp, Homo sapiens
tatagacgtttggactgattt

SEQ ID NO: 1766716 - DNA, 22 bp, Homo sapiens
tatagagacaggacagaatgtg

SEQ ID NO: 1766717 - DNA, 20 bp, Homo sapiens
tatagagcagaaattctgtt

SEQ ID NO: 1766718 - DNA, 18 bp, Homo sapiens
tatagagtcattgtaatg

SEQ ID NO: 1766719 - DNA, 20 bp, Homo sapiens
tatagagtcattgtaatgtt

SEQ ID NO: 1766720 - DNA, 14 bp, Homo sapiens
tatagattctaaag

SEQ ID NO: 1766721 - DNA, 17 bp, Homo sapiens
tatagcaactaatgttt

SEQ ID NO: 1766722 - DNA, 13 bp, Homo sapiens
tatagcaatccat

SEQ ID NO: 1766723 - DNA, 14 bp, Homo sapiens
tatagccatgattt

SEQ ID NO: 1766724 - DNA, 19 bp, Homo sapiens
tatagcctatggcagaaaa

SEQ ID NO: 1766725 - DNA, 17 bp, Homo sapiens
tataggacaaaatgtta

SEQ ID NO: 1766726 - DNA, 24 bp, Homo sapiens
tataggagaaagcaaaatacatca

SEQ ID NO: 1766727 - DNA, 16 bp, Homo sapiens
tataggatattgctaa

SEQ ID NO: 1766728 - DNA, 14 bp, Homo sapiens
tataggcagcttct

SEQ ID NO: 1766729 - DNA, 17 bp, Homo sapiens
tataggcagcttctaag

SEQ ID NO: 1766730 - DNA, 20 bp, Homo sapiens
tataggtcctgtgttaaaca

SEQ ID NO: 1766731 - DNA, 13 bp, Homo sapiens
tatagtatatctg

SEQ ID NO: 1766732 - DNA, 17 bp, Homo sapiens
tatagtatatttatact

SEQ ID NO: 1766733 - DNA, 16 bp, Homo sapiens
tatagtctaagactat

SEQ ID NO: 1766734 - DNA, 20 bp, Homo sapiens
tatagtctaagactatatat

SEQ ID NO: 1766735 - DNA, 11 bp, Homo sapiens
tatagtgccta

SEQ ID NO: 1766736 - DNA, 17 bp, Homo sapiens
tatagtgggtacatcaa

SEQ ID NO: 1766737 - DNA, 20 bp, Homo sapiens
tatagtgttcacaaactgtg

SEQ ID NO: 1766738 - DNA, 16 bp, Homo sapiens
tatagttactgtgtaa

SEQ ID NO: 1766739 - DNA, 16 bp, Homo sapiens
tatagttttactttta

SEQ ID NO: 1766740 - DNA, 12 bp, Homo sapiens
tatataaaaaga

SEQ ID NO: 1766741 - DNA, 20 bp, Homo sapiens
tatataaaaagaaaagataa

SEQ ID NO: 1766742 - DNA, 23 bp, Homo sapiens
tatataaaaagaaaagataaaga

SEQ ID NO: 1766743 - DNA, 19 bp, Homo sapiens
tatataaaacttaaaaaca

SEQ ID NO: 1766744 - DNA, 21 bp, Homo sapiens
tatataaaatattttcataca

SEQ ID NO: 1766745 - DNA, 22 bp, Homo sapiens
tatataaagacaacaaaagaaa

SEQ ID NO: 1766746 - DNA, 12 bp, Homo sapiens
tatataaatgta

SEQ ID NO: 1766747 - DNA, 17 bp, Homo sapiens
tatataacatatatgga

SEQ ID NO: 1766748 - DNA, 12 bp, Homo sapiens
tatataactttt

SEQ ID NO: 1766749 - DNA, 14 bp, Homo sapiens
tatataagactatt

SEQ ID NO: 1766750 - DNA, 18 bp, Homo sapiens
tatataagttgctgtgtg

SEQ ID NO: 1766751 - DNA, 15 bp, Homo sapiens
tatataatggtttca

SEQ ID NO: 1766752 - DNA, 19 bp, Homo sapiens
tatataatggtttcaaaga

SEQ ID NO: 1766753 - DNA, 22 bp, Homo sapiens
tatatacaaggtgagtgtgact

SEQ ID NO: 1766754 - DNA, 16 bp, Homo sapiens
tatatacaataacata

SEQ ID NO: 1766755 - DNA, 22 bp, Homo sapiens
tatatacagtaactttatgtgt

SEQ ID NO: 1766756 - DNA, 21 bp, Homo sapiens
tatatagaatgatctattgct

SEQ ID NO: 1766757 - DNA, 21 bp, Homo sapiens
tatatagattataacttgtct

SEQ ID NO: 1766758 - DNA, 14 bp, Homo sapiens
tatatagggcacaa

SEQ ID NO: 1766759 - DNA, 11 bp, Homo sapiens
tatatagtata

SEQ ID NO: 1766760 - DNA, 13 bp, Homo sapiens
tatatagtatatt

SEQ ID NO: 1766761 - DNA, 19 bp, Homo sapiens
tatatagtatatttatact

SEQ ID NO: 1766762 - DNA, 19 bp, Homo sapiens
tatatagttccttgcctta

SEQ ID NO: 1766763 - DNA, 15 bp, Homo sapiens
tatatataataaata

SEQ ID NO: 1766764 - DNA, 16 bp, Homo sapiens
tatatatagcagcttt

SEQ ID NO: 1766765 - DNA, 14 bp, Homo sapiens
tatatatatataac

SEQ ID NO: 1766766 - DNA, 16 bp, Homo sapiens
tatatatatatgtata

SEQ ID NO: 1766767 - DNA, 13 bp, Homo sapiens
tatatatatctat

SEQ ID NO: 1766768 - DNA, 13 bp, Homo sapiens
tatatatatgcat

SEQ ID NO: 1766769 - DNA, 15 bp, Homo sapiens
tatatatatttctag

SEQ ID NO: 1766770 - DNA, 16 bp, Homo sapiens
tatatatctacaatat

SEQ ID NO: 1766771 - DNA, 12 bp, Homo sapiens
tatctagaaaga

SEQ ID NO: 1766772 - DNA, 17 bp, Homo sapiens
tatctagaaagaaaaga

SEQ ID NO: 1766773 - DNA, 14 bp, Homo sapiens
tatctagtaatata

SEQ ID NO: 1766774 - DNA, 15 bp, Homo sapiens
tatctatatatgtgt

SEQ ID NO: 1766775 - DNA, 13 bp, Homo sapiens
tatctatatcata

SEQ ID NO: 1766776 - DNA, 14 bp, Homo sapiens
tatctatcttccaa

SEQ ID NO: 1766777 - DNA, 16 bp, Homo sapiens
tatctatgtggaaaac

SEQ ID NO: 1766778 - DNA, 18 bp, Homo sapiens
tatctattctgagaaaac

SEQ ID NO: 1766779 - DNA, 19 bp, Homo sapiens
tatctattctgagaaaaca

SEQ ID NO: 1766780 - DNA, 16 bp, Homo sapiens
tatctatttgagagca

SEQ ID NO: 1766781 - DNA, 16 bp, Homo sapiens
tatctatttgtacaat

SEQ ID NO: 1766782 - DNA, 17 bp, Homo sapiens
tatctcaaaactgcact

SEQ ID NO: 1766783 - DNA, 10 bp, Homo sapiens
tatctcagaa

SEQ ID NO: 1766784 - DNA, 13 bp, Homo sapiens
tatctcagaaagt

SEQ ID NO: 1766785 - DNA, 22 bp, Homo sapiens
tatctcagtctaaggtctcatg

SEQ ID NO: 1766786 - DNA, 23 bp, Homo sapiens
tatctccttcccctacacctccc

SEQ ID NO: 1766787 - DNA, 21 bp, Homo sapiens
tatctcctttgtattctgtct

SEQ ID NO: 1766788 - DNA, 19 bp, Homo sapiens
tatctcgtaatagcttctg

SEQ ID NO: 1766789 - DNA, 21 bp, Homo sapiens
tatctcgtaatagcttctgtg

SEQ ID NO: 1766790 - DNA, 17 bp, Homo sapiens
tatctctatttgagaat

SEQ ID NO: 1766791 - DNA, 23 bp, Homo sapiens
tatctctgccaacatgaggacag

SEQ ID NO: 1766792 - DNA, 14 bp, Homo sapiens
tatctcttcagtct

SEQ ID NO: 1766793 - DNA, 16 bp, Homo sapiens
tatctcttcagtctct

SEQ ID NO: 1766794 - DNA, 21 bp, Homo sapiens
tatctcttttatatttgtagg

SEQ ID NO: 1766795 - DNA, 14 bp, Homo sapiens
tatctgaaaatatt

SEQ ID NO: 1766796 - DNA, 15 bp, Homo sapiens
tatctgaaaatgtat

SEQ ID NO: 1766797 - DNA, 21 bp, Homo sapiens
tatctgaagatttccatttgt

SEQ ID NO: 1766798 - DNA, 19 bp, Homo sapiens
tatctgaatgatcctgtct

SEQ ID NO: 1766799 - DNA, 17 bp, Homo sapiens
tatctgagggaggaggc

SEQ ID NO: 1766800 - DNA, 13 bp, Homo sapiens
tatctgaggtcac

SEQ ID NO: 1766801 - DNA, 21 bp, Homo sapiens
tatctgcctggcctggctccc

SEQ ID NO: 1766802 - DNA, 20 bp, Homo sapiens
tatctgctgcctctgaaaat

SEQ ID NO: 1766803 - DNA, 21 bp, Homo sapiens
tatctgctgcctctgaaaata

SEQ ID NO: 1766804 - DNA, 19 bp, Homo sapiens
tatctggaacaacttgtag

SEQ ID NO: 1766805 - DNA, 19 bp, Homo sapiens
tatctggaagtaaccattt

SEQ ID NO: 1766806 - DNA, 20 bp, Homo sapiens
tatctggaggccttccagct

SEQ ID NO: 1766807 - DNA, 23 bp, Homo sapiens
tatctggaggccttccagctgct

SEQ ID NO: 1766808 - DNA, 22 bp, Homo sapiens
tatctggccccaggtagaaact

SEQ ID NO: 1766809 - DNA, 15 bp, Homo sapiens
tatctggcgttcttt

SEQ ID NO: 1766810 - DNA, 16 bp, Homo sapiens
tatctggcttccctgg

SEQ ID NO: 1766811 - DNA, 17 bp, Homo sapiens
tatctgggtaagaagaa

SEQ ID NO: 1766812 - DNA, 21 bp, Homo sapiens
tatctgtaaatttaactgcat

SEQ ID NO: 1766813 - DNA, 22 bp, Homo sapiens
tatctgtatttaattttgacac

SEQ ID NO: 1766814 - DNA, 15 bp, Homo sapiens
tatctgtcagctgca

SEQ ID NO: 1766815 - DNA, 12 bp, Homo sapiens
tatctgttcttg

SEQ ID NO: 1766816 - DNA, 20 bp, Homo sapiens
tatctgtttcctgacattgt

SEQ ID NO: 1766817 - DNA, 22 bp, Homo sapiens
tatctgtttcctgacattgtct

SEQ ID NO: 1766818 - DNA, 13 bp, Homo sapiens
tatcttaagcagg

SEQ ID NO: 1766819 - DNA, 17 bp, Homo sapiens
tatcttaattctttgtt

SEQ ID NO: 1766820 - DNA, 14 bp, Homo sapiens
tatcttacaatatt

SEQ ID NO: 1766821 - DNA, 13 bp, Homo sapiens
tatcttcaaactt

SEQ ID NO: 1766822 - DNA, 18 bp, Homo sapiens
tatcttcaaactttcact

SEQ ID NO: 1766823 - DNA, 19 bp, Homo sapiens
tatcttcaccctcatcctt

SEQ ID NO: 1766824 - DNA, 20 bp, Homo sapiens
tatcttcaccctcatccttt

SEQ ID NO: 1766825 - DNA, 20 bp, Homo sapiens
tatcttcatatgtcaccttt

SEQ ID NO: 1766826 - DNA, 17 bp, Homo sapiens
tatcttctcaagttcta

SEQ ID NO: 1766827 - DNA, 21 bp, Homo sapiens
tatcttctcaagttctaagat

SEQ ID NO: 1766828 - DNA, 22 bp, Homo sapiens
tatcttctcaagttctaagatt

SEQ ID NO: 1766829 - DNA, 15 bp, Homo sapiens
tatcttctttcctca

SEQ ID NO: 1766830 - DNA, 15 bp, Homo sapiens
tatcttgaaatcctg

SEQ ID NO: 1766831 - DNA, 13 bp, Homo sapiens
tatcttgcttgaa

SEQ ID NO: 1766832 - DNA, 20 bp, Homo sapiens
tatcttgcttgaacttacag

SEQ ID NO: 1766833 - DNA, 11 bp, Homo sapiens
tatcttggcct

SEQ ID NO: 1766834 - DNA, 12 bp, Homo sapiens
tatcttgggtgt

SEQ ID NO: 1766835 - DNA, 19 bp, Homo sapiens
tatcttgggtgtattctct

SEQ ID NO: 1766836 - DNA, 23 bp, Homo sapiens
tatcttggtgaatttttttttcc

SEQ ID NO: 1766837 - DNA, 14 bp, Homo sapiens
tatcttgtgcttct

SEQ ID NO: 1766838 - DNA, 17 bp, Homo sapiens
tatcttgttcaggaaaa

SEQ ID NO: 1766839 - DNA, 18 bp, Homo sapiens
tatcttgtttttccacta

SEQ ID NO: 1766840 - DNA, 22 bp, Homo sapiens
tatcttgtttttccactactgc

SEQ ID NO: 1766841 - DNA, 17 bp, Homo sapiens
tatctttagatatttgc

SEQ ID NO: 1766842 - DNA, 19 bp, Homo sapiens
tatctttagatatttgcct

SEQ ID NO: 1766843 - DNA, 16 bp, Homo sapiens
tatctttgattctcct

SEQ ID NO: 1766844 - DNA, 18 bp, Homo sapiens
tatctttgattctccttc

SEQ ID NO: 1766845 - DNA, 19 bp, Homo sapiens
tatctttgattctccttca

SEQ ID NO: 1766846 - DNA, 22 bp, Homo sapiens
tatctttgattctccttcagcc

SEQ ID NO: 1766847 - DNA, 15 bp, Homo sapiens
tatcttttttcaaaa

SEQ ID NO: 1766848 - DNA, 20 bp, Homo sapiens
tatgaaaaaatatgaaccta

SEQ ID NO: 1766849 - DNA, 18 bp, Homo sapiens
tatgaaaaacaaaaataa

SEQ ID NO: 1766850 - DNA, 15 bp, Homo sapiens
tatgaacagctgtgt

SEQ ID NO: 1766851 - DNA, 19 bp, Homo sapiens
tatgaacatattgttgaaa

SEQ ID NO: 1766852 - DNA, 13 bp, Homo sapiens
tatgaacattgta

SEQ ID NO: 1766853 - DNA, 18 bp, Homo sapiens
tatgaacattgtactgtt

SEQ ID NO: 1766854 - DNA, 17 bp, Homo sapiens
tatgaacctattttcat

SEQ ID NO: 1766855 - DNA, 20 bp, Homo sapiens
tatgaacctattttcatttg

SEQ ID NO: 1766856 - DNA, 15 bp, Homo sapiens
tatgaagaaaatact

SEQ ID NO: 1766857 - DNA, 14 bp, Homo sapiens
tatgaagaactgag

SEQ ID NO: 1766858 - DNA, 17 bp, Homo sapiens
tatgaagttgctgttta

SEQ ID NO: 1766859 - DNA, 12 bp, Homo sapiens
tatgaataaagt

SEQ ID NO: 1766860 - DNA, 12 bp, Homo sapiens
tatgaatacagg

SEQ ID NO: 1766861 - DNA, 17 bp, Homo sapiens
tatgaatatatgttttg

SEQ ID NO: 1766862 - DNA, 13 bp, Homo sapiens
tatgaatctatgc

SEQ ID NO: 1766863 - DNA, 14 bp, Homo sapiens
tatgaatgaacaaa

SEQ ID NO: 1766864 - DNA, 21 bp, Homo sapiens
tatgaattcaagaaaggaaat

SEQ ID NO: 1766865 - DNA, 18 bp, Homo sapiens
tatgaattgaattatctt

SEQ ID NO: 1766866 - DNA, 13 bp, Homo sapiens
tatgaattgtaca

SEQ ID NO: 1766867 - DNA, 17 bp, Homo sapiens
tatgaatttaaatataa

SEQ ID NO: 1766868 - DNA, 20 bp, Homo sapiens
tatgaatttaaatataattc

SEQ ID NO: 1766869 - DNA, 14 bp, Homo sapiens
tatgacaaatgttt

SEQ ID NO: 1766870 - DNA, 16 bp, Homo sapiens
tatgacaaatgtttct

SEQ ID NO: 1766871 - DNA, 17 bp, Homo sapiens
tatgacaaatgtttcta

SEQ ID NO: 1766872 - DNA, 14 bp, Homo sapiens
tatgacaaattcaa

SEQ ID NO: 1766873 - DNA, 17 bp, Homo sapiens
tatgacaaattcaagag

SEQ ID NO: 1766874 - DNA, 13 bp, Homo sapiens
tatgacactgagc

SEQ ID NO: 1766875 - DNA, 19 bp, Homo sapiens
tatgacataaaaacaactt

SEQ ID NO: 1766876 - DNA, 20 bp, Homo sapiens
tatgacatcacttgtacaaa

SEQ ID NO: 1766877 - DNA, 16 bp, Homo sapiens
tatgacatgaaatgaa

SEQ ID NO: 1766878 - DNA, 12 bp, Homo sapiens
tatgacatttaa

SEQ ID NO: 1766879 - DNA, 21 bp, Homo sapiens
tatgacctaaatccattttct

SEQ ID NO: 1766880 - DNA, 22 bp, Homo sapiens
tatgacctaagtcaggtaatat

SEQ ID NO: 1766881 - DNA, 19 bp, Homo sapiens
tatgacggaagaacataga

SEQ ID NO: 1766882 - DNA, 14 bp, Homo sapiens
tatgactaaagaga

SEQ ID NO: 1766883 - DNA, 15 bp, Homo sapiens
tatgactaaagagag

SEQ ID NO: 1766884 - DNA, 16 bp, Homo sapiens
tatgactaaagagaga

SEQ ID NO: 1766885 - DNA, 18 bp, Homo sapiens
tatgactaaagagagaat

SEQ ID NO: 1766886 - DNA, 14 bp, Homo sapiens
tatgttgtaataaa

SEQ ID NO: 1766887 - DNA, 16 bp, Homo sapiens
tatgttgtccaattgt

SEQ ID NO: 1766888 - DNA, 16 bp, Homo sapiens
tatgttgttttgtaca

SEQ ID NO: 1766889 - DNA, 14 bp, Homo sapiens
tatgtttacatatc

SEQ ID NO: 1766890 - DNA, 18 bp, Homo sapiens
tatgtttaccttttaatt

SEQ ID NO: 1766891 - DNA, 17 bp, Homo sapiens
tatgtttattacaattt

SEQ ID NO: 1766892 - DNA, 23 bp, Homo sapiens
tatgtttattacaatttttaata

SEQ ID NO: 1766893 - DNA, 18 bp, Homo sapiens
tatgtttatttactaatt

SEQ ID NO: 1766894 - DNA, 18 bp, Homo sapiens
tatgtttgctgattattt

SEQ ID NO: 1766895 - DNA, 19 bp, Homo sapiens
tatgtttgctgattattta

SEQ ID NO: 1766896 - DNA, 11 bp, Homo sapiens
tattaaaacac

SEQ ID NO: 1766897 - DNA, 12 bp, Homo sapiens
tattaaaactca

SEQ ID NO: 1766898 - DNA, 11 bp, Homo sapiens
tattaaaatct

SEQ ID NO: 1766899 - DNA, 10 bp, Homo sapiens
tattaaaatt

SEQ ID NO: 1766900 - DNA, 22 bp, Homo sapiens
tattaaaattctgatgtttctg

SEQ ID NO: 1766901 - DNA, 23 bp, Homo sapiens
tattaaaattctgatgtttctgt

SEQ ID NO: 1766902 - DNA, 19 bp, Homo sapiens
tattaaaattgttaatatg

SEQ ID NO: 1766903 - DNA, 16 bp, Homo sapiens
tattaaaattgttgtc

SEQ ID NO: 1766904 - DNA, 12 bp, Homo sapiens
tattaaacaaag

SEQ ID NO: 1766905 - DNA, 13 bp, Homo sapiens
tattaaacaaagt

SEQ ID NO: 1766906 - DNA, 18 bp, Homo sapiens
tattaaacaaagtttcag

SEQ ID NO: 1766907 - DNA, 20 bp, Homo sapiens
tattaaacagatttttacaa

SEQ ID NO: 1766908 - DNA, 23 bp, Homo sapiens
tattaaacagatttttacaaatg

SEQ ID NO: 1766909 - DNA, 17 bp, Homo sapiens
tattaaacttgtcagaa

SEQ ID NO: 1766910 - DNA, 18 bp, Homo sapiens
tattaaacttgtcagaat

SEQ ID NO: 1766911 - DNA, 23 bp, Homo sapiens
tattaaagaatccttatctataa

SEQ ID NO: 1766912 - DNA, 20 bp, Homo sapiens
tattaaagattctctttaaa

SEQ ID NO: 1766913 - DNA, 13 bp, Homo sapiens
tattaaagggggg

SEQ ID NO: 1766914 - DNA, 18 bp, Homo sapiens
tattaaagtgctaaggtt

SEQ ID NO: 1766915 - DNA, 22 bp, Homo sapiens
tattaaagtgctaaggttctaa

SEQ ID NO: 1766916 - DNA, 12 bp, Homo sapiens
tattaaatacag

SEQ ID NO: 1766917 - DNA, 13 bp, Homo sapiens
tattaaatacaga

SEQ ID NO: 1766918 - DNA, 17 bp, Homo sapiens
tattaaatacagacact

SEQ ID NO: 1766919 - DNA, 23 bp, Homo sapiens
tattaaatgcttcatttgtatgt

SEQ ID NO: 1766920 - DNA, 19 bp, Homo sapiens
tattaaattaaattttgtg

SEQ ID NO: 1766921 - DNA, 16 bp, Homo sapiens
tattaacaaattatgt

SEQ ID NO: 1766922 - DNA, 23 bp, Homo sapiens
tattaacaacaataacactgtct

SEQ ID NO: 1766923 - DNA, 21 bp, Homo sapiens
tattaacacgctgcctggtct

SEQ ID NO: 1766924 - DNA, 22 bp, Homo sapiens
tattaactgctcagtgtttcat

SEQ ID NO: 1766925 - DNA, 23 bp, Homo sapiens
tattaagaaaggaagcattgtaa

SEQ ID NO: 1766926 - DNA, 13 bp, Homo sapiens
tattaagacagtg

SEQ ID NO: 1766927 - DNA, 17 bp, Homo sapiens
tattaagacagtgtaca

SEQ ID NO: 1766928 - DNA, 21 bp, Homo sapiens
tattaagacagtgtacaaaac

SEQ ID NO: 1766929 - DNA, 15 bp, Homo sapiens
tattaagatttccaa

SEQ ID NO: 1766930 - DNA, 19 bp, Homo sapiens
tattaagctttttggaatc

SEQ ID NO: 1766931 - DNA, 16 bp, Homo sapiens
tattaaggaaaaaagc

SEQ ID NO: 1766932 - DNA, 21 bp, Homo sapiens
tattaagtctgggatgtagaa

SEQ ID NO: 1766933 - DNA, 14 bp, Homo sapiens
tattaagtttgaaa

SEQ ID NO: 1766934 - DNA, 13 bp, Homo sapiens
tattaataaagca

SEQ ID NO: 1766935 - DNA, 17 bp, Homo sapiens
tattaataaagcattct

SEQ ID NO: 1766936 - DNA, 18 bp, Homo sapiens
tattaataaagcattctt

SEQ ID NO: 1766937 - DNA, 14 bp, Homo sapiens
tattaataatattt

SEQ ID NO: 1766938 - DNA, 14 bp, Homo sapiens
tattaatcaagaga

SEQ ID NO: 1766939 - DNA, 19 bp, Homo sapiens
tattaatcaagagaaactt

SEQ ID NO: 1766940 - DNA, 20 bp, Homo sapiens
tattaatcttattgtttaat

SEQ ID NO: 1766941 - DNA, 19 bp, Homo sapiens
tattaatctttcttttgat

SEQ ID NO: 1766942 - DNA, 13 bp, Homo sapiens
tattaatgccttt

SEQ ID NO: 1766943 - DNA, 14 bp, Homo sapiens
tattaatgccttta

SEQ ID NO: 1766944 - DNA, 13 bp, Homo sapiens
tattacaacattt

SEQ ID NO: 1766945 - DNA, 17 bp, Homo sapiens
tattacaagtaatgtaa

SEQ ID NO: 1766946 - DNA, 15 bp, Homo sapiens
tattacaatgtatct

SEQ ID NO: 1766947 - DNA, 16 bp, Homo sapiens
tattacaatttttaat

SEQ ID NO: 1766948 - DNA, 17 bp, Homo sapiens
tattacatatatcatta

SEQ ID NO: 1766949 - DNA, 15 bp, Homo sapiens
tattacatctaatgc

SEQ ID NO: 1766950 - DNA, 17 bp, Homo sapiens
tattacatctaatgctt

SEQ ID NO: 1766951 - DNA, 13 bp, Homo sapiens
tattaccagcaag

SEQ ID NO: 1766952 - DNA, 21 bp, Homo sapiens
tattaccagcaagaataaaaa

SEQ ID NO: 1766953 - DNA, 23 bp, Homo sapiens
tattaccctaagaatgctttgcc

SEQ ID NO: 1766954 - DNA, 16 bp, Homo sapiens
tattactctcaaaatc

SEQ ID NO: 1766955 - DNA, 16 bp, Homo sapiens
tattactgacatttct

SEQ ID NO: 1766956 - DNA, 18 bp, Homo sapiens
tattactgacatttcttc

SEQ ID NO: 1766957 - DNA, 19 bp, Homo sapiens
tattactgttgcatttact

SEQ ID NO: 1766958 - DNA, 18 bp, Homo sapiens
tattactgttttgggcct

SEQ ID NO: 1766959 - DNA, 23 bp, Homo sapiens
tattactttgtcttttcaatctt

SEQ ID NO: 1766960 - DNA, 23 bp, Homo sapiens
tattagaaattagaaaaaaatta

SEQ ID NO: 1766961 - DNA, 14 bp, Homo sapiens
tattagaagccaag

SEQ ID NO: 1766962 - DNA, 17 bp, Homo sapiens
tattagagcgccagctc

SEQ ID NO: 1766963 - DNA, 17 bp, Homo sapiens
tattagataatattttt

SEQ ID NO: 1766964 - DNA, 18 bp, Homo sapiens
tattagcatttgttttag

SEQ ID NO: 1766965 - DNA, 23 bp, Homo sapiens
tattagccaactgtttccctgct

SEQ ID NO: 1766966 - DNA, 15 bp, Homo sapiens
tattagccacaaaat

SEQ ID NO: 1766967 - DNA, 13 bp, Homo sapiens
tattagctcactg

SEQ ID NO: 1766968 - DNA, 19 bp, Homo sapiens
tattaggaaaataaacaga

SEQ ID NO: 1766969 - DNA, 16 bp, Homo sapiens
tattaggatctgcaaa

SEQ ID NO: 1766970 - DNA, 21 bp, Homo sapiens
tattaggtgcaatttcaaggt

SEQ ID NO: 1766971 - DNA, 21 bp, Homo sapiens
tattagtactgctcttgtttc

SEQ ID NO: 1766972 - DNA, 14 bp, Homo sapiens
tattagtgattctg

SEQ ID NO: 1766973 - DNA, 16 bp, Homo sapiens
tattagtgctttgcca

SEQ ID NO: 1766974 - DNA, 14 bp, Homo sapiens
tattataaactata

SEQ ID NO: 1766975 - DNA, 19 bp, Homo sapiens
tattataacaagtgtgtct

SEQ ID NO: 1766976 - DNA, 15 bp, Homo sapiens
tattataacttaaaa

SEQ ID NO: 1766977 - DNA, 21 bp, Homo sapiens
tattataagggagagctgagc

SEQ ID NO: 1766978 - DNA, 22 bp, Homo sapiens
tattataagggagagctgagcc

SEQ ID NO: 1766979 - DNA, 19 bp, Homo sapiens
tattatacatgtgatacat

SEQ ID NO: 1766980 - DNA, 12 bp, Homo sapiens
tattatatatat

SEQ ID NO: 1766981 - DNA, 13 bp, Homo sapiens
tattatatatatc

SEQ ID NO: 1766982 - DNA, 14 bp, Homo sapiens
tattatatatatct

SEQ ID NO: 1766983 - DNA, 20 bp, Homo sapiens
tattatcaaagggataaaga

SEQ ID NO: 1766984 - DNA, 13 bp, Homo sapiens
tattatcacatta

SEQ ID NO: 1766985 - DNA, 22 bp, Homo sapiens
tattatcacattaatctcaaag

SEQ ID NO: 1766986 - DNA, 20 bp, Homo sapiens
tattatcttgttcaggaaaa

SEQ ID NO: 1766987 - DNA, 12 bp, Homo sapiens
tattatgagcca

SEQ ID NO: 1766988 - DNA, 16 bp, Homo sapiens
tattatgagctttctt

SEQ ID NO: 1766989 - DNA, 19 bp, Homo sapiens
tattatgaggctattaaaa

SEQ ID NO: 1766990 - DNA, 13 bp, Homo sapiens
tattatgcataaa

SEQ ID NO: 1766991 - DNA, 18 bp, Homo sapiens
tattatgtaggtaagact

SEQ ID NO: 1766992 - DNA, 14 bp, Homo sapiens
tattatgtttatta

SEQ ID NO: 1766993 - DNA, 16 bp, Homo sapiens
tattatgtttattaca

SEQ ID NO: 1766994 - DNA, 15 bp, Homo sapiens
tattattataatctt

SEQ ID NO: 1766995 - DNA, 14 bp, Homo sapiens
tattattctgtttt

SEQ ID NO: 1766996 - DNA, 15 bp, Homo sapiens
tattattctgttttg

SEQ ID NO: 1766997 - DNA, 15 bp, Homo sapiens
tattattgtgtgtta

SEQ ID NO: 1766998 - DNA, 14 bp, Homo sapiens
tattatttaaatgt

SEQ ID NO: 1766999 - DNA, 15 bp, Homo sapiens
tattatttataattc

SEQ ID NO: 1767000 - DNA, 12 bp, Homo sapiens
tattatttctgt

SEQ ID NO: 1767001 - DNA, 17 bp, Homo sapiens
tattgattaaaaatgtg

SEQ ID NO: 1767002 - DNA, 15 bp, Homo sapiens
tattgattgggaaaa

SEQ ID NO: 1767003 - DNA, 22 bp, Homo sapiens
tattgattgggaaaacatttgc

SEQ ID NO: 1767004 - DNA, 22 bp, Homo sapiens
tattgcaaaggttccaactgta

SEQ ID NO: 1767005 - DNA, 18 bp, Homo sapiens
tattgcaaggcagtctct

SEQ ID NO: 1767006 - DNA, 22 bp, Homo sapiens
tattgcagaatgtgggtattga

SEQ ID NO: 1767007 - DNA, 15 bp, Homo sapiens
tattgcattaatttt

SEQ ID NO: 1767008 - DNA, 21 bp, Homo sapiens
tattgccttttaatttttaat

SEQ ID NO: 1767009 - DNA, 14 bp, Homo sapiens
tattgcgctgctac

SEQ ID NO: 1767010 - DNA, 19 bp, Homo sapiens
tattgctgtgtaacactgt

SEQ ID NO: 1767011 - DNA, 18 bp, Homo sapiens
tattgctgtttggtttgt

SEQ ID NO: 1767012 - DNA, 13 bp, Homo sapiens
tattgcttcatct

SEQ ID NO: 1767013 - DNA, 22 bp, Homo sapiens
tattggaaatgtgaataagtaa

SEQ ID NO: 1767014 - DNA, 16 bp, Homo sapiens
tattggggtctgaccc

SEQ ID NO: 1767015 - DNA, 17 bp, Homo sapiens
tattggggtctgacccc

SEQ ID NO: 1767016 - DNA, 13 bp, Homo sapiens
tattggtccagct

SEQ ID NO: 1767017 - DNA, 15 bp, Homo sapiens
tattggtgcgttttt

SEQ ID NO: 1767018 - DNA, 15 bp, Homo sapiens
tattgtaaaacaggt

SEQ ID NO: 1767019 - DNA, 16 bp, Homo sapiens
tattgtaacaggcttt

SEQ ID NO: 1767020 - DNA, 15 bp, Homo sapiens
tattgtacaaatgta

SEQ ID NO: 1767021 - DNA, 13 bp, Homo sapiens
tattgtacataaa

SEQ ID NO: 1767022 - DNA, 13 bp, Homo sapiens
tattgtacctctc

SEQ ID NO: 1767023 - DNA, 16 bp, Homo sapiens
tattgtactctgcttt

SEQ ID NO: 1767024 - DNA, 13 bp, Homo sapiens
tattgtataaaaa

SEQ ID NO: 1767025 - DNA, 14 bp, Homo sapiens
tattgtataaaaag

SEQ ID NO: 1767026 - DNA, 13 bp, Homo sapiens
tattgtatgtaag

SEQ ID NO: 1767027 - DNA, 15 bp, Homo sapiens
tattgtatgtaagta

SEQ ID NO: 1767028 - DNA, 16 bp, Homo sapiens
tattgtcagatatttt

SEQ ID NO: 1767029 - DNA, 20 bp, Homo sapiens
tattgtcccctttttagttt

SEQ ID NO: 1767030 - DNA, 19 bp, Homo sapiens
tattgtctgtctacatttc

SEQ ID NO: 1767031 - DNA, 17 bp, Homo sapiens
tattgtgaagtacatat

SEQ ID NO: 1767032 - DNA, 15 bp, Homo sapiens
tattgtgacttcact

SEQ ID NO: 1767033 - DNA, 16 bp, Homo sapiens
tattgtgacttcactg

SEQ ID NO: 1767034 - DNA, 19 bp, Homo sapiens
tattgtgacttcactgtat

SEQ ID NO: 1767035 - DNA, 15 bp, Homo sapiens
tattgtgattctgtt

SEQ ID NO: 1767036 - DNA, 22 bp, Homo sapiens
tattgtgccaactgccaggctg

SEQ ID NO: 1767037 - DNA, 16 bp, Homo sapiens
tattgtggatgtgttc

SEQ ID NO: 1767038 - DNA, 16 bp, Homo sapiens
tattgtgtaatttaag

SEQ ID NO: 1767039 - DNA, 18 bp, Homo sapiens
tattgtgtgcgctgcctg

SEQ ID NO: 1767040 - DNA, 19 bp, Homo sapiens
tattgtgtgcgctgcctgg

SEQ ID NO: 1767041 - DNA, 17 bp, Homo sapiens
tattgttaactcttgtc

SEQ ID NO: 1767042 - DNA, 15 bp, Homo sapiens
tattgttagaaaatg

SEQ ID NO: 1767043 - DNA, 16 bp, Homo sapiens
tattgttagaaaatga

SEQ ID NO: 1767044 - DNA, 21 bp, Homo sapiens
tattgttagggtcagccattt

SEQ ID NO: 1767045 - DNA, 20 bp, Homo sapiens
tattgttgacaactgtgact

SEQ ID NO: 1767046 - DNA, 23 bp, Homo sapiens
tattgttgacaactgtgactgta

SEQ ID NO: 1767047 - DNA, 17 bp, Homo sapiens
tattgttgggaaaggaa

SEQ ID NO: 1767048 - DNA, 17 bp, Homo sapiens
tattgtttaaaatcatt

SEQ ID NO: 1767049 - DNA, 16 bp, Homo sapiens
tattgtttaaaatgta

SEQ ID NO: 1767050 - DNA, 13 bp, Homo sapiens
tattgtttatgta

SEQ ID NO: 1767051 - DNA, 14 bp, Homo sapiens
tattgtttccctcg

SEQ ID NO: 1767052 - DNA, 11 bp, Homo sapiens
tattgtttcta

SEQ ID NO: 1767053 - DNA, 14 bp, Homo sapiens
tattgtttctagaa

SEQ ID NO: 1767054 - DNA, 20 bp, Homo sapiens
tattgtttctttaagaaagt

SEQ ID NO: 1767055 - DNA, 15 bp, Homo sapiens
tattgtttggtaaat

SEQ ID NO: 1767056 - DNA, 17 bp, Homo sapiens
tattgttttctgtaaat

SEQ ID NO: 1767057 - DNA, 18 bp, Homo sapiens
tattgttttctgtaaata

SEQ ID NO: 1767058 - DNA, 13 bp, Homo sapiens
tatttaaaaataa

SEQ ID NO: 1767059 - DNA, 17 bp, Homo sapiens
tatttaaaaatatttca

SEQ ID NO: 1767060 - DNA, 12 bp, Homo sapiens
tatttaaaagat

SEQ ID NO: 1767061 - DNA, 12 bp, Homo sapiens
tatttaaaaggg

SEQ ID NO: 1767062 - DNA, 22 bp, Homo sapiens
tatttaaaatttcgttgtccaa

SEQ ID NO: 1767063 - DNA, 24 bp, Homo sapiens
tatttaaaatttcgttgtccaatt

SEQ ID NO: 1767064 - DNA, 12 bp, Homo sapiens
tatttaaactat

SEQ ID NO: 1767065 - DNA, 15 bp, Homo sapiens
tatttaaactatctt

SEQ ID NO: 1767066 - DNA, 20 bp, Homo sapiens
tatttaaagaagaaacgtct

SEQ ID NO: 1767067 - DNA, 19 bp, Homo sapiens
tatttaaagatcttttaga

SEQ ID NO: 1767068 - DNA, 14 bp, Homo sapiens
tatttaaattacaa

SEQ ID NO: 1767069 - DNA, 19 bp, Homo sapiens
tatttaacagaaattgtat

SEQ ID NO: 1767070 - DNA, 15 bp, Homo sapiens
tatttaacattattt

SEQ ID NO: 1767071 - DNA, 17 bp, Homo sapiens
tatttaagaaaacacca

SEQ ID NO: 1767072 - DNA, 18 bp, Homo sapiens
tatttaagatgtgaaaat

SEQ ID NO: 1767073 - DNA, 17 bp, Homo sapiens
tatttaagcctaaagat

SEQ ID NO: 1767074 - DNA, 13 bp, Homo sapiens
tatttaagccttt

SEQ ID NO: 1767075 - DNA, 23 bp, Homo sapiens
tatttaaggatggatggcaccct

SEQ ID NO: 1767076 - DNA, 22 bp, Homo sapiens
tatttaagtagtgggcatttca

SEQ ID NO: 1767077 - DNA, 19 bp, Homo sapiens
tatttaagttatcaacttt

SEQ ID NO: 1767078 - DNA, 17 bp, Homo sapiens
tatttaatagctgtgat

SEQ ID NO: 1767079 - DNA, 18 bp, Homo sapiens
tatttaatatcaaaagaa

SEQ ID NO: 1767080 - DNA, 15 bp, Homo sapiens
tatttaatgaaagac

SEQ ID NO: 1767081 - DNA, 20 bp, Homo sapiens
tatttaatgttgaacaaaat

SEQ ID NO: 1767082 - DNA, 20 bp, Homo sapiens
tatttacactattatttcct

SEQ ID NO: 1767083 - DNA, 10 bp, Homo sapiens
tatttacatt

SEQ ID NO: 1767084 - DNA, 14 bp, Homo sapiens
tatttaccaaagta

SEQ ID NO: 1767085 - DNA, 15 bp, Homo sapiens
tatttaccaaagtag

SEQ ID NO: 1767086 - DNA, 15 bp, Homo sapiens
tatttacccttttcc

SEQ ID NO: 1767087 - DNA, 14 bp, Homo sapiens
tatttactaactaa

SEQ ID NO: 1767088 - DNA, 19 bp, Homo sapiens
tatttactaactaaatacc

SEQ ID NO: 1767089 - DNA, 19 bp, Homo sapiens
tatttactgagcttctctg

SEQ ID NO: 1767090 - DNA, 23 bp, Homo sapiens
tatttactgagcttctctgtgaa

SEQ ID NO: 1767091 - DNA, 23 bp, Homo sapiens
tatttactgctctttattgcaga

SEQ ID NO: 1767092 - DNA, 17 bp, Homo sapiens
tatttaggcagattgaa

SEQ ID NO: 1767093 - DNA, 18 bp, Homo sapiens
tatttagggaactgcttg

SEQ ID NO: 1767094 - DNA, 17 bp, Homo sapiens
tatttagtaacttctgt

SEQ ID NO: 1767095 - DNA, 22 bp, Homo sapiens
tatttagttgtaaaccaagtga

SEQ ID NO: 1767096 - DNA, 21 bp, Homo sapiens
tatttataactcatcataaaa

SEQ ID NO: 1767097 - DNA, 22 bp, Homo sapiens
tatttataactcatcataaaat

SEQ ID NO: 1767098 - DNA, 23 bp, Homo sapiens
tatttataactcatcataaaata

SEQ ID NO: 1767099 - DNA, 17 bp, Homo sapiens
tatttataagcagattt

SEQ ID NO: 1767100 - DNA, 18 bp, Homo sapiens
tatttataatacagaatc

SEQ ID NO: 1767101 - DNA, 20 bp, Homo sapiens
tatttataatacagaatctt

SEQ ID NO: 1767102 - DNA, 19 bp, Homo sapiens
tatttatacaagattgaaa

SEQ ID NO: 1767103 - DNA, 14 bp, Homo sapiens
tatttatatatatt

SEQ ID NO: 1767104 - DNA, 16 bp, Homo sapiens
tatttatatatgtatt

SEQ ID NO: 1767105 - DNA, 20 bp, Homo sapiens
tatttatatcacacaatata

SEQ ID NO: 1767106 - DNA, 13 bp, Homo sapiens
tatttatattccg

SEQ ID NO: 1767107 - DNA, 16 bp, Homo sapiens
tatttatattccgtat

SEQ ID NO: 1767108 - DNA, 14 bp, Homo sapiens
tatttatatttcac

SEQ ID NO: 1767109 - DNA, 15 bp, Homo sapiens
tatttatatttggaa

SEQ ID NO: 1767110 - DNA, 20 bp, Homo sapiens
tatttatccaaaatgtgtat

SEQ ID NO: 1767111 - DNA, 21 bp, Homo sapiens
tatttatccagaaaactgtga

SEQ ID NO: 1767112 - DNA, 23 bp, Homo sapiens
tatttatccagaaaactgtgatt

SEQ ID NO: 1767113 - DNA, 16 bp, Homo sapiens
tatttatctgattaag

SEQ ID NO: 1767114 - DNA, 11 bp, Homo sapiens
tatttatgaaa

SEQ ID NO: 1767115 - DNA, 13 bp, Homo sapiens
tatttatgaaaaa

SEQ ID NO: 1767116 - DNA, 20 bp, Homo sapiens
tcaaaaaaggaaacttcctt

SEQ ID NO: 1767117 - DNA, 12 bp, Homo sapiens
tcaaaaaattat

SEQ ID NO: 1767118 - DNA, 15 bp, Homo sapiens
tcaaaaaccagccag

SEQ ID NO: 1767119 - DNA, 22 bp, Homo sapiens
tcaaaaactttggagtcccctc

SEQ ID NO: 1767120 - DNA, 17 bp, Homo sapiens
tcaaaaagaaatcaata

SEQ ID NO: 1767121 - DNA, 20 bp, Homo sapiens
tcaaaaagcagagtggactg

SEQ ID NO: 1767122 - DNA, 18 bp, Homo sapiens
tcaaaaagctaatgtgca

SEQ ID NO: 1767123 - DNA, 16 bp, Homo sapiens
tcaaaaataaactagt

SEQ ID NO: 1767124 - DNA, 18 bp, Homo sapiens
tcaaaaataaactagttt

SEQ ID NO: 1767125 - DNA, 22 bp, Homo sapiens
tcaaaaataaactagtttccag

SEQ ID NO: 1767126 - DNA, 14 bp, Homo sapiens
tcaaaaatataact

SEQ ID NO: 1767127 - DNA, 12 bp, Homo sapiens
tcaaaaattaaa

SEQ ID NO: 1767128 - DNA, 23 bp, Homo sapiens
tcaaaaattaaaccggaccatct

SEQ ID NO: 1767129 - DNA, 12 bp, Homo sapiens
tcaaaacaaaac

SEQ ID NO: 1767130 - DNA, 15 bp, Homo sapiens
tcaaaacctgcagtt

SEQ ID NO: 1767131 - DNA, 19 bp, Homo sapiens
tcaaaacctgcagttaaca

SEQ ID NO: 1767132 - DNA, 20 bp, Homo sapiens
tcaaaacctgcagttaacag

SEQ ID NO: 1767133 - DNA, 14 bp, Homo sapiens
tcaaaaccttcctt

SEQ ID NO: 1767134 - DNA, 18 bp, Homo sapiens
tcaaaaccttccttccct

SEQ ID NO: 1767135 - DNA, 17 bp, Homo sapiens
tcaaaagaggttacttt

SEQ ID NO: 1767136 - DNA, 17 bp, Homo sapiens
tcaaaaggaaaccaagt

SEQ ID NO: 1767137 - DNA, 23 bp, Homo sapiens
tcaaaaggtgcctgtgaggcagg

SEQ ID NO: 1767138 - DNA, 14 bp, Homo sapiens
tcaaaagttccaag

SEQ ID NO: 1767139 - DNA, 13 bp, Homo sapiens
tcaaaataaaaag

SEQ ID NO: 1767140 - DNA, 23 bp, Homo sapiens
tcaaaataaaaagtgacacagca

SEQ ID NO: 1767141 - DNA, 18 bp, Homo sapiens
tcaaaatagttctatttc

SEQ ID NO: 1767142 - DNA, 17 bp, Homo sapiens
tcaaaatatttgtacat

SEQ ID NO: 1767143 - DNA, 18 bp, Homo sapiens
tcaaaatatttgtacata

SEQ ID NO: 1767144 - DNA, 21 bp, Homo sapiens
tcaaaatcactatctttctga

SEQ ID NO: 1767145 - DNA, 14 bp, Homo sapiens
tcaaaatctgtcat

SEQ ID NO: 1767146 - DNA, 20 bp, Homo sapiens
tcaaaatctttgtataaata

SEQ ID NO: 1767147 - DNA, 22 bp, Homo sapiens
tcaaaatctttgtataaataaa

SEQ ID NO: 1767148 - DNA, 22 bp, Homo sapiens
tcaaaatgttatcttctcaagt

SEQ ID NO: 1767149 - DNA, 12 bp, Homo sapiens
tcaaaattgctt

SEQ ID NO: 1767150 - DNA, 18 bp, Homo sapiens
tcaaaattgcttctaaaa

SEQ ID NO: 1767151 - DNA, 23 bp, Homo sapiens
tcaaaattgcttctaaaacaata

SEQ ID NO: 1767152 - DNA, 14 bp, Homo sapiens
tcaaacacaaatgc

SEQ ID NO: 1767153 - DNA, 15 bp, Homo sapiens
tcaaacacaaatgca

SEQ ID NO: 1767154 - DNA, 16 bp, Homo sapiens
tcaaacacaaatgcag

SEQ ID NO: 1767155 - DNA, 17 bp, Homo sapiens
tcaaacacaaatgcagg

SEQ ID NO: 1767156 - DNA, 19 bp, Homo sapiens
tcaaacacttgtgactttt

SEQ ID NO: 1767157 - DNA, 18 bp, Homo sapiens
tcaaacatcagctgaatt

SEQ ID NO: 1767158 - DNA, 20 bp, Homo sapiens
tcaaacattcgtgagctggg

SEQ ID NO: 1767159 - DNA, 17 bp, Homo sapiens
tcaaacatttgccaagt

SEQ ID NO: 1767160 - DNA, 20 bp, Homo sapiens
tcaaaccagtcacttttgtc

SEQ ID NO: 1767161 - DNA, 17 bp, Homo sapiens
tcaaaccctagccttgc

SEQ ID NO: 1767162 - DNA, 19 bp, Homo sapiens
tcaaaccctagccttgctt

SEQ ID NO: 1767163 - DNA, 20 bp, Homo sapiens
tcaaaccctagccttgcttg

SEQ ID NO: 1767164 - DNA, 17 bp, Homo sapiens
tcaaacctcctcttctg

SEQ ID NO: 1767165 - DNA, 17 bp, Homo sapiens
tcaaacctgtttaaata

SEQ ID NO: 1767166 - DNA, 18 bp, Homo sapiens
tcaaacctgtttaaatat

SEQ ID NO: 1767167 - DNA, 22 bp, Homo sapiens
tcaaacctgtttaaatatttca

SEQ ID NO: 1767168 - DNA, 19 bp, Homo sapiens
tcaaacggaggaagcccac

SEQ ID NO: 1767169 - DNA, 23 bp, Homo sapiens
tcaaactaaattcaaagaagtac

SEQ ID NO: 1767170 - DNA, 20 bp, Homo sapiens
tcaaactgccttggcttcag

SEQ ID NO: 1767171 - DNA, 20 bp, Homo sapiens
tcaaactggggcctccagaa

SEQ ID NO: 1767172 - DNA, 23 bp, Homo sapiens
tcaaactggggcctccagaactc

SEQ ID NO: 1767173 - DNA, 20 bp, Homo sapiens
tcaaactgtagaaatgatga

SEQ ID NO: 1767174 - DNA, 16 bp, Homo sapiens
tcaaacttaaacaaaa

SEQ ID NO: 1767175 - DNA, 17 bp, Homo sapiens
tcaaacttaaacaaaaa

SEQ ID NO: 1767176 - DNA, 14 bp, Homo sapiens
tcaaacttccagtc

SEQ ID NO: 1767177 - DNA, 16 bp, Homo sapiens
tcaaactttcactttg

SEQ ID NO: 1767178 - DNA, 16 bp, Homo sapiens
tcaaagaaagtgtatt

SEQ ID NO: 1767179 - DNA, 15 bp, Homo sapiens
tcaaagaacaaacat

SEQ ID NO: 1767180 - DNA, 15 bp, Homo sapiens
tcaaagaacagatgg

SEQ ID NO: 1767181 - DNA, 11 bp, Homo sapiens
tcaaagaagct

SEQ ID NO: 1767182 - DNA, 12 bp, Homo sapiens
tcaaagaaggaa

SEQ ID NO: 1767183 - DNA, 14 bp, Homo sapiens
tcaaagaaggcatt

SEQ ID NO: 1767184 - DNA, 18 bp, Homo sapiens
tcaaagaaggtgctgatc

SEQ ID NO: 1767185 - DNA, 20 bp, Homo sapiens
tcaaagaagtactttattgc

SEQ ID NO: 1767186 - DNA, 23 bp, Homo sapiens
tcaaagaagtcggaatgtcatag

SEQ ID NO: 1767187 - DNA, 18 bp, Homo sapiens
tcaaagaattacagtaca

SEQ ID NO: 1767188 - DNA, 18 bp, Homo sapiens
tcaaagaggtgaacatta

SEQ ID NO: 1767189 - DNA, 14 bp, Homo sapiens
tcaaagatgcattt

SEQ ID NO: 1767190 - DNA, 14 bp, Homo sapiens
tcaaagatttttat

SEQ ID NO: 1767191 - DNA, 15 bp, Homo sapiens
tcaaagcaaaagtgc

SEQ ID NO: 1767192 - DNA, 12 bp, Homo sapiens
tcaaagcattta

SEQ ID NO: 1767193 - DNA, 21 bp, Homo sapiens
tcaaagccacattatttctag

SEQ ID NO: 1767194 - DNA, 12 bp, Homo sapiens
tcaaagccctgc

SEQ ID NO: 1767195 - DNA, 17 bp, Homo sapiens
tcaaagccctgcctctg

SEQ ID NO: 1767196 - DNA, 19 bp, Homo sapiens
tcaaagccctgcctctgtg

SEQ ID NO: 1767197 - DNA, 20 bp, Homo sapiens
tcaaagccctgcctctgtgt

SEQ ID NO: 1767198 - DNA, 15 bp, Homo sapiens
tcaaagcctggccta

SEQ ID NO: 1767199 - DNA, 19 bp, Homo sapiens
tcaaagctcacaccaaatt

SEQ ID NO: 1767200 - DNA, 12 bp, Homo sapiens
tcaaagctgagt

SEQ ID NO: 1767201 - DNA, 18 bp, Homo sapiens
tcaaagctgcctgtccct

SEQ ID NO: 1767202 - DNA, 18 bp, Homo sapiens
tcaaagctgctttattca

SEQ ID NO: 1767203 - DNA, 15 bp, Homo sapiens
tcaaagctttttcca

SEQ ID NO: 1767204 - DNA, 16 bp, Homo sapiens
tcaaagctttttccag

SEQ ID NO: 1767205 - DNA, 12 bp, Homo sapiens
tcaaaggaagac

SEQ ID NO: 1767206 - DNA, 16 bp, Homo sapiens
tcaaaggagctttctc

SEQ ID NO: 1767207 - DNA, 17 bp, Homo sapiens
tcaaaggagctttctca

SEQ ID NO: 1767208 - DNA, 18 bp, Homo sapiens
tcaaagggagagaaaagc

SEQ ID NO: 1767209 - DNA, 23 bp, Homo sapiens
tcaaagggagagaaaagctggac

SEQ ID NO: 1767210 - DNA, 17 bp, Homo sapiens
tcaaagggcagttttga

SEQ ID NO: 1767211 - DNA, 23 bp, Homo sapiens
tcaaaggttctaggtttcaaaga

SEQ ID NO: 1767212 - DNA, 22 bp, Homo sapiens
tcaaagtaaaaaattaaagccc

SEQ ID NO: 1767213 - DNA, 15 bp, Homo sapiens
tcaaagtatgcaatg

SEQ ID NO: 1767214 - DNA, 18 bp, Homo sapiens
tcaaagtatgcaatgctt

SEQ ID NO: 1767215 - DNA, 22 bp, Homo sapiens
tcaaagtggtaaatactgtgaa

SEQ ID NO: 1767216 - DNA, 22 bp, Homo sapiens
tcaaagtgtaacagatatcagt

SEQ ID NO: 1767217 - DNA, 20 bp, Homo sapiens
tcaaagtgtatatttattca

SEQ ID NO: 1767218 - DNA, 21 bp, Homo sapiens
tcaaagtgttgctgtggctcc

SEQ ID NO: 1767219 - DNA, 20 bp, Homo sapiens
tcaaagtgttgtgttcctgg

SEQ ID NO: 1767220 - DNA, 21 bp, Homo sapiens
tcaaagtgttgtgttcctggc

SEQ ID NO: 1767221 - DNA, 14 bp, Homo sapiens
tcaaagttgaaaat

SEQ ID NO: 1767222 - DNA, 15 bp, Homo sapiens
tcaaagttgaaaatt

SEQ ID NO: 1767223 - DNA, 17 bp, Homo sapiens
tcaaagtttatatgcct

SEQ ID NO: 1767224 - DNA, 15 bp, Homo sapiens
tcaaataaaatatca

SEQ ID NO: 1767225 - DNA, 17 bp, Homo sapiens
tcaaataaaatatcata

SEQ ID NO: 1767226 - DNA, 18 bp, Homo sapiens
tcaaataaaatatcataa

SEQ ID NO: 1767227 - DNA, 11 bp, Homo sapiens
tcaaataatac

SEQ ID NO: 1767228 - DNA, 17 bp, Homo sapiens
tcaaatacacatttgct

SEQ ID NO: 1767229 - DNA, 20 bp, Homo sapiens
tcaaataggctattaaaaaa

SEQ ID NO: 1767230 - DNA, 21 bp, Homo sapiens
tcaagatgggggcagggctgt

SEQ ID NO: 1767231 - DNA, 17 bp, Homo sapiens
tcaagatgtcagactgg

SEQ ID NO: 1767232 - DNA, 15 bp, Homo sapiens
tcaagatttttttcc

SEQ ID NO: 1767233 - DNA, 17 bp, Homo sapiens
tcaagcaataattgttt

SEQ ID NO: 1767234 - DNA, 20 bp, Homo sapiens
tcaagcaataattgtttcca

SEQ ID NO: 1767235 - DNA, 18 bp, Homo sapiens
tcaagcacaacccaccac

SEQ ID NO: 1767236 - DNA, 19 bp, Homo sapiens
tcaagcacaacccaccaca

SEQ ID NO: 1767237 - DNA, 16 bp, Homo sapiens
tcaagcacttcccagg

SEQ ID NO: 1767238 - DNA, 17 bp, Homo sapiens
tcaagcacttcccagga

SEQ ID NO: 1767239 - DNA, 19 bp, Homo sapiens
tcaagcacttcccaggatc

SEQ ID NO: 1767240 - DNA, 21 bp, Homo sapiens
tcaagcacttcccaggatctg

SEQ ID NO: 1767241 - DNA, 21 bp, Homo sapiens
tcaagcagacatagaagagcc

SEQ ID NO: 1767242 - DNA, 23 bp, Homo sapiens
tcaagcagcgaccgccccctcct

SEQ ID NO: 1767243 - DNA, 17 bp, Homo sapiens
tcaagcagtcgtgcctg

SEQ ID NO: 1767244 - DNA, 19 bp, Homo sapiens
tcaagcagtcgtgcctgtg

SEQ ID NO: 1767245 - DNA, 21 bp, Homo sapiens
tcaagcagtcgtgcctgtgtc

SEQ ID NO: 1767246 - DNA, 21 bp, Homo sapiens
tcaagccaatcccctccttgg

SEQ ID NO: 1767247 - DNA, 20 bp, Homo sapiens
tcaagccagccccctccagc

SEQ ID NO: 1767248 - DNA, 13 bp, Homo sapiens
tcaagcccaggct

SEQ ID NO: 1767249 - DNA, 18 bp, Homo sapiens
tcaagcccaggcttcctg

SEQ ID NO: 1767250 - DNA, 24 bp, Homo sapiens
tcaagccccaccacatagcatgct

SEQ ID NO: 1767251 - DNA, 16 bp, Homo sapiens
tcaagccgcaagctct

SEQ ID NO: 1767252 - DNA, 18 bp, Homo sapiens
tcaagctattctcatgcc

SEQ ID NO: 1767253 - DNA, 12 bp, Homo sapiens
tcaagctgtccc

SEQ ID NO: 1767254 - DNA, 18 bp, Homo sapiens
tcaagctgtcccctctgt

SEQ ID NO: 1767255 - DNA, 15 bp, Homo sapiens
tcaaggaacagccac

SEQ ID NO: 1767256 - DNA, 16 bp, Homo sapiens
tcaaggaagaagaaat

SEQ ID NO: 1767257 - DNA, 14 bp, Homo sapiens
tcaaggaatcggct

SEQ ID NO: 1767258 - DNA, 16 bp, Homo sapiens
tcaaggaatttcttaa

SEQ ID NO: 1767259 - DNA, 21 bp, Homo sapiens
tcaaggaatttcttaacttct

SEQ ID NO: 1767260 - DNA, 21 bp, Homo sapiens
tcaaggactgtttcagtgtga

SEQ ID NO: 1767261 - DNA, 22 bp, Homo sapiens
tcaaggactgtttcagtgtgag

SEQ ID NO: 1767262 - DNA, 16 bp, Homo sapiens
tcaaggagaatatgat

SEQ ID NO: 1767263 - DNA, 19 bp, Homo sapiens
tcaaggataccttcttatt

SEQ ID NO: 1767264 - DNA, 14 bp, Homo sapiens
tcaaggcactctag

SEQ ID NO: 1767265 - DNA, 15 bp, Homo sapiens
tcaaggcactctaga

SEQ ID NO: 1767266 - DNA, 12 bp, Homo sapiens
tcaaggccttca

SEQ ID NO: 1767267 - DNA, 21 bp, Homo sapiens
tcaaggccttcagtttatttc

SEQ ID NO: 1767268 - DNA, 18 bp, Homo sapiens
tcaaggcgggagggcctg

SEQ ID NO: 1767269 - DNA, 16 bp, Homo sapiens
tcaaggctgtgacctt

SEQ ID NO: 1767270 - DNA, 22 bp, Homo sapiens
tcaagggaaaggcaagcttgag

SEQ ID NO: 1767271 - DNA, 20 bp, Homo sapiens
tcaagggaatgtaactgctg

SEQ ID NO: 1767272 - DNA, 18 bp, Homo sapiens
tcaagggctggcactttt

SEQ ID NO: 1767273 - DNA, 15 bp, Homo sapiens
tcaagggctgtcatt

SEQ ID NO: 1767274 - DNA, 17 bp, Homo sapiens
tcaagggcttactattt

SEQ ID NO: 1767275 - DNA, 14 bp, Homo sapiens
tcaagggtggcagg

SEQ ID NO: 1767276 - DNA, 20 bp, Homo sapiens
tcaagggttctttcctccca

SEQ ID NO: 1767277 - DNA, 15 bp, Homo sapiens
tcaaggtgagaatta

SEQ ID NO: 1767278 - DNA, 11 bp, Homo sapiens
tcaaggttcta

SEQ ID NO: 1767279 - DNA, 18 bp, Homo sapiens
tcaaggttttaggttcta

SEQ ID NO: 1767280 - DNA, 20 bp, Homo sapiens
tcaaggttttaggttctaaa

SEQ ID NO: 1767281 - DNA, 19 bp, Homo sapiens
tcaagtaccaccaagggat

SEQ ID NO: 1767282 - DNA, 21 bp, Homo sapiens
tcaagtagactactgttcagc

SEQ ID NO: 1767283 - DNA, 20 bp, Homo sapiens
tcaagtatatgtcatttact

SEQ ID NO: 1767284 - DNA, 15 bp, Homo sapiens
tcaagtattataaac

SEQ ID NO: 1767285 - DNA, 21 bp, Homo sapiens
tcaagtcatggcaggtacagt

SEQ ID NO: 1767286 - DNA, 20 bp, Homo sapiens
tcaagtcggatctagtccag

SEQ ID NO: 1767287 - DNA, 14 bp, Homo sapiens
tcaagtgatccacc

SEQ ID NO: 1767288 - DNA, 20 bp, Homo sapiens
tcaagtgatccaccggcctc

SEQ ID NO: 1767289 - DNA, 21 bp, Homo sapiens
tcaagtgatctgccgcctcag

SEQ ID NO: 1767290 - DNA, 18 bp, Homo sapiens
tcaagtgattctcctgcc

SEQ ID NO: 1767291 - DNA, 20 bp, Homo sapiens
tcaagtgcatgctctctgca

SEQ ID NO: 1767292 - DNA, 21 bp, Homo sapiens
tcaagtgcctagactgttact

SEQ ID NO: 1767293 - DNA, 16 bp, Homo sapiens
tcaagtggggctcgcc

SEQ ID NO: 1767294 - DNA, 18 bp, Homo sapiens
tcaagtggggctcgccat

SEQ ID NO: 1767295 - DNA, 14 bp, Homo sapiens
tcaagttaaagtga

SEQ ID NO: 1767296 - DNA, 19 bp, Homo sapiens
tcaagttaacaaggaatgc

SEQ ID NO: 1767297 - DNA, 15 bp, Homo sapiens
tcaagttattcaaat

SEQ ID NO: 1767298 - DNA, 17 bp, Homo sapiens
tcaagttctaagattct

SEQ ID NO: 1767299 - DNA, 19 bp, Homo sapiens
tcaagttctaagattctaa

SEQ ID NO: 1767300 - DNA, 14 bp, Homo sapiens
tcaagttgtgcttg

SEQ ID NO: 1767301 - DNA, 23 bp, Homo sapiens
tcaagttgttgactgtgattaga

SEQ ID NO: 1767302 - DNA, 15 bp, Homo sapiens
tcaagttttaaagtt

SEQ ID NO: 1767303 - DNA, 13 bp, Homo sapiens
tcaataaaatgtg

SEQ ID NO: 1767304 - DNA, 14 bp, Homo sapiens
tcaataaaatgtga

SEQ ID NO: 1767305 - DNA, 15 bp, Homo sapiens
tcaataaaatgtgat

SEQ ID NO: 1767306 - DNA, 18 bp, Homo sapiens
tcaataaaatgtgatttt

SEQ ID NO: 1767307 - DNA, 12 bp, Homo sapiens
tcaataaacagc

SEQ ID NO: 1767308 - DNA, 23 bp, Homo sapiens
tcaataaacagcttcatgccttt

SEQ ID NO: 1767309 - DNA, 20 bp, Homo sapiens
tcaataaacttagaggaaaa

SEQ ID NO: 1767310 - DNA, 21 bp, Homo sapiens
tcaataaacttagaggaaaat

SEQ ID NO: 1767311 - DNA, 15 bp, Homo sapiens
tcaataaatgtctgt

SEQ ID NO: 1767312 - DNA, 16 bp, Homo sapiens
tcaataaatgtctgtt

SEQ ID NO: 1767313 - DNA, 21 bp, Homo sapiens
tcaataaattgttttttaatt

SEQ ID NO: 1767314 - DNA, 21 bp, Homo sapiens
tcaatacacacacacagacat

SEQ ID NO: 1767315 - DNA, 18 bp, Homo sapiens
tcaatacactagttgttt

SEQ ID NO: 1767316 - DNA, 15 bp, Homo sapiens
tcaataccagggaag

SEQ ID NO: 1767317 - DNA, 19 bp, Homo sapiens
tcaataccgctcagtattt

SEQ ID NO: 1767318 - DNA, 19 bp, Homo sapiens
tcaatactcttgaaatgta

SEQ ID NO: 1767319 - DNA, 23 bp, Homo sapiens
tcaatacttttgtgtattctgtg

SEQ ID NO: 1767320 - DNA, 12 bp, Homo sapiens
tcaatagcattg

SEQ ID NO: 1767321 - DNA, 22 bp, Homo sapiens
tcaataggaaagcatatgcagc

SEQ ID NO: 1767322 - DNA, 16 bp, Homo sapiens
tcaatagttgaattag

SEQ ID NO: 1767323 - DNA, 16 bp, Homo sapiens
tcaatataagaagcaa

SEQ ID NO: 1767324 - DNA, 22 bp, Homo sapiens
tcaatataggagggaagatttt

SEQ ID NO: 1767325 - DNA, 20 bp, Homo sapiens
tcaatatcagctttgataat

SEQ ID NO: 1767326 - DNA, 18 bp, Homo sapiens
tcaatatccaaaccaaat

SEQ ID NO: 1767327 - DNA, 23 bp, Homo sapiens
tcaatatcgtacctgtccctcca

SEQ ID NO: 1767328 - DNA, 15 bp, Homo sapiens
tcaatatctaatata

SEQ ID NO: 1767329 - DNA, 21 bp, Homo sapiens
tcaatatctaatatatatgaa

SEQ ID NO: 1767330 - DNA, 17 bp, Homo sapiens
tcaatattaaatacaga

SEQ ID NO: 1767331 - DNA, 18 bp, Homo sapiens
tcaatattcctgaatgaa

SEQ ID NO: 1767332 - DNA, 22 bp, Homo sapiens
tcaatattcctgaatgaaatat

SEQ ID NO: 1767333 - DNA, 18 bp, Homo sapiens
tcaatattgacatttgta

SEQ ID NO: 1767334 - DNA, 17 bp, Homo sapiens
tcaatatttagaaaatt

SEQ ID NO: 1767335 - DNA, 17 bp, Homo sapiens
tcaatattttcttttcc

SEQ ID NO: 1767336 - DNA, 19 bp, Homo sapiens
tcaatcactgtaacctgat

SEQ ID NO: 1767337 - DNA, 15 bp, Homo sapiens
tcaatcagtgcagtg

SEQ ID NO: 1767338 - DNA, 20 bp, Homo sapiens
tcaatcctgattcctctcta

SEQ ID NO: 1767339 - DNA, 21 bp, Homo sapiens
tcaatcctgattcctctctaa

SEQ ID NO: 1767340 - DNA, 12 bp, Homo sapiens
tcaatcctggta

SEQ ID NO: 1767341 - DNA, 18 bp, Homo sapiens
tcaatcctggtaaccaaa

SEQ ID NO: 1767342 - DNA, 14 bp, Homo sapiens
tcaatctcctctct

SEQ ID NO: 1767343 - DNA, 11 bp, Homo sapiens
tcaatctctgg

SEQ ID NO: 1767344 - DNA, 15 bp, Homo sapiens
tcaccctgccttatc

SEQ ID NO: 1767345 - DNA, 22 bp, Homo sapiens
tcacccttatagtctaagacta

SEQ ID NO: 1767346 - DNA, 12 bp, Homo sapiens
tcacccttccct

SEQ ID NO: 1767347 - DNA, 14 bp, Homo sapiens
tcacccttccctgc

SEQ ID NO: 1767348 - DNA, 22 bp, Homo sapiens
tcacccttgcaccgtcctcagc

SEQ ID NO: 1767349 - DNA, 13 bp, Homo sapiens
tcaccctttgctg

SEQ ID NO: 1767350 - DNA, 22 bp, Homo sapiens
tcaccctttgctgtgaggctgt

SEQ ID NO: 1767351 - DNA, 15 bp, Homo sapiens
tcaccgaagccactt

SEQ ID NO: 1767352 - DNA, 16 bp, Homo sapiens
tcaccgacagcggcct

SEQ ID NO: 1767353 - DNA, 23 bp, Homo sapiens
tcaccgagagtagccgagagcct

SEQ ID NO: 1767354 - DNA, 15 bp, Homo sapiens
tcaccgcccatcagg

SEQ ID NO: 1767355 - DNA, 17 bp, Homo sapiens
tcacctaagtctctgtg

SEQ ID NO: 1767356 - DNA, 21 bp, Homo sapiens
tcacctaatgtttatgagcca

SEQ ID NO: 1767357 - DNA, 16 bp, Homo sapiens
tcacctagaacgtgca

SEQ ID NO: 1767358 - DNA, 16 bp, Homo sapiens
tcacctatttaatgtt

SEQ ID NO: 1767359 - DNA, 12 bp, Homo sapiens
tcacctcagagt

SEQ ID NO: 1767360 - DNA, 13 bp, Homo sapiens
tcacctcagagtg

SEQ ID NO: 1767361 - DNA, 13 bp, Homo sapiens
tcacctcagctga

SEQ ID NO: 1767362 - DNA, 16 bp, Homo sapiens
tcacctcagtagaaaa

SEQ ID NO: 1767363 - DNA, 20 bp, Homo sapiens
tcacctcatgcccaccccct

SEQ ID NO: 1767364 - DNA, 23 bp, Homo sapiens
tcacctcatgcccaccccctgcc

SEQ ID NO: 1767365 - DNA, 14 bp, Homo sapiens
tcacctcattctga

SEQ ID NO: 1767366 - DNA, 19 bp, Homo sapiens
tcacctccaagcatttcat

SEQ ID NO: 1767367 - DNA, 21 bp, Homo sapiens
tcacctccggtcgtgtctctg

SEQ ID NO: 1767368 - DNA, 23 bp, Homo sapiens
tcacctccggtcgtgtctctggt

SEQ ID NO: 1767369 - DNA, 21 bp, Homo sapiens
tcacctcctccactcactcca

SEQ ID NO: 1767370 - DNA, 12 bp, Homo sapiens
tcacctcctcta

SEQ ID NO: 1767371 - DNA, 17 bp, Homo sapiens
tcacctctctctgagga

SEQ ID NO: 1767372 - DNA, 14 bp, Homo sapiens
tcacctctcttcag

SEQ ID NO: 1767373 - DNA, 17 bp, Homo sapiens
tcacctctgaggacaga

SEQ ID NO: 1767374 - DNA, 13 bp, Homo sapiens
tcacctcttcctc

SEQ ID NO: 1767375 - DNA, 15 bp, Homo sapiens
tcacctcttcctctg

SEQ ID NO: 1767376 - DNA, 19 bp, Homo sapiens
tcacctgaaccccagaggc

SEQ ID NO: 1767377 - DNA, 20 bp, Homo sapiens
tcacctgaaccccagaggca

SEQ ID NO: 1767378 - DNA, 15 bp, Homo sapiens
tcacctgaggtcagg

SEQ ID NO: 1767379 - DNA, 20 bp, Homo sapiens
tcacctgcaagccccagggc

SEQ ID NO: 1767380 - DNA, 21 bp, Homo sapiens
tcacctgcaagccccagggcc

SEQ ID NO: 1767381 - DNA, 21 bp, Homo sapiens
tcacctgctccagaagatgcc

SEQ ID NO: 1767382 - DNA, 13 bp, Homo sapiens
tcacctgctggtt

SEQ ID NO: 1767383 - DNA, 13 bp, Homo sapiens
tcacctggccctg

SEQ ID NO: 1767384 - DNA, 23 bp, Homo sapiens
tcacctggccctgcttcctgctt

SEQ ID NO: 1767385 - DNA, 19 bp, Homo sapiens
tcacctgggaccttactcc

SEQ ID NO: 1767386 - DNA, 16 bp, Homo sapiens
tcacctggtacctgga

SEQ ID NO: 1767387 - DNA, 13 bp, Homo sapiens
tcacctggtcctc

SEQ ID NO: 1767388 - DNA, 17 bp, Homo sapiens
tcacctgtaaacctgag

SEQ ID NO: 1767389 - DNA, 15 bp, Homo sapiens
tcacctgtactattg

SEQ ID NO: 1767390 - DNA, 23 bp, Homo sapiens
tcacctgtactattgcagacctg

SEQ ID NO: 1767391 - DNA, 15 bp, Homo sapiens
tcacctgtgactcct

SEQ ID NO: 1767392 - DNA, 18 bp, Homo sapiens
tcacctgtttttaagctg

SEQ ID NO: 1767393 - DNA, 15 bp, Homo sapiens
tcaccttcaaaatgt

SEQ ID NO: 1767394 - DNA, 13 bp, Homo sapiens
tcaccttgtattc

SEQ ID NO: 1767395 - DNA, 23 bp, Homo sapiens
tcaccttgtattctctttacctt

SEQ ID NO: 1767396 - DNA, 18 bp, Homo sapiens
tcacctttctccactggg

SEQ ID NO: 1767397 - DNA, 19 bp, Homo sapiens
tcacctttctccactgggt

SEQ ID NO: 1767398 - DNA, 14 bp, Homo sapiens
tcacctttggtgca

SEQ ID NO: 1767399 - DNA, 22 bp, Homo sapiens
tcacctttgtaagacatttgta

SEQ ID NO: 1767400 - DNA, 15 bp, Homo sapiens
tcaccttttcaggaa

SEQ ID NO: 1767401 - DNA, 17 bp, Homo sapiens
tcaccttttcaggaaaa

SEQ ID NO: 1767402 - DNA, 23 bp, Homo sapiens
tcacgatttgcaggattcccttc

SEQ ID NO: 1767403 - DNA, 15 bp, Homo sapiens
tcacgcaggctgagt

SEQ ID NO: 1767404 - DNA, 14 bp, Homo sapiens
tcacgcatgcagtg

SEQ ID NO: 1767405 - DNA, 20 bp, Homo sapiens
tcacgccattgtactccagc

SEQ ID NO: 1767406 - DNA, 18 bp, Homo sapiens
tcacgccgtaattctttc

SEQ ID NO: 1767407 - DNA, 22 bp, Homo sapiens
tcacgccgtaattctttctgtc

SEQ ID NO: 1767408 - DNA, 19 bp, Homo sapiens
tcacgcctatgatcccagc

SEQ ID NO: 1767409 - DNA, 22 bp, Homo sapiens
tcacgcctgtaatcccagcact

SEQ ID NO: 1767410 - DNA, 23 bp, Homo sapiens
tcacgcctgtaatcccagcactt

SEQ ID NO: 1767411 - DNA, 21 bp, Homo sapiens
tcacgcctgtaatcccagcag

SEQ ID NO: 1767412 - DNA, 13 bp, Homo sapiens
tcacgcctgtgca

SEQ ID NO: 1767413 - DNA, 14 bp, Homo sapiens
tcacgctttcctga

SEQ ID NO: 1767414 - DNA, 17 bp, Homo sapiens
tcacgctttcctgaatc

SEQ ID NO: 1767415 - DNA, 22 bp, Homo sapiens
tcacgctttcctgaatccaaac

SEQ ID NO: 1767416 - DNA, 18 bp, Homo sapiens
tcacggctgcgcactgtg

SEQ ID NO: 1767417 - DNA, 22 bp, Homo sapiens
tcacggggttggctgttccaga

SEQ ID NO: 1767418 - DNA, 17 bp, Homo sapiens
tcacggtggtaaagaaa

SEQ ID NO: 1767419 - DNA, 22 bp, Homo sapiens
tcacgtaagatacaagtttcag

SEQ ID NO: 1767420 - DNA, 17 bp, Homo sapiens
tcacgtaccccactggg

SEQ ID NO: 1767421 - DNA, 19 bp, Homo sapiens
tcacgtatttcacagagca

SEQ ID NO: 1767422 - DNA, 24 bp, Homo sapiens
tcacgtatttcacagagcacgcct

SEQ ID NO: 1767423 - DNA, 19 bp, Homo sapiens
tcacgtgcaggacagctct

SEQ ID NO: 1767424 - DNA, 22 bp, Homo sapiens
tcacgtgcaggacagctcttga

SEQ ID NO: 1767425 - DNA, 21 bp, Homo sapiens
tcacgtggcctccgcagtgtc

SEQ ID NO: 1767426 - DNA, 22 bp, Homo sapiens
tcacgtggcctccgcagtgtct

SEQ ID NO: 1767427 - DNA, 17 bp, Homo sapiens
tcactaaacaagaaatc

SEQ ID NO: 1767428 - DNA, 18 bp, Homo sapiens
tcactaaagcatgaaatg

SEQ ID NO: 1767429 - DNA, 21 bp, Homo sapiens
tcactaaagcatgaaatgtga

SEQ ID NO: 1767430 - DNA, 14 bp, Homo sapiens
tcactaacagggag

SEQ ID NO: 1767431 - DNA, 19 bp, Homo sapiens
tcactaacagggagaagta

SEQ ID NO: 1767432 - DNA, 15 bp, Homo sapiens
tcactaatacacagt

SEQ ID NO: 1767433 - DNA, 19 bp, Homo sapiens
tcactacagggagaaaatc

SEQ ID NO: 1767434 - DNA, 20 bp, Homo sapiens
tcactaccctgattcttgat

SEQ ID NO: 1767435 - DNA, 23 bp, Homo sapiens
tcactacttgaccattctcaccc

SEQ ID NO: 1767436 - DNA, 15 bp, Homo sapiens
tcactagaagaaaag

SEQ ID NO: 1767437 - DNA, 16 bp, Homo sapiens
tcactagaagaaaagc

SEQ ID NO: 1767438 - DNA, 21 bp, Homo sapiens
tcactagaagaaaagcccatt

SEQ ID NO: 1767439 - DNA, 12 bp, Homo sapiens
tcactagcagct

SEQ ID NO: 1767440 - DNA, 13 bp, Homo sapiens
tcactagcagctg

SEQ ID NO: 1767441 - DNA, 17 bp, Homo sapiens
tcactagcagctgcagt

SEQ ID NO: 1767442 - DNA, 19 bp, Homo sapiens
tcactaggcccccacttgc

SEQ ID NO: 1767443 - DNA, 21 bp, Homo sapiens
tcactaggcccccacttgcct

SEQ ID NO: 1767444 - DNA, 20 bp, Homo sapiens
tcactagtgaccccttccct

SEQ ID NO: 1767445 - DNA, 21 bp, Homo sapiens
tcactatatatatttctagaa

SEQ ID NO: 1767446 - DNA, 15 bp, Homo sapiens
tcactatctttctga

SEQ ID NO: 1767447 - DNA, 15 bp, Homo sapiens
tcactatgacactga

SEQ ID NO: 1767448 - DNA, 17 bp, Homo sapiens
tcactattcctaggagg

SEQ ID NO: 1767449 - DNA, 19 bp, Homo sapiens
tcactcaaatgaatttgct

SEQ ID NO: 1767450 - DNA, 22 bp, Homo sapiens
tcactcaagagttcagtgctca

SEQ ID NO: 1767451 - DNA, 22 bp, Homo sapiens
tcactcacagagtcaaggcctg

SEQ ID NO: 1767452 - DNA, 23 bp, Homo sapiens
tcactcacagagtcaaggcctgc

SEQ ID NO: 1767453 - DNA, 21 bp, Homo sapiens
tcactcaggcctctgcagaag

SEQ ID NO: 1767454 - DNA, 18 bp, Homo sapiens
tcactcattgctgagcct

SEQ ID NO: 1767455 - DNA, 16 bp, Homo sapiens
tcactccaccacccaa

SEQ ID NO: 1767456 - DNA, 15 bp, Homo sapiens
tcactccaccatccc

SEQ ID NO: 1767457 - DNA, 14 bp, Homo sapiens
tcactccagtcaac

SEQ ID NO: 1767458 - DNA, 23 bp, Homo sapiens
tcagcccccatcacccaagccac

SEQ ID NO: 1767459 - DNA, 21 bp, Homo sapiens
tcagccccgacttcctgactc

SEQ ID NO: 1767460 - DNA, 15 bp, Homo sapiens
tcagcccctcctctg

SEQ ID NO: 1767461 - DNA, 16 bp, Homo sapiens
tcagcccctcctctgc

SEQ ID NO: 1767462 - DNA, 18 bp, Homo sapiens
tcagccctcagaagaaaa

SEQ ID NO: 1767463 - DNA, 18 bp, Homo sapiens
tcagccctccctgcccct

SEQ ID NO: 1767464 - DNA, 19 bp, Homo sapiens
tcagccctccctgcccctc

SEQ ID NO: 1767465 - DNA, 13 bp, Homo sapiens
tcagccctgaggt

SEQ ID NO: 1767466 - DNA, 23 bp, Homo sapiens
tcagccctgaggtgaaagggagc

SEQ ID NO: 1767467 - DNA, 15 bp, Homo sapiens
tcagccctgcaccat

SEQ ID NO: 1767468 - DNA, 14 bp, Homo sapiens
tcagccctggccct

SEQ ID NO: 1767469 - DNA, 18 bp, Homo sapiens
tcagccctggccctgccc

SEQ ID NO: 1767470 - DNA, 21 bp, Homo sapiens
tcagccctgggccccaccacc

SEQ ID NO: 1767471 - DNA, 22 bp, Homo sapiens
tcagccctgggccccaccacct

SEQ ID NO: 1767472 - DNA, 16 bp, Homo sapiens
tcagcccttatggcca

SEQ ID NO: 1767473 - DNA, 13 bp, Homo sapiens
tcagcccttgccc

SEQ ID NO: 1767474 - DNA, 21 bp, Homo sapiens
tcagcccttgcccccatccct

SEQ ID NO: 1767475 - DNA, 16 bp, Homo sapiens
tcagccgggccctgag

SEQ ID NO: 1767476 - DNA, 20 bp, Homo sapiens
tcagccgtagggtggcactg

SEQ ID NO: 1767477 - DNA, 13 bp, Homo sapiens
tcagcctaagaga

SEQ ID NO: 1767478 - DNA, 20 bp, Homo sapiens
tcagcctaccgctggccctg

SEQ ID NO: 1767479 - DNA, 21 bp, Homo sapiens
tcagcctagccgacctcagcc

SEQ ID NO: 1767480 - DNA, 19 bp, Homo sapiens
tcagcctcattcagcatgg

SEQ ID NO: 1767481 - DNA, 23 bp, Homo sapiens
tcagcctccaatgcattggcctc

SEQ ID NO: 1767482 - DNA, 20 bp, Homo sapiens
tcagcctccagagtagctgg

SEQ ID NO: 1767483 - DNA, 19 bp, Homo sapiens
tcagcctcccaaccccagg

SEQ ID NO: 1767484 - DNA, 20 bp, Homo sapiens
tcagcctccggagtagctgg

SEQ ID NO: 1767485 - DNA, 11 bp, Homo sapiens
tcagcctcctg

SEQ ID NO: 1767486 - DNA, 13 bp, Homo sapiens
tcagcctcctgag

SEQ ID NO: 1767487 - DNA, 20 bp, Homo sapiens
tcagcctcctgagtagctgg

SEQ ID NO: 1767488 - DNA, 21 bp, Homo sapiens
tcagcctcctgagtagctgga

SEQ ID NO: 1767489 - DNA, 20 bp, Homo sapiens
tcagcctgaggctgagactg

SEQ ID NO: 1767490 - DNA, 15 bp, Homo sapiens
tcagcctgagtctcc

SEQ ID NO: 1767491 - DNA, 16 bp, Homo sapiens
tcagcctgagtctcct

SEQ ID NO: 1767492 - DNA, 22 bp, Homo sapiens
tcagcctgatcaggcttcctgg

SEQ ID NO: 1767493 - DNA, 11 bp, Homo sapiens
tcagcctggaa

SEQ ID NO: 1767494 - DNA, 13 bp, Homo sapiens
tcagcctggaagg

SEQ ID NO: 1767495 - DNA, 14 bp, Homo sapiens
tcagcctggccaga

SEQ ID NO: 1767496 - DNA, 14 bp, Homo sapiens
tcagcctggtgggc

SEQ ID NO: 1767497 - DNA, 22 bp, Homo sapiens
tcagcctgttccagaaggagga

SEQ ID NO: 1767498 - DNA, 22 bp, Homo sapiens
tcagccttatgtggaagaactg

SEQ ID NO: 1767499 - DNA, 24 bp, Homo sapiens
tcagccttccccctcccagggcca

SEQ ID NO: 1767500 - DNA, 17 bp, Homo sapiens
tcagccttgaaaaacaa

SEQ ID NO: 1767501 - DNA, 15 bp, Homo sapiens
tcagccttgctgctc

SEQ ID NO: 1767502 - DNA, 16 bp, Homo sapiens
tcagccttgctgctct

SEQ ID NO: 1767503 - DNA, 17 bp, Homo sapiens
tcagccttgctgctctg

SEQ ID NO: 1767504 - DNA, 19 bp, Homo sapiens
tcagccttgctgctctgcg

SEQ ID NO: 1767505 - DNA, 15 bp, Homo sapiens
tcagcgagaggcagc

SEQ ID NO: 1767506 - DNA, 17 bp, Homo sapiens
tcagcgagaggcagcaa

SEQ ID NO: 1767507 - DNA, 20 bp, Homo sapiens
tcagcgatgtatataagcca

SEQ ID NO: 1767508 - DNA, 14 bp, Homo sapiens
tcagcgtcccctgc

SEQ ID NO: 1767509 - DNA, 14 bp, Homo sapiens
tcagctaagctcac

SEQ ID NO: 1767510 - DNA, 18 bp, Homo sapiens
tcagctagcttttaggaa

SEQ ID NO: 1767511 - DNA, 16 bp, Homo sapiens
tcagctattaagaaaa

SEQ ID NO: 1767512 - DNA, 12 bp, Homo sapiens
tcagctccagct

SEQ ID NO: 1767513 - DNA, 13 bp, Homo sapiens
tcagctccagctg

SEQ ID NO: 1767514 - DNA, 22 bp, Homo sapiens
tcagctccagggaatccaagcc

SEQ ID NO: 1767515 - DNA, 19 bp, Homo sapiens
tcagctccaggtggctctg

SEQ ID NO: 1767516 - DNA, 14 bp, Homo sapiens
tcagctcccaggcc

SEQ ID NO: 1767517 - DNA, 15 bp, Homo sapiens
tcagctctctgcaga

SEQ ID NO: 1767518 - DNA, 21 bp, Homo sapiens
tcagctctctgccctgtgtac

SEQ ID NO: 1767519 - DNA, 14 bp, Homo sapiens
tcagctctctggga

SEQ ID NO: 1767520 - DNA, 18 bp, Homo sapiens
tcagctctctgggacctc

SEQ ID NO: 1767521 - DNA, 14 bp, Homo sapiens
tcagctctggagaa

SEQ ID NO: 1767522 - DNA, 16 bp, Homo sapiens
tcagctctggagaaca

SEQ ID NO: 1767523 - DNA, 17 bp, Homo sapiens
tcagctctggagaacag

SEQ ID NO: 1767524 - DNA, 13 bp, Homo sapiens
tcagctctttttg

SEQ ID NO: 1767525 - DNA, 12 bp, Homo sapiens
tcagctgaattc

SEQ ID NO: 1767526 - DNA, 15 bp, Homo sapiens
tcagctgcccatccc

SEQ ID NO: 1767527 - DNA, 15 bp, Homo sapiens
tcagctgctccctgg

SEQ ID NO: 1767528 - DNA, 21 bp, Homo sapiens
tcagctgctgactggcagggc

SEQ ID NO: 1767529 - DNA, 22 bp, Homo sapiens
tcagctgggtcacatccatccc

SEQ ID NO: 1767530 - DNA, 20 bp, Homo sapiens
tcagctgtaagaagagactg

SEQ ID NO: 1767531 - DNA, 12 bp, Homo sapiens
tcagctgtactt

SEQ ID NO: 1767532 - DNA, 15 bp, Homo sapiens
tcagctgtcctgcag

SEQ ID NO: 1767533 - DNA, 17 bp, Homo sapiens
tcagctgtcctgcagca

SEQ ID NO: 1767534 - DNA, 18 bp, Homo sapiens
tcagctgtcctgcagcaa

SEQ ID NO: 1767535 - DNA, 17 bp, Homo sapiens
tcagctgtggctggagg

SEQ ID NO: 1767536 - DNA, 18 bp, Homo sapiens
tcagctgtggctggagga

SEQ ID NO: 1767537 - DNA, 13 bp, Homo sapiens
tcagcttatctct

SEQ ID NO: 1767538 - DNA, 20 bp, Homo sapiens
tcagcttatctcttttatat

SEQ ID NO: 1767539 - DNA, 18 bp, Homo sapiens
tcagcttatgtaggtaaa

SEQ ID NO: 1767540 - DNA, 23 bp, Homo sapiens
tcagcttcagaatggcattgtac

SEQ ID NO: 1767541 - DNA, 19 bp, Homo sapiens
tcagcttcgtttattttca

SEQ ID NO: 1767542 - DNA, 16 bp, Homo sapiens
tcagcttgcacatttg

SEQ ID NO: 1767543 - DNA, 17 bp, Homo sapiens
tcagcttgcacatttgg

SEQ ID NO: 1767544 - DNA, 16 bp, Homo sapiens
tcagcttgtgcacaat

SEQ ID NO: 1767545 - DNA, 20 bp, Homo sapiens
tcagcttgtttctatactgt

SEQ ID NO: 1767546 - DNA, 14 bp, Homo sapiens
tcagctttcagagc

SEQ ID NO: 1767547 - DNA, 16 bp, Homo sapiens
tcagctttcagagcca

SEQ ID NO: 1767548 - DNA, 22 bp, Homo sapiens
tcagctttgagaagccttcagc

SEQ ID NO: 1767549 - DNA, 18 bp, Homo sapiens
tcagcttttgttctagac

SEQ ID NO: 1767550 - DNA, 19 bp, Homo sapiens
tcagcttttgttctagact

SEQ ID NO: 1767551 - DNA, 20 bp, Homo sapiens
tcaggaaaactgacagagga

SEQ ID NO: 1767552 - DNA, 21 bp, Homo sapiens
tcaggaaaactgacagaggag

SEQ ID NO: 1767553 - DNA, 22 bp, Homo sapiens
tcaggaaaatgtattgattcaa

SEQ ID NO: 1767554 - DNA, 9 bp, Homo sapiens
tcaggaaac

SEQ ID NO: 1767555 - DNA, 19 bp, Homo sapiens
tcaggaaatatatatgtgt

SEQ ID NO: 1767556 - DNA, 22 bp, Homo sapiens
tcaggaaatcaaatatgcaaag

SEQ ID NO: 1767557 - DNA, 23 bp, Homo sapiens
tcaggaagggggccgccaccctc

SEQ ID NO: 1767558 - DNA, 17 bp, Homo sapiens
tcaggaatattttccaa

SEQ ID NO: 1767559 - DNA, 16 bp, Homo sapiens
tcaggaattcttggag

SEQ ID NO: 1767560 - DNA, 14 bp, Homo sapiens
tcaggacagatgcc

SEQ ID NO: 1767561 - DNA, 15 bp, Homo sapiens
tcaggacccaggccc

SEQ ID NO: 1767562 - DNA, 19 bp, Homo sapiens
tcaggacccaggccctcca

SEQ ID NO: 1767563 - DNA, 20 bp, Homo sapiens
tcaggacttaacggctccag

SEQ ID NO: 1767564 - DNA, 15 bp, Homo sapiens
tcaggacttggtctg

SEQ ID NO: 1767565 - DNA, 19 bp, Homo sapiens
tcaggagactgggctctgg

SEQ ID NO: 1767566 - DNA, 18 bp, Homo sapiens
tcaggagaggggcagaac

SEQ ID NO: 1767567 - DNA, 18 bp, Homo sapiens
tcaggagatggagggctt

SEQ ID NO: 1767568 - DNA, 23 bp, Homo sapiens
tcaggagatggagggcttggccc

SEQ ID NO: 1767569 - DNA, 11 bp, Homo sapiens
tcaggagcaca

SEQ ID NO: 1767570 - DNA, 12 bp, Homo sapiens
tcaggagcttgc

SEQ ID NO: 1767571 - DNA, 21 bp, Homo sapiens
tcaggagcttgcaagaagcag

SEQ ID NO: 1767572 - DNA, 22 bp, Homo sapiens
tcaggaggctgagacaggagaa

SEQ ID NO: 1767573 - DNA, 18 bp, Homo sapiens
tcatacctcagaatgtaa

SEQ ID NO: 1767574 - DNA, 14 bp, Homo sapiens
tcatacctctgacc

SEQ ID NO: 1767575 - DNA, 17 bp, Homo sapiens
tcataccttgatggtaa

SEQ ID NO: 1767576 - DNA, 21 bp, Homo sapiens
tcatactactgaaacagattt

SEQ ID NO: 1767577 - DNA, 18 bp, Homo sapiens
tcatactatttagatttt

SEQ ID NO: 1767578 - DNA, 21 bp, Homo sapiens
tcatactcttctaaaacttga

SEQ ID NO: 1767579 - DNA, 18 bp, Homo sapiens
tcatactgtctgggatta

SEQ ID NO: 1767580 - DNA, 19 bp, Homo sapiens
tcatagaaagtgccagaaa

SEQ ID NO: 1767581 - DNA, 15 bp, Homo sapiens
tcatagaattgcagt

SEQ ID NO: 1767582 - DNA, 17 bp, Homo sapiens
tcatagattattataaa

SEQ ID NO: 1767583 - DNA, 18 bp, Homo sapiens
tcatagcaagcttttgct

SEQ ID NO: 1767584 - DNA, 22 bp, Homo sapiens
tcatagcaataacattcccact

SEQ ID NO: 1767585 - DNA, 13 bp, Homo sapiens
tcatagcattcac

SEQ ID NO: 1767586 - DNA, 12 bp, Homo sapiens
tcatagctgaga

SEQ ID NO: 1767587 - DNA, 20 bp, Homo sapiens
tcataggcggtcatgtgtgc

SEQ ID NO: 1767588 - DNA, 22 bp, Homo sapiens
tcataggcggtcatgtgtgcat

SEQ ID NO: 1767589 - DNA, 23 bp, Homo sapiens
tcataggtcactggctctccaag

SEQ ID NO: 1767590 - DNA, 15 bp, Homo sapiens
tcataggttaaaaaa

SEQ ID NO: 1767591 - DNA, 20 bp, Homo sapiens
tcatagtactctttgtagca

SEQ ID NO: 1767592 - DNA, 14 bp, Homo sapiens
tcatagtagttttt

SEQ ID NO: 1767593 - DNA, 22 bp, Homo sapiens
tcatagtagtttttacagctgt

SEQ ID NO: 1767594 - DNA, 15 bp, Homo sapiens
tcatagttaaatgtt

SEQ ID NO: 1767595 - DNA, 14 bp, Homo sapiens
tcatatacaaacat

SEQ ID NO: 1767596 - DNA, 17 bp, Homo sapiens
tcatataccagcaatat

SEQ ID NO: 1767597 - DNA, 14 bp, Homo sapiens
tcatatatcaagaa

SEQ ID NO: 1767598 - DNA, 18 bp, Homo sapiens
tcatatattaaaacaata

SEQ ID NO: 1767599 - DNA, 17 bp, Homo sapiens
tcatatattaaacatcc

SEQ ID NO: 1767600 - DNA, 14 bp, Homo sapiens
tcatatatttaaca

SEQ ID NO: 1767601 - DNA, 11 bp, Homo sapiens
tcatatgaaaa

SEQ ID NO: 1767602 - DNA, 17 bp, Homo sapiens
tcatatggcccagtgtc

SEQ ID NO: 1767603 - DNA, 18 bp, Homo sapiens
tcatatggcccagtgtca

SEQ ID NO: 1767604 - DNA, 21 bp, Homo sapiens
tcatatgtaccatgtacatga

SEQ ID NO: 1767605 - DNA, 15 bp, Homo sapiens
tcatatgtacttgtt

SEQ ID NO: 1767606 - DNA, 15 bp, Homo sapiens
tcatattaagacagt

SEQ ID NO: 1767607 - DNA, 21 bp, Homo sapiens
tcatattaagacagtgtacaa

SEQ ID NO: 1767608 - DNA, 19 bp, Homo sapiens
tcatattccaacccagcca

SEQ ID NO: 1767609 - DNA, 13 bp, Homo sapiens
tcatattgtatgt

SEQ ID NO: 1767610 - DNA, 19 bp, Homo sapiens
tcatatttaagtgtattta

SEQ ID NO: 1767611 - DNA, 20 bp, Homo sapiens
tcatatttacttcttataca

SEQ ID NO: 1767612 - DNA, 15 bp, Homo sapiens
tcatatttattgatt

SEQ ID NO: 1767613 - DNA, 13 bp, Homo sapiens
tcatatttctgtg

SEQ ID NO: 1767614 - DNA, 14 bp, Homo sapiens
tcatatttgtactt

SEQ ID NO: 1767615 - DNA, 19 bp, Homo sapiens
tcatatttgtactttctgt

SEQ ID NO: 1767616 - DNA, 22 bp, Homo sapiens
tcatatttgtactttctgttaa

SEQ ID NO: 1767617 - DNA, 19 bp, Homo sapiens
tcatcaaacatttgccaag

SEQ ID NO: 1767618 - DNA, 17 bp, Homo sapiens
tcatcaaagaacaaaca

SEQ ID NO: 1767619 - DNA, 15 bp, Homo sapiens
tcatcaaatcatcat

SEQ ID NO: 1767620 - DNA, 13 bp, Homo sapiens
tcatcaacaagat

SEQ ID NO: 1767621 - DNA, 23 bp, Homo sapiens
tcatcaatacttttgtgtattct

SEQ ID NO: 1767622 - DNA, 24 bp, Homo sapiens
tcatcaatacttttgtgtattctg

SEQ ID NO: 1767623 - DNA, 17 bp, Homo sapiens
tcatcaccacccttcca

SEQ ID NO: 1767624 - DNA, 19 bp, Homo sapiens
tcatcaccatttcctcctt

SEQ ID NO: 1767625 - DNA, 19 bp, Homo sapiens
tcatcactccctggatgtg

SEQ ID NO: 1767626 - DNA, 18 bp, Homo sapiens
tcatcactggactgcatg

SEQ ID NO: 1767627 - DNA, 12 bp, Homo sapiens
tcatcactgtaa

SEQ ID NO: 1767628 - DNA, 13 bp, Homo sapiens
tcatcactgtaaa

SEQ ID NO: 1767629 - DNA, 17 bp, Homo sapiens
tcatcactgtaaagaca

SEQ ID NO: 1767630 - DNA, 15 bp, Homo sapiens
tcatcagaagataac

SEQ ID NO: 1767631 - DNA, 22 bp, Homo sapiens
tcatcagatgcttgcggcaaaa

SEQ ID NO: 1767632 - DNA, 12 bp, Homo sapiens
tcatcagtgtta

SEQ ID NO: 1767633 - DNA, 16 bp, Homo sapiens
tcatcagtgttaaaaa

SEQ ID NO: 1767634 - DNA, 14 bp, Homo sapiens
tcatcataaaataa

SEQ ID NO: 1767635 - DNA, 17 bp, Homo sapiens
tcatcatattgtatgta

SEQ ID NO: 1767636 - DNA, 22 bp, Homo sapiens
tcatcattcttgtgggagacag

SEQ ID NO: 1767637 - DNA, 22 bp, Homo sapiens
tcatccaatcctcactgggtgg

SEQ ID NO: 1767638 - DNA, 15 bp, Homo sapiens
tcatccaatgtgaag

SEQ ID NO: 1767639 - DNA, 18 bp, Homo sapiens
tcatccacacaacaccag

SEQ ID NO: 1767640 - DNA, 20 bp, Homo sapiens
tcatccacacaacaccagga

SEQ ID NO: 1767641 - DNA, 22 bp, Homo sapiens
tcatccacattgttttaaaaag

SEQ ID NO: 1767642 - DNA, 21 bp, Homo sapiens
tcatccaccaatctctaagcc

SEQ ID NO: 1767643 - DNA, 14 bp, Homo sapiens
tcatccaccccatc

SEQ ID NO: 1767644 - DNA, 16 bp, Homo sapiens
tcatccaccccatccc

SEQ ID NO: 1767645 - DNA, 20 bp, Homo sapiens
tcatccacctgtcttggcct

SEQ ID NO: 1767646 - DNA, 23 bp, Homo sapiens
tcatcccattccaggcagcctct

SEQ ID NO: 1767647 - DNA, 17 bp, Homo sapiens
tcatccccacaatctgg

SEQ ID NO: 1767648 - DNA, 20 bp, Homo sapiens
tcatccccacagctggctct

SEQ ID NO: 1767649 - DNA, 19 bp, Homo sapiens
tcatcccgtatcacagtgt

SEQ ID NO: 1767650 - DNA, 14 bp, Homo sapiens
tcatccctcaactg

SEQ ID NO: 1767651 - DNA, 22 bp, Homo sapiens
tcatccctcaactgagggccag

SEQ ID NO: 1767652 - DNA, 15 bp, Homo sapiens
tcatccgcctgtggg

SEQ ID NO: 1767653 - DNA, 19 bp, Homo sapiens
tcatccggcagcctggatg

SEQ ID NO: 1767654 - DNA, 22 bp, Homo sapiens
tcatcctcaaagaaagtgtatt

SEQ ID NO: 1767655 - DNA, 13 bp, Homo sapiens
tcatcctcaggaa

SEQ ID NO: 1767656 - DNA, 21 bp, Homo sapiens
tcatcctccagtaccttgctt

SEQ ID NO: 1767657 - DNA, 16 bp, Homo sapiens
tcatcctcctccccag

SEQ ID NO: 1767658 - DNA, 17 bp, Homo sapiens
tcatcctcctccccagc

SEQ ID NO: 1767659 - DNA, 20 bp, Homo sapiens
tcatcctgctcttttgtgat

SEQ ID NO: 1767660 - DNA, 21 bp, Homo sapiens
tcatcctgctcttttgtgatg

SEQ ID NO: 1767661 - DNA, 22 bp, Homo sapiens
tcatcctgctcttttgtgatga

SEQ ID NO: 1767662 - DNA, 16 bp, Homo sapiens
tcatcctggcacgccc

SEQ ID NO: 1767663 - DNA, 22 bp, Homo sapiens
tcatcctggcacgccctactcc

SEQ ID NO: 1767664 - DNA, 14 bp, Homo sapiens
tcatcgccagaggt

SEQ ID NO: 1767665 - DNA, 15 bp, Homo sapiens
tcatcgtaaagtgct

SEQ ID NO: 1767666 - DNA, 21 bp, Homo sapiens
tcatctattcaagcacttaca

SEQ ID NO: 1767667 - DNA, 18 bp, Homo sapiens
tcatctatttcgagtgtt

SEQ ID NO: 1767668 - DNA, 18 bp, Homo sapiens
tcatctatttctgagaag

SEQ ID NO: 1767669 - DNA, 13 bp, Homo sapiens
tcatctcagctca

SEQ ID NO: 1767670 - DNA, 21 bp, Homo sapiens
tcatctcatcaggcaaattgt

SEQ ID NO: 1767671 - DNA, 23 bp, Homo sapiens
tcatctcatcaggcaaattgtac

SEQ ID NO: 1767672 - DNA, 13 bp, Homo sapiens
tcatctccatcag

SEQ ID NO: 1767673 - DNA, 14 bp, Homo sapiens
tcatctctacaaaa

SEQ ID NO: 1767674 - DNA, 15 bp, Homo sapiens
tcatctctctacctc

SEQ ID NO: 1767675 - DNA, 20 bp, Homo sapiens
tcatctctctacctccaccc

SEQ ID NO: 1767676 - DNA, 16 bp, Homo sapiens
tcatctctctgcccaa

SEQ ID NO: 1767677 - DNA, 14 bp, Homo sapiens
tcatctcttagctc

SEQ ID NO: 1767678 - DNA, 14 bp, Homo sapiens
tcatctgaaaagca

SEQ ID NO: 1767679 - DNA, 19 bp, Homo sapiens
tcatctgagaggctctccg

SEQ ID NO: 1767680 - DNA, 23 bp, Homo sapiens
tcatctgagaggctctccgtgca

SEQ ID NO: 1767681 - DNA, 16 bp, Homo sapiens
tcatctgcatgtctac

SEQ ID NO: 1767682 - DNA, 17 bp, Homo sapiens
tcatctgcattcctgat

SEQ ID NO: 1767683 - DNA, 13 bp, Homo sapiens
tcatctgccgtgc

SEQ ID NO: 1767684 - DNA, 12 bp, Homo sapiens
tcatctgctctc

SEQ ID NO: 1767685 - DNA, 15 bp, Homo sapiens
tcatctgctctcctt

SEQ ID NO: 1767686 - DNA, 19 bp, Homo sapiens
tcatctggcaacatcttta

SEQ ID NO: 1767687 - DNA, 18 bp, Homo sapiens
tcattttacccttggctc

SEQ ID NO: 1767688 - DNA, 15 bp, Homo sapiens
tcattttagtgactg

SEQ ID NO: 1767689 - DNA, 16 bp, Homo sapiens
tcattttcctgttcag

SEQ ID NO: 1767690 - DNA, 21 bp, Homo sapiens
tcattttcctgttcagtgaga

SEQ ID NO: 1767691 - DNA, 12 bp, Homo sapiens
tcattttgcttt

SEQ ID NO: 1767692 - DNA, 17 bp, Homo sapiens
tcattttgtaacaaatg

SEQ ID NO: 1767693 - DNA, 15 bp, Homo sapiens
tcatttttaacagca

SEQ ID NO: 1767694 - DNA, 16 bp, Homo sapiens
tcatttttaacagcat

SEQ ID NO: 1767695 - DNA, 19 bp, Homo sapiens
tcatttttaatcatgaaat

SEQ ID NO: 1767696 - DNA, 14 bp, Homo sapiens
tcatttttaatgta

SEQ ID NO: 1767697 - DNA, 17 bp, Homo sapiens
tcatttttaatgtatct

SEQ ID NO: 1767698 - DNA, 15 bp, Homo sapiens
tcatttttgtatttt

SEQ ID NO: 1767699 - DNA, 23 bp, Homo sapiens
tcattttttatggctgcatagta

SEQ ID NO: 1767700 - DNA, 23 bp, Homo sapiens
tcattttttcctgtttgggaaga

SEQ ID NO: 1767701 - DNA, 22 bp, Homo sapiens
tcatttttttctctctggagcc

SEQ ID NO: 1767702 - DNA, 14 bp, Homo sapiens
tcattttttttcct

SEQ ID NO: 1767703 - DNA, 14 bp, Homo sapiens
tccaaaaaaaggaa

SEQ ID NO: 1767704 - DNA, 23 bp, Homo sapiens
tccaaaaaaaggaaaaataatca

SEQ ID NO: 1767705 - DNA, 22 bp, Homo sapiens
tccaaaaagaacaataatgaga

SEQ ID NO: 1767706 - DNA, 21 bp, Homo sapiens
tccaaaacctgcttccttcag

SEQ ID NO: 1767707 - DNA, 13 bp, Homo sapiens
tccaaaactgcct

SEQ ID NO: 1767708 - DNA, 23 bp, Homo sapiens
tccaaaacttctcttgaaaagtt

SEQ ID NO: 1767709 - DNA, 21 bp, Homo sapiens
tccaaaagaagcccccagcta

SEQ ID NO: 1767710 - DNA, 14 bp, Homo sapiens
tccaaaagcacatg

SEQ ID NO: 1767711 - DNA, 23 bp, Homo sapiens
tccaaaatttgaaatattaaaat

SEQ ID NO: 1767712 - DNA, 12 bp, Homo sapiens
tccaaacaccgg

SEQ ID NO: 1767713 - DNA, 15 bp, Homo sapiens
tccaaaccctcctgg

SEQ ID NO: 1767714 - DNA, 15 bp, Homo sapiens
tccaaacctccagcc

SEQ ID NO: 1767715 - DNA, 14 bp, Homo sapiens
tccaaacctgtctt

SEQ ID NO: 1767716 - DNA, 19 bp, Homo sapiens
tccaaactcttccctctct

SEQ ID NO: 1767717 - DNA, 14 bp, Homo sapiens
tccaaagaaatgta

SEQ ID NO: 1767718 - DNA, 22 bp, Homo sapiens
tccaaagagagttaaaagcagc

SEQ ID NO: 1767719 - DNA, 15 bp, Homo sapiens
tccaaagaggctgcc

SEQ ID NO: 1767720 - DNA, 18 bp, Homo sapiens
tccaaagaggctgcccct

SEQ ID NO: 1767721 - DNA, 16 bp, Homo sapiens
tccaaaggggctgctg

SEQ ID NO: 1767722 - DNA, 17 bp, Homo sapiens
tccaaaggggctgctgg

SEQ ID NO: 1767723 - DNA, 19 bp, Homo sapiens
tccaaaggggctgctgggg

SEQ ID NO: 1767724 - DNA, 18 bp, Homo sapiens
tccaaagtcacaggaaga

SEQ ID NO: 1767725 - DNA, 14 bp, Homo sapiens
tccaaagtggagct

SEQ ID NO: 1767726 - DNA, 16 bp, Homo sapiens
tccaaataaacatttt

SEQ ID NO: 1767727 - DNA, 16 bp, Homo sapiens
tccaaatattattcaa

SEQ ID NO: 1767728 - DNA, 17 bp, Homo sapiens
tccaaatctgtcctctg

SEQ ID NO: 1767729 - DNA, 20 bp, Homo sapiens
tccaaatctgtcctctgtag

SEQ ID NO: 1767730 - DNA, 21 bp, Homo sapiens
tccaaatctgtcctctgtagt

SEQ ID NO: 1767731 - DNA, 16 bp, Homo sapiens
tccaaatgcaatttga

SEQ ID NO: 1767732 - DNA, 15 bp, Homo sapiens
tccaacaagaatgca

SEQ ID NO: 1767733 - DNA, 16 bp, Homo sapiens
tccaacaaggacagcc

SEQ ID NO: 1767734 - DNA, 16 bp, Homo sapiens
tccaacaataaacagg

SEQ ID NO: 1767735 - DNA, 17 bp, Homo sapiens
tccaacaataaacagga

SEQ ID NO: 1767736 - DNA, 16 bp, Homo sapiens
tccaacaccacagaca

SEQ ID NO: 1767737 - DNA, 17 bp, Homo sapiens
tccaacaccacagacac

SEQ ID NO: 1767738 - DNA, 19 bp, Homo sapiens
tccaacatatatttattga

SEQ ID NO: 1767739 - DNA, 19 bp, Homo sapiens
tccaaccactgtgccactg

SEQ ID NO: 1767740 - DNA, 15 bp, Homo sapiens
tccaaccagacctgg

SEQ ID NO: 1767741 - DNA, 17 bp, Homo sapiens
tccaaccccccacctgc

SEQ ID NO: 1767742 - DNA, 14 bp, Homo sapiens
tccaaccccccagc

SEQ ID NO: 1767743 - DNA, 19 bp, Homo sapiens
tccaaccccccagcactga

SEQ ID NO: 1767744 - DNA, 20 bp, Homo sapiens
tccaaccccccagcactgag

SEQ ID NO: 1767745 - DNA, 21 bp, Homo sapiens
tccaaccccccagcactgagg

SEQ ID NO: 1767746 - DNA, 16 bp, Homo sapiens
tccaacccgaggcccg

SEQ ID NO: 1767747 - DNA, 21 bp, Homo sapiens
tccaacctaacccctttcctg

SEQ ID NO: 1767748 - DNA, 13 bp, Homo sapiens
tccaacctcactt

SEQ ID NO: 1767749 - DNA, 15 bp, Homo sapiens
tccaacctcacttcc

SEQ ID NO: 1767750 - DNA, 15 bp, Homo sapiens
tccaacctcctgctc

SEQ ID NO: 1767751 - DNA, 21 bp, Homo sapiens
tccaacctgcaaagatctgtc

SEQ ID NO: 1767752 - DNA, 14 bp, Homo sapiens
tccaaccttcccaa

SEQ ID NO: 1767753 - DNA, 14 bp, Homo sapiens
tccaacgcccctgt

SEQ ID NO: 1767754 - DNA, 15 bp, Homo sapiens
tccaacgcccctgtg

SEQ ID NO: 1767755 - DNA, 18 bp, Homo sapiens
tccaacgcccctgtggcc

SEQ ID NO: 1767756 - DNA, 22 bp, Homo sapiens
tccaactaatgccttactcttc

SEQ ID NO: 1767757 - DNA, 14 bp, Homo sapiens
tccaactcaggtta

SEQ ID NO: 1767758 - DNA, 13 bp, Homo sapiens
tccaactccagca

SEQ ID NO: 1767759 - DNA, 21 bp, Homo sapiens
tccaactgcctaaggcccttt

SEQ ID NO: 1767760 - DNA, 20 bp, Homo sapiens
tccaactgggcatttcaatc

SEQ ID NO: 1767761 - DNA, 20 bp, Homo sapiens
tccaactgtatatattccca

SEQ ID NO: 1767762 - DNA, 20 bp, Homo sapiens
tccaacttatgtttttaaat

SEQ ID NO: 1767763 - DNA, 13 bp, Homo sapiens
tccaactttcaca

SEQ ID NO: 1767764 - DNA, 12 bp, Homo sapiens
tccaagaaaaat

SEQ ID NO: 1767765 - DNA, 12 bp, Homo sapiens
tccaagaacata

SEQ ID NO: 1767766 - DNA, 14 bp, Homo sapiens
tccaagaatccaca

SEQ ID NO: 1767767 - DNA, 19 bp, Homo sapiens
tccaagaatccacatttct

SEQ ID NO: 1767768 - DNA, 21 bp, Homo sapiens
tccaagaatccacatttctaa

SEQ ID NO: 1767769 - DNA, 18 bp, Homo sapiens
tccaagaatggaagcctg

SEQ ID NO: 1767770 - DNA, 19 bp, Homo sapiens
tccaagaatggaagcctga

SEQ ID NO: 1767771 - DNA, 14 bp, Homo sapiens
tccaagactctaga

SEQ ID NO: 1767772 - DNA, 16 bp, Homo sapiens
tccaagactctagagt

SEQ ID NO: 1767773 - DNA, 22 bp, Homo sapiens
tccaagagaaggtggacctggc

SEQ ID NO: 1767774 - DNA, 23 bp, Homo sapiens
tccaagagaaggtggacctggca

SEQ ID NO: 1767775 - DNA, 16 bp, Homo sapiens
tccaagagtctaaaga

SEQ ID NO: 1767776 - DNA, 18 bp, Homo sapiens
tccaagagtctaaagatg

SEQ ID NO: 1767777 - DNA, 18 bp, Homo sapiens
tccaagatacctaaaaga

SEQ ID NO: 1767778 - DNA, 18 bp, Homo sapiens
tccaagattctagatgat

SEQ ID NO: 1767779 - DNA, 20 bp, Homo sapiens
tccaagatttaaatgccata

SEQ ID NO: 1767780 - DNA, 11 bp, Homo sapiens
tccaagcaaag

SEQ ID NO: 1767781 - DNA, 23 bp, Homo sapiens
tccaagcatttcatgaaaaagct

SEQ ID NO: 1767782 - DNA, 13 bp, Homo sapiens
tccaagccagagt

SEQ ID NO: 1767783 - DNA, 20 bp, Homo sapiens
tccaagcctccacagcgagg

SEQ ID NO: 1767784 - DNA, 21 bp, Homo sapiens
tccaagcctccacagcgaggg

SEQ ID NO: 1767785 - DNA, 19 bp, Homo sapiens
tccaagcctgcctcccaag

SEQ ID NO: 1767786 - DNA, 14 bp, Homo sapiens
tccaagctccttat

SEQ ID NO: 1767787 - DNA, 20 bp, Homo sapiens
tccaaggagaaacagagaca

SEQ ID NO: 1767788 - DNA, 23 bp, Homo sapiens
tccaaggagaaacagagacaggc

SEQ ID NO: 1767789 - DNA, 23 bp, Homo sapiens
tccaaggagaccaagtcctggct

SEQ ID NO: 1767790 - DNA, 16 bp, Homo sapiens
tccaagggacagccca

SEQ ID NO: 1767791 - DNA, 15 bp, Homo sapiens
tccaagggccgtgcc

SEQ ID NO: 1767792 - DNA, 19 bp, Homo sapiens
tccaagggcttctgcaccc

SEQ ID NO: 1767793 - DNA, 21 bp, Homo sapiens
tccaagggcttctgcaccctc

SEQ ID NO: 1767794 - DNA, 22 bp, Homo sapiens
tccaagggcttctgcaccctcc

SEQ ID NO: 1767795 - DNA, 18 bp, Homo sapiens
tccaagggtactaaggaa

SEQ ID NO: 1767796 - DNA, 19 bp, Homo sapiens
tccaaggtttaaagagtct

SEQ ID NO: 1767797 - DNA, 23 bp, Homo sapiens
tccaagtctttcttcttttttaa

SEQ ID NO: 1767798 - DNA, 21 bp, Homo sapiens
tccaagtgaacactagccaga

SEQ ID NO: 1767799 - DNA, 15 bp, Homo sapiens
tccaagtgccaatat

SEQ ID NO: 1767800 - DNA, 17 bp, Homo sapiens
tccaagtgccagaggtg

SEQ ID NO: 1767801 - DNA, 23 bp, Homo sapiens
tccagctaaacaccaacccctga

SEQ ID NO: 1767802 - DNA, 12 bp, Homo sapiens
tccagctccaac

SEQ ID NO: 1767803 - DNA, 18 bp, Homo sapiens
tccagctccaacctgcaa

SEQ ID NO: 1767804 - DNA, 19 bp, Homo sapiens
tccagctccaacctgcaaa

SEQ ID NO: 1767805 - DNA, 23 bp, Homo sapiens
tccagctcccactccctttccaa

SEQ ID NO: 1767806 - DNA, 14 bp, Homo sapiens
tccagctcgtgtgt

SEQ ID NO: 1767807 - DNA, 13 bp, Homo sapiens
tccagctctgaca

SEQ ID NO: 1767808 - DNA, 15 bp, Homo sapiens
tccagctctgacatc

SEQ ID NO: 1767809 - DNA, 21 bp, Homo sapiens
tccagctctgacatcccttcc

SEQ ID NO: 1767810 - DNA, 23 bp, Homo sapiens
tccagctctgacatcccttcctg

SEQ ID NO: 1767811 - DNA, 14 bp, Homo sapiens
tccagctctgcccc

SEQ ID NO: 1767812 - DNA, 15 bp, Homo sapiens
tccagctctggaggg

SEQ ID NO: 1767813 - DNA, 20 bp, Homo sapiens
tccagctctggaggggaggg

SEQ ID NO: 1767814 - DNA, 15 bp, Homo sapiens
tccagctcttggccc

SEQ ID NO: 1767815 - DNA, 21 bp, Homo sapiens
tccagctgactaaactttttt

SEQ ID NO: 1767816 - DNA, 13 bp, Homo sapiens
tccagctgccccg

SEQ ID NO: 1767817 - DNA, 22 bp, Homo sapiens
tccagctgccccggcccctccc

SEQ ID NO: 1767818 - DNA, 12 bp, Homo sapiens
tccagctgcctg

SEQ ID NO: 1767819 - DNA, 15 bp, Homo sapiens
tccagctgcctgggc

SEQ ID NO: 1767820 - DNA, 15 bp, Homo sapiens
tccagctgctgtctt

SEQ ID NO: 1767821 - DNA, 17 bp, Homo sapiens
tccagctgctgtcttct

SEQ ID NO: 1767822 - DNA, 11 bp, Homo sapiens
tccagctggcc

SEQ ID NO: 1767823 - DNA, 17 bp, Homo sapiens
tccagctggcctggaca

SEQ ID NO: 1767824 - DNA, 18 bp, Homo sapiens
tccagctggcctggacag

SEQ ID NO: 1767825 - DNA, 23 bp, Homo sapiens
tccagctgggcctcctgcctccg

SEQ ID NO: 1767826 - DNA, 14 bp, Homo sapiens
tccagcttccaaag

SEQ ID NO: 1767827 - DNA, 16 bp, Homo sapiens
tccagcttcggagggc

SEQ ID NO: 1767828 - DNA, 15 bp, Homo sapiens
tccagcttgctcttc

SEQ ID NO: 1767829 - DNA, 13 bp, Homo sapiens
tccaggaaaaaat

SEQ ID NO: 1767830 - DNA, 17 bp, Homo sapiens
tccaggaaaaaataaaa

SEQ ID NO: 1767831 - DNA, 21 bp, Homo sapiens
tccaggaaaaaataaaaagag

SEQ ID NO: 1767832 - DNA, 21 bp, Homo sapiens
tccaggaaactccacatctgc

SEQ ID NO: 1767833 - DNA, 13 bp, Homo sapiens
tccaggaaggcag

SEQ ID NO: 1767834 - DNA, 16 bp, Homo sapiens
tccaggaaggcagctg

SEQ ID NO: 1767835 - DNA, 20 bp, Homo sapiens
tccaggaaggcagctgctct

SEQ ID NO: 1767836 - DNA, 19 bp, Homo sapiens
tccaggaaggtagcccagc

SEQ ID NO: 1767837 - DNA, 23 bp, Homo sapiens
tccaggaaggtagcccagcactg

SEQ ID NO: 1767838 - DNA, 22 bp, Homo sapiens
tccaggaattcctcttttgctt

SEQ ID NO: 1767839 - DNA, 16 bp, Homo sapiens
tccaggactgggtctg

SEQ ID NO: 1767840 - DNA, 23 bp, Homo sapiens
tccaggactgggtctgacctggt

SEQ ID NO: 1767841 - DNA, 22 bp, Homo sapiens
tccaggagaagtgctccctgga

SEQ ID NO: 1767842 - DNA, 16 bp, Homo sapiens
tccaggagcttcttgt

SEQ ID NO: 1767843 - DNA, 18 bp, Homo sapiens
tccaggaggcagtggaca

SEQ ID NO: 1767844 - DNA, 17 bp, Homo sapiens
tccaggatcctgcagga

SEQ ID NO: 1767845 - DNA, 19 bp, Homo sapiens
tccaggatcctgcaggaac

SEQ ID NO: 1767846 - DNA, 21 bp, Homo sapiens
tccaggatctttgactgaaaa

SEQ ID NO: 1767847 - DNA, 13 bp, Homo sapiens
tccaggcaccagg

SEQ ID NO: 1767848 - DNA, 21 bp, Homo sapiens
tccaggcaccaggactagggc

SEQ ID NO: 1767849 - DNA, 17 bp, Homo sapiens
tccaggcagaaggagag

SEQ ID NO: 1767850 - DNA, 16 bp, Homo sapiens
tccaggcagatccagg

SEQ ID NO: 1767851 - DNA, 18 bp, Homo sapiens
tccaggcagatccaggac

SEQ ID NO: 1767852 - DNA, 18 bp, Homo sapiens
tccaggcagcctctgtca

SEQ ID NO: 1767853 - DNA, 23 bp, Homo sapiens
tccaggcaggccaggctgcctcg

SEQ ID NO: 1767854 - DNA, 18 bp, Homo sapiens
tccaggccactgtggcca

SEQ ID NO: 1767855 - DNA, 19 bp, Homo sapiens
tccaggccactgtggccag

SEQ ID NO: 1767856 - DNA, 13 bp, Homo sapiens
tccaggccagggc

SEQ ID NO: 1767857 - DNA, 14 bp, Homo sapiens
tccaggccagggct

SEQ ID NO: 1767858 - DNA, 15 bp, Homo sapiens
tccaggccagggctc

SEQ ID NO: 1767859 - DNA, 20 bp, Homo sapiens
tccaggccccaccggccagg

SEQ ID NO: 1767860 - DNA, 22 bp, Homo sapiens
tccaggcccctgaggactggag

SEQ ID NO: 1767861 - DNA, 15 bp, Homo sapiens
tccaggcctgaccag

SEQ ID NO: 1767862 - DNA, 19 bp, Homo sapiens
tccaggcctgatcttgcct

SEQ ID NO: 1767863 - DNA, 12 bp, Homo sapiens
tccaggcctgca

SEQ ID NO: 1767864 - DNA, 13 bp, Homo sapiens
tccaggcctgcag

SEQ ID NO: 1767865 - DNA, 18 bp, Homo sapiens
tccaggcctgcaggggca

SEQ ID NO: 1767866 - DNA, 16 bp, Homo sapiens
tccaggcctgcctccc

SEQ ID NO: 1767867 - DNA, 20 bp, Homo sapiens
tccaggctatgtataaaata

SEQ ID NO: 1767868 - DNA, 19 bp, Homo sapiens
tccaggctcttcctggacc

SEQ ID NO: 1767869 - DNA, 22 bp, Homo sapiens
tccaggctcttcctggacctga

SEQ ID NO: 1767870 - DNA, 16 bp, Homo sapiens
tccaggctgagccatg

SEQ ID NO: 1767871 - DNA, 19 bp, Homo sapiens
tccaggctgagccatgagg

SEQ ID NO: 1767872 - DNA, 16 bp, Homo sapiens
tccaggctgccgtggg

SEQ ID NO: 1767873 - DNA, 13 bp, Homo sapiens
tccaggctggcca

SEQ ID NO: 1767874 - DNA, 13 bp, Homo sapiens
tccaggctggttc

SEQ ID NO: 1767875 - DNA, 20 bp, Homo sapiens
tccaggctttcccacttccc

SEQ ID NO: 1767876 - DNA, 16 bp, Homo sapiens
tccagggaagctggcc

SEQ ID NO: 1767877 - DNA, 17 bp, Homo sapiens
tccagggaagctggccg

SEQ ID NO: 1767878 - DNA, 14 bp, Homo sapiens
tccagggacagagg

SEQ ID NO: 1767879 - DNA, 21 bp, Homo sapiens
tccagggacagaggccccagc

SEQ ID NO: 1767880 - DNA, 23 bp, Homo sapiens
tccagggacagaggccccagcct

SEQ ID NO: 1767881 - DNA, 19 bp, Homo sapiens
tccagggatccagggacac

SEQ ID NO: 1767882 - DNA, 22 bp, Homo sapiens
tccagggcagcctccaccttgc

SEQ ID NO: 1767883 - DNA, 13 bp, Homo sapiens
tccagggccctga

SEQ ID NO: 1767884 - DNA, 20 bp, Homo sapiens
tccagggcctgacaccccct

SEQ ID NO: 1767885 - DNA, 14 bp, Homo sapiens
tccagggctggact

SEQ ID NO: 1767886 - DNA, 21 bp, Homo sapiens
tccagggctggactgaggcct

SEQ ID NO: 1767887 - DNA, 13 bp, Homo sapiens
tccaggggcctgc

SEQ ID NO: 1767888 - DNA, 18 bp, Homo sapiens
tccaggggcctgcagaag

SEQ ID NO: 1767889 - DNA, 21 bp, Homo sapiens
tccaggggcctgcagaaggaa

SEQ ID NO: 1767890 - DNA, 15 bp, Homo sapiens
tccagggtcttgggc

SEQ ID NO: 1767891 - DNA, 16 bp, Homo sapiens
tccaggtcagcctgga

SEQ ID NO: 1767892 - DNA, 19 bp, Homo sapiens
tccaggtcagcctggaagg

SEQ ID NO: 1767893 - DNA, 16 bp, Homo sapiens
tccaggtcaggatgca

SEQ ID NO: 1767894 - DNA, 15 bp, Homo sapiens
tccaggtcatgcagt

SEQ ID NO: 1767895 - DNA, 17 bp, Homo sapiens
tccaggtggtgaatttt

SEQ ID NO: 1767896 - DNA, 20 bp, Homo sapiens
tccaggttcaacccacagct

SEQ ID NO: 1767897 - DNA, 23 bp, Homo sapiens
tccaggttcaacccacagctact

SEQ ID NO: 1767898 - DNA, 17 bp, Homo sapiens
tccaggttccatccacc

SEQ ID NO: 1767899 - DNA, 21 bp, Homo sapiens
tccaggttccatccaccacct

SEQ ID NO: 1767900 - DNA, 17 bp, Homo sapiens
tccaggttccctcccag

SEQ ID NO: 1767901 - DNA, 18 bp, Homo sapiens
tccagtaacttttttgtg

SEQ ID NO: 1767902 - DNA, 23 bp, Homo sapiens
tccagtaacttttttgtgtatgt

SEQ ID NO: 1767903 - DNA, 20 bp, Homo sapiens
tccagtacgtcccgctgctg

SEQ ID NO: 1767904 - DNA, 21 bp, Homo sapiens
tccagtacgtcccgctgctgt

SEQ ID NO: 1767905 - DNA, 17 bp, Homo sapiens
tccagtcaaatctgggc

SEQ ID NO: 1767906 - DNA, 13 bp, Homo sapiens
tccagtcaacaaa

SEQ ID NO: 1767907 - DNA, 15 bp, Homo sapiens
tccagtcaacagatt

SEQ ID NO: 1767908 - DNA, 23 bp, Homo sapiens
tccagtcatctgtaagagcttgc

SEQ ID NO: 1767909 - DNA, 16 bp, Homo sapiens
tccagtctatcattgt

SEQ ID NO: 1767910 - DNA, 20 bp, Homo sapiens
tccagtctgtgatccttggt

SEQ ID NO: 1767911 - DNA, 23 bp, Homo sapiens
tccagtgaacattcccagcccag

SEQ ID NO: 1767912 - DNA, 12 bp, Homo sapiens
tccagtgagccg

SEQ ID NO: 1767913 - DNA, 18 bp, Homo sapiens
tccagtgctcagctgtgg

SEQ ID NO: 1767914 - DNA, 17 bp, Homo sapiens
tccagtggaggtttgtc

SEQ ID NO: 1767915 - DNA, 21 bp, Homo sapiens
tcccatctggctttttctgcc

SEQ ID NO: 1767916 - DNA, 14 bp, Homo sapiens
tcccatgaacacac

SEQ ID NO: 1767917 - DNA, 16 bp, Homo sapiens
tcccatgaacacactg

SEQ ID NO: 1767918 - DNA, 22 bp, Homo sapiens
tcccatgacccacccctgtgct

SEQ ID NO: 1767919 - DNA, 19 bp, Homo sapiens
tcccatgatccctgtgttg

SEQ ID NO: 1767920 - DNA, 12 bp, Homo sapiens
tcccatgcctgt

SEQ ID NO: 1767921 - DNA, 16 bp, Homo sapiens
tcccatgcctgtctct

SEQ ID NO: 1767922 - DNA, 17 bp, Homo sapiens
tcccatgcctgtctctg

SEQ ID NO: 1767923 - DNA, 14 bp, Homo sapiens
tcccatgctccacc

SEQ ID NO: 1767924 - DNA, 18 bp, Homo sapiens
tcccatggctgaagctgg

SEQ ID NO: 1767925 - DNA, 20 bp, Homo sapiens
tcccatggctgaagctggag

SEQ ID NO: 1767926 - DNA, 13 bp, Homo sapiens
tcccatgtagccc

SEQ ID NO: 1767927 - DNA, 22 bp, Homo sapiens
tcccatgtagccccctggcctc

SEQ ID NO: 1767928 - DNA, 14 bp, Homo sapiens
tcccatgtatttgt

SEQ ID NO: 1767929 - DNA, 18 bp, Homo sapiens
tcccatgtcacctcagct

SEQ ID NO: 1767930 - DNA, 19 bp, Homo sapiens
tcccatgtgagtccctgtg

SEQ ID NO: 1767931 - DNA, 21 bp, Homo sapiens
tcccatgtgagtccctgtgat

SEQ ID NO: 1767932 - DNA, 10 bp, Homo sapiens
tcccatgtgg

SEQ ID NO: 1767933 - DNA, 14 bp, Homo sapiens
tcccatgttcaagc

SEQ ID NO: 1767934 - DNA, 23 bp, Homo sapiens
tcccattaggacaatcagtcccc

SEQ ID NO: 1767935 - DNA, 18 bp, Homo sapiens
tcccattattatttctgt

SEQ ID NO: 1767936 - DNA, 20 bp, Homo sapiens
tcccattcactagaaaatga

SEQ ID NO: 1767937 - DNA, 17 bp, Homo sapiens
tcccattcactcttcca

SEQ ID NO: 1767938 - DNA, 13 bp, Homo sapiens
tcccattccaggc

SEQ ID NO: 1767939 - DNA, 14 bp, Homo sapiens
tcccattcctgaag

SEQ ID NO: 1767940 - DNA, 13 bp, Homo sapiens
tcccattctagat

SEQ ID NO: 1767941 - DNA, 22 bp, Homo sapiens
tcccattctagatcctgcaccc

SEQ ID NO: 1767942 - DNA, 13 bp, Homo sapiens
tcccattgccctg

SEQ ID NO: 1767943 - DNA, 14 bp, Homo sapiens
tcccattgccctgg

SEQ ID NO: 1767944 - DNA, 21 bp, Homo sapiens
tcccatttagaatggtgattt

SEQ ID NO: 1767945 - DNA, 23 bp, Homo sapiens
tcccatttagaatggtgatttta

SEQ ID NO: 1767946 - DNA, 22 bp, Homo sapiens
tcccatttgcatatcacccttc

SEQ ID NO: 1767947 - DNA, 14 bp, Homo sapiens
tcccatttgtaatt

SEQ ID NO: 1767948 - DNA, 21 bp, Homo sapiens
tcccattttgcaaaatttcca

SEQ ID NO: 1767949 - DNA, 20 bp, Homo sapiens
tccccaaagccactggaagg

SEQ ID NO: 1767950 - DNA, 20 bp, Homo sapiens
tccccaacgtcccctccgcc

SEQ ID NO: 1767951 - DNA, 11 bp, Homo sapiens
tccccaactcc

SEQ ID NO: 1767952 - DNA, 13 bp, Homo sapiens
tccccaactccct

SEQ ID NO: 1767953 - DNA, 19 bp, Homo sapiens
tccccaacttccctagtcc

SEQ ID NO: 1767954 - DNA, 15 bp, Homo sapiens
tccccaagactgtca

SEQ ID NO: 1767955 - DNA, 12 bp, Homo sapiens
tccccaagctgg

SEQ ID NO: 1767956 - DNA, 15 bp, Homo sapiens
tccccaaggcctctc

SEQ ID NO: 1767957 - DNA, 22 bp, Homo sapiens
tccccaaggcctctctctgcct

SEQ ID NO: 1767958 - DNA, 23 bp, Homo sapiens
tccccaaggcctctctctgcctg

SEQ ID NO: 1767959 - DNA, 20 bp, Homo sapiens
tccccaagggccctggcacc

SEQ ID NO: 1767960 - DNA, 20 bp, Homo sapiens
tccccaataattgcagaact

SEQ ID NO: 1767961 - DNA, 21 bp, Homo sapiens
tccccaatcccggtcatgctt

SEQ ID NO: 1767962 - DNA, 14 bp, Homo sapiens
tccccacacagggc

SEQ ID NO: 1767963 - DNA, 17 bp, Homo sapiens
tccccacacagggcact

SEQ ID NO: 1767964 - DNA, 15 bp, Homo sapiens
tccccacactccact

SEQ ID NO: 1767965 - DNA, 18 bp, Homo sapiens
tccccacactccactctg

SEQ ID NO: 1767966 - DNA, 12 bp, Homo sapiens
tccccacagaac

SEQ ID NO: 1767967 - DNA, 17 bp, Homo sapiens
tccccacagaactgctt

SEQ ID NO: 1767968 - DNA, 18 bp, Homo sapiens
tccccacagcgtccctgg

SEQ ID NO: 1767969 - DNA, 19 bp, Homo sapiens
tccccacagcgtccctggc

SEQ ID NO: 1767970 - DNA, 19 bp, Homo sapiens
tccccacagtgccacccat

SEQ ID NO: 1767971 - DNA, 13 bp, Homo sapiens
tccccaccccacc

SEQ ID NO: 1767972 - DNA, 22 bp, Homo sapiens
tccccacccccctctctttctc

SEQ ID NO: 1767973 - DNA, 18 bp, Homo sapiens
tccccacccctgccccca

SEQ ID NO: 1767974 - DNA, 22 bp, Homo sapiens
tccccacccctgcccccagccc

SEQ ID NO: 1767975 - DNA, 17 bp, Homo sapiens
tccccacccgcctgcag

SEQ ID NO: 1767976 - DNA, 20 bp, Homo sapiens
tccccaccttcacctcggag

SEQ ID NO: 1767977 - DNA, 16 bp, Homo sapiens
tccccacgagggctgg

SEQ ID NO: 1767978 - DNA, 22 bp, Homo sapiens
tccccacggggcctcgggacct

SEQ ID NO: 1767979 - DNA, 23 bp, Homo sapiens
tccccacggggcctcgggacctc

SEQ ID NO: 1767980 - DNA, 19 bp, Homo sapiens
tccccactgacagcctccc

SEQ ID NO: 1767981 - DNA, 19 bp, Homo sapiens
tccccacttgtccgctggg

SEQ ID NO: 1767982 - DNA, 15 bp, Homo sapiens
tccccagacttgcac

SEQ ID NO: 1767983 - DNA, 22 bp, Homo sapiens
tccccagagaaaggggagccca

SEQ ID NO: 1767984 - DNA, 12 bp, Homo sapiens
tccccagagccc

SEQ ID NO: 1767985 - DNA, 14 bp, Homo sapiens
tccccagagcccag

SEQ ID NO: 1767986 - DNA, 16 bp, Homo sapiens
tccccagagctgtgcc

SEQ ID NO: 1767987 - DNA, 17 bp, Homo sapiens
tccccagagctgtgcca

SEQ ID NO: 1767988 - DNA, 12 bp, Homo sapiens
tccccagccaca

SEQ ID NO: 1767989 - DNA, 22 bp, Homo sapiens
tccccagccagaggtggagcca

SEQ ID NO: 1767990 - DNA, 12 bp, Homo sapiens
tccccagcccag

SEQ ID NO: 1767991 - DNA, 13 bp, Homo sapiens
tccccagcccaga

SEQ ID NO: 1767992 - DNA, 14 bp, Homo sapiens
tccccagcccagag

SEQ ID NO: 1767993 - DNA, 16 bp, Homo sapiens
tccccagcccttctgc

SEQ ID NO: 1767994 - DNA, 19 bp, Homo sapiens
tccccagcccttctgcctt

SEQ ID NO: 1767995 - DNA, 11 bp, Homo sapiens
tccccagctcc

SEQ ID NO: 1767996 - DNA, 18 bp, Homo sapiens
tccccagctccccaggac

SEQ ID NO: 1767997 - DNA, 15 bp, Homo sapiens
tccccagctcttctc

SEQ ID NO: 1767998 - DNA, 15 bp, Homo sapiens
tccccagctggtggc

SEQ ID NO: 1767999 - DNA, 20 bp, Homo sapiens
tccccagctggtggccctgt

SEQ ID NO: 1768000 - DNA, 19 bp, Homo sapiens
tccccaggactcaccctca

SEQ ID NO: 1768001 - DNA, 15 bp, Homo sapiens
tccccaggcatttgc

SEQ ID NO: 1768002 - DNA, 14 bp, Homo sapiens
tccccaggccaggt

SEQ ID NO: 1768003 - DNA, 15 bp, Homo sapiens
tccccaggcccacca

SEQ ID NO: 1768004 - DNA, 16 bp, Homo sapiens
tccccaggcctccagc

SEQ ID NO: 1768005 - DNA, 17 bp, Homo sapiens
tccccaggcctccagcc

SEQ ID NO: 1768006 - DNA, 13 bp, Homo sapiens
tccccagggagct

SEQ ID NO: 1768007 - DNA, 14 bp, Homo sapiens
tccccagggagctc

SEQ ID NO: 1768008 - DNA, 15 bp, Homo sapiens
tccccagggcccctc

SEQ ID NO: 1768009 - DNA, 18 bp, Homo sapiens
tccccaggggaaaatgaa

SEQ ID NO: 1768010 - DNA, 14 bp, Homo sapiens
tccccaggggagag

SEQ ID NO: 1768011 - DNA, 17 bp, Homo sapiens
tccccaggtccagctct

SEQ ID NO: 1768012 - DNA, 14 bp, Homo sapiens
tccccaggtctctc

SEQ ID NO: 1768013 - DNA, 21 bp, Homo sapiens
tccccaggtctctccactgct

SEQ ID NO: 1768014 - DNA, 19 bp, Homo sapiens
tccccaggtggctgaccca

SEQ ID NO: 1768015 - DNA, 22 bp, Homo sapiens
tccccaggtggctgacccagtc

SEQ ID NO: 1768016 - DNA, 15 bp, Homo sapiens
tccccagtgcctgcc

SEQ ID NO: 1768017 - DNA, 18 bp, Homo sapiens
tccccagtgcctgccact

SEQ ID NO: 1768018 - DNA, 22 bp, Homo sapiens
tccccagtgcctgccactctct

SEQ ID NO: 1768019 - DNA, 21 bp, Homo sapiens
tccccataagacaaacactgc

SEQ ID NO: 1768020 - DNA, 14 bp, Homo sapiens
tccccatctccctg

SEQ ID NO: 1768021 - DNA, 16 bp, Homo sapiens
tccccatctccctgcc

SEQ ID NO: 1768022 - DNA, 20 bp, Homo sapiens
tccccatctccctgcctggc

SEQ ID NO: 1768023 - DNA, 18 bp, Homo sapiens
tccccattcacagagcct

SEQ ID NO: 1768024 - DNA, 16 bp, Homo sapiens
tccccattcagacact

SEQ ID NO: 1768025 - DNA, 13 bp, Homo sapiens
tccccattctata

SEQ ID NO: 1768026 - DNA, 22 bp, Homo sapiens
tccccattcttcctagttttct

SEQ ID NO: 1768027 - DNA, 15 bp, Homo sapiens
tccccatttcccatc

SEQ ID NO: 1768028 - DNA, 21 bp, Homo sapiens
tcccccaaaccctgcttctgc

SEQ ID NO: 1768029 - DNA, 22 bp, Homo sapiens
tcccccaacaccccgcctgcct

SEQ ID NO: 1768030 - DNA, 20 bp, Homo sapiens
tccctggaggcacgcaccac

SEQ ID NO: 1768031 - DNA, 24 bp, Homo sapiens
tccctggagtcagggtgaactgca

SEQ ID NO: 1768032 - DNA, 22 bp, Homo sapiens
tccctggatgtgtggggcatgg

SEQ ID NO: 1768033 - DNA, 15 bp, Homo sapiens
tccctggcagacaca

SEQ ID NO: 1768034 - DNA, 13 bp, Homo sapiens
tccctggccttga

SEQ ID NO: 1768035 - DNA, 15 bp, Homo sapiens
tccctggccttgccc

SEQ ID NO: 1768036 - DNA, 20 bp, Homo sapiens
tccctggctcactggcaggt

SEQ ID NO: 1768037 - DNA, 16 bp, Homo sapiens
tccctggctctcagaa

SEQ ID NO: 1768038 - DNA, 14 bp, Homo sapiens
tccctggctgccct

SEQ ID NO: 1768039 - DNA, 15 bp, Homo sapiens
tccctggctgccctg

SEQ ID NO: 1768040 - DNA, 20 bp, Homo sapiens
tccctggctgccctggccct

SEQ ID NO: 1768041 - DNA, 21 bp, Homo sapiens
tccctggctgccctggccctg

SEQ ID NO: 1768042 - DNA, 22 bp, Homo sapiens
tccctggctgccctggccctga

SEQ ID NO: 1768043 - DNA, 18 bp, Homo sapiens
tccctggctgtgagcagc

SEQ ID NO: 1768044 - DNA, 21 bp, Homo sapiens
tccctggctgtgagcagcctc

SEQ ID NO: 1768045 - DNA, 21 bp, Homo sapiens
tccctggcttgtaactccacc

SEQ ID NO: 1768046 - DNA, 15 bp, Homo sapiens
tccctgggagggagg

SEQ ID NO: 1768047 - DNA, 12 bp, Homo sapiens
tccctgggcatt

SEQ ID NO: 1768048 - DNA, 16 bp, Homo sapiens
tccctgggctgtgcta

SEQ ID NO: 1768049 - DNA, 17 bp, Homo sapiens
tccctggggaccaggag

SEQ ID NO: 1768050 - DNA, 19 bp, Homo sapiens
tccctggggaccaggagct

SEQ ID NO: 1768051 - DNA, 21 bp, Homo sapiens
tccctggggccaacggcaaca

SEQ ID NO: 1768052 - DNA, 11 bp, Homo sapiens
tccctggtcct

SEQ ID NO: 1768053 - DNA, 14 bp, Homo sapiens
tccctggtccttca

SEQ ID NO: 1768054 - DNA, 22 bp, Homo sapiens
tccctggtgcctctgtgcacag

SEQ ID NO: 1768055 - DNA, 14 bp, Homo sapiens
tccctgtagctcag

SEQ ID NO: 1768056 - DNA, 17 bp, Homo sapiens
tccctgtagctcagtca

SEQ ID NO: 1768057 - DNA, 14 bp, Homo sapiens
tccctgtcagaggc

SEQ ID NO: 1768058 - DNA, 11 bp, Homo sapiens
tccctgtccct

SEQ ID NO: 1768059 - DNA, 12 bp, Homo sapiens
tccctgtcctcc

SEQ ID NO: 1768060 - DNA, 14 bp, Homo sapiens
tccctgtcctcctc

SEQ ID NO: 1768061 - DNA, 14 bp, Homo sapiens
tccctgtctccagc

SEQ ID NO: 1768062 - DNA, 19 bp, Homo sapiens
tccctgtctccagctgcct

SEQ ID NO: 1768063 - DNA, 21 bp, Homo sapiens
tccctgtctccagctgcctgg

SEQ ID NO: 1768064 - DNA, 22 bp, Homo sapiens
tccctgtctccagctgcctggg

SEQ ID NO: 1768065 - DNA, 15 bp, Homo sapiens
tccctgtctcccggc

SEQ ID NO: 1768066 - DNA, 22 bp, Homo sapiens
tccctgtctgtgtcccagccac

SEQ ID NO: 1768067 - DNA, 15 bp, Homo sapiens
tccctgtggggcagg

SEQ ID NO: 1768068 - DNA, 17 bp, Homo sapiens
tccctgtgttgtctcta

SEQ ID NO: 1768069 - DNA, 20 bp, Homo sapiens
tccctgttatttttctgccc

SEQ ID NO: 1768070 - DNA, 22 bp, Homo sapiens
tccctgttatttttctgccctg

SEQ ID NO: 1768071 - DNA, 17 bp, Homo sapiens
tccctgttccccagaga

SEQ ID NO: 1768072 - DNA, 18 bp, Homo sapiens
tccctgttttagtttctg

SEQ ID NO: 1768073 - DNA, 22 bp, Homo sapiens
tccctgttttagtttctgaact

SEQ ID NO: 1768074 - DNA, 11 bp, Homo sapiens
tccctgttttc

SEQ ID NO: 1768075 - DNA, 21 bp, Homo sapiens
tccctgttttctgagcccggg

SEQ ID NO: 1768076 - DNA, 17 bp, Homo sapiens
tcccttaacagttgtat

SEQ ID NO: 1768077 - DNA, 20 bp, Homo sapiens
tcccttaacagttgtattta

SEQ ID NO: 1768078 - DNA, 13 bp, Homo sapiens
tcccttaactcca

SEQ ID NO: 1768079 - DNA, 15 bp, Homo sapiens
tcccttaactccaag

SEQ ID NO: 1768080 - DNA, 16 bp, Homo sapiens
tcccttaactccaaga

SEQ ID NO: 1768081 - DNA, 22 bp, Homo sapiens
tcccttaagaatgagtttctta

SEQ ID NO: 1768082 - DNA, 14 bp, Homo sapiens
tcccttaagcagca

SEQ ID NO: 1768083 - DNA, 21 bp, Homo sapiens
tcccttaatattgaggctgca

SEQ ID NO: 1768084 - DNA, 14 bp, Homo sapiens
tcccttagcctctc

SEQ ID NO: 1768085 - DNA, 21 bp, Homo sapiens
tcccttcaaccattccccatg

SEQ ID NO: 1768086 - DNA, 20 bp, Homo sapiens
tcccttcaagacgaggggca

SEQ ID NO: 1768087 - DNA, 18 bp, Homo sapiens
tcccttcagtaccctctc

SEQ ID NO: 1768088 - DNA, 23 bp, Homo sapiens
tcccttcagtaccctctcagctc

SEQ ID NO: 1768089 - DNA, 13 bp, Homo sapiens
tcccttcatctcc

SEQ ID NO: 1768090 - DNA, 12 bp, Homo sapiens
tcccttccaaag

SEQ ID NO: 1768091 - DNA, 17 bp, Homo sapiens
tcccttccagatggtca

SEQ ID NO: 1768092 - DNA, 22 bp, Homo sapiens
tcccttccagatggtcatccag

SEQ ID NO: 1768093 - DNA, 18 bp, Homo sapiens
tcccttccatgccccagg

SEQ ID NO: 1768094 - DNA, 20 bp, Homo sapiens
tcccttccatgccccaggat

SEQ ID NO: 1768095 - DNA, 10 bp, Homo sapiens
tcccttccca

SEQ ID NO: 1768096 - DNA, 15 bp, Homo sapiens
tcccttcccagacca

SEQ ID NO: 1768097 - DNA, 17 bp, Homo sapiens
tcccttcccccataagc

SEQ ID NO: 1768098 - DNA, 14 bp, Homo sapiens
tcccttcctggaaa

SEQ ID NO: 1768099 - DNA, 22 bp, Homo sapiens
tcccttcctggaaacagcatga

SEQ ID NO: 1768100 - DNA, 13 bp, Homo sapiens
tcccttcctggcc

SEQ ID NO: 1768101 - DNA, 15 bp, Homo sapiens
tcccttcctggcctc

SEQ ID NO: 1768102 - DNA, 16 bp, Homo sapiens
tcccttcctggcctca

SEQ ID NO: 1768103 - DNA, 19 bp, Homo sapiens
tcccttccttttccctgct

SEQ ID NO: 1768104 - DNA, 20 bp, Homo sapiens
tcccttccttttccctgctt

SEQ ID NO: 1768105 - DNA, 20 bp, Homo sapiens
tcccttctacaaggactcca

SEQ ID NO: 1768106 - DNA, 14 bp, Homo sapiens
tcccttctccccag

SEQ ID NO: 1768107 - DNA, 17 bp, Homo sapiens
tcccttctcccttgccc

SEQ ID NO: 1768108 - DNA, 15 bp, Homo sapiens
tcccttctctctctc

SEQ ID NO: 1768109 - DNA, 15 bp, Homo sapiens
tcccttctcttgggg

SEQ ID NO: 1768110 - DNA, 16 bp, Homo sapiens
tcccttgaaggaagag

SEQ ID NO: 1768111 - DNA, 15 bp, Homo sapiens
tcccttgaattgtgt

SEQ ID NO: 1768112 - DNA, 16 bp, Homo sapiens
tcccttgagacctcag

SEQ ID NO: 1768113 - DNA, 18 bp, Homo sapiens
tcccttgagacctcagcc

SEQ ID NO: 1768114 - DNA, 23 bp, Homo sapiens
tcccttgccctccctttctctct

SEQ ID NO: 1768115 - DNA, 16 bp, Homo sapiens
tcccttgcctctgccc

SEQ ID NO: 1768116 - DNA, 19 bp, Homo sapiens
tcccttgcctctgccctgg

SEQ ID NO: 1768117 - DNA, 15 bp, Homo sapiens
tcccttgctggcccc

SEQ ID NO: 1768118 - DNA, 16 bp, Homo sapiens
tcccttgctggcccca

SEQ ID NO: 1768119 - DNA, 19 bp, Homo sapiens
tcccttgctgtaccatatt

SEQ ID NO: 1768120 - DNA, 13 bp, Homo sapiens
tcccttgctttgt

SEQ ID NO: 1768121 - DNA, 22 bp, Homo sapiens
tcccttggatgtagtctgaggc

SEQ ID NO: 1768122 - DNA, 16 bp, Homo sapiens
tcccttggctgttaag

SEQ ID NO: 1768123 - DNA, 19 bp, Homo sapiens
tcccttgtgtcaagacatt

SEQ ID NO: 1768124 - DNA, 15 bp, Homo sapiens
tcccttgtgtgtgtg

SEQ ID NO: 1768125 - DNA, 21 bp, Homo sapiens
tccctttcacaaaattttatt

SEQ ID NO: 1768126 - DNA, 14 bp, Homo sapiens
tccctttccctacc

SEQ ID NO: 1768127 - DNA, 14 bp, Homo sapiens
tccctttccttcca

SEQ ID NO: 1768128 - DNA, 18 bp, Homo sapiens
tccctttccttccatccc

SEQ ID NO: 1768129 - DNA, 15 bp, Homo sapiens
tccctttctcccctg

SEQ ID NO: 1768130 - DNA, 17 bp, Homo sapiens
tccctttcttggccagt

SEQ ID NO: 1768131 - DNA, 21 bp, Homo sapiens
tccctttcttggccagttatc

SEQ ID NO: 1768132 - DNA, 21 bp, Homo sapiens
tccctttgtttgaagttggtt

SEQ ID NO: 1768133 - DNA, 14 bp, Homo sapiens
tcccttttccctta

SEQ ID NO: 1768134 - DNA, 14 bp, Homo sapiens
tcccttttctttga

SEQ ID NO: 1768135 - DNA, 17 bp, Homo sapiens
tccgaatgggttttcta

SEQ ID NO: 1768136 - DNA, 23 bp, Homo sapiens
tccgacgctgcctctcattggca

SEQ ID NO: 1768137 - DNA, 12 bp, Homo sapiens
tccgactgcttt

SEQ ID NO: 1768138 - DNA, 15 bp, Homo sapiens
tccgacttcccctgg

SEQ ID NO: 1768139 - DNA, 18 bp, Homo sapiens
tccgacttcccctgggca

SEQ ID NO: 1768140 - DNA, 21 bp, Homo sapiens
tccgacttcccctgggcaaga

SEQ ID NO: 1768141 - DNA, 20 bp, Homo sapiens
tccgagacaccacaaggcag

SEQ ID NO: 1768142 - DNA, 16 bp, Homo sapiens
tccgagaggtgggcca

SEQ ID NO: 1768143 - DNA, 12 bp, Homo sapiens
tccgagctctgg

SEQ ID NO: 1768144 - DNA, 16 bp, Homo sapiens
tccgagctctggtgct

SEQ ID NO: 1768145 - DNA, 14 bp, Homo sapiens
tcctccccctgcca

SEQ ID NO: 1768146 - DNA, 15 bp, Homo sapiens
tcctccccctgccag

SEQ ID NO: 1768147 - DNA, 17 bp, Homo sapiens
tcctccccctgccagtg

SEQ ID NO: 1768148 - DNA, 20 bp, Homo sapiens
tcctccccctgccagtgcct

SEQ ID NO: 1768149 - DNA, 15 bp, Homo sapiens
tcctccccctgttct

SEQ ID NO: 1768150 - DNA, 16 bp, Homo sapiens
tcctccccctgttctg

SEQ ID NO: 1768151 - DNA, 13 bp, Homo sapiens
tcctcccctcctc

SEQ ID NO: 1768152 - DNA, 16 bp, Homo sapiens
tcctcccgccccgccc

SEQ ID NO: 1768153 - DNA, 18 bp, Homo sapiens
tcctcccgcccttccatg

SEQ ID NO: 1768154 - DNA, 15 bp, Homo sapiens
tcctcccgggccctc

SEQ ID NO: 1768155 - DNA, 21 bp, Homo sapiens
tcctcccgggccctcccttgg

SEQ ID NO: 1768156 - DNA, 22 bp, Homo sapiens
tcctcccgggccctcccttgga

SEQ ID NO: 1768157 - DNA, 18 bp, Homo sapiens
tcctcccggggccttcct

SEQ ID NO: 1768158 - DNA, 19 bp, Homo sapiens
tcctcccgttgcggggtgg

SEQ ID NO: 1768159 - DNA, 16 bp, Homo sapiens
tcctccctacttccaa

SEQ ID NO: 1768160 - DNA, 20 bp, Homo sapiens
tcctccctcatggctctggc

SEQ ID NO: 1768161 - DNA, 15 bp, Homo sapiens
tcctccctccccttc

SEQ ID NO: 1768162 - DNA, 17 bp, Homo sapiens
tcctccctcctgcaggc

SEQ ID NO: 1768163 - DNA, 14 bp, Homo sapiens
tcctccctgccccc

SEQ ID NO: 1768164 - DNA, 21 bp, Homo sapiens
tcctccctggctgccctggcc

SEQ ID NO: 1768165 - DNA, 22 bp, Homo sapiens
tcctccctggctgccctggccc

SEQ ID NO: 1768166 - DNA, 19 bp, Homo sapiens
tcctccctgggcagaaagt

SEQ ID NO: 1768167 - DNA, 14 bp, Homo sapiens
tcctccctgggggc

SEQ ID NO: 1768168 - DNA, 17 bp, Homo sapiens
tcctcccttccttttcc

SEQ ID NO: 1768169 - DNA, 16 bp, Homo sapiens
tcctccgtagggtctt

SEQ ID NO: 1768170 - DNA, 23 bp, Homo sapiens
tcctccgtagggtctttcttggg

SEQ ID NO: 1768171 - DNA, 21 bp, Homo sapiens
tcctccgtccacccaggctgc

SEQ ID NO: 1768172 - DNA, 23 bp, Homo sapiens
tcctccgtccacccaggctgcac

SEQ ID NO: 1768173 - DNA, 20 bp, Homo sapiens
tcctcctaggaaaccagctc

SEQ ID NO: 1768174 - DNA, 21 bp, Homo sapiens
tcctcctaggaaaccagctcg

SEQ ID NO: 1768175 - DNA, 13 bp, Homo sapiens
tcctcctataggg

SEQ ID NO: 1768176 - DNA, 22 bp, Homo sapiens
tcctcctatctccctggctcac

SEQ ID NO: 1768177 - DNA, 12 bp, Homo sapiens
tcctcctcaggc

SEQ ID NO: 1768178 - DNA, 12 bp, Homo sapiens
tcctcctccagg

SEQ ID NO: 1768179 - DNA, 14 bp, Homo sapiens
tcctcctccagggt

SEQ ID NO: 1768180 - DNA, 16 bp, Homo sapiens
tcctcctcccagtgcc

SEQ ID NO: 1768181 - DNA, 15 bp, Homo sapiens
tcctcctccccagct

SEQ ID NO: 1768182 - DNA, 15 bp, Homo sapiens
tcctcctcccccaga

SEQ ID NO: 1768183 - DNA, 13 bp, Homo sapiens
tcctcctcctggg

SEQ ID NO: 1768184 - DNA, 14 bp, Homo sapiens
tcctcctcctgggc

SEQ ID NO: 1768185 - DNA, 12 bp, Homo sapiens
tcctcctgatgg

SEQ ID NO: 1768186 - DNA, 12 bp, Homo sapiens
tcctcctgctca

SEQ ID NO: 1768187 - DNA, 17 bp, Homo sapiens
tcctccttggtgcctgg

SEQ ID NO: 1768188 - DNA, 19 bp, Homo sapiens
tcctccttggtgcctggcc

SEQ ID NO: 1768189 - DNA, 19 bp, Homo sapiens
tcctcctttgtttaataaa

SEQ ID NO: 1768190 - DNA, 15 bp, Homo sapiens
tcctcgaacccactc

SEQ ID NO: 1768191 - DNA, 21 bp, Homo sapiens
tcctcgaattttatctgtgga

SEQ ID NO: 1768192 - DNA, 13 bp, Homo sapiens
tcctcgccctggg

SEQ ID NO: 1768193 - DNA, 14 bp, Homo sapiens
tcctcgccctgggt

SEQ ID NO: 1768194 - DNA, 15 bp, Homo sapiens
tcctcgcctgacaac

SEQ ID NO: 1768195 - DNA, 21 bp, Homo sapiens
tcctcggagagcagcagcacc

SEQ ID NO: 1768196 - DNA, 19 bp, Homo sapiens
tcctcggatcaccgagagt

SEQ ID NO: 1768197 - DNA, 18 bp, Homo sapiens
tcctcgggatgccgttct

SEQ ID NO: 1768198 - DNA, 17 bp, Homo sapiens
tcctcggtactcccata

SEQ ID NO: 1768199 - DNA, 18 bp, Homo sapiens
tcctctactcttacagag

SEQ ID NO: 1768200 - DNA, 19 bp, Homo sapiens
tcctctacttaatgagata

SEQ ID NO: 1768201 - DNA, 14 bp, Homo sapiens
tcctctagaagcca

SEQ ID NO: 1768202 - DNA, 16 bp, Homo sapiens
tcctctagaagccaag

SEQ ID NO: 1768203 - DNA, 17 bp, Homo sapiens
tcctctagaagccaagg

SEQ ID NO: 1768204 - DNA, 15 bp, Homo sapiens
tcctctagctgtggg

SEQ ID NO: 1768205 - DNA, 16 bp, Homo sapiens
tcctctagtaagatgc

SEQ ID NO: 1768206 - DNA, 13 bp, Homo sapiens
tcctctatacttt

SEQ ID NO: 1768207 - DNA, 24 bp, Homo sapiens
tcctctatactttgttctgttgtc

SEQ ID NO: 1768208 - DNA, 17 bp, Homo sapiens
tcctctatttaagatat

SEQ ID NO: 1768209 - DNA, 22 bp, Homo sapiens
tcctctcaagctagccagaggg

SEQ ID NO: 1768210 - DNA, 19 bp, Homo sapiens
tcctctcagaactcctgtg

SEQ ID NO: 1768211 - DNA, 21 bp, Homo sapiens
tcctctcagaactcctgtgtg

SEQ ID NO: 1768212 - DNA, 15 bp, Homo sapiens
tcctctcaggctctt

SEQ ID NO: 1768213 - DNA, 14 bp, Homo sapiens
tcctctcagtgttt

SEQ ID NO: 1768214 - DNA, 12 bp, Homo sapiens
tcctctccactg

SEQ ID NO: 1768215 - DNA, 17 bp, Homo sapiens
tcctctccactgccttc

SEQ ID NO: 1768216 - DNA, 18 bp, Homo sapiens
tcctctccactgctggac

SEQ ID NO: 1768217 - DNA, 15 bp, Homo sapiens
tcctctccaggccag

SEQ ID NO: 1768218 - DNA, 15 bp, Homo sapiens
tcctctccattttag

SEQ ID NO: 1768219 - DNA, 13 bp, Homo sapiens
tcctctcccatcc

SEQ ID NO: 1768220 - DNA, 16 bp, Homo sapiens
tcctctcccatccccc

SEQ ID NO: 1768221 - DNA, 17 bp, Homo sapiens
tcctctcccatccccct

SEQ ID NO: 1768222 - DNA, 20 bp, Homo sapiens
tcctctcccatccccctgcc

SEQ ID NO: 1768223 - DNA, 17 bp, Homo sapiens
tcctctcccatccttga

SEQ ID NO: 1768224 - DNA, 16 bp, Homo sapiens
tcctctccccagccca

SEQ ID NO: 1768225 - DNA, 20 bp, Homo sapiens
tcctctccccagcccagaga

SEQ ID NO: 1768226 - DNA, 13 bp, Homo sapiens
tcctctccctgcc

SEQ ID NO: 1768227 - DNA, 16 bp, Homo sapiens
tcctctccctgccaag

SEQ ID NO: 1768228 - DNA, 17 bp, Homo sapiens
tcctctccctgccaagt

SEQ ID NO: 1768229 - DNA, 21 bp, Homo sapiens
tcctctccttgggctcctggc

SEQ ID NO: 1768230 - DNA, 15 bp, Homo sapiens
tcctctcgcggccct

SEQ ID NO: 1768231 - DNA, 16 bp, Homo sapiens
tcctctctagggcaga

SEQ ID NO: 1768232 - DNA, 11 bp, Homo sapiens
tcctctctctc

SEQ ID NO: 1768233 - DNA, 14 bp, Homo sapiens
tcctctctgagact

SEQ ID NO: 1768234 - DNA, 18 bp, Homo sapiens
tcctctctgagtcaaatc

SEQ ID NO: 1768235 - DNA, 17 bp, Homo sapiens
tcctctcttcctcttcc

SEQ ID NO: 1768236 - DNA, 13 bp, Homo sapiens
tcctctcttggca

SEQ ID NO: 1768237 - DNA, 18 bp, Homo sapiens
tcctctgagattctaaga

SEQ ID NO: 1768238 - DNA, 13 bp, Homo sapiens
tcctctgagcagc

SEQ ID NO: 1768239 - DNA, 15 bp, Homo sapiens
tcctctgagcagcct

SEQ ID NO: 1768240 - DNA, 18 bp, Homo sapiens
tcctctgagcagcctctg

SEQ ID NO: 1768241 - DNA, 18 bp, Homo sapiens
tcctctgcagctgacctc

SEQ ID NO: 1768242 - DNA, 13 bp, Homo sapiens
tcctctgcagtgc

SEQ ID NO: 1768243 - DNA, 18 bp, Homo sapiens
tcctctgccacctcccct

SEQ ID NO: 1768244 - DNA, 23 bp, Homo sapiens
tcctctgccacctcccctatcca

SEQ ID NO: 1768245 - DNA, 20 bp, Homo sapiens
tcctctgctcaccgcccatc

SEQ ID NO: 1768246 - DNA, 13 bp, Homo sapiens
tcctctgctccag

SEQ ID NO: 1768247 - DNA, 14 bp, Homo sapiens
tcctctgctccagc

SEQ ID NO: 1768248 - DNA, 12 bp, Homo sapiens
tcctctggagcc

SEQ ID NO: 1768249 - DNA, 17 bp, Homo sapiens
tcctctgggtttctaag

SEQ ID NO: 1768250 - DNA, 14 bp, Homo sapiens
tcctctggttcctt

SEQ ID NO: 1768251 - DNA, 20 bp, Homo sapiens
tcctctggttcctttcatct

SEQ ID NO: 1768252 - DNA, 23 bp, Homo sapiens
tcctctgtccagggccctgagct

SEQ ID NO: 1768253 - DNA, 14 bp, Homo sapiens
tcctcttagcctct

SEQ ID NO: 1768254 - DNA, 17 bp, Homo sapiens
tcctcttcccccaagat

SEQ ID NO: 1768255 - DNA, 18 bp, Homo sapiens
tcctcttccctctctgca

SEQ ID NO: 1768256 - DNA, 19 bp, Homo sapiens
tcctcttctattttgtaaa

SEQ ID NO: 1768257 - DNA, 14 bp, Homo sapiens
tcctcttggctgag

SEQ ID NO: 1768258 - DNA, 20 bp, Homo sapiens
tcctcttgtctgatttctta

SEQ ID NO: 1768259 - DNA, 18 bp, Homo sapiens
tcctctttagtttttggt

SEQ ID NO: 1768260 - DNA, 11 bp, Homo sapiens
tcctctttctg

SEQ ID NO: 1768261 - DNA, 23 bp, Homo sapiens
tccttgagacacggagcccagcc

SEQ ID NO: 1768262 - DNA, 16 bp, Homo sapiens
tccttgagtgtatgag

SEQ ID NO: 1768263 - DNA, 19 bp, Homo sapiens
tccttgatatttgtattta

SEQ ID NO: 1768264 - DNA, 22 bp, Homo sapiens
tccttgatctgtatatacaata

SEQ ID NO: 1768265 - DNA, 17 bp, Homo sapiens
tccttgatgccagaggg

SEQ ID NO: 1768266 - DNA, 21 bp, Homo sapiens
tccttgcaaggttaagcaagg

SEQ ID NO: 1768267 - DNA, 14 bp, Homo sapiens
tccttgcacctgca

SEQ ID NO: 1768268 - DNA, 12 bp, Homo sapiens
tccttgccttaa

SEQ ID NO: 1768269 - DNA, 13 bp, Homo sapiens
tccttgccttctt

SEQ ID NO: 1768270 - DNA, 16 bp, Homo sapiens
tccttgctagccctgg

SEQ ID NO: 1768271 - DNA, 13 bp, Homo sapiens
tccttgctgcagc

SEQ ID NO: 1768272 - DNA, 19 bp, Homo sapiens
tccttgctgtcctaggcca

SEQ ID NO: 1768273 - DNA, 22 bp, Homo sapiens
tccttgctgtgggatgtgccag

SEQ ID NO: 1768274 - DNA, 15 bp, Homo sapiens
tccttgcttcctgat

SEQ ID NO: 1768275 - DNA, 17 bp, Homo sapiens
tccttgcttcctgtctt

SEQ ID NO: 1768276 - DNA, 16 bp, Homo sapiens
tccttggactcatttt

SEQ ID NO: 1768277 - DNA, 16 bp, Homo sapiens
tccttggagtcccagg

SEQ ID NO: 1768278 - DNA, 17 bp, Homo sapiens
tccttggagtcccaggg

SEQ ID NO: 1768279 - DNA, 20 bp, Homo sapiens
tccttggcatcacagggcag

SEQ ID NO: 1768280 - DNA, 19 bp, Homo sapiens
tccttggctgtctgtgggc

SEQ ID NO: 1768281 - DNA, 18 bp, Homo sapiens
tccttggctttatgcaaa

SEQ ID NO: 1768282 - DNA, 22 bp, Homo sapiens
tccttgggccctttttcccttc

SEQ ID NO: 1768283 - DNA, 14 bp, Homo sapiens
tccttgggcctggc

SEQ ID NO: 1768284 - DNA, 17 bp, Homo sapiens
tccttgggcctggccag

SEQ ID NO: 1768285 - DNA, 15 bp, Homo sapiens
tccttgggctcctgg

SEQ ID NO: 1768286 - DNA, 16 bp, Homo sapiens
tccttgggctcctggc

SEQ ID NO: 1768287 - DNA, 17 bp, Homo sapiens
tccttgggctcctggct

SEQ ID NO: 1768288 - DNA, 21 bp, Homo sapiens
tccttgggctcctggctgcca

SEQ ID NO: 1768289 - DNA, 19 bp, Homo sapiens
tccttggggcagggcctgg

SEQ ID NO: 1768290 - DNA, 22 bp, Homo sapiens
tccttggggcagggcctgggcc

SEQ ID NO: 1768291 - DNA, 19 bp, Homo sapiens
tccttggtctatgtgctct

SEQ ID NO: 1768292 - DNA, 16 bp, Homo sapiens
tccttggtgctgtgtg

SEQ ID NO: 1768293 - DNA, 18 bp, Homo sapiens
tccttggtgctgtgtgcc

SEQ ID NO: 1768294 - DNA, 21 bp, Homo sapiens
tccttgtcacgatcacaggcc

SEQ ID NO: 1768295 - DNA, 13 bp, Homo sapiens
tccttgtcactgg

SEQ ID NO: 1768296 - DNA, 18 bp, Homo sapiens
tccttgtgcaattgtctt

SEQ ID NO: 1768297 - DNA, 21 bp, Homo sapiens
tccttgtgcaattgtcttttt

SEQ ID NO: 1768298 - DNA, 23 bp, Homo sapiens
tccttgtggactggctgtgcccc

SEQ ID NO: 1768299 - DNA, 14 bp, Homo sapiens
tccttgtgtgtgtc

SEQ ID NO: 1768300 - DNA, 15 bp, Homo sapiens
tcctttaaaaaagaa

SEQ ID NO: 1768301 - DNA, 19 bp, Homo sapiens
tcctttacactcaggcttt

SEQ ID NO: 1768302 - DNA, 15 bp, Homo sapiens
tcctttacctttcag

SEQ ID NO: 1768303 - DNA, 17 bp, Homo sapiens
tcctttataaggttgtc

SEQ ID NO: 1768304 - DNA, 18 bp, Homo sapiens
tcctttataatatttcag

SEQ ID NO: 1768305 - DNA, 13 bp, Homo sapiens
tcctttataatga

SEQ ID NO: 1768306 - DNA, 18 bp, Homo sapiens
tcctttatattttttgtc

SEQ ID NO: 1768307 - DNA, 20 bp, Homo sapiens
tcctttatattttttgtctg

SEQ ID NO: 1768308 - DNA, 13 bp, Homo sapiens
tcctttatgtgaa

SEQ ID NO: 1768309 - DNA, 16 bp, Homo sapiens
tcctttatgtgaattt

SEQ ID NO: 1768310 - DNA, 23 bp, Homo sapiens
tcctttatgtgaatttttaagct

SEQ ID NO: 1768311 - DNA, 21 bp, Homo sapiens
tcctttatgtggaaaacagaa

SEQ ID NO: 1768312 - DNA, 18 bp, Homo sapiens
tcctttcacaaccttctg

SEQ ID NO: 1768313 - DNA, 16 bp, Homo sapiens
tcctttcatctctcta

SEQ ID NO: 1768314 - DNA, 20 bp, Homo sapiens
tcctttcatctctctacctc

SEQ ID NO: 1768315 - DNA, 14 bp, Homo sapiens
tcctttccatctgt

SEQ ID NO: 1768316 - DNA, 17 bp, Homo sapiens
tcctttccatctgtcca

SEQ ID NO: 1768317 - DNA, 18 bp, Homo sapiens
tcctttccttcccaggcc

SEQ ID NO: 1768318 - DNA, 14 bp, Homo sapiens
tcctttctcagccg

SEQ ID NO: 1768319 - DNA, 16 bp, Homo sapiens
tcctttctccagccag

SEQ ID NO: 1768320 - DNA, 16 bp, Homo sapiens
tcctttctcctgcccc

SEQ ID NO: 1768321 - DNA, 19 bp, Homo sapiens
tcctttctgtaggtttctc

SEQ ID NO: 1768322 - DNA, 23 bp, Homo sapiens
tcctttctgtaggtttctctctt

SEQ ID NO: 1768323 - DNA, 14 bp, Homo sapiens
tcctttctgtgcat

SEQ ID NO: 1768324 - DNA, 20 bp, Homo sapiens
tcctttctttactatgtttc

SEQ ID NO: 1768325 - DNA, 18 bp, Homo sapiens
tcctttgaacgtgcttct

SEQ ID NO: 1768326 - DNA, 19 bp, Homo sapiens
tcctttgaacgtgcttctt

SEQ ID NO: 1768327 - DNA, 16 bp, Homo sapiens
tcctttgagaatgtga

SEQ ID NO: 1768328 - DNA, 18 bp, Homo sapiens
tcctttgagaatgtgatt

SEQ ID NO: 1768329 - DNA, 21 bp, Homo sapiens
tcctttgagtgccaatttctt

SEQ ID NO: 1768330 - DNA, 20 bp, Homo sapiens
tcctttgataaaataaatga

SEQ ID NO: 1768331 - DNA, 22 bp, Homo sapiens
tcctttgatcagtataattttt

SEQ ID NO: 1768332 - DNA, 17 bp, Homo sapiens
tcctttgcactgagggc

SEQ ID NO: 1768333 - DNA, 18 bp, Homo sapiens
tcctttggtcctgtcccc

SEQ ID NO: 1768334 - DNA, 18 bp, Homo sapiens
tcctttgtattctgtctt

SEQ ID NO: 1768335 - DNA, 20 bp, Homo sapiens
tcctttgtgtttctattgac

SEQ ID NO: 1768336 - DNA, 18 bp, Homo sapiens
tcctttgttttctgacta

SEQ ID NO: 1768337 - DNA, 14 bp, Homo sapiens
tccttttatttctc

SEQ ID NO: 1768338 - DNA, 21 bp, Homo sapiens
tccttttatttctccatcttt

SEQ ID NO: 1768339 - DNA, 12 bp, Homo sapiens
tccttttcacat

SEQ ID NO: 1768340 - DNA, 23 bp, Homo sapiens
tccttttcacattagataaatta

SEQ ID NO: 1768341 - DNA, 15 bp, Homo sapiens
tccttttcacatttt

SEQ ID NO: 1768342 - DNA, 14 bp, Homo sapiens
tccttttcagaagt

SEQ ID NO: 1768343 - DNA, 13 bp, Homo sapiens
tccttttccctgc

SEQ ID NO: 1768344 - DNA, 14 bp, Homo sapiens
tccttttccctgct

SEQ ID NO: 1768345 - DNA, 13 bp, Homo sapiens
tccttttctcttt

SEQ ID NO: 1768346 - DNA, 19 bp, Homo sapiens
tccttttcttcaccctccc

SEQ ID NO: 1768347 - DNA, 18 bp, Homo sapiens
tccttttcttccctgacc

SEQ ID NO: 1768348 - DNA, 17 bp, Homo sapiens
tccttttgaacttgtca

SEQ ID NO: 1768349 - DNA, 16 bp, Homo sapiens
tccttttgacactgct

SEQ ID NO: 1768350 - DNA, 18 bp, Homo sapiens
tccttttgacactgctct

SEQ ID NO: 1768351 - DNA, 22 bp, Homo sapiens
tccttttgaggagctggagggg

SEQ ID NO: 1768352 - DNA, 16 bp, Homo sapiens
tccttttgataaattt

SEQ ID NO: 1768353 - DNA, 14 bp, Homo sapiens
tccttttgatgggg

SEQ ID NO: 1768354 - DNA, 14 bp, Homo sapiens
tccttttgctcttt

SEQ ID NO: 1768355 - DNA, 16 bp, Homo sapiens
tccttttggaacattt

SEQ ID NO: 1768356 - DNA, 19 bp, Homo sapiens
tccttttgtccccagggcc

SEQ ID NO: 1768357 - DNA, 17 bp, Homo sapiens
tccttttgtgtacagtg

SEQ ID NO: 1768358 - DNA, 18 bp, Homo sapiens
tccttttgtgtacagtgt

SEQ ID NO: 1768359 - DNA, 17 bp, Homo sapiens
tcctttttaaatgtgaa

SEQ ID NO: 1768360 - DNA, 21 bp, Homo sapiens
tcctttttaaatgtgaatttt

SEQ ID NO: 1768361 - DNA, 21 bp, Homo sapiens
tcctttttcttcgctggacta

SEQ ID NO: 1768362 - DNA, 14 bp, Homo sapiens
tcctttttctttat

SEQ ID NO: 1768363 - DNA, 19 bp, Homo sapiens
tcctttttctttataaact

SEQ ID NO: 1768364 - DNA, 16 bp, Homo sapiens
tcctttttgacactga

SEQ ID NO: 1768365 - DNA, 12 bp, Homo sapiens
tccttttttgtc

SEQ ID NO: 1768366 - DNA, 19 bp, Homo sapiens
tccttttttgtctatgaag

SEQ ID NO: 1768367 - DNA, 19 bp, Homo sapiens
tcgaaagctctagaatctg

SEQ ID NO: 1768368 - DNA, 15 bp, Homo sapiens
tcgaaaggccttcag

SEQ ID NO: 1768369 - DNA, 19 bp, Homo sapiens
tcgaaatttgttgtttgtt

SEQ ID NO: 1768370 - DNA, 20 bp, Homo sapiens
tcgaaccaaggcagcctcca

SEQ ID NO: 1768371 - DNA, 22 bp, Homo sapiens
tcgaaccaaggcagcctccaga

SEQ ID NO: 1768372 - DNA, 14 bp, Homo sapiens
tcgaacttcacaac

SEQ ID NO: 1768373 - DNA, 18 bp, Homo sapiens
tcgaacttcacaactagg

SEQ ID NO: 1768374 - DNA, 23 bp, Homo sapiens
tcgaagccttgcctaaatttaat

SEQ ID NO: 1768375 - DNA, 16 bp, Homo sapiens
tctaaaaagaaaaaga

SEQ ID NO: 1768376 - DNA, 23 bp, Homo sapiens
tctaaaaataaaatgcatttaaa

SEQ ID NO: 1768377 - DNA, 18 bp, Homo sapiens
tctaaaaataactgtaat

SEQ ID NO: 1768378 - DNA, 11 bp, Homo sapiens
tctaaaacaat

SEQ ID NO: 1768379 - DNA, 13 bp, Homo sapiens
tctaaaacaataa

SEQ ID NO: 1768380 - DNA, 11 bp, Homo sapiens
tctaaaactcc

SEQ ID NO: 1768381 - DNA, 17 bp, Homo sapiens
tctaaaagatccttttt

SEQ ID NO: 1768382 - DNA, 12 bp, Homo sapiens
tctaaaagccat

SEQ ID NO: 1768383 - DNA, 22 bp, Homo sapiens
tctaaaatactcaccaaaatat

SEQ ID NO: 1768384 - DNA, 23 bp, Homo sapiens
tctaaaatcttatagttctaggc

SEQ ID NO: 1768385 - DNA, 20 bp, Homo sapiens
tctaaaatgtgatgttctaa

SEQ ID NO: 1768386 - DNA, 18 bp, Homo sapiens
tctaaaattataaatgac

SEQ ID NO: 1768387 - DNA, 15 bp, Homo sapiens
tctaaaattctagtc

SEQ ID NO: 1768388 - DNA, 18 bp, Homo sapiens
tctaaaatttaaaattaa

SEQ ID NO: 1768389 - DNA, 15 bp, Homo sapiens
tctaaaatttgtaat

SEQ ID NO: 1768390 - DNA, 14 bp, Homo sapiens
tctaaacaaaaaat

SEQ ID NO: 1768391 - DNA, 20 bp, Homo sapiens
tctaaacattttttcttcaa

SEQ ID NO: 1768392 - DNA, 12 bp, Homo sapiens
tctaaactgttt

SEQ ID NO: 1768393 - DNA, 17 bp, Homo sapiens
tctaaagaaagatactc

SEQ ID NO: 1768394 - DNA, 18 bp, Homo sapiens
tctaaagatggagtttct

SEQ ID NO: 1768395 - DNA, 13 bp, Homo sapiens
tctaaagattcta

SEQ ID NO: 1768396 - DNA, 23 bp, Homo sapiens
tctaaagattctatagttctaga

SEQ ID NO: 1768397 - DNA, 14 bp, Homo sapiens
tctaaaggtccaca

SEQ ID NO: 1768398 - DNA, 15 bp, Homo sapiens
tctaaaggtccacag

SEQ ID NO: 1768399 - DNA, 22 bp, Homo sapiens
tctaaaggtccacaggtctaga

SEQ ID NO: 1768400 - DNA, 13 bp, Homo sapiens
tctaaagttctaa

SEQ ID NO: 1768401 - DNA, 17 bp, Homo sapiens
tctaaagttctaagatt

SEQ ID NO: 1768402 - DNA, 21 bp, Homo sapiens
tctaaagttctaagattctga

SEQ ID NO: 1768403 - DNA, 15 bp, Homo sapiens
tctaaataaaaatat

SEQ ID NO: 1768404 - DNA, 22 bp, Homo sapiens
tctaaataaaaatatgtaattt

SEQ ID NO: 1768405 - DNA, 23 bp, Homo sapiens
tctaaatatttccttaaactgtg

SEQ ID NO: 1768406 - DNA, 18 bp, Homo sapiens
tctaaatcttccttgtga

SEQ ID NO: 1768407 - DNA, 17 bp, Homo sapiens
tctaaatttgaatgtta

SEQ ID NO: 1768408 - DNA, 23 bp, Homo sapiens
tctaaattttatatcttgtagct

SEQ ID NO: 1768409 - DNA, 15 bp, Homo sapiens
tctaacaataatatt

SEQ ID NO: 1768410 - DNA, 21 bp, Homo sapiens
tctaacaataatatttcaagt

SEQ ID NO: 1768411 - DNA, 19 bp, Homo sapiens
tctaacactggcatgttca

SEQ ID NO: 1768412 - DNA, 23 bp, Homo sapiens
tctaacagccctcctctgcactc

SEQ ID NO: 1768413 - DNA, 12 bp, Homo sapiens
tctaacagtcct

SEQ ID NO: 1768414 - DNA, 13 bp, Homo sapiens
tctaaccattcaa

SEQ ID NO: 1768415 - DNA, 18 bp, Homo sapiens
tctaacccagtggctgga

SEQ ID NO: 1768416 - DNA, 14 bp, Homo sapiens
tctaaccctcccat

SEQ ID NO: 1768417 - DNA, 21 bp, Homo sapiens
tctaaccctcccatggcacct

SEQ ID NO: 1768418 - DNA, 20 bp, Homo sapiens
tctaaccttgaatgctgcca

SEQ ID NO: 1768419 - DNA, 21 bp, Homo sapiens
tctaaccttgaatgctgccag

SEQ ID NO: 1768420 - DNA, 17 bp, Homo sapiens
tctaacggtctgttctg

SEQ ID NO: 1768421 - DNA, 15 bp, Homo sapiens
tctaactcactgcct

SEQ ID NO: 1768422 - DNA, 17 bp, Homo sapiens
tctaactcactgcctag

SEQ ID NO: 1768423 - DNA, 15 bp, Homo sapiens
tctaactcagaaaca

SEQ ID NO: 1768424 - DNA, 23 bp, Homo sapiens
tctaactcccccattttacagat

SEQ ID NO: 1768425 - DNA, 21 bp, Homo sapiens
tctaactggacatgaaggaaa

SEQ ID NO: 1768426 - DNA, 14 bp, Homo sapiens
tctaagaaaatgta

SEQ ID NO: 1768427 - DNA, 13 bp, Homo sapiens
tctaagaagacat

SEQ ID NO: 1768428 - DNA, 22 bp, Homo sapiens
tctaagaagacattttgttaca

SEQ ID NO: 1768429 - DNA, 21 bp, Homo sapiens
tctaagactatatatataaat

SEQ ID NO: 1768430 - DNA, 18 bp, Homo sapiens
tctaagactcaaatgttc

SEQ ID NO: 1768431 - DNA, 19 bp, Homo sapiens
tctaagacttactctaaga

SEQ ID NO: 1768432 - DNA, 12 bp, Homo sapiens
tctaagagaagt

SEQ ID NO: 1768433 - DNA, 12 bp, Homo sapiens
tctaagagtgcc

SEQ ID NO: 1768434 - DNA, 21 bp, Homo sapiens
tctaagatcttagattctctg

SEQ ID NO: 1768435 - DNA, 22 bp, Homo sapiens
tctaagatgccagcatatactg

SEQ ID NO: 1768436 - DNA, 13 bp, Homo sapiens
tctaagatgtgat

SEQ ID NO: 1768437 - DNA, 20 bp, Homo sapiens
tctaagatgtgatattctaa

SEQ ID NO: 1768438 - DNA, 24 bp, Homo sapiens
tctaagatgtgatattctaagact

SEQ ID NO: 1768439 - DNA, 14 bp, Homo sapiens
tctaagattctaaa

SEQ ID NO: 1768440 - DNA, 18 bp, Homo sapiens
tctaagattctaaaggtc

SEQ ID NO: 1768441 - DNA, 14 bp, Homo sapiens
tctaagattctaat

SEQ ID NO: 1768442 - DNA, 15 bp, Homo sapiens
tctaagattctaatg

SEQ ID NO: 1768443 - DNA, 17 bp, Homo sapiens
tctaagattctaatgat

SEQ ID NO: 1768444 - DNA, 19 bp, Homo sapiens
tctaagattctaatgatga

SEQ ID NO: 1768445 - DNA, 20 bp, Homo sapiens
tctaagattctaatgatgat

SEQ ID NO: 1768446 - DNA, 14 bp, Homo sapiens
tctaagattctaga

SEQ ID NO: 1768447 - DNA, 19 bp, Homo sapiens
tctaagattctagatcaga

SEQ ID NO: 1768448 - DNA, 14 bp, Homo sapiens
tctaagatttggtt

SEQ ID NO: 1768449 - DNA, 16 bp, Homo sapiens
tctaagcaatgcaaat

SEQ ID NO: 1768450 - DNA, 16 bp, Homo sapiens
tctaagcacattccaa

SEQ ID NO: 1768451 - DNA, 18 bp, Homo sapiens
tctaagcagcttattgtt

SEQ ID NO: 1768452 - DNA, 22 bp, Homo sapiens
tctaagccaactttaattgctt

SEQ ID NO: 1768453 - DNA, 16 bp, Homo sapiens
tctaagccagttttca

SEQ ID NO: 1768454 - DNA, 19 bp, Homo sapiens
tctaagccagttttcattt

SEQ ID NO: 1768455 - DNA, 22 bp, Homo sapiens
tctaagccctgttctcctgtcc

SEQ ID NO: 1768456 - DNA, 15 bp, Homo sapiens
tctaagctggagctc

SEQ ID NO: 1768457 - DNA, 17 bp, Homo sapiens
tctaagctggagctctt

SEQ ID NO: 1768458 - DNA, 19 bp, Homo sapiens
tctaagcttatttctaact

SEQ ID NO: 1768459 - DNA, 21 bp, Homo sapiens
tctaaggacctgaaattccaa

SEQ ID NO: 1768460 - DNA, 23 bp, Homo sapiens
tctaaggacctgaaattccaaag

SEQ ID NO: 1768461 - DNA, 17 bp, Homo sapiens
tctaaggataatgaaat

SEQ ID NO: 1768462 - DNA, 19 bp, Homo sapiens
tctaaggataatgaaataa

SEQ ID NO: 1768463 - DNA, 22 bp, Homo sapiens
tctaaggcctaggattctaaaa

SEQ ID NO: 1768464 - DNA, 13 bp, Homo sapiens
tctaaggctctga

SEQ ID NO: 1768465 - DNA, 15 bp, Homo sapiens
tctaaggctctgaga

SEQ ID NO: 1768466 - DNA, 20 bp, Homo sapiens
tctaaggtccggtgttctaa

SEQ ID NO: 1768467 - DNA, 18 bp, Homo sapiens
tctaaggtctcatgctgt

SEQ ID NO: 1768468 - DNA, 22 bp, Homo sapiens
tctaagtaaaaccacagcagtt

SEQ ID NO: 1768469 - DNA, 19 bp, Homo sapiens
tctaagtacatatgtagat

SEQ ID NO: 1768470 - DNA, 23 bp, Homo sapiens
tctaagtcaaacacttgtgactt

SEQ ID NO: 1768471 - DNA, 21 bp, Homo sapiens
tctaagtcagtacccaccacc

SEQ ID NO: 1768472 - DNA, 17 bp, Homo sapiens
tctaagtcagtttcaca

SEQ ID NO: 1768473 - DNA, 21 bp, Homo sapiens
tctaagtgttcgtctttagtt

SEQ ID NO: 1768474 - DNA, 14 bp, Homo sapiens
tctaagttataaga

SEQ ID NO: 1768475 - DNA, 17 bp, Homo sapiens
tctaagttataagactc

SEQ ID NO: 1768476 - DNA, 20 bp, Homo sapiens
tctaagttataagactctca

SEQ ID NO: 1768477 - DNA, 16 bp, Homo sapiens
tctaagtttctaagat

SEQ ID NO: 1768478 - DNA, 18 bp, Homo sapiens
tctaagtttctaagattc

SEQ ID NO: 1768479 - DNA, 16 bp, Homo sapiens
tctaataaacttggat

SEQ ID NO: 1768480 - DNA, 13 bp, Homo sapiens
tctaataaacttt

SEQ ID NO: 1768481 - DNA, 17 bp, Homo sapiens
tctaataatttctaatg

SEQ ID NO: 1768482 - DNA, 18 bp, Homo sapiens
tctaataatttctaatgt

SEQ ID NO: 1768483 - DNA, 13 bp, Homo sapiens
tctaatagtgctt

SEQ ID NO: 1768484 - DNA, 15 bp, Homo sapiens
tctaatatatatgaa

SEQ ID NO: 1768485 - DNA, 19 bp, Homo sapiens
tctaatatatatgaataaa

SEQ ID NO: 1768486 - DNA, 15 bp, Homo sapiens
tctaatccttttcct

SEQ ID NO: 1768487 - DNA, 12 bp, Homo sapiens
tctaatctctta

SEQ ID NO: 1768488 - DNA, 16 bp, Homo sapiens
tctaatgaagagaaaa

SEQ ID NO: 1768489 - DNA, 18 bp, Homo sapiens
tctcagggaagcccagct

SEQ ID NO: 1768490 - DNA, 21 bp, Homo sapiens
tctcagggaagcccagctcca

SEQ ID NO: 1768491 - DNA, 16 bp, Homo sapiens
tctcaggggctgtttg

SEQ ID NO: 1768492 - DNA, 16 bp, Homo sapiens
tctcagggtccagacc

SEQ ID NO: 1768493 - DNA, 22 bp, Homo sapiens
tctcaggtagaaggttgacaca

SEQ ID NO: 1768494 - DNA, 17 bp, Homo sapiens
tctcaggtgccactccc

SEQ ID NO: 1768495 - DNA, 22 bp, Homo sapiens
tctcaggtgccactccctgagc

SEQ ID NO: 1768496 - DNA, 21 bp, Homo sapiens
tctcaggtgggttagagatgg

SEQ ID NO: 1768497 - DNA, 20 bp, Homo sapiens
tctcaggtttgttttgtgaa

SEQ ID NO: 1768498 - DNA, 20 bp, Homo sapiens
tctcagtaccccatggagct

SEQ ID NO: 1768499 - DNA, 13 bp, Homo sapiens
tctcagtcttttc

SEQ ID NO: 1768500 - DNA, 16 bp, Homo sapiens
tctcagtgccttctct

SEQ ID NO: 1768501 - DNA, 19 bp, Homo sapiens
tctcagtgccttctctcag

SEQ ID NO: 1768502 - DNA, 23 bp, Homo sapiens
tctcagtgccttctctcagctcc

SEQ ID NO: 1768503 - DNA, 13 bp, Homo sapiens
tctcagtgttggt

SEQ ID NO: 1768504 - DNA, 12 bp, Homo sapiens
tctcagtgtttt

SEQ ID NO: 1768505 - DNA, 15 bp, Homo sapiens
tctcagtgttttgga

SEQ ID NO: 1768506 - DNA, 19 bp, Homo sapiens
tctcagtgttttggactcc

SEQ ID NO: 1768507 - DNA, 22 bp, Homo sapiens
tctcagttatgtagtttcttgt

SEQ ID NO: 1768508 - DNA, 16 bp, Homo sapiens
tctcagtttgtgtgtc

SEQ ID NO: 1768509 - DNA, 19 bp, Homo sapiens
tctcagtttgtgtgtctta

SEQ ID NO: 1768510 - DNA, 16 bp, Homo sapiens
tctcagttttcataag

SEQ ID NO: 1768511 - DNA, 12 bp, Homo sapiens
tctcataaaact

SEQ ID NO: 1768512 - DNA, 15 bp, Homo sapiens
tctcataaaactgtg

SEQ ID NO: 1768513 - DNA, 16 bp, Homo sapiens
tctcatacctctgacc

SEQ ID NO: 1768514 - DNA, 15 bp, Homo sapiens
tctcatactgtctgg

SEQ ID NO: 1768515 - DNA, 22 bp, Homo sapiens
tctcataggaaaagtacattta

SEQ ID NO: 1768516 - DNA, 16 bp, Homo sapiens
tctcataggaattaaa

SEQ ID NO: 1768517 - DNA, 17 bp, Homo sapiens
tctcataggttaaaaaa

SEQ ID NO: 1768518 - DNA, 14 bp, Homo sapiens
tctcatcatattgt

SEQ ID NO: 1768519 - DNA, 15 bp, Homo sapiens
tctcatcatattgta

SEQ ID NO: 1768520 - DNA, 15 bp, Homo sapiens
tctcatccccagggg

SEQ ID NO: 1768521 - DNA, 23 bp, Homo sapiens
tctcatcctggcacgccctactc

SEQ ID NO: 1768522 - DNA, 20 bp, Homo sapiens
tctcatcggaggcccatgcc

SEQ ID NO: 1768523 - DNA, 17 bp, Homo sapiens
tctcatctcttagctcc

SEQ ID NO: 1768524 - DNA, 18 bp, Homo sapiens
tctcatctcttcaggttc

SEQ ID NO: 1768525 - DNA, 13 bp, Homo sapiens
tctcatctgtgat

SEQ ID NO: 1768526 - DNA, 17 bp, Homo sapiens
tctcatctgtgattccc

SEQ ID NO: 1768527 - DNA, 12 bp, Homo sapiens
tctcatctttct

SEQ ID NO: 1768528 - DNA, 16 bp, Homo sapiens
tctcatgaagcaggag

SEQ ID NO: 1768529 - DNA, 16 bp, Homo sapiens
tctcatgagaagccaa

SEQ ID NO: 1768530 - DNA, 16 bp, Homo sapiens
tctcatgaggggagag

SEQ ID NO: 1768531 - DNA, 20 bp, Homo sapiens
tctcatgaggggagaggaga

SEQ ID NO: 1768532 - DNA, 23 bp, Homo sapiens
tctcatgataccacctttactgt

SEQ ID NO: 1768533 - DNA, 15 bp, Homo sapiens
tctcattaaaagaat

SEQ ID NO: 1768534 - DNA, 16 bp, Homo sapiens
tctcattaaaagaata

SEQ ID NO: 1768535 - DNA, 20 bp, Homo sapiens
tctcattaaaagaatatctg

SEQ ID NO: 1768536 - DNA, 12 bp, Homo sapiens
tctcattcagta

SEQ ID NO: 1768537 - DNA, 13 bp, Homo sapiens
tctcattcagtat

SEQ ID NO: 1768538 - DNA, 13 bp, Homo sapiens
tctcattccccag

SEQ ID NO: 1768539 - DNA, 14 bp, Homo sapiens
tctcattccccagg

SEQ ID NO: 1768540 - DNA, 22 bp, Homo sapiens
tctcattcgcctttgtcttgta

SEQ ID NO: 1768541 - DNA, 22 bp, Homo sapiens
tctcattgacttttataaagca

SEQ ID NO: 1768542 - DNA, 19 bp, Homo sapiens
tctcattgttcaattccca

SEQ ID NO: 1768543 - DNA, 20 bp, Homo sapiens
tctcatttggtctgccagaa

SEQ ID NO: 1768544 - DNA, 21 bp, Homo sapiens
tctcatttggtctgccagaat

SEQ ID NO: 1768545 - DNA, 14 bp, Homo sapiens
tctcattttgtcca

SEQ ID NO: 1768546 - DNA, 21 bp, Homo sapiens
tctccaaacaccggcagaaaa

SEQ ID NO: 1768547 - DNA, 17 bp, Homo sapiens
tctccaaaggggctgct

SEQ ID NO: 1768548 - DNA, 12 bp, Homo sapiens
tctccaaatgag

SEQ ID NO: 1768549 - DNA, 24 bp, Homo sapiens
tctccaaatgagatctaagccttt

SEQ ID NO: 1768550 - DNA, 20 bp, Homo sapiens
tctccaaccccccagcactg

SEQ ID NO: 1768551 - DNA, 21 bp, Homo sapiens
tctccaaccccccagcactga

SEQ ID NO: 1768552 - DNA, 21 bp, Homo sapiens
tctccaagaatggaagcctga

SEQ ID NO: 1768553 - DNA, 17 bp, Homo sapiens
tctccaagacaataatt

SEQ ID NO: 1768554 - DNA, 23 bp, Homo sapiens
tctccaagtgccagaggtgggca

SEQ ID NO: 1768555 - DNA, 16 bp, Homo sapiens
tctccacactccactg

SEQ ID NO: 1768556 - DNA, 19 bp, Homo sapiens
tctccacccaccagtcagg

SEQ ID NO: 1768557 - DNA, 11 bp, Homo sapiens
tctccaccccc

SEQ ID NO: 1768558 - DNA, 23 bp, Homo sapiens
tctccaccccccacgtctgtcct

SEQ ID NO: 1768559 - DNA, 11 bp, Homo sapiens
tctccacctca

SEQ ID NO: 1768560 - DNA, 12 bp, Homo sapiens
tctccacctcag

SEQ ID NO: 1768561 - DNA, 13 bp, Homo sapiens
tctccacctcagc

SEQ ID NO: 1768562 - DNA, 21 bp, Homo sapiens
tctccactaaatgagctcctg

SEQ ID NO: 1768563 - DNA, 14 bp, Homo sapiens
tctccactgccttc

SEQ ID NO: 1768564 - DNA, 21 bp, Homo sapiens
tctccactgtgcacacccacc

SEQ ID NO: 1768565 - DNA, 15 bp, Homo sapiens
tctccacttcttaga

SEQ ID NO: 1768566 - DNA, 14 bp, Homo sapiens
tctccagatgtttc

SEQ ID NO: 1768567 - DNA, 15 bp, Homo sapiens
tctccagatgtttcc

SEQ ID NO: 1768568 - DNA, 13 bp, Homo sapiens
tctccagccagca

SEQ ID NO: 1768569 - DNA, 19 bp, Homo sapiens
tctccagcctcagcctccc

SEQ ID NO: 1768570 - DNA, 21 bp, Homo sapiens
tctccagcgtcagctgctccc

SEQ ID NO: 1768571 - DNA, 13 bp, Homo sapiens
tctccagctgcct

SEQ ID NO: 1768572 - DNA, 14 bp, Homo sapiens
tctccagctgcctg

SEQ ID NO: 1768573 - DNA, 15 bp, Homo sapiens
tctccagctgcctgg

SEQ ID NO: 1768574 - DNA, 18 bp, Homo sapiens
tctccagctgcctgggcc

SEQ ID NO: 1768575 - DNA, 17 bp, Homo sapiens
tctccagctgggctctg

SEQ ID NO: 1768576 - DNA, 20 bp, Homo sapiens
tctccagggaggcgatgcca

SEQ ID NO: 1768577 - DNA, 21 bp, Homo sapiens
tctccagggagtcccctcccc

SEQ ID NO: 1768578 - DNA, 12 bp, Homo sapiens
tctccaggggcc

SEQ ID NO: 1768579 - DNA, 17 bp, Homo sapiens
tctccaggggcctgcag

SEQ ID NO: 1768580 - DNA, 17 bp, Homo sapiens
tctccaggggctgcttc

SEQ ID NO: 1768581 - DNA, 23 bp, Homo sapiens
tctccaggggctgcttcctcctg

SEQ ID NO: 1768582 - DNA, 17 bp, Homo sapiens
tctccaggtcagcctgg

SEQ ID NO: 1768583 - DNA, 21 bp, Homo sapiens
tctccatcaccctcttcctgt

SEQ ID NO: 1768584 - DNA, 17 bp, Homo sapiens
tctccatctggcagggt

SEQ ID NO: 1768585 - DNA, 14 bp, Homo sapiens
tctccatctgtttg

SEQ ID NO: 1768586 - DNA, 16 bp, Homo sapiens
tctccatctttataga

SEQ ID NO: 1768587 - DNA, 21 bp, Homo sapiens
tctccatgaggtactggtccc

SEQ ID NO: 1768588 - DNA, 15 bp, Homo sapiens
tctccatgctgcaaa

SEQ ID NO: 1768589 - DNA, 23 bp, Homo sapiens
tctccatttgctcttcagatgcc

SEQ ID NO: 1768590 - DNA, 17 bp, Homo sapiens
tctccattttagcccag

SEQ ID NO: 1768591 - DNA, 16 bp, Homo sapiens
tctccattttcaagct

SEQ ID NO: 1768592 - DNA, 18 bp, Homo sapiens
tctcccaaaaaactactt

SEQ ID NO: 1768593 - DNA, 19 bp, Homo sapiens
tctcccaagaaacctgact

SEQ ID NO: 1768594 - DNA, 14 bp, Homo sapiens
tctcccacatgagg

SEQ ID NO: 1768595 - DNA, 17 bp, Homo sapiens
tctcccacatgaggcca

SEQ ID NO: 1768596 - DNA, 24 bp, Homo sapiens
tctcccacatgaggccatctcagg

SEQ ID NO: 1768597 - DNA, 17 bp, Homo sapiens
tctcccaccccctcccc

SEQ ID NO: 1768598 - DNA, 22 bp, Homo sapiens
tctcccacccggccacagctgc

SEQ ID NO: 1768599 - DNA, 24 bp, Homo sapiens
tctcccacccggccacagctgctg

SEQ ID NO: 1768600 - DNA, 23 bp, Homo sapiens
tctcccaggccaggctccttcct

SEQ ID NO: 1768601 - DNA, 12 bp, Homo sapiens
tctcccaggccc

SEQ ID NO: 1768602 - DNA, 13 bp, Homo sapiens
tctcccaggcccg

SEQ ID NO: 1768603 - DNA, 17 bp, Homo sapiens
tctcccaggtaccagct

SEQ ID NO: 1768604 - DNA, 16 bp, Homo sapiens
tctctgatttgcaaat

SEQ ID NO: 1768605 - DNA, 11 bp, Homo sapiens
tctctgcaccc

SEQ ID NO: 1768606 - DNA, 22 bp, Homo sapiens
tctctgcacccagtgaacacat

SEQ ID NO: 1768607 - DNA, 20 bp, Homo sapiens
tctctgcagacttcccagct

SEQ ID NO: 1768608 - DNA, 20 bp, Homo sapiens
tctctgcagccagcccagcc

SEQ ID NO: 1768609 - DNA, 15 bp, Homo sapiens
tctctgcagctgccg

SEQ ID NO: 1768610 - DNA, 10 bp, Homo sapiens
tctctgcagt

SEQ ID NO: 1768611 - DNA, 19 bp, Homo sapiens
tctctgcagtttttcccaa

SEQ ID NO: 1768612 - DNA, 21 bp, Homo sapiens
tctctgcatctactcccaagt

SEQ ID NO: 1768613 - DNA, 20 bp, Homo sapiens
tctctgccaacatgaggaca

SEQ ID NO: 1768614 - DNA, 18 bp, Homo sapiens
tctctgccatgtggcaga

SEQ ID NO: 1768615 - DNA, 13 bp, Homo sapiens
tctctgcccaacc

SEQ ID NO: 1768616 - DNA, 17 bp, Homo sapiens
tctctgcccacagtctt

SEQ ID NO: 1768617 - DNA, 13 bp, Homo sapiens
tctctgcccagcc

SEQ ID NO: 1768618 - DNA, 16 bp, Homo sapiens
tctctgcccagccggg

SEQ ID NO: 1768619 - DNA, 13 bp, Homo sapiens
tctctgccccagc

SEQ ID NO: 1768620 - DNA, 14 bp, Homo sapiens
tctctgccccagcc

SEQ ID NO: 1768621 - DNA, 15 bp, Homo sapiens
tctctgccccagcct

SEQ ID NO: 1768622 - DNA, 16 bp, Homo sapiens
tctctgccccagcctg

SEQ ID NO: 1768623 - DNA, 12 bp, Homo sapiens
tctctgccctgt

SEQ ID NO: 1768624 - DNA, 20 bp, Homo sapiens
tctctgcccttgatcagccc

SEQ ID NO: 1768625 - DNA, 16 bp, Homo sapiens
tctctgccgcctgcgt

SEQ ID NO: 1768626 - DNA, 22 bp, Homo sapiens
tctctgccgctacctccctccc

SEQ ID NO: 1768627 - DNA, 11 bp, Homo sapiens
tctctgcctga

SEQ ID NO: 1768628 - DNA, 18 bp, Homo sapiens
tctctgcctgtgagccag

SEQ ID NO: 1768629 - DNA, 19 bp, Homo sapiens
tctctgcctgtgagccagt

SEQ ID NO: 1768630 - DNA, 21 bp, Homo sapiens
tctctgcctgtgagccagtct

SEQ ID NO: 1768631 - DNA, 14 bp, Homo sapiens
tctctgcgctgagg

SEQ ID NO: 1768632 - DNA, 13 bp, Homo sapiens
tctctgctatata

SEQ ID NO: 1768633 - DNA, 14 bp, Homo sapiens
tctctgctccacca

SEQ ID NO: 1768634 - DNA, 19 bp, Homo sapiens
tctctgctccaccacatcc

SEQ ID NO: 1768635 - DNA, 23 bp, Homo sapiens
tctctgctggcaggattcttccc

SEQ ID NO: 1768636 - DNA, 15 bp, Homo sapiens
tctctgcttaccctt

SEQ ID NO: 1768637 - DNA, 18 bp, Homo sapiens
tctctggaaaagctgggg

SEQ ID NO: 1768638 - DNA, 23 bp, Homo sapiens
tctctggaagaggaaccaggaga

SEQ ID NO: 1768639 - DNA, 23 bp, Homo sapiens
tctctggaaggccccttccctgg

SEQ ID NO: 1768640 - DNA, 12 bp, Homo sapiens
tctctggagccc

SEQ ID NO: 1768641 - DNA, 13 bp, Homo sapiens
tctctggcccaga

SEQ ID NO: 1768642 - DNA, 17 bp, Homo sapiens
tctctggcccagaaagc

SEQ ID NO: 1768643 - DNA, 18 bp, Homo sapiens
tctctggcccagaaagcc

SEQ ID NO: 1768644 - DNA, 19 bp, Homo sapiens
tctctggcccttcttgcct

SEQ ID NO: 1768645 - DNA, 16 bp, Homo sapiens
tctctggcgacagttt

SEQ ID NO: 1768646 - DNA, 14 bp, Homo sapiens
tctctggctcaggt

SEQ ID NO: 1768647 - DNA, 19 bp, Homo sapiens
tctctggctgtaaggctct

SEQ ID NO: 1768648 - DNA, 14 bp, Homo sapiens
tctctgggactctc

SEQ ID NO: 1768649 - DNA, 16 bp, Homo sapiens
tctctgggactctcct

SEQ ID NO: 1768650 - DNA, 19 bp, Homo sapiens
tctctgggactctcctcct

SEQ ID NO: 1768651 - DNA, 21 bp, Homo sapiens
tctctgggactctcctcctcc

SEQ ID NO: 1768652 - DNA, 13 bp, Homo sapiens
tctctgggagaaa

SEQ ID NO: 1768653 - DNA, 18 bp, Homo sapiens
tctctgggagaaaatcat

SEQ ID NO: 1768654 - DNA, 16 bp, Homo sapiens
tctctgggagcccaga

SEQ ID NO: 1768655 - DNA, 13 bp, Homo sapiens
tctctgggcacag

SEQ ID NO: 1768656 - DNA, 12 bp, Homo sapiens
tctctgggctga

SEQ ID NO: 1768657 - DNA, 21 bp, Homo sapiens
tctctgggcttggggcttcct

SEQ ID NO: 1768658 - DNA, 19 bp, Homo sapiens
tctctgtcacccttgtcct

SEQ ID NO: 1768659 - DNA, 19 bp, Homo sapiens
tctctgtcccttgctgtat

SEQ ID NO: 1768660 - DNA, 23 bp, Homo sapiens
tctctgtgaatcttgaataactt

SEQ ID NO: 1768661 - DNA, 18 bp, Homo sapiens
tctctgtgacctgccccg

SEQ ID NO: 1768662 - DNA, 13 bp, Homo sapiens
tctctgtgagaag

SEQ ID NO: 1768663 - DNA, 14 bp, Homo sapiens
tctctgtgagactc

SEQ ID NO: 1768664 - DNA, 22 bp, Homo sapiens
tctctgtgagactcgagaactt

SEQ ID NO: 1768665 - DNA, 19 bp, Homo sapiens
tctctgtgcttcaattaat

SEQ ID NO: 1768666 - DNA, 17 bp, Homo sapiens
tctctgtgtctaagatt

SEQ ID NO: 1768667 - DNA, 18 bp, Homo sapiens
tctctgtgtgcacaaata

SEQ ID NO: 1768668 - DNA, 10 bp, Homo sapiens
tctctgtgtt

SEQ ID NO: 1768669 - DNA, 18 bp, Homo sapiens
tctctgttaacatctagc

SEQ ID NO: 1768670 - DNA, 16 bp, Homo sapiens
tctctgttacaaaaga

SEQ ID NO: 1768671 - DNA, 23 bp, Homo sapiens
tctctgttactccattactgtga

SEQ ID NO: 1768672 - DNA, 19 bp, Homo sapiens
tctctgttcagatgtgcat

SEQ ID NO: 1768673 - DNA, 18 bp, Homo sapiens
tctcttaaatataacact

SEQ ID NO: 1768674 - DNA, 16 bp, Homo sapiens
tctcttagaaaaggtg

SEQ ID NO: 1768675 - DNA, 16 bp, Homo sapiens
tctcttagctactgta

SEQ ID NO: 1768676 - DNA, 19 bp, Homo sapiens
tctcttagctcccctccaa

SEQ ID NO: 1768677 - DNA, 23 bp, Homo sapiens
tctcttcacccctacactgtgaa

SEQ ID NO: 1768678 - DNA, 24 bp, Homo sapiens
tctcttcaggaggccctggtgtca

SEQ ID NO: 1768679 - DNA, 19 bp, Homo sapiens
tctcttcatttttttttca

SEQ ID NO: 1768680 - DNA, 16 bp, Homo sapiens
tctcttccccttccct

SEQ ID NO: 1768681 - DNA, 18 bp, Homo sapiens
tctcttcccttcccagac

SEQ ID NO: 1768682 - DNA, 15 bp, Homo sapiens
tctcttcccttctcc

SEQ ID NO: 1768683 - DNA, 13 bp, Homo sapiens
tctcttcctcttt

SEQ ID NO: 1768684 - DNA, 17 bp, Homo sapiens
tctcttcggcagggagg

SEQ ID NO: 1768685 - DNA, 16 bp, Homo sapiens
tctcttctctccagct

SEQ ID NO: 1768686 - DNA, 19 bp, Homo sapiens
tctcttctgaataaagcaa

SEQ ID NO: 1768687 - DNA, 20 bp, Homo sapiens
tctcttctgaataaagcaat

SEQ ID NO: 1768688 - DNA, 12 bp, Homo sapiens
tctcttctttaa

SEQ ID NO: 1768689 - DNA, 16 bp, Homo sapiens
tctcttcttttggctt

SEQ ID NO: 1768690 - DNA, 15 bp, Homo sapiens
tctcttgagcatcaa

SEQ ID NO: 1768691 - DNA, 16 bp, Homo sapiens
tctcttgagcatcaat

SEQ ID NO: 1768692 - DNA, 18 bp, Homo sapiens
tctcttgagcatcaatct

SEQ ID NO: 1768693 - DNA, 22 bp, Homo sapiens
tctcttgagggagcttagccaa

SEQ ID NO: 1768694 - DNA, 12 bp, Homo sapiens
tctcttgcaccc

SEQ ID NO: 1768695 - DNA, 13 bp, Homo sapiens
tctcttgcacccg

SEQ ID NO: 1768696 - DNA, 14 bp, Homo sapiens
tctcttggctattg

SEQ ID NO: 1768697 - DNA, 15 bp, Homo sapiens
tctcttggctattga

SEQ ID NO: 1768698 - DNA, 18 bp, Homo sapiens
tctcttggtttccttcct

SEQ ID NO: 1768699 - DNA, 19 bp, Homo sapiens
tctcttgtgacgtgcactg

SEQ ID NO: 1768700 - DNA, 20 bp, Homo sapiens
tctcttgtgacgtgcactgt

SEQ ID NO: 1768701 - DNA, 22 bp, Homo sapiens
tctcttgtgacgtgcactgtga

SEQ ID NO: 1768702 - DNA, 19 bp, Homo sapiens
tctcttgtttgagagagaa

SEQ ID NO: 1768703 - DNA, 21 bp, Homo sapiens
tctctttaaaaggaaagaaaa

SEQ ID NO: 1768704 - DNA, 16 bp, Homo sapiens
tctctttaatcttcag

SEQ ID NO: 1768705 - DNA, 17 bp, Homo sapiens
tctctttaatcttcagt

SEQ ID NO: 1768706 - DNA, 22 bp, Homo sapiens
tctctttcacattgtttgctgc

SEQ ID NO: 1768707 - DNA, 12 bp, Homo sapiens
tctctttccttg

SEQ ID NO: 1768708 - DNA, 13 bp, Homo sapiens
tctctttctctgg

SEQ ID NO: 1768709 - DNA, 22 bp, Homo sapiens
tctctttgtgggtttttcatct

SEQ ID NO: 1768710 - DNA, 12 bp, Homo sapiens
tctcttttccac

SEQ ID NO: 1768711 - DNA, 13 bp, Homo sapiens
tctcttttcctcc

SEQ ID NO: 1768712 - DNA, 18 bp, Homo sapiens
tctcttttcttctcagga

SEQ ID NO: 1768713 - DNA, 23 bp, Homo sapiens
tctcttttgaatccatgcttggg

SEQ ID NO: 1768714 - DNA, 12 bp, Homo sapiens
tctctttttgtt

SEQ ID NO: 1768715 - DNA, 14 bp, Homo sapiens
tctcttttttcaga

SEQ ID NO: 1768716 - DNA, 19 bp, Homo sapiens
tctctttttttggcccagg

SEQ ID NO: 1768717 - DNA, 23 bp, Homo sapiens
tctgaaaaattcctttgtgtttc

SEQ ID NO: 1768718 - DNA, 21 bp, Homo sapiens
tctgaaaactgaatgtcaaga

SEQ ID NO: 1768719 - DNA, 16 bp, Homo sapiens
tctgctgccagcacag

SEQ ID NO: 1768720 - DNA, 19 bp, Homo sapiens
tctgctgccagcacagtag

SEQ ID NO: 1768721 - DNA, 23 bp, Homo sapiens
tctgctgccccgcttccccacag

SEQ ID NO: 1768722 - DNA, 16 bp, Homo sapiens
tctgctgccggctctg

SEQ ID NO: 1768723 - DNA, 17 bp, Homo sapiens
tctgctgcctctgaaaa

SEQ ID NO: 1768724 - DNA, 19 bp, Homo sapiens
tctgctggaaggggcagca

SEQ ID NO: 1768725 - DNA, 22 bp, Homo sapiens
tctgctggataaaatgaggttc

SEQ ID NO: 1768726 - DNA, 16 bp, Homo sapiens
tctgctggcctggatc

SEQ ID NO: 1768727 - DNA, 16 bp, Homo sapiens
tctgctggtatttcta

SEQ ID NO: 1768728 - DNA, 13 bp, Homo sapiens
tctgctggtgaat

SEQ ID NO: 1768729 - DNA, 14 bp, Homo sapiens
tctgctgtcctgca

SEQ ID NO: 1768730 - DNA, 16 bp, Homo sapiens
tctgctgtccttgcct

SEQ ID NO: 1768731 - DNA, 17 bp, Homo sapiens
tctgctgttgccatagc

SEQ ID NO: 1768732 - DNA, 21 bp, Homo sapiens
tctgctgttgccatagcccca

SEQ ID NO: 1768733 - DNA, 17 bp, Homo sapiens
tctgcttacccttcacc

SEQ ID NO: 1768734 - DNA, 18 bp, Homo sapiens
tctgcttcaataaatctt

SEQ ID NO: 1768735 - DNA, 12 bp, Homo sapiens
tctgcttcatcc

SEQ ID NO: 1768736 - DNA, 20 bp, Homo sapiens
tctgcttcatccaatgtgaa

SEQ ID NO: 1768737 - DNA, 15 bp, Homo sapiens
tctgcttctctctct

SEQ ID NO: 1768738 - DNA, 19 bp, Homo sapiens
tctgcttctctctctctca

SEQ ID NO: 1768739 - DNA, 21 bp, Homo sapiens
tctgcttctctctctctcaca

SEQ ID NO: 1768740 - DNA, 16 bp, Homo sapiens
tctgcttgcttggccc

SEQ ID NO: 1768741 - DNA, 18 bp, Homo sapiens
tctgcttgtgacattaaa

SEQ ID NO: 1768742 - DNA, 16 bp, Homo sapiens
tctgctttggatgatt

SEQ ID NO: 1768743 - DNA, 13 bp, Homo sapiens
tctgctttgtggt

SEQ ID NO: 1768744 - DNA, 21 bp, Homo sapiens
tctgcttttctgccctggctg

SEQ ID NO: 1768745 - DNA, 23 bp, Homo sapiens
tctggaaaaaaacaaaaacagaa

SEQ ID NO: 1768746 - DNA, 14 bp, Homo sapiens
tctggaaagcaaag

SEQ ID NO: 1768747 - DNA, 21 bp, Homo sapiens
tctggaacatggactttcttg

SEQ ID NO: 1768748 - DNA, 23 bp, Homo sapiens
tctggaacatggactttcttgca

SEQ ID NO: 1768749 - DNA, 13 bp, Homo sapiens
tctggaacccaga

SEQ ID NO: 1768750 - DNA, 22 bp, Homo sapiens
tctggaacccagactcagacat

SEQ ID NO: 1768751 - DNA, 17 bp, Homo sapiens
tctggaaggctggctga

SEQ ID NO: 1768752 - DNA, 23 bp, Homo sapiens
tctggaagtggagttgactctgg

SEQ ID NO: 1768753 - DNA, 18 bp, Homo sapiens
tctggaatgtaatcaatg

SEQ ID NO: 1768754 - DNA, 22 bp, Homo sapiens
tctggaatgtaatcaatgtttc

SEQ ID NO: 1768755 - DNA, 19 bp, Homo sapiens
tctggaatttaaggcccaa

SEQ ID NO: 1768756 - DNA, 12 bp, Homo sapiens
tctggacaagcc

SEQ ID NO: 1768757 - DNA, 23 bp, Homo sapiens
tctggacaagccaacttgtaaat

SEQ ID NO: 1768758 - DNA, 20 bp, Homo sapiens
tctggacagccccaccctgg

SEQ ID NO: 1768759 - DNA, 14 bp, Homo sapiens
tctggacaggctct

SEQ ID NO: 1768760 - DNA, 20 bp, Homo sapiens
tctggacaggctctgcttct

SEQ ID NO: 1768761 - DNA, 20 bp, Homo sapiens
tctggacatgaattaaagta

SEQ ID NO: 1768762 - DNA, 18 bp, Homo sapiens
tctggacccttataaaat

SEQ ID NO: 1768763 - DNA, 17 bp, Homo sapiens
tctggacggcaggctca

SEQ ID NO: 1768764 - DNA, 19 bp, Homo sapiens
tctggacggcaggctcact

SEQ ID NO: 1768765 - DNA, 22 bp, Homo sapiens
tctggacggcaggctcactgcc

SEQ ID NO: 1768766 - DNA, 16 bp, Homo sapiens
tctggacgtgaaatac

SEQ ID NO: 1768767 - DNA, 15 bp, Homo sapiens
tctggactctgcccc

SEQ ID NO: 1768768 - DNA, 17 bp, Homo sapiens
tctggactctgccccaa

SEQ ID NO: 1768769 - DNA, 12 bp, Homo sapiens
tctggactggcc

SEQ ID NO: 1768770 - DNA, 15 bp, Homo sapiens
tctggagaagcagtg

SEQ ID NO: 1768771 - DNA, 20 bp, Homo sapiens
tctggagaccagggagcctt

SEQ ID NO: 1768772 - DNA, 21 bp, Homo sapiens
tctggagcaacctactgtcta

SEQ ID NO: 1768773 - DNA, 16 bp, Homo sapiens
tctggagcccctcctc

SEQ ID NO: 1768774 - DNA, 17 bp, Homo sapiens
tctggagcccctcctcc

SEQ ID NO: 1768775 - DNA, 13 bp, Homo sapiens
tctggagcccttg

SEQ ID NO: 1768776 - DNA, 18 bp, Homo sapiens
tctggagctgggagacaa

SEQ ID NO: 1768777 - DNA, 19 bp, Homo sapiens
tctggaggaaagggaggag

SEQ ID NO: 1768778 - DNA, 19 bp, Homo sapiens
tctggaggaagttctccag

SEQ ID NO: 1768779 - DNA, 14 bp, Homo sapiens
tctggaggggaggg

SEQ ID NO: 1768780 - DNA, 21 bp, Homo sapiens
tctggagtctcacttgtctca

SEQ ID NO: 1768781 - DNA, 15 bp, Homo sapiens
tctggagtgattcta

SEQ ID NO: 1768782 - DNA, 17 bp, Homo sapiens
tctggagtgattctaga

SEQ ID NO: 1768783 - DNA, 21 bp, Homo sapiens
tctggagttgatctggaaccc

SEQ ID NO: 1768784 - DNA, 17 bp, Homo sapiens
tctggatctcctgctgc

SEQ ID NO: 1768785 - DNA, 13 bp, Homo sapiens
tctggatgaaggc

SEQ ID NO: 1768786 - DNA, 21 bp, Homo sapiens
tctggatggccgggctgctgc

SEQ ID NO: 1768787 - DNA, 22 bp, Homo sapiens
tctggatggccgggctgctgct

SEQ ID NO: 1768788 - DNA, 16 bp, Homo sapiens
tctggattctgaatct

SEQ ID NO: 1768789 - DNA, 13 bp, Homo sapiens
tctggattgtggt

SEQ ID NO: 1768790 - DNA, 18 bp, Homo sapiens
tctggcaaacgtttctca

SEQ ID NO: 1768791 - DNA, 15 bp, Homo sapiens
tctggcaacatcttt

SEQ ID NO: 1768792 - DNA, 16 bp, Homo sapiens
tctggcaacatcttta

SEQ ID NO: 1768793 - DNA, 18 bp, Homo sapiens
tctggcaaggactttgta

SEQ ID NO: 1768794 - DNA, 20 bp, Homo sapiens
tctggcacactccctctcct

SEQ ID NO: 1768795 - DNA, 19 bp, Homo sapiens
tctggcaccatcagcctgt

SEQ ID NO: 1768796 - DNA, 18 bp, Homo sapiens
tctggcagttctggaatg

SEQ ID NO: 1768797 - DNA, 14 bp, Homo sapiens
tctggccaggcatg

SEQ ID NO: 1768798 - DNA, 13 bp, Homo sapiens
tctggcccagaaa

SEQ ID NO: 1768799 - DNA, 20 bp, Homo sapiens
tctggcccagggtgtttgca

SEQ ID NO: 1768800 - DNA, 13 bp, Homo sapiens
tctggccccgcta

SEQ ID NO: 1768801 - DNA, 22 bp, Homo sapiens
tctggccctgacttctggagat

SEQ ID NO: 1768802 - DNA, 14 bp, Homo sapiens
tctggccctggccc

SEQ ID NO: 1768803 - DNA, 19 bp, Homo sapiens
tctggccggtgctgggttc

SEQ ID NO: 1768804 - DNA, 22 bp, Homo sapiens
tctggccggtgctgggttccca

SEQ ID NO: 1768805 - DNA, 15 bp, Homo sapiens
tctggcctcccaccc

SEQ ID NO: 1768806 - DNA, 16 bp, Homo sapiens
tctggcctcccacccg

SEQ ID NO: 1768807 - DNA, 15 bp, Homo sapiens
tctggcctctgcttt

SEQ ID NO: 1768808 - DNA, 19 bp, Homo sapiens
tctggcctgggttttgtgg

SEQ ID NO: 1768809 - DNA, 19 bp, Homo sapiens
tctggcggaggtctctggg

SEQ ID NO: 1768810 - DNA, 21 bp, Homo sapiens
tctggcggaggtctctgggag

SEQ ID NO: 1768811 - DNA, 14 bp, Homo sapiens
tctggctagagccg

SEQ ID NO: 1768812 - DNA, 22 bp, Homo sapiens
tctggctagagccgaggggaga

SEQ ID NO: 1768813 - DNA, 18 bp, Homo sapiens
tctggctcactgcagcct

SEQ ID NO: 1768814 - DNA, 15 bp, Homo sapiens
tctggctccctgccc

SEQ ID NO: 1768815 - DNA, 16 bp, Homo sapiens
tctggctccctgcccc

SEQ ID NO: 1768816 - DNA, 17 bp, Homo sapiens
tctggctccctgcccct

SEQ ID NO: 1768817 - DNA, 18 bp, Homo sapiens
tctggctccctgcccctt

SEQ ID NO: 1768818 - DNA, 19 bp, Homo sapiens
tctggctgaaccctgtgct

SEQ ID NO: 1768819 - DNA, 21 bp, Homo sapiens
tctggctgaaccctgtgctgg

SEQ ID NO: 1768820 - DNA, 18 bp, Homo sapiens
tctggctgagcccctggg

SEQ ID NO: 1768821 - DNA, 21 bp, Homo sapiens
tctggctgccccaacctgctg

SEQ ID NO: 1768822 - DNA, 22 bp, Homo sapiens
tctggctgccccaacctgctga

SEQ ID NO: 1768823 - DNA, 18 bp, Homo sapiens
tctggctgtctagaatgt

SEQ ID NO: 1768824 - DNA, 13 bp, Homo sapiens
tctggcttagtgc

SEQ ID NO: 1768825 - DNA, 15 bp, Homo sapiens
tctggcttagtgcca

SEQ ID NO: 1768826 - DNA, 20 bp, Homo sapiens
tctggcttcagcccccacca

SEQ ID NO: 1768827 - DNA, 23 bp, Homo sapiens
tctggcttccagaaaaccccagc

SEQ ID NO: 1768828 - DNA, 14 bp, Homo sapiens
tctggcttccctgg

SEQ ID NO: 1768829 - DNA, 17 bp, Homo sapiens
tctggcttccctggaag

SEQ ID NO: 1768830 - DNA, 13 bp, Homo sapiens
tctggctttgctc

SEQ ID NO: 1768831 - DNA, 16 bp, Homo sapiens
tctggctttgctctat

SEQ ID NO: 1768832 - DNA, 19 bp, Homo sapiens
tctggctttgctctattaa

SEQ ID NO: 1768833 - DNA, 15 bp, Homo sapiens
tctgttgcccaggct

SEQ ID NO: 1768834 - DNA, 16 bp, Homo sapiens
tctgttgcccaggctg

SEQ ID NO: 1768835 - DNA, 21 bp, Homo sapiens
tctgttgcccaggctggagtg

SEQ ID NO: 1768836 - DNA, 20 bp, Homo sapiens
tctgttggcaggctggccag

SEQ ID NO: 1768837 - DNA, 15 bp, Homo sapiens
tctgttgtcctcccc

SEQ ID NO: 1768838 - DNA, 14 bp, Homo sapiens
tctgttgttccatt

SEQ ID NO: 1768839 - DNA, 18 bp, Homo sapiens
tctgtttataaaaacaaa

SEQ ID NO: 1768840 - DNA, 15 bp, Homo sapiens
tctgtttcaaactga

SEQ ID NO: 1768841 - DNA, 13 bp, Homo sapiens
tctgtttctctgc

SEQ ID NO: 1768842 - DNA, 15 bp, Homo sapiens
tctgtttctctgctg

SEQ ID NO: 1768843 - DNA, 16 bp, Homo sapiens
tctgtttctctgctgt

SEQ ID NO: 1768844 - DNA, 18 bp, Homo sapiens
tctgtttctctgctgtca

SEQ ID NO: 1768845 - DNA, 20 bp, Homo sapiens
tctgtttcttaagggcacac

SEQ ID NO: 1768846 - DNA, 21 bp, Homo sapiens
tctgtttgctcaaaattgctt

SEQ ID NO: 1768847 - DNA, 19 bp, Homo sapiens
tctgtttggactgcagaag

SEQ ID NO: 1768848 - DNA, 13 bp, Homo sapiens
tctgtttggcact

SEQ ID NO: 1768849 - DNA, 14 bp, Homo sapiens
tctgtttggcactt

SEQ ID NO: 1768850 - DNA, 21 bp, Homo sapiens
tctgtttggcacttgtattta

SEQ ID NO: 1768851 - DNA, 14 bp, Homo sapiens
tctgtttgttaaaa

SEQ ID NO: 1768852 - DNA, 13 bp, Homo sapiens
tctgtttgttatt

SEQ ID NO: 1768853 - DNA, 13 bp, Homo sapiens
tctgtttgtttca

SEQ ID NO: 1768854 - DNA, 14 bp, Homo sapiens
tctgttttccccca

SEQ ID NO: 1768855 - DNA, 13 bp, Homo sapiens
tctgttttctgga

SEQ ID NO: 1768856 - DNA, 14 bp, Homo sapiens
tctgttttgtgtct

SEQ ID NO: 1768857 - DNA, 23 bp, Homo sapiens
tctgttttgtttggcaaggaaag

SEQ ID NO: 1768858 - DNA, 20 bp, Homo sapiens
tctgttttgttttgttttaa

SEQ ID NO: 1768859 - DNA, 22 bp, Homo sapiens
tctgttttgttttgttttaatc

SEQ ID NO: 1768860 - DNA, 12 bp, Homo sapiens
tctgtttttgta

SEQ ID NO: 1768861 - DNA, 13 bp, Homo sapiens
tctgtttttgtat

SEQ ID NO: 1768862 - DNA, 16 bp, Homo sapiens
tctgtttttgtatctt

SEQ ID NO: 1768863 - DNA, 19 bp, Homo sapiens
tcttaaaaaaataaaatat

SEQ ID NO: 1768864 - DNA, 20 bp, Homo sapiens
tcttaaaacttgtggttgaa

SEQ ID NO: 1768865 - DNA, 17 bp, Homo sapiens
tcttaaaagtactttaa

SEQ ID NO: 1768866 - DNA, 18 bp, Homo sapiens
tcttaaaagtactttaaa

SEQ ID NO: 1768867 - DNA, 23 bp, Homo sapiens
tcttaaaagtactttaaaaagga

SEQ ID NO: 1768868 - DNA, 20 bp, Homo sapiens
tcttaaaatcaaatgtaaat

SEQ ID NO: 1768869 - DNA, 14 bp, Homo sapiens
tcttaaacaatgta

SEQ ID NO: 1768870 - DNA, 23 bp, Homo sapiens
tcttaaaccatttttgctgaatt

SEQ ID NO: 1768871 - DNA, 16 bp, Homo sapiens
tcttaaaccttcagtt

SEQ ID NO: 1768872 - DNA, 16 bp, Homo sapiens
tcttaaactaatacgt

SEQ ID NO: 1768873 - DNA, 23 bp, Homo sapiens
tcttaaagaaacagctttcaagt

SEQ ID NO: 1768874 - DNA, 22 bp, Homo sapiens
tcttaaataatgcttcagatat

SEQ ID NO: 1768875 - DNA, 16 bp, Homo sapiens
tcttaaatctaaacaa

SEQ ID NO: 1768876 - DNA, 19 bp, Homo sapiens
tcttaaatgctcattttct

SEQ ID NO: 1768877 - DNA, 23 bp, Homo sapiens
tcttaaatgctcattttctggtt

SEQ ID NO: 1768878 - DNA, 19 bp, Homo sapiens
tcttaaattatatatttat

SEQ ID NO: 1768879 - DNA, 13 bp, Homo sapiens
tcttaacaaacca

SEQ ID NO: 1768880 - DNA, 21 bp, Homo sapiens
tcttaacaaaccaacatcttt

SEQ ID NO: 1768881 - DNA, 20 bp, Homo sapiens
tcttaacactggttaaatta

SEQ ID NO: 1768882 - DNA, 20 bp, Homo sapiens
tcttaacctttgctatgtaa

SEQ ID NO: 1768883 - DNA, 23 bp, Homo sapiens
tcttaagaaaacaaactcttttt

SEQ ID NO: 1768884 - DNA, 20 bp, Homo sapiens
tcttaagatggaaatacagt

SEQ ID NO: 1768885 - DNA, 14 bp, Homo sapiens
tcttaagcagcatg

SEQ ID NO: 1768886 - DNA, 18 bp, Homo sapiens
tcttaagcagcatggaaa

SEQ ID NO: 1768887 - DNA, 18 bp, Homo sapiens
tcttaagtcagattttta

SEQ ID NO: 1768888 - DNA, 12 bp, Homo sapiens
tcttaagtgttt

SEQ ID NO: 1768889 - DNA, 16 bp, Homo sapiens
tcttaagtgtttctca

SEQ ID NO: 1768890 - DNA, 14 bp, Homo sapiens
tcttaataaaataa

SEQ ID NO: 1768891 - DNA, 15 bp, Homo sapiens
tcttaatactgttat

SEQ ID NO: 1768892 - DNA, 18 bp, Homo sapiens
tcttaatactgttattct

SEQ ID NO: 1768893 - DNA, 19 bp, Homo sapiens
tcttaatactgttattctt

SEQ ID NO: 1768894 - DNA, 22 bp, Homo sapiens
tcttaatactgttattctttgc

SEQ ID NO: 1768895 - DNA, 17 bp, Homo sapiens
tcttaatatatacattt

SEQ ID NO: 1768896 - DNA, 19 bp, Homo sapiens
tcttaatatatacattttt

SEQ ID NO: 1768897 - DNA, 20 bp, Homo sapiens
tcttaatcattttttatata

SEQ ID NO: 1768898 - DNA, 18 bp, Homo sapiens
tcttaattaaaagaatat

SEQ ID NO: 1768899 - DNA, 14 bp, Homo sapiens
tcttaattctctgc

SEQ ID NO: 1768900 - DNA, 20 bp, Homo sapiens
tcttaattctttgttctgtt

SEQ ID NO: 1768901 - DNA, 16 bp, Homo sapiens
tcttacaaatgtgaaa

SEQ ID NO: 1768902 - DNA, 17 bp, Homo sapiens
tcttacaaccaagaaca

SEQ ID NO: 1768903 - DNA, 21 bp, Homo sapiens
tcttacaatattgattgggaa

SEQ ID NO: 1768904 - DNA, 21 bp, Homo sapiens
tcttacagcacatcacctctt

SEQ ID NO: 1768905 - DNA, 19 bp, Homo sapiens
tcttaccaattgtgaatgt

SEQ ID NO: 1768906 - DNA, 17 bp, Homo sapiens
tcttacccagattgtgt

SEQ ID NO: 1768907 - DNA, 18 bp, Homo sapiens
tcttacccagattgtgta

SEQ ID NO: 1768908 - DNA, 21 bp, Homo sapiens
tcttacctgtatgtctccagt

SEQ ID NO: 1768909 - DNA, 14 bp, Homo sapiens
tcttactaaacatt

SEQ ID NO: 1768910 - DNA, 24 bp, Homo sapiens
tcttactaaacattttgttattgg

SEQ ID NO: 1768911 - DNA, 17 bp, Homo sapiens
tcttactattaagcagt

SEQ ID NO: 1768912 - DNA, 23 bp, Homo sapiens
tcttactattaagcagtaaaaac

SEQ ID NO: 1768913 - DNA, 13 bp, Homo sapiens
tcttactctttcc

SEQ ID NO: 1768914 - DNA, 14 bp, Homo sapiens
tcttactctttcct

SEQ ID NO: 1768915 - DNA, 23 bp, Homo sapiens
tcttactgaaggtaaaattgaaa

SEQ ID NO: 1768916 - DNA, 15 bp, Homo sapiens
tcttactttgcttga

SEQ ID NO: 1768917 - DNA, 22 bp, Homo sapiens
tcttagaaaaggtgataaaatc

SEQ ID NO: 1768918 - DNA, 14 bp, Homo sapiens
tcttagaaatactt

SEQ ID NO: 1768919 - DNA, 20 bp, Homo sapiens
tcttagactacatttagaga

SEQ ID NO: 1768920 - DNA, 13 bp, Homo sapiens
tcttagagtcctt

SEQ ID NO: 1768921 - DNA, 23 bp, Homo sapiens
tcttagagtccttaagacggaag

SEQ ID NO: 1768922 - DNA, 22 bp, Homo sapiens
tcttagatacactaaaaatctg

SEQ ID NO: 1768923 - DNA, 22 bp, Homo sapiens
tcttagatggattctccactca

SEQ ID NO: 1768924 - DNA, 14 bp, Homo sapiens
tcttagattcttaa

SEQ ID NO: 1768925 - DNA, 17 bp, Homo sapiens
tcttagcaataaatgct

SEQ ID NO: 1768926 - DNA, 14 bp, Homo sapiens
tcttagcctctgga

SEQ ID NO: 1768927 - DNA, 15 bp, Homo sapiens
tcttagctactgtat

SEQ ID NO: 1768928 - DNA, 20 bp, Homo sapiens
tcttagctactgtatgcaaa

SEQ ID NO: 1768929 - DNA, 16 bp, Homo sapiens
tcttagctcccctcca

SEQ ID NO: 1768930 - DNA, 17 bp, Homo sapiens
tcttagctcccctccaa

SEQ ID NO: 1768931 - DNA, 20 bp, Homo sapiens
tcttagctctggacgtgaaa

SEQ ID NO: 1768932 - DNA, 15 bp, Homo sapiens
tcttagctttgaaac

SEQ ID NO: 1768933 - DNA, 15 bp, Homo sapiens
tcttagcttttaata

SEQ ID NO: 1768934 - DNA, 19 bp, Homo sapiens
tcttagcttttaatagtgt

SEQ ID NO: 1768935 - DNA, 19 bp, Homo sapiens
tcttaggggagagctttct

SEQ ID NO: 1768936 - DNA, 19 bp, Homo sapiens
tcttaggtttactgtgaag

SEQ ID NO: 1768937 - DNA, 14 bp, Homo sapiens
tcttagtgcctgag

SEQ ID NO: 1768938 - DNA, 21 bp, Homo sapiens
tcttagtgcttcagagtttgt

SEQ ID NO: 1768939 - DNA, 16 bp, Homo sapiens
tcttagtttggattct

SEQ ID NO: 1768940 - DNA, 21 bp, Homo sapiens
tcttataattgttctcagaat

SEQ ID NO: 1768941 - DNA, 19 bp, Homo sapiens
tcttatacgcttttctttg

SEQ ID NO: 1768942 - DNA, 20 bp, Homo sapiens
tcttatacgcttttctttgt

SEQ ID NO: 1768943 - DNA, 19 bp, Homo sapiens
tcttatagaatatttatta

SEQ ID NO: 1768944 - DNA, 16 bp, Homo sapiens
tcttatagttctaggc

SEQ ID NO: 1768945 - DNA, 20 bp, Homo sapiens
tcttatatatatttctttgt

SEQ ID NO: 1768946 - DNA, 15 bp, Homo sapiens
tcttatatatgtgaa

SEQ ID NO: 1768947 - DNA, 21 bp, Homo sapiens
tcttgtttttaagtttgcact

SEQ ID NO: 1768948 - DNA, 23 bp, Homo sapiens
tcttgtttttaagtttgcactca

SEQ ID NO: 1768949 - DNA, 20 bp, Homo sapiens
tcttgtttttattaatttat

SEQ ID NO: 1768950 - DNA, 22 bp, Homo sapiens
tcttgtttttccactactgcta

SEQ ID NO: 1768951 - DNA, 21 bp, Homo sapiens
tcttgttttttttttccactt

SEQ ID NO: 1768952 - DNA, 19 bp, Homo sapiens
tctttaaaaagcagtcctc

SEQ ID NO: 1768953 - DNA, 23 bp, Homo sapiens
tctttaaaagagagagagagaaa

SEQ ID NO: 1768954 - DNA, 12 bp, Homo sapiens
tctttaaaccac

SEQ ID NO: 1768955 - DNA, 18 bp, Homo sapiens
tctttaaagtcaggtcca

SEQ ID NO: 1768956 - DNA, 14 bp, Homo sapiens
tctttaaagttctt

SEQ ID NO: 1768957 - DNA, 12 bp, Homo sapiens
tctttaacatag

SEQ ID NO: 1768958 - DNA, 22 bp, Homo sapiens
tctttaacatagtcctgttact

SEQ ID NO: 1768959 - DNA, 11 bp, Homo sapiens
tctttaactgc

SEQ ID NO: 1768960 - DNA, 21 bp, Homo sapiens
tctttaagttttgattaatgt

SEQ ID NO: 1768961 - DNA, 14 bp, Homo sapiens
tctttaattaaaac

SEQ ID NO: 1768962 - DNA, 18 bp, Homo sapiens
tctttaccaaaaaccatg

SEQ ID NO: 1768963 - DNA, 19 bp, Homo sapiens
tctttaccaaaaaccatgt

SEQ ID NO: 1768964 - DNA, 23 bp, Homo sapiens
tctttaccttctaaaagccatta

SEQ ID NO: 1768965 - DNA, 11 bp, Homo sapiens
tctttagaaca

SEQ ID NO: 1768966 - DNA, 12 bp, Homo sapiens
tctttagaattt

SEQ ID NO: 1768967 - DNA, 15 bp, Homo sapiens
tctttagaccctcgg

SEQ ID NO: 1768968 - DNA, 14 bp, Homo sapiens
tctttagatatttg

SEQ ID NO: 1768969 - DNA, 16 bp, Homo sapiens
tctttagatatttgcc

SEQ ID NO: 1768970 - DNA, 18 bp, Homo sapiens
tctttagatgccaaacca

SEQ ID NO: 1768971 - DNA, 20 bp, Homo sapiens
tctttagcatttttatgcag

SEQ ID NO: 1768972 - DNA, 21 bp, Homo sapiens
tctttataacccatattttcc

SEQ ID NO: 1768973 - DNA, 20 bp, Homo sapiens
tctttataattctactttga

SEQ ID NO: 1768974 - DNA, 21 bp, Homo sapiens
tctttatagaaggaatttgta

SEQ ID NO: 1768975 - DNA, 23 bp, Homo sapiens
tctttatagaaggaatttgtact

SEQ ID NO: 1768976 - DNA, 11 bp, Homo sapiens
tctttatatga

SEQ ID NO: 1768977 - DNA, 13 bp, Homo sapiens
tctttatgctgta

SEQ ID NO: 1768978 - DNA, 15 bp, Homo sapiens
tctttattcttatta

SEQ ID NO: 1768979 - DNA, 14 bp, Homo sapiens
tctttattgaaatt

SEQ ID NO: 1768980 - DNA, 18 bp, Homo sapiens
tctttatttctagcagag

SEQ ID NO: 1768981 - DNA, 23 bp, Homo sapiens
tctttcaaaggaacattgtgtct

SEQ ID NO: 1768982 - DNA, 20 bp, Homo sapiens
tctttcaaaggtagccatca

SEQ ID NO: 1768983 - DNA, 20 bp, Homo sapiens
tctttcaagcagtcgtgcct

SEQ ID NO: 1768984 - DNA, 20 bp, Homo sapiens
tctttcacacttccaccagc

SEQ ID NO: 1768985 - DNA, 21 bp, Homo sapiens
tctttcacacttccaccagcc

SEQ ID NO: 1768986 - DNA, 23 bp, Homo sapiens
tctttcacacttccaccagcctg

SEQ ID NO: 1768987 - DNA, 18 bp, Homo sapiens
tctttcacagctcctccc

SEQ ID NO: 1768988 - DNA, 19 bp, Homo sapiens
tctttcacagctcctccca

SEQ ID NO: 1768989 - DNA, 10 bp, Homo sapiens
tctttcacat

SEQ ID NO: 1768990 - DNA, 20 bp, Homo sapiens
tctttcaccaagatgggtgg

SEQ ID NO: 1768991 - DNA, 13 bp, Homo sapiens
tctttcacttgaa

SEQ ID NO: 1768992 - DNA, 16 bp, Homo sapiens
tctttcacttgaaaga

SEQ ID NO: 1768993 - DNA, 18 bp, Homo sapiens
tctttcagaaatataaca

SEQ ID NO: 1768994 - DNA, 23 bp, Homo sapiens
tctttcagaaatataacacattt

SEQ ID NO: 1768995 - DNA, 16 bp, Homo sapiens
tctttcagctgtgtct

SEQ ID NO: 1768996 - DNA, 15 bp, Homo sapiens
tctttccaaaacatt

SEQ ID NO: 1768997 - DNA, 22 bp, Homo sapiens
tctttccaaagcgctgaggctg

SEQ ID NO: 1768998 - DNA, 16 bp, Homo sapiens
tctttccataataaaa

SEQ ID NO: 1768999 - DNA, 15 bp, Homo sapiens
tctttccatatccat

SEQ ID NO: 1769000 - DNA, 16 bp, Homo sapiens
tctttccatatccata

SEQ ID NO: 1769001 - DNA, 20 bp, Homo sapiens
tctttccatcaactcccaac

SEQ ID NO: 1769002 - DNA, 14 bp, Homo sapiens
tctttcccaggacg

SEQ ID NO: 1769003 - DNA, 17 bp, Homo sapiens
tctttcccatgtatttg

SEQ ID NO: 1769004 - DNA, 13 bp, Homo sapiens
tctttccccagag

SEQ ID NO: 1769005 - DNA, 24 bp, Homo sapiens
tctttccccagcagtttctgtcct

SEQ ID NO: 1769006 - DNA, 12 bp, Homo sapiens
tctttccctgga

SEQ ID NO: 1769007 - DNA, 16 bp, Homo sapiens
tctttcctatttcagt

SEQ ID NO: 1769008 - DNA, 24 bp, Homo sapiens
tctttcctatttcagtgttacctg

SEQ ID NO: 1769009 - DNA, 14 bp, Homo sapiens
tctttcctcaagta

SEQ ID NO: 1769010 - DNA, 21 bp, Homo sapiens
tctttcctcaagtatcttcta

SEQ ID NO: 1769011 - DNA, 23 bp, Homo sapiens
tctttcctctttctgctctgcca

SEQ ID NO: 1769012 - DNA, 16 bp, Homo sapiens
tctttccttcccaata

SEQ ID NO: 1769013 - DNA, 11 bp, Homo sapiens
tctttctagag

SEQ ID NO: 1769014 - DNA, 13 bp, Homo sapiens
tctttctagagca

SEQ ID NO: 1769015 - DNA, 22 bp, Homo sapiens
tctttctattgttaaacaaatg

SEQ ID NO: 1769016 - DNA, 14 bp, Homo sapiens
tctttctctaaata

SEQ ID NO: 1769017 - DNA, 20 bp, Homo sapiens
tctttctctaatgttgtatc

SEQ ID NO: 1769018 - DNA, 11 bp, Homo sapiens
tctttctctgc

SEQ ID NO: 1769019 - DNA, 15 bp, Homo sapiens
tctttctcttccctg

SEQ ID NO: 1769020 - DNA, 19 bp, Homo sapiens
tctttctgagcacacttta

SEQ ID NO: 1769021 - DNA, 22 bp, Homo sapiens
tctttctgcagaaacagaaagg

SEQ ID NO: 1769022 - DNA, 14 bp, Homo sapiens
tctttctgctctgc

SEQ ID NO: 1769023 - DNA, 13 bp, Homo sapiens
tctttctgctttg

SEQ ID NO: 1769024 - DNA, 23 bp, Homo sapiens
tctttctggcctgccttcgttaa

SEQ ID NO: 1769025 - DNA, 13 bp, Homo sapiens
tctttctgtctcc

SEQ ID NO: 1769026 - DNA, 16 bp, Homo sapiens
tctttctgtctccctt

SEQ ID NO: 1769027 - DNA, 20 bp, Homo sapiens
tctttctgtgcttggatttg

SEQ ID NO: 1769028 - DNA, 15 bp, Homo sapiens
tctttcttcctcttc

SEQ ID NO: 1769029 - DNA, 16 bp, Homo sapiens
tctttcttcctcttct

SEQ ID NO: 1769030 - DNA, 21 bp, Homo sapiens
tctttcttgctggctctgaga

SEQ ID NO: 1769031 - DNA, 22 bp, Homo sapiens
tctttcttgctggctctgagaa

SEQ ID NO: 1769032 - DNA, 12 bp, Homo sapiens
tctttcttggga

SEQ ID NO: 1769033 - DNA, 21 bp, Homo sapiens
tctttcttgtttgtcagcatc

SEQ ID NO: 1769034 - DNA, 18 bp, Homo sapiens
tctttctttccaaaacat

SEQ ID NO: 1769035 - DNA, 13 bp, Homo sapiens
tctttctttctct

SEQ ID NO: 1769036 - DNA, 15 bp, Homo sapiens
tctttctttctctaa

SEQ ID NO: 1769037 - DNA, 16 bp, Homo sapiens
tctttgataacaaaaa

SEQ ID NO: 1769038 - DNA, 15 bp, Homo sapiens
tctttgatccttctc

SEQ ID NO: 1769039 - DNA, 16 bp, Homo sapiens
tctttgatccttctga

SEQ ID NO: 1769040 - DNA, 12 bp, Homo sapiens
tctttgatggac

SEQ ID NO: 1769041 - DNA, 13 bp, Homo sapiens
tctttgcacatgt

SEQ ID NO: 1769042 - DNA, 16 bp, Homo sapiens
tctttgcaccaaagac

SEQ ID NO: 1769043 - DNA, 20 bp, Homo sapiens
tctttgcactttttcttaat

SEQ ID NO: 1769044 - DNA, 20 bp, Homo sapiens
tctttgcctctgcagtctca

SEQ ID NO: 1769045 - DNA, 20 bp, Homo sapiens
tctttgctcaacagaacata

SEQ ID NO: 1769046 - DNA, 23 bp, Homo sapiens
tctttgctcagtgtccagcttcc

SEQ ID NO: 1769047 - DNA, 13 bp, Homo sapiens
tctttgctccaga

SEQ ID NO: 1769048 - DNA, 12 bp, Homo sapiens
tctttggaaata

SEQ ID NO: 1769049 - DNA, 15 bp, Homo sapiens
tctttggaagcagcc

SEQ ID NO: 1769050 - DNA, 14 bp, Homo sapiens
tctttggagttaaa

SEQ ID NO: 1769051 - DNA, 11 bp, Homo sapiens
tctttggctgc

SEQ ID NO: 1769052 - DNA, 17 bp, Homo sapiens
tctttgggcctctcctg

SEQ ID NO: 1769053 - DNA, 22 bp, Homo sapiens
tctttgggcctctcctgccctc

SEQ ID NO: 1769054 - DNA, 16 bp, Homo sapiens
tctttggggtgcccct

SEQ ID NO: 1769055 - DNA, 21 bp, Homo sapiens
tctttgggtgggggggagaag

SEQ ID NO: 1769056 - DNA, 15 bp, Homo sapiens
tctttggttctaagg

SEQ ID NO: 1769057 - DNA, 16 bp, Homo sapiens
tctttggttctaagga

SEQ ID NO: 1769058 - DNA, 19 bp, Homo sapiens
tctttggtttaatttaaag

SEQ ID NO: 1769059 - DNA, 17 bp, Homo sapiens
tctttgtaagagcaaaa

SEQ ID NO: 1769060 - DNA, 21 bp, Homo sapiens
tctttgtaccaaaattttaaa

SEQ ID NO: 1769061 - DNA, 23 bp, Homo sapiens
tctttgtaccaaaattttaaaaa

SEQ ID NO: 1769062 - DNA, 15 bp, Homo sapiens
tgaaaagtttttgtt

SEQ ID NO: 1769063 - DNA, 18 bp, Homo sapiens
tgaaaataactgaatttg

SEQ ID NO: 1769064 - DNA, 16 bp, Homo sapiens
tgaaaataattttcca

SEQ ID NO: 1769065 - DNA, 12 bp, Homo sapiens
tgaaaatacaac

SEQ ID NO: 1769066 - DNA, 23 bp, Homo sapiens
tgaaaatacaacttaaataataa

SEQ ID NO: 1769067 - DNA, 18 bp, Homo sapiens
tgaaaataccatcaggcc

SEQ ID NO: 1769068 - DNA, 13 bp, Homo sapiens
tgaaaataccatt

SEQ ID NO: 1769069 - DNA, 16 bp, Homo sapiens
tgaaaatagtgtaaga

SEQ ID NO: 1769070 - DNA, 23 bp, Homo sapiens
tgaaaatatagacattctcacat

SEQ ID NO: 1769071 - DNA, 16 bp, Homo sapiens
tgaaaatatttgtcca

SEQ ID NO: 1769072 - DNA, 21 bp, Homo sapiens
tgaaaatattttttatatata

SEQ ID NO: 1769073 - DNA, 22 bp, Homo sapiens
tgaaaatatttttttctagcta

SEQ ID NO: 1769074 - DNA, 17 bp, Homo sapiens
tgaaaatcaaagtaaaa

SEQ ID NO: 1769075 - DNA, 12 bp, Homo sapiens
tgaaaatcaaat

SEQ ID NO: 1769076 - DNA, 19 bp, Homo sapiens
tgaaaatgaatatctatta

SEQ ID NO: 1769077 - DNA, 13 bp, Homo sapiens
tgaaaatgcaaag

SEQ ID NO: 1769078 - DNA, 18 bp, Homo sapiens
tgaaaatgcaaagctgaa

SEQ ID NO: 1769079 - DNA, 19 bp, Homo sapiens
tgaaaatgcaaagctgaag

SEQ ID NO: 1769080 - DNA, 22 bp, Homo sapiens
tgaaaatggtttcaagttattc

SEQ ID NO: 1769081 - DNA, 17 bp, Homo sapiens
tgaaaatgtatgtgtaa

SEQ ID NO: 1769082 - DNA, 14 bp, Homo sapiens
tgaaaatgtcagaa

SEQ ID NO: 1769083 - DNA, 15 bp, Homo sapiens
tgaaaatgtcagaaa

SEQ ID NO: 1769084 - DNA, 19 bp, Homo sapiens
tgaaaatgtgctatactgc

SEQ ID NO: 1769085 - DNA, 21 bp, Homo sapiens
tgaaaattacagtccaaaata

SEQ ID NO: 1769086 - DNA, 20 bp, Homo sapiens
tgaaaattagagatcatgaa

SEQ ID NO: 1769087 - DNA, 16 bp, Homo sapiens
tgaaaattatgcaaaa

SEQ ID NO: 1769088 - DNA, 16 bp, Homo sapiens
tgaaaattgaaaagta

SEQ ID NO: 1769089 - DNA, 17 bp, Homo sapiens
tgaaaattgaaaagtac

SEQ ID NO: 1769090 - DNA, 17 bp, Homo sapiens
tgaaaattggacagatt

SEQ ID NO: 1769091 - DNA, 20 bp, Homo sapiens
tgaaacaaaccgaaaatgga

SEQ ID NO: 1769092 - DNA, 14 bp, Homo sapiens
tgaaacaaagctgc

SEQ ID NO: 1769093 - DNA, 18 bp, Homo sapiens
tgaaacaaataatcacat

SEQ ID NO: 1769094 - DNA, 19 bp, Homo sapiens
tgaaacaaataatcacatt

SEQ ID NO: 1769095 - DNA, 22 bp, Homo sapiens
tgaaacaacaaataggaattgt

SEQ ID NO: 1769096 - DNA, 22 bp, Homo sapiens
tgaaacaatgcctacagctgtc

SEQ ID NO: 1769097 - DNA, 11 bp, Homo sapiens
tgaaacaatgt

SEQ ID NO: 1769098 - DNA, 22 bp, Homo sapiens
tgaaacaatgttgtccaacaat

SEQ ID NO: 1769099 - DNA, 14 bp, Homo sapiens
tgaaacacagctgt

SEQ ID NO: 1769100 - DNA, 21 bp, Homo sapiens
tgaaacacagctgttcttctg

SEQ ID NO: 1769101 - DNA, 14 bp, Homo sapiens
tgaaacagaaacaa

SEQ ID NO: 1769102 - DNA, 14 bp, Homo sapiens
tgaaacagaaagtt

SEQ ID NO: 1769103 - DNA, 19 bp, Homo sapiens
tgaaacagaaagttggaaa

SEQ ID NO: 1769104 - DNA, 13 bp, Homo sapiens
tgaaacagagaac

SEQ ID NO: 1769105 - DNA, 16 bp, Homo sapiens
tgaaacagttgctgtg

SEQ ID NO: 1769106 - DNA, 22 bp, Homo sapiens
tgaaacagttgctgtgaacttt

SEQ ID NO: 1769107 - DNA, 23 bp, Homo sapiens
tgaaacatgcacattttgtacat

SEQ ID NO: 1769108 - DNA, 14 bp, Homo sapiens
tgaaacattttgtc

SEQ ID NO: 1769109 - DNA, 18 bp, Homo sapiens
tgaaacattttttcttct

SEQ ID NO: 1769110 - DNA, 18 bp, Homo sapiens
tgaaaccccgtctctact

SEQ ID NO: 1769111 - DNA, 18 bp, Homo sapiens
tgaaaccttattttttcc

SEQ ID NO: 1769112 - DNA, 21 bp, Homo sapiens
tgaaactcgcgagtgtaactt

SEQ ID NO: 1769113 - DNA, 16 bp, Homo sapiens
tgaaactgaaggtcaa

SEQ ID NO: 1769114 - DNA, 13 bp, Homo sapiens
tgaaactgcctat

SEQ ID NO: 1769115 - DNA, 14 bp, Homo sapiens
tgaaactgcctatt

SEQ ID NO: 1769116 - DNA, 16 bp, Homo sapiens
tgaaactgcctattca

SEQ ID NO: 1769117 - DNA, 19 bp, Homo sapiens
tgaaactgcctattcacgc

SEQ ID NO: 1769118 - DNA, 16 bp, Homo sapiens
tgaaactggcttcccc

SEQ ID NO: 1769119 - DNA, 23 bp, Homo sapiens
tgaaactttgagatctaaaaata

SEQ ID NO: 1769120 - DNA, 16 bp, Homo sapiens
tgaaactttgggaaaa

SEQ ID NO: 1769121 - DNA, 19 bp, Homo sapiens
tgaaactttgggaaaacat

SEQ ID NO: 1769122 - DNA, 14 bp, Homo sapiens
tgaaagaaacagtt

SEQ ID NO: 1769123 - DNA, 20 bp, Homo sapiens
tgaaagaagaaaacagtaca

SEQ ID NO: 1769124 - DNA, 12 bp, Homo sapiens
tgaaagaagcaa

SEQ ID NO: 1769125 - DNA, 14 bp, Homo sapiens
tgaaagaagcaaga

SEQ ID NO: 1769126 - DNA, 18 bp, Homo sapiens
tgaaagaattatttttgt

SEQ ID NO: 1769127 - DNA, 12 bp, Homo sapiens
tgaaagacatca

SEQ ID NO: 1769128 - DNA, 16 bp, Homo sapiens
tgaaagacatcaatga

SEQ ID NO: 1769129 - DNA, 19 bp, Homo sapiens
tgaaagaccttctccaaat

SEQ ID NO: 1769130 - DNA, 13 bp, Homo sapiens
tgaaagactgtac

SEQ ID NO: 1769131 - DNA, 18 bp, Homo sapiens
tgaaagactgtacaaagt

SEQ ID NO: 1769132 - DNA, 22 bp, Homo sapiens
tgaaagactgtacaaagtagaa

SEQ ID NO: 1769133 - DNA, 22 bp, Homo sapiens
tgaaagaggacgtgttacccac

SEQ ID NO: 1769134 - DNA, 18 bp, Homo sapiens
tgaaagaggcagcttgaa

SEQ ID NO: 1769135 - DNA, 21 bp, Homo sapiens
tgaaagaggtaaaattctcta

SEQ ID NO: 1769136 - DNA, 19 bp, Homo sapiens
tgaaagagttaagaatgtc

SEQ ID NO: 1769137 - DNA, 16 bp, Homo sapiens
tgaaagatgatcattt

SEQ ID NO: 1769138 - DNA, 20 bp, Homo sapiens
tgaaagatttttactaatat

SEQ ID NO: 1769139 - DNA, 22 bp, Homo sapiens
tgaaagcagcagctaggactga

SEQ ID NO: 1769140 - DNA, 21 bp, Homo sapiens
tgaaagccaacaactctgcct

SEQ ID NO: 1769141 - DNA, 22 bp, Homo sapiens
tgaaagccaacaactctgcctt

SEQ ID NO: 1769142 - DNA, 17 bp, Homo sapiens
tgaaagccttagggaag

SEQ ID NO: 1769143 - DNA, 13 bp, Homo sapiens
tgaaagctagaga

SEQ ID NO: 1769144 - DNA, 22 bp, Homo sapiens
tgaaagctgattactgtcaata

SEQ ID NO: 1769145 - DNA, 16 bp, Homo sapiens
tgaaagctgatttttt

SEQ ID NO: 1769146 - DNA, 15 bp, Homo sapiens
tgaaaggaacactgg

SEQ ID NO: 1769147 - DNA, 16 bp, Homo sapiens
tgaaaggaacactggc

SEQ ID NO: 1769148 - DNA, 16 bp, Homo sapiens
tgaaaggaacattttt

SEQ ID NO: 1769149 - DNA, 17 bp, Homo sapiens
tgaaaggaacatttttt

SEQ ID NO: 1769150 - DNA, 19 bp, Homo sapiens
tgaaaggcattctctgaag

SEQ ID NO: 1769151 - DNA, 19 bp, Homo sapiens
tgaaaggcctcaagaacaa

SEQ ID NO: 1769152 - DNA, 15 bp, Homo sapiens
tgaaagggagcccct

SEQ ID NO: 1769153 - DNA, 19 bp, Homo sapiens
tgaaagggctatggcaagg

SEQ ID NO: 1769154 - DNA, 22 bp, Homo sapiens
tgaaagggctatggcaaggggg

SEQ ID NO: 1769155 - DNA, 19 bp, Homo sapiens
tgaaaggggacacctgtac

SEQ ID NO: 1769156 - DNA, 13 bp, Homo sapiens
tgaaaggtactat

SEQ ID NO: 1769157 - DNA, 14 bp, Homo sapiens
tgaaaggtactata

SEQ ID NO: 1769158 - DNA, 14 bp, Homo sapiens
tgaaaggtgtgcta

SEQ ID NO: 1769159 - DNA, 19 bp, Homo sapiens
tgaaaggttagagaataaa

SEQ ID NO: 1769160 - DNA, 23 bp, Homo sapiens
tgaaagtagagctagctgccact

SEQ ID NO: 1769161 - DNA, 22 bp, Homo sapiens
tgaaagtatcactggactagga

SEQ ID NO: 1769162 - DNA, 20 bp, Homo sapiens
tgaaagttagagattttaca

SEQ ID NO: 1769163 - DNA, 21 bp, Homo sapiens
tgaaagttagagattttacaa

SEQ ID NO: 1769164 - DNA, 20 bp, Homo sapiens
tgaaagttcatatctggagc

SEQ ID NO: 1769165 - DNA, 20 bp, Homo sapiens
tgaaagttttcagaacctct

SEQ ID NO: 1769166 - DNA, 20 bp, Homo sapiens
tgaaagttttgtaaaagaaa

SEQ ID NO: 1769167 - DNA, 18 bp, Homo sapiens
tgaaataaaaaaagattt

SEQ ID NO: 1769168 - DNA, 19 bp, Homo sapiens
tgaaataaaattacacagt

SEQ ID NO: 1769169 - DNA, 14 bp, Homo sapiens
tgaaataaatgttc

SEQ ID NO: 1769170 - DNA, 14 bp, Homo sapiens
tgaaataactggaa

SEQ ID NO: 1769171 - DNA, 20 bp, Homo sapiens
tgaaataagaattcagacat

SEQ ID NO: 1769172 - DNA, 14 bp, Homo sapiens
tgaaataataaatc

SEQ ID NO: 1769173 - DNA, 19 bp, Homo sapiens
tgaaataatatatttcttc

SEQ ID NO: 1769174 - DNA, 12 bp, Homo sapiens
tgaaataatcag

SEQ ID NO: 1769175 - DNA, 21 bp, Homo sapiens
tgaaataatcagtgactgaaa

SEQ ID NO: 1769176 - DNA, 22 bp, Homo sapiens
tgaaggtattttgtagatgtga

SEQ ID NO: 1769177 - DNA, 18 bp, Homo sapiens
tgaaggtcccctggcagt

SEQ ID NO: 1769178 - DNA, 19 bp, Homo sapiens
tgaaggtcccctggcagtg

SEQ ID NO: 1769179 - DNA, 23 bp, Homo sapiens
tgaaggtctcctaaaactgggat

SEQ ID NO: 1769180 - DNA, 16 bp, Homo sapiens
tgaaggttaggattta

SEQ ID NO: 1769181 - DNA, 18 bp, Homo sapiens
tgaaggttgtatgtaaat

SEQ ID NO: 1769182 - DNA, 19 bp, Homo sapiens
tgaaggttgtatgtaaatc

SEQ ID NO: 1769183 - DNA, 13 bp, Homo sapiens
tgaaggtttttgt

SEQ ID NO: 1769184 - DNA, 21 bp, Homo sapiens
tgaaggtttttgtaaagattt

SEQ ID NO: 1769185 - DNA, 22 bp, Homo sapiens
tgaagtaaactttttgttctgg

SEQ ID NO: 1769186 - DNA, 15 bp, Homo sapiens
tgaagtacacctgtg

SEQ ID NO: 1769187 - DNA, 22 bp, Homo sapiens
tgaagtacagcataagggaatc

SEQ ID NO: 1769188 - DNA, 22 bp, Homo sapiens
tgaagtagcaataggctgtaat

SEQ ID NO: 1769189 - DNA, 19 bp, Homo sapiens
tgaagtcagccacactggg

SEQ ID NO: 1769190 - DNA, 20 bp, Homo sapiens
tgaagtcagccacactgggc

SEQ ID NO: 1769191 - DNA, 23 bp, Homo sapiens
tgaagtcagccacactgggcctg

SEQ ID NO: 1769192 - DNA, 20 bp, Homo sapiens
tgaagtccaggactgggtct

SEQ ID NO: 1769193 - DNA, 13 bp, Homo sapiens
tgaagtctgtaca

SEQ ID NO: 1769194 - DNA, 14 bp, Homo sapiens
tgaagtcttttctg

SEQ ID NO: 1769195 - DNA, 17 bp, Homo sapiens
tgaagtgaaaaagtttt

SEQ ID NO: 1769196 - DNA, 19 bp, Homo sapiens
tgaagtgctctttcttgga

SEQ ID NO: 1769197 - DNA, 18 bp, Homo sapiens
tgaagtgctgtttattaa

SEQ ID NO: 1769198 - DNA, 22 bp, Homo sapiens
tgaagtgctgtttattaatctt

SEQ ID NO: 1769199 - DNA, 23 bp, Homo sapiens
tgaagtggtttgcaggtcagcct

SEQ ID NO: 1769200 - DNA, 16 bp, Homo sapiens
tgaagttactttatgt

SEQ ID NO: 1769201 - DNA, 16 bp, Homo sapiens
tgaagttagtggaaat

SEQ ID NO: 1769202 - DNA, 19 bp, Homo sapiens
tgaagttatgtgtatgtga

SEQ ID NO: 1769203 - DNA, 12 bp, Homo sapiens
tgaagttcatct

SEQ ID NO: 1769204 - DNA, 14 bp, Homo sapiens
tgaagttcatcttg

SEQ ID NO: 1769205 - DNA, 18 bp, Homo sapiens
tgaagttcatggtgatca

SEQ ID NO: 1769206 - DNA, 20 bp, Homo sapiens
tgaagttcatggtgatcagt

SEQ ID NO: 1769207 - DNA, 12 bp, Homo sapiens
tgaagttgctgt

SEQ ID NO: 1769208 - DNA, 19 bp, Homo sapiens
tgaagttgcttttttgact

SEQ ID NO: 1769209 - DNA, 21 bp, Homo sapiens
tgaagtttcaagttttaaagt

SEQ ID NO: 1769210 - DNA, 22 bp, Homo sapiens
tgaagtttcaagttttaaagtt

SEQ ID NO: 1769211 - DNA, 22 bp, Homo sapiens
tgaagtttttttgctgctgcct

SEQ ID NO: 1769212 - DNA, 14 bp, Homo sapiens
tgaataaaagtgca

SEQ ID NO: 1769213 - DNA, 17 bp, Homo sapiens
tgaataaagtgtaacaa

SEQ ID NO: 1769214 - DNA, 16 bp, Homo sapiens
tgaataaataaatgta

SEQ ID NO: 1769215 - DNA, 14 bp, Homo sapiens
tgaataaataccca

SEQ ID NO: 1769216 - DNA, 21 bp, Homo sapiens
tgaataaattctataggaaca

SEQ ID NO: 1769217 - DNA, 23 bp, Homo sapiens
tgaataactaagatatagaaact

SEQ ID NO: 1769218 - DNA, 23 bp, Homo sapiens
tgaataactgattagtaagtctt

SEQ ID NO: 1769219 - DNA, 22 bp, Homo sapiens
tgaataatgaaaataaaacaca

SEQ ID NO: 1769220 - DNA, 13 bp, Homo sapiens
tgaataattacag

SEQ ID NO: 1769221 - DNA, 13 bp, Homo sapiens
tgaataatttctt

SEQ ID NO: 1769222 - DNA, 14 bp, Homo sapiens
tgaatacattcttt

SEQ ID NO: 1769223 - DNA, 21 bp, Homo sapiens
tgaatacattctttgctagtt

SEQ ID NO: 1769224 - DNA, 15 bp, Homo sapiens
tgaatacatttccaa

SEQ ID NO: 1769225 - DNA, 14 bp, Homo sapiens
tgaatacatttgta

SEQ ID NO: 1769226 - DNA, 15 bp, Homo sapiens
tgaatacatttgtat

SEQ ID NO: 1769227 - DNA, 17 bp, Homo sapiens
tgaatacatttgtattt

SEQ ID NO: 1769228 - DNA, 17 bp, Homo sapiens
tgaatactgaattttga

SEQ ID NO: 1769229 - DNA, 15 bp, Homo sapiens
tgaatactgtgaaaa

SEQ ID NO: 1769230 - DNA, 18 bp, Homo sapiens
tgaatagactatctagaa

SEQ ID NO: 1769231 - DNA, 21 bp, Homo sapiens
tgaatagatatgaaagctgat

SEQ ID NO: 1769232 - DNA, 15 bp, Homo sapiens
tgaatagctgtcata

SEQ ID NO: 1769233 - DNA, 16 bp, Homo sapiens
tgaataggtagtatca

SEQ ID NO: 1769234 - DNA, 17 bp, Homo sapiens
tgaataggttatatgca

SEQ ID NO: 1769235 - DNA, 13 bp, Homo sapiens
tgaatagttgctt

SEQ ID NO: 1769236 - DNA, 23 bp, Homo sapiens
tgaatatatagaattcagaaaat

SEQ ID NO: 1769237 - DNA, 17 bp, Homo sapiens
tgaatatctattaatat

SEQ ID NO: 1769238 - DNA, 21 bp, Homo sapiens
tgaatatctattaatatatgt

SEQ ID NO: 1769239 - DNA, 15 bp, Homo sapiens
tgaatattactctca

SEQ ID NO: 1769240 - DNA, 16 bp, Homo sapiens
tgaatattcctggact

SEQ ID NO: 1769241 - DNA, 17 bp, Homo sapiens
tgaatattcctggactt

SEQ ID NO: 1769242 - DNA, 18 bp, Homo sapiens
tgaatattcctggactta

SEQ ID NO: 1769243 - DNA, 11 bp, Homo sapiens
tgaatatttat

SEQ ID NO: 1769244 - DNA, 18 bp, Homo sapiens
tgaatatttataacagca

SEQ ID NO: 1769245 - DNA, 19 bp, Homo sapiens
tgaatatttataacagcat

SEQ ID NO: 1769246 - DNA, 21 bp, Homo sapiens
tgaatattttcattaaaagct

SEQ ID NO: 1769247 - DNA, 16 bp, Homo sapiens
tgaatattttgtaata

SEQ ID NO: 1769248 - DNA, 18 bp, Homo sapiens
tgaatatttttgtatttt

SEQ ID NO: 1769249 - DNA, 20 bp, Homo sapiens
tgaatcactgtgctcagcca

SEQ ID NO: 1769250 - DNA, 16 bp, Homo sapiens
tgaatcagaccctacc

SEQ ID NO: 1769251 - DNA, 19 bp, Homo sapiens
tgaatccaaatctgtcctc

SEQ ID NO: 1769252 - DNA, 17 bp, Homo sapiens
tgaatccatgcttgggt

SEQ ID NO: 1769253 - DNA, 22 bp, Homo sapiens
tgaatcctctattaattactgt

SEQ ID NO: 1769254 - DNA, 21 bp, Homo sapiens
tgaatcgcaaggcctgtgctg

SEQ ID NO: 1769255 - DNA, 16 bp, Homo sapiens
tgaatcgcagctgtgg

SEQ ID NO: 1769256 - DNA, 16 bp, Homo sapiens
tgaatctacatttgtt

SEQ ID NO: 1769257 - DNA, 18 bp, Homo sapiens
tgaatctatgccaaagat

SEQ ID NO: 1769258 - DNA, 13 bp, Homo sapiens
tgaatctcataat

SEQ ID NO: 1769259 - DNA, 17 bp, Homo sapiens
tgaatctgattgcactg

SEQ ID NO: 1769260 - DNA, 23 bp, Homo sapiens
tgaatctgattggacattttctt

SEQ ID NO: 1769261 - DNA, 14 bp, Homo sapiens
tgaatgaataacta

SEQ ID NO: 1769262 - DNA, 22 bp, Homo sapiens
tgaatgaggtcagcatgtctat

SEQ ID NO: 1769263 - DNA, 18 bp, Homo sapiens
tgaatgagtctgttgtgt

SEQ ID NO: 1769264 - DNA, 23 bp, Homo sapiens
tgaatgagtctgttgtgtgtcat

SEQ ID NO: 1769265 - DNA, 23 bp, Homo sapiens
tgaatgcaaaattgttttcactt

SEQ ID NO: 1769266 - DNA, 14 bp, Homo sapiens
tgaatgccaaagcc

SEQ ID NO: 1769267 - DNA, 21 bp, Homo sapiens
tgaatgccactgccttcgctt

SEQ ID NO: 1769268 - DNA, 22 bp, Homo sapiens
tgaatgccactgccttcgcttc

SEQ ID NO: 1769269 - DNA, 22 bp, Homo sapiens
tgaatgccatttagaatctaga

SEQ ID NO: 1769270 - DNA, 14 bp, Homo sapiens
tgaatgccgtggat

SEQ ID NO: 1769271 - DNA, 19 bp, Homo sapiens
tgaatgcctcgctcccttc

SEQ ID NO: 1769272 - DNA, 11 bp, Homo sapiens
tgaatgctgcc

SEQ ID NO: 1769273 - DNA, 14 bp, Homo sapiens
tgaatgctgccagt

SEQ ID NO: 1769274 - DNA, 12 bp, Homo sapiens
tgaatgctgctt

SEQ ID NO: 1769275 - DNA, 11 bp, Homo sapiens
tgaatgctggg

SEQ ID NO: 1769276 - DNA, 19 bp, Homo sapiens
tgaatgctgggactcagcc

SEQ ID NO: 1769277 - DNA, 20 bp, Homo sapiens
tgaatgctgttaatatttct

SEQ ID NO: 1769278 - DNA, 23 bp, Homo sapiens
tgaatgcttttagtgtgtgcata

SEQ ID NO: 1769279 - DNA, 12 bp, Homo sapiens
tgaatggcctgc

SEQ ID NO: 1769280 - DNA, 21 bp, Homo sapiens
tgaatggcctgccttgaagcc

SEQ ID NO: 1769281 - DNA, 16 bp, Homo sapiens
tgaatggtctctgtca

SEQ ID NO: 1769282 - DNA, 22 bp, Homo sapiens
tgaatggttccatgcctgaggg

SEQ ID NO: 1769283 - DNA, 16 bp, Homo sapiens
tgaatgtaaatttgta

SEQ ID NO: 1769284 - DNA, 18 bp, Homo sapiens
tgaatgtaaatttgtact

SEQ ID NO: 1769285 - DNA, 20 bp, Homo sapiens
tgaatgtaaatttgtactat

SEQ ID NO: 1769286 - DNA, 19 bp, Homo sapiens
tgaatgtactatgtctgaa

SEQ ID NO: 1769287 - DNA, 19 bp, Homo sapiens
tgaatgtagaataggcagg

SEQ ID NO: 1769288 - DNA, 19 bp, Homo sapiens
tgaatgtatgtcagtgcta

SEQ ID NO: 1769289 - DNA, 16 bp, Homo sapiens
tgaatgtattgaactt

SEQ ID NO: 1769290 - DNA, 23 bp, Homo sapiens
tgacacagtcttggctcactgca

SEQ ID NO: 1769291 - DNA, 20 bp, Homo sapiens
tgacacagtgctcgaccttg

SEQ ID NO: 1769292 - DNA, 15 bp, Homo sapiens
tgacacataaatctg

SEQ ID NO: 1769293 - DNA, 17 bp, Homo sapiens
tgacacataaatctgtc

SEQ ID NO: 1769294 - DNA, 18 bp, Homo sapiens
tgacacatcgttttgggg

SEQ ID NO: 1769295 - DNA, 18 bp, Homo sapiens
tgacacattacaaagcca

SEQ ID NO: 1769296 - DNA, 22 bp, Homo sapiens
tgacacattacaagcctggaaa

SEQ ID NO: 1769297 - DNA, 12 bp, Homo sapiens
tgacaccagcct

SEQ ID NO: 1769298 - DNA, 12 bp, Homo sapiens
tgacaccccctc

SEQ ID NO: 1769299 - DNA, 13 bp, Homo sapiens
tgacaccccctcc

SEQ ID NO: 1769300 - DNA, 18 bp, Homo sapiens
tgacaccctggcctgaac

SEQ ID NO: 1769301 - DNA, 18 bp, Homo sapiens
tgacacctaccatgctgc

SEQ ID NO: 1769302 - DNA, 13 bp, Homo sapiens
tgacacctccccc

SEQ ID NO: 1769303 - DNA, 13 bp, Homo sapiens
tgacacctggtgc

SEQ ID NO: 1769304 - DNA, 23 bp, Homo sapiens
tgacacctggtgcgggcctggcc

SEQ ID NO: 1769305 - DNA, 23 bp, Homo sapiens
tgacacgcgctctccaccaccca

SEQ ID NO: 1769306 - DNA, 21 bp, Homo sapiens
tgacactagcccaatgaaatg

SEQ ID NO: 1769307 - DNA, 17 bp, Homo sapiens
tgacactatatctgtat

SEQ ID NO: 1769308 - DNA, 18 bp, Homo sapiens
tgacactatatctgtata

SEQ ID NO: 1769309 - DNA, 13 bp, Homo sapiens
tgacactgctcta

SEQ ID NO: 1769310 - DNA, 16 bp, Homo sapiens
tgacactgctctaaca

SEQ ID NO: 1769311 - DNA, 14 bp, Homo sapiens
tgacactggaccag

SEQ ID NO: 1769312 - DNA, 20 bp, Homo sapiens
tgacactggaccaggtcctg

SEQ ID NO: 1769313 - DNA, 21 bp, Homo sapiens
tgacagaatatgtttcaaact

SEQ ID NO: 1769314 - DNA, 23 bp, Homo sapiens
tgacagaatatgtttcaaacttt

SEQ ID NO: 1769315 - DNA, 16 bp, Homo sapiens
tgacagaatcttgtat

SEQ ID NO: 1769316 - DNA, 18 bp, Homo sapiens
tgacagaatcttgtattt

SEQ ID NO: 1769317 - DNA, 19 bp, Homo sapiens
tgacagactcaagagaaac

SEQ ID NO: 1769318 - DNA, 14 bp, Homo sapiens
tgacagagacccag

SEQ ID NO: 1769319 - DNA, 17 bp, Homo sapiens
tgacagagacccagatc

SEQ ID NO: 1769320 - DNA, 22 bp, Homo sapiens
tgacagagcagctaactccgag

SEQ ID NO: 1769321 - DNA, 22 bp, Homo sapiens
tgacagatgtcagccgagccgg

SEQ ID NO: 1769322 - DNA, 14 bp, Homo sapiens
tgacagccagagcc

SEQ ID NO: 1769323 - DNA, 11 bp, Homo sapiens
tgacagcctcc

SEQ ID NO: 1769324 - DNA, 17 bp, Homo sapiens
tgacagcctcccacccc

SEQ ID NO: 1769325 - DNA, 17 bp, Homo sapiens
tgacagctgtccctgtc

SEQ ID NO: 1769326 - DNA, 20 bp, Homo sapiens
tgacagctgtccctgtcacc

SEQ ID NO: 1769327 - DNA, 21 bp, Homo sapiens
tgacagctgtccctgtcacca

SEQ ID NO: 1769328 - DNA, 12 bp, Homo sapiens
tgacagcttgga

SEQ ID NO: 1769329 - DNA, 18 bp, Homo sapiens
tgacagcttggaaaggga

SEQ ID NO: 1769330 - DNA, 17 bp, Homo sapiens
tgacagctttctgggat

SEQ ID NO: 1769331 - DNA, 17 bp, Homo sapiens
tgacagggacatgccct

SEQ ID NO: 1769332 - DNA, 19 bp, Homo sapiens
tgacagggacatgccctgt

SEQ ID NO: 1769333 - DNA, 22 bp, Homo sapiens
tgacagggacatgccctgtgtg

SEQ ID NO: 1769334 - DNA, 16 bp, Homo sapiens
tgacagggactttgct

SEQ ID NO: 1769335 - DNA, 15 bp, Homo sapiens
tgacaggtaaactat

SEQ ID NO: 1769336 - DNA, 15 bp, Homo sapiens
tgacaggtgcctgtc

SEQ ID NO: 1769337 - DNA, 21 bp, Homo sapiens
tgacagtattatacgctggca

SEQ ID NO: 1769338 - DNA, 22 bp, Homo sapiens
tgacagtcataaatactgtcaa

SEQ ID NO: 1769339 - DNA, 15 bp, Homo sapiens
tgacagtccacaggg

SEQ ID NO: 1769340 - DNA, 22 bp, Homo sapiens
tgacagtgaagcagcactgtga

SEQ ID NO: 1769341 - DNA, 18 bp, Homo sapiens
tgacagtgcctcttccag

SEQ ID NO: 1769342 - DNA, 21 bp, Homo sapiens
tgacagtgcctcttccagtga

SEQ ID NO: 1769343 - DNA, 21 bp, Homo sapiens
tgacagtgcctgggaatgtat

SEQ ID NO: 1769344 - DNA, 22 bp, Homo sapiens
tgacagtgctctaggctgcccc

SEQ ID NO: 1769345 - DNA, 14 bp, Homo sapiens
tgacagtttccaaa

SEQ ID NO: 1769346 - DNA, 15 bp, Homo sapiens
tgacagtttccaaat

SEQ ID NO: 1769347 - DNA, 16 bp, Homo sapiens
tgacagtttttctgtt

SEQ ID NO: 1769348 - DNA, 17 bp, Homo sapiens
tgacataaaaacaactt

SEQ ID NO: 1769349 - DNA, 20 bp, Homo sapiens
tgacataaaaacaactttat

SEQ ID NO: 1769350 - DNA, 13 bp, Homo sapiens
tgacataaaattt

SEQ ID NO: 1769351 - DNA, 21 bp, Homo sapiens
tgacataaaatttacatttaa

SEQ ID NO: 1769352 - DNA, 17 bp, Homo sapiens
tgacatacatccaacat

SEQ ID NO: 1769353 - DNA, 12 bp, Homo sapiens
tgacatacctac

SEQ ID NO: 1769354 - DNA, 18 bp, Homo sapiens
tgacatacctaccagtat

SEQ ID NO: 1769355 - DNA, 19 bp, Homo sapiens
tgacatacctaccagtatt

SEQ ID NO: 1769356 - DNA, 20 bp, Homo sapiens
tgacatacctaccagtatta

SEQ ID NO: 1769357 - DNA, 16 bp, Homo sapiens
tgacatcaaagcctgg

SEQ ID NO: 1769358 - DNA, 19 bp, Homo sapiens
tgacatcaaagcctggcct

SEQ ID NO: 1769359 - DNA, 16 bp, Homo sapiens
tgacatcacttgtaca

SEQ ID NO: 1769360 - DNA, 12 bp, Homo sapiens
tgacatccaaat

SEQ ID NO: 1769361 - DNA, 18 bp, Homo sapiens
tgacatccacaaatgcag

SEQ ID NO: 1769362 - DNA, 15 bp, Homo sapiens
tgacatcccttcctg

SEQ ID NO: 1769363 - DNA, 17 bp, Homo sapiens
tgacatcccttcctgga

SEQ ID NO: 1769364 - DNA, 23 bp, Homo sapiens
tgacatcccttcctggaaacagc

SEQ ID NO: 1769365 - DNA, 21 bp, Homo sapiens
tgacatcctttcttttaatga

SEQ ID NO: 1769366 - DNA, 21 bp, Homo sapiens
tgacatcggaaaaataatcaa

SEQ ID NO: 1769367 - DNA, 15 bp, Homo sapiens
tgacatgaagctgtt

SEQ ID NO: 1769368 - DNA, 15 bp, Homo sapiens
tgacatgcactgacc

SEQ ID NO: 1769369 - DNA, 19 bp, Homo sapiens
tgacatgcactgacccttc

SEQ ID NO: 1769370 - DNA, 18 bp, Homo sapiens
tgacatgtggggccaggt

SEQ ID NO: 1769371 - DNA, 20 bp, Homo sapiens
tgacatgtggggccaggtca

SEQ ID NO: 1769372 - DNA, 13 bp, Homo sapiens
tgacattaaaaga

SEQ ID NO: 1769373 - DNA, 20 bp, Homo sapiens
tgacattatgtggttttaga

SEQ ID NO: 1769374 - DNA, 19 bp, Homo sapiens
tgacattcctaagagtgga

SEQ ID NO: 1769375 - DNA, 11 bp, Homo sapiens
tgacattcctt

SEQ ID NO: 1769376 - DNA, 14 bp, Homo sapiens
tgacattcttagct

SEQ ID NO: 1769377 - DNA, 13 bp, Homo sapiens
tgacattgcttta

SEQ ID NO: 1769378 - DNA, 15 bp, Homo sapiens
tgacattgctttact

SEQ ID NO: 1769379 - DNA, 17 bp, Homo sapiens
tgacatttgtagttgag

SEQ ID NO: 1769380 - DNA, 16 bp, Homo sapiens
tgacattttatttttt

SEQ ID NO: 1769381 - DNA, 14 bp, Homo sapiens
tgaccaaaccagcc

SEQ ID NO: 1769382 - DNA, 22 bp, Homo sapiens
tgaccaaagatgacctgtggta

SEQ ID NO: 1769383 - DNA, 11 bp, Homo sapiens
tgaccaacaga

SEQ ID NO: 1769384 - DNA, 15 bp, Homo sapiens
tgaccaagagagaaa

SEQ ID NO: 1769385 - DNA, 16 bp, Homo sapiens
tgaccaagagagaaag

SEQ ID NO: 1769386 - DNA, 18 bp, Homo sapiens
tgaccaagagagaaagaa

SEQ ID NO: 1769387 - DNA, 15 bp, Homo sapiens
tgaccaatacatttg

SEQ ID NO: 1769388 - DNA, 20 bp, Homo sapiens
tgaccaatacatttgtattt

SEQ ID NO: 1769389 - DNA, 16 bp, Homo sapiens
tgaccaattgtgctgc

SEQ ID NO: 1769390 - DNA, 20 bp, Homo sapiens
tgaccacataagaaggcaat

SEQ ID NO: 1769391 - DNA, 18 bp, Homo sapiens
tgaccaccctcccctctc

SEQ ID NO: 1769392 - DNA, 20 bp, Homo sapiens
tgaccagagaatgcacctct

SEQ ID NO: 1769393 - DNA, 15 bp, Homo sapiens
tgaccagatctttct

SEQ ID NO: 1769394 - DNA, 20 bp, Homo sapiens
tgaccagcagatcccagctc

SEQ ID NO: 1769395 - DNA, 18 bp, Homo sapiens
tgaccagcggctgctcaa

SEQ ID NO: 1769396 - DNA, 17 bp, Homo sapiens
tgaccagctctcttcct

SEQ ID NO: 1769397 - DNA, 19 bp, Homo sapiens
tgaccagctctcttcctgt

SEQ ID NO: 1769398 - DNA, 22 bp, Homo sapiens
tgaccaggatcccaagcctcct

SEQ ID NO: 1769399 - DNA, 16 bp, Homo sapiens
tgaccaggcatcctcc

SEQ ID NO: 1769400 - DNA, 20 bp, Homo sapiens
tgaccaggcttttgtagatg

SEQ ID NO: 1769401 - DNA, 21 bp, Homo sapiens
tgaccagggatgctgggctgg

SEQ ID NO: 1769402 - DNA, 22 bp, Homo sapiens
tgaccagggatgctgggctggg

SEQ ID NO: 1769403 - DNA, 23 bp, Homo sapiens
tgaccagggatgctgggctgggc

SEQ ID NO: 1769404 - DNA, 19 bp, Homo sapiens
tgagatctgcacagtcaga

SEQ ID NO: 1769405 - DNA, 13 bp, Homo sapiens
tgagatctgggga

SEQ ID NO: 1769406 - DNA, 15 bp, Homo sapiens
tgagatgaaaactag

SEQ ID NO: 1769407 - DNA, 21 bp, Homo sapiens
tgagatgataaagtcccctta

SEQ ID NO: 1769408 - DNA, 15 bp, Homo sapiens
tgagatggttaaaaa

SEQ ID NO: 1769409 - DNA, 16 bp, Homo sapiens
tgagatggttaaaaag

SEQ ID NO: 1769410 - DNA, 13 bp, Homo sapiens
tgagatgtaaaaa

SEQ ID NO: 1769411 - DNA, 13 bp, Homo sapiens
tgagatgtgaaca

SEQ ID NO: 1769412 - DNA, 19 bp, Homo sapiens
tgagatgtgaacacatcag

SEQ ID NO: 1769413 - DNA, 16 bp, Homo sapiens
tgagatgtgctttgct

SEQ ID NO: 1769414 - DNA, 17 bp, Homo sapiens
tgagatgtgctttgctg

SEQ ID NO: 1769415 - DNA, 12 bp, Homo sapiens
tgagatgtggac

SEQ ID NO: 1769416 - DNA, 18 bp, Homo sapiens
tgagatgttgtgtggcaa

SEQ ID NO: 1769417 - DNA, 16 bp, Homo sapiens
tgagattggcatggct

SEQ ID NO: 1769418 - DNA, 15 bp, Homo sapiens
tgagattggttttcc

SEQ ID NO: 1769419 - DNA, 22 bp, Homo sapiens
tgagattggttttcctgtggca

SEQ ID NO: 1769420 - DNA, 13 bp, Homo sapiens
tgagatttcatct

SEQ ID NO: 1769421 - DNA, 14 bp, Homo sapiens
tgagatttgccagc

SEQ ID NO: 1769422 - DNA, 18 bp, Homo sapiens
tgagatttgccagcacag

SEQ ID NO: 1769423 - DNA, 12 bp, Homo sapiens
tgagattttcct

SEQ ID NO: 1769424 - DNA, 18 bp, Homo sapiens
tgagcaaactaacttgac

SEQ ID NO: 1769425 - DNA, 20 bp, Homo sapiens
tgagcaatgtctgtgctagg

SEQ ID NO: 1769426 - DNA, 20 bp, Homo sapiens
tgagcacactttagtggccg

SEQ ID NO: 1769427 - DNA, 17 bp, Homo sapiens
tgagcacagcctagggc

SEQ ID NO: 1769428 - DNA, 15 bp, Homo sapiens
tgagcacttagcagg

SEQ ID NO: 1769429 - DNA, 14 bp, Homo sapiens
tgagcacttttcaa

SEQ ID NO: 1769430 - DNA, 22 bp, Homo sapiens
tgagcagaatgttgtacttgaa

SEQ ID NO: 1769431 - DNA, 14 bp, Homo sapiens
tgagcagagcggga

SEQ ID NO: 1769432 - DNA, 13 bp, Homo sapiens
tgagcagagggag

SEQ ID NO: 1769433 - DNA, 19 bp, Homo sapiens
tgagcagccgccagctggg

SEQ ID NO: 1769434 - DNA, 20 bp, Homo sapiens
tgagcagcctccactgtgtc

SEQ ID NO: 1769435 - DNA, 23 bp, Homo sapiens
tgagcagcctccactgtgtccag

SEQ ID NO: 1769436 - DNA, 17 bp, Homo sapiens
tgagcagcctctgccag

SEQ ID NO: 1769437 - DNA, 18 bp, Homo sapiens
tgagcagcctctgccagg

SEQ ID NO: 1769438 - DNA, 20 bp, Homo sapiens
tgagcaggattttaatcttt

SEQ ID NO: 1769439 - DNA, 16 bp, Homo sapiens
tgagcagggtccacag

SEQ ID NO: 1769440 - DNA, 20 bp, Homo sapiens
tgagcagggtccacagctgg

SEQ ID NO: 1769441 - DNA, 16 bp, Homo sapiens
tgagcagtcacactgt

SEQ ID NO: 1769442 - DNA, 18 bp, Homo sapiens
tgagcagtggctggtcca

SEQ ID NO: 1769443 - DNA, 17 bp, Homo sapiens
tgagcatcaatcttgtt

SEQ ID NO: 1769444 - DNA, 21 bp, Homo sapiens
tgagcatcaatcttgttactg

SEQ ID NO: 1769445 - DNA, 19 bp, Homo sapiens
tgagcatgcacagctgctt

SEQ ID NO: 1769446 - DNA, 19 bp, Homo sapiens
tgagcatggaacacttcga

SEQ ID NO: 1769447 - DNA, 20 bp, Homo sapiens
tgagcatggggcgctcccac

SEQ ID NO: 1769448 - DNA, 18 bp, Homo sapiens
tgagcatgggtgtgccct

SEQ ID NO: 1769449 - DNA, 23 bp, Homo sapiens
tgagccaagatcgcaccactgca

SEQ ID NO: 1769450 - DNA, 18 bp, Homo sapiens
tgagccaaggacagggct

SEQ ID NO: 1769451 - DNA, 15 bp, Homo sapiens
tgagccacagaccac

SEQ ID NO: 1769452 - DNA, 18 bp, Homo sapiens
tgagccacagaccacctg

SEQ ID NO: 1769453 - DNA, 12 bp, Homo sapiens
tgagccaccacg

SEQ ID NO: 1769454 - DNA, 14 bp, Homo sapiens
tgagccagaaattg

SEQ ID NO: 1769455 - DNA, 20 bp, Homo sapiens
tgagccagacaaatggagga

SEQ ID NO: 1769456 - DNA, 18 bp, Homo sapiens
tgagccagggaacagccc

SEQ ID NO: 1769457 - DNA, 13 bp, Homo sapiens
tgagccagtccca

SEQ ID NO: 1769458 - DNA, 13 bp, Homo sapiens
tgagccatcacta

SEQ ID NO: 1769459 - DNA, 15 bp, Homo sapiens
tgagccatcactaga

SEQ ID NO: 1769460 - DNA, 20 bp, Homo sapiens
tgagccatcactagaagaaa

SEQ ID NO: 1769461 - DNA, 13 bp, Homo sapiens
tgagccatgagga

SEQ ID NO: 1769462 - DNA, 15 bp, Homo sapiens
tgagccatgaggagc

SEQ ID NO: 1769463 - DNA, 22 bp, Homo sapiens
tgagcccaggagctgagtcacc

SEQ ID NO: 1769464 - DNA, 18 bp, Homo sapiens
tgagccccacgtggagct

SEQ ID NO: 1769465 - DNA, 17 bp, Homo sapiens
tgagccccagtgctgga

SEQ ID NO: 1769466 - DNA, 19 bp, Homo sapiens
tgagccccagtgctggaag

SEQ ID NO: 1769467 - DNA, 22 bp, Homo sapiens
tgagcccccccaacactgtgcc

SEQ ID NO: 1769468 - DNA, 23 bp, Homo sapiens
tgagcccccccaacactgtgccc

SEQ ID NO: 1769469 - DNA, 21 bp, Homo sapiens
tgagccccctgcacccacccc

SEQ ID NO: 1769470 - DNA, 22 bp, Homo sapiens
tgagccccctgcacccacccct

SEQ ID NO: 1769471 - DNA, 23 bp, Homo sapiens
tgagccccctgcacccacccctg

SEQ ID NO: 1769472 - DNA, 15 bp, Homo sapiens
tgagcccctggaggc

SEQ ID NO: 1769473 - DNA, 20 bp, Homo sapiens
tgagcccgggctgcctgggc

SEQ ID NO: 1769474 - DNA, 20 bp, Homo sapiens
tgagccctactccctgcaga

SEQ ID NO: 1769475 - DNA, 23 bp, Homo sapiens
tgagccgagattgcgccactgca

SEQ ID NO: 1769476 - DNA, 21 bp, Homo sapiens
tgagccgcatcttctccatct

SEQ ID NO: 1769477 - DNA, 23 bp, Homo sapiens
tgagccgcatcttctccatctgg

SEQ ID NO: 1769478 - DNA, 17 bp, Homo sapiens
tgagccgggcccctggg

SEQ ID NO: 1769479 - DNA, 23 bp, Homo sapiens
tgagcctcaaccttctgggggaa

SEQ ID NO: 1769480 - DNA, 18 bp, Homo sapiens
tgagcctctgctccccag

SEQ ID NO: 1769481 - DNA, 19 bp, Homo sapiens
tgagcctgaggccttccag

SEQ ID NO: 1769482 - DNA, 13 bp, Homo sapiens
tgagcctgcaggg

SEQ ID NO: 1769483 - DNA, 17 bp, Homo sapiens
tgagcctgccctcactc

SEQ ID NO: 1769484 - DNA, 17 bp, Homo sapiens
tgagcctgctggaagcc

SEQ ID NO: 1769485 - DNA, 16 bp, Homo sapiens
tgagcctgggaaataa

SEQ ID NO: 1769486 - DNA, 16 bp, Homo sapiens
tgagcctggtcctggc

SEQ ID NO: 1769487 - DNA, 13 bp, Homo sapiens
tgagccttcagtc

SEQ ID NO: 1769488 - DNA, 19 bp, Homo sapiens
tgagccttcgtgccccccc

SEQ ID NO: 1769489 - DNA, 23 bp, Homo sapiens
tgagccttgcagatatctgcatg

SEQ ID NO: 1769490 - DNA, 23 bp, Homo sapiens
tgagcgccccgcccccaccccta

SEQ ID NO: 1769491 - DNA, 14 bp, Homo sapiens
tgagcgctcctgcc

SEQ ID NO: 1769492 - DNA, 22 bp, Homo sapiens
tgagcgctcctgccgcagagct

SEQ ID NO: 1769493 - DNA, 18 bp, Homo sapiens
tgagcgctggctccctgg

SEQ ID NO: 1769494 - DNA, 21 bp, Homo sapiens
tgagcgctgtggactgtcctg

SEQ ID NO: 1769495 - DNA, 16 bp, Homo sapiens
tgagcggcgcagagcc

SEQ ID NO: 1769496 - DNA, 19 bp, Homo sapiens
tgagctacaacaaaaggac

SEQ ID NO: 1769497 - DNA, 20 bp, Homo sapiens
tgagctatgattatgccact

SEQ ID NO: 1769498 - DNA, 17 bp, Homo sapiens
tgagctcagacccccac

SEQ ID NO: 1769499 - DNA, 19 bp, Homo sapiens
tgagctcagacccccactc

SEQ ID NO: 1769500 - DNA, 13 bp, Homo sapiens
tgagctcaggcat

SEQ ID NO: 1769501 - DNA, 18 bp, Homo sapiens
tgagctccacctctggtg

SEQ ID NO: 1769502 - DNA, 23 bp, Homo sapiens
tgagctccacctctggtggctcc

SEQ ID NO: 1769503 - DNA, 16 bp, Homo sapiens
tgagctcccacctccc

SEQ ID NO: 1769504 - DNA, 21 bp, Homo sapiens
tgagctcccacctcccttccc

SEQ ID NO: 1769505 - DNA, 16 bp, Homo sapiens
tgagctcccctggagc

SEQ ID NO: 1769506 - DNA, 20 bp, Homo sapiens
tgagctcccctggagccagc

SEQ ID NO: 1769507 - DNA, 18 bp, Homo sapiens
tgagctccctcgctgtat

SEQ ID NO: 1769508 - DNA, 18 bp, Homo sapiens
tgagctcggggggctctg

SEQ ID NO: 1769509 - DNA, 22 bp, Homo sapiens
tgagctcggggggctctgcctt

SEQ ID NO: 1769510 - DNA, 20 bp, Homo sapiens
tgagctcggtggacccaggg

SEQ ID NO: 1769511 - DNA, 16 bp, Homo sapiens
tgagctctgaaatctt

SEQ ID NO: 1769512 - DNA, 17 bp, Homo sapiens
tgagctctgaaatcttc

SEQ ID NO: 1769513 - DNA, 22 bp, Homo sapiens
tgagctctggttatttttctct

SEQ ID NO: 1769514 - DNA, 12 bp, Homo sapiens
tgagctcttccc

SEQ ID NO: 1769515 - DNA, 23 bp, Homo sapiens
tgagctcttcccttattcctaat

SEQ ID NO: 1769516 - DNA, 17 bp, Homo sapiens
tgagctgcagaaacgaa

SEQ ID NO: 1769517 - DNA, 19 bp, Homo sapiens
tgagctgctgactgccaat

SEQ ID NO: 1769518 - DNA, 13 bp, Homo sapiens
tgagggcctgctg

SEQ ID NO: 1769519 - DNA, 18 bp, Homo sapiens
tgagggcctgctggaggc

SEQ ID NO: 1769520 - DNA, 20 bp, Homo sapiens
tgagggcctgctggaggcct

SEQ ID NO: 1769521 - DNA, 18 bp, Homo sapiens
tgagggcgagcggcaaag

SEQ ID NO: 1769522 - DNA, 14 bp, Homo sapiens
tgaggggcaggtct

SEQ ID NO: 1769523 - DNA, 22 bp, Homo sapiens
tgaggggcatctgcccctcccc

SEQ ID NO: 1769524 - DNA, 19 bp, Homo sapiens
tgaggggccctggccagga

SEQ ID NO: 1769525 - DNA, 13 bp, Homo sapiens
tgagggggagctg

SEQ ID NO: 1769526 - DNA, 16 bp, Homo sapiens
tgaggggtctcggatg

SEQ ID NO: 1769527 - DNA, 15 bp, Homo sapiens
tgagggtccacctgg

SEQ ID NO: 1769528 - DNA, 16 bp, Homo sapiens
tgagggtccacctgga

SEQ ID NO: 1769529 - DNA, 12 bp, Homo sapiens
tgagggtcttct

SEQ ID NO: 1769530 - DNA, 19 bp, Homo sapiens
tgagggtcttcttacatgc

SEQ ID NO: 1769531 - DNA, 22 bp, Homo sapiens
tgagggtgactatggagctgag

SEQ ID NO: 1769532 - DNA, 21 bp, Homo sapiens
tgagggtgccccgcctgagtc

SEQ ID NO: 1769533 - DNA, 16 bp, Homo sapiens
tgagggtgggggtgct

SEQ ID NO: 1769534 - DNA, 16 bp, Homo sapiens
tgaggtactggtccct

SEQ ID NO: 1769535 - DNA, 21 bp, Homo sapiens
tgaggtagaggggaaggaaat

SEQ ID NO: 1769536 - DNA, 16 bp, Homo sapiens
tgaggtaggagaggcg

SEQ ID NO: 1769537 - DNA, 16 bp, Homo sapiens
tgaggtataaagacaa

SEQ ID NO: 1769538 - DNA, 13 bp, Homo sapiens
tgaggtcactgct

SEQ ID NO: 1769539 - DNA, 21 bp, Homo sapiens
tgaggtccttatgtcctgtca

SEQ ID NO: 1769540 - DNA, 15 bp, Homo sapiens
tgaggtgaaagggag

SEQ ID NO: 1769541 - DNA, 16 bp, Homo sapiens
tgaggtgaaagggagc

SEQ ID NO: 1769542 - DNA, 18 bp, Homo sapiens
tgaggtgaacaaggtaaa

SEQ ID NO: 1769543 - DNA, 17 bp, Homo sapiens
tgaggtgcagagtgccc

SEQ ID NO: 1769544 - DNA, 15 bp, Homo sapiens
tgaggtgcctgtccc

SEQ ID NO: 1769545 - DNA, 16 bp, Homo sapiens
tgaggtgcctgtccca

SEQ ID NO: 1769546 - DNA, 15 bp, Homo sapiens
tgaggtgctatgttc

SEQ ID NO: 1769547 - DNA, 14 bp, Homo sapiens
tgaggtgctgatga

SEQ ID NO: 1769548 - DNA, 17 bp, Homo sapiens
tgaggtggaagccctcc

SEQ ID NO: 1769549 - DNA, 21 bp, Homo sapiens
tgaggtggaagccctccttcc

SEQ ID NO: 1769550 - DNA, 21 bp, Homo sapiens
tgaggtgggaggtggaagaag

SEQ ID NO: 1769551 - DNA, 11 bp, Homo sapiens
tgaggtgggcc

SEQ ID NO: 1769552 - DNA, 16 bp, Homo sapiens
tgaggtgggctggggc

SEQ ID NO: 1769553 - DNA, 21 bp, Homo sapiens
tgaggtgggttttcttcccat

SEQ ID NO: 1769554 - DNA, 20 bp, Homo sapiens
tgaggtgtcagagaaaatga

SEQ ID NO: 1769555 - DNA, 18 bp, Homo sapiens
tgaggtgtgggggctgca

SEQ ID NO: 1769556 - DNA, 22 bp, Homo sapiens
tgaggttaagtttctcttcacc

SEQ ID NO: 1769557 - DNA, 19 bp, Homo sapiens
tgaggttcctctgcctgcc

SEQ ID NO: 1769558 - DNA, 21 bp, Homo sapiens
tgagtaaaaactagaaggctt

SEQ ID NO: 1769559 - DNA, 20 bp, Homo sapiens
tgagtaaaaagtttctaaag

SEQ ID NO: 1769560 - DNA, 15 bp, Homo sapiens
tgagtaaaacacata

SEQ ID NO: 1769561 - DNA, 18 bp, Homo sapiens
tgagtaaaacacatattc

SEQ ID NO: 1769562 - DNA, 13 bp, Homo sapiens
tgagtaaacataa

SEQ ID NO: 1769563 - DNA, 15 bp, Homo sapiens
tgagtaacatttgct

SEQ ID NO: 1769564 - DNA, 23 bp, Homo sapiens
tgagtaagagctggtgtctgatt

SEQ ID NO: 1769565 - DNA, 23 bp, Homo sapiens
tgagtaagtgaaggtctcctaaa

SEQ ID NO: 1769566 - DNA, 15 bp, Homo sapiens
tgagtaatggtgtag

SEQ ID NO: 1769567 - DNA, 23 bp, Homo sapiens
tgagtacagagtgtggactctgg

SEQ ID NO: 1769568 - DNA, 21 bp, Homo sapiens
tgagtacagtgaggagggtgg

SEQ ID NO: 1769569 - DNA, 20 bp, Homo sapiens
tgagtacatgcacactcatg

SEQ ID NO: 1769570 - DNA, 16 bp, Homo sapiens
tgagtacctgcaaaaa

SEQ ID NO: 1769571 - DNA, 17 bp, Homo sapiens
tgagtacctgcaaaaat

SEQ ID NO: 1769572 - DNA, 20 bp, Homo sapiens
tgagtagaaaagtcggggat

SEQ ID NO: 1769573 - DNA, 17 bp, Homo sapiens
tgagtagagttgatcaa

SEQ ID NO: 1769574 - DNA, 15 bp, Homo sapiens
tgagtaggctgggcc

SEQ ID NO: 1769575 - DNA, 12 bp, Homo sapiens
tgagtattgttt

SEQ ID NO: 1769576 - DNA, 21 bp, Homo sapiens
tgagtattgtttaaaatgtaa

SEQ ID NO: 1769577 - DNA, 15 bp, Homo sapiens
tgagtatttggtcca

SEQ ID NO: 1769578 - DNA, 22 bp, Homo sapiens
tgagtatttttaaaaaatatgt

SEQ ID NO: 1769579 - DNA, 15 bp, Homo sapiens
tgagtcaaaacaaag

SEQ ID NO: 1769580 - DNA, 16 bp, Homo sapiens
tgagtcaaatccagtg

SEQ ID NO: 1769581 - DNA, 18 bp, Homo sapiens
tgagtcaaatccagtggt

SEQ ID NO: 1769582 - DNA, 14 bp, Homo sapiens
tgagtcaattggaa

SEQ ID NO: 1769583 - DNA, 16 bp, Homo sapiens
tgagtcacccatgaag

SEQ ID NO: 1769584 - DNA, 20 bp, Homo sapiens
tgagtcaccctacctgtgcc

SEQ ID NO: 1769585 - DNA, 14 bp, Homo sapiens
tgagtcacctcctc

SEQ ID NO: 1769586 - DNA, 15 bp, Homo sapiens
tgagtcacctcctcc

SEQ ID NO: 1769587 - DNA, 23 bp, Homo sapiens
tgagtcacctcctccactcactc

SEQ ID NO: 1769588 - DNA, 18 bp, Homo sapiens
tgagtcacctgctccaga

SEQ ID NO: 1769589 - DNA, 17 bp, Homo sapiens
tgagtcagaatgtgaaa

SEQ ID NO: 1769590 - DNA, 22 bp, Homo sapiens
tgagtcagaatgtgaaaaagga

SEQ ID NO: 1769591 - DNA, 21 bp, Homo sapiens
tgagtcagcaccttggcccag

SEQ ID NO: 1769592 - DNA, 22 bp, Homo sapiens
tgagtcagcaccttggcccagg

SEQ ID NO: 1769593 - DNA, 14 bp, Homo sapiens
tgagtcagtctctt

SEQ ID NO: 1769594 - DNA, 20 bp, Homo sapiens
tgagtcatgatctccctgcc

SEQ ID NO: 1769595 - DNA, 16 bp, Homo sapiens
tgagtcccaggagctg

SEQ ID NO: 1769596 - DNA, 20 bp, Homo sapiens
tgagtcccaggagctgccca

SEQ ID NO: 1769597 - DNA, 21 bp, Homo sapiens
tgagtcccaggagctgcccag

SEQ ID NO: 1769598 - DNA, 19 bp, Homo sapiens
tgagtcccctactccctct

SEQ ID NO: 1769599 - DNA, 12 bp, Homo sapiens
tgagtccctgct

SEQ ID NO: 1769600 - DNA, 17 bp, Homo sapiens
tgagtcctaggacttaa

SEQ ID NO: 1769601 - DNA, 19 bp, Homo sapiens
tgagtcctggtttcctggc

SEQ ID NO: 1769602 - DNA, 14 bp, Homo sapiens
tgagtcctgtctct

SEQ ID NO: 1769603 - DNA, 16 bp, Homo sapiens
tgagtcctgtctctgc

SEQ ID NO: 1769604 - DNA, 18 bp, Homo sapiens
tgagtcctgtctctgcct

SEQ ID NO: 1769605 - DNA, 16 bp, Homo sapiens
tgagtccttgaaaata

SEQ ID NO: 1769606 - DNA, 18 bp, Homo sapiens
tgagtctatgttcaaaga

SEQ ID NO: 1769607 - DNA, 23 bp, Homo sapiens
tgagtctatgttcaaagactgtg

SEQ ID NO: 1769608 - DNA, 17 bp, Homo sapiens
tgagtctcaagggtggc

SEQ ID NO: 1769609 - DNA, 15 bp, Homo sapiens
tgagtctccagggcc

SEQ ID NO: 1769610 - DNA, 15 bp, Homo sapiens
tgagtctcttcagaa

SEQ ID NO: 1769611 - DNA, 21 bp, Homo sapiens
tgagtctgtactaaacagtaa

SEQ ID NO: 1769612 - DNA, 15 bp, Homo sapiens
tgagtctttgaagat

SEQ ID NO: 1769613 - DNA, 21 bp, Homo sapiens
tgagtctttgaagatagtttt

SEQ ID NO: 1769614 - DNA, 21 bp, Homo sapiens
tgagtctttggttctaaggac

SEQ ID NO: 1769615 - DNA, 16 bp, Homo sapiens
tgagtgacagctttct

SEQ ID NO: 1769616 - DNA, 21 bp, Homo sapiens
tgagtgacatagcctcatgtt

SEQ ID NO: 1769617 - DNA, 17 bp, Homo sapiens
tgagtgagaagagcttg

SEQ ID NO: 1769618 - DNA, 23 bp, Homo sapiens
tgagtgattgacacacagcactc

SEQ ID NO: 1769619 - DNA, 16 bp, Homo sapiens
tgagtgcacctgcctc

SEQ ID NO: 1769620 - DNA, 23 bp, Homo sapiens
tgagtgcacctgcctccaccagc

SEQ ID NO: 1769621 - DNA, 21 bp, Homo sapiens
tgagtgcagaccccttggcca

SEQ ID NO: 1769622 - DNA, 19 bp, Homo sapiens
tgagtgcagccgtttgaga

SEQ ID NO: 1769623 - DNA, 14 bp, Homo sapiens
tgagtgcatgtact

SEQ ID NO: 1769624 - DNA, 15 bp, Homo sapiens
tgagtgccttttgca

SEQ ID NO: 1769625 - DNA, 19 bp, Homo sapiens
tgagtggaatgcagggaag

SEQ ID NO: 1769626 - DNA, 14 bp, Homo sapiens
tgagtggataatca

SEQ ID NO: 1769627 - DNA, 18 bp, Homo sapiens
tgagtggatgatgtttcg

SEQ ID NO: 1769628 - DNA, 12 bp, Homo sapiens
tgagtggcagca

SEQ ID NO: 1769629 - DNA, 20 bp, Homo sapiens
tgagtggcagccatgcctca

SEQ ID NO: 1769630 - DNA, 13 bp, Homo sapiens
tgagtggcagggg

SEQ ID NO: 1769631 - DNA, 12 bp, Homo sapiens
tgagtggcccca

SEQ ID NO: 1769632 - DNA, 23 bp, Homo sapiens
tgattcaaagtgttgtgttcctg

SEQ ID NO: 1769633 - DNA, 17 bp, Homo sapiens
tgattcaagaacaagca

SEQ ID NO: 1769634 - DNA, 23 bp, Homo sapiens
tgattcaaggctcagaaggaatg

SEQ ID NO: 1769635 - DNA, 18 bp, Homo sapiens
tgattcacctcttcctct

SEQ ID NO: 1769636 - DNA, 19 bp, Homo sapiens
tgattcacctcttcctctg

SEQ ID NO: 1769637 - DNA, 21 bp, Homo sapiens
tgattcacctcttcctctggt

SEQ ID NO: 1769638 - DNA, 20 bp, Homo sapiens
tgattcatagtaaaatacct

SEQ ID NO: 1769639 - DNA, 14 bp, Homo sapiens
tgattcattttcct

SEQ ID NO: 1769640 - DNA, 15 bp, Homo sapiens
tgattcattttcctg

SEQ ID NO: 1769641 - DNA, 23 bp, Homo sapiens
tgattcattttcctgttcagtga

SEQ ID NO: 1769642 - DNA, 12 bp, Homo sapiens
tgattccaaata

SEQ ID NO: 1769643 - DNA, 22 bp, Homo sapiens
tgattccactacacctggctga

SEQ ID NO: 1769644 - DNA, 18 bp, Homo sapiens
tgattccctcctgctact

SEQ ID NO: 1769645 - DNA, 23 bp, Homo sapiens
tgattcctaagccacttgaaatg

SEQ ID NO: 1769646 - DNA, 20 bp, Homo sapiens
tgattccttttgatggggag

SEQ ID NO: 1769647 - DNA, 17 bp, Homo sapiens
tgattcggacggccaat

SEQ ID NO: 1769648 - DNA, 22 bp, Homo sapiens
tgattctatgcctgtatttcca

SEQ ID NO: 1769649 - DNA, 13 bp, Homo sapiens
tgattctcctgcc

SEQ ID NO: 1769650 - DNA, 12 bp, Homo sapiens
tgattctccttc

SEQ ID NO: 1769651 - DNA, 18 bp, Homo sapiens
tgattctccttcagccct

SEQ ID NO: 1769652 - DNA, 20 bp, Homo sapiens
tgattctctatgacatgaaa

SEQ ID NO: 1769653 - DNA, 14 bp, Homo sapiens
tgattctctgtggt

SEQ ID NO: 1769654 - DNA, 19 bp, Homo sapiens
tgattctctgtggtttttt

SEQ ID NO: 1769655 - DNA, 21 bp, Homo sapiens
tgattctgataatgctcactt

SEQ ID NO: 1769656 - DNA, 11 bp, Homo sapiens
tgattctgatt

SEQ ID NO: 1769657 - DNA, 14 bp, Homo sapiens
tgattctgatttca

SEQ ID NO: 1769658 - DNA, 15 bp, Homo sapiens
tgattctgatttcag

SEQ ID NO: 1769659 - DNA, 22 bp, Homo sapiens
tgattctgatttcagtttttca

SEQ ID NO: 1769660 - DNA, 14 bp, Homo sapiens
tgattctggcttta

SEQ ID NO: 1769661 - DNA, 15 bp, Homo sapiens
tgattcttgattcct

SEQ ID NO: 1769662 - DNA, 16 bp, Homo sapiens
tgattcttgattcctg

SEQ ID NO: 1769663 - DNA, 15 bp, Homo sapiens
tgattcttttaggac

SEQ ID NO: 1769664 - DNA, 17 bp, Homo sapiens
tgattgaaatatcagtt

SEQ ID NO: 1769665 - DNA, 22 bp, Homo sapiens
tgattgaatctgattggacatt

SEQ ID NO: 1769666 - DNA, 16 bp, Homo sapiens
tgattgacacacagca

SEQ ID NO: 1769667 - DNA, 15 bp, Homo sapiens
tgattgcacattgtt

SEQ ID NO: 1769668 - DNA, 20 bp, Homo sapiens
tgattgcagaaaggagagac

SEQ ID NO: 1769669 - DNA, 20 bp, Homo sapiens
tgattgcagcttttggttaa

SEQ ID NO: 1769670 - DNA, 14 bp, Homo sapiens
tgattgctccagag

SEQ ID NO: 1769671 - DNA, 15 bp, Homo sapiens
tgattgctccagagc

SEQ ID NO: 1769672 - DNA, 20 bp, Homo sapiens
tgattgctgccataattcta

SEQ ID NO: 1769673 - DNA, 18 bp, Homo sapiens
tgattgcttgagctcagg

SEQ ID NO: 1769674 - DNA, 22 bp, Homo sapiens
tgattggacaggcatgggtgca

SEQ ID NO: 1769675 - DNA, 23 bp, Homo sapiens
tgattggacattttcttcagaga

SEQ ID NO: 1769676 - DNA, 16 bp, Homo sapiens
tgattggattattcat

SEQ ID NO: 1769677 - DNA, 21 bp, Homo sapiens
tgattggattattcatttaaa

SEQ ID NO: 1769678 - DNA, 12 bp, Homo sapiens
tgattggctgca

SEQ ID NO: 1769679 - DNA, 15 bp, Homo sapiens
tgattggctgcagga

SEQ ID NO: 1769680 - DNA, 12 bp, Homo sapiens
tgattggctgct

SEQ ID NO: 1769681 - DNA, 13 bp, Homo sapiens
tgattggctgctt

SEQ ID NO: 1769682 - DNA, 10 bp, Homo sapiens
tgattggctt

SEQ ID NO: 1769683 - DNA, 18 bp, Homo sapiens
tgattgggaaaacatttg

SEQ ID NO: 1769684 - DNA, 20 bp, Homo sapiens
tgattgggaaaacatttgct

SEQ ID NO: 1769685 - DNA, 21 bp, Homo sapiens
tgattgggaaaacatttgctg

SEQ ID NO: 1769686 - DNA, 20 bp, Homo sapiens
tgattggttgtgccttccct

SEQ ID NO: 1769687 - DNA, 14 bp, Homo sapiens
tgattgtcagctac

SEQ ID NO: 1769688 - DNA, 21 bp, Homo sapiens
tgattgtcctttaaaaaagaa

SEQ ID NO: 1769689 - DNA, 16 bp, Homo sapiens
tgattgtttgctctga

SEQ ID NO: 1769690 - DNA, 15 bp, Homo sapiens
tgatttaaacacaca

SEQ ID NO: 1769691 - DNA, 22 bp, Homo sapiens
tgatttaaagtgaacacacaca

SEQ ID NO: 1769692 - DNA, 16 bp, Homo sapiens
tgatttaggagaagcc

SEQ ID NO: 1769693 - DNA, 15 bp, Homo sapiens
tgatttattgaaatt

SEQ ID NO: 1769694 - DNA, 19 bp, Homo sapiens
tgatttatttggagtggag

SEQ ID NO: 1769695 - DNA, 20 bp, Homo sapiens
tgatttcaaagttttgttgt

SEQ ID NO: 1769696 - DNA, 11 bp, Homo sapiens
tgatttcagga

SEQ ID NO: 1769697 - DNA, 14 bp, Homo sapiens
tgatttcagtaagt

SEQ ID NO: 1769698 - DNA, 13 bp, Homo sapiens
tgatttcagttca

SEQ ID NO: 1769699 - DNA, 14 bp, Homo sapiens
tgatttcagttcat

SEQ ID NO: 1769700 - DNA, 19 bp, Homo sapiens
tgatttcagtttttcattt

SEQ ID NO: 1769701 - DNA, 21 bp, Homo sapiens
tgatttcagtttttcatttgt

SEQ ID NO: 1769702 - DNA, 18 bp, Homo sapiens
tgatttcatcttctggaa

SEQ ID NO: 1769703 - DNA, 19 bp, Homo sapiens
tgatttcatcttctggaat

SEQ ID NO: 1769704 - DNA, 14 bp, Homo sapiens
tgatttccaaagag

SEQ ID NO: 1769705 - DNA, 12 bp, Homo sapiens
tgatttccaggc

SEQ ID NO: 1769706 - DNA, 23 bp, Homo sapiens
tgatttcccactgcactccagcc

SEQ ID NO: 1769707 - DNA, 13 bp, Homo sapiens
tgatttcccctct

SEQ ID NO: 1769708 - DNA, 14 bp, Homo sapiens
tgatttcctaaaca

SEQ ID NO: 1769709 - DNA, 16 bp, Homo sapiens
tgatttcctaaacata

SEQ ID NO: 1769710 - DNA, 11 bp, Homo sapiens
tgatttctaat

SEQ ID NO: 1769711 - DNA, 13 bp, Homo sapiens
tgatttctctgaa

SEQ ID NO: 1769712 - DNA, 22 bp, Homo sapiens
tgatttcttaggggaaggagaa

SEQ ID NO: 1769713 - DNA, 12 bp, Homo sapiens
tgatttctttcc

SEQ ID NO: 1769714 - DNA, 16 bp, Homo sapiens
tgatttctttccttcc

SEQ ID NO: 1769715 - DNA, 19 bp, Homo sapiens
tgatttctttccttcccaa

SEQ ID NO: 1769716 - DNA, 17 bp, Homo sapiens
tgatttgcctgtaattt

SEQ ID NO: 1769717 - DNA, 13 bp, Homo sapiens
tgatttggtgacc

SEQ ID NO: 1769718 - DNA, 15 bp, Homo sapiens
tgatttgtactgaaa

SEQ ID NO: 1769719 - DNA, 15 bp, Homo sapiens
tgatttgttttgaat

SEQ ID NO: 1769720 - DNA, 20 bp, Homo sapiens
tgatttgttttgaattttgt

SEQ ID NO: 1769721 - DNA, 13 bp, Homo sapiens
tgattttaaaatg

SEQ ID NO: 1769722 - DNA, 14 bp, Homo sapiens
tgattttaatgaaa

SEQ ID NO: 1769723 - DNA, 20 bp, Homo sapiens
tgattttaggagctaaggct

SEQ ID NO: 1769724 - DNA, 18 bp, Homo sapiens
tgattttatgatcagtgt

SEQ ID NO: 1769725 - DNA, 14 bp, Homo sapiens
tgattttattcttg

SEQ ID NO: 1769726 - DNA, 15 bp, Homo sapiens
tgattttattcttga

SEQ ID NO: 1769727 - DNA, 17 bp, Homo sapiens
tgattttcaagcagcat

SEQ ID NO: 1769728 - DNA, 14 bp, Homo sapiens
tgattttcttgcca

SEQ ID NO: 1769729 - DNA, 17 bp, Homo sapiens
tgattttggaaagatgt

SEQ ID NO: 1769730 - DNA, 20 bp, Homo sapiens
tgattttgtagttaatttat

SEQ ID NO: 1769731 - DNA, 15 bp, Homo sapiens
tgatttttaatggaa

SEQ ID NO: 1769732 - DNA, 13 bp, Homo sapiens
tgatttttactgt

SEQ ID NO: 1769733 - DNA, 22 bp, Homo sapiens
tgatttttctaaccttgaatgc

SEQ ID NO: 1769734 - DNA, 15 bp, Homo sapiens
tgatttttctcttca

SEQ ID NO: 1769735 - DNA, 21 bp, Homo sapiens
tgatttttgagcccttgtttc

SEQ ID NO: 1769736 - DNA, 21 bp, Homo sapiens
tgatttttgcctcttccagtc

SEQ ID NO: 1769737 - DNA, 19 bp, Homo sapiens
tgattttttaaggagctgg

SEQ ID NO: 1769738 - DNA, 14 bp, Homo sapiens
tgattttttgaaag

SEQ ID NO: 1769739 - DNA, 18 bp, Homo sapiens
tgattttttgaaagttaa

SEQ ID NO: 1769740 - DNA, 21 bp, Homo sapiens
tgatttttttaatagtgcttt

SEQ ID NO: 1769741 - DNA, 13 bp, Homo sapiens
tgatttttttcca

SEQ ID NO: 1769742 - DNA, 22 bp, Homo sapiens
tgattttttttcccatttagaa

SEQ ID NO: 1769743 - DNA, 16 bp, Homo sapiens
tgattttttttccttt

SEQ ID NO: 1769744 - DNA, 12 bp, Homo sapiens
tgcaaaaaatag

SEQ ID NO: 1769745 - DNA, 19 bp, Homo sapiens
tgcaaaaaatcttaatact

SEQ ID NO: 1769746 - DNA, 17 bp, Homo sapiens
tgcaaaaatccaaatat

SEQ ID NO: 1769747 - DNA, 22 bp, Homo sapiens
tgcacacggctggtcactctgc

SEQ ID NO: 1769748 - DNA, 19 bp, Homo sapiens
tgcacactcatacacatgt

SEQ ID NO: 1769749 - DNA, 21 bp, Homo sapiens
tgcacactcccctgcactgga

SEQ ID NO: 1769750 - DNA, 17 bp, Homo sapiens
tgcacagacaagcagcc

SEQ ID NO: 1769751 - DNA, 15 bp, Homo sapiens
tgcacagatgccatg

SEQ ID NO: 1769752 - DNA, 19 bp, Homo sapiens
tgcacagatggatttgcct

SEQ ID NO: 1769753 - DNA, 23 bp, Homo sapiens
tgcacagatggatttgcctgtgc

SEQ ID NO: 1769754 - DNA, 18 bp, Homo sapiens
tgcacagccaacgagaca

SEQ ID NO: 1769755 - DNA, 12 bp, Homo sapiens
tgcacagctgct

SEQ ID NO: 1769756 - DNA, 14 bp, Homo sapiens
tgcacagctgcttg

SEQ ID NO: 1769757 - DNA, 14 bp, Homo sapiens
tgcacagctgtcca

SEQ ID NO: 1769758 - DNA, 18 bp, Homo sapiens
tgcacaggcacacagggc

SEQ ID NO: 1769759 - DNA, 14 bp, Homo sapiens
tgcacaggccctgg

SEQ ID NO: 1769760 - DNA, 15 bp, Homo sapiens
tgcacagtacaataa

SEQ ID NO: 1769761 - DNA, 17 bp, Homo sapiens
tgcacagtatttgtaat

SEQ ID NO: 1769762 - DNA, 18 bp, Homo sapiens
tgcacagtatttgtaatt

SEQ ID NO: 1769763 - DNA, 16 bp, Homo sapiens
tgcacagtcagaagga

SEQ ID NO: 1769764 - DNA, 20 bp, Homo sapiens
tgcacagtcagaaggacggc

SEQ ID NO: 1769765 - DNA, 15 bp, Homo sapiens
tgcacagtgacttct

SEQ ID NO: 1769766 - DNA, 16 bp, Homo sapiens
tgcacagtgacttctg

SEQ ID NO: 1769767 - DNA, 13 bp, Homo sapiens
tgcacagtgattt

SEQ ID NO: 1769768 - DNA, 19 bp, Homo sapiens
tgcacagtgcatctcagcc

SEQ ID NO: 1769769 - DNA, 20 bp, Homo sapiens
tgcacagtgcatctcagccc

SEQ ID NO: 1769770 - DNA, 21 bp, Homo sapiens
tgcacataagcttccatttta

SEQ ID NO: 1769771 - DNA, 18 bp, Homo sapiens
tgcacatatggactctgc

SEQ ID NO: 1769772 - DNA, 21 bp, Homo sapiens
tgcacatccgcgtgtgcctgt

SEQ ID NO: 1769773 - DNA, 22 bp, Homo sapiens
tgcacatccgcgtgtgcctgtg

SEQ ID NO: 1769774 - DNA, 21 bp, Homo sapiens
tgcacatgactcgggggtggg

SEQ ID NO: 1769775 - DNA, 23 bp, Homo sapiens
tgcacatgctgtctggccctggg

SEQ ID NO: 1769776 - DNA, 12 bp, Homo sapiens
tgcacatggaca

SEQ ID NO: 1769777 - DNA, 15 bp, Homo sapiens
tgcacatgtcttgta

SEQ ID NO: 1769778 - DNA, 19 bp, Homo sapiens
tgcacatgtcttgtacatg

SEQ ID NO: 1769779 - DNA, 22 bp, Homo sapiens
tgcacatgtcttgtacatgtgt

SEQ ID NO: 1769780 - DNA, 22 bp, Homo sapiens
tgcacattgcctgttctgcttc

SEQ ID NO: 1769781 - DNA, 16 bp, Homo sapiens
tgcacatttatatata

SEQ ID NO: 1769782 - DNA, 14 bp, Homo sapiens
tgcacatttctgga

SEQ ID NO: 1769783 - DNA, 15 bp, Homo sapiens
tgcacatttctggat

SEQ ID NO: 1769784 - DNA, 15 bp, Homo sapiens
tgcacattttgtggc

SEQ ID NO: 1769785 - DNA, 21 bp, Homo sapiens
tgcaccaaactgcctcaatcc

SEQ ID NO: 1769786 - DNA, 14 bp, Homo sapiens
tgcaccaaagacat

SEQ ID NO: 1769787 - DNA, 15 bp, Homo sapiens
tgcaccaccaagcca

SEQ ID NO: 1769788 - DNA, 23 bp, Homo sapiens
tgcaccagagtgaaagggctatg

SEQ ID NO: 1769789 - DNA, 18 bp, Homo sapiens
tgcaccagcgcccccaga

SEQ ID NO: 1769790 - DNA, 14 bp, Homo sapiens
tgcaccatctgctt

SEQ ID NO: 1769791 - DNA, 19 bp, Homo sapiens
tgcaccatgctgctgggga

SEQ ID NO: 1769792 - DNA, 15 bp, Homo sapiens
tgcaccatggagacg

SEQ ID NO: 1769793 - DNA, 23 bp, Homo sapiens
tgcaccattgcgctctagcctgg

SEQ ID NO: 1769794 - DNA, 17 bp, Homo sapiens
tgcacccactcaccagg

SEQ ID NO: 1769795 - DNA, 20 bp, Homo sapiens
tgcacccactcaccagggtc

SEQ ID NO: 1769796 - DNA, 21 bp, Homo sapiens
tgcaccccaaagctttcctgc

SEQ ID NO: 1769797 - DNA, 18 bp, Homo sapiens
tgcaccccagcattccag

SEQ ID NO: 1769798 - DNA, 22 bp, Homo sapiens
tgcaccccagcattccagctct

SEQ ID NO: 1769799 - DNA, 23 bp, Homo sapiens
tgcaccccatgtgggtgaccagg

SEQ ID NO: 1769800 - DNA, 20 bp, Homo sapiens
tgcaccccttctctcctccc

SEQ ID NO: 1769801 - DNA, 17 bp, Homo sapiens
tgcacccgcctcgacct

SEQ ID NO: 1769802 - DNA, 19 bp, Homo sapiens
tgcaccctgcgcctccaga

SEQ ID NO: 1769803 - DNA, 21 bp, Homo sapiens
tgcaccctgcgcctccagagg

SEQ ID NO: 1769804 - DNA, 12 bp, Homo sapiens
tgcaccctggaa

SEQ ID NO: 1769805 - DNA, 14 bp, Homo sapiens
tgcacccttccctc

SEQ ID NO: 1769806 - DNA, 17 bp, Homo sapiens
tgcaccgcctgccctcc

SEQ ID NO: 1769807 - DNA, 18 bp, Homo sapiens
tgcaccgcctgccctccc

SEQ ID NO: 1769808 - DNA, 16 bp, Homo sapiens
tgcacctattctgtag

SEQ ID NO: 1769809 - DNA, 14 bp, Homo sapiens
tgcacctcccccca

SEQ ID NO: 1769810 - DNA, 17 bp, Homo sapiens
tgcacctccccccactg

SEQ ID NO: 1769811 - DNA, 16 bp, Homo sapiens
tgcacctcccttccct

SEQ ID NO: 1769812 - DNA, 18 bp, Homo sapiens
tgcacctcccttccctcc

SEQ ID NO: 1769813 - DNA, 14 bp, Homo sapiens
tgcacctctggcta

SEQ ID NO: 1769814 - DNA, 22 bp, Homo sapiens
tgcacctcttgttactccctgt

SEQ ID NO: 1769815 - DNA, 19 bp, Homo sapiens
tgcacctgagaccctactg

SEQ ID NO: 1769816 - DNA, 15 bp, Homo sapiens
tgcacctgcaggctt

SEQ ID NO: 1769817 - DNA, 18 bp, Homo sapiens
tgcacctgcatccgtagt

SEQ ID NO: 1769818 - DNA, 18 bp, Homo sapiens
tgcacctgccagcctggc

SEQ ID NO: 1769819 - DNA, 18 bp, Homo sapiens
tgcacctgcctccaccag

SEQ ID NO: 1769820 - DNA, 13 bp, Homo sapiens
tgcacctgctgcg

SEQ ID NO: 1769821 - DNA, 15 bp, Homo sapiens
tgcacctgctgcgtc

SEQ ID NO: 1769822 - DNA, 16 bp, Homo sapiens
tgcacctgctgcgtcc

SEQ ID NO: 1769823 - DNA, 20 bp, Homo sapiens
tgcacctgctgcgtccccac

SEQ ID NO: 1769824 - DNA, 23 bp, Homo sapiens
tgcacctgctgcgtccccactcc

SEQ ID NO: 1769825 - DNA, 24 bp, Homo sapiens
tgcacctgctgcgtccccactccc

SEQ ID NO: 1769826 - DNA, 14 bp, Homo sapiens
tgcacctggcctgg

SEQ ID NO: 1769827 - DNA, 17 bp, Homo sapiens
tgcacctggcctgggcc

SEQ ID NO: 1769828 - DNA, 17 bp, Homo sapiens
tgcacctgtactcagga

SEQ ID NO: 1769829 - DNA, 16 bp, Homo sapiens
tgcaccttgtgtctgt

SEQ ID NO: 1769830 - DNA, 22 bp, Homo sapiens
tgcacctttttgcatgatatct

SEQ ID NO: 1769831 - DNA, 20 bp, Homo sapiens
tgcacgggcatgcacacggc

SEQ ID NO: 1769832 - DNA, 12 bp, Homo sapiens
tgcacgtggaga

SEQ ID NO: 1769833 - DNA, 16 bp, Homo sapiens
tgcacgtggagagctg

SEQ ID NO: 1769834 - DNA, 21 bp, Homo sapiens
tgcacgtggagagctggtgcc

SEQ ID NO: 1769835 - DNA, 15 bp, Homo sapiens
tgcacgtggcctctt

SEQ ID NO: 1769836 - DNA, 16 bp, Homo sapiens
tgcacgtggcctcttg

SEQ ID NO: 1769837 - DNA, 16 bp, Homo sapiens
tgcactactcctctgc

SEQ ID NO: 1769838 - DNA, 18 bp, Homo sapiens
tgcactactgacatgtgg

SEQ ID NO: 1769839 - DNA, 14 bp, Homo sapiens
tgcactagcctgtg

SEQ ID NO: 1769840 - DNA, 12 bp, Homo sapiens
tgcactcagatt

SEQ ID NO: 1769841 - DNA, 14 bp, Homo sapiens
tgcactccaatctg

SEQ ID NO: 1769842 - DNA, 12 bp, Homo sapiens
tgcactccagcc

SEQ ID NO: 1769843 - DNA, 14 bp, Homo sapiens
tgcactccagcctg

SEQ ID NO: 1769844 - DNA, 17 bp, Homo sapiens
tgcactccagcctgggc

SEQ ID NO: 1769845 - DNA, 18 bp, Homo sapiens
tgcactccagcctgggca

SEQ ID NO: 1769846 - DNA, 14 bp, Homo sapiens
tgcactcccacctg

SEQ ID NO: 1769847 - DNA, 19 bp, Homo sapiens
tgcactcccacctgacaca

SEQ ID NO: 1769848 - DNA, 15 bp, Homo sapiens
tgcactccggcctgg

SEQ ID NO: 1769849 - DNA, 12 bp, Homo sapiens
tgcactcgccat

SEQ ID NO: 1769850 - DNA, 14 bp, Homo sapiens
tgcactctgctaat

SEQ ID NO: 1769851 - DNA, 12 bp, Homo sapiens
tgcactcttcta

SEQ ID NO: 1769852 - DNA, 18 bp, Homo sapiens
tgcactcttgaactgggc

SEQ ID NO: 1769853 - DNA, 22 bp, Homo sapiens
tgcactgaagccggacagctgc

SEQ ID NO: 1769854 - DNA, 23 bp, Homo sapiens
tgcactgaagccggacagctgcc

SEQ ID NO: 1769855 - DNA, 21 bp, Homo sapiens
tgcactgacaccctggtcctg

SEQ ID NO: 1769856 - DNA, 12 bp, Homo sapiens
tgcactgaccct

SEQ ID NO: 1769857 - DNA, 17 bp, Homo sapiens
tgcactgacccttccag

SEQ ID NO: 1769858 - DNA, 16 bp, Homo sapiens
tgcactgagggccaca

SEQ ID NO: 1769859 - DNA, 17 bp, Homo sapiens
tgcactgatgctgcccc

SEQ ID NO: 1769860 - DNA, 21 bp, Homo sapiens
tgcactgatgttgtgttttta

SEQ ID NO: 1769861 - DNA, 20 bp, Homo sapiens
tgcactggagtccagtctct

SEQ ID NO: 1769862 - DNA, 22 bp, Homo sapiens
tgcatcctccaagaatctatct

SEQ ID NO: 1769863 - DNA, 13 bp, Homo sapiens
tgcatccttgtaa

SEQ ID NO: 1769864 - DNA, 15 bp, Homo sapiens
tgcatccttgtaata

SEQ ID NO: 1769865 - DNA, 19 bp, Homo sapiens
tgcatccttgtaatacctg

SEQ ID NO: 1769866 - DNA, 20 bp, Homo sapiens
tgcatccttgtaatacctga

SEQ ID NO: 1769867 - DNA, 19 bp, Homo sapiens
tgcatctactcccaagtat

SEQ ID NO: 1769868 - DNA, 18 bp, Homo sapiens
tgcatctagaaagctttg

SEQ ID NO: 1769869 - DNA, 12 bp, Homo sapiens
tgcatctctgtg

SEQ ID NO: 1769870 - DNA, 23 bp, Homo sapiens
tgcatctgggccagaagtcctcc

SEQ ID NO: 1769871 - DNA, 12 bp, Homo sapiens
tgcatctggtgt

SEQ ID NO: 1769872 - DNA, 20 bp, Homo sapiens
tgcatctggtgtaggaagtt

SEQ ID NO: 1769873 - DNA, 14 bp, Homo sapiens
tgcatgagctccct

SEQ ID NO: 1769874 - DNA, 20 bp, Homo sapiens
tgcatgagctggcaaccagc

SEQ ID NO: 1769875 - DNA, 17 bp, Homo sapiens
tgcatgatgtttgccca

SEQ ID NO: 1769876 - DNA, 16 bp, Homo sapiens
tgcatgattgcagaat

SEQ ID NO: 1769877 - DNA, 22 bp, Homo sapiens
tgcatgcaaatgagctctgaaa

SEQ ID NO: 1769878 - DNA, 16 bp, Homo sapiens
tgcatgcaatttgaag

SEQ ID NO: 1769879 - DNA, 14 bp, Homo sapiens
tgcatgcagttgat

SEQ ID NO: 1769880 - DNA, 17 bp, Homo sapiens
tgcatgctctctgcagc

SEQ ID NO: 1769881 - DNA, 14 bp, Homo sapiens
tgcatgctctggaa

SEQ ID NO: 1769882 - DNA, 15 bp, Homo sapiens
tgcatgctgaaacaa

SEQ ID NO: 1769883 - DNA, 17 bp, Homo sapiens
tgcatggacctaacatt

SEQ ID NO: 1769884 - DNA, 21 bp, Homo sapiens
tgcatggacctaacattcgat

SEQ ID NO: 1769885 - DNA, 13 bp, Homo sapiens
tgcatggactgtg

SEQ ID NO: 1769886 - DNA, 17 bp, Homo sapiens
tgcatggaggactctcc

SEQ ID NO: 1769887 - DNA, 19 bp, Homo sapiens
tgcatggaggactctcctc

SEQ ID NO: 1769888 - DNA, 19 bp, Homo sapiens
tgcatggctccagaaatgt

SEQ ID NO: 1769889 - DNA, 16 bp, Homo sapiens
tgcatggggaggcagc

SEQ ID NO: 1769890 - DNA, 18 bp, Homo sapiens
tgcatggggaggcagcag

SEQ ID NO: 1769891 - DNA, 18 bp, Homo sapiens
tgcatggtgccccaggac

SEQ ID NO: 1769892 - DNA, 19 bp, Homo sapiens
tgcatggtgccccaggacc

SEQ ID NO: 1769893 - DNA, 14 bp, Homo sapiens
tgcatggtggccag

SEQ ID NO: 1769894 - DNA, 18 bp, Homo sapiens
tgcatgtagaggcttgtt

SEQ ID NO: 1769895 - DNA, 12 bp, Homo sapiens
tgcatgtagtaa

SEQ ID NO: 1769896 - DNA, 14 bp, Homo sapiens
tgcatgtatgtctt

SEQ ID NO: 1769897 - DNA, 12 bp, Homo sapiens
tgcatgtattag

SEQ ID NO: 1769898 - DNA, 16 bp, Homo sapiens
tgcatgtcctgtaaag

SEQ ID NO: 1769899 - DNA, 23 bp, Homo sapiens
tgcatgtcctttgcgcctgtgac

SEQ ID NO: 1769900 - DNA, 23 bp, Homo sapiens
tgcatgtctactcagcatttgat

SEQ ID NO: 1769901 - DNA, 17 bp, Homo sapiens
tgcatgtgaagcatgct

SEQ ID NO: 1769902 - DNA, 23 bp, Homo sapiens
tgcatgtgaagcatgctttgctg

SEQ ID NO: 1769903 - DNA, 14 bp, Homo sapiens
tgcatgtgtgtgtg

SEQ ID NO: 1769904 - DNA, 19 bp, Homo sapiens
tgcatgttacataagataa

SEQ ID NO: 1769905 - DNA, 22 bp, Homo sapiens
tgcatgttaggaaaatttcaca

SEQ ID NO: 1769906 - DNA, 19 bp, Homo sapiens
tgcattaaaatttcttatt

SEQ ID NO: 1769907 - DNA, 22 bp, Homo sapiens
tgcattagaaatagacagtata

SEQ ID NO: 1769908 - DNA, 19 bp, Homo sapiens
tgcattagggatgcctcct

SEQ ID NO: 1769909 - DNA, 15 bp, Homo sapiens
tgcattatgtacaca

SEQ ID NO: 1769910 - DNA, 17 bp, Homo sapiens
tgcattattaaattgta

SEQ ID NO: 1769911 - DNA, 20 bp, Homo sapiens
tgcattcacccagacagctc

SEQ ID NO: 1769912 - DNA, 21 bp, Homo sapiens
tgcattcatgcaagagtttct

SEQ ID NO: 1769913 - DNA, 17 bp, Homo sapiens
tgcattccagaatcttg

SEQ ID NO: 1769914 - DNA, 18 bp, Homo sapiens
tgcattccagctgtcact

SEQ ID NO: 1769915 - DNA, 22 bp, Homo sapiens
tgcattccctgaatctgtgcct

SEQ ID NO: 1769916 - DNA, 23 bp, Homo sapiens
tgcattcctgatatgatttaaaa

SEQ ID NO: 1769917 - DNA, 15 bp, Homo sapiens
tgcattcctgtgccc

SEQ ID NO: 1769918 - DNA, 16 bp, Homo sapiens
tgcattcctttgtctt

SEQ ID NO: 1769919 - DNA, 18 bp, Homo sapiens
tgcattcctttgtcttca

SEQ ID NO: 1769920 - DNA, 20 bp, Homo sapiens
tgcattcctttgtcttcaaa

SEQ ID NO: 1769921 - DNA, 15 bp, Homo sapiens
tgcattctctcccat

SEQ ID NO: 1769922 - DNA, 20 bp, Homo sapiens
tgcattctctcccatcctgg

SEQ ID NO: 1769923 - DNA, 21 bp, Homo sapiens
tgcattctgccgtgtgccctc

SEQ ID NO: 1769924 - DNA, 19 bp, Homo sapiens
tgcattctgcctctctagg

SEQ ID NO: 1769925 - DNA, 18 bp, Homo sapiens
tgcattctggccaagggg

SEQ ID NO: 1769926 - DNA, 14 bp, Homo sapiens
tgcattctttggta

SEQ ID NO: 1769927 - DNA, 16 bp, Homo sapiens
tgcattgcctgtaaca

SEQ ID NO: 1769928 - DNA, 17 bp, Homo sapiens
tgcattgctagataaaa

SEQ ID NO: 1769929 - DNA, 22 bp, Homo sapiens
tgcattgctgtgtgaatccagg

SEQ ID NO: 1769930 - DNA, 19 bp, Homo sapiens
tgcattggaagaccccacc

SEQ ID NO: 1769931 - DNA, 13 bp, Homo sapiens
tgcattggcctct

SEQ ID NO: 1769932 - DNA, 15 bp, Homo sapiens
tgcattggcctctgt

SEQ ID NO: 1769933 - DNA, 17 bp, Homo sapiens
tgcattgtcttgtggag

SEQ ID NO: 1769934 - DNA, 16 bp, Homo sapiens
tgcattgtgacaagaa

SEQ ID NO: 1769935 - DNA, 19 bp, Homo sapiens
tgcattgtgattggcctgt

SEQ ID NO: 1769936 - DNA, 14 bp, Homo sapiens
tgcattgttataat

SEQ ID NO: 1769937 - DNA, 17 bp, Homo sapiens
tgcattgttattgtgga

SEQ ID NO: 1769938 - DNA, 18 bp, Homo sapiens
tgcattgttattgtggaa

SEQ ID NO: 1769939 - DNA, 13 bp, Homo sapiens
tgcattgttattt

SEQ ID NO: 1769940 - DNA, 19 bp, Homo sapiens
tgcatttaaaacagacact

SEQ ID NO: 1769941 - DNA, 18 bp, Homo sapiens
tgcatttaaactcatttg

SEQ ID NO: 1769942 - DNA, 14 bp, Homo sapiens
tgcatttaataaag

SEQ ID NO: 1769943 - DNA, 15 bp, Homo sapiens
tgcatttaataaaga

SEQ ID NO: 1769944 - DNA, 23 bp, Homo sapiens
tgcatttaataaagatgagttgg

SEQ ID NO: 1769945 - DNA, 20 bp, Homo sapiens
tgcatttcacatgccttgca

SEQ ID NO: 1769946 - DNA, 18 bp, Homo sapiens
tgcatttcacctgtgaca

SEQ ID NO: 1769947 - DNA, 12 bp, Homo sapiens
tgcatttcagaa

SEQ ID NO: 1769948 - DNA, 14 bp, Homo sapiens
tgcatttctcttcc

SEQ ID NO: 1769949 - DNA, 13 bp, Homo sapiens
tgcatttggaaca

SEQ ID NO: 1769950 - DNA, 23 bp, Homo sapiens
tgcatttgtggtaatctacacca

SEQ ID NO: 1769951 - DNA, 19 bp, Homo sapiens
tgcattttgtttctgtata

SEQ ID NO: 1769952 - DNA, 13 bp, Homo sapiens
tgcatttttaccc

SEQ ID NO: 1769953 - DNA, 19 bp, Homo sapiens
tgcatttttattaaagcat

SEQ ID NO: 1769954 - DNA, 21 bp, Homo sapiens
tgcatttttattaaagcattt

SEQ ID NO: 1769955 - DNA, 21 bp, Homo sapiens
tgcatttttcttatttatatc

SEQ ID NO: 1769956 - DNA, 16 bp, Homo sapiens
tgcatttttgtgaaat

SEQ ID NO: 1769957 - DNA, 21 bp, Homo sapiens
tgcatttttttcattactgtt

SEQ ID NO: 1769958 - DNA, 17 bp, Homo sapiens
tgccaaaaactaaaatt

SEQ ID NO: 1769959 - DNA, 13 bp, Homo sapiens
tgccaaacagagt

SEQ ID NO: 1769960 - DNA, 21 bp, Homo sapiens
tgccaaagctagggtggccct

SEQ ID NO: 1769961 - DNA, 22 bp, Homo sapiens
tgccaaagctagggtggccctt

SEQ ID NO: 1769962 - DNA, 21 bp, Homo sapiens
tgccaaagctttactactgtg

SEQ ID NO: 1769963 - DNA, 18 bp, Homo sapiens
tgccaaagggaaatatca

SEQ ID NO: 1769964 - DNA, 19 bp, Homo sapiens
tgccaaagtacagaatttg

SEQ ID NO: 1769965 - DNA, 22 bp, Homo sapiens
tgccaaagtacagaatttgaat

SEQ ID NO: 1769966 - DNA, 23 bp, Homo sapiens
tgccaaagtgtctacatgtgcca

SEQ ID NO: 1769967 - DNA, 14 bp, Homo sapiens
tgccaaatcagttt

SEQ ID NO: 1769968 - DNA, 19 bp, Homo sapiens
tgccaaattctccggtttg

SEQ ID NO: 1769969 - DNA, 15 bp, Homo sapiens
tgccaaattgagata

SEQ ID NO: 1769970 - DNA, 15 bp, Homo sapiens
tgccaaattgctgca

SEQ ID NO: 1769971 - DNA, 19 bp, Homo sapiens
tgccaacatgaggacagaa

SEQ ID NO: 1769972 - DNA, 12 bp, Homo sapiens
tgccaacctaaa

SEQ ID NO: 1769973 - DNA, 16 bp, Homo sapiens
tgccaacctctggagc

SEQ ID NO: 1769974 - DNA, 18 bp, Homo sapiens
tgccaactgatctgttat

SEQ ID NO: 1769975 - DNA, 19 bp, Homo sapiens
tgccaagacattaattttt

SEQ ID NO: 1769976 - DNA, 18 bp, Homo sapiens
tgcccagcaggcccagca

SEQ ID NO: 1769977 - DNA, 16 bp, Homo sapiens
tgcccagcccctgccc

SEQ ID NO: 1769978 - DNA, 16 bp, Homo sapiens
tgcccagccgggcaca

SEQ ID NO: 1769979 - DNA, 13 bp, Homo sapiens
tgcccagctctct

SEQ ID NO: 1769980 - DNA, 14 bp, Homo sapiens
tgcccagctctctg

SEQ ID NO: 1769981 - DNA, 16 bp, Homo sapiens
tgcccagctctctgac

SEQ ID NO: 1769982 - DNA, 14 bp, Homo sapiens
tgcccagcttgggc

SEQ ID NO: 1769983 - DNA, 16 bp, Homo sapiens
tgcccaggagagccag

SEQ ID NO: 1769984 - DNA, 17 bp, Homo sapiens
tgcccaggagagccagc

SEQ ID NO: 1769985 - DNA, 23 bp, Homo sapiens
tgcccaggagagccagccctccc

SEQ ID NO: 1769986 - DNA, 15 bp, Homo sapiens
tgcccaggagcagct

SEQ ID NO: 1769987 - DNA, 16 bp, Homo sapiens
tgcccaggcagtcttt

SEQ ID NO: 1769988 - DNA, 19 bp, Homo sapiens
tgcccaggcagtctttgct

SEQ ID NO: 1769989 - DNA, 16 bp, Homo sapiens
tgcccaggcccttggc

SEQ ID NO: 1769990 - DNA, 21 bp, Homo sapiens
tgcccaggcccttggctgcag

SEQ ID NO: 1769991 - DNA, 20 bp, Homo sapiens
tgcccaggcctatctggaag

SEQ ID NO: 1769992 - DNA, 20 bp, Homo sapiens
tgcccaggcctctcggtgct

SEQ ID NO: 1769993 - DNA, 13 bp, Homo sapiens
tgcccaggctgga

SEQ ID NO: 1769994 - DNA, 15 bp, Homo sapiens
tgcccaggctggagt

SEQ ID NO: 1769995 - DNA, 20 bp, Homo sapiens
tgcccaggctggagtgcagt

SEQ ID NO: 1769996 - DNA, 19 bp, Homo sapiens
tgcccagggccactctgcc

SEQ ID NO: 1769997 - DNA, 11 bp, Homo sapiens
tgcccagggct

SEQ ID NO: 1769998 - DNA, 17 bp, Homo sapiens
tgcccagggctcagcct

SEQ ID NO: 1769999 - DNA, 19 bp, Homo sapiens
tgcccagggctcagcctgg

SEQ ID NO: 1770000 - DNA, 11 bp, Homo sapiens
tgcccaggggt

SEQ ID NO: 1770001 - DNA, 21 bp, Homo sapiens
tgcccaggggtgccccctcct

SEQ ID NO: 1770002 - DNA, 22 bp, Homo sapiens
tgcccaggggtgccccctcctc

SEQ ID NO: 1770003 - DNA, 23 bp, Homo sapiens
tgcccaggggtgccccctcctct

SEQ ID NO: 1770004 - DNA, 17 bp, Homo sapiens
tgcccagggtcctgtgc

SEQ ID NO: 1770005 - DNA, 16 bp, Homo sapiens
tgcccagtcgacccca

SEQ ID NO: 1770006 - DNA, 12 bp, Homo sapiens
tgcccagtgttg

SEQ ID NO: 1770007 - DNA, 19 bp, Homo sapiens
tgcccagtgttgtttgtaa

SEQ ID NO: 1770008 - DNA, 18 bp, Homo sapiens
tgcccatcatgtggcccc

SEQ ID NO: 1770009 - DNA, 20 bp, Homo sapiens
tgcccatcgtgaagaagcct

SEQ ID NO: 1770010 - DNA, 22 bp, Homo sapiens
tgcccatcgtgaagaagcctgt

SEQ ID NO: 1770011 - DNA, 18 bp, Homo sapiens
tgcccattcaccaaaatt

SEQ ID NO: 1770012 - DNA, 19 bp, Homo sapiens
tgcccattcaccaaaatta

SEQ ID NO: 1770013 - DNA, 16 bp, Homo sapiens
tgcccattctcttagt

SEQ ID NO: 1770014 - DNA, 16 bp, Homo sapiens
tgccccaacctgctga

SEQ ID NO: 1770015 - DNA, 14 bp, Homo sapiens
tgccccaagcagcc

SEQ ID NO: 1770016 - DNA, 15 bp, Homo sapiens
tgccccaagcagcca

SEQ ID NO: 1770017 - DNA, 17 bp, Homo sapiens
tgccccaagcagccagc

SEQ ID NO: 1770018 - DNA, 18 bp, Homo sapiens
tgccccaagcagccagcc

SEQ ID NO: 1770019 - DNA, 22 bp, Homo sapiens
tgccccaatcgggtccagagac

SEQ ID NO: 1770020 - DNA, 18 bp, Homo sapiens
tgccccacatgtggccat

SEQ ID NO: 1770021 - DNA, 13 bp, Homo sapiens
tgccccaccccat

SEQ ID NO: 1770022 - DNA, 19 bp, Homo sapiens
tgccccaccccatccagcc

SEQ ID NO: 1770023 - DNA, 20 bp, Homo sapiens
tgccccacctcccccttccc

SEQ ID NO: 1770024 - DNA, 12 bp, Homo sapiens
tgccccactcca

SEQ ID NO: 1770025 - DNA, 17 bp, Homo sapiens
tgccccactccagcctg

SEQ ID NO: 1770026 - DNA, 16 bp, Homo sapiens
tgccccactctgcctg

SEQ ID NO: 1770027 - DNA, 17 bp, Homo sapiens
tgccccagactgagctc

SEQ ID NO: 1770028 - DNA, 17 bp, Homo sapiens
tgccccagagctgttta

SEQ ID NO: 1770029 - DNA, 13 bp, Homo sapiens
tgccccagagtgg

SEQ ID NO: 1770030 - DNA, 13 bp, Homo sapiens
tgccccagcccag

SEQ ID NO: 1770031 - DNA, 13 bp, Homo sapiens
tgccccagccccg

SEQ ID NO: 1770032 - DNA, 19 bp, Homo sapiens
tgccccagctctggcttcc

SEQ ID NO: 1770033 - DNA, 19 bp, Homo sapiens
tgccccaggaccagctcag

SEQ ID NO: 1770034 - DNA, 13 bp, Homo sapiens
tgccccaggccct

SEQ ID NO: 1770035 - DNA, 20 bp, Homo sapiens
tgccccaggccggagcccag

SEQ ID NO: 1770036 - DNA, 22 bp, Homo sapiens
tgccccagtcggccccatctct

SEQ ID NO: 1770037 - DNA, 21 bp, Homo sapiens
tgccccatccagacctggctc

SEQ ID NO: 1770038 - DNA, 15 bp, Homo sapiens
tgccccatgcctgtc

SEQ ID NO: 1770039 - DNA, 17 bp, Homo sapiens
tgcccccactgaccaga

SEQ ID NO: 1770040 - DNA, 20 bp, Homo sapiens
tgcccccagccccggggtga

SEQ ID NO: 1770041 - DNA, 15 bp, Homo sapiens
tgcccccaggactgg

SEQ ID NO: 1770042 - DNA, 19 bp, Homo sapiens
tgcccccaggactgggcca

SEQ ID NO: 1770043 - DNA, 15 bp, Homo sapiens
tgcccccatccctcg

SEQ ID NO: 1770044 - DNA, 18 bp, Homo sapiens
tgcccccatctccccagg

SEQ ID NO: 1770045 - DNA, 19 bp, Homo sapiens
tgcccccatctccccaggc

SEQ ID NO: 1770046 - DNA, 18 bp, Homo sapiens
tgccccccgaggctgcta

SEQ ID NO: 1770047 - DNA, 17 bp, Homo sapiens
tgcccccctcctccagt

SEQ ID NO: 1770048 - DNA, 13 bp, Homo sapiens
tgcccccgcctgc

SEQ ID NO: 1770049 - DNA, 14 bp, Homo sapiens
tgcccccgcctgcc

SEQ ID NO: 1770050 - DNA, 18 bp, Homo sapiens
tgcccccgcgggttctag

SEQ ID NO: 1770051 - DNA, 16 bp, Homo sapiens
tgcccccgttccagct

SEQ ID NO: 1770052 - DNA, 19 bp, Homo sapiens
tgcccccgttccagctgac

SEQ ID NO: 1770053 - DNA, 16 bp, Homo sapiens
tgccccctcctctccc

SEQ ID NO: 1770054 - DNA, 20 bp, Homo sapiens
tgccccctcctctcccatcc

SEQ ID NO: 1770055 - DNA, 21 bp, Homo sapiens
tgccccctcctctcccatccc

SEQ ID NO: 1770056 - DNA, 21 bp, Homo sapiens
tgccccctcgggggcctgtgg

SEQ ID NO: 1770057 - DNA, 14 bp, Homo sapiens
tgccccctctcact

SEQ ID NO: 1770058 - DNA, 13 bp, Homo sapiens
tgccccctgctta

SEQ ID NO: 1770059 - DNA, 13 bp, Homo sapiens
tgccccctggtgg

SEQ ID NO: 1770060 - DNA, 21 bp, Homo sapiens
tgccccctggtggacagtcct

SEQ ID NO: 1770061 - DNA, 22 bp, Homo sapiens
tgccccctttcagatgtcttct

SEQ ID NO: 1770062 - DNA, 22 bp, Homo sapiens
tgccccgcccccagtccccacc

SEQ ID NO: 1770063 - DNA, 23 bp, Homo sapiens
tgccccgggtccccagctcccca

SEQ ID NO: 1770064 - DNA, 18 bp, Homo sapiens
tgccccgttccctgtcag

SEQ ID NO: 1770065 - DNA, 17 bp, Homo sapiens
tgcccctaatctctgta

SEQ ID NO: 1770066 - DNA, 18 bp, Homo sapiens
tgcccctaggatgctgca

SEQ ID NO: 1770067 - DNA, 18 bp, Homo sapiens
tgcccctattgggagagg

SEQ ID NO: 1770068 - DNA, 17 bp, Homo sapiens
tgcccctcccccaaccc

SEQ ID NO: 1770069 - DNA, 12 bp, Homo sapiens
tgcccctcccct

SEQ ID NO: 1770070 - DNA, 13 bp, Homo sapiens
tgcccctcccctc

SEQ ID NO: 1770071 - DNA, 16 bp, Homo sapiens
tgcccctcccttcaac

SEQ ID NO: 1770072 - DNA, 20 bp, Homo sapiens
tgcccctccgatgctgaggc

SEQ ID NO: 1770073 - DNA, 12 bp, Homo sapiens
tgcccctctcac

SEQ ID NO: 1770074 - DNA, 15 bp, Homo sapiens
tgcccctctccttct

SEQ ID NO: 1770075 - DNA, 16 bp, Homo sapiens
tgcccctggcacctgt

SEQ ID NO: 1770076 - DNA, 13 bp, Homo sapiens
tgcccctggcttt

SEQ ID NO: 1770077 - DNA, 14 bp, Homo sapiens
tgcccctggctttg

SEQ ID NO: 1770078 - DNA, 21 bp, Homo sapiens
tgcccctggctttgcctcttc

SEQ ID NO: 1770079 - DNA, 18 bp, Homo sapiens
tgccccttgggcatccac

SEQ ID NO: 1770080 - DNA, 21 bp, Homo sapiens
tgccccttgggcatccaccca

SEQ ID NO: 1770081 - DNA, 15 bp, Homo sapiens
tgcccgagagagctc

SEQ ID NO: 1770082 - DNA, 16 bp, Homo sapiens
tgcccgagagagctct

SEQ ID NO: 1770083 - DNA, 14 bp, Homo sapiens
tgcccgcacccctc

SEQ ID NO: 1770084 - DNA, 20 bp, Homo sapiens
tgcccgcacccctccctgct

SEQ ID NO: 1770085 - DNA, 14 bp, Homo sapiens
tgcccgccagcctc

SEQ ID NO: 1770086 - DNA, 20 bp, Homo sapiens
tgcccgctcccaacccccct

SEQ ID NO: 1770087 - DNA, 13 bp, Homo sapiens
tgcccgctcctcg

SEQ ID NO: 1770088 - DNA, 16 bp, Homo sapiens
tgcccggcgccgggca

SEQ ID NO: 1770089 - DNA, 18 bp, Homo sapiens
tgcccggggaaaggcaag

SEQ ID NO: 1770090 - DNA, 17 bp, Homo sapiens
tgcccgtaatcccagct

SEQ ID NO: 1770091 - DNA, 17 bp, Homo sapiens
tgcctgcaccaggagac

SEQ ID NO: 1770092 - DNA, 20 bp, Homo sapiens
tgcctgcacccttccctctt

SEQ ID NO: 1770093 - DNA, 16 bp, Homo sapiens
tgcctgcactccctgg

SEQ ID NO: 1770094 - DNA, 20 bp, Homo sapiens
tgcctgcagaggtctgtgct

SEQ ID NO: 1770095 - DNA, 21 bp, Homo sapiens
tgcctgcagaggtctgtgctg

SEQ ID NO: 1770096 - DNA, 15 bp, Homo sapiens
tgcctgcagccccgc

SEQ ID NO: 1770097 - DNA, 22 bp, Homo sapiens
tgcctgcagccccgcgcctcct

SEQ ID NO: 1770098 - DNA, 21 bp, Homo sapiens
tgcctgcaggtcagttgtaat

SEQ ID NO: 1770099 - DNA, 23 bp, Homo sapiens
tgcctgcaggtcagttgtaataa

SEQ ID NO: 1770100 - DNA, 16 bp, Homo sapiens
tgcctgcatgagctgg

SEQ ID NO: 1770101 - DNA, 18 bp, Homo sapiens
tgcctgcatgagctggca

SEQ ID NO: 1770102 - DNA, 21 bp, Homo sapiens
tgcctgcatgagctggcaacc

SEQ ID NO: 1770103 - DNA, 15 bp, Homo sapiens
tgcctgcatgtattt

SEQ ID NO: 1770104 - DNA, 16 bp, Homo sapiens
tgcctgccactctctg

SEQ ID NO: 1770105 - DNA, 21 bp, Homo sapiens
tgcctgccactctctgggact

SEQ ID NO: 1770106 - DNA, 15 bp, Homo sapiens
tgcctgccagctgca

SEQ ID NO: 1770107 - DNA, 18 bp, Homo sapiens
tgcctgccccaaacaaat

SEQ ID NO: 1770108 - DNA, 20 bp, Homo sapiens
tgcctgccccaaacaaatat

SEQ ID NO: 1770109 - DNA, 22 bp, Homo sapiens
tgcctgcccctaccctggactt

SEQ ID NO: 1770110 - DNA, 18 bp, Homo sapiens
tgcctgcccgcaccctgg

SEQ ID NO: 1770111 - DNA, 19 bp, Homo sapiens
tgcctgcccgcaccctggc

SEQ ID NO: 1770112 - DNA, 21 bp, Homo sapiens
tgcctgcccgcaccctggcct

SEQ ID NO: 1770113 - DNA, 22 bp, Homo sapiens
tgcctgcccgcaccctggcctg

SEQ ID NO: 1770114 - DNA, 14 bp, Homo sapiens
tgcctgcctcccct

SEQ ID NO: 1770115 - DNA, 14 bp, Homo sapiens
tgcctgcctgtctg

SEQ ID NO: 1770116 - DNA, 18 bp, Homo sapiens
tgcctgcctttgtgtcag

SEQ ID NO: 1770117 - DNA, 18 bp, Homo sapiens
tgcctgctagagcaaccc

SEQ ID NO: 1770118 - DNA, 15 bp, Homo sapiens
tgcctgctcagcagc

SEQ ID NO: 1770119 - DNA, 18 bp, Homo sapiens
tgcctgctcagcagccag

SEQ ID NO: 1770120 - DNA, 21 bp, Homo sapiens
tgcctgctcagcagccagtct

SEQ ID NO: 1770121 - DNA, 23 bp, Homo sapiens
tgcctgctcagcagccagtctca

SEQ ID NO: 1770122 - DNA, 19 bp, Homo sapiens
tgcctgctccctgtctgtg

SEQ ID NO: 1770123 - DNA, 21 bp, Homo sapiens
tgcctgctccctgtctgtgtc

SEQ ID NO: 1770124 - DNA, 14 bp, Homo sapiens
tgcctgctggggat

SEQ ID NO: 1770125 - DNA, 21 bp, Homo sapiens
tgcctgctgtgttaagaggac

SEQ ID NO: 1770126 - DNA, 14 bp, Homo sapiens
tgcctgcttgataa

SEQ ID NO: 1770127 - DNA, 17 bp, Homo sapiens
tgcctgcttggcccggc

SEQ ID NO: 1770128 - DNA, 22 bp, Homo sapiens
tgcctgctttttggaaagtcag

SEQ ID NO: 1770129 - DNA, 15 bp, Homo sapiens
tgcctggaaaacagg

SEQ ID NO: 1770130 - DNA, 23 bp, Homo sapiens
tgcctggaacaccagcagcactg

SEQ ID NO: 1770131 - DNA, 19 bp, Homo sapiens
tgcctggagacaaggtgct

SEQ ID NO: 1770132 - DNA, 20 bp, Homo sapiens
tgcctggagacaaggtgcta

SEQ ID NO: 1770133 - DNA, 20 bp, Homo sapiens
tgcctggagacttagggcac

SEQ ID NO: 1770134 - DNA, 14 bp, Homo sapiens
tgcctggaggccag

SEQ ID NO: 1770135 - DNA, 22 bp, Homo sapiens
tgcctggagtgtcggatcctgt

SEQ ID NO: 1770136 - DNA, 14 bp, Homo sapiens
tgcctggccaggca

SEQ ID NO: 1770137 - DNA, 16 bp, Homo sapiens
tgcctggccaggcaga

SEQ ID NO: 1770138 - DNA, 16 bp, Homo sapiens
tgcctggccaggccct

SEQ ID NO: 1770139 - DNA, 17 bp, Homo sapiens
tgcctggccaggccctg

SEQ ID NO: 1770140 - DNA, 13 bp, Homo sapiens
tgcctggcctggc

SEQ ID NO: 1770141 - DNA, 16 bp, Homo sapiens
tgcctggcctggcaca

SEQ ID NO: 1770142 - DNA, 17 bp, Homo sapiens
tgcctggcctggcacac

SEQ ID NO: 1770143 - DNA, 11 bp, Homo sapiens
tgcctggctgt

SEQ ID NO: 1770144 - DNA, 15 bp, Homo sapiens
tgcctggctgtggag

SEQ ID NO: 1770145 - DNA, 17 bp, Homo sapiens
tgcctggctgtggaggc

SEQ ID NO: 1770146 - DNA, 20 bp, Homo sapiens
tgcctggctgtggaggcctg

SEQ ID NO: 1770147 - DNA, 21 bp, Homo sapiens
tgcctgggcccggaagggctt

SEQ ID NO: 1770148 - DNA, 15 bp, Homo sapiens
tgcctgggccctggg

SEQ ID NO: 1770149 - DNA, 17 bp, Homo sapiens
tgcctgggccctgggct

SEQ ID NO: 1770150 - DNA, 19 bp, Homo sapiens
tgcctgggccctgggctga

SEQ ID NO: 1770151 - DNA, 14 bp, Homo sapiens
tgcctgggcctgtg

SEQ ID NO: 1770152 - DNA, 17 bp, Homo sapiens
tgcctgggcctgtgcag

SEQ ID NO: 1770153 - DNA, 20 bp, Homo sapiens
tgcctgggcctgtgcagcag

SEQ ID NO: 1770154 - DNA, 17 bp, Homo sapiens
tgcctggggcctccaga

SEQ ID NO: 1770155 - DNA, 21 bp, Homo sapiens
tgcctggggcctccagaagct

SEQ ID NO: 1770156 - DNA, 22 bp, Homo sapiens
tgcctggggcctccagaagctg

SEQ ID NO: 1770157 - DNA, 12 bp, Homo sapiens
tgcctggggtct

SEQ ID NO: 1770158 - DNA, 16 bp, Homo sapiens
tgcctgggtggggctg

SEQ ID NO: 1770159 - DNA, 17 bp, Homo sapiens
tgcctgggtggggctgc

SEQ ID NO: 1770160 - DNA, 21 bp, Homo sapiens
tgcctgggtggggctgctcct

SEQ ID NO: 1770161 - DNA, 23 bp, Homo sapiens
tgcctgggtggggctgctcctcc

SEQ ID NO: 1770162 - DNA, 24 bp, Homo sapiens
tgcctgggtggggctgctcctcca

SEQ ID NO: 1770163 - DNA, 14 bp, Homo sapiens
tgcctggtattttc

SEQ ID NO: 1770164 - DNA, 16 bp, Homo sapiens
tgcctggtattttcaa

SEQ ID NO: 1770165 - DNA, 21 bp, Homo sapiens
tgcctggtcagaaggccagcc

SEQ ID NO: 1770166 - DNA, 19 bp, Homo sapiens
tgcctggtcccagagtggc

SEQ ID NO: 1770167 - DNA, 20 bp, Homo sapiens
tgcctggtcctccctcccaa

SEQ ID NO: 1770168 - DNA, 20 bp, Homo sapiens
tgcctggtgcttccaaatat

SEQ ID NO: 1770169 - DNA, 15 bp, Homo sapiens
tgcctgtaaacatag

SEQ ID NO: 1770170 - DNA, 18 bp, Homo sapiens
tgcctgtaacaatgtaat

SEQ ID NO: 1770171 - DNA, 23 bp, Homo sapiens
tgcctgtagctttcctggtccct

SEQ ID NO: 1770172 - DNA, 15 bp, Homo sapiens
tgcctgtatttccaa

SEQ ID NO: 1770173 - DNA, 17 bp, Homo sapiens
tgcctgtcacgctctgg

SEQ ID NO: 1770174 - DNA, 19 bp, Homo sapiens
tgcctgtccagcctgggca

SEQ ID NO: 1770175 - DNA, 20 bp, Homo sapiens
tgcctgtccagcctgggcag

SEQ ID NO: 1770176 - DNA, 21 bp, Homo sapiens
tgcctgtccttgaaaaacaaa

SEQ ID NO: 1770177 - DNA, 22 bp, Homo sapiens
tgcctgtctcctttgcaggctc

SEQ ID NO: 1770178 - DNA, 15 bp, Homo sapiens
tgcctgtctggctca

SEQ ID NO: 1770179 - DNA, 16 bp, Homo sapiens
tgcctgtctggctcag

SEQ ID NO: 1770180 - DNA, 20 bp, Homo sapiens
tgcctgtgaagaaccctgca

SEQ ID NO: 1770181 - DNA, 16 bp, Homo sapiens
tgcctgtgaggcaggg

SEQ ID NO: 1770182 - DNA, 17 bp, Homo sapiens
tgcctgtgctcctgccc

SEQ ID NO: 1770183 - DNA, 19 bp, Homo sapiens
tgcctgtgctcctgcccag

SEQ ID NO: 1770184 - DNA, 11 bp, Homo sapiens
tgcctgtggcg

SEQ ID NO: 1770185 - DNA, 12 bp, Homo sapiens
tgcctgtgtgct

SEQ ID NO: 1770186 - DNA, 20 bp, Homo sapiens
tgcctgttataactctgcac

SEQ ID NO: 1770187 - DNA, 14 bp, Homo sapiens
tgcctgttctgctt

SEQ ID NO: 1770188 - DNA, 15 bp, Homo sapiens
tgcctgttggcaggc

SEQ ID NO: 1770189 - DNA, 18 bp, Homo sapiens
tgcctgttggcaggccca

SEQ ID NO: 1770190 - DNA, 20 bp, Homo sapiens
tgcctgttggcaggcccact

SEQ ID NO: 1770191 - DNA, 19 bp, Homo sapiens
tgcctgttggctgctgcgg

SEQ ID NO: 1770192 - DNA, 16 bp, Homo sapiens
tgccttaaaaccaaag

SEQ ID NO: 1770193 - DNA, 22 bp, Homo sapiens
tgccttaaaaccaaagagggct

SEQ ID NO: 1770194 - DNA, 20 bp, Homo sapiens
tgccttaaaaggagagaaga

SEQ ID NO: 1770195 - DNA, 17 bp, Homo sapiens
tgccttaaacctacctc

SEQ ID NO: 1770196 - DNA, 14 bp, Homo sapiens
tgccttaagcagaa

SEQ ID NO: 1770197 - DNA, 15 bp, Homo sapiens
tgccttaataaatat

SEQ ID NO: 1770198 - DNA, 19 bp, Homo sapiens
tgccttacatcttttctaa

SEQ ID NO: 1770199 - DNA, 22 bp, Homo sapiens
tgccttaccaagttgtgctttt

SEQ ID NO: 1770200 - DNA, 15 bp, Homo sapiens
tgccttacctcctgc

SEQ ID NO: 1770201 - DNA, 19 bp, Homo sapiens
tgccttacctcctgcccag

SEQ ID NO: 1770202 - DNA, 15 bp, Homo sapiens
tgccttactcttctt

SEQ ID NO: 1770203 - DNA, 22 bp, Homo sapiens
tgccttactggtttccccaggg

SEQ ID NO: 1770204 - DNA, 14 bp, Homo sapiens
tgccttagaacctt

SEQ ID NO: 1770205 - DNA, 15 bp, Homo sapiens
tgcgggcctggccct

SEQ ID NO: 1770206 - DNA, 12 bp, Homo sapiens
tgcgggctcgcc

SEQ ID NO: 1770207 - DNA, 21 bp, Homo sapiens
tgcgggtcaacatttccaaaa

SEQ ID NO: 1770208 - DNA, 15 bp, Homo sapiens
tgcgggtctgaagga

SEQ ID NO: 1770209 - DNA, 23 bp, Homo sapiens
tgcgggtggggcttggggctcac

SEQ ID NO: 1770210 - DNA, 20 bp, Homo sapiens
tgcggttataaaaaatggtt

SEQ ID NO: 1770211 - DNA, 13 bp, Homo sapiens
tgcgtacacagag

SEQ ID NO: 1770212 - DNA, 17 bp, Homo sapiens
tgcgtacacagagaagg

SEQ ID NO: 1770213 - DNA, 23 bp, Homo sapiens
tgcgtacgtttcctgagaagtgt

SEQ ID NO: 1770214 - DNA, 21 bp, Homo sapiens
tgcgtacttgtaatatgtata

SEQ ID NO: 1770215 - DNA, 23 bp, Homo sapiens
tgcgtatatgtgcgtctctcttt

SEQ ID NO: 1770216 - DNA, 13 bp, Homo sapiens
tgcgtcccagctg

SEQ ID NO: 1770217 - DNA, 14 bp, Homo sapiens
tgcgtcccagctga

SEQ ID NO: 1770218 - DNA, 15 bp, Homo sapiens
tgcgtcccagctgaa

SEQ ID NO: 1770219 - DNA, 13 bp, Homo sapiens
tgcgtccccactc

SEQ ID NO: 1770220 - DNA, 13 bp, Homo sapiens
tgcgtccctgtac

SEQ ID NO: 1770221 - DNA, 16 bp, Homo sapiens
tgcgtcctcctcacct

SEQ ID NO: 1770222 - DNA, 14 bp, Homo sapiens
tgcgtcctgcagag

SEQ ID NO: 1770223 - DNA, 15 bp, Homo sapiens
tgcgtctacccagac

SEQ ID NO: 1770224 - DNA, 16 bp, Homo sapiens
tgcgtctatcctgtgt

SEQ ID NO: 1770225 - DNA, 15 bp, Homo sapiens
tgcgtcttggtgtaa

SEQ ID NO: 1770226 - DNA, 20 bp, Homo sapiens
tgcgtcttttttctcttccc

SEQ ID NO: 1770227 - DNA, 23 bp, Homo sapiens
tgcgtgccgcctgctcctcactg

SEQ ID NO: 1770228 - DNA, 20 bp, Homo sapiens
tgcgtggaatgcccttcact

SEQ ID NO: 1770229 - DNA, 16 bp, Homo sapiens
tgcgtggactctgcac

SEQ ID NO: 1770230 - DNA, 14 bp, Homo sapiens
tgcgtggctgtggc

SEQ ID NO: 1770231 - DNA, 21 bp, Homo sapiens
tgcgtggctgtggcacagact

SEQ ID NO: 1770232 - DNA, 14 bp, Homo sapiens
tgcgtgggtgtgtg

SEQ ID NO: 1770233 - DNA, 23 bp, Homo sapiens
tgcgtgggtgtgtgcgtgtttgg

SEQ ID NO: 1770234 - DNA, 15 bp, Homo sapiens
tgcgtggtatacatg

SEQ ID NO: 1770235 - DNA, 23 bp, Homo sapiens
tgcgtggtatacatgtgtacata

SEQ ID NO: 1770236 - DNA, 23 bp, Homo sapiens
tgcgtggtgtggagtgtgtgtct

SEQ ID NO: 1770237 - DNA, 14 bp, Homo sapiens
tgcgtgtgtgtatg

SEQ ID NO: 1770238 - DNA, 22 bp, Homo sapiens
tgcgtgttagtgtgtgtgcatg

SEQ ID NO: 1770239 - DNA, 14 bp, Homo sapiens
tgcgttggagccac

SEQ ID NO: 1770240 - DNA, 19 bp, Homo sapiens
tgcgttggagccactcctg

SEQ ID NO: 1770241 - DNA, 23 bp, Homo sapiens
tgcgttggagccactcctgtccc

SEQ ID NO: 1770242 - DNA, 18 bp, Homo sapiens
tgcgtttggaggcccctg

SEQ ID NO: 1770243 - DNA, 13 bp, Homo sapiens
tgcgttttggaag

SEQ ID NO: 1770244 - DNA, 23 bp, Homo sapiens
tgctaaaaatgagcttgattaaa

SEQ ID NO: 1770245 - DNA, 18 bp, Homo sapiens
tgctaaacaagtaagaaa

SEQ ID NO: 1770246 - DNA, 23 bp, Homo sapiens
tgctaaacaagtaagaaaaataa

SEQ ID NO: 1770247 - DNA, 13 bp, Homo sapiens
tgctaaaccttag

SEQ ID NO: 1770248 - DNA, 19 bp, Homo sapiens
tgctaaaccttagtactga

SEQ ID NO: 1770249 - DNA, 18 bp, Homo sapiens
tgctaaactgtgaaaaat

SEQ ID NO: 1770250 - DNA, 15 bp, Homo sapiens
tgctaaagcactttg

SEQ ID NO: 1770251 - DNA, 19 bp, Homo sapiens
tgctaaagcactttgcact

SEQ ID NO: 1770252 - DNA, 13 bp, Homo sapiens
tgctaaagccagg

SEQ ID NO: 1770253 - DNA, 22 bp, Homo sapiens
tgctaaatggtcgcccaggaga

SEQ ID NO: 1770254 - DNA, 10 bp, Homo sapiens
tgctaactgg

SEQ ID NO: 1770255 - DNA, 13 bp, Homo sapiens
tgctaactgggtt

SEQ ID NO: 1770256 - DNA, 18 bp, Homo sapiens
tgctaactgggttaaata

SEQ ID NO: 1770257 - DNA, 19 bp, Homo sapiens
tgctaactgggttaaatat

SEQ ID NO: 1770258 - DNA, 20 bp, Homo sapiens
tgctaactgggttaaatatt

SEQ ID NO: 1770259 - DNA, 16 bp, Homo sapiens
tgctaactggttaaac

SEQ ID NO: 1770260 - DNA, 17 bp, Homo sapiens
tgctaactggttaaaca

SEQ ID NO: 1770261 - DNA, 19 bp, Homo sapiens
tgctaacttggagccccag

SEQ ID NO: 1770262 - DNA, 11 bp, Homo sapiens
tgctaagaaat

SEQ ID NO: 1770263 - DNA, 22 bp, Homo sapiens
tgctaagaaatgctgaaaatca

SEQ ID NO: 1770264 - DNA, 14 bp, Homo sapiens
tgctaaggttctaa

SEQ ID NO: 1770265 - DNA, 16 bp, Homo sapiens
tgctaagtatttccca

SEQ ID NO: 1770266 - DNA, 19 bp, Homo sapiens
tgctaagtgtgcttagttt

SEQ ID NO: 1770267 - DNA, 14 bp, Homo sapiens
tgctaagttctccc

SEQ ID NO: 1770268 - DNA, 23 bp, Homo sapiens
tgctaatacctcttactttgctt

SEQ ID NO: 1770269 - DNA, 16 bp, Homo sapiens
tgctaatcaaaacttt

SEQ ID NO: 1770270 - DNA, 23 bp, Homo sapiens
tgctaatcatgtgggtgagccag

SEQ ID NO: 1770271 - DNA, 20 bp, Homo sapiens
tgctaatcttcttatgcaat

SEQ ID NO: 1770272 - DNA, 22 bp, Homo sapiens
tgctaatcttcttatgcaattt

SEQ ID NO: 1770273 - DNA, 16 bp, Homo sapiens
tgctaatgtataatgt

SEQ ID NO: 1770274 - DNA, 15 bp, Homo sapiens
tgctaattctttgca

SEQ ID NO: 1770275 - DNA, 16 bp, Homo sapiens
tgctaattctttgcaa

SEQ ID NO: 1770276 - DNA, 17 bp, Homo sapiens
tgctaatttaaagagac

SEQ ID NO: 1770277 - DNA, 18 bp, Homo sapiens
tgctaatttatcctgaaa

SEQ ID NO: 1770278 - DNA, 14 bp, Homo sapiens
tgctacaaaaacac

SEQ ID NO: 1770279 - DNA, 17 bp, Homo sapiens
tgctacaaaaacacagc

SEQ ID NO: 1770280 - DNA, 19 bp, Homo sapiens
tgctacaaaaacacagcaa

SEQ ID NO: 1770281 - DNA, 20 bp, Homo sapiens
tgctacaaaaacacagcaag

SEQ ID NO: 1770282 - DNA, 15 bp, Homo sapiens
tgctacaaatttatg

SEQ ID NO: 1770283 - DNA, 21 bp, Homo sapiens
tgctacaaatttatgcatttc

SEQ ID NO: 1770284 - DNA, 23 bp, Homo sapiens
tgctacaaatttatgcatttcat

SEQ ID NO: 1770285 - DNA, 12 bp, Homo sapiens
tgctacaatgtc

SEQ ID NO: 1770286 - DNA, 16 bp, Homo sapiens
tgctacatcagactct

SEQ ID NO: 1770287 - DNA, 15 bp, Homo sapiens
tgctacattttgtgg

SEQ ID NO: 1770288 - DNA, 16 bp, Homo sapiens
tgctacattttgtggc

SEQ ID NO: 1770289 - DNA, 21 bp, Homo sapiens
tgctaccacagacttgcactg

SEQ ID NO: 1770290 - DNA, 13 bp, Homo sapiens
tgctaccagcgcc

SEQ ID NO: 1770291 - DNA, 22 bp, Homo sapiens
tgctaccagcgccaaatgttca

SEQ ID NO: 1770292 - DNA, 18 bp, Homo sapiens
tgctaccagtatttagaa

SEQ ID NO: 1770293 - DNA, 15 bp, Homo sapiens
tgctaccgttgactt

SEQ ID NO: 1770294 - DNA, 14 bp, Homo sapiens
tgctacctcactgg

SEQ ID NO: 1770295 - DNA, 22 bp, Homo sapiens
tgctacctcactggggtcctgg

SEQ ID NO: 1770296 - DNA, 17 bp, Homo sapiens
tgctacctctgagaaga

SEQ ID NO: 1770297 - DNA, 15 bp, Homo sapiens
tgctacctgtgagca

SEQ ID NO: 1770298 - DNA, 14 bp, Homo sapiens
tgctactccatgca

SEQ ID NO: 1770299 - DNA, 15 bp, Homo sapiens
tgctactctgttcct

SEQ ID NO: 1770300 - DNA, 14 bp, Homo sapiens
tgctactgattgtt

SEQ ID NO: 1770301 - DNA, 15 bp, Homo sapiens
tgctactgcactcca

SEQ ID NO: 1770302 - DNA, 18 bp, Homo sapiens
tgctactgcactccagcc

SEQ ID NO: 1770303 - DNA, 21 bp, Homo sapiens
tgctactgcactccagcctgg

SEQ ID NO: 1770304 - DNA, 22 bp, Homo sapiens
tgctactgtctcactgaaacat

SEQ ID NO: 1770305 - DNA, 21 bp, Homo sapiens
tgctactgttgtaagaattct

SEQ ID NO: 1770306 - DNA, 23 bp, Homo sapiens
tgctagaaagttagggggttctt

SEQ ID NO: 1770307 - DNA, 15 bp, Homo sapiens
tgctagaacaatggg

SEQ ID NO: 1770308 - DNA, 16 bp, Homo sapiens
tgctagacagaaacca

SEQ ID NO: 1770309 - DNA, 21 bp, Homo sapiens
tgctagacagaaaccaagcca

SEQ ID NO: 1770310 - DNA, 22 bp, Homo sapiens
tgctagactcctcaggagagac

SEQ ID NO: 1770311 - DNA, 13 bp, Homo sapiens
tgctagattttaa

SEQ ID NO: 1770312 - DNA, 18 bp, Homo sapiens
tgctagctatatatttag

SEQ ID NO: 1770313 - DNA, 13 bp, Homo sapiens
tgctagctgtaga

SEQ ID NO: 1770314 - DNA, 14 bp, Homo sapiens
tgctaggagcccca

SEQ ID NO: 1770315 - DNA, 15 bp, Homo sapiens
tgctaggagccccag

SEQ ID NO: 1770316 - DNA, 16 bp, Homo sapiens
tgctaggagccccagc

SEQ ID NO: 1770317 - DNA, 18 bp, Homo sapiens
tgctaggagccccagctt

SEQ ID NO: 1770318 - DNA, 20 bp, Homo sapiens
tgctaggagccccagcttcc

SEQ ID NO: 1770319 - DNA, 22 bp, Homo sapiens
tgctaggagccccagcttcctg

SEQ ID NO: 1770320 - DNA, 15 bp, Homo sapiens
tgctgattcttgtaa

SEQ ID NO: 1770321 - DNA, 19 bp, Homo sapiens
tgctgattcttgtaaatct

SEQ ID NO: 1770322 - DNA, 21 bp, Homo sapiens
tgctgattcttgtaaatcttt

SEQ ID NO: 1770323 - DNA, 13 bp, Homo sapiens
tgctgattttatt

SEQ ID NO: 1770324 - DNA, 20 bp, Homo sapiens
tgctgcaaacctgacccctg

SEQ ID NO: 1770325 - DNA, 17 bp, Homo sapiens
tgctgcaaaggagaagc

SEQ ID NO: 1770326 - DNA, 19 bp, Homo sapiens
tgctgcaagcacagccctt

SEQ ID NO: 1770327 - DNA, 18 bp, Homo sapiens
tgctgcacaaaagcagat

SEQ ID NO: 1770328 - DNA, 13 bp, Homo sapiens
tgctgcaccagag

SEQ ID NO: 1770329 - DNA, 14 bp, Homo sapiens
tgctgcaccagagt

SEQ ID NO: 1770330 - DNA, 16 bp, Homo sapiens
tgctgcaccagagtga

SEQ ID NO: 1770331 - DNA, 18 bp, Homo sapiens
tgctgcaccttgtaaatg

SEQ ID NO: 1770332 - DNA, 23 bp, Homo sapiens
tgctgcagattagttctttttgc

SEQ ID NO: 1770333 - DNA, 17 bp, Homo sapiens
tgctgcaggacattaat

SEQ ID NO: 1770334 - DNA, 23 bp, Homo sapiens
tgctgcatactttgacaaggaaa

SEQ ID NO: 1770335 - DNA, 21 bp, Homo sapiens
tgctgcatagctctattttaa

SEQ ID NO: 1770336 - DNA, 13 bp, Homo sapiens
tgctgcatatttg

SEQ ID NO: 1770337 - DNA, 14 bp, Homo sapiens
tgctgcatatttgt

SEQ ID NO: 1770338 - DNA, 23 bp, Homo sapiens
tgctgcatatttgtgccgtaatt

SEQ ID NO: 1770339 - DNA, 15 bp, Homo sapiens
tgctgcatccctgtg

SEQ ID NO: 1770340 - DNA, 20 bp, Homo sapiens
tgctgcatgcgacagcgtcc

SEQ ID NO: 1770341 - DNA, 21 bp, Homo sapiens
tgctgccaaccataccttcct

SEQ ID NO: 1770342 - DNA, 20 bp, Homo sapiens
tgctgccacaaccagccagg

SEQ ID NO: 1770343 - DNA, 21 bp, Homo sapiens
tgctgccacactgtctcatct

SEQ ID NO: 1770344 - DNA, 15 bp, Homo sapiens
tgctgccacacttca

SEQ ID NO: 1770345 - DNA, 16 bp, Homo sapiens
tgctgccacacttcag

SEQ ID NO: 1770346 - DNA, 21 bp, Homo sapiens
tgctgccatgccactgccagg

SEQ ID NO: 1770347 - DNA, 17 bp, Homo sapiens
tgctgcccagccactcc

SEQ ID NO: 1770348 - DNA, 13 bp, Homo sapiens
tgctgcccatgag

SEQ ID NO: 1770349 - DNA, 14 bp, Homo sapiens
tgctgcccatgagc

SEQ ID NO: 1770350 - DNA, 14 bp, Homo sapiens
tgctgcccccaccc

SEQ ID NO: 1770351 - DNA, 20 bp, Homo sapiens
tgctgcccccaccccgggga

SEQ ID NO: 1770352 - DNA, 18 bp, Homo sapiens
tgctgccccgcttcccca

SEQ ID NO: 1770353 - DNA, 22 bp, Homo sapiens
tgctgccccgcttccccacaga

SEQ ID NO: 1770354 - DNA, 19 bp, Homo sapiens
tgctgccccgttccctgtc

SEQ ID NO: 1770355 - DNA, 22 bp, Homo sapiens
tgctgccccgttccctgtcaga

SEQ ID NO: 1770356 - DNA, 13 bp, Homo sapiens
tgctgcccctgca

SEQ ID NO: 1770357 - DNA, 17 bp, Homo sapiens
tgctgcccgtcttcagc

SEQ ID NO: 1770358 - DNA, 12 bp, Homo sapiens
tgctgccgccgc

SEQ ID NO: 1770359 - DNA, 17 bp, Homo sapiens
tgctgccggctctgggc

SEQ ID NO: 1770360 - DNA, 19 bp, Homo sapiens
tgctgcctctttccctagg

SEQ ID NO: 1770361 - DNA, 13 bp, Homo sapiens
tgctgccttcaca

SEQ ID NO: 1770362 - DNA, 12 bp, Homo sapiens
tgctgccttttc

SEQ ID NO: 1770363 - DNA, 14 bp, Homo sapiens
tgctgccttttctg

SEQ ID NO: 1770364 - DNA, 16 bp, Homo sapiens
tgctgcggctgtgggc

SEQ ID NO: 1770365 - DNA, 17 bp, Homo sapiens
tgctgcggctgtgggcg

SEQ ID NO: 1770366 - DNA, 16 bp, Homo sapiens
tgctgcgtccccactc

SEQ ID NO: 1770367 - DNA, 17 bp, Homo sapiens
tgctgcgtccccactcc

SEQ ID NO: 1770368 - DNA, 21 bp, Homo sapiens
tgctgcgtccccactcccttg

SEQ ID NO: 1770369 - DNA, 16 bp, Homo sapiens
tgctgctaccagcgcc

SEQ ID NO: 1770370 - DNA, 14 bp, Homo sapiens
tgctgctactgtct

SEQ ID NO: 1770371 - DNA, 19 bp, Homo sapiens
tgctgctatcctgccaaaa

SEQ ID NO: 1770372 - DNA, 21 bp, Homo sapiens
tgctgctatgaaaatgagcat

SEQ ID NO: 1770373 - DNA, 13 bp, Homo sapiens
tgctgctccgccc

SEQ ID NO: 1770374 - DNA, 23 bp, Homo sapiens
tgctgctccggtttgggctgtct

SEQ ID NO: 1770375 - DNA, 14 bp, Homo sapiens
tgctgctctcagcc

SEQ ID NO: 1770376 - DNA, 12 bp, Homo sapiens
tgctgctcttca

SEQ ID NO: 1770377 - DNA, 16 bp, Homo sapiens
tgctgctgccgccgcc

SEQ ID NO: 1770378 - DNA, 13 bp, Homo sapiens
tgctgctgcctcc

SEQ ID NO: 1770379 - DNA, 17 bp, Homo sapiens
tgctgctgcctctttcc

SEQ ID NO: 1770380 - DNA, 13 bp, Homo sapiens
tgctgctgctgcc

SEQ ID NO: 1770381 - DNA, 22 bp, Homo sapiens
tgctgctggggaagacagtggc

SEQ ID NO: 1770382 - DNA, 22 bp, Homo sapiens
tgctgctgtaactgctgagcca

SEQ ID NO: 1770383 - DNA, 15 bp, Homo sapiens
tgctgcttcatgttt

SEQ ID NO: 1770384 - DNA, 11 bp, Homo sapiens
tgctgcttcca

SEQ ID NO: 1770385 - DNA, 14 bp, Homo sapiens
tgctgcttctcttg

SEQ ID NO: 1770386 - DNA, 16 bp, Homo sapiens
tgctgctttcccctgt

SEQ ID NO: 1770387 - DNA, 17 bp, Homo sapiens
tgctgctttcccctgtg

SEQ ID NO: 1770388 - DNA, 19 bp, Homo sapiens
tgctgctttcccctgtggg

SEQ ID NO: 1770389 - DNA, 21 bp, Homo sapiens
tgctgctttcccctgtgggga

SEQ ID NO: 1770390 - DNA, 23 bp, Homo sapiens
tgctgctttcccctgtggggatc

SEQ ID NO: 1770391 - DNA, 17 bp, Homo sapiens
tgctgctttttggcaca

SEQ ID NO: 1770392 - DNA, 12 bp, Homo sapiens
tgctggaaagag

SEQ ID NO: 1770393 - DNA, 12 bp, Homo sapiens
tgctggaaataa

SEQ ID NO: 1770394 - DNA, 16 bp, Homo sapiens
tgctggaattccacag

SEQ ID NO: 1770395 - DNA, 17 bp, Homo sapiens
tgctggaattccacagg

SEQ ID NO: 1770396 - DNA, 22 bp, Homo sapiens
tgctggaattccacagggacca

SEQ ID NO: 1770397 - DNA, 21 bp, Homo sapiens
tgctggactggaggcccctgg

SEQ ID NO: 1770398 - DNA, 21 bp, Homo sapiens
tgctggagaattgactgaagc

SEQ ID NO: 1770399 - DNA, 14 bp, Homo sapiens
tgctggagatgttt

SEQ ID NO: 1770400 - DNA, 16 bp, Homo sapiens
tgctggaggcctcagg

SEQ ID NO: 1770401 - DNA, 13 bp, Homo sapiens
tgctggatttgat

SEQ ID NO: 1770402 - DNA, 23 bp, Homo sapiens
tgctggccacaaggaaaaggagg

SEQ ID NO: 1770403 - DNA, 14 bp, Homo sapiens
tgctggcccaccca

SEQ ID NO: 1770404 - DNA, 16 bp, Homo sapiens
tgctggcccagggccc

SEQ ID NO: 1770405 - DNA, 19 bp, Homo sapiens
tgctggcccagggcccaga

SEQ ID NO: 1770406 - DNA, 21 bp, Homo sapiens
tgctggcccagggcccagagc

SEQ ID NO: 1770407 - DNA, 23 bp, Homo sapiens
tgctggcccagggcccagagccc

SEQ ID NO: 1770408 - DNA, 18 bp, Homo sapiens
tgctggccccagccctgc

SEQ ID NO: 1770409 - DNA, 21 bp, Homo sapiens
tgctggccccagccctgctgg

SEQ ID NO: 1770410 - DNA, 12 bp, Homo sapiens
tgctggcctgga

SEQ ID NO: 1770411 - DNA, 14 bp, Homo sapiens
tgctggcctggatc

SEQ ID NO: 1770412 - DNA, 18 bp, Homo sapiens
tgctggcctggatctccc

SEQ ID NO: 1770413 - DNA, 13 bp, Homo sapiens
tgctggctctgag

SEQ ID NO: 1770414 - DNA, 15 bp, Homo sapiens
tgctggctctgagaa

SEQ ID NO: 1770415 - DNA, 21 bp, Homo sapiens
tgctggctgcccagacccctc

SEQ ID NO: 1770416 - DNA, 21 bp, Homo sapiens
tgctgggaaccccgcagcccg

SEQ ID NO: 1770417 - DNA, 15 bp, Homo sapiens
tgctgggaagagctc

SEQ ID NO: 1770418 - DNA, 23 bp, Homo sapiens
tgctgggactcagccttcagaca

SEQ ID NO: 1770419 - DNA, 15 bp, Homo sapiens
tgctgggactgagcc

SEQ ID NO: 1770420 - DNA, 16 bp, Homo sapiens
tgctgggactgagcca

SEQ ID NO: 1770421 - DNA, 16 bp, Homo sapiens
tgctgggagctccact

SEQ ID NO: 1770422 - DNA, 14 bp, Homo sapiens
tgctgggagctgaa

SEQ ID NO: 1770423 - DNA, 18 bp, Homo sapiens
tgctgggaggagggagag

SEQ ID NO: 1770424 - DNA, 20 bp, Homo sapiens
tgctgggaggagggagaggg

SEQ ID NO: 1770425 - DNA, 22 bp, Homo sapiens
tgctgggcatactttctctcta

SEQ ID NO: 1770426 - DNA, 19 bp, Homo sapiens
tgctgggccagtggctggg

SEQ ID NO: 1770427 - DNA, 21 bp, Homo sapiens
tgctgggcgtgtgtgacactg

SEQ ID NO: 1770428 - DNA, 15 bp, Homo sapiens
tgctgggctctccac

SEQ ID NO: 1770429 - DNA, 18 bp, Homo sapiens
tgctgggctctccacctc

SEQ ID NO: 1770430 - DNA, 20 bp, Homo sapiens
tgctgggctctccacctcag

SEQ ID NO: 1770431 - DNA, 22 bp, Homo sapiens
tgctgggctctccacctcagcc

SEQ ID NO: 1770432 - DNA, 14 bp, Homo sapiens
tgctgggctgggcc

SEQ ID NO: 1770433 - DNA, 16 bp, Homo sapiens
tgctgggctgggccct

SEQ ID NO: 1770434 - DNA, 17 bp, Homo sapiens
tgctggggaagacagtg

SEQ ID NO: 1770435 - DNA, 22 bp, Homo sapiens
tgctggggaagacagtggcccc

SEQ ID NO: 1770436 - DNA, 23 bp, Homo sapiens
tgctggggaagggttttcttttc

SEQ ID NO: 1770437 - DNA, 12 bp, Homo sapiens
tgctggggcatg

SEQ ID NO: 1770438 - DNA, 19 bp, Homo sapiens
tgctggggcatgtgtgcct

SEQ ID NO: 1770439 - DNA, 13 bp, Homo sapiens
tgctggggccagc

SEQ ID NO: 1770440 - DNA, 18 bp, Homo sapiens
tgctgggttggtgcacag

SEQ ID NO: 1770441 - DNA, 23 bp, Homo sapiens
tgctgggttggtgcacagtgatt

SEQ ID NO: 1770442 - DNA, 13 bp, Homo sapiens
tgctggtacctgc

SEQ ID NO: 1770443 - DNA, 14 bp, Homo sapiens
tgctggtatttcta

SEQ ID NO: 1770444 - DNA, 19 bp, Homo sapiens
tgctggtcccggggccagc

SEQ ID NO: 1770445 - DNA, 16 bp, Homo sapiens
tgctggtccgtgggac

SEQ ID NO: 1770446 - DNA, 19 bp, Homo sapiens
tgctggtgaacactgtgac

SEQ ID NO: 1770447 - DNA, 16 bp, Homo sapiens
tgctggtgtagtcttt

SEQ ID NO: 1770448 - DNA, 15 bp, Homo sapiens
tgctggtgtcctgac

SEQ ID NO: 1770449 - DNA, 16 bp, Homo sapiens
tgctggtgtcctgacc

SEQ ID NO: 1770450 - DNA, 18 bp, Homo sapiens
tgctggttgttgccaggt

SEQ ID NO: 1770451 - DNA, 20 bp, Homo sapiens
tgctgtaaagagttgctttt

SEQ ID NO: 1770452 - DNA, 17 bp, Homo sapiens
tgctgtaactgctgagc

SEQ ID NO: 1770453 - DNA, 17 bp, Homo sapiens
tgctgtaacttaaaata

SEQ ID NO: 1770454 - DNA, 15 bp, Homo sapiens
tgctgtagacatttg

SEQ ID NO: 1770455 - DNA, 15 bp, Homo sapiens
tgctgtatatgcaat

SEQ ID NO: 1770456 - DNA, 22 bp, Homo sapiens
tgctgtatatggaattctttta

SEQ ID NO: 1770457 - DNA, 23 bp, Homo sapiens
tgctgtatccatccatggggctg

SEQ ID NO: 1770458 - DNA, 20 bp, Homo sapiens
tgctgtatgctgatcatcgc

SEQ ID NO: 1770459 - DNA, 16 bp, Homo sapiens
tgctgtattgccccca

SEQ ID NO: 1770460 - DNA, 21 bp, Homo sapiens
tgctgtattttaacactttgt

SEQ ID NO: 1770461 - DNA, 22 bp, Homo sapiens
tgctgtcatgaaatcagcaaga

SEQ ID NO: 1770462 - DNA, 15 bp, Homo sapiens
tgctgtcatggtcct

SEQ ID NO: 1770463 - DNA, 16 bp, Homo sapiens
tgctgtcatggtcctt

SEQ ID NO: 1770464 - DNA, 19 bp, Homo sapiens
tgctgtccacatgacctcc

SEQ ID NO: 1770465 - DNA, 20 bp, Homo sapiens
tgctgtccacatgacctcca

SEQ ID NO: 1770466 - DNA, 22 bp, Homo sapiens
tgctgtccaggcagctccctcc

SEQ ID NO: 1770467 - DNA, 14 bp, Homo sapiens
tgctgtcctggtgg

SEQ ID NO: 1770468 - DNA, 15 bp, Homo sapiens
tgctgtccttttagg

SEQ ID NO: 1770469 - DNA, 13 bp, Homo sapiens
tgctgtctctctg

SEQ ID NO: 1770470 - DNA, 17 bp, Homo sapiens
tgctgtctggccctggg

SEQ ID NO: 1770471 - DNA, 13 bp, Homo sapiens
tgctgtcttaaac

SEQ ID NO: 1770472 - DNA, 21 bp, Homo sapiens
tgctgtcttaaactaaatgtg

SEQ ID NO: 1770473 - DNA, 13 bp, Homo sapiens
tgctgtcttcagt

SEQ ID NO: 1770474 - DNA, 15 bp, Homo sapiens
tgctgtcttcagtct

SEQ ID NO: 1770475 - DNA, 15 bp, Homo sapiens
tgctgtcttctggac

SEQ ID NO: 1770476 - DNA, 18 bp, Homo sapiens
tgctgtgaaccctggggc

SEQ ID NO: 1770477 - DNA, 22 bp, Homo sapiens
tgctgtgaaccctggggcctga

SEQ ID NO: 1770478 - DNA, 18 bp, Homo sapiens
tgctgtgaccatttataa

SEQ ID NO: 1770479 - DNA, 16 bp, Homo sapiens
tgctgtgaggctgtcc

SEQ ID NO: 1770480 - DNA, 19 bp, Homo sapiens
tgctgtgaggctgtcctgt

SEQ ID NO: 1770481 - DNA, 17 bp, Homo sapiens
tgctgtgagggagggga

SEQ ID NO: 1770482 - DNA, 23 bp, Homo sapiens
tgctgtgagggaggggaaaagca

SEQ ID NO: 1770483 - DNA, 18 bp, Homo sapiens
tgctgtgatacactgaaa

SEQ ID NO: 1770484 - DNA, 22 bp, Homo sapiens
tgctgtgcattagatattaggg

SEQ ID NO: 1770485 - DNA, 13 bp, Homo sapiens
tgctgtgccccac

SEQ ID NO: 1770486 - DNA, 15 bp, Homo sapiens
tgctgtgccccacca

SEQ ID NO: 1770487 - DNA, 15 bp, Homo sapiens
tgctgtgcctgctag

SEQ ID NO: 1770488 - DNA, 10 bp, Homo sapiens
tgctgtgctg

SEQ ID NO: 1770489 - DNA, 13 bp, Homo sapiens
tgctgtggctcca

SEQ ID NO: 1770490 - DNA, 16 bp, Homo sapiens
tgctgtgtaacactgt

SEQ ID NO: 1770491 - DNA, 19 bp, Homo sapiens
tgctgtgtatatggtatat

SEQ ID NO: 1770492 - DNA, 19 bp, Homo sapiens
tgctgtgtcttcattttca

SEQ ID NO: 1770493 - DNA, 19 bp, Homo sapiens
tgctgtgtgaccctgggca

SEQ ID NO: 1770494 - DNA, 20 bp, Homo sapiens
tgctgtgtgaccctgggcaa

SEQ ID NO: 1770495 - DNA, 19 bp, Homo sapiens
tgctgtgtgagtgagcaca

SEQ ID NO: 1770496 - DNA, 11 bp, Homo sapiens
tgctgtgtgcc

SEQ ID NO: 1770497 - DNA, 15 bp, Homo sapiens
tgctgtgtgccccac

SEQ ID NO: 1770498 - DNA, 22 bp, Homo sapiens
tgctgtgtgccccactccagcc

SEQ ID NO: 1770499 - DNA, 21 bp, Homo sapiens
tgctgtgtgttgcctgggaca

SEQ ID NO: 1770500 - DNA, 17 bp, Homo sapiens
tgctgttatgtccagaa

SEQ ID NO: 1770501 - DNA, 16 bp, Homo sapiens
tgctgttgaggtggct

SEQ ID NO: 1770502 - DNA, 17 bp, Homo sapiens
tgctgttgatgttttgt

SEQ ID NO: 1770503 - DNA, 12 bp, Homo sapiens
tgctgttgctta

SEQ ID NO: 1770504 - DNA, 20 bp, Homo sapiens
tgctgttggtcctctctctg

SEQ ID NO: 1770505 - DNA, 21 bp, Homo sapiens
tgctgttggtcctctctctgt

SEQ ID NO: 1770506 - DNA, 24 bp, Homo sapiens
tgctgtttaaagtcacatccctgt

SEQ ID NO: 1770507 - DNA, 22 bp, Homo sapiens
tgctgtttatcccttaagaatg

SEQ ID NO: 1770508 - DNA, 13 bp, Homo sapiens
tgctgtttgacaa

SEQ ID NO: 1770509 - DNA, 17 bp, Homo sapiens
tgctgttttatgtcata

SEQ ID NO: 1770510 - DNA, 22 bp, Homo sapiens
tgctgttttatgtcatactctg

SEQ ID NO: 1770511 - DNA, 17 bp, Homo sapiens
tgcttaaaaaagctaat

SEQ ID NO: 1770512 - DNA, 20 bp, Homo sapiens
tgcttaaaaaataatacaac

SEQ ID NO: 1770513 - DNA, 18 bp, Homo sapiens
tgcttaaaaatcattgat

SEQ ID NO: 1770514 - DNA, 19 bp, Homo sapiens
tgcttaaaaatcattgatt

SEQ ID NO: 1770515 - DNA, 14 bp, Homo sapiens
tgcttaaaagacat

SEQ ID NO: 1770516 - DNA, 19 bp, Homo sapiens
tgcttaaaataagcaggtg

SEQ ID NO: 1770517 - DNA, 14 bp, Homo sapiens
tgcttaaactggaa

SEQ ID NO: 1770518 - DNA, 13 bp, Homo sapiens
tgcttaaatcagt

SEQ ID NO: 1770519 - DNA, 20 bp, Homo sapiens
tgcttaaatcagttggagtt

SEQ ID NO: 1770520 - DNA, 21 bp, Homo sapiens
tgcttaaatcagttggagttt

SEQ ID NO: 1770521 - DNA, 15 bp, Homo sapiens
tgcttaaatttctta

SEQ ID NO: 1770522 - DNA, 22 bp, Homo sapiens
tgcttaaggtttgttttcatta

SEQ ID NO: 1770523 - DNA, 15 bp, Homo sapiens
tgcttaataaattgt

SEQ ID NO: 1770524 - DNA, 21 bp, Homo sapiens
tgcttaatcttcaaagccttc

SEQ ID NO: 1770525 - DNA, 15 bp, Homo sapiens
tgcttacccttcacc

SEQ ID NO: 1770526 - DNA, 14 bp, Homo sapiens
tgcttactgatata

SEQ ID NO: 1770527 - DNA, 22 bp, Homo sapiens
tgcttactttggaatacatttc

SEQ ID NO: 1770528 - DNA, 18 bp, Homo sapiens
tgcttagctcatcttaga

SEQ ID NO: 1770529 - DNA, 16 bp, Homo sapiens
tgcttagctgccttga

SEQ ID NO: 1770530 - DNA, 16 bp, Homo sapiens
tgcttaggatgtgtgc

SEQ ID NO: 1770531 - DNA, 20 bp, Homo sapiens
tgcttagtatggttctcaga

SEQ ID NO: 1770532 - DNA, 21 bp, Homo sapiens
tgcttagtatggttctcagat

SEQ ID NO: 1770533 - DNA, 23 bp, Homo sapiens
tgcttagtcacttatttcataaa

SEQ ID NO: 1770534 - DNA, 16 bp, Homo sapiens
tgcttagttggctttg

SEQ ID NO: 1770535 - DNA, 23 bp, Homo sapiens
tgcttagttggctttgcccaccc

SEQ ID NO: 1770536 - DNA, 12 bp, Homo sapiens
tgcttagtttta

SEQ ID NO: 1770537 - DNA, 18 bp, Homo sapiens
tgcttatgaatatttata

SEQ ID NO: 1770538 - DNA, 19 bp, Homo sapiens
tgcttatgttgttttgtac

SEQ ID NO: 1770539 - DNA, 16 bp, Homo sapiens
tgcttcaagagaaaat

SEQ ID NO: 1770540 - DNA, 21 bp, Homo sapiens
tgcttcaagtgttttggtgtt

SEQ ID NO: 1770541 - DNA, 16 bp, Homo sapiens
tgcttcaattaataaa

SEQ ID NO: 1770542 - DNA, 22 bp, Homo sapiens
tgcttcacagtagagccagctt

SEQ ID NO: 1770543 - DNA, 21 bp, Homo sapiens
tgcttcaccatggccttatga

SEQ ID NO: 1770544 - DNA, 20 bp, Homo sapiens
tgcttcagatattattgctt

SEQ ID NO: 1770545 - DNA, 14 bp, Homo sapiens
tgcttcagcctgag

SEQ ID NO: 1770546 - DNA, 15 bp, Homo sapiens
tgcttcagcctgagg

SEQ ID NO: 1770547 - DNA, 18 bp, Homo sapiens
tgcttcataaatgaagca

SEQ ID NO: 1770548 - DNA, 20 bp, Homo sapiens
tgcttcataaatgaagcagc

SEQ ID NO: 1770549 - DNA, 13 bp, Homo sapiens
tggaagagctctt

SEQ ID NO: 1770550 - DNA, 15 bp, Homo sapiens
tggaagaggaaaagg

SEQ ID NO: 1770551 - DNA, 19 bp, Homo sapiens
tggaagatagttttctcct

SEQ ID NO: 1770552 - DNA, 22 bp, Homo sapiens
tggaagatttatgaacagaaat

SEQ ID NO: 1770553 - DNA, 14 bp, Homo sapiens
tggaagcaaagtat

SEQ ID NO: 1770554 - DNA, 13 bp, Homo sapiens
tggaagcaggtgc

SEQ ID NO: 1770555 - DNA, 12 bp, Homo sapiens
tggaagccaggt

SEQ ID NO: 1770556 - DNA, 17 bp, Homo sapiens
tggaagccggcggccca

SEQ ID NO: 1770557 - DNA, 16 bp, Homo sapiens
tggaagctaccagagc

SEQ ID NO: 1770558 - DNA, 23 bp, Homo sapiens
tggaagctagacacatgaaggta

SEQ ID NO: 1770559 - DNA, 14 bp, Homo sapiens
tggaagctggaaga

SEQ ID NO: 1770560 - DNA, 18 bp, Homo sapiens
tggaagctgtttggaaaa

SEQ ID NO: 1770561 - DNA, 20 bp, Homo sapiens
tggaagctgtttggaaaaga

SEQ ID NO: 1770562 - DNA, 14 bp, Homo sapiens
tggaagcttgttga

SEQ ID NO: 1770563 - DNA, 16 bp, Homo sapiens
tggaagcttgttgaaa

SEQ ID NO: 1770564 - DNA, 15 bp, Homo sapiens
tggaaggagcacata

SEQ ID NO: 1770565 - DNA, 12 bp, Homo sapiens
tggaaggagcag

SEQ ID NO: 1770566 - DNA, 21 bp, Homo sapiens
tggaaggatctgctgaggccc

SEQ ID NO: 1770567 - DNA, 23 bp, Homo sapiens
tggaaggatctgctgaggcccag

SEQ ID NO: 1770568 - DNA, 23 bp, Homo sapiens
tggaaggatgggatgggttccag

SEQ ID NO: 1770569 - DNA, 16 bp, Homo sapiens
tggaaggcacccgccc

SEQ ID NO: 1770570 - DNA, 14 bp, Homo sapiens
tggaaggcagagaa

SEQ ID NO: 1770571 - DNA, 16 bp, Homo sapiens
tggaaggcagagaaat

SEQ ID NO: 1770572 - DNA, 17 bp, Homo sapiens
tggaaggcagagaaatc

SEQ ID NO: 1770573 - DNA, 14 bp, Homo sapiens
tggaaggcagggca

SEQ ID NO: 1770574 - DNA, 15 bp, Homo sapiens
tggaaggcagggcag

SEQ ID NO: 1770575 - DNA, 17 bp, Homo sapiens
tggaaggcagggcagag

SEQ ID NO: 1770576 - DNA, 18 bp, Homo sapiens
tggaaggccccttccctg

SEQ ID NO: 1770577 - DNA, 15 bp, Homo sapiens
tggaaggctggctga

SEQ ID NO: 1770578 - DNA, 20 bp, Homo sapiens
tggaagggaggaaggccttt

SEQ ID NO: 1770579 - DNA, 21 bp, Homo sapiens
tggaagggcgttctaggtagg

SEQ ID NO: 1770580 - DNA, 23 bp, Homo sapiens
tggaaggggccacgtggatgggc

SEQ ID NO: 1770581 - DNA, 17 bp, Homo sapiens
tggaagggtttgtggct

SEQ ID NO: 1770582 - DNA, 15 bp, Homo sapiens
tggaaggtgatgggg

SEQ ID NO: 1770583 - DNA, 20 bp, Homo sapiens
tggaaggttcaggggccgct

SEQ ID NO: 1770584 - DNA, 14 bp, Homo sapiens
tggaagtcatgagc

SEQ ID NO: 1770585 - DNA, 13 bp, Homo sapiens
tggaagtctgcgc

SEQ ID NO: 1770586 - DNA, 18 bp, Homo sapiens
tggaagtgcccagcccct

SEQ ID NO: 1770587 - DNA, 17 bp, Homo sapiens
tggaagtggcagtgaaa

SEQ ID NO: 1770588 - DNA, 22 bp, Homo sapiens
tggaagtgtatttattttacag

SEQ ID NO: 1770589 - DNA, 20 bp, Homo sapiens
tggaagtgtctgccagctgg

SEQ ID NO: 1770590 - DNA, 23 bp, Homo sapiens
tggaagtgtgggtctgtgtgtgt

SEQ ID NO: 1770591 - DNA, 21 bp, Homo sapiens
tggaagtgtttcaaaaaatta

SEQ ID NO: 1770592 - DNA, 14 bp, Homo sapiens
tggaagttttgcta

SEQ ID NO: 1770593 - DNA, 17 bp, Homo sapiens
tggaagtttttttttcc

SEQ ID NO: 1770594 - DNA, 15 bp, Homo sapiens
tggaataaacattaa

SEQ ID NO: 1770595 - DNA, 18 bp, Homo sapiens
tggaataaacattaattt

SEQ ID NO: 1770596 - DNA, 19 bp, Homo sapiens
tggaataaacattaatttt

SEQ ID NO: 1770597 - DNA, 14 bp, Homo sapiens
tggaataaagaggg

SEQ ID NO: 1770598 - DNA, 16 bp, Homo sapiens
tggaataatttctatt

SEQ ID NO: 1770599 - DNA, 13 bp, Homo sapiens
tggaatataaaac

SEQ ID NO: 1770600 - DNA, 18 bp, Homo sapiens
tggaatataaggaaagca

SEQ ID NO: 1770601 - DNA, 23 bp, Homo sapiens
tggaatattcccctatctctaga

SEQ ID NO: 1770602 - DNA, 13 bp, Homo sapiens
tggaatattgttt

SEQ ID NO: 1770603 - DNA, 14 bp, Homo sapiens
tggaatattttatc

SEQ ID NO: 1770604 - DNA, 19 bp, Homo sapiens
tggaatattttatcctgta

SEQ ID NO: 1770605 - DNA, 22 bp, Homo sapiens
tggaatcgaagtgtttatgtaa

SEQ ID NO: 1770606 - DNA, 23 bp, Homo sapiens
tggaatcgatttcctcccacctc

SEQ ID NO: 1770607 - DNA, 17 bp, Homo sapiens
tggaatctggagaccag

SEQ ID NO: 1770608 - DNA, 21 bp, Homo sapiens
tggaatcttcacctcagagtg

SEQ ID NO: 1770609 - DNA, 18 bp, Homo sapiens
tggaatgaattaaataaa

SEQ ID NO: 1770610 - DNA, 20 bp, Homo sapiens
tggaatgatgggtcagttgt

SEQ ID NO: 1770611 - DNA, 18 bp, Homo sapiens
tggaatgccgctgtctct

SEQ ID NO: 1770612 - DNA, 23 bp, Homo sapiens
tggaatgtggcccctgaacaaga

SEQ ID NO: 1770613 - DNA, 14 bp, Homo sapiens
tggaattatgtata

SEQ ID NO: 1770614 - DNA, 18 bp, Homo sapiens
tggaattcagcaccctgg

SEQ ID NO: 1770615 - DNA, 21 bp, Homo sapiens
tggaattcagcaccctgggtg

SEQ ID NO: 1770616 - DNA, 16 bp, Homo sapiens
tggaattcctctttaa

SEQ ID NO: 1770617 - DNA, 22 bp, Homo sapiens
tggaattcttagtcacaaaata

SEQ ID NO: 1770618 - DNA, 21 bp, Homo sapiens
tggaatttctagtatgagact

SEQ ID NO: 1770619 - DNA, 22 bp, Homo sapiens
tggaatttctcccagtcattta

SEQ ID NO: 1770620 - DNA, 22 bp, Homo sapiens
tggaattttgcaaagatttaat

SEQ ID NO: 1770621 - DNA, 21 bp, Homo sapiens
tggacaaatcacatattttaa

SEQ ID NO: 1770622 - DNA, 16 bp, Homo sapiens
tggacaacttatttaa

SEQ ID NO: 1770623 - DNA, 20 bp, Homo sapiens
tggacacaacagcagtctcc

SEQ ID NO: 1770624 - DNA, 21 bp, Homo sapiens
tggacacaacagcagtctcct

SEQ ID NO: 1770625 - DNA, 17 bp, Homo sapiens
tggacacacaaggtgca

SEQ ID NO: 1770626 - DNA, 16 bp, Homo sapiens
tggacacacacagact

SEQ ID NO: 1770627 - DNA, 13 bp, Homo sapiens
tggacacagctct

SEQ ID NO: 1770628 - DNA, 14 bp, Homo sapiens
tggacacagctctt

SEQ ID NO: 1770629 - DNA, 15 bp, Homo sapiens
tggacacagctcttc

SEQ ID NO: 1770630 - DNA, 18 bp, Homo sapiens
tggacaccaggagtccct

SEQ ID NO: 1770631 - DNA, 21 bp, Homo sapiens
tggacaccaggagtccctggt

SEQ ID NO: 1770632 - DNA, 21 bp, Homo sapiens
tggacacgagccacaagctgc

SEQ ID NO: 1770633 - DNA, 22 bp, Homo sapiens
tggacacgagccacaagctgca

SEQ ID NO: 1770634 - DNA, 22 bp, Homo sapiens
tggacactttgaaatgtgtttc

SEQ ID NO: 1770635 - DNA, 12 bp, Homo sapiens
tggacagcccca

SEQ ID NO: 1770636 - DNA, 21 bp, Homo sapiens
tggacagctacttctgggaaa

SEQ ID NO: 1770637 - DNA, 16 bp, Homo sapiens
tggacagctgcttgtg

SEQ ID NO: 1770638 - DNA, 22 bp, Homo sapiens
tggacagctttgctccgctccc

SEQ ID NO: 1770639 - DNA, 19 bp, Homo sapiens
tggacaggagatcagcagc

SEQ ID NO: 1770640 - DNA, 15 bp, Homo sapiens
tggacaggcccagcg

SEQ ID NO: 1770641 - DNA, 18 bp, Homo sapiens
tggacagtacctgattgt

SEQ ID NO: 1770642 - DNA, 17 bp, Homo sapiens
tggacagtcctgggaga

SEQ ID NO: 1770643 - DNA, 16 bp, Homo sapiens
tggacatggaaagaaa

SEQ ID NO: 1770644 - DNA, 15 bp, Homo sapiens
tggacatgtgggtgg

SEQ ID NO: 1770645 - DNA, 21 bp, Homo sapiens
tggacatgtgggtggagaagg

SEQ ID NO: 1770646 - DNA, 19 bp, Homo sapiens
tggacattctctttgataa

SEQ ID NO: 1770647 - DNA, 19 bp, Homo sapiens
tggacatttagaagaaaga

SEQ ID NO: 1770648 - DNA, 12 bp, Homo sapiens
tggaccaagaat

SEQ ID NO: 1770649 - DNA, 21 bp, Homo sapiens
tggaccaatagggctgagctc

SEQ ID NO: 1770650 - DNA, 15 bp, Homo sapiens
tggaccaccagcccc

SEQ ID NO: 1770651 - DNA, 16 bp, Homo sapiens
tggaccaccagcccca

SEQ ID NO: 1770652 - DNA, 21 bp, Homo sapiens
tggaccaccagccccagcaag

SEQ ID NO: 1770653 - DNA, 16 bp, Homo sapiens
tggaccactcctgtcc

SEQ ID NO: 1770654 - DNA, 20 bp, Homo sapiens
tggaccactgcatgagcttt

SEQ ID NO: 1770655 - DNA, 19 bp, Homo sapiens
tggaccactgggcaatgat

SEQ ID NO: 1770656 - DNA, 14 bp, Homo sapiens
tggaccaggacagg

SEQ ID NO: 1770657 - DNA, 12 bp, Homo sapiens
tggaccaggtcc

SEQ ID NO: 1770658 - DNA, 17 bp, Homo sapiens
tggaccaggtcctgctc

SEQ ID NO: 1770659 - DNA, 19 bp, Homo sapiens
tggaccaggtcctgctccg

SEQ ID NO: 1770660 - DNA, 22 bp, Homo sapiens
tggaccaggtcctgctccgctg

SEQ ID NO: 1770661 - DNA, 20 bp, Homo sapiens
tggacccactacccttctcc

SEQ ID NO: 1770662 - DNA, 22 bp, Homo sapiens
tggacccactacccttctcctt

SEQ ID NO: 1770663 - DNA, 14 bp, Homo sapiens
tggacccagacaca

SEQ ID NO: 1770664 - DNA, 14 bp, Homo sapiens
tggaccccagctgg

SEQ ID NO: 1770665 - DNA, 15 bp, Homo sapiens
tggaccccagctggg

SEQ ID NO: 1770666 - DNA, 18 bp, Homo sapiens
tggaccccagctgggagg

SEQ ID NO: 1770667 - DNA, 19 bp, Homo sapiens
tggaccccagctgggaggc

SEQ ID NO: 1770668 - DNA, 20 bp, Homo sapiens
tggaccccagctgggaggca

SEQ ID NO: 1770669 - DNA, 17 bp, Homo sapiens
tggaccgggtgggcctg

SEQ ID NO: 1770670 - DNA, 18 bp, Homo sapiens
tggaccgggtgggcctgg

SEQ ID NO: 1770671 - DNA, 16 bp, Homo sapiens
tggaccgtggacaggc

SEQ ID NO: 1770672 - DNA, 20 bp, Homo sapiens
tggaccgtggacaggcccag

SEQ ID NO: 1770673 - DNA, 18 bp, Homo sapiens
tggacctgagtcggcccc

SEQ ID NO: 1770674 - DNA, 12 bp, Homo sapiens
tggacctggcag

SEQ ID NO: 1770675 - DNA, 16 bp, Homo sapiens
tggacctggcagtggt

SEQ ID NO: 1770676 - DNA, 19 bp, Homo sapiens
tggaccttaggccttcctc

SEQ ID NO: 1770677 - DNA, 21 bp, Homo sapiens
tggaccttaggccttcctctc

SEQ ID NO: 1770678 - DNA, 18 bp, Homo sapiens
tggaccttgacagagcag

SEQ ID NO: 1770679 - DNA, 21 bp, Homo sapiens
tggaccttgacagagcagcta

SEQ ID NO: 1770680 - DNA, 16 bp, Homo sapiens
tggaccttgagaccac

SEQ ID NO: 1770681 - DNA, 20 bp, Homo sapiens
tggacctttgggttctttct

SEQ ID NO: 1770682 - DNA, 20 bp, Homo sapiens
tggacgaagagcaggccagc

SEQ ID NO: 1770683 - DNA, 15 bp, Homo sapiens
tggacggcaggctca

SEQ ID NO: 1770684 - DNA, 18 bp, Homo sapiens
tggacgtgaaatacttcg

SEQ ID NO: 1770685 - DNA, 12 bp, Homo sapiens
tggactacacaa

SEQ ID NO: 1770686 - DNA, 14 bp, Homo sapiens
tggactacacaata

SEQ ID NO: 1770687 - DNA, 15 bp, Homo sapiens
tggactacacaatac

SEQ ID NO: 1770688 - DNA, 22 bp, Homo sapiens
tggactacacaatacagtatta

SEQ ID NO: 1770689 - DNA, 19 bp, Homo sapiens
tggactacacccaagcctg

SEQ ID NO: 1770690 - DNA, 20 bp, Homo sapiens
tggactatctgtctggtggc

SEQ ID NO: 1770691 - DNA, 22 bp, Homo sapiens
tggactatctgtctggtggccc

SEQ ID NO: 1770692 - DNA, 18 bp, Homo sapiens
tggactattataatttaa

SEQ ID NO: 1770693 - DNA, 15 bp, Homo sapiens
tggactattgtgcca

SEQ ID NO: 1770694 - DNA, 15 bp, Homo sapiens
tggactcagcagtga

SEQ ID NO: 1770695 - DNA, 12 bp, Homo sapiens
tggactccaggc

SEQ ID NO: 1770696 - DNA, 13 bp, Homo sapiens
tggactccaggcc

SEQ ID NO: 1770697 - DNA, 21 bp, Homo sapiens
tggactccaggcctgaccagg

SEQ ID NO: 1770698 - DNA, 12 bp, Homo sapiens
tggactcccctc

SEQ ID NO: 1770699 - DNA, 19 bp, Homo sapiens
tggactctaagctggagct

SEQ ID NO: 1770700 - DNA, 22 bp, Homo sapiens
tggactctaagctggagctctt

SEQ ID NO: 1770701 - DNA, 23 bp, Homo sapiens
tggactctaagctggagctcttg

SEQ ID NO: 1770702 - DNA, 20 bp, Homo sapiens
tggactctgaggactcctga

SEQ ID NO: 1770703 - DNA, 13 bp, Homo sapiens
tggactctgcaca

SEQ ID NO: 1770704 - DNA, 15 bp, Homo sapiens
tggactctgcacatg

SEQ ID NO: 1770705 - DNA, 17 bp, Homo sapiens
tggactctgcacatgaa

SEQ ID NO: 1770706 - DNA, 17 bp, Homo sapiens
tggactctgcacatgtc

SEQ ID NO: 1770707 - DNA, 19 bp, Homo sapiens
tggactctgcacatgtctt

SEQ ID NO: 1770708 - DNA, 14 bp, Homo sapiens
tggactcttccctc

SEQ ID NO: 1770709 - DNA, 18 bp, Homo sapiens
tggactgaagcctgcagg

SEQ ID NO: 1770710 - DNA, 19 bp, Homo sapiens
tggactgaagcctgcagga

SEQ ID NO: 1770711 - DNA, 13 bp, Homo sapiens
tggactgaccaaa

SEQ ID NO: 1770712 - DNA, 19 bp, Homo sapiens
tggactgaccaaagactgc

SEQ ID NO: 1770713 - DNA, 19 bp, Homo sapiens
tggactgaccacaccaacc

SEQ ID NO: 1770714 - DNA, 12 bp, Homo sapiens
tggactgactgt

SEQ ID NO: 1770715 - DNA, 16 bp, Homo sapiens
tggactgactgtgttg

SEQ ID NO: 1770716 - DNA, 14 bp, Homo sapiens
tggactgaggcctg

SEQ ID NO: 1770717 - DNA, 14 bp, Homo sapiens
tggactgcagaagc

SEQ ID NO: 1770718 - DNA, 19 bp, Homo sapiens
tggactgcagaagcaaggg

SEQ ID NO: 1770719 - DNA, 18 bp, Homo sapiens
tggactgcagtcggcatg

SEQ ID NO: 1770720 - DNA, 12 bp, Homo sapiens
tggactgcatgg

SEQ ID NO: 1770721 - DNA, 19 bp, Homo sapiens
tggactgcatggggaggca

SEQ ID NO: 1770722 - DNA, 21 bp, Homo sapiens
tggactggaggcccctggagc

SEQ ID NO: 1770723 - DNA, 19 bp, Homo sapiens
tggactggctagagtcctc

SEQ ID NO: 1770724 - DNA, 20 bp, Homo sapiens
tggactggctagagtcctca

SEQ ID NO: 1770725 - DNA, 18 bp, Homo sapiens
tggactggctgtgcccct

SEQ ID NO: 1770726 - DNA, 16 bp, Homo sapiens
tggactggtggcccct

SEQ ID NO: 1770727 - DNA, 21 bp, Homo sapiens
tggactgtcatagaaattaca

SEQ ID NO: 1770728 - DNA, 12 bp, Homo sapiens
tggactgtcctg

SEQ ID NO: 1770729 - DNA, 22 bp, Homo sapiens
tggactgtgcctcaggccaggg

SEQ ID NO: 1770730 - DNA, 18 bp, Homo sapiens
tggactgtggcacttgcc

SEQ ID NO: 1770731 - DNA, 21 bp, Homo sapiens
tggactgtggcacttgcctgg

SEQ ID NO: 1770732 - DNA, 22 bp, Homo sapiens
tggactgtggcacttgcctggg

SEQ ID NO: 1770733 - DNA, 19 bp, Homo sapiens
tggacttaagcatctggct

SEQ ID NO: 1770734 - DNA, 18 bp, Homo sapiens
tggacttcaaagcaagct

SEQ ID NO: 1770735 - DNA, 22 bp, Homo sapiens
tggacttcacataagctcagaa

SEQ ID NO: 1770736 - DNA, 18 bp, Homo sapiens
tggacttggtcttgaagt

SEQ ID NO: 1770737 - DNA, 13 bp, Homo sapiens
tggacttgtatat

SEQ ID NO: 1770738 - DNA, 18 bp, Homo sapiens
tggacttgtatatttgta

SEQ ID NO: 1770739 - DNA, 21 bp, Homo sapiens
tggacttgtatatttgtacaa

SEQ ID NO: 1770740 - DNA, 22 bp, Homo sapiens
tggacttgtatatttgtacaaa

SEQ ID NO: 1770741 - DNA, 20 bp, Homo sapiens
tggacttgtcctcagcagct

SEQ ID NO: 1770742 - DNA, 17 bp, Homo sapiens
tggacttgtgattggct

SEQ ID NO: 1770743 - DNA, 13 bp, Homo sapiens
tggacttgtttta

SEQ ID NO: 1770744 - DNA, 14 bp, Homo sapiens
tggacttgttttaa

SEQ ID NO: 1770745 - DNA, 19 bp, Homo sapiens
tggactttcctgcaactca

SEQ ID NO: 1770746 - DNA, 20 bp, Homo sapiens
tggacttttcgttaacattg

SEQ ID NO: 1770747 - DNA, 22 bp, Homo sapiens
tggacttttcgttaacattgac

SEQ ID NO: 1770748 - DNA, 13 bp, Homo sapiens
tggagaaaatggg

SEQ ID NO: 1770749 - DNA, 18 bp, Homo sapiens
tggagaaaattggaactc

SEQ ID NO: 1770750 - DNA, 17 bp, Homo sapiens
tggagaaagaagtggag

SEQ ID NO: 1770751 - DNA, 19 bp, Homo sapiens
tggagaaagaagtggagac

SEQ ID NO: 1770752 - DNA, 20 bp, Homo sapiens
tggagaaagagctgcctgga

SEQ ID NO: 1770753 - DNA, 15 bp, Homo sapiens
tggagaaatgtcata

SEQ ID NO: 1770754 - DNA, 11 bp, Homo sapiens
tggagaacagt

SEQ ID NO: 1770755 - DNA, 15 bp, Homo sapiens
tggagaacagtggtt

SEQ ID NO: 1770756 - DNA, 22 bp, Homo sapiens
tggagaacccaggggacagctg

SEQ ID NO: 1770757 - DNA, 22 bp, Homo sapiens
tggagaactgggatttgaaccc

SEQ ID NO: 1770758 - DNA, 11 bp, Homo sapiens
tggagaagaat

SEQ ID NO: 1770759 - DNA, 16 bp, Homo sapiens
tggagaagatcgcatg

SEQ ID NO: 1770760 - DNA, 18 bp, Homo sapiens
tggagaagccacaggcct

SEQ ID NO: 1770761 - DNA, 23 bp, Homo sapiens
tggagaagccacaggcctgagat

SEQ ID NO: 1770762 - DNA, 12 bp, Homo sapiens
tggagaagggag

SEQ ID NO: 1770763 - DNA, 21 bp, Homo sapiens
tggagaagggttctgccctgc

SEQ ID NO: 1770764 - DNA, 22 bp, Homo sapiens
tggagaagggttctgccctgcc

SEQ ID NO: 1770765 - DNA, 16 bp, Homo sapiens
tggagaagtctcagct

SEQ ID NO: 1770766 - DNA, 23 bp, Homo sapiens
tggagaagtctcagctaagctca

SEQ ID NO: 1770767 - DNA, 14 bp, Homo sapiens
tggagacaaggtgc

SEQ ID NO: 1770768 - DNA, 17 bp, Homo sapiens
tggagacaaggtgctaa

SEQ ID NO: 1770769 - DNA, 18 bp, Homo sapiens
tggagacaaggtgctaac

SEQ ID NO: 1770770 - DNA, 20 bp, Homo sapiens
tggagacaaggtgctaacat

SEQ ID NO: 1770771 - DNA, 17 bp, Homo sapiens
tggagacaccctctggg

SEQ ID NO: 1770772 - DNA, 20 bp, Homo sapiens
tggagacaccctctgggggt

SEQ ID NO: 1770773 - DNA, 14 bp, Homo sapiens
tggagacagggtct

SEQ ID NO: 1770774 - DNA, 22 bp, Homo sapiens
tggagacagtcctttcccacca

SEQ ID NO: 1770775 - DNA, 19 bp, Homo sapiens
tggagaccgcttcacccct

SEQ ID NO: 1770776 - DNA, 22 bp, Homo sapiens
tggagaccgcttcacccctgca

SEQ ID NO: 1770777 - DNA, 16 bp, Homo sapiens
tggattctatatttca

SEQ ID NO: 1770778 - DNA, 18 bp, Homo sapiens
tggattctatatttcata

SEQ ID NO: 1770779 - DNA, 17 bp, Homo sapiens
tggattctccctgggcc

SEQ ID NO: 1770780 - DNA, 17 bp, Homo sapiens
tggattctctaaccttt

SEQ ID NO: 1770781 - DNA, 14 bp, Homo sapiens
tggattctgaatct

SEQ ID NO: 1770782 - DNA, 23 bp, Homo sapiens
tggattctgggaggcaagaaaag

SEQ ID NO: 1770783 - DNA, 20 bp, Homo sapiens
tggattgattcagtcttctg

SEQ ID NO: 1770784 - DNA, 21 bp, Homo sapiens
tggattgattcagtcttctgg

SEQ ID NO: 1770785 - DNA, 19 bp, Homo sapiens
tggattgcaatatctgaag

SEQ ID NO: 1770786 - DNA, 17 bp, Homo sapiens
tggattgcacgtggcct

SEQ ID NO: 1770787 - DNA, 21 bp, Homo sapiens
tggattgcacgtggcctcttg

SEQ ID NO: 1770788 - DNA, 16 bp, Homo sapiens
tggatttaaaagcctg

SEQ ID NO: 1770789 - DNA, 21 bp, Homo sapiens
tggatttgattcattttcctg

SEQ ID NO: 1770790 - DNA, 15 bp, Homo sapiens
tggatttgcatattt

SEQ ID NO: 1770791 - DNA, 17 bp, Homo sapiens
tggatttggagagaaat

SEQ ID NO: 1770792 - DNA, 20 bp, Homo sapiens
tggatttggagagaaatatt

SEQ ID NO: 1770793 - DNA, 18 bp, Homo sapiens
tggatttggcactagcca

SEQ ID NO: 1770794 - DNA, 22 bp, Homo sapiens
tggatttggggtgttacagtag

SEQ ID NO: 1770795 - DNA, 19 bp, Homo sapiens
tggattttcctgaaagtgt

SEQ ID NO: 1770796 - DNA, 23 bp, Homo sapiens
tggattttctttctatgtagaac

SEQ ID NO: 1770797 - DNA, 18 bp, Homo sapiens
tggatttttctttaactg

SEQ ID NO: 1770798 - DNA, 14 bp, Homo sapiens
tggcaaaccctccc

SEQ ID NO: 1770799 - DNA, 20 bp, Homo sapiens
tggcaaaccctcccagaaac

SEQ ID NO: 1770800 - DNA, 17 bp, Homo sapiens
tggcaaacgtttctcaa

SEQ ID NO: 1770801 - DNA, 21 bp, Homo sapiens
tggcaaagccttcattgcctt

SEQ ID NO: 1770802 - DNA, 21 bp, Homo sapiens
tggcaaaggacccttgagtaa

SEQ ID NO: 1770803 - DNA, 14 bp, Homo sapiens
tggcaaagtgctgt

SEQ ID NO: 1770804 - DNA, 15 bp, Homo sapiens
tggcaaattttaaaa

SEQ ID NO: 1770805 - DNA, 19 bp, Homo sapiens
tggcaaattttaaaacatt

SEQ ID NO: 1770806 - DNA, 17 bp, Homo sapiens
tggcaacaacagcttca

SEQ ID NO: 1770807 - DNA, 15 bp, Homo sapiens
tggcaacagatctgg

SEQ ID NO: 1770808 - DNA, 17 bp, Homo sapiens
tggcaacagatctggaa

SEQ ID NO: 1770809 - DNA, 18 bp, Homo sapiens
tggcaacagatctggaac

SEQ ID NO: 1770810 - DNA, 22 bp, Homo sapiens
tggcaacagatctggaacctca

SEQ ID NO: 1770811 - DNA, 22 bp, Homo sapiens
tggcaaccttgtctctatgcca

SEQ ID NO: 1770812 - DNA, 19 bp, Homo sapiens
tggcaactcttcagacgga

SEQ ID NO: 1770813 - DNA, 22 bp, Homo sapiens
tggcaagagggtgacagcttcc

SEQ ID NO: 1770814 - DNA, 12 bp, Homo sapiens
tggcaaggaaag

SEQ ID NO: 1770815 - DNA, 21 bp, Homo sapiens
tggcaaggactttgtacattt

SEQ ID NO: 1770816 - DNA, 13 bp, Homo sapiens
tggcaattttgta

SEQ ID NO: 1770817 - DNA, 12 bp, Homo sapiens
tggcacactccc

SEQ ID NO: 1770818 - DNA, 14 bp, Homo sapiens
tggcacagaaacac

SEQ ID NO: 1770819 - DNA, 17 bp, Homo sapiens
tggcacagccctgagtg

SEQ ID NO: 1770820 - DNA, 13 bp, Homo sapiens
tggcacaggactg

SEQ ID NO: 1770821 - DNA, 16 bp, Homo sapiens
tggcacaggccccctt

SEQ ID NO: 1770822 - DNA, 15 bp, Homo sapiens
tggcacagggcagtg

SEQ ID NO: 1770823 - DNA, 22 bp, Homo sapiens
tggcacagttttctgagaaaga

SEQ ID NO: 1770824 - DNA, 14 bp, Homo sapiens
tggcacatcagaaa

SEQ ID NO: 1770825 - DNA, 18 bp, Homo sapiens
tggcacatcagaaaggaa

SEQ ID NO: 1770826 - DNA, 19 bp, Homo sapiens
tggcaccactgcactccag

SEQ ID NO: 1770827 - DNA, 14 bp, Homo sapiens
tggcaccagacacc

SEQ ID NO: 1770828 - DNA, 16 bp, Homo sapiens
tggcaccagacaccca

SEQ ID NO: 1770829 - DNA, 13 bp, Homo sapiens
tggcaccagcccc

SEQ ID NO: 1770830 - DNA, 16 bp, Homo sapiens
tggcaccagccccctg

SEQ ID NO: 1770831 - DNA, 17 bp, Homo sapiens
tggcaccagccccctgg

SEQ ID NO: 1770832 - DNA, 14 bp, Homo sapiens
tggcaccatcagcc

SEQ ID NO: 1770833 - DNA, 21 bp, Homo sapiens
tggcacccaccgtggaggagg

SEQ ID NO: 1770834 - DNA, 18 bp, Homo sapiens
tggcacccccacaagctg

SEQ ID NO: 1770835 - DNA, 13 bp, Homo sapiens
tggcaccctggaa

SEQ ID NO: 1770836 - DNA, 13 bp, Homo sapiens
tggcacctcctga

SEQ ID NO: 1770837 - DNA, 22 bp, Homo sapiens
tggcaccttcagactttgcttc

SEQ ID NO: 1770838 - DNA, 14 bp, Homo sapiens
tggcacgtattgct

SEQ ID NO: 1770839 - DNA, 22 bp, Homo sapiens
tggcactataatgtaagctcta

SEQ ID NO: 1770840 - DNA, 21 bp, Homo sapiens
tggcactcaacaatggttgaa

SEQ ID NO: 1770841 - DNA, 21 bp, Homo sapiens
tggcactctctaacgtccact

SEQ ID NO: 1770842 - DNA, 21 bp, Homo sapiens
tggcactgactgaatgctgtt

SEQ ID NO: 1770843 - DNA, 14 bp, Homo sapiens
tggcactgagcccc

SEQ ID NO: 1770844 - DNA, 17 bp, Homo sapiens
tggcactgagccccccc

SEQ ID NO: 1770845 - DNA, 13 bp, Homo sapiens
tggcactgggagg

SEQ ID NO: 1770846 - DNA, 17 bp, Homo sapiens
tggcactggggcacttg

SEQ ID NO: 1770847 - DNA, 17 bp, Homo sapiens
tggcactgttaatacac

SEQ ID NO: 1770848 - DNA, 16 bp, Homo sapiens
tggcacttaagtgcac

SEQ ID NO: 1770849 - DNA, 18 bp, Homo sapiens
tggcacttagcccaagag

SEQ ID NO: 1770850 - DNA, 23 bp, Homo sapiens
tggcacttagcccaagaggtctg

SEQ ID NO: 1770851 - DNA, 22 bp, Homo sapiens
tggcacttgccattccaaaata

SEQ ID NO: 1770852 - DNA, 15 bp, Homo sapiens
tggcacttgcctggg

SEQ ID NO: 1770853 - DNA, 16 bp, Homo sapiens
tggcacttgcctgggt

SEQ ID NO: 1770854 - DNA, 17 bp, Homo sapiens
tggcacttgcctgggtc

SEQ ID NO: 1770855 - DNA, 22 bp, Homo sapiens
tggcacttgtatttaattcttc

SEQ ID NO: 1770856 - DNA, 20 bp, Homo sapiens
tggcactttgttttcaagat

SEQ ID NO: 1770857 - DNA, 20 bp, Homo sapiens
tggcagaaaaaatgtctgta

SEQ ID NO: 1770858 - DNA, 17 bp, Homo sapiens
tggcagaaaagaggaga

SEQ ID NO: 1770859 - DNA, 22 bp, Homo sapiens
tggcagaagcattgcctggact

SEQ ID NO: 1770860 - DNA, 19 bp, Homo sapiens
tggcagaagggaattgctc

SEQ ID NO: 1770861 - DNA, 19 bp, Homo sapiens
tggcagaataatctttggg

SEQ ID NO: 1770862 - DNA, 14 bp, Homo sapiens
tggcagacaaacag

SEQ ID NO: 1770863 - DNA, 19 bp, Homo sapiens
tggcagagaaggcctcttg

SEQ ID NO: 1770864 - DNA, 23 bp, Homo sapiens
tggcagagaaggcctcttgtgct

SEQ ID NO: 1770865 - DNA, 15 bp, Homo sapiens
tggcagaggtgcaag

SEQ ID NO: 1770866 - DNA, 17 bp, Homo sapiens
tggcagagttacagttc

SEQ ID NO: 1770867 - DNA, 19 bp, Homo sapiens
tggcagagttacagttctg

SEQ ID NO: 1770868 - DNA, 20 bp, Homo sapiens
tggcagagttacagttctgt

SEQ ID NO: 1770869 - DNA, 20 bp, Homo sapiens
tggcagattcccactgccgc

SEQ ID NO: 1770870 - DNA, 13 bp, Homo sapiens
tggcagattttac

SEQ ID NO: 1770871 - DNA, 17 bp, Homo sapiens
tggcagattttacaaaa

SEQ ID NO: 1770872 - DNA, 13 bp, Homo sapiens
tggcagcagcccc

SEQ ID NO: 1770873 - DNA, 15 bp, Homo sapiens
tggcagccatgcctc

SEQ ID NO: 1770874 - DNA, 18 bp, Homo sapiens
tggcagccatgcctcatg

SEQ ID NO: 1770875 - DNA, 12 bp, Homo sapiens
tggcagccctgt

SEQ ID NO: 1770876 - DNA, 14 bp, Homo sapiens
tggcagccgagctc

SEQ ID NO: 1770877 - DNA, 13 bp, Homo sapiens
tggcagcctgcac

SEQ ID NO: 1770878 - DNA, 17 bp, Homo sapiens
tggcagctagactggag

SEQ ID NO: 1770879 - DNA, 20 bp, Homo sapiens
tggcagctagactggagtga

SEQ ID NO: 1770880 - DNA, 22 bp, Homo sapiens
tggcagctagactggagtgagg

SEQ ID NO: 1770881 - DNA, 14 bp, Homo sapiens
tggcagctagtgcc

SEQ ID NO: 1770882 - DNA, 16 bp, Homo sapiens
tggcagctagtgcctt

SEQ ID NO: 1770883 - DNA, 16 bp, Homo sapiens
tggcagctcaaagact

SEQ ID NO: 1770884 - DNA, 23 bp, Homo sapiens
tggcagctcctctccttgggctc

SEQ ID NO: 1770885 - DNA, 22 bp, Homo sapiens
tggcagctctggacagccccac

SEQ ID NO: 1770886 - DNA, 16 bp, Homo sapiens
tggcagctgcccctgg

SEQ ID NO: 1770887 - DNA, 13 bp, Homo sapiens
tggcagctgggga

SEQ ID NO: 1770888 - DNA, 17 bp, Homo sapiens
tggcagctgtttctcat

SEQ ID NO: 1770889 - DNA, 21 bp, Homo sapiens
tggcagctgtttctcatgaag

SEQ ID NO: 1770890 - DNA, 17 bp, Homo sapiens
tggcagcttaacattga

SEQ ID NO: 1770891 - DNA, 19 bp, Homo sapiens
tggcccacgccctccctct

SEQ ID NO: 1770892 - DNA, 18 bp, Homo sapiens
tggcccactgctggctgc

SEQ ID NO: 1770893 - DNA, 22 bp, Homo sapiens
tggcccagaaagcctctctctc

SEQ ID NO: 1770894 - DNA, 13 bp, Homo sapiens
tggcccagagcct

SEQ ID NO: 1770895 - DNA, 23 bp, Homo sapiens
tggcccagccggcctctctggcc

SEQ ID NO: 1770896 - DNA, 19 bp, Homo sapiens
tggcccagcggcccctccc

SEQ ID NO: 1770897 - DNA, 18 bp, Homo sapiens
tggcccaggagctctgcg

SEQ ID NO: 1770898 - DNA, 17 bp, Homo sapiens
tggcccagggcccagag

SEQ ID NO: 1770899 - DNA, 20 bp, Homo sapiens
tggcccagggcccagagccc

SEQ ID NO: 1770900 - DNA, 23 bp, Homo sapiens
tggcccagggcccagagcccagc

SEQ ID NO: 1770901 - DNA, 13 bp, Homo sapiens
tggcccagggggc

SEQ ID NO: 1770902 - DNA, 19 bp, Homo sapiens
tggcccagtcctctcccaa

SEQ ID NO: 1770903 - DNA, 20 bp, Homo sapiens
tggcccatagaaacatgaca

SEQ ID NO: 1770904 - DNA, 15 bp, Homo sapiens
tggcccatcaactgt

SEQ ID NO: 1770905 - DNA, 13 bp, Homo sapiens
tggccccaccctg

SEQ ID NO: 1770906 - DNA, 18 bp, Homo sapiens
tggccccaccctgggccc

SEQ ID NO: 1770907 - DNA, 19 bp, Homo sapiens
tggccccactttgaagggc

SEQ ID NO: 1770908 - DNA, 16 bp, Homo sapiens
tggccccagccctgct

SEQ ID NO: 1770909 - DNA, 21 bp, Homo sapiens
tggccccagccctgctgggga

SEQ ID NO: 1770910 - DNA, 21 bp, Homo sapiens
tggccccagtgcggttcctca

SEQ ID NO: 1770911 - DNA, 22 bp, Homo sapiens
tggccccagtgcggttcctcat

SEQ ID NO: 1770912 - DNA, 21 bp, Homo sapiens
tggccccatgtctctcagaat

SEQ ID NO: 1770913 - DNA, 14 bp, Homo sapiens
tggcccccaataaa

SEQ ID NO: 1770914 - DNA, 16 bp, Homo sapiens
tggcccccaataaagg

SEQ ID NO: 1770915 - DNA, 18 bp, Homo sapiens
tggcccccaataaaggca

SEQ ID NO: 1770916 - DNA, 20 bp, Homo sapiens
tggcccccaataaaggcagc

SEQ ID NO: 1770917 - DNA, 22 bp, Homo sapiens
tggcccccaataaaggcagctg

SEQ ID NO: 1770918 - DNA, 23 bp, Homo sapiens
tggcccccaataaaggcagctgc

SEQ ID NO: 1770919 - DNA, 16 bp, Homo sapiens
tggcccccaggggcag

SEQ ID NO: 1770920 - DNA, 15 bp, Homo sapiens
tggccccctccgtga

SEQ ID NO: 1770921 - DNA, 16 bp, Homo sapiens
tggccccgcctgcctg

SEQ ID NO: 1770922 - DNA, 20 bp, Homo sapiens
tggccccgggctctggccac

SEQ ID NO: 1770923 - DNA, 22 bp, Homo sapiens
tggccccgggctctggccaccc

SEQ ID NO: 1770924 - DNA, 15 bp, Homo sapiens
tggccccgtttctgg

SEQ ID NO: 1770925 - DNA, 21 bp, Homo sapiens
tggcccctccagaccctgcct

SEQ ID NO: 1770926 - DNA, 10 bp, Homo sapiens
tggcccctct

SEQ ID NO: 1770927 - DNA, 12 bp, Homo sapiens
tggcccctctga

SEQ ID NO: 1770928 - DNA, 14 bp, Homo sapiens
tggcccctgaacaa

SEQ ID NO: 1770929 - DNA, 21 bp, Homo sapiens
tggcccctgagcccagagaag

SEQ ID NO: 1770930 - DNA, 22 bp, Homo sapiens
tggcccctgctgtctctctggg

SEQ ID NO: 1770931 - DNA, 18 bp, Homo sapiens
tggcccctgtctcggggc

SEQ ID NO: 1770932 - DNA, 17 bp, Homo sapiens
tggccccttttactttt

SEQ ID NO: 1770933 - DNA, 21 bp, Homo sapiens
tggcccgcccctcgctgctgc

SEQ ID NO: 1770934 - DNA, 16 bp, Homo sapiens
tggccctcacccctgc

SEQ ID NO: 1770935 - DNA, 18 bp, Homo sapiens
tggccctcacccctgccc

SEQ ID NO: 1770936 - DNA, 20 bp, Homo sapiens
tggccctcacccctgccctg

SEQ ID NO: 1770937 - DNA, 22 bp, Homo sapiens
tggccctcactcaagaccaggc

SEQ ID NO: 1770938 - DNA, 11 bp, Homo sapiens
tggccctccac

SEQ ID NO: 1770939 - DNA, 20 bp, Homo sapiens
tggccctcggaggtccagct

SEQ ID NO: 1770940 - DNA, 19 bp, Homo sapiens
tggccctcttgcgggcctg

SEQ ID NO: 1770941 - DNA, 13 bp, Homo sapiens
tggccctgccgtt

SEQ ID NO: 1770942 - DNA, 11 bp, Homo sapiens
tggccctgcct

SEQ ID NO: 1770943 - DNA, 14 bp, Homo sapiens
tggccctggagcca

SEQ ID NO: 1770944 - DNA, 17 bp, Homo sapiens
tggccctggagccaggg

SEQ ID NO: 1770945 - DNA, 19 bp, Homo sapiens
tggccctggagccagggca

SEQ ID NO: 1770946 - DNA, 13 bp, Homo sapiens
tggccctggccct

SEQ ID NO: 1770947 - DNA, 17 bp, Homo sapiens
tggccctggcctgctgg

SEQ ID NO: 1770948 - DNA, 12 bp, Homo sapiens
tggccctgggcg

SEQ ID NO: 1770949 - DNA, 13 bp, Homo sapiens
tggccctggggat

SEQ ID NO: 1770950 - DNA, 19 bp, Homo sapiens
tggccctggggatcttccc

SEQ ID NO: 1770951 - DNA, 15 bp, Homo sapiens
tggccctgtgcctgg

SEQ ID NO: 1770952 - DNA, 19 bp, Homo sapiens
tggccctgtgcctgggccc

SEQ ID NO: 1770953 - DNA, 23 bp, Homo sapiens
tggcccttaagccaaactcaggc

SEQ ID NO: 1770954 - DNA, 21 bp, Homo sapiens
tggcccttacttgcttctcta

SEQ ID NO: 1770955 - DNA, 18 bp, Homo sapiens
tggcccttcagtctgctc

SEQ ID NO: 1770956 - DNA, 20 bp, Homo sapiens
tggcccttcagtctgctcca

SEQ ID NO: 1770957 - DNA, 22 bp, Homo sapiens
tggcccttcagtctgctccacc

SEQ ID NO: 1770958 - DNA, 23 bp, Homo sapiens
tggcccttgcagttcagcaccac

SEQ ID NO: 1770959 - DNA, 18 bp, Homo sapiens
tggccgaagccccttgga

SEQ ID NO: 1770960 - DNA, 19 bp, Homo sapiens
tggccgaagccccttggag

SEQ ID NO: 1770961 - DNA, 22 bp, Homo sapiens
tggccgaagccccttggagaga

SEQ ID NO: 1770962 - DNA, 17 bp, Homo sapiens
tggccgcacgcctctcc

SEQ ID NO: 1770963 - DNA, 13 bp, Homo sapiens
tggccgccacctg

SEQ ID NO: 1770964 - DNA, 23 bp, Homo sapiens
tggccgccccctgccccccagcc

SEQ ID NO: 1770965 - DNA, 18 bp, Homo sapiens
tggccgcctggcaggtgg

SEQ ID NO: 1770966 - DNA, 21 bp, Homo sapiens
tggccgcgccaaataatgtct

SEQ ID NO: 1770967 - DNA, 12 bp, Homo sapiens
tggccgctccgt

SEQ ID NO: 1770968 - DNA, 20 bp, Homo sapiens
tggccggcttgctgctccgg

SEQ ID NO: 1770969 - DNA, 16 bp, Homo sapiens
tggccgggcacagtgg

SEQ ID NO: 1770970 - DNA, 24 bp, Homo sapiens
tggccgggcacagtggctcacgcc

SEQ ID NO: 1770971 - DNA, 18 bp, Homo sapiens
tggccgggctgctgctga

SEQ ID NO: 1770972 - DNA, 16 bp, Homo sapiens
tggccggtgctgggtt

SEQ ID NO: 1770973 - DNA, 18 bp, Homo sapiens
tggccggtgctgggttcc

SEQ ID NO: 1770974 - DNA, 15 bp, Homo sapiens
tggccgtctcctccc

SEQ ID NO: 1770975 - DNA, 19 bp, Homo sapiens
tggccgtggtccagctctt

SEQ ID NO: 1770976 - DNA, 14 bp, Homo sapiens
tggccgttcagcct

SEQ ID NO: 1770977 - DNA, 15 bp, Homo sapiens
tggccgttcagcctg

SEQ ID NO: 1770978 - DNA, 19 bp, Homo sapiens
tggccgttcagcctgtctc

SEQ ID NO: 1770979 - DNA, 18 bp, Homo sapiens
tggcctagaccagcagac

SEQ ID NO: 1770980 - DNA, 20 bp, Homo sapiens
tggcctagcaggcacaggac

SEQ ID NO: 1770981 - DNA, 14 bp, Homo sapiens
tggcctatgcacat

SEQ ID NO: 1770982 - DNA, 19 bp, Homo sapiens
tggcctatgtggtctaagg

SEQ ID NO: 1770983 - DNA, 20 bp, Homo sapiens
tggcctattatattaaaata

SEQ ID NO: 1770984 - DNA, 19 bp, Homo sapiens
tggcctcaagtgatccacc

SEQ ID NO: 1770985 - DNA, 13 bp, Homo sapiens
tggcctcactggc

SEQ ID NO: 1770986 - DNA, 16 bp, Homo sapiens
tggcctcactggctgg

SEQ ID NO: 1770987 - DNA, 22 bp, Homo sapiens
tggcctcagaggaccctttcca

SEQ ID NO: 1770988 - DNA, 17 bp, Homo sapiens
tggcctcagctgcctca

SEQ ID NO: 1770989 - DNA, 16 bp, Homo sapiens
tggcctcagttcccag

SEQ ID NO: 1770990 - DNA, 20 bp, Homo sapiens
tggcctcagttcccagctcc

SEQ ID NO: 1770991 - DNA, 15 bp, Homo sapiens
tggcctcatgtggct

SEQ ID NO: 1770992 - DNA, 20 bp, Homo sapiens
tggcctcatgtggctggaag

SEQ ID NO: 1770993 - DNA, 14 bp, Homo sapiens
tggcctccatttct

SEQ ID NO: 1770994 - DNA, 14 bp, Homo sapiens
tggcctcccacccg

SEQ ID NO: 1770995 - DNA, 13 bp, Homo sapiens
tggcctcccagaa

SEQ ID NO: 1770996 - DNA, 20 bp, Homo sapiens
tggcctcccagaatgctggg

SEQ ID NO: 1770997 - DNA, 14 bp, Homo sapiens
tggcctcccctgcc

SEQ ID NO: 1770998 - DNA, 15 bp, Homo sapiens
tggcctcccctgcca

SEQ ID NO: 1770999 - DNA, 17 bp, Homo sapiens
tggcctcccctgccacc

SEQ ID NO: 1771000 - DNA, 19 bp, Homo sapiens
tggcctcccctgccaccag

SEQ ID NO: 1771001 - DNA, 21 bp, Homo sapiens
tggcctcccctgccaccaggc

SEQ ID NO: 1771002 - DNA, 12 bp, Homo sapiens
tggcctccctgc

SEQ ID NO: 1771003 - DNA, 19 bp, Homo sapiens
tggcctccctgctgtgcca

SEQ ID NO: 1771004 - DNA, 22 bp, Homo sapiens
tggcctcccttctcctttctaa

SEQ ID NO: 1771005 - DNA, 15 bp, Homo sapiens
tggctcaggcccagc

SEQ ID NO: 1771006 - DNA, 21 bp, Homo sapiens
tggctcagggtcaaagacaga

SEQ ID NO: 1771007 - DNA, 14 bp, Homo sapiens
tggctcagggtggt

SEQ ID NO: 1771008 - DNA, 14 bp, Homo sapiens
tggctcagtgcctt

SEQ ID NO: 1771009 - DNA, 22 bp, Homo sapiens
tggctcatggcgtaatgggcct

SEQ ID NO: 1771010 - DNA, 23 bp, Homo sapiens
tggctcatggcgtaatgggcctg

SEQ ID NO: 1771011 - DNA, 15 bp, Homo sapiens
tggctccagaaatgt

SEQ ID NO: 1771012 - DNA, 20 bp, Homo sapiens
tggctccagaaatgtctaaa

SEQ ID NO: 1771013 - DNA, 20 bp, Homo sapiens
tggctccaggcagaaggaga

SEQ ID NO: 1771014 - DNA, 16 bp, Homo sapiens
tggctcccacaggagt

SEQ ID NO: 1771015 - DNA, 17 bp, Homo sapiens
tggctcccacaggccct

SEQ ID NO: 1771016 - DNA, 14 bp, Homo sapiens
tggctcccaggaca

SEQ ID NO: 1771017 - DNA, 20 bp, Homo sapiens
tggctcccatgaccatactg

SEQ ID NO: 1771018 - DNA, 17 bp, Homo sapiens
tggctcccattcactct

SEQ ID NO: 1771019 - DNA, 19 bp, Homo sapiens
tggctccccacgagtcacc

SEQ ID NO: 1771020 - DNA, 23 bp, Homo sapiens
tggctccccacgagtcacctgca

SEQ ID NO: 1771021 - DNA, 17 bp, Homo sapiens
tggctccccctctgctt

SEQ ID NO: 1771022 - DNA, 19 bp, Homo sapiens
tggctccccctctgcttct

SEQ ID NO: 1771023 - DNA, 19 bp, Homo sapiens
tggctcccgcggtgccatg

SEQ ID NO: 1771024 - DNA, 17 bp, Homo sapiens
tggctccctcctccagg

SEQ ID NO: 1771025 - DNA, 21 bp, Homo sapiens
tggctccctcctccaggcctg

SEQ ID NO: 1771026 - DNA, 14 bp, Homo sapiens
tggctccctgcccc

SEQ ID NO: 1771027 - DNA, 19 bp, Homo sapiens
tggctccggcctctgcctt

SEQ ID NO: 1771028 - DNA, 16 bp, Homo sapiens
tggctcctcccggtgc

SEQ ID NO: 1771029 - DNA, 23 bp, Homo sapiens
tggctcctgaggggcatctgccc

SEQ ID NO: 1771030 - DNA, 13 bp, Homo sapiens
tggctcctgggcc

SEQ ID NO: 1771031 - DNA, 20 bp, Homo sapiens
tggctcctgggccggctgag

SEQ ID NO: 1771032 - DNA, 17 bp, Homo sapiens
tggctcctgtctggctc

SEQ ID NO: 1771033 - DNA, 18 bp, Homo sapiens
tggctcgaatctctgtgc

SEQ ID NO: 1771034 - DNA, 19 bp, Homo sapiens
tggctcgaatctctgtgcc

SEQ ID NO: 1771035 - DNA, 20 bp, Homo sapiens
tggctcgcagggtgcaggag

SEQ ID NO: 1771036 - DNA, 15 bp, Homo sapiens
tggctcgctccctgt

SEQ ID NO: 1771037 - DNA, 18 bp, Homo sapiens
tggctcggacccacccca

SEQ ID NO: 1771038 - DNA, 19 bp, Homo sapiens
tggctcggacccaccccaa

SEQ ID NO: 1771039 - DNA, 19 bp, Homo sapiens
tggctctaattcacagtgc

SEQ ID NO: 1771040 - DNA, 17 bp, Homo sapiens
tggctctaccctgtctg

SEQ ID NO: 1771041 - DNA, 21 bp, Homo sapiens
tggctctaccctgtctgtccc

SEQ ID NO: 1771042 - DNA, 15 bp, Homo sapiens
tggctctccaagtgc

SEQ ID NO: 1771043 - DNA, 20 bp, Homo sapiens
tggctctccaagtgccagag

SEQ ID NO: 1771044 - DNA, 14 bp, Homo sapiens
tggctctgagaatc

SEQ ID NO: 1771045 - DNA, 20 bp, Homo sapiens
tggctctgaggtgcctgtcc

SEQ ID NO: 1771046 - DNA, 22 bp, Homo sapiens
tggctctgggtacctgcaagca

SEQ ID NO: 1771047 - DNA, 23 bp, Homo sapiens
tggctctggtatgaattcacccg

SEQ ID NO: 1771048 - DNA, 20 bp, Homo sapiens
tggctcttgatacccccctc

SEQ ID NO: 1771049 - DNA, 16 bp, Homo sapiens
tggctgaaattctcct

SEQ ID NO: 1771050 - DNA, 21 bp, Homo sapiens
tggctgaaattctcctggagg

SEQ ID NO: 1771051 - DNA, 16 bp, Homo sapiens
tggctgaaccctgtgc

SEQ ID NO: 1771052 - DNA, 20 bp, Homo sapiens
tggctgaaccctgtgctggt

SEQ ID NO: 1771053 - DNA, 13 bp, Homo sapiens
tggctgaagctgg

SEQ ID NO: 1771054 - DNA, 20 bp, Homo sapiens
tggctgaagctggagcagcg

SEQ ID NO: 1771055 - DNA, 21 bp, Homo sapiens
tggctgacccagtccctgggg

SEQ ID NO: 1771056 - DNA, 14 bp, Homo sapiens
tggctgacccctct

SEQ ID NO: 1771057 - DNA, 17 bp, Homo sapiens
tggctgagacactgaag

SEQ ID NO: 1771058 - DNA, 14 bp, Homo sapiens
tggctgagatggag

SEQ ID NO: 1771059 - DNA, 21 bp, Homo sapiens
tggctgagcaaatattaaaat

SEQ ID NO: 1771060 - DNA, 21 bp, Homo sapiens
tggctgaggttcctctgcctg

SEQ ID NO: 1771061 - DNA, 23 bp, Homo sapiens
tggctgaggttcctctgcctgcc

SEQ ID NO: 1771062 - DNA, 21 bp, Homo sapiens
tggctgagtggaatgcaggga

SEQ ID NO: 1771063 - DNA, 13 bp, Homo sapiens
tggctgcaattgc

SEQ ID NO: 1771064 - DNA, 22 bp, Homo sapiens
tggctgcaccacttccagggtt

SEQ ID NO: 1771065 - DNA, 20 bp, Homo sapiens
tggctgcagcggcaggaccg

SEQ ID NO: 1771066 - DNA, 21 bp, Homo sapiens
tggctgcaggtgttctgctga

SEQ ID NO: 1771067 - DNA, 13 bp, Homo sapiens
tggctgccaggcg

SEQ ID NO: 1771068 - DNA, 23 bp, Homo sapiens
tggctgcccagacccctctggcc

SEQ ID NO: 1771069 - DNA, 18 bp, Homo sapiens
tggctgccccacctgccg

SEQ ID NO: 1771070 - DNA, 14 bp, Homo sapiens
tggctgccctggcc

SEQ ID NO: 1771071 - DNA, 16 bp, Homo sapiens
tggctgccctggccct

SEQ ID NO: 1771072 - DNA, 14 bp, Homo sapiens
tggctgccggagga

SEQ ID NO: 1771073 - DNA, 17 bp, Homo sapiens
tggctgcctcatttaga

SEQ ID NO: 1771074 - DNA, 22 bp, Homo sapiens
tggctgccttgtgaaggaatta

SEQ ID NO: 1771075 - DNA, 16 bp, Homo sapiens
tggctgctgcccccac

SEQ ID NO: 1771076 - DNA, 13 bp, Homo sapiens
tggctgctgggct

SEQ ID NO: 1771077 - DNA, 15 bp, Homo sapiens
tggctgcttcctgtg

SEQ ID NO: 1771078 - DNA, 17 bp, Homo sapiens
tggctgcttcctgtgac

SEQ ID NO: 1771079 - DNA, 12 bp, Homo sapiens
tggctgcttctc

SEQ ID NO: 1771080 - DNA, 18 bp, Homo sapiens
tggctggaaactgctccc

SEQ ID NO: 1771081 - DNA, 21 bp, Homo sapiens
tggctggaggagctggcctgt

SEQ ID NO: 1771082 - DNA, 22 bp, Homo sapiens
tggctggaggagctggcctgtg

SEQ ID NO: 1771083 - DNA, 23 bp, Homo sapiens
tggctggaggagctggcctgtgg

SEQ ID NO: 1771084 - DNA, 23 bp, Homo sapiens
tggctggcagctgagagccctgc

SEQ ID NO: 1771085 - DNA, 17 bp, Homo sapiens
tggctggcccgtcatgt

SEQ ID NO: 1771086 - DNA, 12 bp, Homo sapiens
tggctggcctgg

SEQ ID NO: 1771087 - DNA, 13 bp, Homo sapiens
tggctggcctggt

SEQ ID NO: 1771088 - DNA, 22 bp, Homo sapiens
tggctggctaactggaagcatg

SEQ ID NO: 1771089 - DNA, 13 bp, Homo sapiens
tggctggctgcag

SEQ ID NO: 1771090 - DNA, 14 bp, Homo sapiens
tggctggctgcagt

SEQ ID NO: 1771091 - DNA, 18 bp, Homo sapiens
tggctgggcgtgctagag

SEQ ID NO: 1771092 - DNA, 22 bp, Homo sapiens
tggctgggcgtgctagaggttg

SEQ ID NO: 1771093 - DNA, 17 bp, Homo sapiens
tggctgggctggctgaa

SEQ ID NO: 1771094 - DNA, 20 bp, Homo sapiens
tggctggggcagaggggcag

SEQ ID NO: 1771095 - DNA, 13 bp, Homo sapiens
tggctgggtcctt

SEQ ID NO: 1771096 - DNA, 23 bp, Homo sapiens
tggctgggtccttgggcctggcc

SEQ ID NO: 1771097 - DNA, 16 bp, Homo sapiens
tggctgggtgccctct

SEQ ID NO: 1771098 - DNA, 17 bp, Homo sapiens
tggctgtaatcagttat

SEQ ID NO: 1771099 - DNA, 22 bp, Homo sapiens
tggctgtaatcatttgtttaca

SEQ ID NO: 1771100 - DNA, 19 bp, Homo sapiens
tggctgtaatgacaaaaga

SEQ ID NO: 1771101 - DNA, 21 bp, Homo sapiens
tggctgtagatggtgacctgg

SEQ ID NO: 1771102 - DNA, 19 bp, Homo sapiens
tggctgtctagaatgtgga

SEQ ID NO: 1771103 - DNA, 13 bp, Homo sapiens
tggctgtctgcct

SEQ ID NO: 1771104 - DNA, 19 bp, Homo sapiens
tggctgtctgcctgtattt

SEQ ID NO: 1771105 - DNA, 17 bp, Homo sapiens
tggctgtgagacgaggc

SEQ ID NO: 1771106 - DNA, 20 bp, Homo sapiens
tggctgtgagacgaggcagg

SEQ ID NO: 1771107 - DNA, 16 bp, Homo sapiens
tggctgtgagcagcct

SEQ ID NO: 1771108 - DNA, 18 bp, Homo sapiens
tggctgtgagcagcctcc

SEQ ID NO: 1771109 - DNA, 18 bp, Homo sapiens
tggctgtgcccagcaggc

SEQ ID NO: 1771110 - DNA, 14 bp, Homo sapiens
tggctgtggaggcc

SEQ ID NO: 1771111 - DNA, 16 bp, Homo sapiens
tggctgtggaggcctg

SEQ ID NO: 1771112 - DNA, 17 bp, Homo sapiens
tggctgtggaggcctga

SEQ ID NO: 1771113 - DNA, 21 bp, Homo sapiens
tggctgtggaggcctgatgct

SEQ ID NO: 1771114 - DNA, 13 bp, Homo sapiens
tggctgtggcaca

SEQ ID NO: 1771115 - DNA, 16 bp, Homo sapiens
tggctgtggcacagac

SEQ ID NO: 1771116 - DNA, 17 bp, Homo sapiens
tggctgtggcacagact

SEQ ID NO: 1771117 - DNA, 20 bp, Homo sapiens
tggctgtggcatttccaaac

SEQ ID NO: 1771118 - DNA, 14 bp, Homo sapiens
tggctgttccagac

SEQ ID NO: 1771119 - DNA, 14 bp, Homo sapiens
tgggaccctttcct

SEQ ID NO: 1771120 - DNA, 18 bp, Homo sapiens
tgggaccctttccttcct

SEQ ID NO: 1771121 - DNA, 18 bp, Homo sapiens
tgggacctgccaggcagg

SEQ ID NO: 1771122 - DNA, 23 bp, Homo sapiens
tgggacggtgcccaagccagagg

SEQ ID NO: 1771123 - DNA, 18 bp, Homo sapiens
tgggacgtggtcagggca

SEQ ID NO: 1771124 - DNA, 21 bp, Homo sapiens
tgggactacaggcacaggcca

SEQ ID NO: 1771125 - DNA, 17 bp, Homo sapiens
tgggactcagccttcag

SEQ ID NO: 1771126 - DNA, 15 bp, Homo sapiens
tgggactcaggatat

SEQ ID NO: 1771127 - DNA, 15 bp, Homo sapiens
tgggactctcctcct

SEQ ID NO: 1771128 - DNA, 22 bp, Homo sapiens
tgggactctcctcctcccctcc

SEQ ID NO: 1771129 - DNA, 21 bp, Homo sapiens
tgggactgatgtcatcttgag

SEQ ID NO: 1771130 - DNA, 18 bp, Homo sapiens
tgggacttccatgcctta

SEQ ID NO: 1771131 - DNA, 16 bp, Homo sapiens
tgggacttctacccag

SEQ ID NO: 1771132 - DNA, 23 bp, Homo sapiens
tgggactttccttccctctcctg

SEQ ID NO: 1771133 - DNA, 17 bp, Homo sapiens
tgggacttttctttctt

SEQ ID NO: 1771134 - DNA, 13 bp, Homo sapiens
tgggagaaagcaa

SEQ ID NO: 1771135 - DNA, 22 bp, Homo sapiens
tgggagaacctcaggcttcctt

SEQ ID NO: 1771136 - DNA, 18 bp, Homo sapiens
tgggagaaggactatcaa

SEQ ID NO: 1771137 - DNA, 22 bp, Homo sapiens
tgggagaatgtcagtatgtgga

SEQ ID NO: 1771138 - DNA, 15 bp, Homo sapiens
tgggagacagcagcc

SEQ ID NO: 1771139 - DNA, 18 bp, Homo sapiens
tgggagacagcagcctgt

SEQ ID NO: 1771140 - DNA, 21 bp, Homo sapiens
tgggagagacttgttttggat

SEQ ID NO: 1771141 - DNA, 18 bp, Homo sapiens
tgggagagcccagccatt

SEQ ID NO: 1771142 - DNA, 15 bp, Homo sapiens
tgggagattggcttt

SEQ ID NO: 1771143 - DNA, 21 bp, Homo sapiens
tgggagcagcggtttggggag

SEQ ID NO: 1771144 - DNA, 10 bp, Homo sapiens
tgggagccag

SEQ ID NO: 1771145 - DNA, 17 bp, Homo sapiens
tgggagccagctgcttt

SEQ ID NO: 1771146 - DNA, 11 bp, Homo sapiens
tgggagccagg

SEQ ID NO: 1771147 - DNA, 24 bp, Homo sapiens
tgggagccaggagtaagacaagtg

SEQ ID NO: 1771148 - DNA, 16 bp, Homo sapiens
tgggagccccagggtc

SEQ ID NO: 1771149 - DNA, 12 bp, Homo sapiens
tgggagcctagc

SEQ ID NO: 1771150 - DNA, 16 bp, Homo sapiens
tgggagctccactctg

SEQ ID NO: 1771151 - DNA, 22 bp, Homo sapiens
tgggagctccactctgcttctc

SEQ ID NO: 1771152 - DNA, 14 bp, Homo sapiens
tgggagctgagctg

SEQ ID NO: 1771153 - DNA, 19 bp, Homo sapiens
tgggagctggttagaaatg

SEQ ID NO: 1771154 - DNA, 12 bp, Homo sapiens
tgggaggaaaag

SEQ ID NO: 1771155 - DNA, 21 bp, Homo sapiens
tgggaggaaagggcctggcca

SEQ ID NO: 1771156 - DNA, 14 bp, Homo sapiens
tgggaggagggaga

SEQ ID NO: 1771157 - DNA, 15 bp, Homo sapiens
tgggaggagggagag

SEQ ID NO: 1771158 - DNA, 18 bp, Homo sapiens
tgggaggagggagaggga

SEQ ID NO: 1771159 - DNA, 14 bp, Homo sapiens
tgggaggcaagaaa

SEQ ID NO: 1771160 - DNA, 15 bp, Homo sapiens
tgggaggcaagaaaa

SEQ ID NO: 1771161 - DNA, 17 bp, Homo sapiens
tgggaggcaagaaaagg

SEQ ID NO: 1771162 - DNA, 21 bp, Homo sapiens
tgggaggcagccgaggcctgg

SEQ ID NO: 1771163 - DNA, 12 bp, Homo sapiens
tgggaggcaggg

SEQ ID NO: 1771164 - DNA, 13 bp, Homo sapiens
tgggaggccaagg

SEQ ID NO: 1771165 - DNA, 14 bp, Homo sapiens
tgggaggccaaggc

SEQ ID NO: 1771166 - DNA, 14 bp, Homo sapiens
tgggaggcgtgccc

SEQ ID NO: 1771167 - DNA, 16 bp, Homo sapiens
tgggaggcgtgccccc

SEQ ID NO: 1771168 - DNA, 17 bp, Homo sapiens
tgggaggcgtgcccccc

SEQ ID NO: 1771169 - DNA, 22 bp, Homo sapiens
tgggaggcgtgcccccctcctc

SEQ ID NO: 1771170 - DNA, 14 bp, Homo sapiens
tgggaggctgaggc

SEQ ID NO: 1771171 - DNA, 19 bp, Homo sapiens
tgggaggggaagggctggg

SEQ ID NO: 1771172 - DNA, 12 bp, Homo sapiens
tgggaggggcag

SEQ ID NO: 1771173 - DNA, 23 bp, Homo sapiens
tgggagggggcttgaagccaaag

SEQ ID NO: 1771174 - DNA, 18 bp, Homo sapiens
tgggagggttcccctggc

SEQ ID NO: 1771175 - DNA, 14 bp, Homo sapiens
tgggaggtgcgtgt

SEQ ID NO: 1771176 - DNA, 19 bp, Homo sapiens
tgggaggtggaagaaggga

SEQ ID NO: 1771177 - DNA, 20 bp, Homo sapiens
tgggaggtgttggctgcacg

SEQ ID NO: 1771178 - DNA, 23 bp, Homo sapiens
tgggagtcacacagtgttggagg

SEQ ID NO: 1771179 - DNA, 21 bp, Homo sapiens
tgggagtgaggatgtctgggc

SEQ ID NO: 1771180 - DNA, 13 bp, Homo sapiens
tgggagtgtgggc

SEQ ID NO: 1771181 - DNA, 17 bp, Homo sapiens
tgggagtgtgggctgcc

SEQ ID NO: 1771182 - DNA, 11 bp, Homo sapiens
tgggagtgtgt

SEQ ID NO: 1771183 - DNA, 13 bp, Homo sapiens
tgggagtgtgtaa

SEQ ID NO: 1771184 - DNA, 17 bp, Homo sapiens
tgggagtgtgtctgctg

SEQ ID NO: 1771185 - DNA, 20 bp, Homo sapiens
tgggagtttttatgagaaac

SEQ ID NO: 1771186 - DNA, 22 bp, Homo sapiens
tgggatacttagtggtatgtct

SEQ ID NO: 1771187 - DNA, 21 bp, Homo sapiens
tgggatagtgttctgctcctg

SEQ ID NO: 1771188 - DNA, 18 bp, Homo sapiens
tgggatatggctgcccag

SEQ ID NO: 1771189 - DNA, 15 bp, Homo sapiens
tgggatcaataggaa

SEQ ID NO: 1771190 - DNA, 14 bp, Homo sapiens
tgggatcctccctc

SEQ ID NO: 1771191 - DNA, 19 bp, Homo sapiens
tgggatcctccctcatggc

SEQ ID NO: 1771192 - DNA, 15 bp, Homo sapiens
tgggatctgagctcc

SEQ ID NO: 1771193 - DNA, 14 bp, Homo sapiens
tgggatctggggag

SEQ ID NO: 1771194 - DNA, 22 bp, Homo sapiens
tgggatctggggagagcggctg

SEQ ID NO: 1771195 - DNA, 18 bp, Homo sapiens
tgggatctgttttctgga

SEQ ID NO: 1771196 - DNA, 14 bp, Homo sapiens
tgggatgaggtcac

SEQ ID NO: 1771197 - DNA, 20 bp, Homo sapiens
tgggatgccaatttcctctc

SEQ ID NO: 1771198 - DNA, 14 bp, Homo sapiens
tgggatggaggaga

SEQ ID NO: 1771199 - DNA, 23 bp, Homo sapiens
tgggatggcatttggtctcaggc

SEQ ID NO: 1771200 - DNA, 19 bp, Homo sapiens
tgggatgggttccagaggt

SEQ ID NO: 1771201 - DNA, 20 bp, Homo sapiens
tgggatggtcggatctcaca

SEQ ID NO: 1771202 - DNA, 21 bp, Homo sapiens
tgggatggtcggatctcacag

SEQ ID NO: 1771203 - DNA, 21 bp, Homo sapiens
tgggatgttcagcactgtccc

SEQ ID NO: 1771204 - DNA, 23 bp, Homo sapiens
tgggattaagaaaccttgctctc

SEQ ID NO: 1771205 - DNA, 15 bp, Homo sapiens
tgggattactggcat

SEQ ID NO: 1771206 - DNA, 15 bp, Homo sapiens
tgggattatgggtca

SEQ ID NO: 1771207 - DNA, 16 bp, Homo sapiens
tgggattcctgaccca

SEQ ID NO: 1771208 - DNA, 21 bp, Homo sapiens
tgggattcctgacccaggccg

SEQ ID NO: 1771209 - DNA, 24 bp, Homo sapiens
tgggattcctgacccaggccgcag

SEQ ID NO: 1771210 - DNA, 18 bp, Homo sapiens
tgggattgggggctggtg

SEQ ID NO: 1771211 - DNA, 13 bp, Homo sapiens
tgggatttgagat

SEQ ID NO: 1771212 - DNA, 20 bp, Homo sapiens
tgggatttggggcctcaaga

SEQ ID NO: 1771213 - DNA, 15 bp, Homo sapiens
tgggattttgcaaaa

SEQ ID NO: 1771214 - DNA, 16 bp, Homo sapiens
tgggattttttccctt

SEQ ID NO: 1771215 - DNA, 14 bp, Homo sapiens
tgggcaacagagca

SEQ ID NO: 1771216 - DNA, 15 bp, Homo sapiens
tgggcaactggctga

SEQ ID NO: 1771217 - DNA, 15 bp, Homo sapiens
tgggcaagtcactta

SEQ ID NO: 1771218 - DNA, 17 bp, Homo sapiens
tgggcaattgttacaag

SEQ ID NO: 1771219 - DNA, 21 bp, Homo sapiens
tgggcaattgttacaagtgtt

SEQ ID NO: 1771220 - DNA, 21 bp, Homo sapiens
tgggcacctgcgcacaggtgg

SEQ ID NO: 1771221 - DNA, 22 bp, Homo sapiens
tgggcactccgcgccgatgcca

SEQ ID NO: 1771222 - DNA, 15 bp, Homo sapiens
tgggcactttttaat

SEQ ID NO: 1771223 - DNA, 16 bp, Homo sapiens
tgggcagaaggccaag

SEQ ID NO: 1771224 - DNA, 18 bp, Homo sapiens
tgggcagaaggccaagag

SEQ ID NO: 1771225 - DNA, 14 bp, Homo sapiens
tgggcagcaaggct

SEQ ID NO: 1771226 - DNA, 20 bp, Homo sapiens
tgggcagcaaggctgctgcc

SEQ ID NO: 1771227 - DNA, 17 bp, Homo sapiens
tgggcagcacaaggcct

SEQ ID NO: 1771228 - DNA, 13 bp, Homo sapiens
tgggcagccagac

SEQ ID NO: 1771229 - DNA, 14 bp, Homo sapiens
tgggcagccaggct

SEQ ID NO: 1771230 - DNA, 16 bp, Homo sapiens
tgggcagccaggctgc

SEQ ID NO: 1771231 - DNA, 21 bp, Homo sapiens
tgggcagctggggggctgtcc

SEQ ID NO: 1771232 - DNA, 15 bp, Homo sapiens
tgggcaggaggcccc

SEQ ID NO: 1771233 - DNA, 18 bp, Homo sapiens
tgggcaggaggccccagg

SEQ ID NO: 1771234 - DNA, 22 bp, Homo sapiens
tggggccggcggggcccacgca

SEQ ID NO: 1771235 - DNA, 21 bp, Homo sapiens
tggggcctagcgatctctcct

SEQ ID NO: 1771236 - DNA, 13 bp, Homo sapiens
tggggcctcaaga

SEQ ID NO: 1771237 - DNA, 20 bp, Homo sapiens
tggggcctccagaactcact

SEQ ID NO: 1771238 - DNA, 19 bp, Homo sapiens
tggggcctccagaagctgc

SEQ ID NO: 1771239 - DNA, 20 bp, Homo sapiens
tggggcctccagaagctgct

SEQ ID NO: 1771240 - DNA, 21 bp, Homo sapiens
tggggcctccagaagctgctc

SEQ ID NO: 1771241 - DNA, 19 bp, Homo sapiens
tggggcctccttgtccagg

SEQ ID NO: 1771242 - DNA, 17 bp, Homo sapiens
tggggcctggacctgcc

SEQ ID NO: 1771243 - DNA, 16 bp, Homo sapiens
tggggcctggcttgct

SEQ ID NO: 1771244 - DNA, 21 bp, Homo sapiens
tggggcctggcttgctccagg

SEQ ID NO: 1771245 - DNA, 19 bp, Homo sapiens
tggggcgctcccactcaga

SEQ ID NO: 1771246 - DNA, 15 bp, Homo sapiens
tggggctacaggatg

SEQ ID NO: 1771247 - DNA, 20 bp, Homo sapiens
tggggctcacttttcatcct

SEQ ID NO: 1771248 - DNA, 14 bp, Homo sapiens
tggggctccctctc

SEQ ID NO: 1771249 - DNA, 21 bp, Homo sapiens
tggggctcctttctccagcca

SEQ ID NO: 1771250 - DNA, 17 bp, Homo sapiens
tggggctgagcctgagg

SEQ ID NO: 1771251 - DNA, 22 bp, Homo sapiens
tggggctgatctcagggaagcc

SEQ ID NO: 1771252 - DNA, 13 bp, Homo sapiens
tggggctgccgga

SEQ ID NO: 1771253 - DNA, 21 bp, Homo sapiens
tggggctgcgggacagaggac

SEQ ID NO: 1771254 - DNA, 16 bp, Homo sapiens
tggggctgctccccta

SEQ ID NO: 1771255 - DNA, 14 bp, Homo sapiens
tggggctgctcctc

SEQ ID NO: 1771256 - DNA, 21 bp, Homo sapiens
tggggctgctcctccagggcc

SEQ ID NO: 1771257 - DNA, 11 bp, Homo sapiens
tggggctggca

SEQ ID NO: 1771258 - DNA, 15 bp, Homo sapiens
tggggctggcatcaa

SEQ ID NO: 1771259 - DNA, 18 bp, Homo sapiens
tggggctgtcctgctgcc

SEQ ID NO: 1771260 - DNA, 21 bp, Homo sapiens
tggggctgtcctgctgccctc

SEQ ID NO: 1771261 - DNA, 22 bp, Homo sapiens
tggggctgtcgggggctgtgga

SEQ ID NO: 1771262 - DNA, 15 bp, Homo sapiens
tggggcttcaccagt

SEQ ID NO: 1771263 - DNA, 15 bp, Homo sapiens
tggggcttctcctga

SEQ ID NO: 1771264 - DNA, 16 bp, Homo sapiens
tggggctttcccagga

SEQ ID NO: 1771265 - DNA, 23 bp, Homo sapiens
tgggggaagactttaaaccacct

SEQ ID NO: 1771266 - DNA, 15 bp, Homo sapiens
tgggggaagccctgg

SEQ ID NO: 1771267 - DNA, 14 bp, Homo sapiens
tgggggaaggcagg

SEQ ID NO: 1771268 - DNA, 16 bp, Homo sapiens
tgggggaaggcaggag

SEQ ID NO: 1771269 - DNA, 15 bp, Homo sapiens
tgggggacagccttc

SEQ ID NO: 1771270 - DNA, 15 bp, Homo sapiens
tgggggagagaggca

SEQ ID NO: 1771271 - DNA, 14 bp, Homo sapiens
tgggggagagggtg

SEQ ID NO: 1771272 - DNA, 12 bp, Homo sapiens
tgggggagccag

SEQ ID NO: 1771273 - DNA, 16 bp, Homo sapiens
tgggggagccaggaga

SEQ ID NO: 1771274 - DNA, 16 bp, Homo sapiens
tgggggagggaagacc

SEQ ID NO: 1771275 - DNA, 18 bp, Homo sapiens
tgggggagggaagaccag

SEQ ID NO: 1771276 - DNA, 21 bp, Homo sapiens
tgggggagggaagaccagaat

SEQ ID NO: 1771277 - DNA, 15 bp, Homo sapiens
tgggggatctgggca

SEQ ID NO: 1771278 - DNA, 20 bp, Homo sapiens
tgggggatgactagaggcag

SEQ ID NO: 1771279 - DNA, 11 bp, Homo sapiens
tgggggatgta

SEQ ID NO: 1771280 - DNA, 17 bp, Homo sapiens
tgggggcagagggcaga

SEQ ID NO: 1771281 - DNA, 13 bp, Homo sapiens
tgggggcagggct

SEQ ID NO: 1771282 - DNA, 21 bp, Homo sapiens
tgggggcgccctctctgctcc

SEQ ID NO: 1771283 - DNA, 13 bp, Homo sapiens
tgggggctcctgt

SEQ ID NO: 1771284 - DNA, 18 bp, Homo sapiens
tgggggctgtcctgctca

SEQ ID NO: 1771285 - DNA, 20 bp, Homo sapiens
tgggggctgtcctgctcacc

SEQ ID NO: 1771286 - DNA, 19 bp, Homo sapiens
tgggggctttccttttatt

SEQ ID NO: 1771287 - DNA, 15 bp, Homo sapiens
tggggggcattgagt

SEQ ID NO: 1771288 - DNA, 17 bp, Homo sapiens
tggggggcgggccaggg

SEQ ID NO: 1771289 - DNA, 15 bp, Homo sapiens
tggggggctgtcctg

SEQ ID NO: 1771290 - DNA, 15 bp, Homo sapiens
tgggggtagcagctg

SEQ ID NO: 1771291 - DNA, 17 bp, Homo sapiens
tgggggtagcagctgga

SEQ ID NO: 1771292 - DNA, 18 bp, Homo sapiens
tgggggtagcagctggac

SEQ ID NO: 1771293 - DNA, 14 bp, Homo sapiens
tgggggtctgtgtg

SEQ ID NO: 1771294 - DNA, 15 bp, Homo sapiens
tgggggtgagggtcc

SEQ ID NO: 1771295 - DNA, 21 bp, Homo sapiens
tgggggtgccgctctaaattg

SEQ ID NO: 1771296 - DNA, 21 bp, Homo sapiens
tgggggtgccgctttctctga

SEQ ID NO: 1771297 - DNA, 18 bp, Homo sapiens
tgggggtgggaactcacg

SEQ ID NO: 1771298 - DNA, 17 bp, Homo sapiens
tgggggtggggagacct

SEQ ID NO: 1771299 - DNA, 22 bp, Homo sapiens
tgggggtgttcagccactgagg

SEQ ID NO: 1771300 - DNA, 12 bp, Homo sapiens
tgggggttgctg

SEQ ID NO: 1771301 - DNA, 22 bp, Homo sapiens
tggggtaagccagagcctgggg

SEQ ID NO: 1771302 - DNA, 21 bp, Homo sapiens
tggggtaggttgggagaatgt

SEQ ID NO: 1771303 - DNA, 20 bp, Homo sapiens
tggggtcaagaaacagccag

SEQ ID NO: 1771304 - DNA, 16 bp, Homo sapiens
tggggtcctcctgtgc

SEQ ID NO: 1771305 - DNA, 17 bp, Homo sapiens
tggggtcctcctgtgct

SEQ ID NO: 1771306 - DNA, 20 bp, Homo sapiens
tggggtcctggagcagacca

SEQ ID NO: 1771307 - DNA, 13 bp, Homo sapiens
tggggtccttgga

SEQ ID NO: 1771308 - DNA, 23 bp, Homo sapiens
tggggtctcacagtgttgcccag

SEQ ID NO: 1771309 - DNA, 19 bp, Homo sapiens
tggggtctgagcatgatgg

SEQ ID NO: 1771310 - DNA, 17 bp, Homo sapiens
tggggtgaggaccactc

SEQ ID NO: 1771311 - DNA, 20 bp, Homo sapiens
tggggtgagggacagagccc

SEQ ID NO: 1771312 - DNA, 23 bp, Homo sapiens
tggggtgagggagttagggagag

SEQ ID NO: 1771313 - DNA, 15 bp, Homo sapiens
tggggtgagggatca

SEQ ID NO: 1771314 - DNA, 12 bp, Homo sapiens
tggggtgcatct

SEQ ID NO: 1771315 - DNA, 14 bp, Homo sapiens
tggggtgctgccct

SEQ ID NO: 1771316 - DNA, 21 bp, Homo sapiens
tggggtgggggggggtcctaa

SEQ ID NO: 1771317 - DNA, 22 bp, Homo sapiens
tggggtgggggtggggagacct

SEQ ID NO: 1771318 - DNA, 18 bp, Homo sapiens
tggggttatctctgtgtt

SEQ ID NO: 1771319 - DNA, 19 bp, Homo sapiens
tggggttatctctgtgtta

SEQ ID NO: 1771320 - DNA, 16 bp, Homo sapiens
tggggttcaagcccag

SEQ ID NO: 1771321 - DNA, 19 bp, Homo sapiens
tggggttcaagcccaggct

SEQ ID NO: 1771322 - DNA, 15 bp, Homo sapiens
tggggttcagcccct

SEQ ID NO: 1771323 - DNA, 22 bp, Homo sapiens
tggggttcagcccctcctctgc

SEQ ID NO: 1771324 - DNA, 13 bp, Homo sapiens
tggggttctggaa

SEQ ID NO: 1771325 - DNA, 15 bp, Homo sapiens
tggggttctggaaat

SEQ ID NO: 1771326 - DNA, 22 bp, Homo sapiens
tggggttgggggacagccttca

SEQ ID NO: 1771327 - DNA, 12 bp, Homo sapiens
tggggttttgta

SEQ ID NO: 1771328 - DNA, 23 bp, Homo sapiens
tgggtaaaatacttttactctgc

SEQ ID NO: 1771329 - DNA, 15 bp, Homo sapiens
tgggtaagaggagca

SEQ ID NO: 1771330 - DNA, 17 bp, Homo sapiens
tgggtaagaggagcaga

SEQ ID NO: 1771331 - DNA, 23 bp, Homo sapiens
tgggtaatccaggcacagctgag

SEQ ID NO: 1771332 - DNA, 18 bp, Homo sapiens
tgggtaattgtacaataa

SEQ ID NO: 1771333 - DNA, 16 bp, Homo sapiens
tgggtaatttataaag

SEQ ID NO: 1771334 - DNA, 13 bp, Homo sapiens
tgggtacatcaag

SEQ ID NO: 1771335 - DNA, 22 bp, Homo sapiens
tgggtacatcaagtccatctga

SEQ ID NO: 1771336 - DNA, 16 bp, Homo sapiens
tgggtactgactgaga

SEQ ID NO: 1771337 - DNA, 17 bp, Homo sapiens
tgggtactgactgagat

SEQ ID NO: 1771338 - DNA, 19 bp, Homo sapiens
tgggtactggagcttttaa

SEQ ID NO: 1771339 - DNA, 17 bp, Homo sapiens
tgggtacttatactaaa

SEQ ID NO: 1771340 - DNA, 24 bp, Homo sapiens
tgggtaggtggttcgtgctgtgct

SEQ ID NO: 1771341 - DNA, 18 bp, Homo sapiens
tgggtatcccctgcctcc

SEQ ID NO: 1771342 - DNA, 19 bp, Homo sapiens
tgggtatcctgcccagtgt

SEQ ID NO: 1771343 - DNA, 22 bp, Homo sapiens
tgggtatccttaatagaggagc

SEQ ID NO: 1771344 - DNA, 22 bp, Homo sapiens
tgggtattaaacttgtcagaat

SEQ ID NO: 1771345 - DNA, 22 bp, Homo sapiens
tgggtatttttataacaatata

SEQ ID NO: 1771346 - DNA, 21 bp, Homo sapiens
tgggtcacagagtgagactcc

SEQ ID NO: 1771347 - DNA, 13 bp, Homo sapiens
tgggtcacaggaa

SEQ ID NO: 1771348 - DNA, 20 bp, Homo sapiens
tggtaggaatgcttccgaga

SEQ ID NO: 1771349 - DNA, 15 bp, Homo sapiens
tggtaggggcaggga

SEQ ID NO: 1771350 - DNA, 15 bp, Homo sapiens
tggtaggtaaatcta

SEQ ID NO: 1771351 - DNA, 14 bp, Homo sapiens
tggtaggttgggac

SEQ ID NO: 1771352 - DNA, 18 bp, Homo sapiens
tggtagtacccagggcca

SEQ ID NO: 1771353 - DNA, 15 bp, Homo sapiens
tggtagtatctcgta

SEQ ID NO: 1771354 - DNA, 21 bp, Homo sapiens
tggtagtgtagctgtgtggct

SEQ ID NO: 1771355 - DNA, 14 bp, Homo sapiens
tggtagttctgtgc

SEQ ID NO: 1771356 - DNA, 18 bp, Homo sapiens
tggtagttctgtgcctcc

SEQ ID NO: 1771357 - DNA, 19 bp, Homo sapiens
tggtataaaaggttgccaa

SEQ ID NO: 1771358 - DNA, 14 bp, Homo sapiens
tggtatacatgtgt

SEQ ID NO: 1771359 - DNA, 21 bp, Homo sapiens
tggtatacatgtgtacatata

SEQ ID NO: 1771360 - DNA, 13 bp, Homo sapiens
tggtatatataca

SEQ ID NO: 1771361 - DNA, 22 bp, Homo sapiens
tggtatgaaataaattctgact

SEQ ID NO: 1771362 - DNA, 17 bp, Homo sapiens
tggtatgagggggtggt

SEQ ID NO: 1771363 - DNA, 22 bp, Homo sapiens
tggtatgggggatttcaaactt

SEQ ID NO: 1771364 - DNA, 13 bp, Homo sapiens
tggtatgtctgcc

SEQ ID NO: 1771365 - DNA, 24 bp, Homo sapiens
tggtattaactttatacacttgga

SEQ ID NO: 1771366 - DNA, 14 bp, Homo sapiens
tggtcaacacttaa

SEQ ID NO: 1771367 - DNA, 17 bp, Homo sapiens
tggtcaaggccacctct

SEQ ID NO: 1771368 - DNA, 22 bp, Homo sapiens
tggtcaaggccacctctgcctc

SEQ ID NO: 1771369 - DNA, 23 bp, Homo sapiens
tggtcaaggccacctctgcctct

SEQ ID NO: 1771370 - DNA, 15 bp, Homo sapiens
tggtcaatgcagttt

SEQ ID NO: 1771371 - DNA, 23 bp, Homo sapiens
tggtcaccaaatcagctgctact

SEQ ID NO: 1771372 - DNA, 19 bp, Homo sapiens
tggtcacccgactttggaa

SEQ ID NO: 1771373 - DNA, 15 bp, Homo sapiens
tggtcaccttcgagt

SEQ ID NO: 1771374 - DNA, 14 bp, Homo sapiens
tggtcactctgccc

SEQ ID NO: 1771375 - DNA, 16 bp, Homo sapiens
tggtcactctgccctc

SEQ ID NO: 1771376 - DNA, 12 bp, Homo sapiens
tggtcagagtgc

SEQ ID NO: 1771377 - DNA, 22 bp, Homo sapiens
tggtcagatttgaactcttcaa

SEQ ID NO: 1771378 - DNA, 15 bp, Homo sapiens
tggtcagcttttgtt

SEQ ID NO: 1771379 - DNA, 15 bp, Homo sapiens
tggtcagggcagggc

SEQ ID NO: 1771380 - DNA, 15 bp, Homo sapiens
tggtcataaaataga

SEQ ID NO: 1771381 - DNA, 15 bp, Homo sapiens
tggtcatatacatat

SEQ ID NO: 1771382 - DNA, 16 bp, Homo sapiens
tggtcatatacatatt

SEQ ID NO: 1771383 - DNA, 17 bp, Homo sapiens
tggtcatatacatattg

SEQ ID NO: 1771384 - DNA, 16 bp, Homo sapiens
tggtcatcaccaccct

SEQ ID NO: 1771385 - DNA, 13 bp, Homo sapiens
tggtcatgctcag

SEQ ID NO: 1771386 - DNA, 15 bp, Homo sapiens
tggtcatgctcagcc

SEQ ID NO: 1771387 - DNA, 23 bp, Homo sapiens
tggtcatgctcagccttgctgct

SEQ ID NO: 1771388 - DNA, 20 bp, Homo sapiens
tggtccaaaaaaaggaaaaa

SEQ ID NO: 1771389 - DNA, 19 bp, Homo sapiens
tggtccaattagtttcctt

SEQ ID NO: 1771390 - DNA, 21 bp, Homo sapiens
tggtccaattagtttcctttt

SEQ ID NO: 1771391 - DNA, 23 bp, Homo sapiens
tggtccaattagtttccttttta

SEQ ID NO: 1771392 - DNA, 17 bp, Homo sapiens
tggtccagaaacaaaaa

SEQ ID NO: 1771393 - DNA, 14 bp, Homo sapiens
tggtccagcctggt

SEQ ID NO: 1771394 - DNA, 19 bp, Homo sapiens
tggtccagcgtcactccag

SEQ ID NO: 1771395 - DNA, 21 bp, Homo sapiens
tggtccagcgtcactccagtg

SEQ ID NO: 1771396 - DNA, 23 bp, Homo sapiens
tggtccagctctgacatcccttc

SEQ ID NO: 1771397 - DNA, 13 bp, Homo sapiens
tggtccagctctt

SEQ ID NO: 1771398 - DNA, 15 bp, Homo sapiens
tggtccagctcttgg

SEQ ID NO: 1771399 - DNA, 21 bp, Homo sapiens
tggtccagctcttggcccctg

SEQ ID NO: 1771400 - DNA, 15 bp, Homo sapiens
tggtccagcttgctc

SEQ ID NO: 1771401 - DNA, 22 bp, Homo sapiens
tggtccagcttgctcttcagtg

SEQ ID NO: 1771402 - DNA, 17 bp, Homo sapiens
tggtccatttgttcctg

SEQ ID NO: 1771403 - DNA, 18 bp, Homo sapiens
tggtccatttgttcctgc

SEQ ID NO: 1771404 - DNA, 17 bp, Homo sapiens
tggtcccatcctctaaa

SEQ ID NO: 1771405 - DNA, 13 bp, Homo sapiens
tggtccctcaccc

SEQ ID NO: 1771406 - DNA, 22 bp, Homo sapiens
tggtccctccagaaccaccccg

SEQ ID NO: 1771407 - DNA, 13 bp, Homo sapiens
tggtccctgagga

SEQ ID NO: 1771408 - DNA, 19 bp, Homo sapiens
tggtccctgggaggaaatt

SEQ ID NO: 1771409 - DNA, 13 bp, Homo sapiens
tggtcccttaagg

SEQ ID NO: 1771410 - DNA, 13 bp, Homo sapiens
tggtccgtgccca

SEQ ID NO: 1771411 - DNA, 23 bp, Homo sapiens
tggtcctcacaagcctcttctga

SEQ ID NO: 1771412 - DNA, 22 bp, Homo sapiens
tggtcctctctctgtggggctg

SEQ ID NO: 1771413 - DNA, 12 bp, Homo sapiens
tggtcctggcct

SEQ ID NO: 1771414 - DNA, 12 bp, Homo sapiens
tggtcctggctg

SEQ ID NO: 1771415 - DNA, 17 bp, Homo sapiens
tggtcctggctgcactc

SEQ ID NO: 1771416 - DNA, 19 bp, Homo sapiens
tggtcctggctgcactctt

SEQ ID NO: 1771417 - DNA, 19 bp, Homo sapiens
tggtcctggggctctgtgc

SEQ ID NO: 1771418 - DNA, 14 bp, Homo sapiens
tggtcctttacact

SEQ ID NO: 1771419 - DNA, 15 bp, Homo sapiens
tggtcctttctggaa

SEQ ID NO: 1771420 - DNA, 23 bp, Homo sapiens
tggtcgagaaagaggcaccagga

SEQ ID NO: 1771421 - DNA, 17 bp, Homo sapiens
tggtcgaggagtaacaa

SEQ ID NO: 1771422 - DNA, 19 bp, Homo sapiens
tggtcgagtgacacacctc

SEQ ID NO: 1771423 - DNA, 15 bp, Homo sapiens
tggtcgctcctgccc

SEQ ID NO: 1771424 - DNA, 20 bp, Homo sapiens
tggtcggatctcacaggctg

SEQ ID NO: 1771425 - DNA, 23 bp, Homo sapiens
tggtctaacactggcatgttcaa

SEQ ID NO: 1771426 - DNA, 16 bp, Homo sapiens
tggtctactctagaag

SEQ ID NO: 1771427 - DNA, 18 bp, Homo sapiens
tggtctcaaactcctgac

SEQ ID NO: 1771428 - DNA, 21 bp, Homo sapiens
tggtctccttgcactttctca

SEQ ID NO: 1771429 - DNA, 17 bp, Homo sapiens
tggtctccttgggccct

SEQ ID NO: 1771430 - DNA, 17 bp, Homo sapiens
tggtctcgatctcctga

SEQ ID NO: 1771431 - DNA, 14 bp, Homo sapiens
tggtctctgtgcca

SEQ ID NO: 1771432 - DNA, 13 bp, Homo sapiens
tggtctgccagaa

SEQ ID NO: 1771433 - DNA, 17 bp, Homo sapiens
tggtctggctttaagaa

SEQ ID NO: 1771434 - DNA, 22 bp, Homo sapiens
tggtctgggtgtagctcttaga

SEQ ID NO: 1771435 - DNA, 18 bp, Homo sapiens
tggtctgttggcaggctg

SEQ ID NO: 1771436 - DNA, 14 bp, Homo sapiens
tggtctttctggag

SEQ ID NO: 1771437 - DNA, 11 bp, Homo sapiens
tggtctttgct

SEQ ID NO: 1771438 - DNA, 14 bp, Homo sapiens
tggtctttgctcca

SEQ ID NO: 1771439 - DNA, 19 bp, Homo sapiens
tggtgaactgttggagccc

SEQ ID NO: 1771440 - DNA, 18 bp, Homo sapiens
tggtgaagggaagtgggg

SEQ ID NO: 1771441 - DNA, 14 bp, Homo sapiens
tggtgaatggattt

SEQ ID NO: 1771442 - DNA, 13 bp, Homo sapiens
tggtgaattttcc

SEQ ID NO: 1771443 - DNA, 20 bp, Homo sapiens
tggtgaattttccaagaaca

SEQ ID NO: 1771444 - DNA, 18 bp, Homo sapiens
tggtgacaccagcctttc

SEQ ID NO: 1771445 - DNA, 14 bp, Homo sapiens
tggtgacacctccc

SEQ ID NO: 1771446 - DNA, 18 bp, Homo sapiens
tggtgacacctccccctt

SEQ ID NO: 1771447 - DNA, 19 bp, Homo sapiens
tggtgacctgatgtaaaca

SEQ ID NO: 1771448 - DNA, 18 bp, Homo sapiens
tggtgagagtcaaagctg

SEQ ID NO: 1771449 - DNA, 17 bp, Homo sapiens
tggtgagcagagcggga

SEQ ID NO: 1771450 - DNA, 19 bp, Homo sapiens
tggtgagcctagccctggg

SEQ ID NO: 1771451 - DNA, 21 bp, Homo sapiens
tggtgagctgggaagctgtac

SEQ ID NO: 1771452 - DNA, 18 bp, Homo sapiens
tggtgaggggctttctct

SEQ ID NO: 1771453 - DNA, 19 bp, Homo sapiens
tggtgaggggctttctctt

SEQ ID NO: 1771454 - DNA, 20 bp, Homo sapiens
tggtgaggggctttctcttc

SEQ ID NO: 1771455 - DNA, 23 bp, Homo sapiens
tggtgagggtgccccgcctgagt

SEQ ID NO: 1771456 - DNA, 20 bp, Homo sapiens
tggtgagtcttggcggcagc

SEQ ID NO: 1771457 - DNA, 13 bp, Homo sapiens
tggtgatgactta

SEQ ID NO: 1771458 - DNA, 14 bp, Homo sapiens
tggtgatttgaaaa

SEQ ID NO: 1771459 - DNA, 19 bp, Homo sapiens
tggtgatttgaaaaatata

SEQ ID NO: 1771460 - DNA, 16 bp, Homo sapiens
tggtgattttaaatgt

SEQ ID NO: 1771461 - DNA, 16 bp, Homo sapiens
tggtgcaagttgagga

SEQ ID NO: 1771462 - DNA, 20 bp, Homo sapiens
tggtgcacaagtaacacatt

SEQ ID NO: 1771463 - DNA, 16 bp, Homo sapiens
tgtaacatccaagcca

SEQ ID NO: 1771464 - DNA, 16 bp, Homo sapiens
tgtaacattggtgaag

SEQ ID NO: 1771465 - DNA, 15 bp, Homo sapiens
tgtaactaagttatt

SEQ ID NO: 1771466 - DNA, 16 bp, Homo sapiens
tgtaactactttataa

SEQ ID NO: 1771467 - DNA, 18 bp, Homo sapiens
tgtaactattgggtgaat

SEQ ID NO: 1771468 - DNA, 12 bp, Homo sapiens
tgtaactcaact

SEQ ID NO: 1771469 - DNA, 16 bp, Homo sapiens
tgtaactgagagaaag

SEQ ID NO: 1771470 - DNA, 21 bp, Homo sapiens
tgtaactgaggactgtttgca

SEQ ID NO: 1771471 - DNA, 19 bp, Homo sapiens
tgtaactgctgagccactc

SEQ ID NO: 1771472 - DNA, 14 bp, Homo sapiens
tgtaacttcctgct

SEQ ID NO: 1771473 - DNA, 19 bp, Homo sapiens
tgtaacttcctgctgcacc

SEQ ID NO: 1771474 - DNA, 22 bp, Homo sapiens
tgtaacttcctgctgcaccctg

SEQ ID NO: 1771475 - DNA, 16 bp, Homo sapiens
tgtaacttgcttaaat

SEQ ID NO: 1771476 - DNA, 18 bp, Homo sapiens
tgtaactttcataccact

SEQ ID NO: 1771477 - DNA, 23 bp, Homo sapiens
tgtaactttccactcttcctgta

SEQ ID NO: 1771478 - DNA, 15 bp, Homo sapiens
tgtaacttttgtaag

SEQ ID NO: 1771479 - DNA, 21 bp, Homo sapiens
tgtaagaagagactgggaaga

SEQ ID NO: 1771480 - DNA, 18 bp, Homo sapiens
tgtaagaagctgtgaata

SEQ ID NO: 1771481 - DNA, 14 bp, Homo sapiens
tgtaagaaggcaat

SEQ ID NO: 1771482 - DNA, 18 bp, Homo sapiens
tgtaagaattcagaagac

SEQ ID NO: 1771483 - DNA, 18 bp, Homo sapiens
tgtaagacccttattgct

SEQ ID NO: 1771484 - DNA, 21 bp, Homo sapiens
tgtaagaggctgacttttcca

SEQ ID NO: 1771485 - DNA, 22 bp, Homo sapiens
tgtaagagtgagctctggtgga

SEQ ID NO: 1771486 - DNA, 12 bp, Homo sapiens
tgtaagatgctg

SEQ ID NO: 1771487 - DNA, 14 bp, Homo sapiens
tgtaagatgctggg

SEQ ID NO: 1771488 - DNA, 22 bp, Homo sapiens
tgtaagcaaaggctctgaaata

SEQ ID NO: 1771489 - DNA, 18 bp, Homo sapiens
tgtaagcactctggatga

SEQ ID NO: 1771490 - DNA, 19 bp, Homo sapiens
tgtaagccatcagaagtta

SEQ ID NO: 1771491 - DNA, 18 bp, Homo sapiens
tgtaaggctctagatcat

SEQ ID NO: 1771492 - DNA, 18 bp, Homo sapiens
tgtaagggaaactgccag

SEQ ID NO: 1771493 - DNA, 13 bp, Homo sapiens
tgtaagggcagtg

SEQ ID NO: 1771494 - DNA, 14 bp, Homo sapiens
tgtaagggcagtgc

SEQ ID NO: 1771495 - DNA, 16 bp, Homo sapiens
tgtaagggcagtgccc

SEQ ID NO: 1771496 - DNA, 19 bp, Homo sapiens
tgtaaggtatatcattcta

SEQ ID NO: 1771497 - DNA, 16 bp, Homo sapiens
tgtaaggttgtgcagg

SEQ ID NO: 1771498 - DNA, 16 bp, Homo sapiens
tgtaagtgaaattaag

SEQ ID NO: 1771499 - DNA, 15 bp, Homo sapiens
tgtaagtgtaaaaaa

SEQ ID NO: 1771500 - DNA, 13 bp, Homo sapiens
tgtaagtttattt

SEQ ID NO: 1771501 - DNA, 17 bp, Homo sapiens
tgtaataaaaagcctct

SEQ ID NO: 1771502 - DNA, 15 bp, Homo sapiens
tgtaataaactttaa

SEQ ID NO: 1771503 - DNA, 16 bp, Homo sapiens
tgtaataaattcaaaa

SEQ ID NO: 1771504 - DNA, 15 bp, Homo sapiens
tgtaataagaaagta

SEQ ID NO: 1771505 - DNA, 13 bp, Homo sapiens
tgtaataagcaat

SEQ ID NO: 1771506 - DNA, 20 bp, Homo sapiens
tgtaatagggaaaattctaa

SEQ ID NO: 1771507 - DNA, 23 bp, Homo sapiens
tgtaatagttctatccttttgcc

SEQ ID NO: 1771508 - DNA, 17 bp, Homo sapiens
tgtaatataaagatgtt

SEQ ID NO: 1771509 - DNA, 23 bp, Homo sapiens
tgtaatataaagtattcaacaat

SEQ ID NO: 1771510 - DNA, 20 bp, Homo sapiens
tgtaatataaatttaagcaa

SEQ ID NO: 1771511 - DNA, 21 bp, Homo sapiens
tgtaatatatttcagacattt

SEQ ID NO: 1771512 - DNA, 19 bp, Homo sapiens
tgtaatattcattcaaaag

SEQ ID NO: 1771513 - DNA, 20 bp, Homo sapiens
tgtaatattgtaaatactgg

SEQ ID NO: 1771514 - DNA, 17 bp, Homo sapiens
tgtaatatttcttcaaa

SEQ ID NO: 1771515 - DNA, 14 bp, Homo sapiens
tgtaatcaagaaaa

SEQ ID NO: 1771516 - DNA, 17 bp, Homo sapiens
tgtaatcatataataaa

SEQ ID NO: 1771517 - DNA, 15 bp, Homo sapiens
tgtaatcccagaact

SEQ ID NO: 1771518 - DNA, 16 bp, Homo sapiens
tgtaatcccagcactt

SEQ ID NO: 1771519 - DNA, 15 bp, Homo sapiens
tgtaatcccagctac

SEQ ID NO: 1771520 - DNA, 21 bp, Homo sapiens
tgtaatcccagctactcagga

SEQ ID NO: 1771521 - DNA, 20 bp, Homo sapiens
tgtaatcccagttactcggg

SEQ ID NO: 1771522 - DNA, 16 bp, Homo sapiens
tgtaatcgtgtgccat

SEQ ID NO: 1771523 - DNA, 17 bp, Homo sapiens
tgtaatctaccagtggt

SEQ ID NO: 1771524 - DNA, 17 bp, Homo sapiens
tgtaatctctctgcagc

SEQ ID NO: 1771525 - DNA, 19 bp, Homo sapiens
tgtaatctctctgcagctg

SEQ ID NO: 1771526 - DNA, 15 bp, Homo sapiens
tgtaatgaaaatgaa

SEQ ID NO: 1771527 - DNA, 22 bp, Homo sapiens
tgtaatgacaaaagatacaaaa

SEQ ID NO: 1771528 - DNA, 19 bp, Homo sapiens
tgtaatgctgcacttcctg

SEQ ID NO: 1771529 - DNA, 20 bp, Homo sapiens
tgtaatggtatcttaaagtg

SEQ ID NO: 1771530 - DNA, 12 bp, Homo sapiens
tgtaatgtaaat

SEQ ID NO: 1771531 - DNA, 14 bp, Homo sapiens
tgtaatgtaaataa

SEQ ID NO: 1771532 - DNA, 18 bp, Homo sapiens
tgtaatgtaaataaacta

SEQ ID NO: 1771533 - DNA, 20 bp, Homo sapiens
tgtaatgtgacttcatgcta

SEQ ID NO: 1771534 - DNA, 14 bp, Homo sapiens
tgtaatgttgtgaa

SEQ ID NO: 1771535 - DNA, 15 bp, Homo sapiens
tgtaatgttgtgaat

SEQ ID NO: 1771536 - DNA, 19 bp, Homo sapiens
tgtaattaaaagcaaatca

SEQ ID NO: 1771537 - DNA, 17 bp, Homo sapiens
tgtaattaagtactatg

SEQ ID NO: 1771538 - DNA, 21 bp, Homo sapiens
tgtaattaagtactatgtatc

SEQ ID NO: 1771539 - DNA, 16 bp, Homo sapiens
tgtaattaatatcttg

SEQ ID NO: 1771540 - DNA, 14 bp, Homo sapiens
tgtaattatttgaa

SEQ ID NO: 1771541 - DNA, 15 bp, Homo sapiens
tgtaattatttgaat

SEQ ID NO: 1771542 - DNA, 19 bp, Homo sapiens
tgtaattcaggtttttcct

SEQ ID NO: 1771543 - DNA, 16 bp, Homo sapiens
tgtaattctaaatgaa

SEQ ID NO: 1771544 - DNA, 17 bp, Homo sapiens
tgtaattgcttacattt

SEQ ID NO: 1771545 - DNA, 21 bp, Homo sapiens
tgtaattggaatcttcacctc

SEQ ID NO: 1771546 - DNA, 14 bp, Homo sapiens
tgtaattgtggatt

SEQ ID NO: 1771547 - DNA, 14 bp, Homo sapiens
tgtaattgtgtaaa

SEQ ID NO: 1771548 - DNA, 22 bp, Homo sapiens
tgtaattgtgtaaaaaatggaa

SEQ ID NO: 1771549 - DNA, 20 bp, Homo sapiens
tgtaattgtgtggattcttt

SEQ ID NO: 1771550 - DNA, 21 bp, Homo sapiens
tgtaattgtgtggattcttta

SEQ ID NO: 1771551 - DNA, 18 bp, Homo sapiens
tgtaattgttttggaata

SEQ ID NO: 1771552 - DNA, 16 bp, Homo sapiens
tgtaatttaaacaggc

SEQ ID NO: 1771553 - DNA, 23 bp, Homo sapiens
tgtaatttaaacaggcccagcat

SEQ ID NO: 1771554 - DNA, 12 bp, Homo sapiens
tgtaatttcaaa

SEQ ID NO: 1771555 - DNA, 13 bp, Homo sapiens
tgtaatttcaaaa

SEQ ID NO: 1771556 - DNA, 18 bp, Homo sapiens
tgtaatttcaaaatacat

SEQ ID NO: 1771557 - DNA, 16 bp, Homo sapiens
tgtaatttcgccttaa

SEQ ID NO: 1771558 - DNA, 19 bp, Homo sapiens
tgtaatttgatgaggtatt

SEQ ID NO: 1771559 - DNA, 17 bp, Homo sapiens
tgtaattttattttaaa

SEQ ID NO: 1771560 - DNA, 23 bp, Homo sapiens
tgtaattttattttaaaatttca

SEQ ID NO: 1771561 - DNA, 13 bp, Homo sapiens
tgtaatttttgct

SEQ ID NO: 1771562 - DNA, 13 bp, Homo sapiens
tgtacaaaataaa

SEQ ID NO: 1771563 - DNA, 16 bp, Homo sapiens
tgtacaaaattaagca

SEQ ID NO: 1771564 - DNA, 19 bp, Homo sapiens
tgtacaaacagtatttctg

SEQ ID NO: 1771565 - DNA, 14 bp, Homo sapiens
tgtacaaactcatc

SEQ ID NO: 1771566 - DNA, 19 bp, Homo sapiens
tgtacaaagtagaagtctt

SEQ ID NO: 1771567 - DNA, 14 bp, Homo sapiens
tgtacaaataaacc

SEQ ID NO: 1771568 - DNA, 21 bp, Homo sapiens
tgtacaaataaacctgaggca

SEQ ID NO: 1771569 - DNA, 17 bp, Homo sapiens
tgtacaaatgtaagcaa

SEQ ID NO: 1771570 - DNA, 17 bp, Homo sapiens
tgtacaaggtaattgtt

SEQ ID NO: 1771571 - DNA, 19 bp, Homo sapiens
tgtacaagttttgtataaa

SEQ ID NO: 1771572 - DNA, 23 bp, Homo sapiens
tgtacaagttttgtataaataat

SEQ ID NO: 1771573 - DNA, 17 bp, Homo sapiens
tgtacaatggtttattc

SEQ ID NO: 1771574 - DNA, 18 bp, Homo sapiens
tgtacaatggtttattcc

SEQ ID NO: 1771575 - DNA, 16 bp, Homo sapiens
tgtacaattaaaaacc

SEQ ID NO: 1771576 - DNA, 14 bp, Homo sapiens
tgtacaattatgtc

SEQ ID NO: 1771577 - DNA, 16 bp, Homo sapiens
tgtacaattttaaagt

SEQ ID NO: 1771578 - DNA, 18 bp, Homo sapiens
tgtagatggtgacctggg

SEQ ID NO: 1771579 - DNA, 22 bp, Homo sapiens
tgtagcactgacagatttccat

SEQ ID NO: 1771580 - DNA, 19 bp, Homo sapiens
tgtagcacttactggtagg

SEQ ID NO: 1771581 - DNA, 22 bp, Homo sapiens
tgtagcaggggaattccctccc

SEQ ID NO: 1771582 - DNA, 10 bp, Homo sapiens
tgtagccaag

SEQ ID NO: 1771583 - DNA, 15 bp, Homo sapiens
tgtagccagctgtgc

SEQ ID NO: 1771584 - DNA, 18 bp, Homo sapiens
tgtagccagctgtgcact

SEQ ID NO: 1771585 - DNA, 16 bp, Homo sapiens
tgtagccatggctcag

SEQ ID NO: 1771586 - DNA, 18 bp, Homo sapiens
tgtagccatggctcaggc

SEQ ID NO: 1771587 - DNA, 19 bp, Homo sapiens
tgtagccatggctcaggca

SEQ ID NO: 1771588 - DNA, 17 bp, Homo sapiens
tgtagccccctggcctc

SEQ ID NO: 1771589 - DNA, 15 bp, Homo sapiens
tgtagcctaaagggc

SEQ ID NO: 1771590 - DNA, 21 bp, Homo sapiens
tgtagcctaaagggcagggcc

SEQ ID NO: 1771591 - DNA, 22 bp, Homo sapiens
tgtagcctaaagggcagggccc

SEQ ID NO: 1771592 - DNA, 14 bp, Homo sapiens
tgtagcctgtgcat

SEQ ID NO: 1771593 - DNA, 16 bp, Homo sapiens
tgtagcctgtgcatgt

SEQ ID NO: 1771594 - DNA, 20 bp, Homo sapiens
tgtagcctgtgcatgtatgt

SEQ ID NO: 1771595 - DNA, 21 bp, Homo sapiens
tgtagccttcctccacatcct

SEQ ID NO: 1771596 - DNA, 17 bp, Homo sapiens
tgtagccttgcccggat

SEQ ID NO: 1771597 - DNA, 12 bp, Homo sapiens
tgtagccttttt

SEQ ID NO: 1771598 - DNA, 13 bp, Homo sapiens
tgtagcctttttg

SEQ ID NO: 1771599 - DNA, 14 bp, Homo sapiens
tgtagcgacagcat

SEQ ID NO: 1771600 - DNA, 16 bp, Homo sapiens
tgtagctagaatatcc

SEQ ID NO: 1771601 - DNA, 15 bp, Homo sapiens
tgtagctccctcctc

SEQ ID NO: 1771602 - DNA, 20 bp, Homo sapiens
tgtagctccctcctcccatc

SEQ ID NO: 1771603 - DNA, 22 bp, Homo sapiens
tgtagctccctcctcccatctc

SEQ ID NO: 1771604 - DNA, 14 bp, Homo sapiens
tgtagctgatgaaa

SEQ ID NO: 1771605 - DNA, 21 bp, Homo sapiens
tgtagctgatgaaactcctga

SEQ ID NO: 1771606 - DNA, 15 bp, Homo sapiens
tgtagctgtaagggc

SEQ ID NO: 1771607 - DNA, 16 bp, Homo sapiens
tgtagctgtaagggca

SEQ ID NO: 1771608 - DNA, 12 bp, Homo sapiens
tgtagctgtcct

SEQ ID NO: 1771609 - DNA, 13 bp, Homo sapiens
tgtagctgtgaaa

SEQ ID NO: 1771610 - DNA, 14 bp, Homo sapiens
tgtagctttatcaa

SEQ ID NO: 1771611 - DNA, 12 bp, Homo sapiens
tgtagctttgct

SEQ ID NO: 1771612 - DNA, 22 bp, Homo sapiens
tgtaggaaccgtggtatgtctg

SEQ ID NO: 1771613 - DNA, 19 bp, Homo sapiens
tgtaggaatcctttgagaa

SEQ ID NO: 1771614 - DNA, 18 bp, Homo sapiens
tgtaggagacttgccaga

SEQ ID NO: 1771615 - DNA, 10 bp, Homo sapiens
tgtaggagag

SEQ ID NO: 1771616 - DNA, 22 bp, Homo sapiens
tgtaggagctgccttggctcag

SEQ ID NO: 1771617 - DNA, 18 bp, Homo sapiens
tgtaggcacagagctgca

SEQ ID NO: 1771618 - DNA, 16 bp, Homo sapiens
tgtaggcagaggctgc

SEQ ID NO: 1771619 - DNA, 23 bp, Homo sapiens
tgtaggccttaactatttcacat

SEQ ID NO: 1771620 - DNA, 12 bp, Homo sapiens
tgtagggctgga

SEQ ID NO: 1771621 - DNA, 14 bp, Homo sapiens
tgtaggggccacct

SEQ ID NO: 1771622 - DNA, 22 bp, Homo sapiens
tgtaggggccacctcctccccc

SEQ ID NO: 1771623 - DNA, 15 bp, Homo sapiens
tgtaggggttaactt

SEQ ID NO: 1771624 - DNA, 22 bp, Homo sapiens
tgtaggggttaacttggtcaga

SEQ ID NO: 1771625 - DNA, 21 bp, Homo sapiens
tgtagggtccaaccagacctg

SEQ ID NO: 1771626 - DNA, 16 bp, Homo sapiens
tgtagggttataataa

SEQ ID NO: 1771627 - DNA, 23 bp, Homo sapiens
tgtaggtgatgtttccagctgcc

SEQ ID NO: 1771628 - DNA, 18 bp, Homo sapiens
tgtaggtgtctgccttca

SEQ ID NO: 1771629 - DNA, 17 bp, Homo sapiens
tgtaggttgtctaaaaa

SEQ ID NO: 1771630 - DNA, 19 bp, Homo sapiens
tgtaggtttctctcttccc

SEQ ID NO: 1771631 - DNA, 22 bp, Homo sapiens
tgtaggtttctctcttcccttc

SEQ ID NO: 1771632 - DNA, 19 bp, Homo sapiens
tgtagtaaactatttatct

SEQ ID NO: 1771633 - DNA, 19 bp, Homo sapiens
tgtagtaaagccgttgttt

SEQ ID NO: 1771634 - DNA, 14 bp, Homo sapiens
tgtagtaacactaa

SEQ ID NO: 1771635 - DNA, 15 bp, Homo sapiens
tgtagtaacactaat

SEQ ID NO: 1771636 - DNA, 17 bp, Homo sapiens
tgtagtaacactaatat

SEQ ID NO: 1771637 - DNA, 20 bp, Homo sapiens
tgtagtaacactaatatatt

SEQ ID NO: 1771638 - DNA, 15 bp, Homo sapiens
tgtagtataaagaaa

SEQ ID NO: 1771639 - DNA, 15 bp, Homo sapiens
tgtagtatcttgaaa

SEQ ID NO: 1771640 - DNA, 20 bp, Homo sapiens
tgtagtattttttgtataat

SEQ ID NO: 1771641 - DNA, 21 bp, Homo sapiens
tgtagtcttgtcttagctctg

SEQ ID NO: 1771642 - DNA, 14 bp, Homo sapiens
tgtagtctttttat

SEQ ID NO: 1771643 - DNA, 21 bp, Homo sapiens
tgtagtctttttataggtttt

SEQ ID NO: 1771644 - DNA, 16 bp, Homo sapiens
tgtagtgagaaactga

SEQ ID NO: 1771645 - DNA, 20 bp, Homo sapiens
tgtagtgcatttttaaactt

SEQ ID NO: 1771646 - DNA, 21 bp, Homo sapiens
tgtagtgcatttttaaacttg

SEQ ID NO: 1771647 - DNA, 18 bp, Homo sapiens
tgtagtggaagagcagcc

SEQ ID NO: 1771648 - DNA, 20 bp, Homo sapiens
tgtagtggaagagcagcctg

SEQ ID NO: 1771649 - DNA, 14 bp, Homo sapiens
tgtagttagacaat

SEQ ID NO: 1771650 - DNA, 23 bp, Homo sapiens
tgtagttgggcctaaataaatga

SEQ ID NO: 1771651 - DNA, 16 bp, Homo sapiens
tgtagtttacagaaaa

SEQ ID NO: 1771652 - DNA, 19 bp, Homo sapiens
tgtagtttacctctttaaa

SEQ ID NO: 1771653 - DNA, 17 bp, Homo sapiens
tgtagttttatttgtat

SEQ ID NO: 1771654 - DNA, 24 bp, Homo sapiens
tgtagtttttgaaaattatgcaaa

SEQ ID NO: 1771655 - DNA, 18 bp, Homo sapiens
tgtataaaaattatcaaa

SEQ ID NO: 1771656 - DNA, 19 bp, Homo sapiens
tgtataaaaattatcaaaa

SEQ ID NO: 1771657 - DNA, 21 bp, Homo sapiens
tgtataaaagtgtgaaataaa

SEQ ID NO: 1771658 - DNA, 13 bp, Homo sapiens
tgtataaaataga

SEQ ID NO: 1771659 - DNA, 21 bp, Homo sapiens
tgtataaaatccaaaatgaat

SEQ ID NO: 1771660 - DNA, 13 bp, Homo sapiens
tgtataaaatctg

SEQ ID NO: 1771661 - DNA, 15 bp, Homo sapiens
tgtataaagaaactg

SEQ ID NO: 1771662 - DNA, 14 bp, Homo sapiens
tgtataaagattgt

SEQ ID NO: 1771663 - DNA, 12 bp, Homo sapiens
tgtataaatata

SEQ ID NO: 1771664 - DNA, 13 bp, Homo sapiens
tgtataaatatac

SEQ ID NO: 1771665 - DNA, 23 bp, Homo sapiens
tgtataagttatttttgtacatg

SEQ ID NO: 1771666 - DNA, 14 bp, Homo sapiens
tgtataataagaaa

SEQ ID NO: 1771667 - DNA, 14 bp, Homo sapiens
tgtataatattgaa

SEQ ID NO: 1771668 - DNA, 22 bp, Homo sapiens
tgtataatattgaaaattgaaa

SEQ ID NO: 1771669 - DNA, 21 bp, Homo sapiens
tgtataattggatttcctaat

SEQ ID NO: 1771670 - DNA, 13 bp, Homo sapiens
tgtatacagtgca

SEQ ID NO: 1771671 - DNA, 16 bp, Homo sapiens
tgtatacagtgcagag

SEQ ID NO: 1771672 - DNA, 18 bp, Homo sapiens
tgtatacattttgttata

SEQ ID NO: 1771673 - DNA, 19 bp, Homo sapiens
tgtatacattttgttatag

SEQ ID NO: 1771674 - DNA, 21 bp, Homo sapiens
tgtatacattttgttatagaa

SEQ ID NO: 1771675 - DNA, 19 bp, Homo sapiens
tgtatagtgttcacaaact

SEQ ID NO: 1771676 - DNA, 21 bp, Homo sapiens
tgtatagtgttcacaaactgt

SEQ ID NO: 1771677 - DNA, 16 bp, Homo sapiens
tgtatagttgcttgcc

SEQ ID NO: 1771678 - DNA, 22 bp, Homo sapiens
tgtatagttgcttgcctgatat

SEQ ID NO: 1771679 - DNA, 21 bp, Homo sapiens
tgtatataagtactgaccact

SEQ ID NO: 1771680 - DNA, 15 bp, Homo sapiens
tgtatatacaataac

SEQ ID NO: 1771681 - DNA, 17 bp, Homo sapiens
tgtatatacgcatctat

SEQ ID NO: 1771682 - DNA, 18 bp, Homo sapiens
tgtatatatttcctatat

SEQ ID NO: 1771683 - DNA, 15 bp, Homo sapiens
tgtatatgattctct

SEQ ID NO: 1771684 - DNA, 17 bp, Homo sapiens
tgtatatgattctctgt

SEQ ID NO: 1771685 - DNA, 19 bp, Homo sapiens
tgtatatgattctctgtgg

SEQ ID NO: 1771686 - DNA, 21 bp, Homo sapiens
tgtatatgattctcttgagat

SEQ ID NO: 1771687 - DNA, 12 bp, Homo sapiens
tgtatatgtatt

SEQ ID NO: 1771688 - DNA, 14 bp, Homo sapiens
tgtatatgtattcc

SEQ ID NO: 1771689 - DNA, 21 bp, Homo sapiens
tgtatatgtattcccttgtat

SEQ ID NO: 1771690 - DNA, 21 bp, Homo sapiens
tgtatattaagaagcaataac

SEQ ID NO: 1771691 - DNA, 21 bp, Homo sapiens
tgtatattccaccattcacat

SEQ ID NO: 1771692 - DNA, 22 bp, Homo sapiens
tgtcatcctcaaagaaagtgta

SEQ ID NO: 1771693 - DNA, 23 bp, Homo sapiens
tgtcatcctcaaagaaagtgtat

SEQ ID NO: 1771694 - DNA, 15 bp, Homo sapiens
tgtcatctgaggagt

SEQ ID NO: 1771695 - DNA, 18 bp, Homo sapiens
tgtcatctgcatgtctac

SEQ ID NO: 1771696 - DNA, 12 bp, Homo sapiens
tgtcatgaacat

SEQ ID NO: 1771697 - DNA, 16 bp, Homo sapiens
tgtcatgaacatgttc

SEQ ID NO: 1771698 - DNA, 15 bp, Homo sapiens
tgtcatgaagaatgt

SEQ ID NO: 1771699 - DNA, 20 bp, Homo sapiens
tgtcatgaagtgcacaggag

SEQ ID NO: 1771700 - DNA, 21 bp, Homo sapiens
tgtcatgaagtgcacaggagc

SEQ ID NO: 1771701 - DNA, 20 bp, Homo sapiens
tgtcatgcagagtatttcta

SEQ ID NO: 1771702 - DNA, 16 bp, Homo sapiens
tgtcatgcccccctca

SEQ ID NO: 1771703 - DNA, 13 bp, Homo sapiens
tgtcatgtagctg

SEQ ID NO: 1771704 - DNA, 15 bp, Homo sapiens
tgtcattaaacatga

SEQ ID NO: 1771705 - DNA, 20 bp, Homo sapiens
tgtcattcaagcctgtgaat

SEQ ID NO: 1771706 - DNA, 16 bp, Homo sapiens
tgtcattccagagtgc

SEQ ID NO: 1771707 - DNA, 23 bp, Homo sapiens
tgtcattcccctttgcactgtaa

SEQ ID NO: 1771708 - DNA, 17 bp, Homo sapiens
tgtcattgcacataagc

SEQ ID NO: 1771709 - DNA, 19 bp, Homo sapiens
tgtcattgctaaaaaataa

SEQ ID NO: 1771710 - DNA, 13 bp, Homo sapiens
tgtcattggaagc

SEQ ID NO: 1771711 - DNA, 17 bp, Homo sapiens
tgtcattggaagccatc

SEQ ID NO: 1771712 - DNA, 24 bp, Homo sapiens
tgtcatttactcaaaatctgtcat

SEQ ID NO: 1771713 - DNA, 20 bp, Homo sapiens
tgtcatttagttcagcatcc

SEQ ID NO: 1771714 - DNA, 16 bp, Homo sapiens
tgtcatttatatagat

SEQ ID NO: 1771715 - DNA, 16 bp, Homo sapiens
tgtcatttcagaagtt

SEQ ID NO: 1771716 - DNA, 13 bp, Homo sapiens
tgtcatttcttca

SEQ ID NO: 1771717 - DNA, 14 bp, Homo sapiens
tgtcattttgcact

SEQ ID NO: 1771718 - DNA, 23 bp, Homo sapiens
tgtcatttttaatattactgtct

SEQ ID NO: 1771719 - DNA, 23 bp, Homo sapiens
tgtccaaaccaaccgcacatgca

SEQ ID NO: 1771720 - DNA, 19 bp, Homo sapiens
tgtccaaaggaggctggca

SEQ ID NO: 1771721 - DNA, 18 bp, Homo sapiens
tgtccaacaataaacagg

SEQ ID NO: 1771722 - DNA, 18 bp, Homo sapiens
tgtccaacccgaggcccg

SEQ ID NO: 1771723 - DNA, 22 bp, Homo sapiens
tgtccaacctaacccctttcct

SEQ ID NO: 1771724 - DNA, 16 bp, Homo sapiens
tgtccaagaactctaa

SEQ ID NO: 1771725 - DNA, 20 bp, Homo sapiens
tgtccaagaactctaaccag

SEQ ID NO: 1771726 - DNA, 21 bp, Homo sapiens
tgtccaagggccgtgcccttg

SEQ ID NO: 1771727 - DNA, 23 bp, Homo sapiens
tgtccaattgttgacagttctga

SEQ ID NO: 1771728 - DNA, 12 bp, Homo sapiens
tgtccaatttgt

SEQ ID NO: 1771729 - DNA, 17 bp, Homo sapiens
tgtccaatttgtaagta

SEQ ID NO: 1771730 - DNA, 20 bp, Homo sapiens
tgtccacagatgcctccacc

SEQ ID NO: 1771731 - DNA, 17 bp, Homo sapiens
tgtccacatccccagag

SEQ ID NO: 1771732 - DNA, 21 bp, Homo sapiens
tgtccacatccccagagccca

SEQ ID NO: 1771733 - DNA, 22 bp, Homo sapiens
tgtccacatccccagagcccag

SEQ ID NO: 1771734 - DNA, 23 bp, Homo sapiens
tgtccacatccccagagcccagc

SEQ ID NO: 1771735 - DNA, 19 bp, Homo sapiens
tgtccaccatccccagctg

SEQ ID NO: 1771736 - DNA, 12 bp, Homo sapiens
tgtccacctggc

SEQ ID NO: 1771737 - DNA, 15 bp, Homo sapiens
tgtccagaagaatat

SEQ ID NO: 1771738 - DNA, 20 bp, Homo sapiens
tgtccagaagaatattcagg

SEQ ID NO: 1771739 - DNA, 21 bp, Homo sapiens
tgtccagaagaatattcagga

SEQ ID NO: 1771740 - DNA, 12 bp, Homo sapiens
tgtccagcacct

SEQ ID NO: 1771741 - DNA, 21 bp, Homo sapiens
tgtccagcagctgcgggtctg

SEQ ID NO: 1771742 - DNA, 15 bp, Homo sapiens
tgtccagcagtctga

SEQ ID NO: 1771743 - DNA, 19 bp, Homo sapiens
tgtccagcctgggcagcca

SEQ ID NO: 1771744 - DNA, 22 bp, Homo sapiens
tgtccagcctgggcagccaggc

SEQ ID NO: 1771745 - DNA, 23 bp, Homo sapiens
tgtccagcctgggcagccaggct

SEQ ID NO: 1771746 - DNA, 14 bp, Homo sapiens
tgtccagcgcctag

SEQ ID NO: 1771747 - DNA, 16 bp, Homo sapiens
tgtccagctccaacct

SEQ ID NO: 1771748 - DNA, 23 bp, Homo sapiens
tgtccagctccaacctgcaaaga

SEQ ID NO: 1771749 - DNA, 16 bp, Homo sapiens
tgtccagcttccaaag

SEQ ID NO: 1771750 - DNA, 17 bp, Homo sapiens
tgtccagcttccaaagc

SEQ ID NO: 1771751 - DNA, 21 bp, Homo sapiens
tgtccagcttccaaagcctag

SEQ ID NO: 1771752 - DNA, 20 bp, Homo sapiens
tgtccaggcagctccctcct

SEQ ID NO: 1771753 - DNA, 21 bp, Homo sapiens
tgtccagggggagaaggaaga

SEQ ID NO: 1771754 - DNA, 13 bp, Homo sapiens
tgtccagggtcct

SEQ ID NO: 1771755 - DNA, 21 bp, Homo sapiens
tgtccagttttggaggctgag

SEQ ID NO: 1771756 - DNA, 20 bp, Homo sapiens
tgtccatacactttgttgca

SEQ ID NO: 1771757 - DNA, 20 bp, Homo sapiens
tgtccatgcgctcagggcca

SEQ ID NO: 1771758 - DNA, 14 bp, Homo sapiens
tgtccatttgtccc

SEQ ID NO: 1771759 - DNA, 14 bp, Homo sapiens
tgtcccaagccggg

SEQ ID NO: 1771760 - DNA, 12 bp, Homo sapiens
tgtcccacaaaa

SEQ ID NO: 1771761 - DNA, 16 bp, Homo sapiens
tgtcccaccaactctg

SEQ ID NO: 1771762 - DNA, 23 bp, Homo sapiens
tgtcccaccatacgagcacctcc

SEQ ID NO: 1771763 - DNA, 12 bp, Homo sapiens
tgtcccacccac

SEQ ID NO: 1771764 - DNA, 14 bp, Homo sapiens
tgtcccacccacac

SEQ ID NO: 1771765 - DNA, 24 bp, Homo sapiens
tgtcccagaggttatctgcctggc

SEQ ID NO: 1771766 - DNA, 15 bp, Homo sapiens
tgtcccagccacgca

SEQ ID NO: 1771767 - DNA, 20 bp, Homo sapiens
tgtcccagccacgcagggcc

SEQ ID NO: 1771768 - DNA, 21 bp, Homo sapiens
tgtcccagccacgcagggcca

SEQ ID NO: 1771769 - DNA, 14 bp, Homo sapiens
tgtcccaggcaggg

SEQ ID NO: 1771770 - DNA, 17 bp, Homo sapiens
tgtcccaggtcctcact

SEQ ID NO: 1771771 - DNA, 15 bp, Homo sapiens
tgtcccagtcagaaa

SEQ ID NO: 1771772 - DNA, 18 bp, Homo sapiens
tgtcccagttgtggcaac

SEQ ID NO: 1771773 - DNA, 17 bp, Homo sapiens
tgtcccatgacccaccc

SEQ ID NO: 1771774 - DNA, 20 bp, Homo sapiens
tgtcccatgacccacccctg

SEQ ID NO: 1771775 - DNA, 21 bp, Homo sapiens
tgtcccatttccttggaggcc

SEQ ID NO: 1771776 - DNA, 19 bp, Homo sapiens
tgtccccataagacaaaca

SEQ ID NO: 1771777 - DNA, 20 bp, Homo sapiens
tgtccccataagacaaacac

SEQ ID NO: 1771778 - DNA, 9 bp, Homo sapiens
tgtccccca

SEQ ID NO: 1771779 - DNA, 16 bp, Homo sapiens
tgtcccccaacttgag

SEQ ID NO: 1771780 - DNA, 23 bp, Homo sapiens
tgtcccccaaggttttggagtca

SEQ ID NO: 1771781 - DNA, 15 bp, Homo sapiens
tgtcccccagctctg

SEQ ID NO: 1771782 - DNA, 16 bp, Homo sapiens
tgtcccccagctctgg

SEQ ID NO: 1771783 - DNA, 20 bp, Homo sapiens
tgtcccccaggttccgaaga

SEQ ID NO: 1771784 - DNA, 14 bp, Homo sapiens
tgtcccccggggca

SEQ ID NO: 1771785 - DNA, 17 bp, Homo sapiens
tgtcccccgtgcacggt

SEQ ID NO: 1771786 - DNA, 13 bp, Homo sapiens
tgtcccctctgtc

SEQ ID NO: 1771787 - DNA, 14 bp, Homo sapiens
tgtcccctgcccca

SEQ ID NO: 1771788 - DNA, 13 bp, Homo sapiens
tgtcccctgggtc

SEQ ID NO: 1771789 - DNA, 19 bp, Homo sapiens
tgtcccctgtcccaccaac

SEQ ID NO: 1771790 - DNA, 20 bp, Homo sapiens
tgtcccctgtcccaccaact

SEQ ID NO: 1771791 - DNA, 20 bp, Homo sapiens
tgtccccttctctcatctct

SEQ ID NO: 1771792 - DNA, 12 bp, Homo sapiens
tgtccctacacc

SEQ ID NO: 1771793 - DNA, 19 bp, Homo sapiens
tgtccctacacccctcccc

SEQ ID NO: 1771794 - DNA, 17 bp, Homo sapiens
tgtccctatgcatatca

SEQ ID NO: 1771795 - DNA, 13 bp, Homo sapiens
tgtccctccaggc

SEQ ID NO: 1771796 - DNA, 14 bp, Homo sapiens
tgtccctccccctt

SEQ ID NO: 1771797 - DNA, 22 bp, Homo sapiens
tgtccctctcctatgtggcagc

SEQ ID NO: 1771798 - DNA, 13 bp, Homo sapiens
tgtccctctgtgg

SEQ ID NO: 1771799 - DNA, 12 bp, Homo sapiens
tgtccctgcagg

SEQ ID NO: 1771800 - DNA, 14 bp, Homo sapiens
tgtccctgcagggc

SEQ ID NO: 1771801 - DNA, 12 bp, Homo sapiens
tgtccctggaca

SEQ ID NO: 1771802 - DNA, 14 bp, Homo sapiens
tgtccctggacaca

SEQ ID NO: 1771803 - DNA, 16 bp, Homo sapiens
tgtccctggacacagc

SEQ ID NO: 1771804 - DNA, 19 bp, Homo sapiens
tgtccctggacacagctct

SEQ ID NO: 1771805 - DNA, 22 bp, Homo sapiens
tgtccctggacacagctcttca

SEQ ID NO: 1771806 - DNA, 18 bp, Homo sapiens
tgtctcaaaggagctttc

SEQ ID NO: 1771807 - DNA, 23 bp, Homo sapiens
tgtctcaagagggcactggtggc

SEQ ID NO: 1771808 - DNA, 13 bp, Homo sapiens
tgtctcagcctct

SEQ ID NO: 1771809 - DNA, 15 bp, Homo sapiens
tgtctcagcctctgc

SEQ ID NO: 1771810 - DNA, 20 bp, Homo sapiens
tgtctccaaccccccagcac

SEQ ID NO: 1771811 - DNA, 23 bp, Homo sapiens
tgtctccaaccccccagcactga

SEQ ID NO: 1771812 - DNA, 11 bp, Homo sapiens
tgtctccagct

SEQ ID NO: 1771813 - DNA, 15 bp, Homo sapiens
tgtctccagctgcct

SEQ ID NO: 1771814 - DNA, 16 bp, Homo sapiens
tgtctccagctgcctg

SEQ ID NO: 1771815 - DNA, 20 bp, Homo sapiens
tgtctccagctgcctgggcc

SEQ ID NO: 1771816 - DNA, 23 bp, Homo sapiens
tgtctccatgaggtactggtccc

SEQ ID NO: 1771817 - DNA, 18 bp, Homo sapiens
tgtctcccttctctctct

SEQ ID NO: 1771818 - DNA, 15 bp, Homo sapiens
tgtctcctactgagg

SEQ ID NO: 1771819 - DNA, 18 bp, Homo sapiens
tgtctcctttgctcttgc

SEQ ID NO: 1771820 - DNA, 15 bp, Homo sapiens
tgtctcgaactattt

SEQ ID NO: 1771821 - DNA, 21 bp, Homo sapiens
tgtctcgatgccataatcaga

SEQ ID NO: 1771822 - DNA, 19 bp, Homo sapiens
tgtctcgctatactgcact

SEQ ID NO: 1771823 - DNA, 20 bp, Homo sapiens
tgtctctaaccattcaaatg

SEQ ID NO: 1771824 - DNA, 21 bp, Homo sapiens
tgtctctaaccattcaaatga

SEQ ID NO: 1771825 - DNA, 22 bp, Homo sapiens
tgtctctaaccattcaaatgac

SEQ ID NO: 1771826 - DNA, 22 bp, Homo sapiens
tgtctctagctgttctggacta

SEQ ID NO: 1771827 - DNA, 18 bp, Homo sapiens
tgtctctcccaccccggc

SEQ ID NO: 1771828 - DNA, 14 bp, Homo sapiens
tgtctctctgccaa

SEQ ID NO: 1771829 - DNA, 15 bp, Homo sapiens
tgtctctgccatgtg

SEQ ID NO: 1771830 - DNA, 17 bp, Homo sapiens
tgtctctgccatgtggc

SEQ ID NO: 1771831 - DNA, 18 bp, Homo sapiens
tgtctctgttcagatgtg

SEQ ID NO: 1771832 - DNA, 17 bp, Homo sapiens
tgtctcttagaaatact

SEQ ID NO: 1771833 - DNA, 13 bp, Homo sapiens
tgtctcttctgag

SEQ ID NO: 1771834 - DNA, 23 bp, Homo sapiens
tgtctctttggcgacctcctttc

SEQ ID NO: 1771835 - DNA, 17 bp, Homo sapiens
tgtctgaaacagagaac

SEQ ID NO: 1771836 - DNA, 21 bp, Homo sapiens
tgtctgaaacagagaaccaaa

SEQ ID NO: 1771837 - DNA, 13 bp, Homo sapiens
tgtctgaacaaag

SEQ ID NO: 1771838 - DNA, 19 bp, Homo sapiens
tgtctgaacaatctccaaa

SEQ ID NO: 1771839 - DNA, 15 bp, Homo sapiens
tgtctgaacatagaa

SEQ ID NO: 1771840 - DNA, 16 bp, Homo sapiens
tgtctgaacttgcatt

SEQ ID NO: 1771841 - DNA, 18 bp, Homo sapiens
tgtctgaaggacacttcc

SEQ ID NO: 1771842 - DNA, 19 bp, Homo sapiens
tgtctgaaggacacttcct

SEQ ID NO: 1771843 - DNA, 19 bp, Homo sapiens
tgtctgaagtcactgcaca

SEQ ID NO: 1771844 - DNA, 20 bp, Homo sapiens
tgtctgaagtcactgcacag

SEQ ID NO: 1771845 - DNA, 18 bp, Homo sapiens
tgtctgaatattctagaa

SEQ ID NO: 1771846 - DNA, 14 bp, Homo sapiens
tgtctgacatgttt

SEQ ID NO: 1771847 - DNA, 14 bp, Homo sapiens
tgtctgaccagaga

SEQ ID NO: 1771848 - DNA, 15 bp, Homo sapiens
tgtctgaccagagaa

SEQ ID NO: 1771849 - DNA, 21 bp, Homo sapiens
tgtctgagatacgtctgtgac

SEQ ID NO: 1771850 - DNA, 16 bp, Homo sapiens
tgtctgaggcctcatc

SEQ ID NO: 1771851 - DNA, 13 bp, Homo sapiens
tgtctgattctat

SEQ ID NO: 1771852 - DNA, 14 bp, Homo sapiens
tgtctgattctatg

SEQ ID NO: 1771853 - DNA, 16 bp, Homo sapiens
tgtctgattctatgcc

SEQ ID NO: 1771854 - DNA, 13 bp, Homo sapiens
tgtctgatttctt

SEQ ID NO: 1771855 - DNA, 23 bp, Homo sapiens
tgtctgcaggtgggctgctgagg

SEQ ID NO: 1771856 - DNA, 19 bp, Homo sapiens
tgtctgccagccagcagcc

SEQ ID NO: 1771857 - DNA, 18 bp, Homo sapiens
tgtctgccatgttgcccc

SEQ ID NO: 1771858 - DNA, 13 bp, Homo sapiens
tgtctgccccctc

SEQ ID NO: 1771859 - DNA, 16 bp, Homo sapiens
tgtctgccctctgggt

SEQ ID NO: 1771860 - DNA, 21 bp, Homo sapiens
tgtctgcgtggttcctttctc

SEQ ID NO: 1771861 - DNA, 18 bp, Homo sapiens
tgtctgctgagttggcct

SEQ ID NO: 1771862 - DNA, 23 bp, Homo sapiens
tgtctgctgagttggcctggcca

SEQ ID NO: 1771863 - DNA, 11 bp, Homo sapiens
tgtctgctggt

SEQ ID NO: 1771864 - DNA, 18 bp, Homo sapiens
tgtctggcaaaagaaaaa

SEQ ID NO: 1771865 - DNA, 23 bp, Homo sapiens
tgtctggcgttctcaagaatcta

SEQ ID NO: 1771866 - DNA, 15 bp, Homo sapiens
tgtctgggaattgtg

SEQ ID NO: 1771867 - DNA, 19 bp, Homo sapiens
tgtctgggattaagggcaa

SEQ ID NO: 1771868 - DNA, 18 bp, Homo sapiens
tgtctggggtgagggagt

SEQ ID NO: 1771869 - DNA, 15 bp, Homo sapiens
tgtctggtgcctgga

SEQ ID NO: 1771870 - DNA, 15 bp, Homo sapiens
tgtctgtaaaaaatg

SEQ ID NO: 1771871 - DNA, 23 bp, Homo sapiens
tgtctgtaaaaaatggagctcag

SEQ ID NO: 1771872 - DNA, 21 bp, Homo sapiens
tgtctgtacacgtgtcctgta

SEQ ID NO: 1771873 - DNA, 22 bp, Homo sapiens
tgtctgtcaaatgtttccttaa

SEQ ID NO: 1771874 - DNA, 12 bp, Homo sapiens
tgtctgtccctt

SEQ ID NO: 1771875 - DNA, 14 bp, Homo sapiens
tgtctgtctacatt

SEQ ID NO: 1771876 - DNA, 15 bp, Homo sapiens
tgtctgtctccctcc

SEQ ID NO: 1771877 - DNA, 14 bp, Homo sapiens
tgtctgtctggcac

SEQ ID NO: 1771878 - DNA, 21 bp, Homo sapiens
tgtctgtgctagggaaacttc

SEQ ID NO: 1771879 - DNA, 21 bp, Homo sapiens
tgtctgtggatggtcattgca

SEQ ID NO: 1771880 - DNA, 17 bp, Homo sapiens
tgtctgtgtcccagcca

SEQ ID NO: 1771881 - DNA, 20 bp, Homo sapiens
tgtctgtgttttgaaagaat

SEQ ID NO: 1771882 - DNA, 13 bp, Homo sapiens
tgtctgtttgttt

SEQ ID NO: 1771883 - DNA, 15 bp, Homo sapiens
tgtctgtttgtttca

SEQ ID NO: 1771884 - DNA, 20 bp, Homo sapiens
tgtctgtttgtttcaagaac

SEQ ID NO: 1771885 - DNA, 22 bp, Homo sapiens
tgtctgtttgtttcaagaacct

SEQ ID NO: 1771886 - DNA, 23 bp, Homo sapiens
tgtctgtttgtttcaagaacctg

SEQ ID NO: 1771887 - DNA, 17 bp, Homo sapiens
tgtctgtttttgtatct

SEQ ID NO: 1771888 - DNA, 19 bp, Homo sapiens
tgtctgtttttgtatcttt

SEQ ID NO: 1771889 - DNA, 15 bp, Homo sapiens
tgtcttaattattat

SEQ ID NO: 1771890 - DNA, 15 bp, Homo sapiens
tgtcttagctctgga

SEQ ID NO: 1771891 - DNA, 15 bp, Homo sapiens
tgtcttatggtccag

SEQ ID NO: 1771892 - DNA, 14 bp, Homo sapiens
tgtcttatgtgaaa

SEQ ID NO: 1771893 - DNA, 14 bp, Homo sapiens
tgtcttattgacag

SEQ ID NO: 1771894 - DNA, 19 bp, Homo sapiens
tgtcttattgacagttgtg

SEQ ID NO: 1771895 - DNA, 13 bp, Homo sapiens
tgtcttattgcac

SEQ ID NO: 1771896 - DNA, 14 bp, Homo sapiens
tgtcttcacatgta

SEQ ID NO: 1771897 - DNA, 16 bp, Homo sapiens
tgtcttcagtctcaca

SEQ ID NO: 1771898 - DNA, 17 bp, Homo sapiens
tgtcttcagtctcacag

SEQ ID NO: 1771899 - DNA, 21 bp, Homo sapiens
tgtcttcagtctcacagagaa

SEQ ID NO: 1771900 - DNA, 15 bp, Homo sapiens
tgtcttcatagcaga

SEQ ID NO: 1771901 - DNA, 22 bp, Homo sapiens
tgtcttcattttcattaccagg

SEQ ID NO: 1771902 - DNA, 16 bp, Homo sapiens
tgtcttccatgtatct

SEQ ID NO: 1771903 - DNA, 20 bp, Homo sapiens
tgtcttcccgatgagggaag

SEQ ID NO: 1771904 - DNA, 20 bp, Homo sapiens
tgtcttccgatcaacattta

SEQ ID NO: 1771905 - DNA, 21 bp, Homo sapiens
tgtcttccgatcaacatttat

SEQ ID NO: 1771906 - DNA, 11 bp, Homo sapiens
tgtcttcctca

SEQ ID NO: 1771907 - DNA, 18 bp, Homo sapiens
tgtcttcctgcattcacc

SEQ ID NO: 1771908 - DNA, 13 bp, Homo sapiens
tgtcttcttaaaa

SEQ ID NO: 1771909 - DNA, 22 bp, Homo sapiens
tgtcttcttaaaatcaaatgta

SEQ ID NO: 1771910 - DNA, 16 bp, Homo sapiens
tgtcttcttctgtgct

SEQ ID NO: 1771911 - DNA, 13 bp, Homo sapiens
tgtcttcttttgt

SEQ ID NO: 1771912 - DNA, 21 bp, Homo sapiens
tgtcttcttttgtggtgtctt

SEQ ID NO: 1771913 - DNA, 23 bp, Homo sapiens
tgtcttcttttgtggtgtcttcc

SEQ ID NO: 1771914 - DNA, 19 bp, Homo sapiens
tgtcttgaataagagtgat

SEQ ID NO: 1771915 - DNA, 23 bp, Homo sapiens
tgtcttggaagacttaattctga

SEQ ID NO: 1771916 - DNA, 13 bp, Homo sapiens
tgtcttggacact

SEQ ID NO: 1771917 - DNA, 15 bp, Homo sapiens
tgtcttggacactgt

SEQ ID NO: 1771918 - DNA, 14 bp, Homo sapiens
tgtcttggcactgt

SEQ ID NO: 1771919 - DNA, 14 bp, Homo sapiens
tgtcttggcctccc

SEQ ID NO: 1771920 - DNA, 19 bp, Homo sapiens
tgtcttggctgtgagcaac

SEQ ID NO: 1771921 - DNA, 17 bp, Homo sapiens
tgtgcctgcaccaggag

SEQ ID NO: 1771922 - DNA, 19 bp, Homo sapiens
tgtgcctgcaccaggagac

SEQ ID NO: 1771923 - DNA, 12 bp, Homo sapiens
tgtgcctgcagc

SEQ ID NO: 1771924 - DNA, 20 bp, Homo sapiens
tgtgcctgctagagcaaccc

SEQ ID NO: 1771925 - DNA, 19 bp, Homo sapiens
tgtgcctgctcagcagcca

SEQ ID NO: 1771926 - DNA, 21 bp, Homo sapiens
tgtgcctgctcagcagccagt

SEQ ID NO: 1771927 - DNA, 20 bp, Homo sapiens
tgtgcctggttaatattaat

SEQ ID NO: 1771928 - DNA, 16 bp, Homo sapiens
tgtgcctgtgctcctg

SEQ ID NO: 1771929 - DNA, 19 bp, Homo sapiens
tgtgcctgtgctcctgccc

SEQ ID NO: 1771930 - DNA, 13 bp, Homo sapiens
tgtgcctgtggca

SEQ ID NO: 1771931 - DNA, 13 bp, Homo sapiens
tgtgccttaagtt

SEQ ID NO: 1771932 - DNA, 14 bp, Homo sapiens
tgtgccttcgtctt

SEQ ID NO: 1771933 - DNA, 19 bp, Homo sapiens
tgtgccttgattgattaga

SEQ ID NO: 1771934 - DNA, 16 bp, Homo sapiens
tgtgccttggtctctc

SEQ ID NO: 1771935 - DNA, 17 bp, Homo sapiens
tgtgccttggtgtgctg

SEQ ID NO: 1771936 - DNA, 10 bp, Homo sapiens
tgtgcctttc

SEQ ID NO: 1771937 - DNA, 13 bp, Homo sapiens
tgtgcctttcttt

SEQ ID NO: 1771938 - DNA, 14 bp, Homo sapiens
tgtgcctttctttg

SEQ ID NO: 1771939 - DNA, 15 bp, Homo sapiens
tgtgcctttctttgc

SEQ ID NO: 1771940 - DNA, 13 bp, Homo sapiens
tgtgcctttggcc

SEQ ID NO: 1771941 - DNA, 15 bp, Homo sapiens
tgtgccttttctgaa

SEQ ID NO: 1771942 - DNA, 13 bp, Homo sapiens
tgtgcgctgcctg

SEQ ID NO: 1771943 - DNA, 14 bp, Homo sapiens
tgtgcgctgcctgg

SEQ ID NO: 1771944 - DNA, 15 bp, Homo sapiens
tgtgcgctgcctggc

SEQ ID NO: 1771945 - DNA, 16 bp, Homo sapiens
tgtgcgtcccagctga

SEQ ID NO: 1771946 - DNA, 17 bp, Homo sapiens
tgtgcgtcccagctgaa

SEQ ID NO: 1771947 - DNA, 23 bp, Homo sapiens
tgtgcgtcccagctgaaggcagt

SEQ ID NO: 1771948 - DNA, 24 bp, Homo sapiens
tgtgcgtctctctttctccctcac

SEQ ID NO: 1771949 - DNA, 16 bp, Homo sapiens
tgtgcgtgcgtgtgtg

SEQ ID NO: 1771950 - DNA, 22 bp, Homo sapiens
tgtgcgtgcgtgttagtgtgtg

SEQ ID NO: 1771951 - DNA, 19 bp, Homo sapiens
tgtgctagtcactggcagc

SEQ ID NO: 1771952 - DNA, 17 bp, Homo sapiens
tgtgctatacacacaca

SEQ ID NO: 1771953 - DNA, 18 bp, Homo sapiens
tgtgctatacacacacac

SEQ ID NO: 1771954 - DNA, 13 bp, Homo sapiens
tgtgctatactgc

SEQ ID NO: 1771955 - DNA, 20 bp, Homo sapiens
tgtgctatactgcatacttt

SEQ ID NO: 1771956 - DNA, 21 bp, Homo sapiens
tgtgctatactgcatactttt

SEQ ID NO: 1771957 - DNA, 14 bp, Homo sapiens
tgtgctatgaattt

SEQ ID NO: 1771958 - DNA, 15 bp, Homo sapiens
tgtgctatttgtaca

SEQ ID NO: 1771959 - DNA, 21 bp, Homo sapiens
tgtgctcacgctcccccgcag

SEQ ID NO: 1771960 - DNA, 13 bp, Homo sapiens
tgtgctcagccaa

SEQ ID NO: 1771961 - DNA, 15 bp, Homo sapiens
tgtgctcatttaagt

SEQ ID NO: 1771962 - DNA, 22 bp, Homo sapiens
tgtgctccaacctgaaggtccc

SEQ ID NO: 1771963 - DNA, 23 bp, Homo sapiens
tgtgctccgtgcctccaccacca

SEQ ID NO: 1771964 - DNA, 16 bp, Homo sapiens
tgtgctcctccttggt

SEQ ID NO: 1771965 - DNA, 20 bp, Homo sapiens
tgtgctcctcttgattcctg

SEQ ID NO: 1771966 - DNA, 16 bp, Homo sapiens
tgtgctcctgcccagg

SEQ ID NO: 1771967 - DNA, 21 bp, Homo sapiens
tgtgctctccccggcaggcct

SEQ ID NO: 1771968 - DNA, 22 bp, Homo sapiens
tgtgctctgaatgggagccaga

SEQ ID NO: 1771969 - DNA, 13 bp, Homo sapiens
tgtgctctgggga

SEQ ID NO: 1771970 - DNA, 16 bp, Homo sapiens
tgtgctctttgaagag

SEQ ID NO: 1771971 - DNA, 15 bp, Homo sapiens
tgtgctgaagacatg

SEQ ID NO: 1771972 - DNA, 14 bp, Homo sapiens
tgtgctgaggcctt

SEQ ID NO: 1771973 - DNA, 16 bp, Homo sapiens
tgtgctgccatttgat

SEQ ID NO: 1771974 - DNA, 19 bp, Homo sapiens
tgtgctgcggtcactcagg

SEQ ID NO: 1771975 - DNA, 18 bp, Homo sapiens
tgtgctggagatgtttta

SEQ ID NO: 1771976 - DNA, 17 bp, Homo sapiens
tgtgctgggagctccac

SEQ ID NO: 1771977 - DNA, 16 bp, Homo sapiens
tgtgctggtgaacact

SEQ ID NO: 1771978 - DNA, 20 bp, Homo sapiens
tgtgctggtgaacactgtga

SEQ ID NO: 1771979 - DNA, 15 bp, Homo sapiens
tgtgctgtgcctgct

SEQ ID NO: 1771980 - DNA, 17 bp, Homo sapiens
tgtgctgtgcctgctag

SEQ ID NO: 1771981 - DNA, 12 bp, Homo sapiens
tgtgctgtgtgt

SEQ ID NO: 1771982 - DNA, 23 bp, Homo sapiens
tgtgcttacagtaactaattttg

SEQ ID NO: 1771983 - DNA, 13 bp, Homo sapiens
tgtgcttatgttt

SEQ ID NO: 1771984 - DNA, 22 bp, Homo sapiens
tgtgcttcacagtagagccagc

SEQ ID NO: 1771985 - DNA, 23 bp, Homo sapiens
tgtgcttcacagtagagccagct

SEQ ID NO: 1771986 - DNA, 15 bp, Homo sapiens
tgtgcttggtctgtt

SEQ ID NO: 1771987 - DNA, 18 bp, Homo sapiens
tgtgcttggtctgtttga

SEQ ID NO: 1771988 - DNA, 14 bp, Homo sapiens
tgtgcttgtttaca

SEQ ID NO: 1771989 - DNA, 23 bp, Homo sapiens
tgtgcttgtttacagcactactc

SEQ ID NO: 1771990 - DNA, 13 bp, Homo sapiens
tgtgctttctagc

SEQ ID NO: 1771991 - DNA, 21 bp, Homo sapiens
tgtgcttttcctgataaagca

SEQ ID NO: 1771992 - DNA, 17 bp, Homo sapiens
tgtgctttttaagaata

SEQ ID NO: 1771993 - DNA, 16 bp, Homo sapiens
tgtgctttttttgtgt

SEQ ID NO: 1771994 - DNA, 22 bp, Homo sapiens
tgtggaaaacacaataaaaaat

SEQ ID NO: 1771995 - DNA, 19 bp, Homo sapiens
tgtggaaaaccaggaaaag

SEQ ID NO: 1771996 - DNA, 14 bp, Homo sapiens
tgtggaaagcctct

SEQ ID NO: 1771997 - DNA, 15 bp, Homo sapiens
tgtggaaagcctctg

SEQ ID NO: 1771998 - DNA, 17 bp, Homo sapiens
tgtggaaagcctctgct

SEQ ID NO: 1771999 - DNA, 15 bp, Homo sapiens
tgtggaaagtagctg

SEQ ID NO: 1772000 - DNA, 18 bp, Homo sapiens
tgtggaaagtagctgcta

SEQ ID NO: 1772001 - DNA, 20 bp, Homo sapiens
tgtggaagtcagtacgatca

SEQ ID NO: 1772002 - DNA, 11 bp, Homo sapiens
tgtggacagga

SEQ ID NO: 1772003 - DNA, 14 bp, Homo sapiens
tgtggacaggatga

SEQ ID NO: 1772004 - DNA, 17 bp, Homo sapiens
tgtggaccactgcatga

SEQ ID NO: 1772005 - DNA, 19 bp, Homo sapiens
tgtggaccactgcatgagc

SEQ ID NO: 1772006 - DNA, 20 bp, Homo sapiens
tgtggaccgtggacaggccc

SEQ ID NO: 1772007 - DNA, 21 bp, Homo sapiens
tgtggactgtcctgaggagcc

SEQ ID NO: 1772008 - DNA, 14 bp, Homo sapiens
tgtggactgtgatg

SEQ ID NO: 1772009 - DNA, 24 bp, Homo sapiens
tgtggactgtgcctcaggccaggg

SEQ ID NO: 1772010 - DNA, 13 bp, Homo sapiens
tgtggagaaagga

SEQ ID NO: 1772011 - DNA, 19 bp, Homo sapiens
tgtggagagggaatgtgaa

SEQ ID NO: 1772012 - DNA, 20 bp, Homo sapiens
tgtggagccgaggcctaccc

SEQ ID NO: 1772013 - DNA, 20 bp, Homo sapiens
tgtggaggaagagccacctg

SEQ ID NO: 1772014 - DNA, 21 bp, Homo sapiens
tgtggaggaagagccacctgc

SEQ ID NO: 1772015 - DNA, 22 bp, Homo sapiens
tgtggaggaagagccacctgca

SEQ ID NO: 1772016 - DNA, 20 bp, Homo sapiens
tgtggagggtcaccaggttg

SEQ ID NO: 1772017 - DNA, 15 bp, Homo sapiens
tgtggagtccagctc

SEQ ID NO: 1772018 - DNA, 22 bp, Homo sapiens
tgtggagttcaccttggaaggg

SEQ ID NO: 1772019 - DNA, 20 bp, Homo sapiens
tgtggatcaaccatcgcttt

SEQ ID NO: 1772020 - DNA, 19 bp, Homo sapiens
tgtggatgaccacataaga

SEQ ID NO: 1772021 - DNA, 18 bp, Homo sapiens
tgtggattctatatttca

SEQ ID NO: 1772022 - DNA, 21 bp, Homo sapiens
tgtggattctatatttcatat

SEQ ID NO: 1772023 - DNA, 22 bp, Homo sapiens
tgtggcaaagccttcattgcct

SEQ ID NO: 1772024 - DNA, 16 bp, Homo sapiens
tgtggcaaagtgctgt

SEQ ID NO: 1772025 - DNA, 19 bp, Homo sapiens
tgtggcaaagtgctgtacc

SEQ ID NO: 1772026 - DNA, 17 bp, Homo sapiens
tgtggcacagccctgag

SEQ ID NO: 1772027 - DNA, 20 bp, Homo sapiens
tgtggcacagccctgagtgt

SEQ ID NO: 1772028 - DNA, 21 bp, Homo sapiens
tgtggcagccgtcccaggcca

SEQ ID NO: 1772029 - DNA, 16 bp, Homo sapiens
tgtggcagctgcccct

SEQ ID NO: 1772030 - DNA, 20 bp, Homo sapiens
tgtggcagggggccccgcca

SEQ ID NO: 1772031 - DNA, 11 bp, Homo sapiens
tgtggcagtgg

SEQ ID NO: 1772032 - DNA, 16 bp, Homo sapiens
tgtggcagtggccagg

SEQ ID NO: 1772033 - DNA, 17 bp, Homo sapiens
tgtggcagtggccaggc

SEQ ID NO: 1772034 - DNA, 12 bp, Homo sapiens
tgtggcagtggt

SEQ ID NO: 1772035 - DNA, 21 bp, Homo sapiens
tgtggcatctttgccttgggc

SEQ ID NO: 1772036 - DNA, 21 bp, Homo sapiens
tgtgtattgatgcaatataag

SEQ ID NO: 1772037 - DNA, 13 bp, Homo sapiens
tgtgtatttgcta

SEQ ID NO: 1772038 - DNA, 15 bp, Homo sapiens
tgtgtatttgctaat

SEQ ID NO: 1772039 - DNA, 19 bp, Homo sapiens
tgtgtatttgtattaataa

SEQ ID NO: 1772040 - DNA, 17 bp, Homo sapiens
tgtgtatttttcaaggc

SEQ ID NO: 1772041 - DNA, 17 bp, Homo sapiens
tgtgtcagaaacatgaa

SEQ ID NO: 1772042 - DNA, 20 bp, Homo sapiens
tgtgtcagaataggaaaaca

SEQ ID NO: 1772043 - DNA, 17 bp, Homo sapiens
tgtgtcagagcccagcc

SEQ ID NO: 1772044 - DNA, 20 bp, Homo sapiens
tgtgtcagagcccagcccag

SEQ ID NO: 1772045 - DNA, 15 bp, Homo sapiens
tgtgtcagctgaggc

SEQ ID NO: 1772046 - DNA, 17 bp, Homo sapiens
tgtgtcagctgaggctg

SEQ ID NO: 1772047 - DNA, 13 bp, Homo sapiens
tgtgtcaggccct

SEQ ID NO: 1772048 - DNA, 16 bp, Homo sapiens
tgtgtcaggccctctg

SEQ ID NO: 1772049 - DNA, 19 bp, Homo sapiens
tgtgtcaggccctctgcct

SEQ ID NO: 1772050 - DNA, 16 bp, Homo sapiens
tgtgtcataccagaaa

SEQ ID NO: 1772051 - DNA, 14 bp, Homo sapiens
tgtgtcatgccagt

SEQ ID NO: 1772052 - DNA, 18 bp, Homo sapiens
tgtgtcatttattcaagt

SEQ ID NO: 1772053 - DNA, 13 bp, Homo sapiens
tgtgtcatttctt

SEQ ID NO: 1772054 - DNA, 17 bp, Homo sapiens
tgtgtcatttcttcact

SEQ ID NO: 1772055 - DNA, 21 bp, Homo sapiens
tgtgtccagttttggaggctg

SEQ ID NO: 1772056 - DNA, 15 bp, Homo sapiens
tgtgtccatcccagc

SEQ ID NO: 1772057 - DNA, 15 bp, Homo sapiens
tgtgtcccagccacg

SEQ ID NO: 1772058 - DNA, 17 bp, Homo sapiens
tgtgtcccagccacgca

SEQ ID NO: 1772059 - DNA, 19 bp, Homo sapiens
tgtgtcccatgatccctgt

SEQ ID NO: 1772060 - DNA, 17 bp, Homo sapiens
tgtgtccctggacacag

SEQ ID NO: 1772061 - DNA, 19 bp, Homo sapiens
tgtgtccctggacacagct

SEQ ID NO: 1772062 - DNA, 16 bp, Homo sapiens
tgtgtccgatgctgga

SEQ ID NO: 1772063 - DNA, 17 bp, Homo sapiens
tgtgtcctaaggcccat

SEQ ID NO: 1772064 - DNA, 23 bp, Homo sapiens
tgtgtcctccaccatgcactcac

SEQ ID NO: 1772065 - DNA, 19 bp, Homo sapiens
tgtgtcctggtgctctctg

SEQ ID NO: 1772066 - DNA, 14 bp, Homo sapiens
tgtgtcctggttcc

SEQ ID NO: 1772067 - DNA, 19 bp, Homo sapiens
tgtgtccttgcacctgcat

SEQ ID NO: 1772068 - DNA, 16 bp, Homo sapiens
tgtgtctaagattcta

SEQ ID NO: 1772069 - DNA, 18 bp, Homo sapiens
tgtgtctaagattctaga

SEQ ID NO: 1772070 - DNA, 20 bp, Homo sapiens
tgtgtctaagattctagatc

SEQ ID NO: 1772071 - DNA, 13 bp, Homo sapiens
tgtgtctaggctg

SEQ ID NO: 1772072 - DNA, 15 bp, Homo sapiens
tgtgtctgacatgtt

SEQ ID NO: 1772073 - DNA, 10 bp, Homo sapiens
tgtgtctgct

SEQ ID NO: 1772074 - DNA, 19 bp, Homo sapiens
tgtgtctggtgcagaatat

SEQ ID NO: 1772075 - DNA, 13 bp, Homo sapiens
tgtgtctgtacac

SEQ ID NO: 1772076 - DNA, 21 bp, Homo sapiens
tgtgtctgtgccctccaaaga

SEQ ID NO: 1772077 - DNA, 22 bp, Homo sapiens
tgtgtctgtgccctccaaagag

SEQ ID NO: 1772078 - DNA, 16 bp, Homo sapiens
tgtgtcttaattatta

SEQ ID NO: 1772079 - DNA, 18 bp, Homo sapiens
tgtgtctttcacagctcc

SEQ ID NO: 1772080 - DNA, 19 bp, Homo sapiens
tgtgtgaaaaaagaaaatg

SEQ ID NO: 1772081 - DNA, 14 bp, Homo sapiens
tgtgtgaaattgca

SEQ ID NO: 1772082 - DNA, 15 bp, Homo sapiens
tgtgtgacaattctg

SEQ ID NO: 1772083 - DNA, 16 bp, Homo sapiens
tgtgtgacactgatga

SEQ ID NO: 1772084 - DNA, 23 bp, Homo sapiens
tgtgtgacagaatcttgtatttg

SEQ ID NO: 1772085 - DNA, 15 bp, Homo sapiens
tgtgtgactgagcaa

SEQ ID NO: 1772086 - DNA, 17 bp, Homo sapiens
tgtgtgagcaagcattt

SEQ ID NO: 1772087 - DNA, 21 bp, Homo sapiens
tgtgtgagtggagttgaggtg

SEQ ID NO: 1772088 - DNA, 13 bp, Homo sapiens
tgtgtgagttgag

SEQ ID NO: 1772089 - DNA, 15 bp, Homo sapiens
tgtgtgatatttcag

SEQ ID NO: 1772090 - DNA, 14 bp, Homo sapiens
tgtgtgattgaagg

SEQ ID NO: 1772091 - DNA, 19 bp, Homo sapiens
tgtgtgatttcctaaacat

SEQ ID NO: 1772092 - DNA, 14 bp, Homo sapiens
tgtgtgcacaccca

SEQ ID NO: 1772093 - DNA, 14 bp, Homo sapiens
tgtgtgcatgtgag

SEQ ID NO: 1772094 - DNA, 20 bp, Homo sapiens
tgtgtgccccactccagcct

SEQ ID NO: 1772095 - DNA, 21 bp, Homo sapiens
tgtgtgccccactccagcctg

SEQ ID NO: 1772096 - DNA, 15 bp, Homo sapiens
tgtgtgcctgtggca

SEQ ID NO: 1772097 - DNA, 17 bp, Homo sapiens
tgtgtgcctgtggcaga

SEQ ID NO: 1772098 - DNA, 18 bp, Homo sapiens
tgtgtgcgctgcctggcc

SEQ ID NO: 1772099 - DNA, 12 bp, Homo sapiens
tgtgtgctccgg

SEQ ID NO: 1772100 - DNA, 15 bp, Homo sapiens
tgtgtgctgactgaa

SEQ ID NO: 1772101 - DNA, 20 bp, Homo sapiens
tgtgtgctttttttgtgtgt

SEQ ID NO: 1772102 - DNA, 19 bp, Homo sapiens
tgtgtggaaggcacccgcc

SEQ ID NO: 1772103 - DNA, 18 bp, Homo sapiens
tgtgtggcccagttctga

SEQ ID NO: 1772104 - DNA, 15 bp, Homo sapiens
tgtgtggctcctggg

SEQ ID NO: 1772105 - DNA, 14 bp, Homo sapiens
tgtgtggctgggac

SEQ ID NO: 1772106 - DNA, 11 bp, Homo sapiens
tgtgtggctgt

SEQ ID NO: 1772107 - DNA, 20 bp, Homo sapiens
tgtgtggtctctgccccagc

SEQ ID NO: 1772108 - DNA, 21 bp, Homo sapiens
tgtgtggtggattctccctgg

SEQ ID NO: 1772109 - DNA, 17 bp, Homo sapiens
tgtgtgtaagattttta

SEQ ID NO: 1772110 - DNA, 13 bp, Homo sapiens
tgtgtgtatgtgt

SEQ ID NO: 1772111 - DNA, 15 bp, Homo sapiens
tgtgtgtatgtgtga

SEQ ID NO: 1772112 - DNA, 19 bp, Homo sapiens
tgtgtgtatgtttgcacac

SEQ ID NO: 1772113 - DNA, 18 bp, Homo sapiens
tgtgtgtattcagaggca

SEQ ID NO: 1772114 - DNA, 12 bp, Homo sapiens
tgtgtgtatttg

SEQ ID NO: 1772115 - DNA, 18 bp, Homo sapiens
tgtgtgtcatgccagtga

SEQ ID NO: 1772116 - DNA, 21 bp, Homo sapiens
tgtgtgtctgtctttgtggga

SEQ ID NO: 1772117 - DNA, 12 bp, Homo sapiens
tgtgtgtggaag

SEQ ID NO: 1772118 - DNA, 19 bp, Homo sapiens
tgtgtgtgggctgtgagtg

SEQ ID NO: 1772119 - DNA, 14 bp, Homo sapiens
tgtgtgtgtgcatg

SEQ ID NO: 1772120 - DNA, 16 bp, Homo sapiens
tgtgtgtgtgtatgtg

SEQ ID NO: 1772121 - DNA, 13 bp, Homo sapiens
tgtgtgtgtgtgt

SEQ ID NO: 1772122 - DNA, 16 bp, Homo sapiens
tgtgtgtgtgtgtgca

SEQ ID NO: 1772123 - DNA, 12 bp, Homo sapiens
tgtgtgtgtgtt

SEQ ID NO: 1772124 - DNA, 13 bp, Homo sapiens
tgtgtgttcacct

SEQ ID NO: 1772125 - DNA, 14 bp, Homo sapiens
tgtgtgttcacctt

SEQ ID NO: 1772126 - DNA, 12 bp, Homo sapiens
tgtgtgttgctt

SEQ ID NO: 1772127 - DNA, 20 bp, Homo sapiens
tgtgtgttttcccaaagcac

SEQ ID NO: 1772128 - DNA, 20 bp, Homo sapiens
tgtgttaaacatgctaaata

SEQ ID NO: 1772129 - DNA, 23 bp, Homo sapiens
tgtgttactaaaaaaaagatgaa

SEQ ID NO: 1772130 - DNA, 20 bp, Homo sapiens
tgtgttactgctttgcaaag

SEQ ID NO: 1772131 - DNA, 14 bp, Homo sapiens
tgtgttatttaaat

SEQ ID NO: 1772132 - DNA, 20 bp, Homo sapiens
tgtgttcaatatttagaaaa

SEQ ID NO: 1772133 - DNA, 19 bp, Homo sapiens
tgtgttcagctctttccaa

SEQ ID NO: 1772134 - DNA, 16 bp, Homo sapiens
tgtgttcccatttcag

SEQ ID NO: 1772135 - DNA, 22 bp, Homo sapiens
tgtgttcctggcccactctgta

SEQ ID NO: 1772136 - DNA, 21 bp, Homo sapiens
tgtgttctgtttgttaaaact

SEQ ID NO: 1772137 - DNA, 13 bp, Homo sapiens
tgtgttgaacaca

SEQ ID NO: 1772138 - DNA, 16 bp, Homo sapiens
tgtgttgagatccagt

SEQ ID NO: 1772139 - DNA, 19 bp, Homo sapiens
tgtgttgcaaattattcta

SEQ ID NO: 1772140 - DNA, 13 bp, Homo sapiens
tgtgttgccaagc

SEQ ID NO: 1772141 - DNA, 16 bp, Homo sapiens
tgtgttgccaagctcc

SEQ ID NO: 1772142 - DNA, 15 bp, Homo sapiens
tgtgttgcttatgtt

SEQ ID NO: 1772143 - DNA, 13 bp, Homo sapiens
tgtgttgtctcta

SEQ ID NO: 1772144 - DNA, 19 bp, Homo sapiens
tgtgttgtctcttgagttt

SEQ ID NO: 1772145 - DNA, 14 bp, Homo sapiens
tgtgttgtcttgaa

SEQ ID NO: 1772146 - DNA, 18 bp, Homo sapiens
tgtgttgtcttgaaagat

SEQ ID NO: 1772147 - DNA, 19 bp, Homo sapiens
tgtgttgtcttttttatgt

SEQ ID NO: 1772148 - DNA, 20 bp, Homo sapiens
tgtgttgttttttgttcaat

SEQ ID NO: 1772149 - DNA, 17 bp, Homo sapiens
tgtgtttatgtgagctg

SEQ ID NO: 1772150 - DNA, 14 bp, Homo sapiens
tgtgtttattcaaa

SEQ ID NO: 1772151 - DNA, 14 bp, Homo sapiens
tgtgtttattcttg

SEQ ID NO: 1772152 - DNA, 20 bp, Homo sapiens
tgttcttttctcctttacca

SEQ ID NO: 1772153 - DNA, 16 bp, Homo sapiens
tgttcttttgtcccag

SEQ ID NO: 1772154 - DNA, 23 bp, Homo sapiens
tgttctttttctgaactccattt

SEQ ID NO: 1772155 - DNA, 24 bp, Homo sapiens
tgttgaaaggtaatttgagagaaa

SEQ ID NO: 1772156 - DNA, 22 bp, Homo sapiens
tgttgaaattatgtatgtttac

SEQ ID NO: 1772157 - DNA, 18 bp, Homo sapiens
tgttgaacaaaataaatt

SEQ ID NO: 1772158 - DNA, 11 bp, Homo sapiens
tgttgaagagc

SEQ ID NO: 1772159 - DNA, 22 bp, Homo sapiens
tgttgaatgcccacaggcaaat

SEQ ID NO: 1772160 - DNA, 21 bp, Homo sapiens
tgttgacagcaaaatgttgaa

SEQ ID NO: 1772161 - DNA, 17 bp, Homo sapiens
tgttgacagttcatatg

SEQ ID NO: 1772162 - DNA, 16 bp, Homo sapiens
tgttgacagttctgaa

SEQ ID NO: 1772163 - DNA, 18 bp, Homo sapiens
tgttgacctgtgcaccta

SEQ ID NO: 1772164 - DNA, 13 bp, Homo sapiens
tgttgagaggttc

SEQ ID NO: 1772165 - DNA, 15 bp, Homo sapiens
tgttgagatccagtg

SEQ ID NO: 1772166 - DNA, 14 bp, Homo sapiens
tgttgagcaagcag

SEQ ID NO: 1772167 - DNA, 20 bp, Homo sapiens
tgttgagcatgacagcctgc

SEQ ID NO: 1772168 - DNA, 17 bp, Homo sapiens
tgttgagccccagtgct

SEQ ID NO: 1772169 - DNA, 18 bp, Homo sapiens
tgttgagccccagtgctg

SEQ ID NO: 1772170 - DNA, 16 bp, Homo sapiens
tgttgagccttttccc

SEQ ID NO: 1772171 - DNA, 18 bp, Homo sapiens
tgttgagccttttccctc

SEQ ID NO: 1772172 - DNA, 13 bp, Homo sapiens
tgttgagctgttt

SEQ ID NO: 1772173 - DNA, 18 bp, Homo sapiens
tgttgagggccacttttt

SEQ ID NO: 1772174 - DNA, 16 bp, Homo sapiens
tgttgagttatgataa

SEQ ID NO: 1772175 - DNA, 21 bp, Homo sapiens
tgttgatagtgatgtatttta

SEQ ID NO: 1772176 - DNA, 20 bp, Homo sapiens
tgttgatcagccttatgtgg

SEQ ID NO: 1772177 - DNA, 19 bp, Homo sapiens
tgttgatcatgtacttttt

SEQ ID NO: 1772178 - DNA, 22 bp, Homo sapiens
tgttgatcatgtactttttagt

SEQ ID NO: 1772179 - DNA, 20 bp, Homo sapiens
tgttgatcccacttcactgt

SEQ ID NO: 1772180 - DNA, 16 bp, Homo sapiens
tgttgattatcttcag

SEQ ID NO: 1772181 - DNA, 11 bp, Homo sapiens
tgttgattatt

SEQ ID NO: 1772182 - DNA, 20 bp, Homo sapiens
tgttgattgcaggaataagg

SEQ ID NO: 1772183 - DNA, 20 bp, Homo sapiens
tgttgatttctttccttccc

SEQ ID NO: 1772184 - DNA, 18 bp, Homo sapiens
tgttgatttttactgtgt

SEQ ID NO: 1772185 - DNA, 20 bp, Homo sapiens
tgttgcaaattattctagtc

SEQ ID NO: 1772186 - DNA, 15 bp, Homo sapiens
tgttgcaagatgtga

SEQ ID NO: 1772187 - DNA, 17 bp, Homo sapiens
tgttgcaagatgtgaat

SEQ ID NO: 1772188 - DNA, 14 bp, Homo sapiens
tgttgcagtggcct

SEQ ID NO: 1772189 - DNA, 20 bp, Homo sapiens
tgttgccaaatatgtcctgg

SEQ ID NO: 1772190 - DNA, 19 bp, Homo sapiens
tgttgccaactaagccctc

SEQ ID NO: 1772191 - DNA, 12 bp, Homo sapiens
tgttgccaggtt

SEQ ID NO: 1772192 - DNA, 20 bp, Homo sapiens
tgttgccaggttgcagctgc

SEQ ID NO: 1772193 - DNA, 16 bp, Homo sapiens
tgttgccagtcagcaa

SEQ ID NO: 1772194 - DNA, 19 bp, Homo sapiens
tgttgccatgtgcaccttg

SEQ ID NO: 1772195 - DNA, 14 bp, Homo sapiens
tgttgcccaggctg

SEQ ID NO: 1772196 - DNA, 16 bp, Homo sapiens
tgttgcccctttctct

SEQ ID NO: 1772197 - DNA, 20 bp, Homo sapiens
tgttgcccctttctcttttc

SEQ ID NO: 1772198 - DNA, 18 bp, Homo sapiens
tgttgcctttatggtttc

SEQ ID NO: 1772199 - DNA, 16 bp, Homo sapiens
tgttgcgttcaaagag

SEQ ID NO: 1772200 - DNA, 21 bp, Homo sapiens
tgttgctcaaatctattcaga

SEQ ID NO: 1772201 - DNA, 15 bp, Homo sapiens
tgttgctctaggaag

SEQ ID NO: 1772202 - DNA, 14 bp, Homo sapiens
tgttgctcttggaa

SEQ ID NO: 1772203 - DNA, 15 bp, Homo sapiens
tgttgctcttggaaa

SEQ ID NO: 1772204 - DNA, 12 bp, Homo sapiens
tgttgctgctgt

SEQ ID NO: 1772205 - DNA, 15 bp, Homo sapiens
tgttgcttagatgag

SEQ ID NO: 1772206 - DNA, 20 bp, Homo sapiens
tgttgcttagtcacttattt

SEQ ID NO: 1772207 - DNA, 14 bp, Homo sapiens
tgttgcttatgttg

SEQ ID NO: 1772208 - DNA, 14 bp, Homo sapiens
tgttgcttctcagg

SEQ ID NO: 1772209 - DNA, 17 bp, Homo sapiens
tgttgcttttgaaaagt

SEQ ID NO: 1772210 - DNA, 13 bp, Homo sapiens
tgttggaaagtaa

SEQ ID NO: 1772211 - DNA, 24 bp, Homo sapiens
tgttggaactctgtgcaggtgctg

SEQ ID NO: 1772212 - DNA, 21 bp, Homo sapiens
tgttggacacctttaggttct

SEQ ID NO: 1772213 - DNA, 14 bp, Homo sapiens
tgttggagtgagga

SEQ ID NO: 1772214 - DNA, 15 bp, Homo sapiens
tgttggcactcacag

SEQ ID NO: 1772215 - DNA, 21 bp, Homo sapiens
tgttggcactcacagacctgg

SEQ ID NO: 1772216 - DNA, 13 bp, Homo sapiens
tgttggcaggccc

SEQ ID NO: 1772217 - DNA, 15 bp, Homo sapiens
tgttggcaggcccac

SEQ ID NO: 1772218 - DNA, 16 bp, Homo sapiens
tgttggcctccggcct

SEQ ID NO: 1772219 - DNA, 17 bp, Homo sapiens
tgttggcctccggcctc

SEQ ID NO: 1772220 - DNA, 15 bp, Homo sapiens
tgttgggacctgctg

SEQ ID NO: 1772221 - DNA, 13 bp, Homo sapiens
tgttgggagaaag

SEQ ID NO: 1772222 - DNA, 20 bp, Homo sapiens
tgttgggaggggaagggctg

SEQ ID NO: 1772223 - DNA, 13 bp, Homo sapiens
tgttggtagccat

SEQ ID NO: 1772224 - DNA, 19 bp, Homo sapiens
tgttggttgttttttcctt

SEQ ID NO: 1772225 - DNA, 17 bp, Homo sapiens
tgttgtaaaacaaaatt

SEQ ID NO: 1772226 - DNA, 22 bp, Homo sapiens
tgttgtaaaacaaaatttgact

SEQ ID NO: 1772227 - DNA, 19 bp, Homo sapiens
tgttgtaaaagatgcagag

SEQ ID NO: 1772228 - DNA, 21 bp, Homo sapiens
tgttgtaaatatttatgtaaa

SEQ ID NO: 1772229 - DNA, 16 bp, Homo sapiens
tgttgtaatgctgcac

SEQ ID NO: 1772230 - DNA, 22 bp, Homo sapiens
tgttgtaatgctgcacttcctg

SEQ ID NO: 1772231 - DNA, 17 bp, Homo sapiens
tgttgtacgtaaagctt

SEQ ID NO: 1772232 - DNA, 15 bp, Homo sapiens
tgttgtagatgctaa

SEQ ID NO: 1772233 - DNA, 22 bp, Homo sapiens
tgttgtagatgctaacgtgtca

SEQ ID NO: 1772234 - DNA, 22 bp, Homo sapiens
tgttgtagattgattgtattgt

SEQ ID NO: 1772235 - DNA, 17 bp, Homo sapiens
tgttgtccaacaataaa

SEQ ID NO: 1772236 - DNA, 22 bp, Homo sapiens
tgttgtccaacaataaacagga

SEQ ID NO: 1772237 - DNA, 23 bp, Homo sapiens
tgttgtccaacaataaacaggaa

SEQ ID NO: 1772238 - DNA, 15 bp, Homo sapiens
tgttgtctccctctt

SEQ ID NO: 1772239 - DNA, 15 bp, Homo sapiens
tgttgtgaataatta

SEQ ID NO: 1772240 - DNA, 19 bp, Homo sapiens
tgttgtgaataattacagt

SEQ ID NO: 1772241 - DNA, 20 bp, Homo sapiens
tgttgtgaataattacagtg

SEQ ID NO: 1772242 - DNA, 14 bp, Homo sapiens
tgttgtgatgtatt

SEQ ID NO: 1772243 - DNA, 20 bp, Homo sapiens
tgttgtgatgtattctagct

SEQ ID NO: 1772244 - DNA, 23 bp, Homo sapiens
tgttgtggtactggcaataagat

SEQ ID NO: 1772245 - DNA, 13 bp, Homo sapiens
tgttgtgtgtgca

SEQ ID NO: 1772246 - DNA, 15 bp, Homo sapiens
tgttgtgtgtgggag

SEQ ID NO: 1772247 - DNA, 13 bp, Homo sapiens
tgttgtgttcctg

SEQ ID NO: 1772248 - DNA, 15 bp, Homo sapiens
tgttgtgttcctggc

SEQ ID NO: 1772249 - DNA, 21 bp, Homo sapiens
tgttgtgttcctggctgatga

SEQ ID NO: 1772250 - DNA, 17 bp, Homo sapiens
tgttgttaatgaaaatg

SEQ ID NO: 1772251 - DNA, 21 bp, Homo sapiens
tgttgttaatgaaaatgtcag

SEQ ID NO: 1772252 - DNA, 19 bp, Homo sapiens
tgttgttccattttatgca

SEQ ID NO: 1772253 - DNA, 13 bp, Homo sapiens
tgttgttcctcta

SEQ ID NO: 1772254 - DNA, 14 bp, Homo sapiens
tgttgttccttttg

SEQ ID NO: 1772255 - DNA, 16 bp, Homo sapiens
tgttgttgctgctgtt

SEQ ID NO: 1772256 - DNA, 13 bp, Homo sapiens
tgttgttggttgt

SEQ ID NO: 1772257 - DNA, 16 bp, Homo sapiens
tgttgttgttgttctt

SEQ ID NO: 1772258 - DNA, 12 bp, Homo sapiens
tgttgtttgcca

SEQ ID NO: 1772259 - DNA, 22 bp, Homo sapiens
tgtttaaaactcagaatataac

SEQ ID NO: 1772260 - DNA, 23 bp, Homo sapiens
tgtttaaagaagctctccaggcc

SEQ ID NO: 1772261 - DNA, 16 bp, Homo sapiens
tgtttaaagtatatgt

SEQ ID NO: 1772262 - DNA, 15 bp, Homo sapiens
tgtttaaataaaatt

SEQ ID NO: 1772263 - DNA, 23 bp, Homo sapiens
tgtttaaatagcctaaatgatgg

SEQ ID NO: 1772264 - DNA, 11 bp, Homo sapiens
tgtttaaatat

SEQ ID NO: 1772265 - DNA, 22 bp, Homo sapiens
tgtttaaatataaatgtttaaa

SEQ ID NO: 1772266 - DNA, 13 bp, Homo sapiens
tgtttaacaaatc

SEQ ID NO: 1772267 - DNA, 23 bp, Homo sapiens
tgtttgtcagcatctgaccatct

SEQ ID NO: 1772268 - DNA, 14 bp, Homo sapiens
tgtttgtgagaagc

SEQ ID NO: 1772269 - DNA, 12 bp, Homo sapiens
tgtttgtgggac

SEQ ID NO: 1772270 - DNA, 17 bp, Homo sapiens
tgtttgtgtgatttcct

SEQ ID NO: 1772271 - DNA, 15 bp, Homo sapiens
tgtttgtttcaagaa

SEQ ID NO: 1772272 - DNA, 13 bp, Homo sapiens
tgtttgtttgtct

SEQ ID NO: 1772273 - DNA, 16 bp, Homo sapiens
tgtttgtttgtctgtt

SEQ ID NO: 1772274 - DNA, 12 bp, Homo sapiens
tgttttaaaaaa

SEQ ID NO: 1772275 - DNA, 20 bp, Homo sapiens
tgttttaaaaagaaacaaga

SEQ ID NO: 1772276 - DNA, 21 bp, Homo sapiens
tgttttaaactctcctagtca

SEQ ID NO: 1772277 - DNA, 22 bp, Homo sapiens
tgttttaaagaatatgactttt

SEQ ID NO: 1772278 - DNA, 16 bp, Homo sapiens
tgttttaataacttat

SEQ ID NO: 1772279 - DNA, 18 bp, Homo sapiens
tgttttaattgtagttct

SEQ ID NO: 1772280 - DNA, 14 bp, Homo sapiens
tgttttaattttag

SEQ ID NO: 1772281 - DNA, 13 bp, Homo sapiens
tgttttacaatgt

SEQ ID NO: 1772282 - DNA, 19 bp, Homo sapiens
tgttttagagttaacaatg

SEQ ID NO: 1772283 - DNA, 13 bp, Homo sapiens
tgttttagcatta

SEQ ID NO: 1772284 - DNA, 16 bp, Homo sapiens
tgttttagcatttgta

SEQ ID NO: 1772285 - DNA, 17 bp, Homo sapiens
tgttttagcatttgtat

SEQ ID NO: 1772286 - DNA, 23 bp, Homo sapiens
tgttttagggagtggttcctgtg

SEQ ID NO: 1772287 - DNA, 20 bp, Homo sapiens
tgttttagtcattaatgtgt

SEQ ID NO: 1772288 - DNA, 17 bp, Homo sapiens
tgttttagtttctgaac

SEQ ID NO: 1772289 - DNA, 18 bp, Homo sapiens
tgttttagtttctgaact

SEQ ID NO: 1772290 - DNA, 22 bp, Homo sapiens
tgttttagtttctgaactctga

SEQ ID NO: 1772291 - DNA, 23 bp, Homo sapiens
tgttttatctagtcacataaatg

SEQ ID NO: 1772292 - DNA, 18 bp, Homo sapiens
tgttttatgtcatactct

SEQ ID NO: 1772293 - DNA, 21 bp, Homo sapiens
tgttttatgtcatactctgtg

SEQ ID NO: 1772294 - DNA, 14 bp, Homo sapiens
tgttttattcctgt

SEQ ID NO: 1772295 - DNA, 15 bp, Homo sapiens
tgttttattcctgta

SEQ ID NO: 1772296 - DNA, 21 bp, Homo sapiens
tgttttattgactgtctttcc

SEQ ID NO: 1772297 - DNA, 22 bp, Homo sapiens
tgttttattgactgtctttcct

SEQ ID NO: 1772298 - DNA, 16 bp, Homo sapiens
tgttttcaagtgtaaa

SEQ ID NO: 1772299 - DNA, 21 bp, Homo sapiens
tgttttcacttgtattgactt

SEQ ID NO: 1772300 - DNA, 19 bp, Homo sapiens
tgttttcattatctcaaaa

SEQ ID NO: 1772301 - DNA, 20 bp, Homo sapiens
tgttttctcagaacagctga

SEQ ID NO: 1772302 - DNA, 16 bp, Homo sapiens
tgttttctgactaatt

SEQ ID NO: 1772303 - DNA, 23 bp, Homo sapiens
tgttttctgagcccgggctgcct

SEQ ID NO: 1772304 - DNA, 20 bp, Homo sapiens
tgttttctggggaaagggga

SEQ ID NO: 1772305 - DNA, 17 bp, Homo sapiens
tgttttctgtaaataac

SEQ ID NO: 1772306 - DNA, 12 bp, Homo sapiens
tgttttcttcaa

SEQ ID NO: 1772307 - DNA, 11 bp, Homo sapiens
tgttttcttct

SEQ ID NO: 1772308 - DNA, 17 bp, Homo sapiens
tgttttcttgtaaatgt

SEQ ID NO: 1772309 - DNA, 17 bp, Homo sapiens
tgttttgaaactcagta

SEQ ID NO: 1772310 - DNA, 11 bp, Homo sapiens
tgttttgaaag

SEQ ID NO: 1772311 - DNA, 15 bp, Homo sapiens
tgttttgaaatgata

SEQ ID NO: 1772312 - DNA, 22 bp, Homo sapiens
tgttttgaatggtgttgtatgc

SEQ ID NO: 1772313 - DNA, 15 bp, Homo sapiens
tgttttgaattttgt

SEQ ID NO: 1772314 - DNA, 20 bp, Homo sapiens
tgttttgatgagaaaaaact

SEQ ID NO: 1772315 - DNA, 18 bp, Homo sapiens
tgttttgcacttctgtaa

SEQ ID NO: 1772316 - DNA, 14 bp, Homo sapiens
tgttttgcactttt

SEQ ID NO: 1772317 - DNA, 21 bp, Homo sapiens
tgttttggatttggagagaaa

SEQ ID NO: 1772318 - DNA, 18 bp, Homo sapiens
tgttttggctgaaattct

SEQ ID NO: 1772319 - DNA, 23 bp, Homo sapiens
tgttttggctgaaattctcctgg

SEQ ID NO: 1772320 - DNA, 17 bp, Homo sapiens
tgttttgggcctccatg

SEQ ID NO: 1772321 - DNA, 24 bp, Homo sapiens
tgttttggggctttcccaggagaa

SEQ ID NO: 1772322 - DNA, 21 bp, Homo sapiens
tgttttgtacaattactaaat

SEQ ID NO: 1772323 - DNA, 13 bp, Homo sapiens
tgttttgtataaa

SEQ ID NO: 1772324 - DNA, 19 bp, Homo sapiens
tgttttgtcagacttccaa

SEQ ID NO: 1772325 - DNA, 18 bp, Homo sapiens
tgttttgtcccatttcct

SEQ ID NO: 1772326 - DNA, 19 bp, Homo sapiens
tgttttgtggtttggaata

SEQ ID NO: 1772327 - DNA, 16 bp, Homo sapiens
tgttttgtgtctggtg

SEQ ID NO: 1772328 - DNA, 16 bp, Homo sapiens
tgttttgttgtttgat

SEQ ID NO: 1772329 - DNA, 15 bp, Homo sapiens
tgtttttaagctgtt

SEQ ID NO: 1772330 - DNA, 17 bp, Homo sapiens
tgtttttaagctgtttc

SEQ ID NO: 1772331 - DNA, 13 bp, Homo sapiens
tgtttttaatgct

SEQ ID NO: 1772332 - DNA, 20 bp, Homo sapiens
tgtttttagagcttccaaat

SEQ ID NO: 1772333 - DNA, 18 bp, Homo sapiens
tgtttttattaatttata

SEQ ID NO: 1772334 - DNA, 13 bp, Homo sapiens
tgtttttcacatt

SEQ ID NO: 1772335 - DNA, 20 bp, Homo sapiens
tgtttttcatgttttagcat

SEQ ID NO: 1772336 - DNA, 19 bp, Homo sapiens
tgtttttctttttccacaa

SEQ ID NO: 1772337 - DNA, 13 bp, Homo sapiens
tgtttttgaattt

SEQ ID NO: 1772338 - DNA, 18 bp, Homo sapiens
tgtttttgcatgaaattg

SEQ ID NO: 1772339 - DNA, 13 bp, Homo sapiens
tgtttttgtaaag

SEQ ID NO: 1772340 - DNA, 14 bp, Homo sapiens
tgtttttgtaaaga

SEQ ID NO: 1772341 - DNA, 13 bp, Homo sapiens
tgtttttgtatct

SEQ ID NO: 1772342 - DNA, 12 bp, Homo sapiens
tgttttttaaga

SEQ ID NO: 1772343 - DNA, 16 bp, Homo sapiens
tgttttttaagatagt

SEQ ID NO: 1772344 - DNA, 21 bp, Homo sapiens
tgttttttaatttaaaaaaag

SEQ ID NO: 1772345 - DNA, 13 bp, Homo sapiens
tgttttttagaac

SEQ ID NO: 1772346 - DNA, 13 bp, Homo sapiens
tgttttttccttt

SEQ ID NO: 1772347 - DNA, 14 bp, Homo sapiens
tgttttttccttta

SEQ ID NO: 1772348 - DNA, 11 bp, Homo sapiens
tgttttttgta

SEQ ID NO: 1772349 - DNA, 21 bp, Homo sapiens
tgttttttgtaactacaaagc

SEQ ID NO: 1772350 - DNA, 19 bp, Homo sapiens
tgtttttttaactgcattt

SEQ ID NO: 1772351 - DNA, 20 bp, Homo sapiens
tgtttttttcctcatgtaac

SEQ ID NO: 1772352 - DNA, 18 bp, Homo sapiens
tgttttttttttccactt

SEQ ID NO: 1772353 - DNA, 16 bp, Homo sapiens
tgtttttttttttaag

SEQ ID NO: 1772354 - DNA, 18 bp, Homo sapiens
tgtttttttttttttaag

SEQ ID NO: 1772355 - DNA, 15 bp, Homo sapiens
ttaaaaaaaaaaaca

SEQ ID NO: 1772356 - DNA, 16 bp, Homo sapiens
ttaaaaaaaaaagtca

SEQ ID NO: 1772357 - DNA, 16 bp, Homo sapiens
ttaaaaaaaaacacaa

SEQ ID NO: 1772358 - DNA, 16 bp, Homo sapiens
ttaaaaaaaaattgta

SEQ ID NO: 1772359 - DNA, 13 bp, Homo sapiens
ttaaaaaaaagaa

SEQ ID NO: 1772360 - DNA, 13 bp, Homo sapiens
ttaaaaaaactgg

SEQ ID NO: 1772361 - DNA, 19 bp, Homo sapiens
ttaaaaaaataacatctga

SEQ ID NO: 1772362 - DNA, 22 bp, Homo sapiens
ttaaaaaaataacatctgaaaa

SEQ ID NO: 1772363 - DNA, 18 bp, Homo sapiens
ttaaaaaaatcaaaacaa

SEQ ID NO: 1772364 - DNA, 19 bp, Homo sapiens
ttaaaaaaatttttgcaaa

SEQ ID NO: 1772365 - DNA, 20 bp, Homo sapiens
ttaaaaaaatttttgcaaat

SEQ ID NO: 1772366 - DNA, 23 bp, Homo sapiens
ttaaaaaactctttggtgcacaa

SEQ ID NO: 1772367 - DNA, 22 bp, Homo sapiens
ttaaaaaagactgaacatgttt

SEQ ID NO: 1772368 - DNA, 19 bp, Homo sapiens
ttaaaaaataacatattct

SEQ ID NO: 1772369 - DNA, 15 bp, Homo sapiens
ttaaaaaataataca

SEQ ID NO: 1772370 - DNA, 16 bp, Homo sapiens
ttaaaaaatttttgaa

SEQ ID NO: 1772371 - DNA, 18 bp, Homo sapiens
ttaaaaacaaatgagttt

SEQ ID NO: 1772372 - DNA, 19 bp, Homo sapiens
ttaaaaacataacataaat

SEQ ID NO: 1772373 - DNA, 19 bp, Homo sapiens
ttaaaaacctgcctaaatt

SEQ ID NO: 1772374 - DNA, 16 bp, Homo sapiens
ttaaaaactcacttac

SEQ ID NO: 1772375 - DNA, 19 bp, Homo sapiens
ttaaaaactgacttaatgc

SEQ ID NO: 1772376 - DNA, 17 bp, Homo sapiens
ttaaaaagaaatccagt

SEQ ID NO: 1772377 - DNA, 13 bp, Homo sapiens
ttaaaaagccagt

SEQ ID NO: 1772378 - DNA, 12 bp, Homo sapiens
ttaaaaaggcca

SEQ ID NO: 1772379 - DNA, 23 bp, Homo sapiens
ttaaaaagggcagggcatctcct

SEQ ID NO: 1772380 - DNA, 11 bp, Homo sapiens
ttaaaaataaa

SEQ ID NO: 1772381 - DNA, 14 bp, Homo sapiens
ttaaaaatatttca

SEQ ID NO: 1772382 - DNA, 22 bp, Homo sapiens
ttaatgaatattgatgttaaca

SEQ ID NO: 1772383 - DNA, 20 bp, Homo sapiens
ttaatgactttatgtattat

SEQ ID NO: 1772384 - DNA, 24 bp, Homo sapiens
ttaatgagccatcactagaagaaa

SEQ ID NO: 1772385 - DNA, 22 bp, Homo sapiens
ttaatgagtgcacctgcctcca

SEQ ID NO: 1772386 - DNA, 22 bp, Homo sapiens
ttaatgataaactcagatctga

SEQ ID NO: 1772387 - DNA, 21 bp, Homo sapiens
ttaatgatctcggatgaccaa

SEQ ID NO: 1772388 - DNA, 21 bp, Homo sapiens
ttaatgcctgctttttggaaa

SEQ ID NO: 1772389 - DNA, 18 bp, Homo sapiens
ttaatgcctttaaagtat

SEQ ID NO: 1772390 - DNA, 16 bp, Homo sapiens
ttaatgctatttgaac

SEQ ID NO: 1772391 - DNA, 20 bp, Homo sapiens
ttaatgctatttgaacaagt

SEQ ID NO: 1772392 - DNA, 17 bp, Homo sapiens
ttaatgctgccttttct

SEQ ID NO: 1772393 - DNA, 21 bp, Homo sapiens
ttaatgctgtttctaagaaaa

SEQ ID NO: 1772394 - DNA, 14 bp, Homo sapiens
ttaatgcttcattc

SEQ ID NO: 1772395 - DNA, 15 bp, Homo sapiens
ttaatgcttcattca

SEQ ID NO: 1772396 - DNA, 20 bp, Homo sapiens
ttaatggaagtgtatttatt

SEQ ID NO: 1772397 - DNA, 19 bp, Homo sapiens
ttaatggacatgagataat

SEQ ID NO: 1772398 - DNA, 22 bp, Homo sapiens
ttaatggacatgagataatgtt

SEQ ID NO: 1772399 - DNA, 14 bp, Homo sapiens
ttaatggcactgat

SEQ ID NO: 1772400 - DNA, 18 bp, Homo sapiens
ttaatgtaaaattcatag

SEQ ID NO: 1772401 - DNA, 15 bp, Homo sapiens
ttaatgtatctattt

SEQ ID NO: 1772402 - DNA, 16 bp, Homo sapiens
ttaatgtatctatttg

SEQ ID NO: 1772403 - DNA, 22 bp, Homo sapiens
ttaatgtatctatttgtacaat

SEQ ID NO: 1772404 - DNA, 23 bp, Homo sapiens
ttaatgtatctatttgtacaatt

SEQ ID NO: 1772405 - DNA, 13 bp, Homo sapiens
ttaatgtatgtta

SEQ ID NO: 1772406 - DNA, 20 bp, Homo sapiens
ttaatgtcattgctaaaaaa

SEQ ID NO: 1772407 - DNA, 18 bp, Homo sapiens
ttaatgtctcctttgctc

SEQ ID NO: 1772408 - DNA, 23 bp, Homo sapiens
ttaatgtctcctttgctcttgcc

SEQ ID NO: 1772409 - DNA, 23 bp, Homo sapiens
ttaatgttctgaataatttctta

SEQ ID NO: 1772410 - DNA, 19 bp, Homo sapiens
ttaatgttgaatgctgctt

SEQ ID NO: 1772411 - DNA, 14 bp, Homo sapiens
ttaatgttttcaaa

SEQ ID NO: 1772412 - DNA, 13 bp, Homo sapiens
ttaatgttttgta

SEQ ID NO: 1772413 - DNA, 20 bp, Homo sapiens
ttaattaatgaaatatctgt

SEQ ID NO: 1772414 - DNA, 13 bp, Homo sapiens
ttaattacaccat

SEQ ID NO: 1772415 - DNA, 15 bp, Homo sapiens
ttaattactgctata

SEQ ID NO: 1772416 - DNA, 20 bp, Homo sapiens
ttaattagttccagtttctc

SEQ ID NO: 1772417 - DNA, 23 bp, Homo sapiens
ttaattataggagccttaatttt

SEQ ID NO: 1772418 - DNA, 17 bp, Homo sapiens
ttaattattattcttca

SEQ ID NO: 1772419 - DNA, 14 bp, Homo sapiens
ttaattattatttg

SEQ ID NO: 1772420 - DNA, 16 bp, Homo sapiens
ttaattcaccaaagta

SEQ ID NO: 1772421 - DNA, 23 bp, Homo sapiens
ttaattcagtctcagctgctgaa

SEQ ID NO: 1772422 - DNA, 15 bp, Homo sapiens
ttaattcatgaggag

SEQ ID NO: 1772423 - DNA, 15 bp, Homo sapiens
ttaattcatgtttct

SEQ ID NO: 1772424 - DNA, 17 bp, Homo sapiens
ttaattccaattatatg

SEQ ID NO: 1772425 - DNA, 23 bp, Homo sapiens
ttaattccatattgatgaagatg

SEQ ID NO: 1772426 - DNA, 17 bp, Homo sapiens
ttaattctctttcaaag

SEQ ID NO: 1772427 - DNA, 15 bp, Homo sapiens
ttaattctttgttct

SEQ ID NO: 1772428 - DNA, 22 bp, Homo sapiens
ttaattgattattctgattcca

SEQ ID NO: 1772429 - DNA, 19 bp, Homo sapiens
ttaattgtagttctgtgta

SEQ ID NO: 1772430 - DNA, 12 bp, Homo sapiens
ttaattgtataa

SEQ ID NO: 1772431 - DNA, 12 bp, Homo sapiens
ttaatttaaact

SEQ ID NO: 1772432 - DNA, 15 bp, Homo sapiens
ttaatttatttagtt

SEQ ID NO: 1772433 - DNA, 14 bp, Homo sapiens
ttaatttcaggaaa

SEQ ID NO: 1772434 - DNA, 15 bp, Homo sapiens
ttaatttcaggaaaa

SEQ ID NO: 1772435 - DNA, 21 bp, Homo sapiens
ttaatttccaggaaaaaataa

SEQ ID NO: 1772436 - DNA, 13 bp, Homo sapiens
ttaatttcctttt

SEQ ID NO: 1772437 - DNA, 19 bp, Homo sapiens
ttaattttagagaaacttt

SEQ ID NO: 1772438 - DNA, 17 bp, Homo sapiens
ttaattttagtttttca

SEQ ID NO: 1772439 - DNA, 17 bp, Homo sapiens
ttaattttattcaagaa

SEQ ID NO: 1772440 - DNA, 13 bp, Homo sapiens
ttaattttcctgg

SEQ ID NO: 1772441 - DNA, 14 bp, Homo sapiens
ttaattttctatgt

SEQ ID NO: 1772442 - DNA, 20 bp, Homo sapiens
ttaattttgaagtgctgttt

SEQ ID NO: 1772443 - DNA, 22 bp, Homo sapiens
ttaattttgacactatatctgt

SEQ ID NO: 1772444 - DNA, 21 bp, Homo sapiens
ttaattttgatatacattgtg

SEQ ID NO: 1772445 - DNA, 17 bp, Homo sapiens
ttaattttgctaactgg

SEQ ID NO: 1772446 - DNA, 15 bp, Homo sapiens
ttaattttgtgcatt

SEQ ID NO: 1772447 - DNA, 15 bp, Homo sapiens
ttaatttttaaatgc

SEQ ID NO: 1772448 - DNA, 16 bp, Homo sapiens
ttaatttttaaatgca

SEQ ID NO: 1772449 - DNA, 13 bp, Homo sapiens
ttaatttttccta

SEQ ID NO: 1772450 - DNA, 17 bp, Homo sapiens
ttaattttttttaatgt

SEQ ID NO: 1772451 - DNA, 14 bp, Homo sapiens
ttacaaaagatgta

SEQ ID NO: 1772452 - DNA, 18 bp, Homo sapiens
ttacaaaagatgtatcct

SEQ ID NO: 1772453 - DNA, 21 bp, Homo sapiens
ttacaaaaggctcgtttggat

SEQ ID NO: 1772454 - DNA, 14 bp, Homo sapiens
ttacaaaatgccaa

SEQ ID NO: 1772455 - DNA, 17 bp, Homo sapiens
ttacaaaatgccaaggg

SEQ ID NO: 1772456 - DNA, 12 bp, Homo sapiens
ttacaaactgca

SEQ ID NO: 1772457 - DNA, 21 bp, Homo sapiens
ttacaaactgcaatagagact

SEQ ID NO: 1772458 - DNA, 16 bp, Homo sapiens
ttacaaagcagttact

SEQ ID NO: 1772459 - DNA, 16 bp, Homo sapiens
ttacaaatcagaagtc

SEQ ID NO: 1772460 - DNA, 17 bp, Homo sapiens
ttacaaatcagaagtca

SEQ ID NO: 1772461 - DNA, 23 bp, Homo sapiens
ttacaaattataatgtattcata

SEQ ID NO: 1772462 - DNA, 20 bp, Homo sapiens
ttacaacagtagagagggaa

SEQ ID NO: 1772463 - DNA, 18 bp, Homo sapiens
ttacaacatttatgtgag

SEQ ID NO: 1772464 - DNA, 19 bp, Homo sapiens
ttacaacggagtcaaaaat

SEQ ID NO: 1772465 - DNA, 15 bp, Homo sapiens
ttacaagatattatt

SEQ ID NO: 1772466 - DNA, 16 bp, Homo sapiens
ttacaaggcaatggaa

SEQ ID NO: 1772467 - DNA, 17 bp, Homo sapiens
ttacaaggcaatggaaa

SEQ ID NO: 1772468 - DNA, 17 bp, Homo sapiens
ttacaagtgttcttagg

SEQ ID NO: 1772469 - DNA, 21 bp, Homo sapiens
ttacaataaaactttgctgcc

SEQ ID NO: 1772470 - DNA, 17 bp, Homo sapiens
ttacaataaagtttaca

SEQ ID NO: 1772471 - DNA, 19 bp, Homo sapiens
ttacaataaatattctgca

SEQ ID NO: 1772472 - DNA, 12 bp, Homo sapiens
ttacaatagaat

SEQ ID NO: 1772473 - DNA, 20 bp, Homo sapiens
ttacaataggtgcttattct

SEQ ID NO: 1772474 - DNA, 15 bp, Homo sapiens
ttacaattgaaatga

SEQ ID NO: 1772475 - DNA, 17 bp, Homo sapiens
ttacaattgaaatgact

SEQ ID NO: 1772476 - DNA, 19 bp, Homo sapiens
ttacaattgttacagtact

SEQ ID NO: 1772477 - DNA, 14 bp, Homo sapiens
ttacaattttctgt

SEQ ID NO: 1772478 - DNA, 17 bp, Homo sapiens
ttacaattttctgtaag

SEQ ID NO: 1772479 - DNA, 18 bp, Homo sapiens
ttacaattttttatcatg

SEQ ID NO: 1772480 - DNA, 20 bp, Homo sapiens
ttacaattttttatcatgca

SEQ ID NO: 1772481 - DNA, 21 bp, Homo sapiens
ttacacaaagaacttgctgct

SEQ ID NO: 1772482 - DNA, 22 bp, Homo sapiens
ttacacaaagaacttgctgctg

SEQ ID NO: 1772483 - DNA, 23 bp, Homo sapiens
ttacacaaagaacttgctgctgc

SEQ ID NO: 1772484 - DNA, 13 bp, Homo sapiens
ttacacagaaaca

SEQ ID NO: 1772485 - DNA, 20 bp, Homo sapiens
ttacacagaaacactgcctt

SEQ ID NO: 1772486 - DNA, 20 bp, Homo sapiens
ttacacagaaatgctgctgg

SEQ ID NO: 1772487 - DNA, 23 bp, Homo sapiens
ttacacagaaatgctgctggcca

SEQ ID NO: 1772488 - DNA, 17 bp, Homo sapiens
ttacacagcccaagagg

SEQ ID NO: 1772489 - DNA, 16 bp, Homo sapiens
ttacaccaactcctaa

SEQ ID NO: 1772490 - DNA, 17 bp, Homo sapiens
ttacacgtatctcttgg

SEQ ID NO: 1772491 - DNA, 19 bp, Homo sapiens
ttacactgcggaagccaaa

SEQ ID NO: 1772492 - DNA, 22 bp, Homo sapiens
ttacactgcggaagccaaaggc

SEQ ID NO: 1772493 - DNA, 18 bp, Homo sapiens
ttacactggtctaatgtt

SEQ ID NO: 1772494 - DNA, 13 bp, Homo sapiens
ttacactttatgc

SEQ ID NO: 1772495 - DNA, 23 bp, Homo sapiens
ttacactttatgccggatgtgct

SEQ ID NO: 1772496 - DNA, 22 bp, Homo sapiens
ttactgaataatatcaaataaa

SEQ ID NO: 1772497 - DNA, 12 bp, Homo sapiens
ttactgaccagc

SEQ ID NO: 1772498 - DNA, 20 bp, Homo sapiens
ttactgacctcacctaggaa

SEQ ID NO: 1772499 - DNA, 14 bp, Homo sapiens
ttactgagcttctc

SEQ ID NO: 1772500 - DNA, 18 bp, Homo sapiens
ttactgagcttctctgtg

SEQ ID NO: 1772501 - DNA, 14 bp, Homo sapiens
ttactgatatattt

SEQ ID NO: 1772502 - DNA, 20 bp, Homo sapiens
ttactgatgtgatattctgt

SEQ ID NO: 1772503 - DNA, 13 bp, Homo sapiens
ttactgattattt

SEQ ID NO: 1772504 - DNA, 18 bp, Homo sapiens
ttactgcactcagattta

SEQ ID NO: 1772505 - DNA, 21 bp, Homo sapiens
ttactgccaaagggaaatatc

SEQ ID NO: 1772506 - DNA, 13 bp, Homo sapiens
ttactgcgtagaa

SEQ ID NO: 1772507 - DNA, 17 bp, Homo sapiens
ttactgctaagtatttc

SEQ ID NO: 1772508 - DNA, 22 bp, Homo sapiens
ttactgctaagtatttcccagc

SEQ ID NO: 1772509 - DNA, 23 bp, Homo sapiens
ttactgctaagtatttcccagca

SEQ ID NO: 1772510 - DNA, 20 bp, Homo sapiens
ttactgctgattcttgtaaa

SEQ ID NO: 1772511 - DNA, 19 bp, Homo sapiens
ttactgctttaatcagaaa

SEQ ID NO: 1772512 - DNA, 13 bp, Homo sapiens
ttactgcttttca

SEQ ID NO: 1772513 - DNA, 22 bp, Homo sapiens
ttactggtaaagcctcatttga

SEQ ID NO: 1772514 - DNA, 15 bp, Homo sapiens
ttactggtttcccca

SEQ ID NO: 1772515 - DNA, 15 bp, Homo sapiens
ttactgtaaaatgca

SEQ ID NO: 1772516 - DNA, 11 bp, Homo sapiens
ttactgtaaat

SEQ ID NO: 1772517 - DNA, 12 bp, Homo sapiens
ttactgtaaatt

SEQ ID NO: 1772518 - DNA, 13 bp, Homo sapiens
ttactgtacctgt

SEQ ID NO: 1772519 - DNA, 20 bp, Homo sapiens
ttactgtcaataaacagctt

SEQ ID NO: 1772520 - DNA, 19 bp, Homo sapiens
ttactgtccccttgatata

SEQ ID NO: 1772521 - DNA, 15 bp, Homo sapiens
ttactgtcttgaatt

SEQ ID NO: 1772522 - DNA, 14 bp, Homo sapiens
ttactgtctttatt

SEQ ID NO: 1772523 - DNA, 14 bp, Homo sapiens
ttactgtgaagaga

SEQ ID NO: 1772524 - DNA, 14 bp, Homo sapiens
ttactgtgttttat

SEQ ID NO: 1772525 - DNA, 16 bp, Homo sapiens
ttactgttatttaatt

SEQ ID NO: 1772526 - DNA, 12 bp, Homo sapiens
ttactgttgaac

SEQ ID NO: 1772527 - DNA, 22 bp, Homo sapiens
ttactgttgaacttagaactat

SEQ ID NO: 1772528 - DNA, 19 bp, Homo sapiens
ttactgttgcatttacttt

SEQ ID NO: 1772529 - DNA, 20 bp, Homo sapiens
ttactgttttaattgtagtt

SEQ ID NO: 1772530 - DNA, 23 bp, Homo sapiens
ttactgttttgaaatcaatgcaa

SEQ ID NO: 1772531 - DNA, 19 bp, Homo sapiens
ttactgttttgccaagaat

SEQ ID NO: 1772532 - DNA, 14 bp, Homo sapiens
ttacttaaagattt

SEQ ID NO: 1772533 - DNA, 22 bp, Homo sapiens
ttacttaattcagtctcagctg

SEQ ID NO: 1772534 - DNA, 15 bp, Homo sapiens
ttacttagaggaaat

SEQ ID NO: 1772535 - DNA, 19 bp, Homo sapiens
ttacttaggttattttgct

SEQ ID NO: 1772536 - DNA, 23 bp, Homo sapiens
ttacttatcatccacattgtttt

SEQ ID NO: 1772537 - DNA, 13 bp, Homo sapiens
ttacttcttctct

SEQ ID NO: 1772538 - DNA, 23 bp, Homo sapiens
ttacttgccaagcagtgcacatt

SEQ ID NO: 1772539 - DNA, 13 bp, Homo sapiens
ttacttgcttctc

SEQ ID NO: 1772540 - DNA, 14 bp, Homo sapiens
ttacttgcttctct

SEQ ID NO: 1772541 - DNA, 19 bp, Homo sapiens
ttacttgtggtgtgaccat

SEQ ID NO: 1772542 - DNA, 12 bp, Homo sapiens
ttactttagtta

SEQ ID NO: 1772543 - DNA, 15 bp, Homo sapiens
ttactttatgtttgt

SEQ ID NO: 1772544 - DNA, 13 bp, Homo sapiens
ttactttgctgag

SEQ ID NO: 1772545 - DNA, 17 bp, Homo sapiens
ttacttttaaacagtga

SEQ ID NO: 1772546 - DNA, 14 bp, Homo sapiens
ttacttttaaactg

SEQ ID NO: 1772547 - DNA, 15 bp, Homo sapiens
ttacttttaaactgt

SEQ ID NO: 1772548 - DNA, 16 bp, Homo sapiens
ttacttttcacactgt

SEQ ID NO: 1772549 - DNA, 21 bp, Homo sapiens
ttacttttcacactgtcttcc

SEQ ID NO: 1772550 - DNA, 14 bp, Homo sapiens
ttactttttcccat

SEQ ID NO: 1772551 - DNA, 17 bp, Homo sapiens
ttactttttcccatctg

SEQ ID NO: 1772552 - DNA, 13 bp, Homo sapiens
ttagaaaagtgaa

SEQ ID NO: 1772553 - DNA, 20 bp, Homo sapiens
ttagaaaatgacttatttct

SEQ ID NO: 1772554 - DNA, 16 bp, Homo sapiens
ttagaaaattttgtaa

SEQ ID NO: 1772555 - DNA, 17 bp, Homo sapiens
ttagaaaattttgtaaa

SEQ ID NO: 1772556 - DNA, 21 bp, Homo sapiens
ttagaaaattttgtaaaacaa

SEQ ID NO: 1772557 - DNA, 13 bp, Homo sapiens
ttagaaaggacaa

SEQ ID NO: 1772558 - DNA, 22 bp, Homo sapiens
ttagaaaggacaacagttctga

SEQ ID NO: 1772559 - DNA, 21 bp, Homo sapiens
ttagaaagtagccacgtatgg

SEQ ID NO: 1772560 - DNA, 19 bp, Homo sapiens
ttagaaataaatgtacctg

SEQ ID NO: 1772561 - DNA, 13 bp, Homo sapiens
ttagaaatagaca

SEQ ID NO: 1772562 - DNA, 12 bp, Homo sapiens
ttagaaatataa

SEQ ID NO: 1772563 - DNA, 19 bp, Homo sapiens
ttagaaatattcacatctt

SEQ ID NO: 1772564 - DNA, 22 bp, Homo sapiens
ttagaaatattttaaaatcagc

SEQ ID NO: 1772565 - DNA, 19 bp, Homo sapiens
ttagaaatcattgtagaaa

SEQ ID NO: 1772566 - DNA, 16 bp, Homo sapiens
ttagaaatgcagaatc

SEQ ID NO: 1772567 - DNA, 15 bp, Homo sapiens
ttagaaatgtgaaga

SEQ ID NO: 1772568 - DNA, 22 bp, Homo sapiens
ttagaaatgtgaagaggtctga

SEQ ID NO: 1772569 - DNA, 19 bp, Homo sapiens
ttagaaattacctgtggat

SEQ ID NO: 1772570 - DNA, 20 bp, Homo sapiens
ttagaacactggtttaaagg

SEQ ID NO: 1772571 - DNA, 23 bp, Homo sapiens
ttagaactctagagagccttaac

SEQ ID NO: 1772572 - DNA, 15 bp, Homo sapiens
ttagaagaagtgtgt

SEQ ID NO: 1772573 - DNA, 16 bp, Homo sapiens
ttagaagaagtgtgtc

SEQ ID NO: 1772574 - DNA, 16 bp, Homo sapiens
ttagaataaggaggag

SEQ ID NO: 1772575 - DNA, 17 bp, Homo sapiens
ttagaatcaaatactca

SEQ ID NO: 1772576 - DNA, 17 bp, Homo sapiens
ttagaatctagaaatgt

SEQ ID NO: 1772577 - DNA, 14 bp, Homo sapiens
ttagaatgaattta

SEQ ID NO: 1772578 - DNA, 15 bp, Homo sapiens
ttagaatggaggaag

SEQ ID NO: 1772579 - DNA, 16 bp, Homo sapiens
ttagaattatttaaac

SEQ ID NO: 1772580 - DNA, 15 bp, Homo sapiens
ttagaattgctggat

SEQ ID NO: 1772581 - DNA, 14 bp, Homo sapiens
ttagacaactagat

SEQ ID NO: 1772582 - DNA, 18 bp, Homo sapiens
ttagacaactagatttgt

SEQ ID NO: 1772583 - DNA, 13 bp, Homo sapiens
ttagaccctgggt

SEQ ID NO: 1772584 - DNA, 12 bp, Homo sapiens
ttagacctcagc

SEQ ID NO: 1772585 - DNA, 13 bp, Homo sapiens
ttagacctcagcc

SEQ ID NO: 1772586 - DNA, 15 bp, Homo sapiens
ttagacctcagcctg

SEQ ID NO: 1772587 - DNA, 14 bp, Homo sapiens
ttagactacattta

SEQ ID NO: 1772588 - DNA, 18 bp, Homo sapiens
ttagactacatttagaga

SEQ ID NO: 1772589 - DNA, 21 bp, Homo sapiens
ttagactcatcaatcaaataa

SEQ ID NO: 1772590 - DNA, 23 bp, Homo sapiens
ttagacttcccactgttctgaaa

SEQ ID NO: 1772591 - DNA, 18 bp, Homo sapiens
ttagactttagaaataaa

SEQ ID NO: 1772592 - DNA, 21 bp, Homo sapiens
ttagacttttccaatatgtga

SEQ ID NO: 1772593 - DNA, 15 bp, Homo sapiens
ttagagaaactttga

SEQ ID NO: 1772594 - DNA, 14 bp, Homo sapiens
ttagagaagctgaa

SEQ ID NO: 1772595 - DNA, 15 bp, Homo sapiens
ttagagaagctgaaa

SEQ ID NO: 1772596 - DNA, 16 bp, Homo sapiens
ttagagaagctgaaag

SEQ ID NO: 1772597 - DNA, 18 bp, Homo sapiens
ttagagaatgtgtttcaa

SEQ ID NO: 1772598 - DNA, 20 bp, Homo sapiens
ttagagagcctgtcaccaga

SEQ ID NO: 1772599 - DNA, 15 bp, Homo sapiens
ttagagattttacaa

SEQ ID NO: 1772600 - DNA, 22 bp, Homo sapiens
ttagagattttacaaaatgctg

SEQ ID NO: 1772601 - DNA, 13 bp, Homo sapiens
ttagagctgcata

SEQ ID NO: 1772602 - DNA, 14 bp, Homo sapiens
ttagagctgcataa

SEQ ID NO: 1772603 - DNA, 15 bp, Homo sapiens
ttagagcttccaaat

SEQ ID NO: 1772604 - DNA, 18 bp, Homo sapiens
ttagaggaaaaaaatgac

SEQ ID NO: 1772605 - DNA, 19 bp, Homo sapiens
ttagaggaaaaaaatgact

SEQ ID NO: 1772606 - DNA, 15 bp, Homo sapiens
ttagaggaaaatgag

SEQ ID NO: 1772607 - DNA, 20 bp, Homo sapiens
ttagaggcattgttagttta

SEQ ID NO: 1772608 - DNA, 17 bp, Homo sapiens
ttagagtatttcccttc

SEQ ID NO: 1772609 - DNA, 19 bp, Homo sapiens
ttagagtatttcccttcca

SEQ ID NO: 1772610 - DNA, 23 bp, Homo sapiens
ttagagtatttcccttccaaaga

SEQ ID NO: 1772611 - DNA, 15 bp, Homo sapiens
ttagtgggcaggtgg

SEQ ID NO: 1772612 - DNA, 13 bp, Homo sapiens
ttagtgtattaat

SEQ ID NO: 1772613 - DNA, 12 bp, Homo sapiens
ttagtgtctgac

SEQ ID NO: 1772614 - DNA, 14 bp, Homo sapiens
ttagtgtctgacct

SEQ ID NO: 1772615 - DNA, 15 bp, Homo sapiens
ttagtgtctgaccta

SEQ ID NO: 1772616 - DNA, 16 bp, Homo sapiens
ttagtgtctgacctaa

SEQ ID NO: 1772617 - DNA, 21 bp, Homo sapiens
ttagtgtgacagtttccaaat

SEQ ID NO: 1772618 - DNA, 22 bp, Homo sapiens
ttagtgtgacagtttccaaatt

SEQ ID NO: 1772619 - DNA, 14 bp, Homo sapiens
ttagtgtgtgtgca

SEQ ID NO: 1772620 - DNA, 17 bp, Homo sapiens
ttagtgtgtgtgcagag

SEQ ID NO: 1772621 - DNA, 19 bp, Homo sapiens
ttagtgtgtgtgcatgtgt

SEQ ID NO: 1772622 - DNA, 21 bp, Homo sapiens
ttagtgtgtgtgcatgtgtgt

SEQ ID NO: 1772623 - DNA, 16 bp, Homo sapiens
ttagtgttaaaaatct

SEQ ID NO: 1772624 - DNA, 16 bp, Homo sapiens
ttagttaccttatagt

SEQ ID NO: 1772625 - DNA, 20 bp, Homo sapiens
ttagttaccttatagttact

SEQ ID NO: 1772626 - DNA, 20 bp, Homo sapiens
ttagttccagtttctccttg

SEQ ID NO: 1772627 - DNA, 16 bp, Homo sapiens
ttagttctttttgcca

SEQ ID NO: 1772628 - DNA, 19 bp, Homo sapiens
ttagttgacaacctagaat

SEQ ID NO: 1772629 - DNA, 22 bp, Homo sapiens
ttagttgacaacctagaatgtc

SEQ ID NO: 1772630 - DNA, 18 bp, Homo sapiens
ttagttgcactaactgct

SEQ ID NO: 1772631 - DNA, 13 bp, Homo sapiens
ttagtttaaaatg

SEQ ID NO: 1772632 - DNA, 13 bp, Homo sapiens
ttagtttagtgtg

SEQ ID NO: 1772633 - DNA, 20 bp, Homo sapiens
ttagtttcaagagtctaaac

SEQ ID NO: 1772634 - DNA, 14 bp, Homo sapiens
ttagtttctgaact

SEQ ID NO: 1772635 - DNA, 16 bp, Homo sapiens
ttagtttgtgtgttgt

SEQ ID NO: 1772636 - DNA, 17 bp, Homo sapiens
ttagtttttgtaattta

SEQ ID NO: 1772637 - DNA, 18 bp, Homo sapiens
ttagtttttgtaatttat

SEQ ID NO: 1772638 - DNA, 19 bp, Homo sapiens
ttagtttttgtaatttatt

SEQ ID NO: 1772639 - DNA, 19 bp, Homo sapiens
ttagttttttttttttaca

SEQ ID NO: 1772640 - DNA, 15 bp, Homo sapiens
ttataaaaaatggtt

SEQ ID NO: 1772641 - DNA, 17 bp, Homo sapiens
ttataaaaaatggttca

SEQ ID NO: 1772642 - DNA, 13 bp, Homo sapiens
ttataaaaaatgt

SEQ ID NO: 1772643 - DNA, 17 bp, Homo sapiens
ttataaaaaatgtaaca

SEQ ID NO: 1772644 - DNA, 18 bp, Homo sapiens
ttataaaaaatgtaacat

SEQ ID NO: 1772645 - DNA, 12 bp, Homo sapiens
ttataaaagtgt

SEQ ID NO: 1772646 - DNA, 18 bp, Homo sapiens
ttataaaataacttgcat

SEQ ID NO: 1772647 - DNA, 18 bp, Homo sapiens
ttataaaatataaacaaa

SEQ ID NO: 1772648 - DNA, 20 bp, Homo sapiens
ttataaacaagaatgaaggt

SEQ ID NO: 1772649 - DNA, 19 bp, Homo sapiens
ttataaaccacttgagcct

SEQ ID NO: 1772650 - DNA, 19 bp, Homo sapiens
ttataaactataaacttaa

SEQ ID NO: 1772651 - DNA, 13 bp, Homo sapiens
ttataaagcatgt

SEQ ID NO: 1772652 - DNA, 19 bp, Homo sapiens
ttataaagtctaagcaaga

SEQ ID NO: 1772653 - DNA, 13 bp, Homo sapiens
ttataacagttat

SEQ ID NO: 1772654 - DNA, 21 bp, Homo sapiens
ttataacctggcaaaatcttg

SEQ ID NO: 1772655 - DNA, 13 bp, Homo sapiens
ttataacttaaaa

SEQ ID NO: 1772656 - DNA, 15 bp, Homo sapiens
ttataacttaaaaaa

SEQ ID NO: 1772657 - DNA, 16 bp, Homo sapiens
ttataagaaaaacttt

SEQ ID NO: 1772658 - DNA, 18 bp, Homo sapiens
ttataagtagcaggccaa

SEQ ID NO: 1772659 - DNA, 17 bp, Homo sapiens
ttataagtgaagtgata

SEQ ID NO: 1772660 - DNA, 20 bp, Homo sapiens
ttataagtgactttaaactt

SEQ ID NO: 1772661 - DNA, 22 bp, Homo sapiens
ttataataggtatatagaacac

SEQ ID NO: 1772662 - DNA, 18 bp, Homo sapiens
ttataatatgtgccttaa

SEQ ID NO: 1772663 - DNA, 21 bp, Homo sapiens
ttataatatgtgccttaagtt

SEQ ID NO: 1772664 - DNA, 20 bp, Homo sapiens
ttataatctcaaaggagaaa

SEQ ID NO: 1772665 - DNA, 20 bp, Homo sapiens
ttataatcttccatacttct

SEQ ID NO: 1772666 - DNA, 14 bp, Homo sapiens
ttataatgaatgac

SEQ ID NO: 1772667 - DNA, 19 bp, Homo sapiens
ttataatgtattcatattt

SEQ ID NO: 1772668 - DNA, 14 bp, Homo sapiens
ttataattggctta

SEQ ID NO: 1772669 - DNA, 14 bp, Homo sapiens
ttataattgtaatg

SEQ ID NO: 1772670 - DNA, 20 bp, Homo sapiens
ttataattttttttaaaata

SEQ ID NO: 1772671 - DNA, 18 bp, Homo sapiens
ttatacaatggaataaat

SEQ ID NO: 1772672 - DNA, 20 bp, Homo sapiens
ttatacactgtgtaaatacc

SEQ ID NO: 1772673 - DNA, 20 bp, Homo sapiens
ttatacagatagagttccat

SEQ ID NO: 1772674 - DNA, 21 bp, Homo sapiens
ttatacagctgtattgtctga

SEQ ID NO: 1772675 - DNA, 22 bp, Homo sapiens
ttatacaggtcatattaatata

SEQ ID NO: 1772676 - DNA, 19 bp, Homo sapiens
ttatacagtgtacatgtac

SEQ ID NO: 1772677 - DNA, 18 bp, Homo sapiens
ttatacccagaaagttat

SEQ ID NO: 1772678 - DNA, 19 bp, Homo sapiens
ttatacccagaaagttatt

SEQ ID NO: 1772679 - DNA, 21 bp, Homo sapiens
ttatacctgtgtattttttaa

SEQ ID NO: 1772680 - DNA, 12 bp, Homo sapiens
ttatacctgttt

SEQ ID NO: 1772681 - DNA, 15 bp, Homo sapiens
ttatacctgtttaaa

SEQ ID NO: 1772682 - DNA, 19 bp, Homo sapiens
ttatactcttcctattttt

SEQ ID NO: 1772683 - DNA, 19 bp, Homo sapiens
ttatactgcacagtggcac

SEQ ID NO: 1772684 - DNA, 22 bp, Homo sapiens
ttatactgtacttaataaattc

SEQ ID NO: 1772685 - DNA, 13 bp, Homo sapiens
ttatactttattg

SEQ ID NO: 1772686 - DNA, 21 bp, Homo sapiens
ttatactttgcaatccaaata

SEQ ID NO: 1772687 - DNA, 14 bp, Homo sapiens
ttatacttttgctt

SEQ ID NO: 1772688 - DNA, 18 bp, Homo sapiens
ttatagaaaacctgactt

SEQ ID NO: 1772689 - DNA, 19 bp, Homo sapiens
ttatagaataaaagctata

SEQ ID NO: 1772690 - DNA, 14 bp, Homo sapiens
ttatagaatacttt

SEQ ID NO: 1772691 - DNA, 21 bp, Homo sapiens
ttatagacaaaagaataagac

SEQ ID NO: 1772692 - DNA, 22 bp, Homo sapiens
ttatagacaaaagaataagaca

SEQ ID NO: 1772693 - DNA, 15 bp, Homo sapiens
ttatagacaaataat

SEQ ID NO: 1772694 - DNA, 21 bp, Homo sapiens
ttatagacgtttggactgatt

SEQ ID NO: 1772695 - DNA, 22 bp, Homo sapiens
ttatagagcagaaattctgttt

SEQ ID NO: 1772696 - DNA, 19 bp, Homo sapiens
ttatagatatataaataat

SEQ ID NO: 1772697 - DNA, 15 bp, Homo sapiens
ttatagatgtctagg

SEQ ID NO: 1772698 - DNA, 13 bp, Homo sapiens
ttatagattctaa

SEQ ID NO: 1772699 - DNA, 14 bp, Homo sapiens
ttatagattctaaa

SEQ ID NO: 1772700 - DNA, 16 bp, Homo sapiens
ttatagattctaaaga

SEQ ID NO: 1772701 - DNA, 21 bp, Homo sapiens
ttatagattctaaagattcta

SEQ ID NO: 1772702 - DNA, 19 bp, Homo sapiens
ttatagcaactaatgtttg

SEQ ID NO: 1772703 - DNA, 20 bp, Homo sapiens
ttatagcctggactgctacc

SEQ ID NO: 1772704 - DNA, 16 bp, Homo sapiens
ttatagcttaactaat

SEQ ID NO: 1772705 - DNA, 16 bp, Homo sapiens
ttataggatcatttgt

SEQ ID NO: 1772706 - DNA, 17 bp, Homo sapiens
ttataggtcactcctgg

SEQ ID NO: 1772707 - DNA, 18 bp, Homo sapiens
ttataggtgagaaaaaaa

SEQ ID NO: 1772708 - DNA, 13 bp, Homo sapiens
ttataggttttat

SEQ ID NO: 1772709 - DNA, 21 bp, Homo sapiens
ttatagtgaatactgctacag

SEQ ID NO: 1772710 - DNA, 13 bp, Homo sapiens
ttatagttactgt

SEQ ID NO: 1772711 - DNA, 14 bp, Homo sapiens
ttatagttactgtg

SEQ ID NO: 1772712 - DNA, 15 bp, Homo sapiens
ttatagttactgtgt

SEQ ID NO: 1772713 - DNA, 13 bp, Homo sapiens
ttatagtttctga

SEQ ID NO: 1772714 - DNA, 18 bp, Homo sapiens
ttatataactgtatttga

SEQ ID NO: 1772715 - DNA, 19 bp, Homo sapiens
ttatatacctggcttttac

SEQ ID NO: 1772716 - DNA, 23 bp, Homo sapiens
ttatatacctggcttttacttta

SEQ ID NO: 1772717 - DNA, 17 bp, Homo sapiens
ttatatactgctattta

SEQ ID NO: 1772718 - DNA, 14 bp, Homo sapiens
ttatatataataaa

SEQ ID NO: 1772719 - DNA, 15 bp, Homo sapiens
ttatatatatatgta

SEQ ID NO: 1772720 - DNA, 18 bp, Homo sapiens
ttatatatatatgtatat

SEQ ID NO: 1772721 - DNA, 23 bp, Homo sapiens
ttatatatattgttaaatccttt

SEQ ID NO: 1772722 - DNA, 17 bp, Homo sapiens
ttatatatgtatttata

SEQ ID NO: 1772723 - DNA, 15 bp, Homo sapiens
ttatatatttataac

SEQ ID NO: 1772724 - DNA, 12 bp, Homo sapiens
ttatatatttct

SEQ ID NO: 1772725 - DNA, 19 bp, Homo sapiens
ttatatcagtcctctttca

SEQ ID NO: 1772726 - DNA, 22 bp, Homo sapiens
ttattgtaagcatctcaatctt

SEQ ID NO: 1772727 - DNA, 18 bp, Homo sapiens
ttattgtacagactgttt

SEQ ID NO: 1772728 - DNA, 14 bp, Homo sapiens
ttattgtacctctc

SEQ ID NO: 1772729 - DNA, 15 bp, Homo sapiens
ttattgtacctctct

SEQ ID NO: 1772730 - DNA, 14 bp, Homo sapiens
ttattgtatttatg

SEQ ID NO: 1772731 - DNA, 16 bp, Homo sapiens
ttattgtctgtctaca

SEQ ID NO: 1772732 - DNA, 19 bp, Homo sapiens
ttattgtgacttcactgta

SEQ ID NO: 1772733 - DNA, 20 bp, Homo sapiens
ttattgtgacttcactgtat

SEQ ID NO: 1772734 - DNA, 21 bp, Homo sapiens
ttattgttcccctaagtggat

SEQ ID NO: 1772735 - DNA, 15 bp, Homo sapiens
ttatttaaaagattc

SEQ ID NO: 1772736 - DNA, 20 bp, Homo sapiens
ttatttaaactctgttgcaa

SEQ ID NO: 1772737 - DNA, 16 bp, Homo sapiens
ttatttaaatgtttaa

SEQ ID NO: 1772738 - DNA, 19 bp, Homo sapiens
ttatttaaatgtttaacat

SEQ ID NO: 1772739 - DNA, 14 bp, Homo sapiens
ttatttaaggatgg

SEQ ID NO: 1772740 - DNA, 16 bp, Homo sapiens
ttatttaaggatggat

SEQ ID NO: 1772741 - DNA, 17 bp, Homo sapiens
ttatttaaggatggatg

SEQ ID NO: 1772742 - DNA, 22 bp, Homo sapiens
ttatttaatgaaagactgtaca

SEQ ID NO: 1772743 - DNA, 17 bp, Homo sapiens
ttatttactaattttct

SEQ ID NO: 1772744 - DNA, 21 bp, Homo sapiens
ttatttactcctcctgctcct

SEQ ID NO: 1772745 - DNA, 17 bp, Homo sapiens
ttatttactgagcttct

SEQ ID NO: 1772746 - DNA, 21 bp, Homo sapiens
ttatttactgagcttctctgt

SEQ ID NO: 1772747 - DNA, 16 bp, Homo sapiens
ttatttagacaagaga

SEQ ID NO: 1772748 - DNA, 20 bp, Homo sapiens
ttatttagttgaaaaatcta

SEQ ID NO: 1772749 - DNA, 15 bp, Homo sapiens
ttatttatatgtact

SEQ ID NO: 1772750 - DNA, 21 bp, Homo sapiens
ttatttatcaatttttcccag

SEQ ID NO: 1772751 - DNA, 22 bp, Homo sapiens
ttatttatccagaaaactgtga

SEQ ID NO: 1772752 - DNA, 23 bp, Homo sapiens
ttatttatccagaaaactgtgat

SEQ ID NO: 1772753 - DNA, 13 bp, Homo sapiens
ttatttatgtact

SEQ ID NO: 1772754 - DNA, 16 bp, Homo sapiens
ttatttatgtactttt

SEQ ID NO: 1772755 - DNA, 12 bp, Homo sapiens
ttatttatttct

SEQ ID NO: 1772756 - DNA, 23 bp, Homo sapiens
ttatttcaaaatatacattcaaa

SEQ ID NO: 1772757 - DNA, 20 bp, Homo sapiens
ttatttcactttagatgctg

SEQ ID NO: 1772758 - DNA, 19 bp, Homo sapiens
ttatttccactattttcaa

SEQ ID NO: 1772759 - DNA, 13 bp, Homo sapiens
ttatttccccagc

SEQ ID NO: 1772760 - DNA, 17 bp, Homo sapiens
ttatttcctttgtcctt

SEQ ID NO: 1772761 - DNA, 12 bp, Homo sapiens
ttatttctagca

SEQ ID NO: 1772762 - DNA, 23 bp, Homo sapiens
ttatttcttcccagaatctctga

SEQ ID NO: 1772763 - DNA, 21 bp, Homo sapiens
ttatttcttccctgctttgca

SEQ ID NO: 1772764 - DNA, 14 bp, Homo sapiens
ttatttcttcgtga

SEQ ID NO: 1772765 - DNA, 15 bp, Homo sapiens
ttatttgcagagaca

SEQ ID NO: 1772766 - DNA, 13 bp, Homo sapiens
ttatttgcatgtg

SEQ ID NO: 1772767 - DNA, 18 bp, Homo sapiens
ttatttggaaccttgttt

SEQ ID NO: 1772768 - DNA, 21 bp, Homo sapiens
ttatttggagcctgccaagag

SEQ ID NO: 1772769 - DNA, 21 bp, Homo sapiens
ttatttgggggggcgtgagac

SEQ ID NO: 1772770 - DNA, 15 bp, Homo sapiens
ttatttgtaaagtga

SEQ ID NO: 1772771 - DNA, 11 bp, Homo sapiens
ttatttgtatt

SEQ ID NO: 1772772 - DNA, 15 bp, Homo sapiens
ttatttgtctgtaaa

SEQ ID NO: 1772773 - DNA, 14 bp, Homo sapiens
ttattttaaaatat

SEQ ID NO: 1772774 - DNA, 21 bp, Homo sapiens
ttattttaaatataaatagct

SEQ ID NO: 1772775 - DNA, 13 bp, Homo sapiens
ttattttcaagag

SEQ ID NO: 1772776 - DNA, 12 bp, Homo sapiens
ttattttctaca

SEQ ID NO: 1772777 - DNA, 14 bp, Homo sapiens
ttattttgccagtt

SEQ ID NO: 1772778 - DNA, 16 bp, Homo sapiens
ttattttgctgagttg

SEQ ID NO: 1772779 - DNA, 18 bp, Homo sapiens
ttattttgctttggttaa

SEQ ID NO: 1772780 - DNA, 15 bp, Homo sapiens
ttattttggaactat

SEQ ID NO: 1772781 - DNA, 17 bp, Homo sapiens
ttattttggaactatga

SEQ ID NO: 1772782 - DNA, 21 bp, Homo sapiens
ttattttggagattataataa

SEQ ID NO: 1772783 - DNA, 18 bp, Homo sapiens
ttattttggtacttttat

SEQ ID NO: 1772784 - DNA, 14 bp, Homo sapiens
ttattttgttcata

SEQ ID NO: 1772785 - DNA, 20 bp, Homo sapiens
ttatttttatatcagcctga

SEQ ID NO: 1772786 - DNA, 22 bp, Homo sapiens
ttatttttctaaggttctcata

SEQ ID NO: 1772787 - DNA, 16 bp, Homo sapiens
ttatttttctgtgggt

SEQ ID NO: 1772788 - DNA, 22 bp, Homo sapiens
ttatttttcttaccaattgtga

SEQ ID NO: 1772789 - DNA, 23 bp, Homo sapiens
ttatttttggcgtggctgactta

SEQ ID NO: 1772790 - DNA, 14 bp, Homo sapiens
ttatttttgtacat

SEQ ID NO: 1772791 - DNA, 21 bp, Homo sapiens
ttatttttgttagcaaagatt

SEQ ID NO: 1772792 - DNA, 14 bp, Homo sapiens
ttattttttaatta

SEQ ID NO: 1772793 - DNA, 21 bp, Homo sapiens
ttattttttggacttcaaagc

SEQ ID NO: 1772794 - DNA, 14 bp, Homo sapiens
ttcaaaaaaacact

SEQ ID NO: 1772795 - DNA, 15 bp, Homo sapiens
ttcaaaaaaatctat

SEQ ID NO: 1772796 - DNA, 20 bp, Homo sapiens
ttcaaaaaccagccaggcag

SEQ ID NO: 1772797 - DNA, 22 bp, Homo sapiens
ttcaaaacctgcagttaacagg

SEQ ID NO: 1772798 - DNA, 14 bp, Homo sapiens
ttcaaaagttccaa

SEQ ID NO: 1772799 - DNA, 16 bp, Homo sapiens
ttcaaaagttgaaatt

SEQ ID NO: 1772800 - DNA, 21 bp, Homo sapiens
ttcaaaataagtatttctgat

SEQ ID NO: 1772801 - DNA, 15 bp, Homo sapiens
ttcaaaatagttcta

SEQ ID NO: 1772802 - DNA, 20 bp, Homo sapiens
ttcaaaatgttctatttaac

SEQ ID NO: 1772803 - DNA, 14 bp, Homo sapiens
ttcaaacacaaatg

SEQ ID NO: 1772804 - DNA, 15 bp, Homo sapiens
ttcaaacacaaatgc

SEQ ID NO: 1772805 - DNA, 17 bp, Homo sapiens
ttcaaacacaaatgcag

SEQ ID NO: 1772806 - DNA, 20 bp, Homo sapiens
ttcaaacagtatataacttt

SEQ ID NO: 1772807 - DNA, 16 bp, Homo sapiens
ttcaaactgaatttgt

SEQ ID NO: 1772808 - DNA, 21 bp, Homo sapiens
ttcaaactgaatttgttctta

SEQ ID NO: 1772809 - DNA, 17 bp, Homo sapiens
ttcaaacttactatttt

SEQ ID NO: 1772810 - DNA, 18 bp, Homo sapiens
ttcaaagaggtgaacatt

SEQ ID NO: 1772811 - DNA, 13 bp, Homo sapiens
ttcaaagatgctg

SEQ ID NO: 1772812 - DNA, 17 bp, Homo sapiens
ttcaaagattcaaaatt

SEQ ID NO: 1772813 - DNA, 13 bp, Homo sapiens
ttcaaagccacat

SEQ ID NO: 1772814 - DNA, 21 bp, Homo sapiens
ttcaaagccctgcctctgtgt

SEQ ID NO: 1772815 - DNA, 12 bp, Homo sapiens
ttcaaagctgag

SEQ ID NO: 1772816 - DNA, 16 bp, Homo sapiens
ttcaaagcttgaagat

SEQ ID NO: 1772817 - DNA, 16 bp, Homo sapiens
ttcaaagttttgttgt

SEQ ID NO: 1772818 - DNA, 19 bp, Homo sapiens
ttcaaatagggtctaactc

SEQ ID NO: 1772819 - DNA, 13 bp, Homo sapiens
ttcaaatcagtga

SEQ ID NO: 1772820 - DNA, 22 bp, Homo sapiens
ttcaaatcagtgatctatgttt

SEQ ID NO: 1772821 - DNA, 15 bp, Homo sapiens
ttcaaattgctgctt

SEQ ID NO: 1772822 - DNA, 13 bp, Homo sapiens
ttcaaatttgtgt

SEQ ID NO: 1772823 - DNA, 23 bp, Homo sapiens
ttcaacagaccccctctagaaat

SEQ ID NO: 1772824 - DNA, 16 bp, Homo sapiens
ttcaaccataaaagaa

SEQ ID NO: 1772825 - DNA, 15 bp, Homo sapiens
ttcaaccattcccca

SEQ ID NO: 1772826 - DNA, 23 bp, Homo sapiens
ttcaacctctagaattttaagcc

SEQ ID NO: 1772827 - DNA, 14 bp, Homo sapiens
ttcaacgcagccct

SEQ ID NO: 1772828 - DNA, 13 bp, Homo sapiens
ttcaactgctttg

SEQ ID NO: 1772829 - DNA, 15 bp, Homo sapiens
ttcaactgtcttcct

SEQ ID NO: 1772830 - DNA, 12 bp, Homo sapiens
ttcaacttttct

SEQ ID NO: 1772831 - DNA, 22 bp, Homo sapiens
ttcaagaaaacaacttcaatat

SEQ ID NO: 1772832 - DNA, 13 bp, Homo sapiens
ttcaagaaactga

SEQ ID NO: 1772833 - DNA, 20 bp, Homo sapiens
ttcaagaaactgaggaattt

SEQ ID NO: 1772834 - DNA, 23 bp, Homo sapiens
ttcaagaaactgaggaattttct

SEQ ID NO: 1772835 - DNA, 17 bp, Homo sapiens
ttcaagaatgaaaaata

SEQ ID NO: 1772836 - DNA, 18 bp, Homo sapiens
ttcaagaatgaaaaatat

SEQ ID NO: 1772837 - DNA, 15 bp, Homo sapiens
ttcaagaccagcctg

SEQ ID NO: 1772838 - DNA, 18 bp, Homo sapiens
ttcaagaccttctcccca

SEQ ID NO: 1772839 - DNA, 13 bp, Homo sapiens
ttcaagattctaa

SEQ ID NO: 1772840 - DNA, 22 bp, Homo sapiens
ttcaagcagtcgtgcctgtgtc

SEQ ID NO: 1772841 - DNA, 14 bp, Homo sapiens
ttcaagcccaggct

SEQ ID NO: 1772842 - DNA, 19 bp, Homo sapiens
ttcaagcccaggcttcctg

SEQ ID NO: 1772843 - DNA, 14 bp, Homo sapiens
ttcaagcctgtggg

SEQ ID NO: 1772844 - DNA, 20 bp, Homo sapiens
ttcaagcctgtgggagtaga

SEQ ID NO: 1772845 - DNA, 18 bp, Homo sapiens
ttcaagcgattctcctgc

SEQ ID NO: 1772846 - DNA, 22 bp, Homo sapiens
ttcaagctattctcatgcctca

SEQ ID NO: 1772847 - DNA, 14 bp, Homo sapiens
ttcaagctatttaa

SEQ ID NO: 1772848 - DNA, 23 bp, Homo sapiens
ttcaagctgttatttcttccctg

SEQ ID NO: 1772849 - DNA, 16 bp, Homo sapiens
ttcaaggaatttctta

SEQ ID NO: 1772850 - DNA, 17 bp, Homo sapiens
ttcaaggaatttcttaa

SEQ ID NO: 1772851 - DNA, 19 bp, Homo sapiens
ttcaaggaatttcttaact

SEQ ID NO: 1772852 - DNA, 16 bp, Homo sapiens
ttcaaggactgtttca

SEQ ID NO: 1772853 - DNA, 22 bp, Homo sapiens
ttcaaggactgtttcagtgtga

SEQ ID NO: 1772854 - DNA, 10 bp, Homo sapiens
ttcaaggcct

SEQ ID NO: 1772855 - DNA, 13 bp, Homo sapiens
ttcaaggccttca

SEQ ID NO: 1772856 - DNA, 15 bp, Homo sapiens
ttcaaggccttcagt

SEQ ID NO: 1772857 - DNA, 17 bp, Homo sapiens
ttcaaggctcagaagga

SEQ ID NO: 1772858 - DNA, 16 bp, Homo sapiens
ttcaaggcttccactg

SEQ ID NO: 1772859 - DNA, 21 bp, Homo sapiens
ttcaagggaagaaacactctt

SEQ ID NO: 1772860 - DNA, 15 bp, Homo sapiens
ttcaaggttctaacc

SEQ ID NO: 1772861 - DNA, 14 bp, Homo sapiens
ttcaagtatttaag

SEQ ID NO: 1772862 - DNA, 15 bp, Homo sapiens
ttcaagtatttaagc

SEQ ID NO: 1772863 - DNA, 13 bp, Homo sapiens
ttcaagtgccttt

SEQ ID NO: 1772864 - DNA, 17 bp, Homo sapiens
ttcaagtgttttggtgt

SEQ ID NO: 1772865 - DNA, 16 bp, Homo sapiens
ttcaagttagctcagg

SEQ ID NO: 1772866 - DNA, 17 bp, Homo sapiens
ttcaagttattcaaatt

SEQ ID NO: 1772867 - DNA, 15 bp, Homo sapiens
ttcaagttttaaagt

SEQ ID NO: 1772868 - DNA, 18 bp, Homo sapiens
ttcaagttttaaagttca

SEQ ID NO: 1772869 - DNA, 21 bp, Homo sapiens
ttcaataaaaaaaagaaatga

SEQ ID NO: 1772870 - DNA, 13 bp, Homo sapiens
ttcaataaatctt

SEQ ID NO: 1772871 - DNA, 18 bp, Homo sapiens
ttcaataaatgtctgttg

SEQ ID NO: 1772872 - DNA, 19 bp, Homo sapiens
ttcaataaatgtctgttga

SEQ ID NO: 1772873 - DNA, 16 bp, Homo sapiens
ttcaataataaatatt

SEQ ID NO: 1772874 - DNA, 17 bp, Homo sapiens
ttcaataccgctcagta

SEQ ID NO: 1772875 - DNA, 18 bp, Homo sapiens
ttcaataccgctcagtat

SEQ ID NO: 1772876 - DNA, 17 bp, Homo sapiens
ttcaatagcacatatgg

SEQ ID NO: 1772877 - DNA, 17 bp, Homo sapiens
ttcaatataagaagcaa

SEQ ID NO: 1772878 - DNA, 15 bp, Homo sapiens
ttcaatatattgaac

SEQ ID NO: 1772879 - DNA, 14 bp, Homo sapiens
ttcaatattgacat

SEQ ID NO: 1772880 - DNA, 17 bp, Homo sapiens
ttcaatattgacatttg

SEQ ID NO: 1772881 - DNA, 18 bp, Homo sapiens
ttcaatattgacatttgt

SEQ ID NO: 1772882 - DNA, 22 bp, Homo sapiens
ttcaatattgacatttgtagtt

SEQ ID NO: 1772883 - DNA, 18 bp, Homo sapiens
ttcaatatttagaaaatt

SEQ ID NO: 1772884 - DNA, 11 bp, Homo sapiens
ttcaatatttt

SEQ ID NO: 1772885 - DNA, 19 bp, Homo sapiens
ttcaatcactgtaacctga

SEQ ID NO: 1772886 - DNA, 22 bp, Homo sapiens
ttcaatcactgtaacctgattc

SEQ ID NO: 1772887 - DNA, 16 bp, Homo sapiens
ttcaatcatttattca

SEQ ID NO: 1772888 - DNA, 15 bp, Homo sapiens
ttcaatctctggaaa

SEQ ID NO: 1772889 - DNA, 17 bp, Homo sapiens
ttcaatctctgttctgc

SEQ ID NO: 1772890 - DNA, 18 bp, Homo sapiens
ttcaatctctgttctgct

SEQ ID NO: 1772891 - DNA, 15 bp, Homo sapiens
ttcaatctgtaaact

SEQ ID NO: 1772892 - DNA, 16 bp, Homo sapiens
ttcaatctgtaaactg

SEQ ID NO: 1772893 - DNA, 18 bp, Homo sapiens
ttcaatctgtaaactgtg

SEQ ID NO: 1772894 - DNA, 21 bp, Homo sapiens
ttcaatgaacttccatttgta

SEQ ID NO: 1772895 - DNA, 17 bp, Homo sapiens
ttcaatgggctcttcca

SEQ ID NO: 1772896 - DNA, 20 bp, Homo sapiens
ttcaatgtttttaaaaatct

SEQ ID NO: 1772897 - DNA, 18 bp, Homo sapiens
ttcaattagtggtcataa

SEQ ID NO: 1772898 - DNA, 12 bp, Homo sapiens
ttcaattcctct

SEQ ID NO: 1772899 - DNA, 16 bp, Homo sapiens
ttcaattcctggccct

SEQ ID NO: 1772900 - DNA, 13 bp, Homo sapiens
ttcaattcctggg

SEQ ID NO: 1772901 - DNA, 16 bp, Homo sapiens
ttcaattcctgggccc

SEQ ID NO: 1772902 - DNA, 19 bp, Homo sapiens
ttcaattggtggaattcct

SEQ ID NO: 1772903 - DNA, 14 bp, Homo sapiens
ttcaattttaaaga

SEQ ID NO: 1772904 - DNA, 15 bp, Homo sapiens
ttcacaaactgtgaa

SEQ ID NO: 1772905 - DNA, 21 bp, Homo sapiens
ttcacaaactgtgaaaatagt

SEQ ID NO: 1772906 - DNA, 18 bp, Homo sapiens
ttcacaaggtaccccaaa

SEQ ID NO: 1772907 - DNA, 18 bp, Homo sapiens
ttcacaatgtgaaactga

SEQ ID NO: 1772908 - DNA, 19 bp, Homo sapiens
ttcacaatgtgaaactgaa

SEQ ID NO: 1772909 - DNA, 20 bp, Homo sapiens
ttcacaatgtgaaactgaag

SEQ ID NO: 1772910 - DNA, 13 bp, Homo sapiens
ttcacaatgtggc

SEQ ID NO: 1772911 - DNA, 23 bp, Homo sapiens
ttcacacactcacaatttaaaat

SEQ ID NO: 1772912 - DNA, 23 bp, Homo sapiens
ttcacacatctgggtgccctgaa

SEQ ID NO: 1772913 - DNA, 17 bp, Homo sapiens
ttcacactgtcttcccg

SEQ ID NO: 1772914 - DNA, 19 bp, Homo sapiens
ttcacacttccaccagcct

SEQ ID NO: 1772915 - DNA, 18 bp, Homo sapiens
ttcacagaaaaagcatga

SEQ ID NO: 1772916 - DNA, 13 bp, Homo sapiens
ttcacagaaaata

SEQ ID NO: 1772917 - DNA, 14 bp, Homo sapiens
ttcacagactgatt

SEQ ID NO: 1772918 - DNA, 18 bp, Homo sapiens
ttcacagagcacgcctgc

SEQ ID NO: 1772919 - DNA, 23 bp, Homo sapiens
ttcacagagtgtgctgctatttt

SEQ ID NO: 1772920 - DNA, 15 bp, Homo sapiens
ttcacagctcctccc

SEQ ID NO: 1772921 - DNA, 17 bp, Homo sapiens
ttcacagctcctcccac

SEQ ID NO: 1772922 - DNA, 18 bp, Homo sapiens
ttcacaggcagtgcatgt

SEQ ID NO: 1772923 - DNA, 19 bp, Homo sapiens
ttcacagtacccaaactgc

SEQ ID NO: 1772924 - DNA, 17 bp, Homo sapiens
ttcacagtagagccagc

SEQ ID NO: 1772925 - DNA, 18 bp, Homo sapiens
ttcacagtagagccagct

SEQ ID NO: 1772926 - DNA, 22 bp, Homo sapiens
ttcacagtgtttcgacagctga

SEQ ID NO: 1772927 - DNA, 20 bp, Homo sapiens
ttcacagttctttgggccag

SEQ ID NO: 1772928 - DNA, 18 bp, Homo sapiens
ttcacataagctcagaat

SEQ ID NO: 1772929 - DNA, 18 bp, Homo sapiens
ttcacatagctgtctaga

SEQ ID NO: 1772930 - DNA, 21 bp, Homo sapiens
ttcacatatctagtatgaaat

SEQ ID NO: 1772931 - DNA, 18 bp, Homo sapiens
ttcacatcctgtgtttct

SEQ ID NO: 1772932 - DNA, 20 bp, Homo sapiens
ttcacatctctggaaattta

SEQ ID NO: 1772933 - DNA, 19 bp, Homo sapiens
ttcacattgtttgctgcta

SEQ ID NO: 1772934 - DNA, 20 bp, Homo sapiens
ttcacattgtttgctgctat

SEQ ID NO: 1772935 - DNA, 14 bp, Homo sapiens
ttcacatttagaaa

SEQ ID NO: 1772936 - DNA, 13 bp, Homo sapiens
ttcaccaaaatta

SEQ ID NO: 1772937 - DNA, 14 bp, Homo sapiens
ttcaccagaagtta

SEQ ID NO: 1772938 - DNA, 15 bp, Homo sapiens
ttcaccagtctgtct

SEQ ID NO: 1772939 - DNA, 16 bp, Homo sapiens
ttcaccagtctgtcta

SEQ ID NO: 1772940 - DNA, 19 bp, Homo sapiens
ttcaccagtctgtctactg

SEQ ID NO: 1772941 - DNA, 22 bp, Homo sapiens
ttcaccagtctgtctactgtgg

SEQ ID NO: 1772942 - DNA, 19 bp, Homo sapiens
ttcaccatcaatcctgatt

SEQ ID NO: 1772943 - DNA, 17 bp, Homo sapiens
ttcaccatggccccctc

SEQ ID NO: 1772944 - DNA, 13 bp, Homo sapiens
ttcacccccaact

SEQ ID NO: 1772945 - DNA, 17 bp, Homo sapiens
ttcacccctccctttct

SEQ ID NO: 1772946 - DNA, 22 bp, Homo sapiens
ttcaccctgtccaaactgccta

SEQ ID NO: 1772947 - DNA, 22 bp, Homo sapiens
ttcacccttatagtctaagact

SEQ ID NO: 1772948 - DNA, 23 bp, Homo sapiens
ttcacctcggagggatggagaaa

SEQ ID NO: 1772949 - DNA, 14 bp, Homo sapiens
ttcacctcttcctc

SEQ ID NO: 1772950 - DNA, 15 bp, Homo sapiens
ttcacctcttcctct

SEQ ID NO: 1772951 - DNA, 13 bp, Homo sapiens
ttcacctgtaaac

SEQ ID NO: 1772952 - DNA, 16 bp, Homo sapiens
ttcacctgtgacaaag

SEQ ID NO: 1772953 - DNA, 16 bp, Homo sapiens
ttcacctgtgactcct

SEQ ID NO: 1772954 - DNA, 22 bp, Homo sapiens
ttcaccttgggatgatgcctca

SEQ ID NO: 1772955 - DNA, 15 bp, Homo sapiens
ttcacctttttaata

SEQ ID NO: 1772956 - DNA, 14 bp, Homo sapiens
ttcatgcaagtatt

SEQ ID NO: 1772957 - DNA, 14 bp, Homo sapiens
ttcatgcaatgaca

SEQ ID NO: 1772958 - DNA, 23 bp, Homo sapiens
ttcatgcagacaaagccctgtcc

SEQ ID NO: 1772959 - DNA, 13 bp, Homo sapiens
ttcatgcagctgt

SEQ ID NO: 1772960 - DNA, 19 bp, Homo sapiens
ttcatgcataggtttagca

SEQ ID NO: 1772961 - DNA, 21 bp, Homo sapiens
ttcatgccagctacttcctcc

SEQ ID NO: 1772962 - DNA, 18 bp, Homo sapiens
ttcatgccatctgttttc

SEQ ID NO: 1772963 - DNA, 23 bp, Homo sapiens
ttcatgcccttctgattcccctc

SEQ ID NO: 1772964 - DNA, 15 bp, Homo sapiens
ttcatgcctttgtaa

SEQ ID NO: 1772965 - DNA, 14 bp, Homo sapiens
ttcatgctacagaa

SEQ ID NO: 1772966 - DNA, 17 bp, Homo sapiens
ttcatgctatctctgtg

SEQ ID NO: 1772967 - DNA, 21 bp, Homo sapiens
ttcatggcatcttcaatatga

SEQ ID NO: 1772968 - DNA, 21 bp, Homo sapiens
ttcatggcctttgataaatgt

SEQ ID NO: 1772969 - DNA, 18 bp, Homo sapiens
ttcatggctgctgttgct

SEQ ID NO: 1772970 - DNA, 19 bp, Homo sapiens
ttcatggctgctgttgctt

SEQ ID NO: 1772971 - DNA, 13 bp, Homo sapiens
ttcatgtaatttt

SEQ ID NO: 1772972 - DNA, 20 bp, Homo sapiens
ttcatgtagaactcagcagt

SEQ ID NO: 1772973 - DNA, 22 bp, Homo sapiens
ttcatgtgttgcaaattattct

SEQ ID NO: 1772974 - DNA, 13 bp, Homo sapiens
ttcatgttagtta

SEQ ID NO: 1772975 - DNA, 18 bp, Homo sapiens
ttcatgttcactgtgagt

SEQ ID NO: 1772976 - DNA, 14 bp, Homo sapiens
ttcatgttcatgtg

SEQ ID NO: 1772977 - DNA, 13 bp, Homo sapiens
ttcatgtttctta

SEQ ID NO: 1772978 - DNA, 14 bp, Homo sapiens
ttcatgtttgcttc

SEQ ID NO: 1772979 - DNA, 15 bp, Homo sapiens
ttcatgtttgtaaat

SEQ ID NO: 1772980 - DNA, 18 bp, Homo sapiens
ttcatgtttgtaaattaa

SEQ ID NO: 1772981 - DNA, 13 bp, Homo sapiens
ttcattaaacttg

SEQ ID NO: 1772982 - DNA, 14 bp, Homo sapiens
ttcattaaacttga

SEQ ID NO: 1772983 - DNA, 15 bp, Homo sapiens
ttcattaaacttgaa

SEQ ID NO: 1772984 - DNA, 12 bp, Homo sapiens
ttcattaaataa

SEQ ID NO: 1772985 - DNA, 13 bp, Homo sapiens
ttcattacctttt

SEQ ID NO: 1772986 - DNA, 21 bp, Homo sapiens
ttcattaccttttttgataaa

SEQ ID NO: 1772987 - DNA, 20 bp, Homo sapiens
ttcattagaaatattttaaa

SEQ ID NO: 1772988 - DNA, 14 bp, Homo sapiens
ttcattatctcaaa

SEQ ID NO: 1772989 - DNA, 13 bp, Homo sapiens
ttcattcaagcta

SEQ ID NO: 1772990 - DNA, 14 bp, Homo sapiens
ttcattcaagctat

SEQ ID NO: 1772991 - DNA, 18 bp, Homo sapiens
ttcattcaatattgacat

SEQ ID NO: 1772992 - DNA, 12 bp, Homo sapiens
ttcattctcaga

SEQ ID NO: 1772993 - DNA, 20 bp, Homo sapiens
ttcattctcccgcttcctgg

SEQ ID NO: 1772994 - DNA, 22 bp, Homo sapiens
ttcattctcccgcttcctggcc

SEQ ID NO: 1772995 - DNA, 12 bp, Homo sapiens
ttcattctcctt

SEQ ID NO: 1772996 - DNA, 12 bp, Homo sapiens
ttcattctgcat

SEQ ID NO: 1772997 - DNA, 14 bp, Homo sapiens
ttcattctgcattg

SEQ ID NO: 1772998 - DNA, 13 bp, Homo sapiens
ttcattctggaaa

SEQ ID NO: 1772999 - DNA, 20 bp, Homo sapiens
ttcattgacctcatcattaa

SEQ ID NO: 1773000 - DNA, 16 bp, Homo sapiens
ttcattgactatcaaa

SEQ ID NO: 1773001 - DNA, 17 bp, Homo sapiens
ttcattgagagttttgt

SEQ ID NO: 1773002 - DNA, 16 bp, Homo sapiens
ttcattgcaattaaac

SEQ ID NO: 1773003 - DNA, 14 bp, Homo sapiens
ttcattgtaaatca

SEQ ID NO: 1773004 - DNA, 13 bp, Homo sapiens
ttcatttaaaatg

SEQ ID NO: 1773005 - DNA, 18 bp, Homo sapiens
ttcatttatctataattt

SEQ ID NO: 1773006 - DNA, 15 bp, Homo sapiens
ttcatttcaactgtt

SEQ ID NO: 1773007 - DNA, 15 bp, Homo sapiens
ttcatttcatttcag

SEQ ID NO: 1773008 - DNA, 14 bp, Homo sapiens
ttcatttccaccaa

SEQ ID NO: 1773009 - DNA, 14 bp, Homo sapiens
ttcatttcctgccc

SEQ ID NO: 1773010 - DNA, 14 bp, Homo sapiens
ttcatttctgcaga

SEQ ID NO: 1773011 - DNA, 18 bp, Homo sapiens
ttcatttgagaagtaaac

SEQ ID NO: 1773012 - DNA, 16 bp, Homo sapiens
ttcatttgatgctaaa

SEQ ID NO: 1773013 - DNA, 15 bp, Homo sapiens
ttcatttggtgctgg

SEQ ID NO: 1773014 - DNA, 20 bp, Homo sapiens
ttcatttggtgttcctggaa

SEQ ID NO: 1773015 - DNA, 12 bp, Homo sapiens
ttcatttgtaca

SEQ ID NO: 1773016 - DNA, 21 bp, Homo sapiens
ttcatttgtacaaggtaattg

SEQ ID NO: 1773017 - DNA, 22 bp, Homo sapiens
ttcatttgtacaaggtaattgt

SEQ ID NO: 1773018 - DNA, 11 bp, Homo sapiens
ttcatttgtat

SEQ ID NO: 1773019 - DNA, 13 bp, Homo sapiens
ttcatttgtattg

SEQ ID NO: 1773020 - DNA, 11 bp, Homo sapiens
ttcatttgtgg

SEQ ID NO: 1773021 - DNA, 15 bp, Homo sapiens
ttcatttgttttgct

SEQ ID NO: 1773022 - DNA, 15 bp, Homo sapiens
ttcattttcctgtgc

SEQ ID NO: 1773023 - DNA, 19 bp, Homo sapiens
ttcattttgagctgaaatg

SEQ ID NO: 1773024 - DNA, 19 bp, Homo sapiens
ttcattttgagtattttta

SEQ ID NO: 1773025 - DNA, 14 bp, Homo sapiens
ttcattttgcttta

SEQ ID NO: 1773026 - DNA, 21 bp, Homo sapiens
ttcattttgggccttgctaaa

SEQ ID NO: 1773027 - DNA, 16 bp, Homo sapiens
ttcattttggttttgt

SEQ ID NO: 1773028 - DNA, 20 bp, Homo sapiens
ttcattttgttttgctctga

SEQ ID NO: 1773029 - DNA, 18 bp, Homo sapiens
ttcatttttaatcatgaa

SEQ ID NO: 1773030 - DNA, 21 bp, Homo sapiens
ttcatttttgttatccttttt

SEQ ID NO: 1773031 - DNA, 19 bp, Homo sapiens
ttcatttttttctctctgg

SEQ ID NO: 1773032 - DNA, 19 bp, Homo sapiens
ttcatttttttttcaatca

SEQ ID NO: 1773033 - DNA, 18 bp, Homo sapiens
ttccaaaaaggttgctgt

SEQ ID NO: 1773034 - DNA, 14 bp, Homo sapiens
ttccaaaacaaaaa

SEQ ID NO: 1773035 - DNA, 22 bp, Homo sapiens
ttccaaaacatttctggacagt

SEQ ID NO: 1773036 - DNA, 17 bp, Homo sapiens
ttccaaaacctgcttcc

SEQ ID NO: 1773037 - DNA, 20 bp, Homo sapiens
ttccaaaacctgcttccttc

SEQ ID NO: 1773038 - DNA, 12 bp, Homo sapiens
ttccaaaataat

SEQ ID NO: 1773039 - DNA, 13 bp, Homo sapiens
ttccaaaataatt

SEQ ID NO: 1773040 - DNA, 18 bp, Homo sapiens
ttccaaaccctcctggga

SEQ ID NO: 1773041 - DNA, 16 bp, Homo sapiens
ttccaaacctggttca

SEQ ID NO: 1773042 - DNA, 17 bp, Homo sapiens
ttccaaacctggttcat

SEQ ID NO: 1773043 - DNA, 12 bp, Homo sapiens
ttccaaagaaag

SEQ ID NO: 1773044 - DNA, 14 bp, Homo sapiens
ttccaaagaaagtt

SEQ ID NO: 1773045 - DNA, 13 bp, Homo sapiens
ttccaaaggttcc

SEQ ID NO: 1773046 - DNA, 19 bp, Homo sapiens
ttccaaagtcacaggaaga

SEQ ID NO: 1773047 - DNA, 17 bp, Homo sapiens
ttccaaatgcaatttga

SEQ ID NO: 1773048 - DNA, 22 bp, Homo sapiens
ttccaaatgcagttcattgcag

SEQ ID NO: 1773049 - DNA, 19 bp, Homo sapiens
ttccaaatgtgtcagaata

SEQ ID NO: 1773050 - DNA, 23 bp, Homo sapiens
ttccaaattcacaagttgtgttt

SEQ ID NO: 1773051 - DNA, 12 bp, Homo sapiens
ttccaacaccac

SEQ ID NO: 1773052 - DNA, 18 bp, Homo sapiens
ttccaacaccacagacac

SEQ ID NO: 1773053 - DNA, 22 bp, Homo sapiens
ttccaacaccacagacacacac

SEQ ID NO: 1773054 - DNA, 15 bp, Homo sapiens
ttccaacatttctca

SEQ ID NO: 1773055 - DNA, 19 bp, Homo sapiens
ttccaaccatttatcttga

SEQ ID NO: 1773056 - DNA, 20 bp, Homo sapiens
ttccaaccatttatcttgaa

SEQ ID NO: 1773057 - DNA, 19 bp, Homo sapiens
ttccaacctcctgctctgg

SEQ ID NO: 1773058 - DNA, 20 bp, Homo sapiens
ttccaacctcctgctctggg

SEQ ID NO: 1773059 - DNA, 18 bp, Homo sapiens
ttccaactactaatagaa

SEQ ID NO: 1773060 - DNA, 22 bp, Homo sapiens
ttccaactgggcatttcaatcc

SEQ ID NO: 1773061 - DNA, 22 bp, Homo sapiens
ttccaactgtatatattcccaa

SEQ ID NO: 1773062 - DNA, 21 bp, Homo sapiens
ttccaagactctagagtccaa

SEQ ID NO: 1773063 - DNA, 14 bp, Homo sapiens
ttccaagaggctgt

SEQ ID NO: 1773064 - DNA, 15 bp, Homo sapiens
ttccaagaggctgta

SEQ ID NO: 1773065 - DNA, 13 bp, Homo sapiens
ttccaagagtcta

SEQ ID NO: 1773066 - DNA, 15 bp, Homo sapiens
ttccaagagtctaaa

SEQ ID NO: 1773067 - DNA, 17 bp, Homo sapiens
ttccaagagtctaaaga

SEQ ID NO: 1773068 - DNA, 13 bp, Homo sapiens
ttccaaggagacc

SEQ ID NO: 1773069 - DNA, 15 bp, Homo sapiens
ttccaagggtactaa

SEQ ID NO: 1773070 - DNA, 17 bp, Homo sapiens
ttccaagttgaagggaa

SEQ ID NO: 1773071 - DNA, 13 bp, Homo sapiens
ttccaatatgtga

SEQ ID NO: 1773072 - DNA, 14 bp, Homo sapiens
ttccaattctaaat

SEQ ID NO: 1773073 - DNA, 22 bp, Homo sapiens
ttccacaggtcatcagatgcct

SEQ ID NO: 1773074 - DNA, 13 bp, Homo sapiens
ttccacatttgtc

SEQ ID NO: 1773075 - DNA, 21 bp, Homo sapiens
ttccaccacagccagcacctg

SEQ ID NO: 1773076 - DNA, 12 bp, Homo sapiens
ttccaccagcct

SEQ ID NO: 1773077 - DNA, 14 bp, Homo sapiens
ttccacccattccc

SEQ ID NO: 1773078 - DNA, 20 bp, Homo sapiens
ttccaccccaagagaactcg

SEQ ID NO: 1773079 - DNA, 11 bp, Homo sapiens
ttccaccctgg

SEQ ID NO: 1773080 - DNA, 18 bp, Homo sapiens
ttccacctgtgccctcac

SEQ ID NO: 1773081 - DNA, 19 bp, Homo sapiens
ttccacctgtgccctcacc

SEQ ID NO: 1773082 - DNA, 19 bp, Homo sapiens
ttccacgatgaaaaacttc

SEQ ID NO: 1773083 - DNA, 17 bp, Homo sapiens
ttccactacacctggct

SEQ ID NO: 1773084 - DNA, 19 bp, Homo sapiens
ttccactacacctggctga

SEQ ID NO: 1773085 - DNA, 21 bp, Homo sapiens
ttccactatcccaatcaaaga

SEQ ID NO: 1773086 - DNA, 15 bp, Homo sapiens
ttccactattttcaa

SEQ ID NO: 1773087 - DNA, 18 bp, Homo sapiens
ttccactattttcaaaga

SEQ ID NO: 1773088 - DNA, 16 bp, Homo sapiens
ttccactccattgtcg

SEQ ID NO: 1773089 - DNA, 16 bp, Homo sapiens
ttccactgaaactctt

SEQ ID NO: 1773090 - DNA, 23 bp, Homo sapiens
ttccactgcctgggatgatgcag

SEQ ID NO: 1773091 - DNA, 15 bp, Homo sapiens
ttccacttgtgggct

SEQ ID NO: 1773092 - DNA, 18 bp, Homo sapiens
ttccacttgtgggcttca

SEQ ID NO: 1773093 - DNA, 19 bp, Homo sapiens
ttccacttgtttgcactgt

SEQ ID NO: 1773094 - DNA, 18 bp, Homo sapiens
ttccagaaaaccccagca

SEQ ID NO: 1773095 - DNA, 21 bp, Homo sapiens
ttccagaaaaccccagcatcc

SEQ ID NO: 1773096 - DNA, 23 bp, Homo sapiens
ttccagaaagcaggagcagctgt

SEQ ID NO: 1773097 - DNA, 15 bp, Homo sapiens
ttccagaaaggatat

SEQ ID NO: 1773098 - DNA, 20 bp, Homo sapiens
ttccagaacagccctcggcc

SEQ ID NO: 1773099 - DNA, 22 bp, Homo sapiens
ttccagaacagccctcggcctc

SEQ ID NO: 1773100 - DNA, 22 bp, Homo sapiens
ttccagaagaaagatggaaatt

SEQ ID NO: 1773101 - DNA, 23 bp, Homo sapiens
ttccagaagaagagaagctgctg

SEQ ID NO: 1773102 - DNA, 21 bp, Homo sapiens
ttccagaatcttgactttctg

SEQ ID NO: 1773103 - DNA, 22 bp, Homo sapiens
ttccagaccaataaatttgtaa

SEQ ID NO: 1773104 - DNA, 23 bp, Homo sapiens
ttccagaccaataaatttgtaac

SEQ ID NO: 1773105 - DNA, 18 bp, Homo sapiens
ttccagactcaggttcca

SEQ ID NO: 1773106 - DNA, 23 bp, Homo sapiens
ttccagactcaggttccagaaca

SEQ ID NO: 1773107 - DNA, 20 bp, Homo sapiens
ttccagacttccttgagaca

SEQ ID NO: 1773108 - DNA, 19 bp, Homo sapiens
ttccagagagtggctcctc

SEQ ID NO: 1773109 - DNA, 16 bp, Homo sapiens
ttccagagtgctgagg

SEQ ID NO: 1773110 - DNA, 22 bp, Homo sapiens
ttccagagttaaaatgtttact

SEQ ID NO: 1773111 - DNA, 17 bp, Homo sapiens
ttccagagtttgtcatt

SEQ ID NO: 1773112 - DNA, 16 bp, Homo sapiens
ttccagatctttcaga

SEQ ID NO: 1773113 - DNA, 19 bp, Homo sapiens
ttccagatggtcatccaga

SEQ ID NO: 1773114 - DNA, 14 bp, Homo sapiens
ttccagatgtggat

SEQ ID NO: 1773115 - DNA, 18 bp, Homo sapiens
ttccagcaagtacagaga

SEQ ID NO: 1773116 - DNA, 22 bp, Homo sapiens
ttccagcaattctcctgcctca

SEQ ID NO: 1773117 - DNA, 18 bp, Homo sapiens
ttccagctgccaagtgct

SEQ ID NO: 1773118 - DNA, 20 bp, Homo sapiens
ttccagctgctgtcttctgg

SEQ ID NO: 1773119 - DNA, 22 bp, Homo sapiens
ttccagctgctgtcttctggac

SEQ ID NO: 1773120 - DNA, 14 bp, Homo sapiens
ttccagcttgcatt

SEQ ID NO: 1773121 - DNA, 18 bp, Homo sapiens
ttccaggaaaaaataaaa

SEQ ID NO: 1773122 - DNA, 21 bp, Homo sapiens
ttccaggaaaaaataaaaaga

SEQ ID NO: 1773123 - DNA, 22 bp, Homo sapiens
ttccaggaaaaaataaaaagag

SEQ ID NO: 1773124 - DNA, 12 bp, Homo sapiens
ttccaggagaag

SEQ ID NO: 1773125 - DNA, 20 bp, Homo sapiens
ttccaggcctgatcttgcct

SEQ ID NO: 1773126 - DNA, 20 bp, Homo sapiens
ttccaggctatgtataaaat

SEQ ID NO: 1773127 - DNA, 21 bp, Homo sapiens
ttccaggctcttcctggacct

SEQ ID NO: 1773128 - DNA, 15 bp, Homo sapiens
ttccaggggaacctg

SEQ ID NO: 1773129 - DNA, 17 bp, Homo sapiens
ttccaggggaacctgcc

SEQ ID NO: 1773130 - DNA, 16 bp, Homo sapiens
ttccagggtccctctg

SEQ ID NO: 1773131 - DNA, 20 bp, Homo sapiens
ttccagggtccctctgtgta

SEQ ID NO: 1773132 - DNA, 19 bp, Homo sapiens
ttccagtacacctttcagc

SEQ ID NO: 1773133 - DNA, 16 bp, Homo sapiens
ttccagtacagtattc

SEQ ID NO: 1773134 - DNA, 21 bp, Homo sapiens
ttccagtacagtattctttta

SEQ ID NO: 1773135 - DNA, 23 bp, Homo sapiens
ttccagtgaacattcccagccca

SEQ ID NO: 1773136 - DNA, 11 bp, Homo sapiens
ttccagttccc

SEQ ID NO: 1773137 - DNA, 13 bp, Homo sapiens
ttccagtttctcc

SEQ ID NO: 1773138 - DNA, 16 bp, Homo sapiens
ttccagtttctccttg

SEQ ID NO: 1773139 - DNA, 17 bp, Homo sapiens
ttccataaggaatgtag

SEQ ID NO: 1773140 - DNA, 16 bp, Homo sapiens
ttccataattatgaca

SEQ ID NO: 1773141 - DNA, 18 bp, Homo sapiens
ttccataattatgacagt

SEQ ID NO: 1773142 - DNA, 17 bp, Homo sapiens
ttccatacttctctcag

SEQ ID NO: 1773143 - DNA, 15 bp, Homo sapiens
ttccatagcaacagg

SEQ ID NO: 1773144 - DNA, 17 bp, Homo sapiens
ttccatagcaacaggaa

SEQ ID NO: 1773145 - DNA, 19 bp, Homo sapiens
ttccatcaggttccatccc

SEQ ID NO: 1773146 - DNA, 18 bp, Homo sapiens
ttccatcatgtctgtata

SEQ ID NO: 1773147 - DNA, 15 bp, Homo sapiens
ttccatcatttggtt

SEQ ID NO: 1773148 - DNA, 12 bp, Homo sapiens
ttccatccacca

SEQ ID NO: 1773149 - DNA, 21 bp, Homo sapiens
ttccatccatctttccatcca

SEQ ID NO: 1773150 - DNA, 22 bp, Homo sapiens
ttccatccattacctccatcca

SEQ ID NO: 1773151 - DNA, 17 bp, Homo sapiens
ttccatctaaaaatata

SEQ ID NO: 1773152 - DNA, 14 bp, Homo sapiens
ttccatctctgact

SEQ ID NO: 1773153 - DNA, 14 bp, Homo sapiens
ttccatctctgcct

SEQ ID NO: 1773154 - DNA, 15 bp, Homo sapiens
ttccatctctgcctg

SEQ ID NO: 1773155 - DNA, 17 bp, Homo sapiens
ttccatgaatgttcctg

SEQ ID NO: 1773156 - DNA, 22 bp, Homo sapiens
ttccatgcaactggagttcctt

SEQ ID NO: 1773157 - DNA, 17 bp, Homo sapiens
ttccatgcagccttggg

SEQ ID NO: 1773158 - DNA, 15 bp, Homo sapiens
ttccatgccccagga

SEQ ID NO: 1773159 - DNA, 14 bp, Homo sapiens
ttccatgcctgagg

SEQ ID NO: 1773160 - DNA, 15 bp, Homo sapiens
ttccatgcctgaggg

SEQ ID NO: 1773161 - DNA, 18 bp, Homo sapiens
ttccatgcctgagggtgg

SEQ ID NO: 1773162 - DNA, 15 bp, Homo sapiens
ttccatgtgaacagc

SEQ ID NO: 1773163 - DNA, 17 bp, Homo sapiens
ttccatgtgcctttctt

SEQ ID NO: 1773164 - DNA, 19 bp, Homo sapiens
ttccatgtgcctttctttg

SEQ ID NO: 1773165 - DNA, 13 bp, Homo sapiens
ttccatgttgctg

SEQ ID NO: 1773166 - DNA, 21 bp, Homo sapiens
ttccatgttttttcttcaaat

SEQ ID NO: 1773167 - DNA, 22 bp, Homo sapiens
ttccatgttttttcttcaaatg

SEQ ID NO: 1773168 - DNA, 16 bp, Homo sapiens
ttccattatgattctt

SEQ ID NO: 1773169 - DNA, 16 bp, Homo sapiens
ttccattatgttcatc

SEQ ID NO: 1773170 - DNA, 14 bp, Homo sapiens
ttccattccacaca

SEQ ID NO: 1773171 - DNA, 23 bp, Homo sapiens
ttccattgaccagctctcttcct

SEQ ID NO: 1773172 - DNA, 20 bp, Homo sapiens
ttccattggtccaagattcc

SEQ ID NO: 1773173 - DNA, 21 bp, Homo sapiens
ttccatttccagttcatctat

SEQ ID NO: 1773174 - DNA, 16 bp, Homo sapiens
ttccattttcccccac

SEQ ID NO: 1773175 - DNA, 17 bp, Homo sapiens
ttccatttttcctctgt

SEQ ID NO: 1773176 - DNA, 22 bp, Homo sapiens
ttccatttttcctctgttcaca

SEQ ID NO: 1773177 - DNA, 21 bp, Homo sapiens
ttcccaaacccagtctcctct

SEQ ID NO: 1773178 - DNA, 18 bp, Homo sapiens
ttcccaaactacagaata

SEQ ID NO: 1773179 - DNA, 20 bp, Homo sapiens
ttcccaaactacagaataat

SEQ ID NO: 1773180 - DNA, 13 bp, Homo sapiens
ttcccaaagcact

SEQ ID NO: 1773181 - DNA, 16 bp, Homo sapiens
ttcccaaagcactttt

SEQ ID NO: 1773182 - DNA, 17 bp, Homo sapiens
ttcccaaagtcctctgc

SEQ ID NO: 1773183 - DNA, 20 bp, Homo sapiens
ttcccaaagtcctctgctcc

SEQ ID NO: 1773184 - DNA, 21 bp, Homo sapiens
ttcccaaagtcctctgctcca

SEQ ID NO: 1773185 - DNA, 15 bp, Homo sapiens
ttcccaacgtgcaaa

SEQ ID NO: 1773186 - DNA, 15 bp, Homo sapiens
ttcctgcgtcctcct

SEQ ID NO: 1773187 - DNA, 19 bp, Homo sapiens
ttcctgctccgtggactgc

SEQ ID NO: 1773188 - DNA, 15 bp, Homo sapiens
ttcctgctcttccca

SEQ ID NO: 1773189 - DNA, 22 bp, Homo sapiens
ttcctgctgaacgtttccccga

SEQ ID NO: 1773190 - DNA, 12 bp, Homo sapiens
ttcctgctgctg

SEQ ID NO: 1773191 - DNA, 11 bp, Homo sapiens
ttcctgctggt

SEQ ID NO: 1773192 - DNA, 18 bp, Homo sapiens
ttcctgctgtatttcctg

SEQ ID NO: 1773193 - DNA, 20 bp, Homo sapiens
ttcctgctgtatttcctgct

SEQ ID NO: 1773194 - DNA, 11 bp, Homo sapiens
ttcctgctgtc

SEQ ID NO: 1773195 - DNA, 19 bp, Homo sapiens
ttcctgctgtcctggtggc

SEQ ID NO: 1773196 - DNA, 23 bp, Homo sapiens
ttcctgctgtcctggtggctggg

SEQ ID NO: 1773197 - DNA, 18 bp, Homo sapiens
ttcctgcttcctcagagg

SEQ ID NO: 1773198 - DNA, 17 bp, Homo sapiens
ttcctggaaaagaagaa

SEQ ID NO: 1773199 - DNA, 21 bp, Homo sapiens
ttcctggaaaagaagaaactt

SEQ ID NO: 1773200 - DNA, 14 bp, Homo sapiens
ttcctggaaacagc

SEQ ID NO: 1773201 - DNA, 18 bp, Homo sapiens
ttcctggaaacagcatga

SEQ ID NO: 1773202 - DNA, 20 bp, Homo sapiens
ttcctggaaacagcatgaat

SEQ ID NO: 1773203 - DNA, 13 bp, Homo sapiens
ttcctggaagcag

SEQ ID NO: 1773204 - DNA, 19 bp, Homo sapiens
ttcctggacatcaccagtc

SEQ ID NO: 1773205 - DNA, 14 bp, Homo sapiens
ttcctggagcccga

SEQ ID NO: 1773206 - DNA, 11 bp, Homo sapiens
ttcctggcctc

SEQ ID NO: 1773207 - DNA, 20 bp, Homo sapiens
ttcctggcctcactggctgg

SEQ ID NO: 1773208 - DNA, 17 bp, Homo sapiens
ttcctggcctcccttct

SEQ ID NO: 1773209 - DNA, 14 bp, Homo sapiens
ttcctggccttctg

SEQ ID NO: 1773210 - DNA, 17 bp, Homo sapiens
ttcctggccttctgaac

SEQ ID NO: 1773211 - DNA, 18 bp, Homo sapiens
ttcctggctctaccctgt

SEQ ID NO: 1773212 - DNA, 11 bp, Homo sapiens
ttcctggctga

SEQ ID NO: 1773213 - DNA, 13 bp, Homo sapiens
ttcctggctgatg

SEQ ID NO: 1773214 - DNA, 21 bp, Homo sapiens
ttcctggctgatgatccagaa

SEQ ID NO: 1773215 - DNA, 12 bp, Homo sapiens
ttcctgggcctg

SEQ ID NO: 1773216 - DNA, 17 bp, Homo sapiens
ttcctgggcctttgcaa

SEQ ID NO: 1773217 - DNA, 15 bp, Homo sapiens
ttcctggggccccgc

SEQ ID NO: 1773218 - DNA, 15 bp, Homo sapiens
ttcctggtacccagc

SEQ ID NO: 1773219 - DNA, 19 bp, Homo sapiens
ttcctggtacccagccatc

SEQ ID NO: 1773220 - DNA, 14 bp, Homo sapiens
ttcctgtaaataag

SEQ ID NO: 1773221 - DNA, 23 bp, Homo sapiens
ttcctgtcccaccatacgagcac

SEQ ID NO: 1773222 - DNA, 22 bp, Homo sapiens
ttcctgtgacagtgaaatacat

SEQ ID NO: 1773223 - DNA, 13 bp, Homo sapiens
ttcctgtggctcc

SEQ ID NO: 1773224 - DNA, 18 bp, Homo sapiens
ttcctgtgtactctttat

SEQ ID NO: 1773225 - DNA, 11 bp, Homo sapiens
ttcctgtgtcc

SEQ ID NO: 1773226 - DNA, 22 bp, Homo sapiens
ttcctgtgtgtccaaaactgcc

SEQ ID NO: 1773227 - DNA, 15 bp, Homo sapiens
ttcctgttgctctgt

SEQ ID NO: 1773228 - DNA, 13 bp, Homo sapiens
ttcctgtttgaaa

SEQ ID NO: 1773229 - DNA, 17 bp, Homo sapiens
ttcctgtttgttgaagg

SEQ ID NO: 1773230 - DNA, 19 bp, Homo sapiens
ttcctgtttttcacatttt

SEQ ID NO: 1773231 - DNA, 20 bp, Homo sapiens
ttccttaaaattaagttgaa

SEQ ID NO: 1773232 - DNA, 15 bp, Homo sapiens
ttccttaaacatgaa

SEQ ID NO: 1773233 - DNA, 15 bp, Homo sapiens
ttccttacccaaact

SEQ ID NO: 1773234 - DNA, 13 bp, Homo sapiens
ttccttacctttt

SEQ ID NO: 1773235 - DNA, 21 bp, Homo sapiens
ttccttagcttagacctcagc

SEQ ID NO: 1773236 - DNA, 23 bp, Homo sapiens
ttccttagcttagacctcagcct

SEQ ID NO: 1773237 - DNA, 21 bp, Homo sapiens
ttccttatgtatcagtgtcct

SEQ ID NO: 1773238 - DNA, 16 bp, Homo sapiens
ttccttcagggtttaa

SEQ ID NO: 1773239 - DNA, 22 bp, Homo sapiens
ttccttcagggtttaatagact

SEQ ID NO: 1773240 - DNA, 21 bp, Homo sapiens
ttccttcccacccatcgctgt

SEQ ID NO: 1773241 - DNA, 16 bp, Homo sapiens
ttccttcccaggccct

SEQ ID NO: 1773242 - DNA, 14 bp, Homo sapiens
ttccttccctctcc

SEQ ID NO: 1773243 - DNA, 22 bp, Homo sapiens
ttccttccctggctacttccct

SEQ ID NO: 1773244 - DNA, 18 bp, Homo sapiens
ttccttctaacatgttat

SEQ ID NO: 1773245 - DNA, 11 bp, Homo sapiens
ttccttctctg

SEQ ID NO: 1773246 - DNA, 24 bp, Homo sapiens
ttccttgagacacggagcccagcc

SEQ ID NO: 1773247 - DNA, 14 bp, Homo sapiens
ttccttgccttaat

SEQ ID NO: 1773248 - DNA, 20 bp, Homo sapiens
ttccttggaggccaccggga

SEQ ID NO: 1773249 - DNA, 15 bp, Homo sapiens
ttccttggctcccat

SEQ ID NO: 1773250 - DNA, 21 bp, Homo sapiens
ttccttggctcccattcactc

SEQ ID NO: 1773251 - DNA, 23 bp, Homo sapiens
ttccttggctcccattcactctt

SEQ ID NO: 1773252 - DNA, 18 bp, Homo sapiens
ttccttgttcttcccttc

SEQ ID NO: 1773253 - DNA, 15 bp, Homo sapiens
ttcctttataatatt

SEQ ID NO: 1773254 - DNA, 20 bp, Homo sapiens
ttcctttatatttgctcccc

SEQ ID NO: 1773255 - DNA, 14 bp, Homo sapiens
ttcctttatgtgaa

SEQ ID NO: 1773256 - DNA, 23 bp, Homo sapiens
ttcctttcctgtgtgtactctgt

SEQ ID NO: 1773257 - DNA, 12 bp, Homo sapiens
ttcctttctcag

SEQ ID NO: 1773258 - DNA, 14 bp, Homo sapiens
ttcctttctcctgc

SEQ ID NO: 1773259 - DNA, 15 bp, Homo sapiens
ttcctttctctcctg

SEQ ID NO: 1773260 - DNA, 23 bp, Homo sapiens
ttcctttgaagctttaggcagag

SEQ ID NO: 1773261 - DNA, 15 bp, Homo sapiens
ttcctttgctctttc

SEQ ID NO: 1773262 - DNA, 22 bp, Homo sapiens
ttcctttggaacaagacagcct

SEQ ID NO: 1773263 - DNA, 14 bp, Homo sapiens
ttcctttgtcattt

SEQ ID NO: 1773264 - DNA, 12 bp, Homo sapiens
ttccttttaatt

SEQ ID NO: 1773265 - DNA, 20 bp, Homo sapiens
ttccttttagcctagttcat

SEQ ID NO: 1773266 - DNA, 14 bp, Homo sapiens
ttccttttccctgc

SEQ ID NO: 1773267 - DNA, 15 bp, Homo sapiens
ttccttttccctgct

SEQ ID NO: 1773268 - DNA, 16 bp, Homo sapiens
ttccttttccctgctt

SEQ ID NO: 1773269 - DNA, 14 bp, Homo sapiens
ttccttttggaaca

SEQ ID NO: 1773270 - DNA, 18 bp, Homo sapiens
ttcctttttaaatgtgaa

SEQ ID NO: 1773271 - DNA, 15 bp, Homo sapiens
ttcctttttcttcgc

SEQ ID NO: 1773272 - DNA, 16 bp, Homo sapiens
ttcctttttcttcgct

SEQ ID NO: 1773273 - DNA, 22 bp, Homo sapiens
ttcgaaacctgggattcaggaa

SEQ ID NO: 1773274 - DNA, 17 bp, Homo sapiens
ttcgaaaggccttcaga

SEQ ID NO: 1773275 - DNA, 21 bp, Homo sapiens
ttcgaagaaacccttgctgct

SEQ ID NO: 1773276 - DNA, 23 bp, Homo sapiens
ttcgaatcttaatttattatttt

SEQ ID NO: 1773277 - DNA, 22 bp, Homo sapiens
ttcgacatccgtcattgctgct

SEQ ID NO: 1773278 - DNA, 13 bp, Homo sapiens
ttcgagactccat

SEQ ID NO: 1773279 - DNA, 13 bp, Homo sapiens
ttcgaggcctgaa

SEQ ID NO: 1773280 - DNA, 15 bp, Homo sapiens
ttcgaggcctgaagc

SEQ ID NO: 1773281 - DNA, 12 bp, Homo sapiens
ttcgagtagaga

SEQ ID NO: 1773282 - DNA, 18 bp, Homo sapiens
ttcgagtagagaggcccg

SEQ ID NO: 1773283 - DNA, 17 bp, Homo sapiens
ttcgcattaagcacaca

SEQ ID NO: 1773284 - DNA, 13 bp, Homo sapiens
ttcgccttaaact

SEQ ID NO: 1773285 - DNA, 21 bp, Homo sapiens
ttcgcctttgtcttgtacttc

SEQ ID NO: 1773286 - DNA, 19 bp, Homo sapiens
ttcgcgtgccctcgctgct

SEQ ID NO: 1773287 - DNA, 15 bp, Homo sapiens
ttcgctgaaattgct

SEQ ID NO: 1773288 - DNA, 15 bp, Homo sapiens
ttcgctgtcccctca

SEQ ID NO: 1773289 - DNA, 17 bp, Homo sapiens
ttcgctgtcccctcagc

SEQ ID NO: 1773290 - DNA, 19 bp, Homo sapiens
ttcggaactgtcctttcct

SEQ ID NO: 1773291 - DNA, 23 bp, Homo sapiens
ttcggacatgcttttctgccact

SEQ ID NO: 1773292 - DNA, 17 bp, Homo sapiens
ttcggccccatgtatct

SEQ ID NO: 1773293 - DNA, 23 bp, Homo sapiens
ttcggccttggtgaacacacacg

SEQ ID NO: 1773294 - DNA, 18 bp, Homo sapiens
ttcgggcgtctgtgtgcg

SEQ ID NO: 1773295 - DNA, 19 bp, Homo sapiens
ttcggggtgatcctgttct

SEQ ID NO: 1773296 - DNA, 16 bp, Homo sapiens
ttcgggtgctggaagt

SEQ ID NO: 1773297 - DNA, 16 bp, Homo sapiens
ttcgggttaagtgatg

SEQ ID NO: 1773298 - DNA, 16 bp, Homo sapiens
ttcggtttcaaagtga

SEQ ID NO: 1773299 - DNA, 13 bp, Homo sapiens
ttcggtttctgag

SEQ ID NO: 1773300 - DNA, 14 bp, Homo sapiens
ttcggtttctgagc

SEQ ID NO: 1773301 - DNA, 20 bp, Homo sapiens
ttctccgttagctcctgtgg

SEQ ID NO: 1773302 - DNA, 18 bp, Homo sapiens
ttctcctcactgtatcca

SEQ ID NO: 1773303 - DNA, 19 bp, Homo sapiens
ttctcctcccttccttttc

SEQ ID NO: 1773304 - DNA, 20 bp, Homo sapiens
ttctcctcccttccttttcc

SEQ ID NO: 1773305 - DNA, 14 bp, Homo sapiens
ttctcctgccccaa

SEQ ID NO: 1773306 - DNA, 21 bp, Homo sapiens
ttctcctgcctgtgctgtgac

SEQ ID NO: 1773307 - DNA, 21 bp, Homo sapiens
ttctcctgtccctccatccca

SEQ ID NO: 1773308 - DNA, 21 bp, Homo sapiens
ttctcctgtctcagcctcctg

SEQ ID NO: 1773309 - DNA, 12 bp, Homo sapiens
ttctcctgtgcc

SEQ ID NO: 1773310 - DNA, 13 bp, Homo sapiens
ttctcctgtgccc

SEQ ID NO: 1773311 - DNA, 20 bp, Homo sapiens
ttctccttcagccctcaccc

SEQ ID NO: 1773312 - DNA, 17 bp, Homo sapiens
ttctccttctccttccc

SEQ ID NO: 1773313 - DNA, 13 bp, Homo sapiens
ttctcctttcctt

SEQ ID NO: 1773314 - DNA, 16 bp, Homo sapiens
ttctcctttccttccc

SEQ ID NO: 1773315 - DNA, 18 bp, Homo sapiens
ttctccttttcctatcct

SEQ ID NO: 1773316 - DNA, 18 bp, Homo sapiens
ttctccttttcctctctc

SEQ ID NO: 1773317 - DNA, 23 bp, Homo sapiens
ttctcgcaaaaacgtatctccta

SEQ ID NO: 1773318 - DNA, 21 bp, Homo sapiens
ttctcgtgctgcatccctgtg

SEQ ID NO: 1773319 - DNA, 16 bp, Homo sapiens
ttctctaactcctgcc

SEQ ID NO: 1773320 - DNA, 17 bp, Homo sapiens
ttctctaactcctgcca

SEQ ID NO: 1773321 - DNA, 18 bp, Homo sapiens
ttctctaactcctgccat

SEQ ID NO: 1773322 - DNA, 20 bp, Homo sapiens
ttctctagctctctaggcct

SEQ ID NO: 1773323 - DNA, 15 bp, Homo sapiens
ttctctattaaaatg

SEQ ID NO: 1773324 - DNA, 22 bp, Homo sapiens
ttctctccacagtgttgtgccc

SEQ ID NO: 1773325 - DNA, 12 bp, Homo sapiens
ttctctccagct

SEQ ID NO: 1773326 - DNA, 15 bp, Homo sapiens
ttctctcccatcctg

SEQ ID NO: 1773327 - DNA, 20 bp, Homo sapiens
ttctctccccctatttattg

SEQ ID NO: 1773328 - DNA, 19 bp, Homo sapiens
ttctctcccttcctctctc

SEQ ID NO: 1773329 - DNA, 21 bp, Homo sapiens
ttctctcccttcctctctcct

SEQ ID NO: 1773330 - DNA, 17 bp, Homo sapiens
ttctctccgacttcccc

SEQ ID NO: 1773331 - DNA, 12 bp, Homo sapiens
ttctctcctccc

SEQ ID NO: 1773332 - DNA, 12 bp, Homo sapiens
ttctctcctggc

SEQ ID NO: 1773333 - DNA, 17 bp, Homo sapiens
ttctctcggctccccat

SEQ ID NO: 1773334 - DNA, 15 bp, Homo sapiens
ttctctctccagggt

SEQ ID NO: 1773335 - DNA, 13 bp, Homo sapiens
ttctctctctaag

SEQ ID NO: 1773336 - DNA, 16 bp, Homo sapiens
ttctctctctctcaca

SEQ ID NO: 1773337 - DNA, 20 bp, Homo sapiens
ttctctctctctcacacaca

SEQ ID NO: 1773338 - DNA, 15 bp, Homo sapiens
ttctctctctctctc

SEQ ID NO: 1773339 - DNA, 20 bp, Homo sapiens
ttctctctggcttctctctt

SEQ ID NO: 1773340 - DNA, 19 bp, Homo sapiens
ttctctcttcaatctctgg

SEQ ID NO: 1773341 - DNA, 12 bp, Homo sapiens
ttctctcttccc

SEQ ID NO: 1773342 - DNA, 20 bp, Homo sapiens
ttctctctttatacagctgt

SEQ ID NO: 1773343 - DNA, 21 bp, Homo sapiens
ttctctctttatacagctgta

SEQ ID NO: 1773344 - DNA, 11 bp, Homo sapiens
ttctctctttt

SEQ ID NO: 1773345 - DNA, 13 bp, Homo sapiens
ttctctcttttcc

SEQ ID NO: 1773346 - DNA, 16 bp, Homo sapiens
ttctctcttttcctcc

SEQ ID NO: 1773347 - DNA, 23 bp, Homo sapiens
ttctctgaagagtgggtttcaca

SEQ ID NO: 1773348 - DNA, 11 bp, Homo sapiens
ttctctgactt

SEQ ID NO: 1773349 - DNA, 12 bp, Homo sapiens
ttctctgacttc

SEQ ID NO: 1773350 - DNA, 11 bp, Homo sapiens
ttctctgctcc

SEQ ID NO: 1773351 - DNA, 14 bp, Homo sapiens
ttctctgctccacc

SEQ ID NO: 1773352 - DNA, 20 bp, Homo sapiens
ttctctgcttacccttcacc

SEQ ID NO: 1773353 - DNA, 16 bp, Homo sapiens
ttctctgcttgacaga

SEQ ID NO: 1773354 - DNA, 20 bp, Homo sapiens
ttctctggctgtaaggctct

SEQ ID NO: 1773355 - DNA, 15 bp, Homo sapiens
ttctctgggagaaaa

SEQ ID NO: 1773356 - DNA, 16 bp, Homo sapiens
ttctctgggagaaaat

SEQ ID NO: 1773357 - DNA, 19 bp, Homo sapiens
ttctctgggagaaaatcat

SEQ ID NO: 1773358 - DNA, 18 bp, Homo sapiens
ttctctggtggtcttcct

SEQ ID NO: 1773359 - DNA, 13 bp, Homo sapiens
ttctctgtacttt

SEQ ID NO: 1773360 - DNA, 19 bp, Homo sapiens
ttctctgtcctacttctga

SEQ ID NO: 1773361 - DNA, 15 bp, Homo sapiens
ttctctgtgctctga

SEQ ID NO: 1773362 - DNA, 17 bp, Homo sapiens
ttctctgtgctctgaat

SEQ ID NO: 1773363 - DNA, 17 bp, Homo sapiens
ttctctgtgtctaagat

SEQ ID NO: 1773364 - DNA, 15 bp, Homo sapiens
ttctctgttcccttg

SEQ ID NO: 1773365 - DNA, 16 bp, Homo sapiens
ttctcttacctgttat

SEQ ID NO: 1773366 - DNA, 22 bp, Homo sapiens
ttctcttaggtggctctgggaa

SEQ ID NO: 1773367 - DNA, 19 bp, Homo sapiens
ttctcttatcctctctctc

SEQ ID NO: 1773368 - DNA, 18 bp, Homo sapiens
ttctcttcactcccaata

SEQ ID NO: 1773369 - DNA, 23 bp, Homo sapiens
ttctcttccccttcctgtttcag

SEQ ID NO: 1773370 - DNA, 22 bp, Homo sapiens
ttctcttcctagatctgcaggc

SEQ ID NO: 1773371 - DNA, 14 bp, Homo sapiens
ttctcttcgctgtg

SEQ ID NO: 1773372 - DNA, 19 bp, Homo sapiens
ttctcttcttgctatatga

SEQ ID NO: 1773373 - DNA, 16 bp, Homo sapiens
ttctcttgagctggcc

SEQ ID NO: 1773374 - DNA, 13 bp, Homo sapiens
ttctcttgtacca

SEQ ID NO: 1773375 - DNA, 19 bp, Homo sapiens
ttctcttgtataagatcct

SEQ ID NO: 1773376 - DNA, 19 bp, Homo sapiens
ttctctttaaaatatttgt

SEQ ID NO: 1773377 - DNA, 16 bp, Homo sapiens
ttctcttttctttctg

SEQ ID NO: 1773378 - DNA, 18 bp, Homo sapiens
ttctcttttttaaaaaca

SEQ ID NO: 1773379 - DNA, 18 bp, Homo sapiens
ttctcttttttcagagaa

SEQ ID NO: 1773380 - DNA, 22 bp, Homo sapiens
ttctgaaaactgaatgtcaaga

SEQ ID NO: 1773381 - DNA, 16 bp, Homo sapiens
ttctgaactcaaactg

SEQ ID NO: 1773382 - DNA, 17 bp, Homo sapiens
ttctgaactcaaactga

SEQ ID NO: 1773383 - DNA, 22 bp, Homo sapiens
ttctgaactcaagctgcgttta

SEQ ID NO: 1773384 - DNA, 13 bp, Homo sapiens
ttctgaactccat

SEQ ID NO: 1773385 - DNA, 22 bp, Homo sapiens
ttctgaactccatacagcctct

SEQ ID NO: 1773386 - DNA, 15 bp, Homo sapiens
ttctgaataaagcaa

SEQ ID NO: 1773387 - DNA, 17 bp, Homo sapiens
ttctgaattcataaaaa

SEQ ID NO: 1773388 - DNA, 18 bp, Homo sapiens
ttctgaattggaagggaa

SEQ ID NO: 1773389 - DNA, 18 bp, Homo sapiens
ttctgacatgtaagaaaa

SEQ ID NO: 1773390 - DNA, 21 bp, Homo sapiens
ttctgacgtcagcgcaccaaa

SEQ ID NO: 1773391 - DNA, 18 bp, Homo sapiens
ttctgactcggtttctcc

SEQ ID NO: 1773392 - DNA, 16 bp, Homo sapiens
ttctgactctgagcta

SEQ ID NO: 1773393 - DNA, 13 bp, Homo sapiens
ttctgactgttta

SEQ ID NO: 1773394 - DNA, 14 bp, Homo sapiens
ttctgactgtttat

SEQ ID NO: 1773395 - DNA, 15 bp, Homo sapiens
ttctgactgtttatt

SEQ ID NO: 1773396 - DNA, 18 bp, Homo sapiens
ttctgactgtttatttaa

SEQ ID NO: 1773397 - DNA, 13 bp, Homo sapiens
ttctgactttact

SEQ ID NO: 1773398 - DNA, 19 bp, Homo sapiens
ttctgactttacttgtggt

SEQ ID NO: 1773399 - DNA, 13 bp, Homo sapiens
ttctgagaaaaca

SEQ ID NO: 1773400 - DNA, 14 bp, Homo sapiens
ttctgagaaaacaa

SEQ ID NO: 1773401 - DNA, 23 bp, Homo sapiens
ttctgagagttggctcaggcaga

SEQ ID NO: 1773402 - DNA, 16 bp, Homo sapiens
ttctgagatctgttga

SEQ ID NO: 1773403 - DNA, 20 bp, Homo sapiens
ttctgagcccgggctgcctg

SEQ ID NO: 1773404 - DNA, 13 bp, Homo sapiens
ttctgagccttga

SEQ ID NO: 1773405 - DNA, 14 bp, Homo sapiens
ttctgagctccacc

SEQ ID NO: 1773406 - DNA, 16 bp, Homo sapiens
ttctgaggctttatga

SEQ ID NO: 1773407 - DNA, 13 bp, Homo sapiens
ttctgagtacaga

SEQ ID NO: 1773408 - DNA, 20 bp, Homo sapiens
ttctgagtgtttttactaca

SEQ ID NO: 1773409 - DNA, 21 bp, Homo sapiens
ttctgagttttgtgtttgttg

SEQ ID NO: 1773410 - DNA, 18 bp, Homo sapiens
ttctgataaaagatggcc

SEQ ID NO: 1773411 - DNA, 19 bp, Homo sapiens
ttctgataaagttccttaa

SEQ ID NO: 1773412 - DNA, 18 bp, Homo sapiens
ttctgatgaatctcaaag

SEQ ID NO: 1773413 - DNA, 12 bp, Homo sapiens
ttctgatgtttc

SEQ ID NO: 1773414 - DNA, 16 bp, Homo sapiens
ttctgatgtttctgtg

SEQ ID NO: 1773415 - DNA, 20 bp, Homo sapiens
ttctgattcccctccaccaa

SEQ ID NO: 1773416 - DNA, 20 bp, Homo sapiens
ttcttgctggctctgagaat

SEQ ID NO: 1773417 - DNA, 23 bp, Homo sapiens
ttcttgctggttgtcatttttgc

SEQ ID NO: 1773418 - DNA, 12 bp, Homo sapiens
ttcttgctttca

SEQ ID NO: 1773419 - DNA, 20 bp, Homo sapiens
ttcttgtaaatctttttgct

SEQ ID NO: 1773420 - DNA, 15 bp, Homo sapiens
ttcttgtaaatgttt

SEQ ID NO: 1773421 - DNA, 15 bp, Homo sapiens
ttcttgtaagccatc

SEQ ID NO: 1773422 - DNA, 14 bp, Homo sapiens
ttcttgtggttaaa

SEQ ID NO: 1773423 - DNA, 15 bp, Homo sapiens
ttcttgtttgtcagc

SEQ ID NO: 1773424 - DNA, 15 bp, Homo sapiens
ttcttgttttatata

SEQ ID NO: 1773425 - DNA, 14 bp, Homo sapiens
ttctttaaacactc

SEQ ID NO: 1773426 - DNA, 14 bp, Homo sapiens
ttctttaaagaagt

SEQ ID NO: 1773427 - DNA, 22 bp, Homo sapiens
ttctttaaagaagttgaagttt

SEQ ID NO: 1773428 - DNA, 19 bp, Homo sapiens
ttctttaactgccgtaatt

SEQ ID NO: 1773429 - DNA, 16 bp, Homo sapiens
ttctttactaaagata

SEQ ID NO: 1773430 - DNA, 18 bp, Homo sapiens
ttctttactcggcgtgct

SEQ ID NO: 1773431 - DNA, 13 bp, Homo sapiens
ttctttagaattt

SEQ ID NO: 1773432 - DNA, 21 bp, Homo sapiens
ttctttagcatttttatgcag

SEQ ID NO: 1773433 - DNA, 19 bp, Homo sapiens
ttctttcagttctttggat

SEQ ID NO: 1773434 - DNA, 14 bp, Homo sapiens
ttctttccattatg

SEQ ID NO: 1773435 - DNA, 19 bp, Homo sapiens
ttctttcccatgtatttgt

SEQ ID NO: 1773436 - DNA, 22 bp, Homo sapiens
ttctttccccagaggctcccaa

SEQ ID NO: 1773437 - DNA, 12 bp, Homo sapiens
ttctttccctgg

SEQ ID NO: 1773438 - DNA, 13 bp, Homo sapiens
ttctttccctgga

SEQ ID NO: 1773439 - DNA, 16 bp, Homo sapiens
ttctttccggccaagg

SEQ ID NO: 1773440 - DNA, 15 bp, Homo sapiens
ttctttccttcccaa

SEQ ID NO: 1773441 - DNA, 12 bp, Homo sapiens
ttctttctagaa

SEQ ID NO: 1773442 - DNA, 13 bp, Homo sapiens
ttctttctagaaa

SEQ ID NO: 1773443 - DNA, 12 bp, Homo sapiens
ttctttctctaa

SEQ ID NO: 1773444 - DNA, 18 bp, Homo sapiens
ttctttctgtctcccttc

SEQ ID NO: 1773445 - DNA, 14 bp, Homo sapiens
ttctttcttgctgg

SEQ ID NO: 1773446 - DNA, 22 bp, Homo sapiens
ttctttgatcatgaataactga

SEQ ID NO: 1773447 - DNA, 14 bp, Homo sapiens
ttctttgattctgt

SEQ ID NO: 1773448 - DNA, 15 bp, Homo sapiens
ttctttgcaaaaatc

SEQ ID NO: 1773449 - DNA, 21 bp, Homo sapiens
ttctttgcaccaaagacatca

SEQ ID NO: 1773450 - DNA, 14 bp, Homo sapiens
ttctttgcacttaa

SEQ ID NO: 1773451 - DNA, 16 bp, Homo sapiens
ttctttgcacttaaaa

SEQ ID NO: 1773452 - DNA, 20 bp, Homo sapiens
ttctttgcacttaaaaatta

SEQ ID NO: 1773453 - DNA, 19 bp, Homo sapiens
ttctttgcactttttctta

SEQ ID NO: 1773454 - DNA, 14 bp, Homo sapiens
ttctttgctagttg

SEQ ID NO: 1773455 - DNA, 13 bp, Homo sapiens
ttctttgggccag

SEQ ID NO: 1773456 - DNA, 22 bp, Homo sapiens
ttctttggtggagataaagatt

SEQ ID NO: 1773457 - DNA, 15 bp, Homo sapiens
ttctttgtgcctttg

SEQ ID NO: 1773458 - DNA, 15 bp, Homo sapiens
ttctttgttctgttt

SEQ ID NO: 1773459 - DNA, 12 bp, Homo sapiens
ttctttgtttcc

SEQ ID NO: 1773460 - DNA, 15 bp, Homo sapiens
ttctttgtttcctgg

SEQ ID NO: 1773461 - DNA, 20 bp, Homo sapiens
ttctttgtttctttcttcct

SEQ ID NO: 1773462 - DNA, 14 bp, Homo sapiens
ttcttttaaagacc

SEQ ID NO: 1773463 - DNA, 15 bp, Homo sapiens
ttcttttatatctgt

SEQ ID NO: 1773464 - DNA, 23 bp, Homo sapiens
ttcttttcagcttgtttctatac

SEQ ID NO: 1773465 - DNA, 14 bp, Homo sapiens
ttcttttctcagtg

SEQ ID NO: 1773466 - DNA, 20 bp, Homo sapiens
ttcttttcttcactcaaatt

SEQ ID NO: 1773467 - DNA, 23 bp, Homo sapiens
ttcttttgcccttcacagtgttt

SEQ ID NO: 1773468 - DNA, 14 bp, Homo sapiens
ttcttttggcttcc

SEQ ID NO: 1773469 - DNA, 15 bp, Homo sapiens
ttcttttgtttggta

SEQ ID NO: 1773470 - DNA, 20 bp, Homo sapiens
ttctttttaattattttaaa

SEQ ID NO: 1773471 - DNA, 15 bp, Homo sapiens
ttctttttacagcat

SEQ ID NO: 1773472 - DNA, 17 bp, Homo sapiens
ttctttttactgttgaa

SEQ ID NO: 1773473 - DNA, 15 bp, Homo sapiens
ttctttttattttct

SEQ ID NO: 1773474 - DNA, 16 bp, Homo sapiens
ttctttttattttctt

SEQ ID NO: 1773475 - DNA, 13 bp, Homo sapiens
ttctttttccagt

SEQ ID NO: 1773476 - DNA, 13 bp, Homo sapiens
ttctttttctgag

SEQ ID NO: 1773477 - DNA, 18 bp, Homo sapiens
ttctttttgaatctttaa

SEQ ID NO: 1773478 - DNA, 17 bp, Homo sapiens
ttcttttttaaaatcaa

SEQ ID NO: 1773479 - DNA, 19 bp, Homo sapiens
ttctttttttcctttttaa

SEQ ID NO: 1773480 - DNA, 18 bp, Homo sapiens
ttcttttttttcattata

SEQ ID NO: 1773481 - DNA, 20 bp, Homo sapiens
ttctttttttttaagttctt

SEQ ID NO: 1773482 - DNA, 21 bp, Homo sapiens
ttctttttttttaagttctta

SEQ ID NO: 1773483 - DNA, 21 bp, Homo sapiens
ttcttttttttttttttgaga

SEQ ID NO: 1773484 - DNA, 20 bp, Homo sapiens
ttgaaaaaggaaatattctt

SEQ ID NO: 1773485 - DNA, 15 bp, Homo sapiens
ttgaaaaagtttgtt

SEQ ID NO: 1773486 - DNA, 13 bp, Homo sapiens
ttgaaaacttttc

SEQ ID NO: 1773487 - DNA, 17 bp, Homo sapiens
ttgaaaacttttctcag

SEQ ID NO: 1773488 - DNA, 18 bp, Homo sapiens
ttgaaaagaagaaagtct

SEQ ID NO: 1773489 - DNA, 16 bp, Homo sapiens
ttgaaaagactccaaa

SEQ ID NO: 1773490 - DNA, 18 bp, Homo sapiens
ttgaaaagactccaaaga

SEQ ID NO: 1773491 - DNA, 14 bp, Homo sapiens
ttgaaaagttgaaa

SEQ ID NO: 1773492 - DNA, 16 bp, Homo sapiens
ttgaaaagttggaagg

SEQ ID NO: 1773493 - DNA, 15 bp, Homo sapiens
ttgaaaataaaaaga

SEQ ID NO: 1773494 - DNA, 22 bp, Homo sapiens
ttgaaaatggtttcaagttatt

SEQ ID NO: 1773495 - DNA, 16 bp, Homo sapiens
ttgaaaattgaaaagt

SEQ ID NO: 1773496 - DNA, 14 bp, Homo sapiens
ttgaaaattttact

SEQ ID NO: 1773497 - DNA, 19 bp, Homo sapiens
ttgaaaccaccttttatta

SEQ ID NO: 1773498 - DNA, 17 bp, Homo sapiens
ttgaaactcactagtaa

SEQ ID NO: 1773499 - DNA, 22 bp, Homo sapiens
ttgaaactcgcgagtgtaactt

SEQ ID NO: 1773500 - DNA, 22 bp, Homo sapiens
ttgaaactgtaaatatgtttgt

SEQ ID NO: 1773501 - DNA, 14 bp, Homo sapiens
ttgaaactttgaga

SEQ ID NO: 1773502 - DNA, 16 bp, Homo sapiens
ttgaaactttgagatc

SEQ ID NO: 1773503 - DNA, 22 bp, Homo sapiens
ttgaaactttgggaaaacatgt

SEQ ID NO: 1773504 - DNA, 16 bp, Homo sapiens
ttgaaagacatcaatg

SEQ ID NO: 1773505 - DNA, 17 bp, Homo sapiens
ttgaaagacatcaatga

SEQ ID NO: 1773506 - DNA, 18 bp, Homo sapiens
ttgaaagacatcaatgaa

SEQ ID NO: 1773507 - DNA, 19 bp, Homo sapiens
ttgaaagagttaagaatgt

SEQ ID NO: 1773508 - DNA, 19 bp, Homo sapiens
ttgaaagccaacaactctg

SEQ ID NO: 1773509 - DNA, 22 bp, Homo sapiens
ttgaaagccaacaactctgcct

SEQ ID NO: 1773510 - DNA, 22 bp, Homo sapiens
ttgaaaggggacacctgtacat

SEQ ID NO: 1773511 - DNA, 23 bp, Homo sapiens
ttgaaaggggacacctgtacatt

SEQ ID NO: 1773512 - DNA, 16 bp, Homo sapiens
ttgaaataactggaac

SEQ ID NO: 1773513 - DNA, 15 bp, Homo sapiens
ttgaaataataaatc

SEQ ID NO: 1773514 - DNA, 17 bp, Homo sapiens
ttgaaatagtatacatt

SEQ ID NO: 1773515 - DNA, 14 bp, Homo sapiens
ttgaaatatataat

SEQ ID NO: 1773516 - DNA, 18 bp, Homo sapiens
ttgaaatatataatattc

SEQ ID NO: 1773517 - DNA, 13 bp, Homo sapiens
ttgaaatctttta

SEQ ID NO: 1773518 - DNA, 16 bp, Homo sapiens
ttgaaatgaaagggaa

SEQ ID NO: 1773519 - DNA, 13 bp, Homo sapiens
ttgaaatgagtaa

SEQ ID NO: 1773520 - DNA, 21 bp, Homo sapiens
ttgaaattatgtatgtttaca

SEQ ID NO: 1773521 - DNA, 23 bp, Homo sapiens
ttgaaattatgtatgtttacata

SEQ ID NO: 1773522 - DNA, 14 bp, Homo sapiens
ttgaaattctattt

SEQ ID NO: 1773523 - DNA, 21 bp, Homo sapiens
ttgaaattctatttataatac

SEQ ID NO: 1773524 - DNA, 19 bp, Homo sapiens
ttgaaattgtttaagtgtt

SEQ ID NO: 1773525 - DNA, 21 bp, Homo sapiens
ttgaaatttttattaaattat

SEQ ID NO: 1773526 - DNA, 12 bp, Homo sapiens
ttgaacaaaata

SEQ ID NO: 1773527 - DNA, 20 bp, Homo sapiens
ttgaacaagttgtttcattg

SEQ ID NO: 1773528 - DNA, 13 bp, Homo sapiens
ttgaacacagttg

SEQ ID NO: 1773529 - DNA, 21 bp, Homo sapiens
ttgaacatgtgccttttctga

SEQ ID NO: 1773530 - DNA, 15 bp, Homo sapiens
ttgaaccaacatctt

SEQ ID NO: 1773531 - DNA, 20 bp, Homo sapiens
ttgaaccccctccctgtccc

SEQ ID NO: 1773532 - DNA, 14 bp, Homo sapiens
ttgaacccctgtgt

SEQ ID NO: 1773533 - DNA, 15 bp, Homo sapiens
ttgaacccctgtgtc

SEQ ID NO: 1773534 - DNA, 17 bp, Homo sapiens
ttgaactagcaatgcct

SEQ ID NO: 1773535 - DNA, 19 bp, Homo sapiens
ttgaactcttcaatctctt

SEQ ID NO: 1773536 - DNA, 16 bp, Homo sapiens
ttgaacttgctctttt

SEQ ID NO: 1773537 - DNA, 19 bp, Homo sapiens
ttgaacttttgtactgaat

SEQ ID NO: 1773538 - DNA, 23 bp, Homo sapiens
ttgaacttttgtactgaattttt

SEQ ID NO: 1773539 - DNA, 19 bp, Homo sapiens
ttgaagacaatttgataca

SEQ ID NO: 1773540 - DNA, 16 bp, Homo sapiens
ttgaagacacagcctc

SEQ ID NO: 1773541 - DNA, 18 bp, Homo sapiens
ttgaagacacagcctccc

SEQ ID NO: 1773542 - DNA, 19 bp, Homo sapiens
ttgaagacacagcctcccc

SEQ ID NO: 1773543 - DNA, 18 bp, Homo sapiens
ttgaagacggaaaacaat

SEQ ID NO: 1773544 - DNA, 14 bp, Homo sapiens
ttgaagagtgaaat

SEQ ID NO: 1773545 - DNA, 14 bp, Homo sapiens
ttgaagatgctgcc

SEQ ID NO: 1773546 - DNA, 19 bp, Homo sapiens
ttgaagcatagataatatt

SEQ ID NO: 1773547 - DNA, 23 bp, Homo sapiens
ttgaagcatttcaaagccctgcc

SEQ ID NO: 1773548 - DNA, 11 bp, Homo sapiens
ttgaagccaaa

SEQ ID NO: 1773549 - DNA, 17 bp, Homo sapiens
ttgaagccactgaagct

SEQ ID NO: 1773550 - DNA, 21 bp, Homo sapiens
ttgaagccactgaagctggga

SEQ ID NO: 1773551 - DNA, 17 bp, Homo sapiens
ttgaagccgactctggc

SEQ ID NO: 1773552 - DNA, 14 bp, Homo sapiens
ttgaagctaagatt

SEQ ID NO: 1773553 - DNA, 13 bp, Homo sapiens
ttgaagctctggt

SEQ ID NO: 1773554 - DNA, 17 bp, Homo sapiens
ttgaagctgttgctatt

SEQ ID NO: 1773555 - DNA, 23 bp, Homo sapiens
ttgaagctgttgctatttgtatt

SEQ ID NO: 1773556 - DNA, 11 bp, Homo sapiens
ttgaaggaaac

SEQ ID NO: 1773557 - DNA, 21 bp, Homo sapiens
ttgaaggaaagctatatctat

SEQ ID NO: 1773558 - DNA, 15 bp, Homo sapiens
ttgaaggaagaggga

SEQ ID NO: 1773559 - DNA, 14 bp, Homo sapiens
ttgaaggcagtctg

SEQ ID NO: 1773560 - DNA, 16 bp, Homo sapiens
ttgaagggcaagaaat

SEQ ID NO: 1773561 - DNA, 15 bp, Homo sapiens
ttgaagggccagagc

SEQ ID NO: 1773562 - DNA, 19 bp, Homo sapiens
ttgaagggccagagccagg

SEQ ID NO: 1773563 - DNA, 22 bp, Homo sapiens
ttgaaggtgataagggaaaaga

SEQ ID NO: 1773564 - DNA, 23 bp, Homo sapiens
ttgaaggtgctgacggccaggga

SEQ ID NO: 1773565 - DNA, 17 bp, Homo sapiens
ttgaagtaatgaatttt

SEQ ID NO: 1773566 - DNA, 21 bp, Homo sapiens
ttgaagtacagcataagggaa

SEQ ID NO: 1773567 - DNA, 23 bp, Homo sapiens
ttgaagtaggtggcttgagctag

SEQ ID NO: 1773568 - DNA, 21 bp, Homo sapiens
ttgaagtcagccacactgggc

SEQ ID NO: 1773569 - DNA, 13 bp, Homo sapiens
ttgaagtccagga

SEQ ID NO: 1773570 - DNA, 20 bp, Homo sapiens
ttgaagtctttaataaataa

SEQ ID NO: 1773571 - DNA, 18 bp, Homo sapiens
ttgaagtggccagatgag

SEQ ID NO: 1773572 - DNA, 16 bp, Homo sapiens
ttgaagtgtataatat

SEQ ID NO: 1773573 - DNA, 21 bp, Homo sapiens
ttgaagttcatggtgatcagt

SEQ ID NO: 1773574 - DNA, 19 bp, Homo sapiens
ttgaagttgggtgtttcca

SEQ ID NO: 1773575 - DNA, 22 bp, Homo sapiens
ttgaagttgggtgtttccagaa

SEQ ID NO: 1773576 - DNA, 14 bp, Homo sapiens
ttgaataaaagtgc

SEQ ID NO: 1773577 - DNA, 16 bp, Homo sapiens
ttgaataaaagtgcac

SEQ ID NO: 1773578 - DNA, 16 bp, Homo sapiens
ttgaataaactctccc

SEQ ID NO: 1773579 - DNA, 12 bp, Homo sapiens
ttgaataaataa

SEQ ID NO: 1773580 - DNA, 14 bp, Homo sapiens
ttgaataagagtga

SEQ ID NO: 1773581 - DNA, 18 bp, Homo sapiens
ttgaatacatttgtattt

SEQ ID NO: 1773582 - DNA, 16 bp, Homo sapiens
ttgaataccattaaaa

SEQ ID NO: 1773583 - DNA, 20 bp, Homo sapiens
ttgaatccaaatctgtcctc

SEQ ID NO: 1773584 - DNA, 17 bp, Homo sapiens
ttgaatccatgcttggg

SEQ ID NO: 1773585 - DNA, 21 bp, Homo sapiens
ttgaatctcataatttataca

SEQ ID NO: 1773586 - DNA, 15 bp, Homo sapiens
ttgaatgaataaaac

SEQ ID NO: 1773587 - DNA, 13 bp, Homo sapiens
ttgaatgctgcca

SEQ ID NO: 1773588 - DNA, 14 bp, Homo sapiens
ttgaatgctgccag

SEQ ID NO: 1773589 - DNA, 23 bp, Homo sapiens
ttgaatgctgccagtgtggagtg

SEQ ID NO: 1773590 - DNA, 15 bp, Homo sapiens
ttgaatgggtccatt

SEQ ID NO: 1773591 - DNA, 18 bp, Homo sapiens
ttgaatgtcacaaattga

SEQ ID NO: 1773592 - DNA, 20 bp, Homo sapiens
ttgaatgtccccattctata

SEQ ID NO: 1773593 - DNA, 13 bp, Homo sapiens
ttgaatgtgtcag

SEQ ID NO: 1773594 - DNA, 14 bp, Homo sapiens
ttgaatgttaagca

SEQ ID NO: 1773595 - DNA, 15 bp, Homo sapiens
ttgaatgttatatca

SEQ ID NO: 1773596 - DNA, 16 bp, Homo sapiens
ttgaattagtatttca

SEQ ID NO: 1773597 - DNA, 20 bp, Homo sapiens
ttgaattttgttctctggga

SEQ ID NO: 1773598 - DNA, 22 bp, Homo sapiens
ttgaattttgtttttattttca

SEQ ID NO: 1773599 - DNA, 19 bp, Homo sapiens
ttgaattttttttaacatt

SEQ ID NO: 1773600 - DNA, 12 bp, Homo sapiens
ttgacaacatct

SEQ ID NO: 1773601 - DNA, 13 bp, Homo sapiens
ttgacaacatctg

SEQ ID NO: 1773602 - DNA, 22 bp, Homo sapiens
ttgacaagctgacttggcactt

SEQ ID NO: 1773603 - DNA, 14 bp, Homo sapiens
ttgacaaggaaaat

SEQ ID NO: 1773604 - DNA, 18 bp, Homo sapiens
ttgacaataatttcaggt

SEQ ID NO: 1773605 - DNA, 19 bp, Homo sapiens
ttgacaattactcaggttt

SEQ ID NO: 1773606 - DNA, 19 bp, Homo sapiens
ttgacaattcctagataaa

SEQ ID NO: 1773607 - DNA, 17 bp, Homo sapiens
ttgacaattttgtctta

SEQ ID NO: 1773608 - DNA, 18 bp, Homo sapiens
ttgacacaagtggacctt

SEQ ID NO: 1773609 - DNA, 19 bp, Homo sapiens
ttgacaccattctcctgcc

SEQ ID NO: 1773610 - DNA, 13 bp, Homo sapiens
ttgacacctgtct

SEQ ID NO: 1773611 - DNA, 23 bp, Homo sapiens
ttgacactagcccaatgaaatga

SEQ ID NO: 1773612 - DNA, 18 bp, Homo sapiens
ttgacactatatctgtat

SEQ ID NO: 1773613 - DNA, 22 bp, Homo sapiens
ttgacactatatctgtatataa

SEQ ID NO: 1773614 - DNA, 22 bp, Homo sapiens
ttgacactgctctaacagccct

SEQ ID NO: 1773615 - DNA, 20 bp, Homo sapiens
ttgacagaatatgtttcaaa

SEQ ID NO: 1773616 - DNA, 14 bp, Homo sapiens
ttgacagtatattt

SEQ ID NO: 1773617 - DNA, 13 bp, Homo sapiens
ttgacatggaaat

SEQ ID NO: 1773618 - DNA, 16 bp, Homo sapiens
ttgacatggaaatgaa

SEQ ID NO: 1773619 - DNA, 15 bp, Homo sapiens
ttgacatgggtgggg

SEQ ID NO: 1773620 - DNA, 17 bp, Homo sapiens
ttgaccaagaactgcat

SEQ ID NO: 1773621 - DNA, 22 bp, Homo sapiens
ttgaccagatctttctcttccc

SEQ ID NO: 1773622 - DNA, 12 bp, Homo sapiens
ttgaccagctct

SEQ ID NO: 1773623 - DNA, 23 bp, Homo sapiens
ttgaccattctcaccctgtgaaa

SEQ ID NO: 1773624 - DNA, 18 bp, Homo sapiens
ttgacctcagctgcacat

SEQ ID NO: 1773625 - DNA, 23 bp, Homo sapiens
ttgacctcagctgcacattcctg

SEQ ID NO: 1773626 - DNA, 16 bp, Homo sapiens
ttgacctcatcattaa

SEQ ID NO: 1773627 - DNA, 13 bp, Homo sapiens
ttgacctgaggct

SEQ ID NO: 1773628 - DNA, 19 bp, Homo sapiens
ttgacctgaggctgtggtc

SEQ ID NO: 1773629 - DNA, 23 bp, Homo sapiens
ttgaccttctccctcactcctgc

SEQ ID NO: 1773630 - DNA, 14 bp, Homo sapiens
ttgacgaactggct

SEQ ID NO: 1773631 - DNA, 15 bp, Homo sapiens
ttgacgcttgcttag

SEQ ID NO: 1773632 - DNA, 20 bp, Homo sapiens
ttgacggatgattggattat

SEQ ID NO: 1773633 - DNA, 20 bp, Homo sapiens
ttgacgtttcttctttctag

SEQ ID NO: 1773634 - DNA, 22 bp, Homo sapiens
ttgactaactcaaatacacatt

SEQ ID NO: 1773635 - DNA, 14 bp, Homo sapiens
ttgactaattttac

SEQ ID NO: 1773636 - DNA, 15 bp, Homo sapiens
ttgactaattttaca

SEQ ID NO: 1773637 - DNA, 23 bp, Homo sapiens
ttgactcaggatttaaaaactgg

SEQ ID NO: 1773638 - DNA, 14 bp, Homo sapiens
ttgactcagttcca

SEQ ID NO: 1773639 - DNA, 22 bp, Homo sapiens
ttgactcatggcagctgtttct

SEQ ID NO: 1773640 - DNA, 21 bp, Homo sapiens
ttgactcttttgccattaaac

SEQ ID NO: 1773641 - DNA, 20 bp, Homo sapiens
ttgactgaaaaaaaaaaaga

SEQ ID NO: 1773642 - DNA, 19 bp, Homo sapiens
ttgactgatgattttcctt

SEQ ID NO: 1773643 - DNA, 20 bp, Homo sapiens
ttgactgcttttaaatgacc

SEQ ID NO: 1773644 - DNA, 18 bp, Homo sapiens
ttgactgtctttcctata

SEQ ID NO: 1773645 - DNA, 17 bp, Homo sapiens
ttgcattccagaatctt

SEQ ID NO: 1773646 - DNA, 17 bp, Homo sapiens
ttgcattcctttgtctt

SEQ ID NO: 1773647 - DNA, 17 bp, Homo sapiens
ttgcattgaatatatta

SEQ ID NO: 1773648 - DNA, 15 bp, Homo sapiens
ttgcattgtctaatg

SEQ ID NO: 1773649 - DNA, 15 bp, Homo sapiens
ttgcatttaaaacag

SEQ ID NO: 1773650 - DNA, 20 bp, Homo sapiens
ttgcatttaaaacagacact

SEQ ID NO: 1773651 - DNA, 14 bp, Homo sapiens
ttgcatttactttt

SEQ ID NO: 1773652 - DNA, 16 bp, Homo sapiens
ttgcatttacttttaa

SEQ ID NO: 1773653 - DNA, 13 bp, Homo sapiens
ttgcatttcagaa

SEQ ID NO: 1773654 - DNA, 20 bp, Homo sapiens
ttgcatttcagaaagccttt

SEQ ID NO: 1773655 - DNA, 20 bp, Homo sapiens
ttgcatttctcttcctaaat

SEQ ID NO: 1773656 - DNA, 17 bp, Homo sapiens
ttgcatttttattaaag

SEQ ID NO: 1773657 - DNA, 15 bp, Homo sapiens
ttgccaaaaaggggt

SEQ ID NO: 1773658 - DNA, 16 bp, Homo sapiens
ttgccaaaataccaga

SEQ ID NO: 1773659 - DNA, 22 bp, Homo sapiens
ttgccaaaataccagagccttc

SEQ ID NO: 1773660 - DNA, 13 bp, Homo sapiens
ttgccaaaattca

SEQ ID NO: 1773661 - DNA, 19 bp, Homo sapiens
ttgccaaaattcatttcta

SEQ ID NO: 1773662 - DNA, 21 bp, Homo sapiens
ttgccaaagtacagaatttga

SEQ ID NO: 1773663 - DNA, 16 bp, Homo sapiens
ttgccaaatatgtcct

SEQ ID NO: 1773664 - DNA, 17 bp, Homo sapiens
ttgccaaatatgtcctg

SEQ ID NO: 1773665 - DNA, 15 bp, Homo sapiens
ttgccaaattgctgc

SEQ ID NO: 1773666 - DNA, 17 bp, Homo sapiens
ttgccaaattgctgcat

SEQ ID NO: 1773667 - DNA, 21 bp, Homo sapiens
ttgccaaattgctgcatattt

SEQ ID NO: 1773668 - DNA, 17 bp, Homo sapiens
ttgccaactaagccctc

SEQ ID NO: 1773669 - DNA, 15 bp, Homo sapiens
ttgccaagaaaatga

SEQ ID NO: 1773670 - DNA, 21 bp, Homo sapiens
ttgccaagaaaatgaagggat

SEQ ID NO: 1773671 - DNA, 21 bp, Homo sapiens
ttgccaagttgctgtcactgt

SEQ ID NO: 1773672 - DNA, 11 bp, Homo sapiens
ttgccaataaa

SEQ ID NO: 1773673 - DNA, 22 bp, Homo sapiens
ttgccaataaagcttttggaag

SEQ ID NO: 1773674 - DNA, 23 bp, Homo sapiens
ttgccaatggtgtagctgtcctc

SEQ ID NO: 1773675 - DNA, 16 bp, Homo sapiens
ttgccactaattttag

SEQ ID NO: 1773676 - DNA, 21 bp, Homo sapiens
ttgccactaattttagtattc

SEQ ID NO: 1773677 - DNA, 14 bp, Homo sapiens
ttgccactctcctc

SEQ ID NO: 1773678 - DNA, 15 bp, Homo sapiens
ttgccactttggctt

SEQ ID NO: 1773679 - DNA, 21 bp, Homo sapiens
ttgccactttggcttctcctg

SEQ ID NO: 1773680 - DNA, 12 bp, Homo sapiens
ttgccagagcag

SEQ ID NO: 1773681 - DNA, 19 bp, Homo sapiens
ttgccagagcaggagcccc

SEQ ID NO: 1773682 - DNA, 23 bp, Homo sapiens
ttgccaggctggagtgcagtggc

SEQ ID NO: 1773683 - DNA, 22 bp, Homo sapiens
ttgccagggatgggcagcccaa

SEQ ID NO: 1773684 - DNA, 16 bp, Homo sapiens
ttgccagttttccctg

SEQ ID NO: 1773685 - DNA, 18 bp, Homo sapiens
ttgccatactttgtctga

SEQ ID NO: 1773686 - DNA, 23 bp, Homo sapiens
ttgccatgcaggaagaggcccac

SEQ ID NO: 1773687 - DNA, 20 bp, Homo sapiens
ttgccattctcttgcattgt

SEQ ID NO: 1773688 - DNA, 14 bp, Homo sapiens
ttgccatttctctg

SEQ ID NO: 1773689 - DNA, 23 bp, Homo sapiens
ttgcccacacactttccatctct

SEQ ID NO: 1773690 - DNA, 14 bp, Homo sapiens
ttgcccacccctca

SEQ ID NO: 1773691 - DNA, 21 bp, Homo sapiens
ttgcccacccctcactcccca

SEQ ID NO: 1773692 - DNA, 12 bp, Homo sapiens
ttgcccagagat

SEQ ID NO: 1773693 - DNA, 22 bp, Homo sapiens
ttgcccagagatgcctccaccg

SEQ ID NO: 1773694 - DNA, 20 bp, Homo sapiens
ttgcccaggctggagtgcag

SEQ ID NO: 1773695 - DNA, 18 bp, Homo sapiens
ttgcccaggctggtctca

SEQ ID NO: 1773696 - DNA, 18 bp, Homo sapiens
ttgcccagggctcagcct

SEQ ID NO: 1773697 - DNA, 20 bp, Homo sapiens
ttgcccagggctcagcctgg

SEQ ID NO: 1773698 - DNA, 18 bp, Homo sapiens
ttgcccagggtcctgtgc

SEQ ID NO: 1773699 - DNA, 13 bp, Homo sapiens
ttgcccatcctga

SEQ ID NO: 1773700 - DNA, 17 bp, Homo sapiens
ttgccccagacctggaa

SEQ ID NO: 1773701 - DNA, 21 bp, Homo sapiens
ttgccccatccagacctggct

SEQ ID NO: 1773702 - DNA, 20 bp, Homo sapiens
ttgcccccatggggtccttg

SEQ ID NO: 1773703 - DNA, 21 bp, Homo sapiens
ttgcccccgtgagccaatccc

SEQ ID NO: 1773704 - DNA, 23 bp, Homo sapiens
ttgccccggccccggccccagcc

SEQ ID NO: 1773705 - DNA, 17 bp, Homo sapiens
ttgcccgtcgtgtgctg

SEQ ID NO: 1773706 - DNA, 16 bp, Homo sapiens
ttgccctatgctgtgc

SEQ ID NO: 1773707 - DNA, 13 bp, Homo sapiens
ttgccctgttaaa

SEQ ID NO: 1773708 - DNA, 17 bp, Homo sapiens
ttgcccttcacagtgtt

SEQ ID NO: 1773709 - DNA, 14 bp, Homo sapiens
ttgcccttggagct

SEQ ID NO: 1773710 - DNA, 16 bp, Homo sapiens
ttgccgggcctgggcc

SEQ ID NO: 1773711 - DNA, 20 bp, Homo sapiens
ttgcctaaatccaaagaaaa

SEQ ID NO: 1773712 - DNA, 22 bp, Homo sapiens
ttgcctaaatcccaagaaatgg

SEQ ID NO: 1773713 - DNA, 23 bp, Homo sapiens
ttgcctaggcgattttgtctacc

SEQ ID NO: 1773714 - DNA, 17 bp, Homo sapiens
ttgcctatattttcctg

SEQ ID NO: 1773715 - DNA, 18 bp, Homo sapiens
ttgcctatattttcctga

SEQ ID NO: 1773716 - DNA, 17 bp, Homo sapiens
ttgcctcatattgtcct

SEQ ID NO: 1773717 - DNA, 21 bp, Homo sapiens
ttgcctcatttccctatcttc

SEQ ID NO: 1773718 - DNA, 17 bp, Homo sapiens
ttgcctccccatttccc

SEQ ID NO: 1773719 - DNA, 15 bp, Homo sapiens
ttgcctctgccctgg

SEQ ID NO: 1773720 - DNA, 19 bp, Homo sapiens
ttgcctctgccctggattg

SEQ ID NO: 1773721 - DNA, 12 bp, Homo sapiens
ttgcctctgtgc

SEQ ID NO: 1773722 - DNA, 14 bp, Homo sapiens
ttgcctctgtgctg

SEQ ID NO: 1773723 - DNA, 21 bp, Homo sapiens
ttgcctcttctttgtgccttt

SEQ ID NO: 1773724 - DNA, 15 bp, Homo sapiens
ttgcctgaggctgta

SEQ ID NO: 1773725 - DNA, 12 bp, Homo sapiens
ttgcctgcaaga

SEQ ID NO: 1773726 - DNA, 16 bp, Homo sapiens
ttgcctgcacccttcc

SEQ ID NO: 1773727 - DNA, 18 bp, Homo sapiens
ttgcctgcacccttccct

SEQ ID NO: 1773728 - DNA, 13 bp, Homo sapiens
ttgcctgcagggc

SEQ ID NO: 1773729 - DNA, 23 bp, Homo sapiens
ttgcctgcaggtcagttgtaata

SEQ ID NO: 1773730 - DNA, 13 bp, Homo sapiens
ttgcctggactga

SEQ ID NO: 1773731 - DNA, 22 bp, Homo sapiens
ttgcctggactgaccacaccaa

SEQ ID NO: 1773732 - DNA, 23 bp, Homo sapiens
ttgcctggactgaccacaccaac

SEQ ID NO: 1773733 - DNA, 11 bp, Homo sapiens
ttgcctggctg

SEQ ID NO: 1773734 - DNA, 15 bp, Homo sapiens
ttgcctggctgtgga

SEQ ID NO: 1773735 - DNA, 19 bp, Homo sapiens
ttgcctggctgtggaggcc

SEQ ID NO: 1773736 - DNA, 22 bp, Homo sapiens
ttgcctggctgtggaggcctga

SEQ ID NO: 1773737 - DNA, 23 bp, Homo sapiens
ttgcctgggggcttttgccactc

SEQ ID NO: 1773738 - DNA, 17 bp, Homo sapiens
ttgcctgtctgtttgct

SEQ ID NO: 1773739 - DNA, 11 bp, Homo sapiens
ttgcctgttct

SEQ ID NO: 1773740 - DNA, 17 bp, Homo sapiens
ttgcctgttctgcttcg

SEQ ID NO: 1773741 - DNA, 22 bp, Homo sapiens
ttgcctgttggctgctgcggct

SEQ ID NO: 1773742 - DNA, 16 bp, Homo sapiens
ttgccttaactggagc

SEQ ID NO: 1773743 - DNA, 19 bp, Homo sapiens
ttgccttatgggctgaagt

SEQ ID NO: 1773744 - DNA, 11 bp, Homo sapiens
ttgccttcagc

SEQ ID NO: 1773745 - DNA, 18 bp, Homo sapiens
ttgccttctactcccctt

SEQ ID NO: 1773746 - DNA, 19 bp, Homo sapiens
ttgccttctctgcccacag

SEQ ID NO: 1773747 - DNA, 20 bp, Homo sapiens
ttgccttgggctgctcctca

SEQ ID NO: 1773748 - DNA, 16 bp, Homo sapiens
ttgcctttcgaggcct

SEQ ID NO: 1773749 - DNA, 19 bp, Homo sapiens
ttgccttttaatttttaat

SEQ ID NO: 1773750 - DNA, 18 bp, Homo sapiens
ttgcgacggagagaaaaa

SEQ ID NO: 1773751 - DNA, 14 bp, Homo sapiens
ttgcgtcctgcaga

SEQ ID NO: 1773752 - DNA, 15 bp, Homo sapiens
ttgctaaaaaataaa

SEQ ID NO: 1773753 - DNA, 12 bp, Homo sapiens
ttgctaaagcac

SEQ ID NO: 1773754 - DNA, 14 bp, Homo sapiens
ttgctaaagcactt

SEQ ID NO: 1773755 - DNA, 12 bp, Homo sapiens
ttgctaactggg

SEQ ID NO: 1773756 - DNA, 13 bp, Homo sapiens
ttgctaactgggt

SEQ ID NO: 1773757 - DNA, 21 bp, Homo sapiens
ttgctaactgggttaaatatt

SEQ ID NO: 1773758 - DNA, 15 bp, Homo sapiens
ttgctaactggttaa

SEQ ID NO: 1773759 - DNA, 16 bp, Homo sapiens
ttgctaagtgtgctta

SEQ ID NO: 1773760 - DNA, 21 bp, Homo sapiens
ttggcctggggtgcatctcct

SEQ ID NO: 1773761 - DNA, 22 bp, Homo sapiens
ttggcctggggtgcatctcctc

SEQ ID NO: 1773762 - DNA, 19 bp, Homo sapiens
ttggcctgtagagttgctg

SEQ ID NO: 1773763 - DNA, 23 bp, Homo sapiens
ttggcctgtctcatccccagggg

SEQ ID NO: 1773764 - DNA, 19 bp, Homo sapiens
ttggcctgtttgatgtatg

SEQ ID NO: 1773765 - DNA, 14 bp, Homo sapiens
ttggccttaagaac

SEQ ID NO: 1773766 - DNA, 14 bp, Homo sapiens
ttggccttgcagct

SEQ ID NO: 1773767 - DNA, 18 bp, Homo sapiens
ttggcgaatctcaaaatt

SEQ ID NO: 1773768 - DNA, 20 bp, Homo sapiens
ttggctaactatatttgctt

SEQ ID NO: 1773769 - DNA, 21 bp, Homo sapiens
ttggctattgaagatgctgcc

SEQ ID NO: 1773770 - DNA, 13 bp, Homo sapiens
ttggctcaatcct

SEQ ID NO: 1773771 - DNA, 16 bp, Homo sapiens
ttggctcacactgaga

SEQ ID NO: 1773772 - DNA, 12 bp, Homo sapiens
ttggctcaggca

SEQ ID NO: 1773773 - DNA, 17 bp, Homo sapiens
ttggctcgaatctctgt

SEQ ID NO: 1773774 - DNA, 21 bp, Homo sapiens
ttggctcgaatctctgtgcct

SEQ ID NO: 1773775 - DNA, 22 bp, Homo sapiens
ttggctgaaattctcctggagg

SEQ ID NO: 1773776 - DNA, 16 bp, Homo sapiens
ttggctgacccctctg

SEQ ID NO: 1773777 - DNA, 14 bp, Homo sapiens
ttggctgcaggaag

SEQ ID NO: 1773778 - DNA, 16 bp, Homo sapiens
ttggctggtagcagca

SEQ ID NO: 1773779 - DNA, 19 bp, Homo sapiens
ttggctggtagcagcaggc

SEQ ID NO: 1773780 - DNA, 17 bp, Homo sapiens
ttggctggttaatggga

SEQ ID NO: 1773781 - DNA, 14 bp, Homo sapiens
ttggctgttccaga

SEQ ID NO: 1773782 - DNA, 18 bp, Homo sapiens
ttggcttaaagggatgga

SEQ ID NO: 1773783 - DNA, 16 bp, Homo sapiens
ttggcttaatcatttt

SEQ ID NO: 1773784 - DNA, 16 bp, Homo sapiens
ttggcttcctccgtcc

SEQ ID NO: 1773785 - DNA, 16 bp, Homo sapiens
ttggcttctcctgtga

SEQ ID NO: 1773786 - DNA, 21 bp, Homo sapiens
ttggcttctgatttttctctt

SEQ ID NO: 1773787 - DNA, 16 bp, Homo sapiens
ttggcttgccattttt

SEQ ID NO: 1773788 - DNA, 17 bp, Homo sapiens
ttggctttatgcacatt

SEQ ID NO: 1773789 - DNA, 14 bp, Homo sapiens
ttggctttgtgctt

SEQ ID NO: 1773790 - DNA, 20 bp, Homo sapiens
ttgggaaagaagttgctaag

SEQ ID NO: 1773791 - DNA, 17 bp, Homo sapiens
ttgggaagagcttagaa

SEQ ID NO: 1773792 - DNA, 18 bp, Homo sapiens
ttgggaagagcttagaaa

SEQ ID NO: 1773793 - DNA, 19 bp, Homo sapiens
ttgggaatatccatgtact

SEQ ID NO: 1773794 - DNA, 23 bp, Homo sapiens
ttgggaatgaggaaaattcttaa

SEQ ID NO: 1773795 - DNA, 18 bp, Homo sapiens
ttgggaatggatcctgga

SEQ ID NO: 1773796 - DNA, 22 bp, Homo sapiens
ttgggacccaaaacacaggaag

SEQ ID NO: 1773797 - DNA, 16 bp, Homo sapiens
ttgggagatatatttt

SEQ ID NO: 1773798 - DNA, 11 bp, Homo sapiens
ttgggagcact

SEQ ID NO: 1773799 - DNA, 14 bp, Homo sapiens
ttgggagctctgct

SEQ ID NO: 1773800 - DNA, 17 bp, Homo sapiens
ttgggagcttgggaatg

SEQ ID NO: 1773801 - DNA, 15 bp, Homo sapiens
ttgggaggccaaggc

SEQ ID NO: 1773802 - DNA, 19 bp, Homo sapiens
ttgggaggtgcgtgttcag

SEQ ID NO: 1773803 - DNA, 16 bp, Homo sapiens
ttgggatattaaaaca

SEQ ID NO: 1773804 - DNA, 17 bp, Homo sapiens
ttgggatattaaaacac

SEQ ID NO: 1773805 - DNA, 16 bp, Homo sapiens
ttgggatcaataggaa

SEQ ID NO: 1773806 - DNA, 21 bp, Homo sapiens
ttgggattcctgacccaggcc

SEQ ID NO: 1773807 - DNA, 14 bp, Homo sapiens
ttgggattgggggc

SEQ ID NO: 1773808 - DNA, 16 bp, Homo sapiens
ttgggattgggggctg

SEQ ID NO: 1773809 - DNA, 23 bp, Homo sapiens
ttgggcatccacccagtgctgcc

SEQ ID NO: 1773810 - DNA, 22 bp, Homo sapiens
ttgggcccagctgggctctgcc

SEQ ID NO: 1773811 - DNA, 16 bp, Homo sapiens
ttgggcccccagcctg

SEQ ID NO: 1773812 - DNA, 12 bp, Homo sapiens
ttgggccctgca

SEQ ID NO: 1773813 - DNA, 15 bp, Homo sapiens
ttgggccctgcacag

SEQ ID NO: 1773814 - DNA, 19 bp, Homo sapiens
ttgggccctgcattggcct

SEQ ID NO: 1773815 - DNA, 15 bp, Homo sapiens
ttgggccgaaagaga

SEQ ID NO: 1773816 - DNA, 14 bp, Homo sapiens
ttgggcctaaataa

SEQ ID NO: 1773817 - DNA, 19 bp, Homo sapiens
ttgggcctcaggctctgca

SEQ ID NO: 1773818 - DNA, 20 bp, Homo sapiens
ttgggcctcaggctctgcac

SEQ ID NO: 1773819 - DNA, 22 bp, Homo sapiens
ttgggcctccatgccccagctc

SEQ ID NO: 1773820 - DNA, 18 bp, Homo sapiens
ttgggcctctcctgccct

SEQ ID NO: 1773821 - DNA, 23 bp, Homo sapiens
ttgggcctctcctgccctctgct

SEQ ID NO: 1773822 - DNA, 16 bp, Homo sapiens
ttgggcctgctccaga

SEQ ID NO: 1773823 - DNA, 17 bp, Homo sapiens
ttgggcctgctccagac

SEQ ID NO: 1773824 - DNA, 22 bp, Homo sapiens
ttgggcctggccagtcttcctc

SEQ ID NO: 1773825 - DNA, 18 bp, Homo sapiens
ttgggcggctgagagccc

SEQ ID NO: 1773826 - DNA, 21 bp, Homo sapiens
ttgggcggctgagagccccag

SEQ ID NO: 1773827 - DNA, 19 bp, Homo sapiens
ttgggctactggcagctcc

SEQ ID NO: 1773828 - DNA, 20 bp, Homo sapiens
ttgggctactggcagctcct

SEQ ID NO: 1773829 - DNA, 24 bp, Homo sapiens
ttgggctactggcagctcctctcc

SEQ ID NO: 1773830 - DNA, 14 bp, Homo sapiens
ttgggctcagggtt

SEQ ID NO: 1773831 - DNA, 20 bp, Homo sapiens
ttgggctcagggttggccat

SEQ ID NO: 1773832 - DNA, 20 bp, Homo sapiens
ttgggctcctggctgccagg

SEQ ID NO: 1773833 - DNA, 17 bp, Homo sapiens
ttgggctgacccagcat

SEQ ID NO: 1773834 - DNA, 22 bp, Homo sapiens
ttgggctgtgcggatctctgga

SEQ ID NO: 1773835 - DNA, 18 bp, Homo sapiens
ttgggcttgacacctgtc

SEQ ID NO: 1773836 - DNA, 21 bp, Homo sapiens
ttggggagaaataaattttgt

SEQ ID NO: 1773837 - DNA, 13 bp, Homo sapiens
ttggggaggggcg

SEQ ID NO: 1773838 - DNA, 17 bp, Homo sapiens
ttggggagttaagacct

SEQ ID NO: 1773839 - DNA, 16 bp, Homo sapiens
ttggggcatcctggat

SEQ ID NO: 1773840 - DNA, 12 bp, Homo sapiens
ttggggcctggc

SEQ ID NO: 1773841 - DNA, 14 bp, Homo sapiens
ttggggcctggctt

SEQ ID NO: 1773842 - DNA, 15 bp, Homo sapiens
ttggggcctggcttg

SEQ ID NO: 1773843 - DNA, 21 bp, Homo sapiens
ttggggcctggcttgctccag

SEQ ID NO: 1773844 - DNA, 16 bp, Homo sapiens
ttggggctatttgtgt

SEQ ID NO: 1773845 - DNA, 21 bp, Homo sapiens
ttggggctttcccaggagaaa

SEQ ID NO: 1773846 - DNA, 17 bp, Homo sapiens
ttgggggacagccttca

SEQ ID NO: 1773847 - DNA, 14 bp, Homo sapiens
ttgggggagggaag

SEQ ID NO: 1773848 - DNA, 12 bp, Homo sapiens
ttgggggctggt

SEQ ID NO: 1773849 - DNA, 14 bp, Homo sapiens
ttgggggctggtgc

SEQ ID NO: 1773850 - DNA, 13 bp, Homo sapiens
ttgggggggtggc

SEQ ID NO: 1773851 - DNA, 20 bp, Homo sapiens
ttgggggggtggccgctgag

SEQ ID NO: 1773852 - DNA, 17 bp, Homo sapiens
ttggggggtgtgctgac

SEQ ID NO: 1773853 - DNA, 14 bp, Homo sapiens
ttggggtctgaccc

SEQ ID NO: 1773854 - DNA, 15 bp, Homo sapiens
ttggggtctgacccc

SEQ ID NO: 1773855 - DNA, 18 bp, Homo sapiens
ttggggtgtggggtgggg

SEQ ID NO: 1773856 - DNA, 15 bp, Homo sapiens
ttggggttgtgttgt

SEQ ID NO: 1773857 - DNA, 17 bp, Homo sapiens
ttgggtaaaatactttt

SEQ ID NO: 1773858 - DNA, 14 bp, Homo sapiens
ttgggtaggcggga

SEQ ID NO: 1773859 - DNA, 21 bp, Homo sapiens
ttgggtatcctgcccagtgtt

SEQ ID NO: 1773860 - DNA, 17 bp, Homo sapiens
ttgggtatgtctacctg

SEQ ID NO: 1773861 - DNA, 15 bp, Homo sapiens
ttgggtcctgggcag

SEQ ID NO: 1773862 - DNA, 19 bp, Homo sapiens
ttgggtcctgggcaggtgg

SEQ ID NO: 1773863 - DNA, 21 bp, Homo sapiens
ttgggtggggggcattgagta

SEQ ID NO: 1773864 - DNA, 20 bp, Homo sapiens
ttgggtgtaacaggtctcct

SEQ ID NO: 1773865 - DNA, 20 bp, Homo sapiens
ttgggtgtctccttaagctg

SEQ ID NO: 1773866 - DNA, 15 bp, Homo sapiens
ttggtaatgcttgga

SEQ ID NO: 1773867 - DNA, 19 bp, Homo sapiens
ttggtagatgcatgacttg

SEQ ID NO: 1773868 - DNA, 23 bp, Homo sapiens
ttggtaggagttttgttccagag

SEQ ID NO: 1773869 - DNA, 15 bp, Homo sapiens
ttggtagttaacaca

SEQ ID NO: 1773870 - DNA, 13 bp, Homo sapiens
ttggtcaaggcca

SEQ ID NO: 1773871 - DNA, 20 bp, Homo sapiens
ttggtcaaggccacctctgc

SEQ ID NO: 1773872 - DNA, 22 bp, Homo sapiens
ttggtcaaggccacctctgcct

SEQ ID NO: 1773873 - DNA, 15 bp, Homo sapiens
ttggtcagcttttgt

SEQ ID NO: 1773874 - DNA, 15 bp, Homo sapiens
tttaaaaaaataaca

SEQ ID NO: 1773875 - DNA, 15 bp, Homo sapiens
tttaaaaaaataatt

SEQ ID NO: 1773876 - DNA, 15 bp, Homo sapiens
tttaaaaaaatttga

SEQ ID NO: 1773877 - DNA, 20 bp, Homo sapiens
tttaaaaaaatttttgcaaa

SEQ ID NO: 1773878 - DNA, 19 bp, Homo sapiens
tttaaaaaactctttggtg

SEQ ID NO: 1773879 - DNA, 15 bp, Homo sapiens
tttaaaaaataacat

SEQ ID NO: 1773880 - DNA, 16 bp, Homo sapiens
tttaaaaaatattttc

SEQ ID NO: 1773881 - DNA, 17 bp, Homo sapiens
tttaaaaaatattttct

SEQ ID NO: 1773882 - DNA, 18 bp, Homo sapiens
tttaaaaacatagaaaaa

SEQ ID NO: 1773883 - DNA, 20 bp, Homo sapiens
tttaaaaaggaaatttgttt

SEQ ID NO: 1773884 - DNA, 18 bp, Homo sapiens
tttaaaaataagtcaaca

SEQ ID NO: 1773885 - DNA, 23 bp, Homo sapiens
tttaaaaatacagatagatatat

SEQ ID NO: 1773886 - DNA, 16 bp, Homo sapiens
tttaaaaatatttcag

SEQ ID NO: 1773887 - DNA, 13 bp, Homo sapiens
tttaaaaatgttt

SEQ ID NO: 1773888 - DNA, 23 bp, Homo sapiens
tttaaaaattagcctaagatata

SEQ ID NO: 1773889 - DNA, 12 bp, Homo sapiens
tttaaaaattta

SEQ ID NO: 1773890 - DNA, 13 bp, Homo sapiens
tttaaaacacatg

SEQ ID NO: 1773891 - DNA, 16 bp, Homo sapiens
tttaaaacacatgttt

SEQ ID NO: 1773892 - DNA, 15 bp, Homo sapiens
tttaaaacatgtaat

SEQ ID NO: 1773893 - DNA, 16 bp, Homo sapiens
tttaaaactgttattt

SEQ ID NO: 1773894 - DNA, 14 bp, Homo sapiens
tttaaaagaagctt

SEQ ID NO: 1773895 - DNA, 17 bp, Homo sapiens
tttaaaaggaaagaaaa

SEQ ID NO: 1773896 - DNA, 20 bp, Homo sapiens
tttaaaaggtattttgaata

SEQ ID NO: 1773897 - DNA, 20 bp, Homo sapiens
tttaaaagttactcctttta

SEQ ID NO: 1773898 - DNA, 24 bp, Homo sapiens
tttaaaataaattcctacaactta

SEQ ID NO: 1773899 - DNA, 19 bp, Homo sapiens
tttaaaatacacactcaaa

SEQ ID NO: 1773900 - DNA, 23 bp, Homo sapiens
tttaaaatagaaattttgtaaga

SEQ ID NO: 1773901 - DNA, 13 bp, Homo sapiens
tttaaaatatatg

SEQ ID NO: 1773902 - DNA, 16 bp, Homo sapiens
tttaaaatatttatct

SEQ ID NO: 1773903 - DNA, 21 bp, Homo sapiens
tttaaaatgcaggtgaacttt

SEQ ID NO: 1773904 - DNA, 12 bp, Homo sapiens
tttaaaatgtaa

SEQ ID NO: 1773905 - DNA, 17 bp, Homo sapiens
tttaaaattaagtagaa

SEQ ID NO: 1773906 - DNA, 22 bp, Homo sapiens
tttaaaattaagtagaacaaaa

SEQ ID NO: 1773907 - DNA, 18 bp, Homo sapiens
tttaaaattgatttttct

SEQ ID NO: 1773908 - DNA, 16 bp, Homo sapiens
tttaaaattgtgatgt

SEQ ID NO: 1773909 - DNA, 15 bp, Homo sapiens
tttaaaatttagagt

SEQ ID NO: 1773910 - DNA, 13 bp, Homo sapiens
tttaaacacacag

SEQ ID NO: 1773911 - DNA, 23 bp, Homo sapiens
tttaaacacacagatacacacac

SEQ ID NO: 1773912 - DNA, 16 bp, Homo sapiens
tttaaacatagaaagt

SEQ ID NO: 1773913 - DNA, 17 bp, Homo sapiens
tttaaacccaagtgctg

SEQ ID NO: 1773914 - DNA, 12 bp, Homo sapiens
tttaaagaaagt

SEQ ID NO: 1773915 - DNA, 13 bp, Homo sapiens
tttaaagaaagtg

SEQ ID NO: 1773916 - DNA, 18 bp, Homo sapiens
tttaaagaagaaacgtct

SEQ ID NO: 1773917 - DNA, 13 bp, Homo sapiens
tttaaagaataaa

SEQ ID NO: 1773918 - DNA, 14 bp, Homo sapiens
tttaaagaataaag

SEQ ID NO: 1773919 - DNA, 10 bp, Homo sapiens
tttaaagaca

SEQ ID NO: 1773920 - DNA, 17 bp, Homo sapiens
tttaaagaccctcctat

SEQ ID NO: 1773921 - DNA, 15 bp, Homo sapiens
tttaaagagtctaga

SEQ ID NO: 1773922 - DNA, 16 bp, Homo sapiens
tttaaagagtctagat

SEQ ID NO: 1773923 - DNA, 17 bp, Homo sapiens
tttaaagagtctagatt

SEQ ID NO: 1773924 - DNA, 15 bp, Homo sapiens
tttaaagccttctgg

SEQ ID NO: 1773925 - DNA, 22 bp, Homo sapiens
tttaaaggggcagaaaaactct

SEQ ID NO: 1773926 - DNA, 17 bp, Homo sapiens
tttaaagtacctgtagt

SEQ ID NO: 1773927 - DNA, 15 bp, Homo sapiens
tttaaagtatgcatt

SEQ ID NO: 1773928 - DNA, 18 bp, Homo sapiens
tttaaagtctcagtttct

SEQ ID NO: 1773929 - DNA, 13 bp, Homo sapiens
tttaaagttctta

SEQ ID NO: 1773930 - DNA, 17 bp, Homo sapiens
tttaaagttcttatttt

SEQ ID NO: 1773931 - DNA, 23 bp, Homo sapiens
tttaaagttcttattttagtata

SEQ ID NO: 1773932 - DNA, 16 bp, Homo sapiens
tttaaataaaagcaca

SEQ ID NO: 1773933 - DNA, 17 bp, Homo sapiens
tttaaataaaagcacaa

SEQ ID NO: 1773934 - DNA, 19 bp, Homo sapiens
tttaaataaaagcacaagt

SEQ ID NO: 1773935 - DNA, 12 bp, Homo sapiens
tttaaataaaat

SEQ ID NO: 1773936 - DNA, 14 bp, Homo sapiens
tttaaataaaccta

SEQ ID NO: 1773937 - DNA, 13 bp, Homo sapiens
tttaaataaagtt

SEQ ID NO: 1773938 - DNA, 12 bp, Homo sapiens
tttaaataattg

SEQ ID NO: 1773939 - DNA, 20 bp, Homo sapiens
tttaaatacccatcttcatt

SEQ ID NO: 1773940 - DNA, 18 bp, Homo sapiens
tttaaatataaaaatggg

SEQ ID NO: 1773941 - DNA, 18 bp, Homo sapiens
tttaaatataattctgta

SEQ ID NO: 1773942 - DNA, 21 bp, Homo sapiens
tttaaatataattctgtaaat

SEQ ID NO: 1773943 - DNA, 15 bp, Homo sapiens
tttaaatattaagca

SEQ ID NO: 1773944 - DNA, 13 bp, Homo sapiens
tttaaatattttc

SEQ ID NO: 1773945 - DNA, 13 bp, Homo sapiens
tttaaatcaagga

SEQ ID NO: 1773946 - DNA, 14 bp, Homo sapiens
tttaaatcaaggaa

SEQ ID NO: 1773947 - DNA, 15 bp, Homo sapiens
tttaaatcaaggaaa

SEQ ID NO: 1773948 - DNA, 15 bp, Homo sapiens
tttaaatgcaacagt

SEQ ID NO: 1773949 - DNA, 18 bp, Homo sapiens
tttaaatgcataaatgca

SEQ ID NO: 1773950 - DNA, 18 bp, Homo sapiens
tttaaatggttctgtgct

SEQ ID NO: 1773951 - DNA, 11 bp, Homo sapiens
tttaaatgtga

SEQ ID NO: 1773952 - DNA, 11 bp, Homo sapiens
tttaaattgca

SEQ ID NO: 1773953 - DNA, 18 bp, Homo sapiens
tttaaattttacccttta

SEQ ID NO: 1773954 - DNA, 22 bp, Homo sapiens
tttaaattttatgtcatagaaa

SEQ ID NO: 1773955 - DNA, 18 bp, Homo sapiens
tttaaatttttttcctta

SEQ ID NO: 1773956 - DNA, 19 bp, Homo sapiens
tttaacaaaagatttgttt

SEQ ID NO: 1773957 - DNA, 15 bp, Homo sapiens
tttaacaaaagcaag

SEQ ID NO: 1773958 - DNA, 20 bp, Homo sapiens
tttaacaatgacaagatgtt

SEQ ID NO: 1773959 - DNA, 14 bp, Homo sapiens
tttaacacttaaat

SEQ ID NO: 1773960 - DNA, 20 bp, Homo sapiens
tttaacacttaaatttcttg

SEQ ID NO: 1773961 - DNA, 15 bp, Homo sapiens
tttaacactttgtat

SEQ ID NO: 1773962 - DNA, 13 bp, Homo sapiens
tttaacagaaatt

SEQ ID NO: 1773963 - DNA, 12 bp, Homo sapiens
tttaacattatt

SEQ ID NO: 1773964 - DNA, 19 bp, Homo sapiens
tttaaccaaaacatgtctc

SEQ ID NO: 1773965 - DNA, 21 bp, Homo sapiens
tttaaccatggtgcttgttaa

SEQ ID NO: 1773966 - DNA, 21 bp, Homo sapiens
tttaaccattttaacctagat

SEQ ID NO: 1773967 - DNA, 23 bp, Homo sapiens
tttaaccggtaagagtttcagtt

SEQ ID NO: 1773968 - DNA, 21 bp, Homo sapiens
tttaacctaatatcacttaaa

SEQ ID NO: 1773969 - DNA, 14 bp, Homo sapiens
tttaaccttaaaat

SEQ ID NO: 1773970 - DNA, 16 bp, Homo sapiens
tttaacggcagtgtca

SEQ ID NO: 1773971 - DNA, 22 bp, Homo sapiens
tttaactcataatttttgcaga

SEQ ID NO: 1773972 - DNA, 19 bp, Homo sapiens
tttaactgacaagccatct

SEQ ID NO: 1773973 - DNA, 11 bp, Homo sapiens
tttaactgact

SEQ ID NO: 1773974 - DNA, 21 bp, Homo sapiens
tttaactgccaatccttaaat

SEQ ID NO: 1773975 - DNA, 14 bp, Homo sapiens
tttaactgccttgt

SEQ ID NO: 1773976 - DNA, 12 bp, Homo sapiens
tttaactgtgga

SEQ ID NO: 1773977 - DNA, 17 bp, Homo sapiens
tttaactgtggatattg

SEQ ID NO: 1773978 - DNA, 19 bp, Homo sapiens
tttaactttatcacattat

SEQ ID NO: 1773979 - DNA, 14 bp, Homo sapiens
tttaactttctaga

SEQ ID NO: 1773980 - DNA, 17 bp, Homo sapiens
tttaacttttttttctc

SEQ ID NO: 1773981 - DNA, 19 bp, Homo sapiens
tttaagaaaaacatgtcat

SEQ ID NO: 1773982 - DNA, 20 bp, Homo sapiens
tttaagaaaaacatgtcatg

SEQ ID NO: 1773983 - DNA, 16 bp, Homo sapiens
tttaagaaaacatttc

SEQ ID NO: 1773984 - DNA, 23 bp, Homo sapiens
tttaagaaatctggcccagggtg

SEQ ID NO: 1773985 - DNA, 18 bp, Homo sapiens
tttaagaatatttttaga

SEQ ID NO: 1773986 - DNA, 15 bp, Homo sapiens
tttaagaattgagta

SEQ ID NO: 1773987 - DNA, 19 bp, Homo sapiens
tttaagatatatacatgga

SEQ ID NO: 1773988 - DNA, 15 bp, Homo sapiens
tttaagatccagaaa

SEQ ID NO: 1773989 - DNA, 12 bp, Homo sapiens
tttaagatgtga

SEQ ID NO: 1773990 - DNA, 23 bp, Homo sapiens
tttccccacccccctctctttct

SEQ ID NO: 1773991 - DNA, 20 bp, Homo sapiens
tttccccagaggctcccaat

SEQ ID NO: 1773992 - DNA, 22 bp, Homo sapiens
tttccccagaggctcccaatca

SEQ ID NO: 1773993 - DNA, 15 bp, Homo sapiens
tttccccagccacag

SEQ ID NO: 1773994 - DNA, 21 bp, Homo sapiens
tttccccaggggaaaatgaag

SEQ ID NO: 1773995 - DNA, 21 bp, Homo sapiens
tttcccccacagttttaataa

SEQ ID NO: 1773996 - DNA, 22 bp, Homo sapiens
tttcccccagcaacgcccctcc

SEQ ID NO: 1773997 - DNA, 23 bp, Homo sapiens
tttcccccagcaacgcccctcca

SEQ ID NO: 1773998 - DNA, 13 bp, Homo sapiens
tttccccctcctc

SEQ ID NO: 1773999 - DNA, 23 bp, Homo sapiens
tttcccccttcccatttcttccc

SEQ ID NO: 1774000 - DNA, 16 bp, Homo sapiens
tttcccccttctacat

SEQ ID NO: 1774001 - DNA, 16 bp, Homo sapiens
tttcccctagcttact

SEQ ID NO: 1774002 - DNA, 12 bp, Homo sapiens
tttcccctggcc

SEQ ID NO: 1774003 - DNA, 15 bp, Homo sapiens
tttccctactcccca

SEQ ID NO: 1774004 - DNA, 12 bp, Homo sapiens
tttccctgagga

SEQ ID NO: 1774005 - DNA, 18 bp, Homo sapiens
tttccctgcaccactctc

SEQ ID NO: 1774006 - DNA, 16 bp, Homo sapiens
tttcccttcagtaccc

SEQ ID NO: 1774007 - DNA, 20 bp, Homo sapiens
tttcccttcagtaccctctc

SEQ ID NO: 1774008 - DNA, 15 bp, Homo sapiens
tttcccttgctgtac

SEQ ID NO: 1774009 - DNA, 18 bp, Homo sapiens
tttccctttagctgtgtt

SEQ ID NO: 1774010 - DNA, 19 bp, Homo sapiens
tttccctttagctgtgtta

SEQ ID NO: 1774011 - DNA, 17 bp, Homo sapiens
tttcctacagaaatact

SEQ ID NO: 1774012 - DNA, 23 bp, Homo sapiens
tttcctacagaaatactgctctg

SEQ ID NO: 1774013 - DNA, 14 bp, Homo sapiens
tttcctactgtcct

SEQ ID NO: 1774014 - DNA, 17 bp, Homo sapiens
tttcctagccctctcac

SEQ ID NO: 1774015 - DNA, 19 bp, Homo sapiens
tttcctcagcttatctctt

SEQ ID NO: 1774016 - DNA, 14 bp, Homo sapiens
tttcctcatgtaac

SEQ ID NO: 1774017 - DNA, 15 bp, Homo sapiens
tttcctcatgtaaca

SEQ ID NO: 1774018 - DNA, 17 bp, Homo sapiens
tttcctcatgtaacatt

SEQ ID NO: 1774019 - DNA, 20 bp, Homo sapiens
tttcctcatgtaacattggt

SEQ ID NO: 1774020 - DNA, 19 bp, Homo sapiens
tttcctcattcctgaaaga

SEQ ID NO: 1774021 - DNA, 16 bp, Homo sapiens
tttcctccccctgcaa

SEQ ID NO: 1774022 - DNA, 19 bp, Homo sapiens
tttcctctattgatgtaca

SEQ ID NO: 1774023 - DNA, 23 bp, Homo sapiens
tttcctctgagttctgtacttca

SEQ ID NO: 1774024 - DNA, 23 bp, Homo sapiens
tttcctctgttcaaagctgcctg

SEQ ID NO: 1774025 - DNA, 16 bp, Homo sapiens
tttcctctgttcacaa

SEQ ID NO: 1774026 - DNA, 22 bp, Homo sapiens
tttcctcttctattttgtaaac

SEQ ID NO: 1774027 - DNA, 17 bp, Homo sapiens
tttcctgaacctggaaa

SEQ ID NO: 1774028 - DNA, 23 bp, Homo sapiens
tttcctgacagaaggactcaggt

SEQ ID NO: 1774029 - DNA, 20 bp, Homo sapiens
tttcctgatagcatatgaca

SEQ ID NO: 1774030 - DNA, 16 bp, Homo sapiens
tttcctgatgcccctg

SEQ ID NO: 1774031 - DNA, 12 bp, Homo sapiens
tttcctgcatgt

SEQ ID NO: 1774032 - DNA, 17 bp, Homo sapiens
tttcctgcccttcctca

SEQ ID NO: 1774033 - DNA, 16 bp, Homo sapiens
tttcctgcttccctgt

SEQ ID NO: 1774034 - DNA, 14 bp, Homo sapiens
tttcctggaagcag

SEQ ID NO: 1774035 - DNA, 20 bp, Homo sapiens
tttcctggaattgccagctg

SEQ ID NO: 1774036 - DNA, 20 bp, Homo sapiens
tttcctggacactcagacct

SEQ ID NO: 1774037 - DNA, 22 bp, Homo sapiens
tttcctgtggcataaattgcat

SEQ ID NO: 1774038 - DNA, 13 bp, Homo sapiens
tttcctgtttgaa

SEQ ID NO: 1774039 - DNA, 22 bp, Homo sapiens
tttcctgtttgaaatatcatgt

SEQ ID NO: 1774040 - DNA, 23 bp, Homo sapiens
tttccttaaactgtgtggactgt

SEQ ID NO: 1774041 - DNA, 16 bp, Homo sapiens
tttccttatttgcctt

SEQ ID NO: 1774042 - DNA, 18 bp, Homo sapiens
tttccttatttgccttct

SEQ ID NO: 1774043 - DNA, 14 bp, Homo sapiens
tttccttcccaggc

SEQ ID NO: 1774044 - DNA, 22 bp, Homo sapiens
tttccttccttcctcctttcct

SEQ ID NO: 1774045 - DNA, 15 bp, Homo sapiens
tttccttctcatctg

SEQ ID NO: 1774046 - DNA, 18 bp, Homo sapiens
tttccttctgttaaaatg

SEQ ID NO: 1774047 - DNA, 22 bp, Homo sapiens
tttccttgaaaataaaaagaga

SEQ ID NO: 1774048 - DNA, 14 bp, Homo sapiens
tttcctttatgtga

SEQ ID NO: 1774049 - DNA, 17 bp, Homo sapiens
tttcctttatgtgaatt

SEQ ID NO: 1774050 - DNA, 23 bp, Homo sapiens
tttcctttatgtgaatttttaag

SEQ ID NO: 1774051 - DNA, 14 bp, Homo sapiens
tttcctttgtcctt

SEQ ID NO: 1774052 - DNA, 15 bp, Homo sapiens
tttcctttttcttcg

SEQ ID NO: 1774053 - DNA, 17 bp, Homo sapiens
tttcctttttgacactg

SEQ ID NO: 1774054 - DNA, 18 bp, Homo sapiens
tttcctttttgacactga

SEQ ID NO: 1774055 - DNA, 17 bp, Homo sapiens
tttcgactggtccagct

SEQ ID NO: 1774056 - DNA, 20 bp, Homo sapiens
tttcgactggtccagctctg

SEQ ID NO: 1774057 - DNA, 13 bp, Homo sapiens
tttcgaggcctga

SEQ ID NO: 1774058 - DNA, 15 bp, Homo sapiens
tttcgccttaaactc

SEQ ID NO: 1774059 - DNA, 17 bp, Homo sapiens
tttcgccttaaactctg

SEQ ID NO: 1774060 - DNA, 16 bp, Homo sapiens
tttcgtaatagctcag

SEQ ID NO: 1774061 - DNA, 13 bp, Homo sapiens
tttcgtggggagg

SEQ ID NO: 1774062 - DNA, 19 bp, Homo sapiens
tttcgttaacattgaccaa

SEQ ID NO: 1774063 - DNA, 17 bp, Homo sapiens
tttctaaaaataaagct

SEQ ID NO: 1774064 - DNA, 19 bp, Homo sapiens
tttctaaaagctttcatgt

SEQ ID NO: 1774065 - DNA, 13 bp, Homo sapiens
tttctaaacaaga

SEQ ID NO: 1774066 - DNA, 15 bp, Homo sapiens
tttctaaactgtttt

SEQ ID NO: 1774067 - DNA, 21 bp, Homo sapiens
tttctaaactgttttcatgtg

SEQ ID NO: 1774068 - DNA, 21 bp, Homo sapiens
tttctaaataaaaatatgtaa

SEQ ID NO: 1774069 - DNA, 21 bp, Homo sapiens
tttctaaatgttggaatgtta

SEQ ID NO: 1774070 - DNA, 13 bp, Homo sapiens
tttctaaatgttt

SEQ ID NO: 1774071 - DNA, 17 bp, Homo sapiens
tttctaacagtccttgc

SEQ ID NO: 1774072 - DNA, 14 bp, Homo sapiens
tttctaaccttgaa

SEQ ID NO: 1774073 - DNA, 15 bp, Homo sapiens
tttctaaccttgaat

SEQ ID NO: 1774074 - DNA, 19 bp, Homo sapiens
tttctaaccttgaatgctg

SEQ ID NO: 1774075 - DNA, 23 bp, Homo sapiens
tttctaaccttgaatgctgccag

SEQ ID NO: 1774076 - DNA, 16 bp, Homo sapiens
tttctaactttcttta

SEQ ID NO: 1774077 - DNA, 11 bp, Homo sapiens
tttctaagaga

SEQ ID NO: 1774078 - DNA, 16 bp, Homo sapiens
tttctaagagaagcaa

SEQ ID NO: 1774079 - DNA, 14 bp, Homo sapiens
tttctaagattcta

SEQ ID NO: 1774080 - DNA, 17 bp, Homo sapiens
tttctaagattctaaag

SEQ ID NO: 1774081 - DNA, 20 bp, Homo sapiens
tttctaaggtaacaagatga

SEQ ID NO: 1774082 - DNA, 20 bp, Homo sapiens
tttctaatccttttccttat

SEQ ID NO: 1774083 - DNA, 20 bp, Homo sapiens
tttctaatggaatggtttgg

SEQ ID NO: 1774084 - DNA, 12 bp, Homo sapiens
tttctaattgta

SEQ ID NO: 1774085 - DNA, 22 bp, Homo sapiens
tttctacacagtaaaaacttgt

SEQ ID NO: 1774086 - DNA, 21 bp, Homo sapiens
tttctacattcagattatatg

SEQ ID NO: 1774087 - DNA, 15 bp, Homo sapiens
tttctaccctagcca

SEQ ID NO: 1774088 - DNA, 17 bp, Homo sapiens
tttctaccctagccatt

SEQ ID NO: 1774089 - DNA, 13 bp, Homo sapiens
tttctagaaagag

SEQ ID NO: 1774090 - DNA, 13 bp, Homo sapiens
tttctagactcaa

SEQ ID NO: 1774091 - DNA, 16 bp, Homo sapiens
tttctagacttgtgct

SEQ ID NO: 1774092 - DNA, 16 bp, Homo sapiens
tttctagagacacatt

SEQ ID NO: 1774093 - DNA, 20 bp, Homo sapiens
tttctagcaattttctttgt

SEQ ID NO: 1774094 - DNA, 22 bp, Homo sapiens
tttctagcaattttctttgttt

SEQ ID NO: 1774095 - DNA, 22 bp, Homo sapiens
tttctagctataacaactctat

SEQ ID NO: 1774096 - DNA, 16 bp, Homo sapiens
tttctagttctttcct

SEQ ID NO: 1774097 - DNA, 14 bp, Homo sapiens
tttctagtttcagt

SEQ ID NO: 1774098 - DNA, 15 bp, Homo sapiens
tttctataaatcagt

SEQ ID NO: 1774099 - DNA, 17 bp, Homo sapiens
tttctatactgtttgta

SEQ ID NO: 1774100 - DNA, 14 bp, Homo sapiens
tttctatgacaaat

SEQ ID NO: 1774101 - DNA, 17 bp, Homo sapiens
tttctatgtcattttta

SEQ ID NO: 1774102 - DNA, 21 bp, Homo sapiens
tttctatgtcatttttaatgt

SEQ ID NO: 1774103 - DNA, 20 bp, Homo sapiens
tttctattaatatcaactct

SEQ ID NO: 1774104 - DNA, 20 bp, Homo sapiens
tttgtataaaagtgtgaaat

SEQ ID NO: 1774105 - DNA, 14 bp, Homo sapiens
tttgtataaaatct

SEQ ID NO: 1774106 - DNA, 17 bp, Homo sapiens
tttgtataaaatctgaa

SEQ ID NO: 1774107 - DNA, 14 bp, Homo sapiens
tttgtataaataat

SEQ ID NO: 1774108 - DNA, 13 bp, Homo sapiens
tttgtataattgg

SEQ ID NO: 1774109 - DNA, 21 bp, Homo sapiens
tttgtataattggatttccta

SEQ ID NO: 1774110 - DNA, 19 bp, Homo sapiens
tttgtatataggcttctca

SEQ ID NO: 1774111 - DNA, 20 bp, Homo sapiens
tttgtatattacaacattta

SEQ ID NO: 1774112 - DNA, 15 bp, Homo sapiens
tttgtatctttatgc

SEQ ID NO: 1774113 - DNA, 14 bp, Homo sapiens
tttgtatctttctt

SEQ ID NO: 1774114 - DNA, 21 bp, Homo sapiens
tttgtatgaaattataatctg

SEQ ID NO: 1774115 - DNA, 14 bp, Homo sapiens
tttgtatgagatgg

SEQ ID NO: 1774116 - DNA, 16 bp, Homo sapiens
tttgtatgagatggtt

SEQ ID NO: 1774117 - DNA, 18 bp, Homo sapiens
tttgtatgagatggttaa

SEQ ID NO: 1774118 - DNA, 16 bp, Homo sapiens
tttgtatgcactttgt

SEQ ID NO: 1774119 - DNA, 13 bp, Homo sapiens
tttgtatgtctgt

SEQ ID NO: 1774120 - DNA, 14 bp, Homo sapiens
tttgtatgtctgtg

SEQ ID NO: 1774121 - DNA, 17 bp, Homo sapiens
tttgtatgtctgtgtat

SEQ ID NO: 1774122 - DNA, 12 bp, Homo sapiens
tttgtatgtgtg

SEQ ID NO: 1774123 - DNA, 13 bp, Homo sapiens
tttgtattaataa

SEQ ID NO: 1774124 - DNA, 19 bp, Homo sapiens
tttgtattaataaagcatt

SEQ ID NO: 1774125 - DNA, 17 bp, Homo sapiens
tttgtattacttaggtt

SEQ ID NO: 1774126 - DNA, 17 bp, Homo sapiens
tttgtattctgtcttca

SEQ ID NO: 1774127 - DNA, 17 bp, Homo sapiens
tttgtatttctctattt

SEQ ID NO: 1774128 - DNA, 13 bp, Homo sapiens
tttgtattttcaa

SEQ ID NO: 1774129 - DNA, 20 bp, Homo sapiens
tttgtatttttcatctttaa

SEQ ID NO: 1774130 - DNA, 20 bp, Homo sapiens
tttgtattttttatttacat

SEQ ID NO: 1774131 - DNA, 17 bp, Homo sapiens
tttgtcaaactgtagaa

SEQ ID NO: 1774132 - DNA, 11 bp, Homo sapiens
tttgtcaatga

SEQ ID NO: 1774133 - DNA, 15 bp, Homo sapiens
tttgtcagaaaagag

SEQ ID NO: 1774134 - DNA, 14 bp, Homo sapiens
tttgtcagcatctg

SEQ ID NO: 1774135 - DNA, 18 bp, Homo sapiens
tttgtcagtttatcttaa

SEQ ID NO: 1774136 - DNA, 17 bp, Homo sapiens
tttgtcatcagccacca

SEQ ID NO: 1774137 - DNA, 15 bp, Homo sapiens
tttgtccaaataaat

SEQ ID NO: 1774138 - DNA, 15 bp, Homo sapiens
tttgtcccatttcct

SEQ ID NO: 1774139 - DNA, 17 bp, Homo sapiens
tttgtccccagggcccc

SEQ ID NO: 1774140 - DNA, 20 bp, Homo sapiens
tttgtccccagggcccctcc

SEQ ID NO: 1774141 - DNA, 18 bp, Homo sapiens
tttgtcccccaacttgag

SEQ ID NO: 1774142 - DNA, 21 bp, Homo sapiens
tttgtcccccaacttgagatg

SEQ ID NO: 1774143 - DNA, 12 bp, Homo sapiens
tttgtcctcaaa

SEQ ID NO: 1774144 - DNA, 17 bp, Homo sapiens
tttgtccttttatttct

SEQ ID NO: 1774145 - DNA, 17 bp, Homo sapiens
tttgtcctttttcactt

SEQ ID NO: 1774146 - DNA, 16 bp, Homo sapiens
tttgtctatgaagttg

SEQ ID NO: 1774147 - DNA, 17 bp, Homo sapiens
tttgtctatgaagttgc

SEQ ID NO: 1774148 - DNA, 20 bp, Homo sapiens
tttgtctatgaagttgctgt

SEQ ID NO: 1774149 - DNA, 18 bp, Homo sapiens
tttgtctattttaaaata

SEQ ID NO: 1774150 - DNA, 13 bp, Homo sapiens
tttgtctgtctcc

SEQ ID NO: 1774151 - DNA, 21 bp, Homo sapiens
tttgtctgtttgtttcaagaa

SEQ ID NO: 1774152 - DNA, 12 bp, Homo sapiens
tttgtcttaagt

SEQ ID NO: 1774153 - DNA, 17 bp, Homo sapiens
tttgtcttaagtgtttc

SEQ ID NO: 1774154 - DNA, 19 bp, Homo sapiens
tttgtcttatatatatttc

SEQ ID NO: 1774155 - DNA, 20 bp, Homo sapiens
tttgtcttatatatatttct

SEQ ID NO: 1774156 - DNA, 16 bp, Homo sapiens
tttgtcttgaatgtct

SEQ ID NO: 1774157 - DNA, 14 bp, Homo sapiens
tttgtcttgtactt

SEQ ID NO: 1774158 - DNA, 23 bp, Homo sapiens
tttgtcttgtacttctgtgttca

SEQ ID NO: 1774159 - DNA, 15 bp, Homo sapiens
tttgtctttaaacag

SEQ ID NO: 1774160 - DNA, 13 bp, Homo sapiens
tttgtctttttgt

SEQ ID NO: 1774161 - DNA, 12 bp, Homo sapiens
tttgtgaactgg

SEQ ID NO: 1774162 - DNA, 18 bp, Homo sapiens
tttgtgaagtattcacaa

SEQ ID NO: 1774163 - DNA, 22 bp, Homo sapiens
tttgtgagcatgggtgtgccct

SEQ ID NO: 1774164 - DNA, 18 bp, Homo sapiens
tttgtgagtcaatacata

SEQ ID NO: 1774165 - DNA, 23 bp, Homo sapiens
tttgtgatattaaatttcaaatg

SEQ ID NO: 1774166 - DNA, 17 bp, Homo sapiens
tttgtgatgaacatatt

SEQ ID NO: 1774167 - DNA, 20 bp, Homo sapiens
tttgtgatgaatctacattt

SEQ ID NO: 1774168 - DNA, 15 bp, Homo sapiens
tttgtgattcaatct

SEQ ID NO: 1774169 - DNA, 21 bp, Homo sapiens
tttgtgcaaacatggagaaat

SEQ ID NO: 1774170 - DNA, 15 bp, Homo sapiens
tttgtgcaaagccaa

SEQ ID NO: 1774171 - DNA, 15 bp, Homo sapiens
tttgtgcagaatctc

SEQ ID NO: 1774172 - DNA, 13 bp, Homo sapiens
tttgtgcattctt

SEQ ID NO: 1774173 - DNA, 15 bp, Homo sapiens
tttgtgcattctttg

SEQ ID NO: 1774174 - DNA, 23 bp, Homo sapiens
tttgtgcattctttggtaatttt

SEQ ID NO: 1774175 - DNA, 13 bp, Homo sapiens
tttgtgccagagg

SEQ ID NO: 1774176 - DNA, 15 bp, Homo sapiens
tttgtgcctttggcc

SEQ ID NO: 1774177 - DNA, 14 bp, Homo sapiens
tttgtgctagaaat

SEQ ID NO: 1774178 - DNA, 21 bp, Homo sapiens
tttgtgctccattttttcttc

SEQ ID NO: 1774179 - DNA, 21 bp, Homo sapiens
tttgtggacgagagggctgtg

SEQ ID NO: 1774180 - DNA, 18 bp, Homo sapiens
tttgtggcagtggccagg

SEQ ID NO: 1774181 - DNA, 12 bp, Homo sapiens
tttgtggcctca

SEQ ID NO: 1774182 - DNA, 22 bp, Homo sapiens
tttgtggctgttgagatgtgct

SEQ ID NO: 1774183 - DNA, 19 bp, Homo sapiens
tttgtgggtttctctgtgc

SEQ ID NO: 1774184 - DNA, 17 bp, Homo sapiens
tttgtggtaatctacac

SEQ ID NO: 1774185 - DNA, 16 bp, Homo sapiens
tttgtggtttggaata

SEQ ID NO: 1774186 - DNA, 18 bp, Homo sapiens
tttgtgtaaatttctcaa

SEQ ID NO: 1774187 - DNA, 14 bp, Homo sapiens
tttgtgtatgtact

SEQ ID NO: 1774188 - DNA, 23 bp, Homo sapiens
tttgtgtattctgtggattctat

SEQ ID NO: 1774189 - DNA, 18 bp, Homo sapiens
tttgtgtcctccaggagc

SEQ ID NO: 1774190 - DNA, 21 bp, Homo sapiens
tttgtgtgagacttaaaacat

SEQ ID NO: 1774191 - DNA, 13 bp, Homo sapiens
tttgtgtgattga

SEQ ID NO: 1774192 - DNA, 13 bp, Homo sapiens
tttgtgtgatttc

SEQ ID NO: 1774193 - DNA, 15 bp, Homo sapiens
tttgtgtgatttcct

SEQ ID NO: 1774194 - DNA, 14 bp, Homo sapiens
tttgtgtgtatttg

SEQ ID NO: 1774195 - DNA, 16 bp, Homo sapiens
tttgtgtgtatttgct

SEQ ID NO: 1774196 - DNA, 20 bp, Homo sapiens
tttgtgtgtatttgtattaa

SEQ ID NO: 1774197 - DNA, 15 bp, Homo sapiens
tttgtgtgtgtgtca

SEQ ID NO: 1774198 - DNA, 23 bp, Homo sapiens
tttgtgttgtcttttttatgtta

SEQ ID NO: 1774199 - DNA, 20 bp, Homo sapiens
tttgtgttgttgttgctgct

SEQ ID NO: 1774200 - DNA, 14 bp, Homo sapiens
tttgtgttttcttg

SEQ ID NO: 1774201 - DNA, 16 bp, Homo sapiens
tttgtgtttttctata

SEQ ID NO: 1774202 - DNA, 16 bp, Homo sapiens
tttgttactgattcaa

SEQ ID NO: 1774203 - DNA, 14 bp, Homo sapiens
tttgttactgtatt

SEQ ID NO: 1774204 - DNA, 16 bp, Homo sapiens
tttgttactgtatttt

SEQ ID NO: 1774205 - DNA, 14 bp, Homo sapiens
tttgttagcaaaga

SEQ ID NO: 1774206 - DNA, 17 bp, Homo sapiens
tttgttaggattttcac

SEQ ID NO: 1774207 - DNA, 22 bp, Homo sapiens
tttgttaggattttcacattct

SEQ ID NO: 1774208 - DNA, 17 bp, Homo sapiens
tttgttataccatttcc

SEQ ID NO: 1774209 - DNA, 19 bp, Homo sapiens
tttgttatagaatactttt

SEQ ID NO: 1774210 - DNA, 20 bp, Homo sapiens
tttgttatatataataaata

SEQ ID NO: 1774211 - DNA, 17 bp, Homo sapiens
tttgttcaagttttggg

SEQ ID NO: 1774212 - DNA, 16 bp, Homo sapiens
tttgttcaatgttcca

SEQ ID NO: 1774213 - DNA, 21 bp, Homo sapiens
tttgttcaatgttccattctt

SEQ ID NO: 1774214 - DNA, 13 bp, Homo sapiens
tttgttcatctgt

SEQ ID NO: 1774215 - DNA, 12 bp, Homo sapiens
tttgttccactt

SEQ ID NO: 1774216 - DNA, 21 bp, Homo sapiens
tttgttccccattccttaatt

SEQ ID NO: 1774217 - DNA, 13 bp, Homo sapiens
tttgttcccctcc

SEQ ID NO: 1774218 - DNA, 15 bp, Homo sapiens
tttgttcccctcctc

SEQ ID NO: 1774219 - DNA, 10 bp, Homo sapiens
tttgttcctg

SEQ ID NO: 1774220 - DNA, 18 bp, Homo sapiens
ttttgcattccagaatct

SEQ ID NO: 1774221 - DNA, 18 bp, Homo sapiens
ttttgcatttaaaacaga

SEQ ID NO: 1774222 - DNA, 13 bp, Homo sapiens
ttttgcatttatg

SEQ ID NO: 1774223 - DNA, 18 bp, Homo sapiens
ttttgccaagaatatagt

SEQ ID NO: 1774224 - DNA, 19 bp, Homo sapiens
ttttgccagtattatgcat

SEQ ID NO: 1774225 - DNA, 13 bp, Homo sapiens
ttttgccttcatt

SEQ ID NO: 1774226 - DNA, 17 bp, Homo sapiens
ttttgcgtacacagaga

SEQ ID NO: 1774227 - DNA, 14 bp, Homo sapiens
ttttgctgaattca

SEQ ID NO: 1774228 - DNA, 15 bp, Homo sapiens
ttttgcttgcaatgt

SEQ ID NO: 1774229 - DNA, 16 bp, Homo sapiens
ttttgcttgcaatgta

SEQ ID NO: 1774230 - DNA, 13 bp, Homo sapiens
ttttgcttttgtt

SEQ ID NO: 1774231 - DNA, 23 bp, Homo sapiens
ttttggaagagacaaagatttct

SEQ ID NO: 1774232 - DNA, 20 bp, Homo sapiens
ttttggagaaatgtcataaa

SEQ ID NO: 1774233 - DNA, 22 bp, Homo sapiens
ttttggagaaatgtcataaatt

SEQ ID NO: 1774234 - DNA, 18 bp, Homo sapiens
ttttggagattataataa

SEQ ID NO: 1774235 - DNA, 20 bp, Homo sapiens
ttttggatttggagagaaat

SEQ ID NO: 1774236 - DNA, 15 bp, Homo sapiens
ttttggccaaagtgt

SEQ ID NO: 1774237 - DNA, 18 bp, Homo sapiens
ttttggcctgtttgatgt

SEQ ID NO: 1774238 - DNA, 18 bp, Homo sapiens
ttttggctctttcagaga

SEQ ID NO: 1774239 - DNA, 18 bp, Homo sapiens
ttttgggaagttaaaggg

SEQ ID NO: 1774240 - DNA, 11 bp, Homo sapiens
ttttgggactt

SEQ ID NO: 1774241 - DNA, 16 bp, Homo sapiens
ttttggggagccagaa

SEQ ID NO: 1774242 - DNA, 19 bp, Homo sapiens
ttttggggttgtgttgtca

SEQ ID NO: 1774243 - DNA, 18 bp, Homo sapiens
ttttgggtgtttttcatg

SEQ ID NO: 1774244 - DNA, 16 bp, Homo sapiens
ttttggtggtgaaatt

SEQ ID NO: 1774245 - DNA, 13 bp, Homo sapiens
ttttgtaaaacaa

SEQ ID NO: 1774246 - DNA, 13 bp, Homo sapiens
ttttgtaaaactg

SEQ ID NO: 1774247 - DNA, 19 bp, Homo sapiens
ttttgtaaacgacaagaat

SEQ ID NO: 1774248 - DNA, 21 bp, Homo sapiens
ttttgtaaacgacaagaataa

SEQ ID NO: 1774249 - DNA, 18 bp, Homo sapiens
ttttgtaaactcaaaata

SEQ ID NO: 1774250 - DNA, 21 bp, Homo sapiens
ttttgtaaactgtatcaaatc

SEQ ID NO: 1774251 - DNA, 21 bp, Homo sapiens
ttttgtaaagatgccgggttt

SEQ ID NO: 1774252 - DNA, 13 bp, Homo sapiens
ttttgtaaagatt

SEQ ID NO: 1774253 - DNA, 20 bp, Homo sapiens
ttttgtaaagatttctgttc

SEQ ID NO: 1774254 - DNA, 13 bp, Homo sapiens
ttttgtaaagttt

SEQ ID NO: 1774255 - DNA, 13 bp, Homo sapiens
ttttgtaaatgta

SEQ ID NO: 1774256 - DNA, 19 bp, Homo sapiens
ttttgtaaatgtactggta

SEQ ID NO: 1774257 - DNA, 19 bp, Homo sapiens
ttttgtaactacaaagctt

SEQ ID NO: 1774258 - DNA, 11 bp, Homo sapiens
ttttgtaagaa

SEQ ID NO: 1774259 - DNA, 14 bp, Homo sapiens
ttttgtaattgtgt

SEQ ID NO: 1774260 - DNA, 15 bp, Homo sapiens
ttttgtaattgtgta

SEQ ID NO: 1774261 - DNA, 16 bp, Homo sapiens
ttttgtaattgtgtaa

SEQ ID NO: 1774262 - DNA, 14 bp, Homo sapiens
ttttgtacaattac

SEQ ID NO: 1774263 - DNA, 16 bp, Homo sapiens
ttttgtacatattgtt

SEQ ID NO: 1774264 - DNA, 18 bp, Homo sapiens
ttttgtactttggaacga

SEQ ID NO: 1774265 - DNA, 18 bp, Homo sapiens
ttttgtagcactgacaga

SEQ ID NO: 1774266 - DNA, 14 bp, Homo sapiens
ttttgtagttttat

SEQ ID NO: 1774267 - DNA, 18 bp, Homo sapiens
ttttgtagttttatttgt

SEQ ID NO: 1774268 - DNA, 21 bp, Homo sapiens
ttttgtagttttatttgtatt

SEQ ID NO: 1774269 - DNA, 16 bp, Homo sapiens
ttttgtataaaataga

SEQ ID NO: 1774270 - DNA, 14 bp, Homo sapiens
ttttgtataaaatc

SEQ ID NO: 1774271 - DNA, 14 bp, Homo sapiens
ttttgtatctacat

SEQ ID NO: 1774272 - DNA, 14 bp, Homo sapiens
ttttgtatgtgtgt

SEQ ID NO: 1774273 - DNA, 21 bp, Homo sapiens
ttttgtattacatctaatgct

SEQ ID NO: 1774274 - DNA, 18 bp, Homo sapiens
ttttgtattctttactaa

SEQ ID NO: 1774275 - DNA, 18 bp, Homo sapiens
ttttgtatttttaatggg

SEQ ID NO: 1774276 - DNA, 18 bp, Homo sapiens
ttttgtcactttttctga

SEQ ID NO: 1774277 - DNA, 16 bp, Homo sapiens
ttttgtccccagggcc

SEQ ID NO: 1774278 - DNA, 14 bp, Homo sapiens
ttttgtctgagcct

SEQ ID NO: 1774279 - DNA, 16 bp, Homo sapiens
ttttgtcttaagtgtt

SEQ ID NO: 1774280 - DNA, 17 bp, Homo sapiens
ttttgtctttaaataga

SEQ ID NO: 1774281 - DNA, 24 bp, Homo sapiens
ttttgtgaaatgaaaacatgtaat

SEQ ID NO: 1774282 - DNA, 19 bp, Homo sapiens
ttttgtgaatttgggtagg

SEQ ID NO: 1774283 - DNA, 15 bp, Homo sapiens
ttttgtgatgaacat

SEQ ID NO: 1774284 - DNA, 23 bp, Homo sapiens
ttttgtgatgaatctacatttgt

SEQ ID NO: 1774285 - DNA, 12 bp, Homo sapiens
ttttgtgcattc

SEQ ID NO: 1774286 - DNA, 13 bp, Homo sapiens
ttttgtgcattct

SEQ ID NO: 1774287 - DNA, 21 bp, Homo sapiens
ttttgtgggctggttgctgta

SEQ ID NO: 1774288 - DNA, 16 bp, Homo sapiens
ttttgtggtttggaat

SEQ ID NO: 1774289 - DNA, 17 bp, Homo sapiens
ttttgtgtatgtactta

SEQ ID NO: 1774290 - DNA, 13 bp, Homo sapiens
ttttgtgtattct

SEQ ID NO: 1774291 - DNA, 21 bp, Homo sapiens
ttttgtgtgagacttaaaaca

SEQ ID NO: 1774292 - DNA, 13 bp, Homo sapiens
ttttgtgtttcta

SEQ ID NO: 1774293 - DNA, 16 bp, Homo sapiens
ttttgttacctttatg

SEQ ID NO: 1774294 - DNA, 18 bp, Homo sapiens
ttttgttcaatgttccat

SEQ ID NO: 1774295 - DNA, 15 bp, Homo sapiens
ttttgttcacaacct

SEQ ID NO: 1774296 - DNA, 13 bp, Homo sapiens
ttttgttcagaat

SEQ ID NO: 1774297 - DNA, 21 bp, Homo sapiens
ttttgttccacaagttaaata

SEQ ID NO: 1774298 - DNA, 13 bp, Homo sapiens
ttttgttgtgtgt

SEQ ID NO: 1774299 - DNA, 13 bp, Homo sapiens
ttttgttgttcct

SEQ ID NO: 1774300 - DNA, 17 bp, Homo sapiens
ttttgtttaaaactcag

SEQ ID NO: 1774301 - DNA, 17 bp, Homo sapiens
ttttgtttataaaaaac

SEQ ID NO: 1774302 - DNA, 12 bp, Homo sapiens
ttttgtttcaga

SEQ ID NO: 1774303 - DNA, 18 bp, Homo sapiens
ttttgtttggcaaggaaa

SEQ ID NO: 1774304 - DNA, 22 bp, Homo sapiens
ttttgttttaaaactggacctg

SEQ ID NO: 1774305 - DNA, 16 bp, Homo sapiens
ttttgtttttgcatga

SEQ ID NO: 1774306 - DNA, 21 bp, Homo sapiens
tttttaaaaaaaaaaacaaag

SEQ ID NO: 1774307 - DNA, 14 bp, Homo sapiens
tttttaaaaaaact

SEQ ID NO: 1774308 - DNA, 23 bp, Homo sapiens
tttttaaaaaaatttttgcaaat

SEQ ID NO: 1774309 - DNA, 19 bp, Homo sapiens
tttttaaaatatattgctg

SEQ ID NO: 1774310 - DNA, 19 bp, Homo sapiens
tttttaaaatgtcaagaca

SEQ ID NO: 1774311 - DNA, 15 bp, Homo sapiens
tttttaaaatttaga

SEQ ID NO: 1774312 - DNA, 12 bp, Homo sapiens
tttttaaagcaa

SEQ ID NO: 1774313 - DNA, 16 bp, Homo sapiens
tttttaaagcaagtca

SEQ ID NO: 1774314 - DNA, 13 bp, Homo sapiens
tttttaaagcctt

SEQ ID NO: 1774315 - DNA, 18 bp, Homo sapiens
tttttaaataaaagcaca

SEQ ID NO: 1774316 - DNA, 20 bp, Homo sapiens
tttttaaatgtaaagatatt

SEQ ID NO: 1774317 - DNA, 12 bp, Homo sapiens
tttttaaattat

SEQ ID NO: 1774318 - DNA, 20 bp, Homo sapiens
tttttaaattcttactctgg

SEQ ID NO: 1774319 - DNA, 18 bp, Homo sapiens
tttttaacaatctaacaa

SEQ ID NO: 1774320 - DNA, 10 bp, Homo sapiens
tttttaacac

SEQ ID NO: 1774321 - DNA, 16 bp, Homo sapiens
tttttaagaaaacatt

SEQ ID NO: 1774322 - DNA, 16 bp, Homo sapiens
tttttaagaatatctg

SEQ ID NO: 1774323 - DNA, 13 bp, Homo sapiens
tttttaagaattg

SEQ ID NO: 1774324 - DNA, 18 bp, Homo sapiens
tttttaagagaattagac

SEQ ID NO: 1774325 - DNA, 23 bp, Homo sapiens
tttttaagggttatcttagatgt

SEQ ID NO: 1774326 - DNA, 18 bp, Homo sapiens
tttttaagtaagactttt

SEQ ID NO: 1774327 - DNA, 16 bp, Homo sapiens
tttttaagtatttata

SEQ ID NO: 1774328 - DNA, 22 bp, Homo sapiens
tttttaagttgtcaaagaagct

SEQ ID NO: 1774329 - DNA, 23 bp, Homo sapiens
tttttaatagtcattccaaatat

SEQ ID NO: 1774330 - DNA, 13 bp, Homo sapiens
tttttaatcatga

SEQ ID NO: 1774331 - DNA, 14 bp, Homo sapiens
tttttacaagatgt

SEQ ID NO: 1774332 - DNA, 19 bp, Homo sapiens
tttttacaagttttaaata

SEQ ID NO: 1774333 - DNA, 22 bp, Homo sapiens
tttttacagcattgtctttgct

SEQ ID NO: 1774334 - DNA, 19 bp, Homo sapiens
tttttacagctgtgttatt

SEQ ID NO: 1774335 - DNA, 22 bp, Homo sapiens
tttttacctaccacagtgtctg

SEQ ID NO: 1774336 - DNA, 12 bp, Homo sapiens
aggtttgtatat

SEQ ID NO: 1774337 - DNA, 21 bp, Homo sapiens
aggtttgtcccagtcagaaat

SEQ ID NO: 1774338 - DNA, 17 bp, Homo sapiens
aggtttgtcctggtcat

SEQ ID NO: 1774339 - DNA, 18 bp, Homo sapiens
aggtttgttttcagcact

SEQ ID NO: 1774340 - DNA, 15 bp, Homo sapiens
aggtttgttttcatt

SEQ ID NO: 1774341 - DNA, 22 bp, Homo sapiens
aggtttgttttcattaaattag

SEQ ID NO: 1774342 - DNA, 18 bp, Homo sapiens
aggttttaaaagccttgg

SEQ ID NO: 1774343 - DNA, 15 bp, Homo sapiens
aggttttaaagtgat

SEQ ID NO: 1774344 - DNA, 17 bp, Homo sapiens
aggttttaaagtgatta

SEQ ID NO: 1774345 - DNA, 15 bp, Homo sapiens
aggttttaaatctgc

SEQ ID NO: 1774346 - DNA, 18 bp, Homo sapiens
aggttttaagctaaaatg

SEQ ID NO: 1774347 - DNA, 20 bp, Homo sapiens
aggttttaagctaaaatgtt

SEQ ID NO: 1774348 - DNA, 14 bp, Homo sapiens
aggttttaagttgt

SEQ ID NO: 1774349 - DNA, 19 bp, Homo sapiens
aggttttaagttgtttgca

SEQ ID NO: 1774350 - DNA, 14 bp, Homo sapiens
aggttttaggttct

SEQ ID NO: 1774351 - DNA, 18 bp, Homo sapiens
aggttttaggttctaaag

SEQ ID NO: 1774352 - DNA, 23 bp, Homo sapiens
aggttttaggttctaaagttcta

SEQ ID NO: 1774353 - DNA, 23 bp, Homo sapiens
aggtttttaaacactaaaatata

SEQ ID NO: 1774354 - DNA, 19 bp, Homo sapiens
aggtttttcatctgaaaag

SEQ ID NO: 1774355 - DNA, 23 bp, Homo sapiens
aggtttttcctactgtcctcaga

SEQ ID NO: 1774356 - DNA, 22 bp, Homo sapiens
aggtttttgcttctccagtggt

SEQ ID NO: 1774357 - DNA, 16 bp, Homo sapiens
aggtttttgtaaagat

SEQ ID NO: 1774358 - DNA, 22 bp, Homo sapiens
aggtttttgtaaagatttctgt

SEQ ID NO: 1774359 - DNA, 19 bp, Homo sapiens
aggtttttgtttgtttcct

SEQ ID NO: 1774360 - DNA, 18 bp, Homo sapiens
agtaaaaaattaaagccc

SEQ ID NO: 1774361 - DNA, 19 bp, Homo sapiens
agtaaaaagaaaacaaaac

SEQ ID NO: 1774362 - DNA, 16 bp, Homo sapiens
agtaaaacattttatt

SEQ ID NO: 1774363 - DNA, 18 bp, Homo sapiens
agtaaaagtggtctctgc

SEQ ID NO: 1774364 - DNA, 22 bp, Homo sapiens
agtaaaagtggtctctgctggg

SEQ ID NO: 1774365 - DNA, 16 bp, Homo sapiens
agtaaacagggtacct

SEQ ID NO: 1774366 - DNA, 15 bp, Homo sapiens
agtaaaccactgaaa

SEQ ID NO: 1774367 - DNA, 23 bp, Homo sapiens
agtaaaccactgaaaaaatatat

SEQ ID NO: 1774368 - DNA, 14 bp, Homo sapiens
agtaaactgatgta

SEQ ID NO: 1774369 - DNA, 16 bp, Homo sapiens
agtaaagaaagcagaa

SEQ ID NO: 1774370 - DNA, 17 bp, Homo sapiens
agtaaagccgttgttta

SEQ ID NO: 1774371 - DNA, 19 bp, Homo sapiens
agtaaaggagtaagaacct

SEQ ID NO: 1774372 - DNA, 21 bp, Homo sapiens
agtaaatatatatgtcaatat

SEQ ID NO: 1774373 - DNA, 17 bp, Homo sapiens
agtaaatcagaaagtaa

SEQ ID NO: 1774374 - DNA, 21 bp, Homo sapiens
agtaaatcagaaagtaacaat

SEQ ID NO: 1774375 - DNA, 20 bp, Homo sapiens
agtaaatgtgattcacctct

SEQ ID NO: 1774376 - DNA, 16 bp, Homo sapiens
agtaaattatgatgtc

SEQ ID NO: 1774377 - DNA, 15 bp, Homo sapiens
agtaacaaggtgtct

SEQ ID NO: 1774378 - DNA, 19 bp, Homo sapiens
agtaacaatacaaatggat

SEQ ID NO: 1774379 - DNA, 14 bp, Homo sapiens
agtaacacagtatt

SEQ ID NO: 1774380 - DNA, 12 bp, Homo sapiens
agtaacactaat

SEQ ID NO: 1774381 - DNA, 17 bp, Homo sapiens
agtaacactaatatatt

SEQ ID NO: 1774382 - DNA, 13 bp, Homo sapiens
agtaacagacaca

SEQ ID NO: 1774383 - DNA, 15 bp, Homo sapiens
agtaacatttgctgt

SEQ ID NO: 1774384 - DNA, 17 bp, Homo sapiens
agtaacatttgctgttt

SEQ ID NO: 1774385 - DNA, 14 bp, Homo sapiens
agtaaccatttgca

SEQ ID NO: 1774386 - DNA, 15 bp, Homo sapiens
agtaacccctcctgg

SEQ ID NO: 1774387 - DNA, 17 bp, Homo sapiens
agtaacgcgtcttcctg

SEQ ID NO: 1774388 - DNA, 22 bp, Homo sapiens
agtaacgcgtcttcctgagtgg

SEQ ID NO: 1774389 - DNA, 15 bp, Homo sapiens
agtaactaattttgt

SEQ ID NO: 1774390 - DNA, 19 bp, Homo sapiens
agtaactgccatcaagatg

SEQ ID NO: 1774391 - DNA, 18 bp, Homo sapiens
agtaacttgggagtgtgg

SEQ ID NO: 1774392 - DNA, 19 bp, Homo sapiens
agtaactttatgtgtaaat

SEQ ID NO: 1774393 - DNA, 14 bp, Homo sapiens
agtaacttttttgt

SEQ ID NO: 1774394 - DNA, 15 bp, Homo sapiens
agtaacttttttgtg

SEQ ID NO: 1774395 - DNA, 18 bp, Homo sapiens
agtaacttttttgtgtat

SEQ ID NO: 1774396 - DNA, 20 bp, Homo sapiens
agtaacttttttgtgtatgt

SEQ ID NO: 1774397 - DNA, 14 bp, Homo sapiens
agtaagaagacatg

SEQ ID NO: 1774398 - DNA, 19 bp, Homo sapiens
agtaagaagaggagcctca

SEQ ID NO: 1774399 - DNA, 20 bp, Homo sapiens
agtaagaagaggagcctcag

SEQ ID NO: 1774400 - DNA, 21 bp, Homo sapiens
agtaagaataccacatcaaat

SEQ ID NO: 1774401 - DNA, 23 bp, Homo sapiens
agtaagaataccacatcaaataa

SEQ ID NO: 1774402 - DNA, 21 bp, Homo sapiens
agtaagacttttattaataaa

SEQ ID NO: 1774403 - DNA, 14 bp, Homo sapiens
agtaagagctggtg

SEQ ID NO: 1774404 - DNA, 21 bp, Homo sapiens
agtaagcagtgttacttgcag

SEQ ID NO: 1774405 - DNA, 14 bp, Homo sapiens
agtaaggcatgtta

SEQ ID NO: 1774406 - DNA, 23 bp, Homo sapiens
agtaaggctggtaagagaagtga

SEQ ID NO: 1774407 - DNA, 19 bp, Homo sapiens
agtaagtaccactcaggcc

SEQ ID NO: 1774408 - DNA, 23 bp, Homo sapiens
agtaagtcttgcctatattttcc

SEQ ID NO: 1774409 - DNA, 23 bp, Homo sapiens
agtaagtggggttgcaaccactg

SEQ ID NO: 1774410 - DNA, 16 bp, Homo sapiens
agtaataccaaagact

SEQ ID NO: 1774411 - DNA, 14 bp, Homo sapiens
agtaatagagcaaa

SEQ ID NO: 1774412 - DNA, 17 bp, Homo sapiens
agtaatcgcttaaagat

SEQ ID NO: 1774413 - DNA, 16 bp, Homo sapiens
agtaatctaggtgtgg

SEQ ID NO: 1774414 - DNA, 22 bp, Homo sapiens
agtaatctaggtgtggctgtga

SEQ ID NO: 1774415 - DNA, 21 bp, Homo sapiens
agtaatgaatttttatgatat

SEQ ID NO: 1774416 - DNA, 22 bp, Homo sapiens
agtaatgaatttttatgatatt

SEQ ID NO: 1774417 - DNA, 19 bp, Homo sapiens
agtaatgacttagaaactg

SEQ ID NO: 1774418 - DNA, 16 bp, Homo sapiens
agtaatgatactgtgt

SEQ ID NO: 1774419 - DNA, 17 bp, Homo sapiens
agtaatgatactgtgtg

SEQ ID NO: 1774420 - DNA, 15 bp, Homo sapiens
agtaatgcagttttt

SEQ ID NO: 1774421 - DNA, 16 bp, Homo sapiens
agtaatgcagttttta

SEQ ID NO: 1774422 - DNA, 23 bp, Homo sapiens
agtaatgggtttcatatttctta

SEQ ID NO: 1774423 - DNA, 14 bp, Homo sapiens
agtaatggtgtaga

SEQ ID NO: 1774424 - DNA, 18 bp, Homo sapiens
agtaatggtgtagaacac

SEQ ID NO: 1774425 - DNA, 23 bp, Homo sapiens
agtaatggtgtagaacactaatt

SEQ ID NO: 1774426 - DNA, 13 bp, Homo sapiens
agtaatgtaaaga

SEQ ID NO: 1774427 - DNA, 20 bp, Homo sapiens
agtaatgttaaacaccattt

SEQ ID NO: 1774428 - DNA, 16 bp, Homo sapiens
agtaatgttttttaga

SEQ ID NO: 1774429 - DNA, 22 bp, Homo sapiens
agtaattatcgggaacagtgtt

SEQ ID NO: 1774430 - DNA, 22 bp, Homo sapiens
agtaattccttctcttttttca

SEQ ID NO: 1774431 - DNA, 22 bp, Homo sapiens
agtaattggtccgatctttgac

SEQ ID NO: 1774432 - DNA, 22 bp, Homo sapiens
agtaatttattgtctgtctaca

SEQ ID NO: 1774433 - DNA, 12 bp, Homo sapiens
agtaatttcagt

SEQ ID NO: 1774434 - DNA, 19 bp, Homo sapiens
agtaatttcagtgtaaagt

SEQ ID NO: 1774435 - DNA, 22 bp, Homo sapiens
agtaatttcagtgtaaagtgtg

SEQ ID NO: 1774436 - DNA, 15 bp, Homo sapiens
agtaatttgaggaca

SEQ ID NO: 1774437 - DNA, 18 bp, Homo sapiens
agtacaagtggtaatttt

SEQ ID NO: 1774438 - DNA, 21 bp, Homo sapiens
agtacaagtggtaatttttgt

SEQ ID NO: 1774439 - DNA, 22 bp, Homo sapiens
agtacaagtggtaatttttgta

SEQ ID NO: 1774440 - DNA, 14 bp, Homo sapiens
agtacaagttccaa

SEQ ID NO: 1774441 - DNA, 14 bp, Homo sapiens
agtacaataatgta

SEQ ID NO: 1774442 - DNA, 19 bp, Homo sapiens
agtacaataatgtactcac

SEQ ID NO: 1774443 - DNA, 19 bp, Homo sapiens
agtacacacaaaaaccttg

SEQ ID NO: 1774444 - DNA, 16 bp, Homo sapiens
agtacagtattctttt

SEQ ID NO: 1774445 - DNA, 15 bp, Homo sapiens
agtacatatgtaatt

SEQ ID NO: 1774446 - DNA, 13 bp, Homo sapiens
agtacatttaaat

SEQ ID NO: 1774447 - DNA, 21 bp, Homo sapiens
agtacattttttgaaatgctg

SEQ ID NO: 1774448 - DNA, 22 bp, Homo sapiens
agtacattttttgaaatgctga

SEQ ID NO: 1774449 - DNA, 15 bp, Homo sapiens
agtaccaatcatttt

SEQ ID NO: 1774450 - DNA, 15 bp, Homo sapiens
agtagagagggaaca

SEQ ID NO: 1774451 - DNA, 15 bp, Homo sapiens
agtagatactctcag

SEQ ID NO: 1774452 - DNA, 17 bp, Homo sapiens
agtagatactctcagca

SEQ ID NO: 1774453 - DNA, 15 bp, Homo sapiens
agtagatctatatta

SEQ ID NO: 1774454 - DNA, 21 bp, Homo sapiens
agtagattcttacaaggccct

SEQ ID NO: 1774455 - DNA, 16 bp, Homo sapiens
agtagcaatgtgcctt

SEQ ID NO: 1774456 - DNA, 18 bp, Homo sapiens
agtagcaccctggattga

SEQ ID NO: 1774457 - DNA, 19 bp, Homo sapiens
agtagccaaacccctagag

SEQ ID NO: 1774458 - DNA, 15 bp, Homo sapiens
agtagccgagagcct

SEQ ID NO: 1774459 - DNA, 20 bp, Homo sapiens
agtagcctgatctttctaga

SEQ ID NO: 1774460 - DNA, 14 bp, Homo sapiens
agtagctagtttgc

SEQ ID NO: 1774461 - DNA, 14 bp, Homo sapiens
agtagctctgcctt

SEQ ID NO: 1774462 - DNA, 22 bp, Homo sapiens
agtagctctgcctttgctctgg

SEQ ID NO: 1774463 - DNA, 18 bp, Homo sapiens
agtagctggcgcccatcc

SEQ ID NO: 1774464 - DNA, 15 bp, Homo sapiens
agtagctgtcagatg

SEQ ID NO: 1774465 - DNA, 21 bp, Homo sapiens
agtagctgtcagatgtcacat

SEQ ID NO: 1774466 - DNA, 19 bp, Homo sapiens
agtagggatgcggatcctg

SEQ ID NO: 1774467 - DNA, 21 bp, Homo sapiens
agtagggatgcggatcctgct

SEQ ID NO: 1774468 - DNA, 14 bp, Homo sapiens
agtaggtattaatc

SEQ ID NO: 1774469 - DNA, 16 bp, Homo sapiens
agtaggtcccggccag

SEQ ID NO: 1774470 - DNA, 20 bp, Homo sapiens
agtagtaaaagaagaaatag

SEQ ID NO: 1774471 - DNA, 16 bp, Homo sapiens
agtagtagtatggcac

SEQ ID NO: 1774472 - DNA, 21 bp, Homo sapiens
agtagtccctgcacagtgact

SEQ ID NO: 1774473 - DNA, 21 bp, Homo sapiens
agtagtctctgtgaggcctta

SEQ ID NO: 1774474 - DNA, 15 bp, Homo sapiens
agtagtgttctagat

SEQ ID NO: 1774475 - DNA, 13 bp, Homo sapiens
agtagttaaataa

SEQ ID NO: 1774476 - DNA, 13 bp, Homo sapiens
agtagttggtttg

SEQ ID NO: 1774477 - DNA, 18 bp, Homo sapiens
agtagttggtttgtatga

SEQ ID NO: 1774478 - DNA, 17 bp, Homo sapiens
agtagtttgagaccagc

SEQ ID NO: 1774479 - DNA, 16 bp, Homo sapiens
agtagtttgcatttca

SEQ ID NO: 1774480 - DNA, 19 bp, Homo sapiens
agtataaccatatgatact

SEQ ID NO: 1774481 - DNA, 15 bp, Homo sapiens
agtataactttaaat

SEQ ID NO: 1774482 - DNA, 10 bp, Homo sapiens
agtataattg

SEQ ID NO: 1774483 - DNA, 13 bp, Homo sapiens
agtatacattgtc

SEQ ID NO: 1774484 - DNA, 20 bp, Homo sapiens
agtatacgtataaatatcag

SEQ ID NO: 1774485 - DNA, 22 bp, Homo sapiens
agtatacgtataaatatcagta

SEQ ID NO: 1774486 - DNA, 12 bp, Homo sapiens
agtatactgtgt

SEQ ID NO: 1774487 - DNA, 21 bp, Homo sapiens
agtatagatacaaaaccttgt

SEQ ID NO: 1774488 - DNA, 14 bp, Homo sapiens
agtatagtgcaaat

SEQ ID NO: 1774489 - DNA, 15 bp, Homo sapiens
agtatatctggacaa

SEQ ID NO: 1774490 - DNA, 13 bp, Homo sapiens
agtatatgtcatt

SEQ ID NO: 1774491 - DNA, 15 bp, Homo sapiens
agtatatgtcattta

SEQ ID NO: 1774492 - DNA, 15 bp, Homo sapiens
agtatatgttccctc

SEQ ID NO: 1774493 - DNA, 11 bp, Homo sapiens
agtatattctt

SEQ ID NO: 1774494 - DNA, 14 bp, Homo sapiens
agtatattgttgaa

SEQ ID NO: 1774495 - DNA, 14 bp, Homo sapiens
agtatatttatact

SEQ ID NO: 1774496 - DNA, 18 bp, Homo sapiens
agtatatttatagtcaca

SEQ ID NO: 1774497 - DNA, 17 bp, Homo sapiens
agtatcacgatttgcag

SEQ ID NO: 1774498 - DNA, 13 bp, Homo sapiens
agtatccttcctt

SEQ ID NO: 1774499 - DNA, 14 bp, Homo sapiens
agtatccttccttc

SEQ ID NO: 1774500 - DNA, 17 bp, Homo sapiens
agtatctatatatgtgt

SEQ ID NO: 1774501 - DNA, 18 bp, Homo sapiens
agtatctatatatgtgta

SEQ ID NO: 1774502 - DNA, 20 bp, Homo sapiens
agtatctcgtaatagcttct

SEQ ID NO: 1774503 - DNA, 23 bp, Homo sapiens
agtatctcgtaatagcttctgtg

SEQ ID NO: 1774504 - DNA, 18 bp, Homo sapiens
agtatctcttcagtctct

SEQ ID NO: 1774505 - DNA, 20 bp, Homo sapiens
agtatctgtatataagttgc

SEQ ID NO: 1774506 - DNA, 13 bp, Homo sapiens
agtatcttgaaat

SEQ ID NO: 1774507 - DNA, 15 bp, Homo sapiens
agtatcttgggtgta

SEQ ID NO: 1774508 - DNA, 23 bp, Homo sapiens
agtatcttgggtgtattctctgt

SEQ ID NO: 1774509 - DNA, 14 bp, Homo sapiens
agtatcttgtgctt

SEQ ID NO: 1774510 - DNA, 12 bp, Homo sapiens
agtatcttttga

SEQ ID NO: 1774511 - DNA, 16 bp, Homo sapiens
agtatgaaattatata

SEQ ID NO: 1774512 - DNA, 23 bp, Homo sapiens
agtatgatgaaaataattttcca

SEQ ID NO: 1774513 - DNA, 14 bp, Homo sapiens
agtatgcaatgctt

SEQ ID NO: 1774514 - DNA, 16 bp, Homo sapiens
agtatgcattattaaa

SEQ ID NO: 1774515 - DNA, 19 bp, Homo sapiens
agtatgcattattaaattg

SEQ ID NO: 1774516 - DNA, 22 bp, Homo sapiens
agtatgccaaaaatatatgcta

SEQ ID NO: 1774517 - DNA, 15 bp, Homo sapiens
agtatgccttaagca

SEQ ID NO: 1774518 - DNA, 23 bp, Homo sapiens
agtatgctttccctgaggaatga

SEQ ID NO: 1774519 - DNA, 23 bp, Homo sapiens
agtatggtaatctttacctgtat

SEQ ID NO: 1774520 - DNA, 18 bp, Homo sapiens
agtcaggggtcaggtgtc

SEQ ID NO: 1774521 - DNA, 21 bp, Homo sapiens
agtcagggtgggaagaaagaa

SEQ ID NO: 1774522 - DNA, 22 bp, Homo sapiens
agtcagggtgggaagaaagaat

SEQ ID NO: 1774523 - DNA, 19 bp, Homo sapiens
agtcagtaggtccaagggc

SEQ ID NO: 1774524 - DNA, 22 bp, Homo sapiens
agtcagtgcatttcaaggaaca

SEQ ID NO: 1774525 - DNA, 17 bp, Homo sapiens
agtcagtgctctcagct

SEQ ID NO: 1774526 - DNA, 20 bp, Homo sapiens
agtcagttcccggagcacag

SEQ ID NO: 1774527 - DNA, 21 bp, Homo sapiens
agtcagttcccggagcacagc

SEQ ID NO: 1774528 - DNA, 16 bp, Homo sapiens
agtcagttgaaattct

SEQ ID NO: 1774529 - DNA, 23 bp, Homo sapiens
agtcagttgctcaaaaagaaatc

SEQ ID NO: 1774530 - DNA, 14 bp, Homo sapiens
agtcagtttgcagt

SEQ ID NO: 1774531 - DNA, 13 bp, Homo sapiens
agtcataaacctt

SEQ ID NO: 1774532 - DNA, 15 bp, Homo sapiens
agtcataaatactgt

SEQ ID NO: 1774533 - DNA, 17 bp, Homo sapiens
agtcatctccatcagct

SEQ ID NO: 1774534 - DNA, 11 bp, Homo sapiens
agtcatcttgc

SEQ ID NO: 1774535 - DNA, 13 bp, Homo sapiens
agtcatcttgcta

SEQ ID NO: 1774536 - DNA, 19 bp, Homo sapiens
agtcatcttgctaccagta

SEQ ID NO: 1774537 - DNA, 23 bp, Homo sapiens
agtcatcttgctaccagtattta

SEQ ID NO: 1774538 - DNA, 18 bp, Homo sapiens
agtcatcttgtgagtgga

SEQ ID NO: 1774539 - DNA, 13 bp, Homo sapiens
agtcatgaagccc

SEQ ID NO: 1774540 - DNA, 21 bp, Homo sapiens
agtcatgaagcccaagtgaaa

SEQ ID NO: 1774541 - DNA, 20 bp, Homo sapiens
agtcatgatctccctgccgc

SEQ ID NO: 1774542 - DNA, 21 bp, Homo sapiens
agtcatgatctccctgccgcc

SEQ ID NO: 1774543 - DNA, 21 bp, Homo sapiens
agtcatgctgaatactcctcc

SEQ ID NO: 1774544 - DNA, 19 bp, Homo sapiens
agtcatggcctgagatgca

SEQ ID NO: 1774545 - DNA, 21 bp, Homo sapiens
agtcatggctaatttaacacc

SEQ ID NO: 1774546 - DNA, 20 bp, Homo sapiens
agtcatggggtccctgctgc

SEQ ID NO: 1774547 - DNA, 22 bp, Homo sapiens
agtcattcagcagcaaattttc

SEQ ID NO: 1774548 - DNA, 16 bp, Homo sapiens
agtcattctaggatgt

SEQ ID NO: 1774549 - DNA, 12 bp, Homo sapiens
agtcattgtaat

SEQ ID NO: 1774550 - DNA, 13 bp, Homo sapiens
agtcattttcaag

SEQ ID NO: 1774551 - DNA, 21 bp, Homo sapiens
agtccaaaaagctcctggggc

SEQ ID NO: 1774552 - DNA, 16 bp, Homo sapiens
agtccaaatgtcctcc

SEQ ID NO: 1774553 - DNA, 19 bp, Homo sapiens
agtccaaatgtcctccaga

SEQ ID NO: 1774554 - DNA, 23 bp, Homo sapiens
agtccaaatgtcctccagaagcc

SEQ ID NO: 1774555 - DNA, 16 bp, Homo sapiens
agtccaaccagaaaca

SEQ ID NO: 1774556 - DNA, 21 bp, Homo sapiens
agtccaaccagaaacacccct

SEQ ID NO: 1774557 - DNA, 19 bp, Homo sapiens
agtccaagagggtccttta

SEQ ID NO: 1774558 - DNA, 23 bp, Homo sapiens
agtccagacagcttgactgcttt

SEQ ID NO: 1774559 - DNA, 15 bp, Homo sapiens
agtccagccttccag

SEQ ID NO: 1774560 - DNA, 18 bp, Homo sapiens
agtccaggactgggtctg

SEQ ID NO: 1774561 - DNA, 19 bp, Homo sapiens
agtccaggaggccctggtc

SEQ ID NO: 1774562 - DNA, 14 bp, Homo sapiens
agtccaggctgccg

SEQ ID NO: 1774563 - DNA, 17 bp, Homo sapiens
agtccaggtaaatggta

SEQ ID NO: 1774564 - DNA, 14 bp, Homo sapiens
agtccatgctccag

SEQ ID NO: 1774565 - DNA, 14 bp, Homo sapiens
agtcccaaggaaag

SEQ ID NO: 1774566 - DNA, 19 bp, Homo sapiens
agtcccaccctcttcccat

SEQ ID NO: 1774567 - DNA, 17 bp, Homo sapiens
agtcccagagctcatcc

SEQ ID NO: 1774568 - DNA, 20 bp, Homo sapiens
agtcccagctacttgggagg

SEQ ID NO: 1774569 - DNA, 15 bp, Homo sapiens
agtgaaaattgtctt

SEQ ID NO: 1774570 - DNA, 16 bp, Homo sapiens
agtgaaagaggcagct

SEQ ID NO: 1774571 - DNA, 14 bp, Homo sapiens
agtgaacacatttt

SEQ ID NO: 1774572 - DNA, 21 bp, Homo sapiens
agtgaacattcccagcccagc

SEQ ID NO: 1774573 - DNA, 13 bp, Homo sapiens
agtgaaccatcat

SEQ ID NO: 1774574 - DNA, 21 bp, Homo sapiens
agtgaaccatcattataaacg

SEQ ID NO: 1774575 - DNA, 17 bp, Homo sapiens
agtgaaccgtcctttca

SEQ ID NO: 1774576 - DNA, 23 bp, Homo sapiens
agtgaagaaccctatttaaaact

SEQ ID NO: 1774577 - DNA, 13 bp, Homo sapiens
agtgaagaatcta

SEQ ID NO: 1774578 - DNA, 13 bp, Homo sapiens
agtgaagaatctt

SEQ ID NO: 1774579 - DNA, 16 bp, Homo sapiens
agtgaagaggggcagc

SEQ ID NO: 1774580 - DNA, 19 bp, Homo sapiens
agtgaagaggggcagccct

SEQ ID NO: 1774581 - DNA, 19 bp, Homo sapiens
agtgaagatgctgtaaata

SEQ ID NO: 1774582 - DNA, 12 bp, Homo sapiens
agtgaagcagca

SEQ ID NO: 1774583 - DNA, 19 bp, Homo sapiens
agtgaagtagcctcttgtg

SEQ ID NO: 1774584 - DNA, 22 bp, Homo sapiens
agtgaagtagcctcttgtgtaa

SEQ ID NO: 1774585 - DNA, 15 bp, Homo sapiens
agtgaatacattaac

SEQ ID NO: 1774586 - DNA, 22 bp, Homo sapiens
agtgaatacattaacggtgcta

SEQ ID NO: 1774587 - DNA, 18 bp, Homo sapiens
agtgaatatttttgtatt

SEQ ID NO: 1774588 - DNA, 15 bp, Homo sapiens
agtgaatccctggga

SEQ ID NO: 1774589 - DNA, 13 bp, Homo sapiens
agtgaatctgatt

SEQ ID NO: 1774590 - DNA, 15 bp, Homo sapiens
agtgaatctgattgc

SEQ ID NO: 1774591 - DNA, 13 bp, Homo sapiens
agtgaatgaaaca

SEQ ID NO: 1774592 - DNA, 14 bp, Homo sapiens
agtgaatgctggga

SEQ ID NO: 1774593 - DNA, 15 bp, Homo sapiens
agtgaatttttctct

SEQ ID NO: 1774594 - DNA, 17 bp, Homo sapiens
agtgaatttttctctaa

SEQ ID NO: 1774595 - DNA, 23 bp, Homo sapiens
agtgaatttttctctaactcaga

SEQ ID NO: 1774596 - DNA, 15 bp, Homo sapiens
agtgacaagtgaaga

SEQ ID NO: 1774597 - DNA, 18 bp, Homo sapiens
agtgacacagcagcttca

SEQ ID NO: 1774598 - DNA, 21 bp, Homo sapiens
agtgacagagcgagactccat

SEQ ID NO: 1774599 - DNA, 15 bp, Homo sapiens
agtgacagagttcac

SEQ ID NO: 1774600 - DNA, 23 bp, Homo sapiens
agtgacagctttcctcaaaaagc

SEQ ID NO: 1774601 - DNA, 21 bp, Homo sapiens
agtgacagtcataaatactgt

SEQ ID NO: 1774602 - DNA, 20 bp, Homo sapiens
agtgacatcaaagcctggcc

SEQ ID NO: 1774603 - DNA, 21 bp, Homo sapiens
agtgacatcaaagcctggcct

SEQ ID NO: 1774604 - DNA, 13 bp, Homo sapiens
agtgacccttccc

SEQ ID NO: 1774605 - DNA, 13 bp, Homo sapiens
agtgacctctctc

SEQ ID NO: 1774606 - DNA, 22 bp, Homo sapiens
agtgactggcaggtgcagatgg

SEQ ID NO: 1774607 - DNA, 21 bp, Homo sapiens
agtgacttcctggggatgtca

SEQ ID NO: 1774608 - DNA, 14 bp, Homo sapiens
agtgacttctgaga

SEQ ID NO: 1774609 - DNA, 17 bp, Homo sapiens
agtgacttctgagatct

SEQ ID NO: 1774610 - DNA, 17 bp, Homo sapiens
agtgacttggccccaga

SEQ ID NO: 1774611 - DNA, 18 bp, Homo sapiens
agtgacttgtgtcccatg

SEQ ID NO: 1774612 - DNA, 20 bp, Homo sapiens
agtgacttttcaagtattta

SEQ ID NO: 1774613 - DNA, 20 bp, Homo sapiens
agtgagaactctctccctgg

SEQ ID NO: 1774614 - DNA, 18 bp, Homo sapiens
agtgagacccctgtctcc

SEQ ID NO: 1774615 - DNA, 15 bp, Homo sapiens
agtgagaccctgtct

SEQ ID NO: 1774616 - DNA, 17 bp, Homo sapiens
agtgagaccctgtctca

SEQ ID NO: 1774617 - DNA, 19 bp, Homo sapiens
agtgagagacctctgccta

SEQ ID NO: 1774618 - DNA, 13 bp, Homo sapiens
agtgagagggcat

SEQ ID NO: 1774619 - DNA, 14 bp, Homo sapiens
agtgagatagaata

SEQ ID NO: 1774620 - DNA, 18 bp, Homo sapiens
agtgagatggtatgaaat

SEQ ID NO: 1774621 - DNA, 17 bp, Homo sapiens
agtgagatgtagaaagt

SEQ ID NO: 1774622 - DNA, 18 bp, Homo sapiens
agtgagatgtagaaagtt

SEQ ID NO: 1774623 - DNA, 17 bp, Homo sapiens
agtgagcagaacaggta

SEQ ID NO: 1774624 - DNA, 12 bp, Homo sapiens
agtgcctggagt

SEQ ID NO: 1774625 - DNA, 13 bp, Homo sapiens
agtgcctgggaat

SEQ ID NO: 1774626 - DNA, 18 bp, Homo sapiens
agtgccttacctcctgcc

SEQ ID NO: 1774627 - DNA, 11 bp, Homo sapiens
agtgccttctc

SEQ ID NO: 1774628 - DNA, 17 bp, Homo sapiens
agtgccttctctcagct

SEQ ID NO: 1774629 - DNA, 22 bp, Homo sapiens
agtgccttctctcagctcccag

SEQ ID NO: 1774630 - DNA, 16 bp, Homo sapiens
agtgcctttagagggt

SEQ ID NO: 1774631 - DNA, 22 bp, Homo sapiens
agtgcctttctgcagtttttca

SEQ ID NO: 1774632 - DNA, 21 bp, Homo sapiens
agtgcgtggtataatctccat

SEQ ID NO: 1774633 - DNA, 23 bp, Homo sapiens
agtgctaaacatggcttaatctt

SEQ ID NO: 1774634 - DNA, 13 bp, Homo sapiens
agtgctaaggttc

SEQ ID NO: 1774635 - DNA, 14 bp, Homo sapiens
agtgctaaggttct

SEQ ID NO: 1774636 - DNA, 15 bp, Homo sapiens
agtgctaaggttcta

SEQ ID NO: 1774637 - DNA, 18 bp, Homo sapiens
agtgctaaggttctaagg

SEQ ID NO: 1774638 - DNA, 13 bp, Homo sapiens
agtgctacatttt

SEQ ID NO: 1774639 - DNA, 22 bp, Homo sapiens
agtgctagtgtggtctgtaata

SEQ ID NO: 1774640 - DNA, 23 bp, Homo sapiens
agtgctagtgtggtctgtaatat

SEQ ID NO: 1774641 - DNA, 16 bp, Homo sapiens
agtgctatgtgtgaga

SEQ ID NO: 1774642 - DNA, 14 bp, Homo sapiens
agtgctattctgtg

SEQ ID NO: 1774643 - DNA, 23 bp, Homo sapiens
agtgctattctgtgttgaacaca

SEQ ID NO: 1774644 - DNA, 22 bp, Homo sapiens
agtgctcaaggttactgggagt

SEQ ID NO: 1774645 - DNA, 19 bp, Homo sapiens
agtgctcctccgtgtggac

SEQ ID NO: 1774646 - DNA, 17 bp, Homo sapiens
agtgctcgaccttgata

SEQ ID NO: 1774647 - DNA, 16 bp, Homo sapiens
agtgctcttggctgac

SEQ ID NO: 1774648 - DNA, 19 bp, Homo sapiens
agtgctcttggctgacccc

SEQ ID NO: 1774649 - DNA, 23 bp, Homo sapiens
agtgctcttggctgacccctctg

SEQ ID NO: 1774650 - DNA, 17 bp, Homo sapiens
agtgctcttttctcctc

SEQ ID NO: 1774651 - DNA, 15 bp, Homo sapiens
agtgctgaatttccc

SEQ ID NO: 1774652 - DNA, 15 bp, Homo sapiens
agtgctgagattaca

SEQ ID NO: 1774653 - DNA, 20 bp, Homo sapiens
agtgctgagattacaggcat

SEQ ID NO: 1774654 - DNA, 14 bp, Homo sapiens
agtgctgaggccag

SEQ ID NO: 1774655 - DNA, 19 bp, Homo sapiens
agtgctgaggccagggctg

SEQ ID NO: 1774656 - DNA, 18 bp, Homo sapiens
agtgctgccatgccactg

SEQ ID NO: 1774657 - DNA, 18 bp, Homo sapiens
agtgctgggaccagagcc

SEQ ID NO: 1774658 - DNA, 19 bp, Homo sapiens
agtgctgggaccagagcca

SEQ ID NO: 1774659 - DNA, 12 bp, Homo sapiens
agtgctgggatt

SEQ ID NO: 1774660 - DNA, 17 bp, Homo sapiens
agtgctgggattacagg

SEQ ID NO: 1774661 - DNA, 22 bp, Homo sapiens
agtgctggtcagagagacctca

SEQ ID NO: 1774662 - DNA, 23 bp, Homo sapiens
agtgctggtcagagagacctcat

SEQ ID NO: 1774663 - DNA, 18 bp, Homo sapiens
agtgctgtacccttccac

SEQ ID NO: 1774664 - DNA, 22 bp, Homo sapiens
agtgctgtacccttccacctcc

SEQ ID NO: 1774665 - DNA, 23 bp, Homo sapiens
agtgctgtcttaaactaaatgtg

SEQ ID NO: 1774666 - DNA, 18 bp, Homo sapiens
agtgctgtggcctgggca

SEQ ID NO: 1774667 - DNA, 20 bp, Homo sapiens
agtgctgtttattaatctta

SEQ ID NO: 1774668 - DNA, 16 bp, Homo sapiens
agtgcttaaaaatcat

SEQ ID NO: 1774669 - DNA, 17 bp, Homo sapiens
agtgcttaaaaatcatt

SEQ ID NO: 1774670 - DNA, 11 bp, Homo sapiens
agtgcttcaga

SEQ ID NO: 1774671 - DNA, 15 bp, Homo sapiens
agtgcttcagcctga

SEQ ID NO: 1774672 - DNA, 17 bp, Homo sapiens
agtgcttcagcctgagg

SEQ ID NO: 1774673 - DNA, 18 bp, Homo sapiens
agtgcttcagcctgaggc

SEQ ID NO: 1774674 - DNA, 21 bp, Homo sapiens
agtgcttcttaaagagttctt

SEQ ID NO: 1774675 - DNA, 13 bp, Homo sapiens
agtgcttgctggc

SEQ ID NO: 1774676 - DNA, 14 bp, Homo sapiens
agtgcttgctggcc

SEQ ID NO: 1774677 - DNA, 19 bp, Homo sapiens
agtgctttgcatgtattag

SEQ ID NO: 1774678 - DNA, 13 bp, Homo sapiens
agtgctttgtaat

SEQ ID NO: 1774679 - DNA, 20 bp, Homo sapiens
agttcagtagaattaccatt

SEQ ID NO: 1774680 - DNA, 23 bp, Homo sapiens
agttcagtgtatggcgttggttt

SEQ ID NO: 1774681 - DNA, 18 bp, Homo sapiens
agttcataaatttatggt

SEQ ID NO: 1774682 - DNA, 11 bp, Homo sapiens
agttcatacat

SEQ ID NO: 1774683 - DNA, 15 bp, Homo sapiens
agttcatacattgta

SEQ ID NO: 1774684 - DNA, 20 bp, Homo sapiens
agttcatagggtctcttcag

SEQ ID NO: 1774685 - DNA, 16 bp, Homo sapiens
agttcatatatcaaga

SEQ ID NO: 1774686 - DNA, 19 bp, Homo sapiens
agttcatattccatattta

SEQ ID NO: 1774687 - DNA, 18 bp, Homo sapiens
agttcatccaatcctcac

SEQ ID NO: 1774688 - DNA, 18 bp, Homo sapiens
agttcatctatggcagtc

SEQ ID NO: 1774689 - DNA, 20 bp, Homo sapiens
agttcatctatggcagtcca

SEQ ID NO: 1774690 - DNA, 13 bp, Homo sapiens
agttcatcttgca

SEQ ID NO: 1774691 - DNA, 22 bp, Homo sapiens
agttcatcttgcagcatttact

SEQ ID NO: 1774692 - DNA, 22 bp, Homo sapiens
agttcatgtatgttcagaagaa

SEQ ID NO: 1774693 - DNA, 18 bp, Homo sapiens
agttcatgtctgaaacag

SEQ ID NO: 1774694 - DNA, 21 bp, Homo sapiens
agttcatgtctgaaacagaga

SEQ ID NO: 1774695 - DNA, 22 bp, Homo sapiens
agttcatgtctgaaacagagaa

SEQ ID NO: 1774696 - DNA, 18 bp, Homo sapiens
agttccaaaatgccaaat

SEQ ID NO: 1774697 - DNA, 13 bp, Homo sapiens
agttccaagagtc

SEQ ID NO: 1774698 - DNA, 15 bp, Homo sapiens
agttccagtttctcc

SEQ ID NO: 1774699 - DNA, 19 bp, Homo sapiens
agttcccccagtacctcca

SEQ ID NO: 1774700 - DNA, 23 bp, Homo sapiens
agttcccggagcacagccctggg

SEQ ID NO: 1774701 - DNA, 24 bp, Homo sapiens
agttccctgaaaacccagagagga

SEQ ID NO: 1774702 - DNA, 13 bp, Homo sapiens
agttcccttggcc

SEQ ID NO: 1774703 - DNA, 17 bp, Homo sapiens
agttcccttggcctcag

SEQ ID NO: 1774704 - DNA, 18 bp, Homo sapiens
agttcccttggcctcaga

SEQ ID NO: 1774705 - DNA, 17 bp, Homo sapiens
agttcctatgacacagt

SEQ ID NO: 1774706 - DNA, 14 bp, Homo sapiens
agttcctcctactt

SEQ ID NO: 1774707 - DNA, 15 bp, Homo sapiens
agttcctcgccctgg

SEQ ID NO: 1774708 - DNA, 16 bp, Homo sapiens
agttcctcgccctggg

SEQ ID NO: 1774709 - DNA, 13 bp, Homo sapiens
agttcctctgggt

SEQ ID NO: 1774710 - DNA, 18 bp, Homo sapiens
agttcctgatgacccagg

SEQ ID NO: 1774711 - DNA, 20 bp, Homo sapiens
agttcctgcggagtgaagag

SEQ ID NO: 1774712 - DNA, 18 bp, Homo sapiens
agttcctgtaacaggtgt

SEQ ID NO: 1774713 - DNA, 18 bp, Homo sapiens
agttccttatccctctct

SEQ ID NO: 1774714 - DNA, 15 bp, Homo sapiens
agttccttgccttaa

SEQ ID NO: 1774715 - DNA, 16 bp, Homo sapiens
agttccttgccttaat

SEQ ID NO: 1774716 - DNA, 21 bp, Homo sapiens
agttcgaccaaactcagttca

SEQ ID NO: 1774717 - DNA, 19 bp, Homo sapiens
agttcgagaccagcctggc

SEQ ID NO: 1774718 - DNA, 16 bp, Homo sapiens
agttctaagattctaa

SEQ ID NO: 1774719 - DNA, 15 bp, Homo sapiens
agttctaagattctg

SEQ ID NO: 1774720 - DNA, 17 bp, Homo sapiens
agttctaagattctgat

SEQ ID NO: 1774721 - DNA, 20 bp, Homo sapiens
agttctacctcaggcagctc

SEQ ID NO: 1774722 - DNA, 12 bp, Homo sapiens
agttctagaagc

SEQ ID NO: 1774723 - DNA, 21 bp, Homo sapiens
agttctagaagccacagtgcc

SEQ ID NO: 1774724 - DNA, 10 bp, Homo sapiens
agttctagat

SEQ ID NO: 1774725 - DNA, 20 bp, Homo sapiens
agttctagatttttaagaga

SEQ ID NO: 1774726 - DNA, 10 bp, Homo sapiens
agttctaggc

SEQ ID NO: 1774727 - DNA, 22 bp, Homo sapiens
agttctaggcactgtagttcta

SEQ ID NO: 1774728 - DNA, 18 bp, Homo sapiens
agttctagtgcagctgaa

SEQ ID NO: 1774729 - DNA, 22 bp, Homo sapiens
agttctagtgcagctgaaattg

SEQ ID NO: 1774730 - DNA, 23 bp, Homo sapiens
agttctagtgcagctgaaattga

SEQ ID NO: 1774731 - DNA, 15 bp, Homo sapiens
agttctagtttgcat

SEQ ID NO: 1774732 - DNA, 19 bp, Homo sapiens
agttctatccccaagctgg

SEQ ID NO: 1774733 - DNA, 13 bp, Homo sapiens
agttctatttcta

SEQ ID NO: 1774734 - DNA, 14 bp, Homo sapiens
agttctatttctat

SEQ ID NO: 1774735 - DNA, 15 bp, Homo sapiens
agttctcagaataac

SEQ ID NO: 1774736 - DNA, 17 bp, Homo sapiens
agttctccttttgaact

SEQ ID NO: 1774737 - DNA, 21 bp, Homo sapiens
agttctctcatcggaggccca

SEQ ID NO: 1774738 - DNA, 16 bp, Homo sapiens
agttctctgtggaagc

SEQ ID NO: 1774739 - DNA, 11 bp, Homo sapiens
agttctgaaag

SEQ ID NO: 1774740 - DNA, 22 bp, Homo sapiens
agttctgagtgtttttactaca

SEQ ID NO: 1774741 - DNA, 23 bp, Homo sapiens
agttctgctacattataatgtac

SEQ ID NO: 1774742 - DNA, 12 bp, Homo sapiens
agttctgctcta

SEQ ID NO: 1774743 - DNA, 12 bp, Homo sapiens
agttctgctgcc

SEQ ID NO: 1774744 - DNA, 14 bp, Homo sapiens
agttctgctgccct

SEQ ID NO: 1774745 - DNA, 15 bp, Homo sapiens
agttctgctgccctc

SEQ ID NO: 1774746 - DNA, 16 bp, Homo sapiens
agttctgctgccctct

SEQ ID NO: 1774747 - DNA, 19 bp, Homo sapiens
agttctgctttctgcctct

SEQ ID NO: 1774748 - DNA, 21 bp, Homo sapiens
agttctggttcatgcagacaa

SEQ ID NO: 1774749 - DNA, 23 bp, Homo sapiens
agttctgtgcctccccccagacc

SEQ ID NO: 1774750 - DNA, 16 bp, Homo sapiens
agttctgtggtttcat

SEQ ID NO: 1774751 - DNA, 14 bp, Homo sapiens
agttctgtgtactt

SEQ ID NO: 1774752 - DNA, 18 bp, Homo sapiens
agttctgtgtgtctggtg

SEQ ID NO: 1774753 - DNA, 14 bp, Homo sapiens
agttcttaacccag

SEQ ID NO: 1774754 - DNA, 22 bp, Homo sapiens
agttcttaaggattgtgatatt

SEQ ID NO: 1774755 - DNA, 20 bp, Homo sapiens
agttcttatgaggaggggag

SEQ ID NO: 1774756 - DNA, 13 bp, Homo sapiens
agttcttgtgcca

SEQ ID NO: 1774757 - DNA, 20 bp, Homo sapiens
agttctttcctccccctgca

SEQ ID NO: 1774758 - DNA, 21 bp, Homo sapiens
agttctttcctccccctgcaa

SEQ ID NO: 1774759 - DNA, 14 bp, Homo sapiens
agttctttcctctt

SEQ ID NO: 1774760 - DNA, 19 bp, Homo sapiens
agttctttcctctttctgc

SEQ ID NO: 1774761 - DNA, 20 bp, Homo sapiens
agttctttcctctttctgct

SEQ ID NO: 1774762 - DNA, 23 bp, Homo sapiens
agttctttcctctttctgctctg

SEQ ID NO: 1774763 - DNA, 16 bp, Homo sapiens
agttctttgattctgt

SEQ ID NO: 1774764 - DNA, 15 bp, Homo sapiens
agttctttgggccag

SEQ ID NO: 1774765 - DNA, 13 bp, Homo sapiens
agttgaaaaagga

SEQ ID NO: 1774766 - DNA, 14 bp, Homo sapiens
agttgaaaaaggaa

SEQ ID NO: 1774767 - DNA, 16 bp, Homo sapiens
agttgaaaaatctagt

SEQ ID NO: 1774768 - DNA, 21 bp, Homo sapiens
agttgaaaagactccaaagaa

SEQ ID NO: 1774769 - DNA, 18 bp, Homo sapiens
agttgaaaagccaaaggt

SEQ ID NO: 1774770 - DNA, 18 bp, Homo sapiens
agttgaaaggcctcaaga

SEQ ID NO: 1774771 - DNA, 13 bp, Homo sapiens
agttgaagggaaa

SEQ ID NO: 1774772 - DNA, 22 bp, Homo sapiens
agttgaagggaaacaaagaagt

SEQ ID NO: 1774773 - DNA, 18 bp, Homo sapiens
agttgaagggaggtgaag

SEQ ID NO: 1774774 - DNA, 22 bp, Homo sapiens
agttgaattttttctaaaaaga

SEQ ID NO: 1774775 - DNA, 21 bp, Homo sapiens
agttgaattttttttaacatt

SEQ ID NO: 1774776 - DNA, 23 bp, Homo sapiens
agttgaattttttttaacattcc

SEQ ID NO: 1774777 - DNA, 17 bp, Homo sapiens
agttgacaacctagaat

SEQ ID NO: 1774778 - DNA, 22 bp, Homo sapiens
agttgcgacggagagaaaaaag

SEQ ID NO: 1774779 - DNA, 23 bp, Homo sapiens
agttgctgatccctgctctctga

SEQ ID NO: 1774780 - DNA, 16 bp, Homo sapiens
agttgctgtgaacttt

SEQ ID NO: 1774781 - DNA, 20 bp, Homo sapiens
agttgctgtgtgtctgtcct

SEQ ID NO: 1774782 - DNA, 17 bp, Homo sapiens
agttgcttaattttgat

SEQ ID NO: 1774783 - DNA, 22 bp, Homo sapiens
agttgctttaaagtacctgtag

SEQ ID NO: 1774784 - DNA, 17 bp, Homo sapiens
agttgctttgccagagc

SEQ ID NO: 1774785 - DNA, 19 bp, Homo sapiens
agttgctttgccagagcag

SEQ ID NO: 1774786 - DNA, 13 bp, Homo sapiens
agttgcttttcag

SEQ ID NO: 1774787 - DNA, 16 bp, Homo sapiens
agttgcttttttgact

SEQ ID NO: 1774788 - DNA, 16 bp, Homo sapiens
agttggaaagttggaa

SEQ ID NO: 1774789 - DNA, 16 bp, Homo sapiens
agttggactctcaggg

SEQ ID NO: 1774790 - DNA, 17 bp, Homo sapiens
agttggactctcaggga

SEQ ID NO: 1774791 - DNA, 15 bp, Homo sapiens
agttggagaccaggc

SEQ ID NO: 1774792 - DNA, 14 bp, Homo sapiens
agttggagcagggg

SEQ ID NO: 1774793 - DNA, 17 bp, Homo sapiens
agttggagtagaatgta

SEQ ID NO: 1774794 - DNA, 14 bp, Homo sapiens
agttggcagagaag

SEQ ID NO: 1774795 - DNA, 21 bp, Homo sapiens
agttggcagagaaggcctctt

SEQ ID NO: 1774796 - DNA, 23 bp, Homo sapiens
agttggcaggagctcctggaagc

SEQ ID NO: 1774797 - DNA, 15 bp, Homo sapiens
agttggccaagcaga

SEQ ID NO: 1774798 - DNA, 20 bp, Homo sapiens
agttggccagcgtcttgctc

SEQ ID NO: 1774799 - DNA, 15 bp, Homo sapiens
agttggccaggctct

SEQ ID NO: 1774800 - DNA, 23 bp, Homo sapiens
agttgggatgccaatttcctctc

SEQ ID NO: 1774801 - DNA, 15 bp, Homo sapiens
agttgggcccctgag

SEQ ID NO: 1774802 - DNA, 17 bp, Homo sapiens
agttgggcccctgagga

SEQ ID NO: 1774803 - DNA, 17 bp, Homo sapiens
agttggggacagaactc

SEQ ID NO: 1774804 - DNA, 17 bp, Homo sapiens
agttgggggagggaaga

SEQ ID NO: 1774805 - DNA, 13 bp, Homo sapiens
agttggtaacttt

SEQ ID NO: 1774806 - DNA, 20 bp, Homo sapiens
agttggtaacttttgtgaat

SEQ ID NO: 1774807 - DNA, 18 bp, Homo sapiens
agttggtgactgggaaag

SEQ ID NO: 1774808 - DNA, 14 bp, Homo sapiens
agttggtttgtatg

SEQ ID NO: 1774809 - DNA, 18 bp, Homo sapiens
agttgtaaagtatgtatt

SEQ ID NO: 1774810 - DNA, 16 bp, Homo sapiens
agttgtaacttatatt

SEQ ID NO: 1774811 - DNA, 17 bp, Homo sapiens
agttgtaacttatattg

SEQ ID NO: 1774812 - DNA, 20 bp, Homo sapiens
agttgtactttaaaaattta

SEQ ID NO: 1774813 - DNA, 23 bp, Homo sapiens
agttgtactttaaaaatttacta

SEQ ID NO: 1774814 - DNA, 18 bp, Homo sapiens
agttgtagacaaagtaca

SEQ ID NO: 1774815 - DNA, 23 bp, Homo sapiens
agttgtagacaaagtacattctg

SEQ ID NO: 1774816 - DNA, 20 bp, Homo sapiens
agttgtatcagcacgtgtgg

SEQ ID NO: 1774817 - DNA, 22 bp, Homo sapiens
agttgtatctcttttgaatcca

SEQ ID NO: 1774818 - DNA, 15 bp, Homo sapiens
agttgtatgtttgct

SEQ ID NO: 1774819 - DNA, 16 bp, Homo sapiens
agttgtatgtttgctg

SEQ ID NO: 1774820 - DNA, 20 bp, Homo sapiens
agttgtatttaacagaaatt

SEQ ID NO: 1774821 - DNA, 22 bp, Homo sapiens
agttgtatttaacagaaattgt

SEQ ID NO: 1774822 - DNA, 21 bp, Homo sapiens
agttgtcctatggacaactta

SEQ ID NO: 1774823 - DNA, 18 bp, Homo sapiens
agttgtctattctgagcc

SEQ ID NO: 1774824 - DNA, 19 bp, Homo sapiens
agttgtctattctgagcct

SEQ ID NO: 1774825 - DNA, 20 bp, Homo sapiens
agttgtctattctgagcctt

SEQ ID NO: 1774826 - DNA, 12 bp, Homo sapiens
agttgtcttaaa

SEQ ID NO: 1774827 - DNA, 23 bp, Homo sapiens
agttgtcttatgtgaaaaattaa

SEQ ID NO: 1774828 - DNA, 20 bp, Homo sapiens
agttgtgaaagaaagctgag

SEQ ID NO: 1774829 - DNA, 15 bp, Homo sapiens
agttgtgaatacatt

SEQ ID NO: 1774830 - DNA, 14 bp, Homo sapiens
agttgtgcttgttt

SEQ ID NO: 1774831 - DNA, 16 bp, Homo sapiens
agttgtgcttttctgt

SEQ ID NO: 1774832 - DNA, 13 bp, Homo sapiens
agttgtggatatc

SEQ ID NO: 1774833 - DNA, 14 bp, Homo sapiens
agttgtgtttcaac

SEQ ID NO: 1774834 - DNA, 12 bp, Homo sapiens
agttgttaaaac

SEQ ID NO: 1774835 - DNA, 13 bp, Homo sapiens
agttgttgactgt

SEQ ID NO: 1774836 - DNA, 14 bp, Homo sapiens
agttgttggcctcc

SEQ ID NO: 1774837 - DNA, 12 bp, Homo sapiens
agttgttgtaac

SEQ ID NO: 1774838 - DNA, 16 bp, Homo sapiens
agttgttgtaacctgc

SEQ ID NO: 1774839 - DNA, 20 bp, Homo sapiens
agttgtttctaagagcagag

SEQ ID NO: 1774840 - DNA, 14 bp, Homo sapiens
agttgtttgcttct

SEQ ID NO: 1774841 - DNA, 16 bp, Homo sapiens
agttgtttgtttttgc

SEQ ID NO: 1774842 - DNA, 19 bp, Homo sapiens
agttgttttcagactcaga

SEQ ID NO: 1774843 - DNA, 20 bp, Homo sapiens
agttgttttccatcatttgg

SEQ ID NO: 1774844 - DNA, 15 bp, Homo sapiens
agtttaaaaaaataa

SEQ ID NO: 1774845 - DNA, 17 bp, Homo sapiens
agtttaaaaaaataaca

SEQ ID NO: 1774846 - DNA, 14 bp, Homo sapiens
agtttaaaatgcag

SEQ ID NO: 1774847 - DNA, 18 bp, Homo sapiens
agtttaagtaattgccta

SEQ ID NO: 1774848 - DNA, 17 bp, Homo sapiens
agtttaatacaggaaat

SEQ ID NO: 1774849 - DNA, 13 bp, Homo sapiens
agtttaatgtctc

SEQ ID NO: 1774850 - DNA, 15 bp, Homo sapiens
agtttaatgtctcct

SEQ ID NO: 1774851 - DNA, 18 bp, Homo sapiens
agtttacagaaaaatctt

SEQ ID NO: 1774852 - DNA, 14 bp, Homo sapiens
agtttacagatgtt

SEQ ID NO: 1774853 - DNA, 14 bp, Homo sapiens
agtttacattctaa

SEQ ID NO: 1774854 - DNA, 14 bp, Homo sapiens
agtttaccaatcaa

SEQ ID NO: 1774855 - DNA, 20 bp, Homo sapiens
agtttaccagttgcctttta

SEQ ID NO: 1774856 - DNA, 21 bp, Homo sapiens
agtttaccatttgtaataaag

SEQ ID NO: 1774857 - DNA, 14 bp, Homo sapiens
agtttaggagaaac

SEQ ID NO: 1774858 - DNA, 19 bp, Homo sapiens
agtttagtgtgtgtgcaga

SEQ ID NO: 1774859 - DNA, 16 bp, Homo sapiens
agtttagttctgttga

SEQ ID NO: 1774860 - DNA, 17 bp, Homo sapiens
agtttatacagtgtaca

SEQ ID NO: 1774861 - DNA, 22 bp, Homo sapiens
agtttatacagtgtacatgtac

SEQ ID NO: 1774862 - DNA, 22 bp, Homo sapiens
agtttatatttgaatatccatt

SEQ ID NO: 1774863 - DNA, 18 bp, Homo sapiens
agtttatcagtaaataac

SEQ ID NO: 1774864 - DNA, 21 bp, Homo sapiens
agtttatcttaagcatgtcaa

SEQ ID NO: 1774865 - DNA, 19 bp, Homo sapiens
agtttattacaatgtatct

SEQ ID NO: 1774866 - DNA, 13 bp, Homo sapiens
agtttatttccac

SEQ ID NO: 1774867 - DNA, 22 bp, Homo sapiens
agtttatttccactattttcaa

SEQ ID NO: 1774868 - DNA, 23 bp, Homo sapiens
agtttattttttctacacagtaa

SEQ ID NO: 1774869 - DNA, 17 bp, Homo sapiens
agtttcaaatctgtaat

SEQ ID NO: 1774870 - DNA, 18 bp, Homo sapiens
agtttcaagttttaaagt

SEQ ID NO: 1774871 - DNA, 22 bp, Homo sapiens
agtttcaagttttaaagttcat

SEQ ID NO: 1774872 - DNA, 17 bp, Homo sapiens
agtttcacagaaaataa

SEQ ID NO: 1774873 - DNA, 17 bp, Homo sapiens
agtttcactgtactgca

SEQ ID NO: 1774874 - DNA, 15 bp, Homo sapiens
agtttcagacagggt

SEQ ID NO: 1774875 - DNA, 21 bp, Homo sapiens
agtttcagtaaataatgaaaa

SEQ ID NO: 1774876 - DNA, 20 bp, Homo sapiens
agtttcagtattagatgcac

SEQ ID NO: 1774877 - DNA, 19 bp, Homo sapiens
agtttcagtttgttggaaa

SEQ ID NO: 1774878 - DNA, 21 bp, Homo sapiens
agtttcctgaagcatttagtt

SEQ ID NO: 1774879 - DNA, 14 bp, Homo sapiens
agtttctaagattc

SEQ ID NO: 1774880 - DNA, 16 bp, Homo sapiens
agtttctaagattcta

SEQ ID NO: 1774881 - DNA, 20 bp, Homo sapiens
agtttctaagattctaaagg

SEQ ID NO: 1774882 - DNA, 11 bp, Homo sapiens
agtttctaagg

SEQ ID NO: 1774883 - DNA, 14 bp, Homo sapiens
agtttctacattca

SEQ ID NO: 1774884 - DNA, 19 bp, Homo sapiens
agtttctagaattttatat

SEQ ID NO: 1774885 - DNA, 16 bp, Homo sapiens
agtttctagaggcctc

SEQ ID NO: 1774886 - DNA, 18 bp, Homo sapiens
agtttctagaggcctcag

SEQ ID NO: 1774887 - DNA, 22 bp, Homo sapiens
agtttctggtgccatttctgaa

SEQ ID NO: 1774888 - DNA, 23 bp, Homo sapiens
agtttctgttctccctgggaagc

SEQ ID NO: 1774889 - DNA, 16 bp, Homo sapiens
agtttctgtttcaaag

SEQ ID NO: 1774890 - DNA, 13 bp, Homo sapiens
agtttcttgcttg

SEQ ID NO: 1774891 - DNA, 18 bp, Homo sapiens
agtttcttgcttggaagc

SEQ ID NO: 1774892 - DNA, 16 bp, Homo sapiens
agtttcttgtaagcca

SEQ ID NO: 1774893 - DNA, 15 bp, Homo sapiens
agtttgaattcagta

SEQ ID NO: 1774894 - DNA, 20 bp, Homo sapiens
agtttgagacaagccctggc

SEQ ID NO: 1774895 - DNA, 16 bp, Homo sapiens
agtttgagaccagcct

SEQ ID NO: 1774896 - DNA, 17 bp, Homo sapiens
agtttgagaccagcctg

SEQ ID NO: 1774897 - DNA, 14 bp, Homo sapiens
agtttgagctgcct

SEQ ID NO: 1774898 - DNA, 15 bp, Homo sapiens
agtttgagctgcctt

SEQ ID NO: 1774899 - DNA, 20 bp, Homo sapiens
agtttgaggaaatttgcagc

SEQ ID NO: 1774900 - DNA, 21 bp, Homo sapiens
agtttgattgaggagctgcac

SEQ ID NO: 1774901 - DNA, 21 bp, Homo sapiens
agtttgcaaataggcagaatg

SEQ ID NO: 1774902 - DNA, 24 bp, Homo sapiens
agtttgcacaagttcatctcattt

SEQ ID NO: 1774903 - DNA, 10 bp, Homo sapiens
agtttgcact

SEQ ID NO: 1774904 - DNA, 23 bp, Homo sapiens
agtttgcactcaaatcttaagaa

SEQ ID NO: 1774905 - DNA, 22 bp, Homo sapiens
agtttgcagaaaagcacctgcc

SEQ ID NO: 1774906 - DNA, 23 bp, Homo sapiens
agtttgcagaaaagcacctgccg

SEQ ID NO: 1774907 - DNA, 11 bp, Homo sapiens
agtttgcagtt

SEQ ID NO: 1774908 - DNA, 23 bp, Homo sapiens
agtttgcatacttcctggatttt

SEQ ID NO: 1774909 - DNA, 15 bp, Homo sapiens
agtttgcattcctga

SEQ ID NO: 1774910 - DNA, 22 bp, Homo sapiens
agtttgccggatacaaactggt

SEQ ID NO: 1774911 - DNA, 23 bp, Homo sapiens
agtttgctagcagaaatctagaa

SEQ ID NO: 1774912 - DNA, 14 bp, Homo sapiens
agtttgctattaga

SEQ ID NO: 1774913 - DNA, 11 bp, Homo sapiens
agtttgcttag

SEQ ID NO: 1774914 - DNA, 13 bp, Homo sapiens
agtttgcttagaa

SEQ ID NO: 1774915 - DNA, 14 bp, Homo sapiens
agtttgcttagaaa

SEQ ID NO: 1774916 - DNA, 12 bp, Homo sapiens
agtttggccctg

SEQ ID NO: 1774917 - DNA, 13 bp, Homo sapiens
agtttggccctgg

SEQ ID NO: 1774918 - DNA, 17 bp, Homo sapiens
agtttggccctggagcc

SEQ ID NO: 1774919 - DNA, 19 bp, Homo sapiens
agtttggccctggagccag

SEQ ID NO: 1774920 - DNA, 20 bp, Homo sapiens
agtttggccctggagccagg

SEQ ID NO: 1774921 - DNA, 19 bp, Homo sapiens
agtttggctataagtgctc

SEQ ID NO: 1774922 - DNA, 17 bp, Homo sapiens
agtttgtagaactttat

SEQ ID NO: 1774923 - DNA, 12 bp, Homo sapiens
agtttgtagcca

SEQ ID NO: 1774924 - DNA, 15 bp, Homo sapiens
agtttgtagccaggt

SEQ ID NO: 1774925 - DNA, 19 bp, Homo sapiens
agtttgtagtaaaagtggt

SEQ ID NO: 1774926 - DNA, 18 bp, Homo sapiens
agtttgtattttgcatac

SEQ ID NO: 1774927 - DNA, 14 bp, Homo sapiens
agtttgtcattata

SEQ ID NO: 1774928 - DNA, 19 bp, Homo sapiens
agtttgtcgctcatgtgtg

SEQ ID NO: 1774929 - DNA, 13 bp, Homo sapiens
agtttgtctattt

SEQ ID NO: 1774930 - DNA, 21 bp, Homo sapiens
agtttgtgtctgttgcttgta

SEQ ID NO: 1774931 - DNA, 17 bp, Homo sapiens
agtttgtgtgtatttgt

SEQ ID NO: 1774932 - DNA, 19 bp, Homo sapiens
agtttgtgtgtatttgtat

SEQ ID NO: 1774933 - DNA, 21 bp, Homo sapiens
agtttgtgtgtatttgtatta

SEQ ID NO: 1774934 - DNA, 15 bp, Homo sapiens
agtttgtgtgtctta

SEQ ID NO: 1774935 - DNA, 23 bp, Homo sapiens
agtttgttatagatttagctatt

SEQ ID NO: 1774936 - DNA, 13 bp, Homo sapiens
agtttgttggaaa

SEQ ID NO: 1774937 - DNA, 20 bp, Homo sapiens
agttttaaaaggctcccatg

SEQ ID NO: 1774938 - DNA, 14 bp, Homo sapiens
agttttaaaagtct

SEQ ID NO: 1774939 - DNA, 19 bp, Homo sapiens
agttttaacacttctagat

SEQ ID NO: 1774940 - DNA, 16 bp, Homo sapiens
agttttaatccagaat

SEQ ID NO: 1774941 - DNA, 20 bp, Homo sapiens
agttttacttttaaactgtg

SEQ ID NO: 1774942 - DNA, 20 bp, Homo sapiens
agttttagggtacagtttgg

SEQ ID NO: 1774943 - DNA, 19 bp, Homo sapiens
agttttagggtacatgtgc

SEQ ID NO: 1774944 - DNA, 17 bp, Homo sapiens
agttttagtctttagaa

SEQ ID NO: 1774945 - DNA, 21 bp, Homo sapiens
agttttagttgcagaaacatt

SEQ ID NO: 1774946 - DNA, 19 bp, Homo sapiens
agttttatagcctggactg

SEQ ID NO: 1774947 - DNA, 16 bp, Homo sapiens
agttttattgagaatt

SEQ ID NO: 1774948 - DNA, 14 bp, Homo sapiens
agttttcaaactgc

SEQ ID NO: 1774949 - DNA, 22 bp, Homo sapiens
agttttcaaactgctgcatact

SEQ ID NO: 1774950 - DNA, 18 bp, Homo sapiens
agttttcagaacctcttc

SEQ ID NO: 1774951 - DNA, 16 bp, Homo sapiens
agttttcagccttggg

SEQ ID NO: 1774952 - DNA, 15 bp, Homo sapiens
agttttcattaaatc

SEQ ID NO: 1774953 - DNA, 20 bp, Homo sapiens
agttttccctgcactgtgtc

SEQ ID NO: 1774954 - DNA, 12 bp, Homo sapiens
agttttccttct

SEQ ID NO: 1774955 - DNA, 14 bp, Homo sapiens
agttttccttctca

SEQ ID NO: 1774956 - DNA, 13 bp, Homo sapiens
agttttccttctg

SEQ ID NO: 1774957 - DNA, 14 bp, Homo sapiens
agttttccttctgt

SEQ ID NO: 1774958 - DNA, 21 bp, Homo sapiens
agttttccttctgttaaaatg

SEQ ID NO: 1774959 - DNA, 18 bp, Homo sapiens
agttttctgagaaagact

SEQ ID NO: 1774960 - DNA, 19 bp, Homo sapiens
agttttctgagaaagacta

SEQ ID NO: 1774961 - DNA, 23 bp, Homo sapiens
agttttctgagaaagactattca

SEQ ID NO: 1774962 - DNA, 14 bp, Homo sapiens
agttttgaaagaaa

SEQ ID NO: 1774963 - DNA, 20 bp, Homo sapiens
agttttgattttggaaagat

SEQ ID NO: 1774964 - DNA, 16 bp, Homo sapiens
agttttgcatttatgg

SEQ ID NO: 1774965 - DNA, 16 bp, Homo sapiens
agttttgtaaaagaaa

SEQ ID NO: 1774966 - DNA, 22 bp, Homo sapiens
agttttgtaaaagaaatcatgt

SEQ ID NO: 1774967 - DNA, 11 bp, Homo sapiens
agttttgtata

SEQ ID NO: 1774968 - DNA, 18 bp, Homo sapiens
agttttgtataaataata

SEQ ID NO: 1774969 - DNA, 20 bp, Homo sapiens
agttttgtataaataataaa

SEQ ID NO: 1774970 - DNA, 13 bp, Homo sapiens
agttttgtcagaa

SEQ ID NO: 1774971 - DNA, 15 bp, Homo sapiens
agttttgtctgtctc

SEQ ID NO: 1774972 - DNA, 14 bp, Homo sapiens
agttttgttgcccc

SEQ ID NO: 1774973 - DNA, 18 bp, Homo sapiens
agttttgttgtacttaaa

SEQ ID NO: 1774974 - DNA, 23 bp, Homo sapiens
agttttgttttaaaactggacct

SEQ ID NO: 1774975 - DNA, 18 bp, Homo sapiens
agttttgttttaaaatta

SEQ ID NO: 1774976 - DNA, 21 bp, Homo sapiens
agtttttaaaatatattgctg

SEQ ID NO: 1774977 - DNA, 15 bp, Homo sapiens
agtttttaaagcctt

SEQ ID NO: 1774978 - DNA, 18 bp, Homo sapiens
agtttttaaagccttctg

SEQ ID NO: 1774979 - DNA, 21 bp, Homo sapiens
agtttttaaagccttctggat

SEQ ID NO: 1774980 - DNA, 17 bp, Homo sapiens
agtttttatatgttgta

SEQ ID NO: 1774981 - DNA, 21 bp, Homo sapiens
agtttttcaggagcgcaagat

SEQ ID NO: 1774982 - DNA, 18 bp, Homo sapiens
agtttttcattaaataaa

SEQ ID NO: 1774983 - DNA, 13 bp, Homo sapiens
agtttttcatttg

SEQ ID NO: 1774984 - DNA, 15 bp, Homo sapiens
agtttttcatttgtt

SEQ ID NO: 1774985 - DNA, 15 bp, Homo sapiens
agtttttcctggaat

SEQ ID NO: 1774986 - DNA, 17 bp, Homo sapiens
agtttttgaaaattatg

SEQ ID NO: 1774987 - DNA, 19 bp, Homo sapiens
agtttttgaaaattatgca

SEQ ID NO: 1774988 - DNA, 21 bp, Homo sapiens
agtttttgaaaattatgcaaa

SEQ ID NO: 1774989 - DNA, 13 bp, Homo sapiens
agtttttgatagt

SEQ ID NO: 1774990 - DNA, 22 bp, Homo sapiens
agtttttgatcaagaatgcaat

SEQ ID NO: 1774991 - DNA, 11 bp, Homo sapiens
agtttttgctt

SEQ ID NO: 1774992 - DNA, 17 bp, Homo sapiens
agtttttggttgggaat

SEQ ID NO: 1774993 - DNA, 14 bp, Homo sapiens
agtttttttctttg

SEQ ID NO: 1774994 - DNA, 11 bp, Homo sapiens
ataaaaaagat

SEQ ID NO: 1774995 - DNA, 19 bp, Homo sapiens
ataaaaaatcctcaacact

SEQ ID NO: 1774996 - DNA, 20 bp, Homo sapiens
ataaaaaatctttagggaat

SEQ ID NO: 1774997 - DNA, 17 bp, Homo sapiens
ataaaaacaagtcattt

SEQ ID NO: 1774998 - DNA, 17 bp, Homo sapiens
ataaaaactaatttcat

SEQ ID NO: 1774999 - DNA, 21 bp, Homo sapiens
ataaaaagaaaaaaatggaaa

SEQ ID NO: 1775000 - DNA, 22 bp, Homo sapiens
ataaaaagaaaagataaagatg

SEQ ID NO: 1775001 - DNA, 14 bp, Homo sapiens
ataaaaagaaaggc

SEQ ID NO: 1775002 - DNA, 14 bp, Homo sapiens
ataaaaagagaaac

SEQ ID NO: 1775003 - DNA, 18 bp, Homo sapiens
ataaaaagatcactttct

SEQ ID NO: 1775004 - DNA, 22 bp, Homo sapiens
ataaaaagatcactttctcagt

SEQ ID NO: 1775005 - DNA, 13 bp, Homo sapiens
ataaaaagcagaa

SEQ ID NO: 1775006 - DNA, 23 bp, Homo sapiens
ataaaaagcatttggtgcctatt

SEQ ID NO: 1775007 - DNA, 13 bp, Homo sapiens
ataaaaagcctct

SEQ ID NO: 1775008 - DNA, 22 bp, Homo sapiens
ataaaaagcctgcaatttcata

SEQ ID NO: 1775009 - DNA, 13 bp, Homo sapiens
ataaaaaggaata

SEQ ID NO: 1775010 - DNA, 17 bp, Homo sapiens
ataaaaagtaatgactt

SEQ ID NO: 1775011 - DNA, 19 bp, Homo sapiens
ataaaaagtgacacagcag

SEQ ID NO: 1775012 - DNA, 23 bp, Homo sapiens
ataaaaagtttcacaggtcaata

SEQ ID NO: 1775013 - DNA, 19 bp, Homo sapiens
ataaaaataaaaaagatcc

SEQ ID NO: 1775014 - DNA, 13 bp, Homo sapiens
ataaaaatacaca

SEQ ID NO: 1775015 - DNA, 15 bp, Homo sapiens
ataaaaatacacatg

SEQ ID NO: 1775016 - DNA, 20 bp, Homo sapiens
ataaaaatacacatgaaaac

SEQ ID NO: 1775017 - DNA, 21 bp, Homo sapiens
ataaaaatacacatgaaaaca

SEQ ID NO: 1775018 - DNA, 14 bp, Homo sapiens
ataaaaatattgtg

SEQ ID NO: 1775019 - DNA, 23 bp, Homo sapiens
ataaaaatattgtgttgtgaatg

SEQ ID NO: 1775020 - DNA, 19 bp, Homo sapiens
ataaaaatcatggcaacat

SEQ ID NO: 1775021 - DNA, 13 bp, Homo sapiens
ataaaaatgcatt

SEQ ID NO: 1775022 - DNA, 12 bp, Homo sapiens
ataaaaatggat

SEQ ID NO: 1775023 - DNA, 16 bp, Homo sapiens
ataaaacaataaatga

SEQ ID NO: 1775024 - DNA, 17 bp, Homo sapiens
ataaaacaataaatgaa

SEQ ID NO: 1775025 - DNA, 20 bp, Homo sapiens
ataaaactgcgaggacatca

SEQ ID NO: 1775026 - DNA, 22 bp, Homo sapiens
ataaaactgcgaggacatcaaa

SEQ ID NO: 1775027 - DNA, 17 bp, Homo sapiens
ataaaacttaaaaacaa

SEQ ID NO: 1775028 - DNA, 11 bp, Homo sapiens
ataaaagcaaa

SEQ ID NO: 1775029 - DNA, 14 bp, Homo sapiens
ataaaagcaaaaga

SEQ ID NO: 1775030 - DNA, 12 bp, Homo sapiens
ataaaagcaatt

SEQ ID NO: 1775031 - DNA, 21 bp, Homo sapiens
ataaaagcaattctgactgtc

SEQ ID NO: 1775032 - DNA, 13 bp, Homo sapiens
ataaaagctataa

SEQ ID NO: 1775033 - DNA, 14 bp, Homo sapiens
ataaaaggttgcca

SEQ ID NO: 1775034 - DNA, 16 bp, Homo sapiens
ataaaaggtttctttt

SEQ ID NO: 1775035 - DNA, 23 bp, Homo sapiens
ataaaaggtttctttttttttcc

SEQ ID NO: 1775036 - DNA, 13 bp, Homo sapiens
ataaaagtgatca

SEQ ID NO: 1775037 - DNA, 17 bp, Homo sapiens
ataaaagtgatcaataa

SEQ ID NO: 1775038 - DNA, 18 bp, Homo sapiens
ataaaagtgatcaataaa

SEQ ID NO: 1775039 - DNA, 16 bp, Homo sapiens
ataaaagttttctcca

SEQ ID NO: 1775040 - DNA, 14 bp, Homo sapiens
ataaaataaagtat

SEQ ID NO: 1775041 - DNA, 18 bp, Homo sapiens
ataaaataacttgcatct

SEQ ID NO: 1775042 - DNA, 21 bp, Homo sapiens
ataaaataagtggattttgta

SEQ ID NO: 1775043 - DNA, 15 bp, Homo sapiens
ataaaatataaacaa

SEQ ID NO: 1775044 - DNA, 15 bp, Homo sapiens
ataaaatatcataaa

SEQ ID NO: 1775045 - DNA, 17 bp, Homo sapiens
ataaaatatcataaagc

SEQ ID NO: 1775046 - DNA, 17 bp, Homo sapiens
ataaaatattcactctc

SEQ ID NO: 1775047 - DNA, 11 bp, Homo sapiens
ataaaatattt

SEQ ID NO: 1775048 - DNA, 15 bp, Homo sapiens
ataaaatcataagta

SEQ ID NO: 1775049 - DNA, 16 bp, Homo sapiens
ataaaatcctgtgcaa

SEQ ID NO: 1775050 - DNA, 11 bp, Homo sapiens
ataaaatctga

SEQ ID NO: 1775051 - DNA, 13 bp, Homo sapiens
ataaaatctgaat

SEQ ID NO: 1775052 - DNA, 18 bp, Homo sapiens
ataaaatctgaattttgc

SEQ ID NO: 1775053 - DNA, 18 bp, Homo sapiens
ataaaatctgctgcacct

SEQ ID NO: 1775054 - DNA, 13 bp, Homo sapiens
ataaaatgaaaga

SEQ ID NO: 1775055 - DNA, 15 bp, Homo sapiens
ataaaatgaaagatt

SEQ ID NO: 1775056 - DNA, 23 bp, Homo sapiens
ataaaatgaacatctcttgaaac

SEQ ID NO: 1775057 - DNA, 16 bp, Homo sapiens
ataaaatggctgtaat

SEQ ID NO: 1775058 - DNA, 13 bp, Homo sapiens
ataaaatgtgatt

SEQ ID NO: 1775059 - DNA, 11 bp, Homo sapiens
ataaaatgtgc

SEQ ID NO: 1775060 - DNA, 14 bp, Homo sapiens
ataaaatgtgtaca

SEQ ID NO: 1775061 - DNA, 16 bp, Homo sapiens
ataaaatgtgtacagt

SEQ ID NO: 1775062 - DNA, 14 bp, Homo sapiens
ataaaatgtttcat

SEQ ID NO: 1775063 - DNA, 15 bp, Homo sapiens
ataaaattcctatct

SEQ ID NO: 1775064 - DNA, 16 bp, Homo sapiens
ataaaattcctatctc

SEQ ID NO: 1775065 - DNA, 22 bp, Homo sapiens
ataaaattctattacagtatgt

SEQ ID NO: 1775066 - DNA, 18 bp, Homo sapiens
ataaaatttacatttaat

SEQ ID NO: 1775067 - DNA, 22 bp, Homo sapiens
ataaaatttacatttaatacag

SEQ ID NO: 1775068 - DNA, 21 bp, Homo sapiens
ataaaatttccttcaggtttt

SEQ ID NO: 1775069 - DNA, 17 bp, Homo sapiens
ataaacagacaaaaaca

SEQ ID NO: 1775070 - DNA, 14 bp, Homo sapiens
ataaacagacaata

SEQ ID NO: 1775071 - DNA, 20 bp, Homo sapiens
ataaacagactgttaattat

SEQ ID NO: 1775072 - DNA, 22 bp, Homo sapiens
ataaacagcttcatgcctttgt

SEQ ID NO: 1775073 - DNA, 18 bp, Homo sapiens
ataaacaggaattttatt

SEQ ID NO: 1775074 - DNA, 22 bp, Homo sapiens
ataaacatatttttatacttta

SEQ ID NO: 1775075 - DNA, 17 bp, Homo sapiens
ataaacatgtgccctca

SEQ ID NO: 1775076 - DNA, 23 bp, Homo sapiens
ataaacattaattttgtgcattc

SEQ ID NO: 1775077 - DNA, 12 bp, Homo sapiens
ataaacattttt

SEQ ID NO: 1775078 - DNA, 16 bp, Homo sapiens
ataaacattttttaag

SEQ ID NO: 1775079 - DNA, 14 bp, Homo sapiens
ataaacctgaggca

SEQ ID NO: 1775080 - DNA, 16 bp, Homo sapiens
ataaacctgttttgca

SEQ ID NO: 1775081 - DNA, 20 bp, Homo sapiens
ataaacgtgatgatcagctg

SEQ ID NO: 1775082 - DNA, 14 bp, Homo sapiens
ataaactaccaaat

SEQ ID NO: 1775083 - DNA, 14 bp, Homo sapiens
ataaactagtttcc

SEQ ID NO: 1775084 - DNA, 18 bp, Homo sapiens
ataaactagtttccagtg

SEQ ID NO: 1775085 - DNA, 19 bp, Homo sapiens
ataaactagtttccagtgg

SEQ ID NO: 1775086 - DNA, 19 bp, Homo sapiens
ataaactataaacttaagg

SEQ ID NO: 1775087 - DNA, 18 bp, Homo sapiens
ataaactcagatctgatc

SEQ ID NO: 1775088 - DNA, 14 bp, Homo sapiens
ataaactgagcctc

SEQ ID NO: 1775089 - DNA, 19 bp, Homo sapiens
ataaactgtattaaatctt

SEQ ID NO: 1775090 - DNA, 16 bp, Homo sapiens
ataaactgtgtttact

SEQ ID NO: 1775091 - DNA, 20 bp, Homo sapiens
ataaacttagaggaaaatga

SEQ ID NO: 1775092 - DNA, 21 bp, Homo sapiens
ataaacttgattatattgttt

SEQ ID NO: 1775093 - DNA, 18 bp, Homo sapiens
ataaagaaaaaaatacta

SEQ ID NO: 1775094 - DNA, 20 bp, Homo sapiens
ataaagaaaagacattttaa

SEQ ID NO: 1775095 - DNA, 22 bp, Homo sapiens
ataaagaactccttattttgta

SEQ ID NO: 1775096 - DNA, 23 bp, Homo sapiens
ataaagaactccttattttgtat

SEQ ID NO: 1775097 - DNA, 15 bp, Homo sapiens
ataaagaagaaaata

SEQ ID NO: 1775098 - DNA, 18 bp, Homo sapiens
ataaagacaatcactgcc

SEQ ID NO: 1775099 - DNA, 12 bp, Homo sapiens
ataaagacacct

SEQ ID NO: 1775100 - DNA, 11 bp, Homo sapiens
ataaagacagg

SEQ ID NO: 1775101 - DNA, 17 bp, Homo sapiens
ataaagaccagaaattc

SEQ ID NO: 1775102 - DNA, 16 bp, Homo sapiens
ataaagacccaggggg

SEQ ID NO: 1775103 - DNA, 22 bp, Homo sapiens
ataaagactcctaatagctttt

SEQ ID NO: 1775104 - DNA, 14 bp, Homo sapiens
ataaagataggatt

SEQ ID NO: 1775105 - DNA, 18 bp, Homo sapiens
ataaagcctgtattctca

SEQ ID NO: 1775106 - DNA, 18 bp, Homo sapiens
ataaagcctttgtatctt

SEQ ID NO: 1775107 - DNA, 22 bp, Homo sapiens
ataaagctcaaatgaaatgtat

SEQ ID NO: 1775108 - DNA, 14 bp, Homo sapiens
ataaagctgttatt

SEQ ID NO: 1775109 - DNA, 21 bp, Homo sapiens
ataaagctgttattcttgtta

SEQ ID NO: 1775110 - DNA, 14 bp, Homo sapiens
ataaaggcagctgc

SEQ ID NO: 1775111 - DNA, 18 bp, Homo sapiens
ataaaggcagctgcctct

SEQ ID NO: 1775112 - DNA, 23 bp, Homo sapiens
ataaaggcagctgcctctgctcc

SEQ ID NO: 1775113 - DNA, 17 bp, Homo sapiens
ataaaggcagttttcta

SEQ ID NO: 1775114 - DNA, 15 bp, Homo sapiens
ataaaggcgctaatt

SEQ ID NO: 1775115 - DNA, 14 bp, Homo sapiens
ataaagggaacaaa

SEQ ID NO: 1775116 - DNA, 19 bp, Homo sapiens
ataaagggagaatggtgct

SEQ ID NO: 1775117 - DNA, 23 bp, Homo sapiens
ataaagggagaatggtgctgttt

SEQ ID NO: 1775118 - DNA, 15 bp, Homo sapiens
ataaagggatttgac

SEQ ID NO: 1775119 - DNA, 14 bp, Homo sapiens
ataaaggtgtagaa

SEQ ID NO: 1775120 - DNA, 22 bp, Homo sapiens
ataaaggttgacaataaatgtg

SEQ ID NO: 1775121 - DNA, 18 bp, Homo sapiens
ataaaggtttaaagctga

SEQ ID NO: 1775122 - DNA, 14 bp, Homo sapiens
ataaagtacaaatg

SEQ ID NO: 1775123 - DNA, 16 bp, Homo sapiens
ataaagtagtaaaaga

SEQ ID NO: 1775124 - DNA, 17 bp, Homo sapiens
ataaagtataatgttta

SEQ ID NO: 1775125 - DNA, 21 bp, Homo sapiens
ataaagtcacttccagtgttg

SEQ ID NO: 1775126 - DNA, 21 bp, Homo sapiens
ataaagttctgagtgttttta

SEQ ID NO: 1775127 - DNA, 14 bp, Homo sapiens
ataaagttgctttt

SEQ ID NO: 1775128 - DNA, 23 bp, Homo sapiens
ataaagttggttcacttcaaagc

SEQ ID NO: 1775129 - DNA, 14 bp, Homo sapiens
ataaagtttacaag

SEQ ID NO: 1775130 - DNA, 16 bp, Homo sapiens
ataaataaaaatgcat

SEQ ID NO: 1775131 - DNA, 15 bp, Homo sapiens
ataaataaaaatgga

SEQ ID NO: 1775132 - DNA, 14 bp, Homo sapiens
ataaataaaagcta

SEQ ID NO: 1775133 - DNA, 19 bp, Homo sapiens
ataaataaaattcatttct

SEQ ID NO: 1775134 - DNA, 16 bp, Homo sapiens
ataaataaagaagaaa

SEQ ID NO: 1775135 - DNA, 22 bp, Homo sapiens
ataaataggtcaatacaaatgt

SEQ ID NO: 1775136 - DNA, 22 bp, Homo sapiens
ataaataggtttatattattga

SEQ ID NO: 1775137 - DNA, 11 bp, Homo sapiens
ataaatatgta

SEQ ID NO: 1775138 - DNA, 14 bp, Homo sapiens
ataaatatgtaata

SEQ ID NO: 1775139 - DNA, 20 bp, Homo sapiens
ataaatatttatgtagatgt

SEQ ID NO: 1775140 - DNA, 18 bp, Homo sapiens
ataaatatttttgccata

SEQ ID NO: 1775141 - DNA, 18 bp, Homo sapiens
ataaatatttttggggca

SEQ ID NO: 1775142 - DNA, 13 bp, Homo sapiens
ataaatccagtga

SEQ ID NO: 1775143 - DNA, 14 bp, Homo sapiens
ataaatccagtgac

SEQ ID NO: 1775144 - DNA, 15 bp, Homo sapiens
ataaatctgacccag

SEQ ID NO: 1775145 - DNA, 20 bp, Homo sapiens
ataaatctgtctgattctat

SEQ ID NO: 1775146 - DNA, 22 bp, Homo sapiens
ataaatctgtctgattctatgc

SEQ ID NO: 1775147 - DNA, 15 bp, Homo sapiens
ataaatctttggaaa

SEQ ID NO: 1775148 - DNA, 11 bp, Homo sapiens
ataaatgaagc

SEQ ID NO: 1775149 - DNA, 11 bp, Homo sapiens
ataaatgaatg

SEQ ID NO: 1775150 - DNA, 18 bp, Homo sapiens
ataaatgagctatgtatt

SEQ ID NO: 1775151 - DNA, 15 bp, Homo sapiens
ataaatgattatatt

SEQ ID NO: 1775152 - DNA, 16 bp, Homo sapiens
ataaatgattcttagt

SEQ ID NO: 1775153 - DNA, 15 bp, Homo sapiens
ataaatgcaatatta

SEQ ID NO: 1775154 - DNA, 23 bp, Homo sapiens
ataaatgcaatattaatgccttt

SEQ ID NO: 1775155 - DNA, 15 bp, Homo sapiens
ataaatgcataattt

SEQ ID NO: 1775156 - DNA, 15 bp, Homo sapiens
ataaatgccagagcc

SEQ ID NO: 1775157 - DNA, 22 bp, Homo sapiens
ataaatgtaatagccaaaccca

SEQ ID NO: 1775158 - DNA, 15 bp, Homo sapiens
ataaatgtacattaa

SEQ ID NO: 1775159 - DNA, 17 bp, Homo sapiens
ataaatgtataaatata

SEQ ID NO: 1775160 - DNA, 21 bp, Homo sapiens
ataaatgtatcatagaaatgt

SEQ ID NO: 1775161 - DNA, 15 bp, Homo sapiens
ataaattatatccgt

SEQ ID NO: 1775162 - DNA, 19 bp, Homo sapiens
ataaattatggcatttcta

SEQ ID NO: 1775163 - DNA, 11 bp, Homo sapiens
ataaattattt

SEQ ID NO: 1775164 - DNA, 15 bp, Homo sapiens
ataaattcaactttg

SEQ ID NO: 1775165 - DNA, 19 bp, Homo sapiens
ataaattcaataaaaacct

SEQ ID NO: 1775166 - DNA, 15 bp, Homo sapiens
ataaattcacctagt

SEQ ID NO: 1775167 - DNA, 12 bp, Homo sapiens
ataaattcagat

SEQ ID NO: 1775168 - DNA, 16 bp, Homo sapiens
ataaattcagatatat

SEQ ID NO: 1775169 - DNA, 21 bp, Homo sapiens
ataaattctataggaacatat

SEQ ID NO: 1775170 - DNA, 19 bp, Homo sapiens
ataaattctgacttatgaa

SEQ ID NO: 1775171 - DNA, 12 bp, Homo sapiens
ataaattggatt

SEQ ID NO: 1775172 - DNA, 17 bp, Homo sapiens
ataaattggattatttt

SEQ ID NO: 1775173 - DNA, 21 bp, Homo sapiens
ataaatttaaacttacaaact

SEQ ID NO: 1775174 - DNA, 16 bp, Homo sapiens
ataaatttaagcaaac

SEQ ID NO: 1775175 - DNA, 14 bp, Homo sapiens
ataaatttaataaa

SEQ ID NO: 1775176 - DNA, 21 bp, Homo sapiens
ataaatttcccagttaaagat

SEQ ID NO: 1775177 - DNA, 18 bp, Homo sapiens
ataaatttgacttttctg

SEQ ID NO: 1775178 - DNA, 13 bp, Homo sapiens
ataaatttgtaac

SEQ ID NO: 1775179 - DNA, 15 bp, Homo sapiens
ataaatttgtaactt

SEQ ID NO: 1775180 - DNA, 17 bp, Homo sapiens
ataaattttaaaaagga

SEQ ID NO: 1775181 - DNA, 19 bp, Homo sapiens
ataaattttaaaaaggaat

SEQ ID NO: 1775182 - DNA, 16 bp, Homo sapiens
ataaattttaaatgtt

SEQ ID NO: 1775183 - DNA, 16 bp, Homo sapiens
ataaattttttttggt

SEQ ID NO: 1775184 - DNA, 14 bp, Homo sapiens
ataacaaaaaataa

SEQ ID NO: 1775185 - DNA, 16 bp, Homo sapiens
ataacaaaaaataaat

SEQ ID NO: 1775186 - DNA, 16 bp, Homo sapiens
ataacaaccttttaca

SEQ ID NO: 1775187 - DNA, 21 bp, Homo sapiens
ataacaaccttttacattgtg

SEQ ID NO: 1775188 - DNA, 18 bp, Homo sapiens
ataacaactaacttgttt

SEQ ID NO: 1775189 - DNA, 20 bp, Homo sapiens
ataacaactatttttgttgt

SEQ ID NO: 1775190 - DNA, 15 bp, Homo sapiens
ataacaactctattt

SEQ ID NO: 1775191 - DNA, 14 bp, Homo sapiens
ataacaacttcata

SEQ ID NO: 1775192 - DNA, 13 bp, Homo sapiens
ataacaagagttt

SEQ ID NO: 1775193 - DNA, 18 bp, Homo sapiens
ataacaagagttttaaca

SEQ ID NO: 1775194 - DNA, 20 bp, Homo sapiens
ataacaagccaaacattctt

SEQ ID NO: 1775195 - DNA, 14 bp, Homo sapiens
ataacaatcactgg

SEQ ID NO: 1775196 - DNA, 16 bp, Homo sapiens
ataacaatgtgctctc

SEQ ID NO: 1775197 - DNA, 23 bp, Homo sapiens
ataacacatttttttgcatgcat

SEQ ID NO: 1775198 - DNA, 22 bp, Homo sapiens
ataacaccgtcccagggctctg

SEQ ID NO: 1775199 - DNA, 13 bp, Homo sapiens
ataacactgtatt

SEQ ID NO: 1775200 - DNA, 19 bp, Homo sapiens
ataacagattttttttgga

SEQ ID NO: 1775201 - DNA, 19 bp, Homo sapiens
ataacagggattgatttta

SEQ ID NO: 1775202 - DNA, 20 bp, Homo sapiens
ataacagggattgattttaa

SEQ ID NO: 1775203 - DNA, 21 bp, Homo sapiens
ataacagggattgattttaaa

SEQ ID NO: 1775204 - DNA, 15 bp, Homo sapiens
ataacagttatattt

SEQ ID NO: 1775205 - DNA, 17 bp, Homo sapiens
ataacatattcttgctt

SEQ ID NO: 1775206 - DNA, 20 bp, Homo sapiens
ataacatattcttgctttca

SEQ ID NO: 1775207 - DNA, 13 bp, Homo sapiens
ataacatctgaaa

SEQ ID NO: 1775208 - DNA, 21 bp, Homo sapiens
ataacatctttattgaaattc

SEQ ID NO: 1775209 - DNA, 12 bp, Homo sapiens
ataacatgtaat

SEQ ID NO: 1775210 - DNA, 16 bp, Homo sapiens
ataatcccagcacttt

SEQ ID NO: 1775211 - DNA, 13 bp, Homo sapiens
ataatcccagcta

SEQ ID NO: 1775212 - DNA, 14 bp, Homo sapiens
ataatcccagctac

SEQ ID NO: 1775213 - DNA, 20 bp, Homo sapiens
ataatcctgtgaaaatatga

SEQ ID NO: 1775214 - DNA, 22 bp, Homo sapiens
ataatcggcccacagctcccac

SEQ ID NO: 1775215 - DNA, 12 bp, Homo sapiens
ataatctagaac

SEQ ID NO: 1775216 - DNA, 13 bp, Homo sapiens
ataatctcaaagg

SEQ ID NO: 1775217 - DNA, 15 bp, Homo sapiens
ataatctcaaaggag

SEQ ID NO: 1775218 - DNA, 20 bp, Homo sapiens
ataatctcaaaggagaaaaa

SEQ ID NO: 1775219 - DNA, 17 bp, Homo sapiens
ataatcttataattgtt

SEQ ID NO: 1775220 - DNA, 20 bp, Homo sapiens
ataatcttctgccttctcat

SEQ ID NO: 1775221 - DNA, 18 bp, Homo sapiens
ataatgaaataatcagtg

SEQ ID NO: 1775222 - DNA, 15 bp, Homo sapiens
ataatgaatgaaaca

SEQ ID NO: 1775223 - DNA, 10 bp, Homo sapiens
ataatgagga

SEQ ID NO: 1775224 - DNA, 16 bp, Homo sapiens
ataatgatgatgatga

SEQ ID NO: 1775225 - DNA, 16 bp, Homo sapiens
ataatgcactgagtat

SEQ ID NO: 1775226 - DNA, 18 bp, Homo sapiens
ataatgcagaagtattct

SEQ ID NO: 1775227 - DNA, 20 bp, Homo sapiens
ataatgctacaattttaaga

SEQ ID NO: 1775228 - DNA, 18 bp, Homo sapiens
ataatgctgttgcctcat

SEQ ID NO: 1775229 - DNA, 22 bp, Homo sapiens
ataatggaaaatgccatgaatt

SEQ ID NO: 1775230 - DNA, 16 bp, Homo sapiens
ataatggaattatgta

SEQ ID NO: 1775231 - DNA, 16 bp, Homo sapiens
ataatggagaacaagt

SEQ ID NO: 1775232 - DNA, 17 bp, Homo sapiens
ataatggggcagacaca

SEQ ID NO: 1775233 - DNA, 18 bp, Homo sapiens
ataatggggcagacacaa

SEQ ID NO: 1775234 - DNA, 18 bp, Homo sapiens
ataatggttgactgggtt

SEQ ID NO: 1775235 - DNA, 14 bp, Homo sapiens
ataatgtaagctct

SEQ ID NO: 1775236 - DNA, 19 bp, Homo sapiens
ataatgtactcacatataa

SEQ ID NO: 1775237 - DNA, 20 bp, Homo sapiens
ataatgtactgatttcagta

SEQ ID NO: 1775238 - DNA, 23 bp, Homo sapiens
ataatgtattcatatttgtactt

SEQ ID NO: 1775239 - DNA, 14 bp, Homo sapiens
ataatgtattgttg

SEQ ID NO: 1775240 - DNA, 19 bp, Homo sapiens
ataatgtctctgtgagact

SEQ ID NO: 1775241 - DNA, 18 bp, Homo sapiens
ataatgtgcagaaaatat

SEQ ID NO: 1775242 - DNA, 12 bp, Homo sapiens
ataatgttaaca

SEQ ID NO: 1775243 - DNA, 11 bp, Homo sapiens
ataatgttctt

SEQ ID NO: 1775244 - DNA, 16 bp, Homo sapiens
ataatgttctttaatg

SEQ ID NO: 1775245 - DNA, 16 bp, Homo sapiens
ataatgtttattaaat

SEQ ID NO: 1775246 - DNA, 14 bp, Homo sapiens
ataatgtttgctat

SEQ ID NO: 1775247 - DNA, 19 bp, Homo sapiens
ataattaaaaaaaaaactt

SEQ ID NO: 1775248 - DNA, 13 bp, Homo sapiens
ataattaaagact

SEQ ID NO: 1775249 - DNA, 20 bp, Homo sapiens
ataattaaattttgagttct

SEQ ID NO: 1775250 - DNA, 12 bp, Homo sapiens
ataattaacact

SEQ ID NO: 1775251 - DNA, 18 bp, Homo sapiens
ataattaacacttaaggt

SEQ ID NO: 1775252 - DNA, 18 bp, Homo sapiens
ataattacattcctaact

SEQ ID NO: 1775253 - DNA, 23 bp, Homo sapiens
ataattacattcctaactagaat

SEQ ID NO: 1775254 - DNA, 16 bp, Homo sapiens
ataattataatatact

SEQ ID NO: 1775255 - DNA, 19 bp, Homo sapiens
ataattatgacagttatac

SEQ ID NO: 1775256 - DNA, 20 bp, Homo sapiens
ataattatgacagttatact

SEQ ID NO: 1775257 - DNA, 18 bp, Homo sapiens
ataattcaattttaaaga

SEQ ID NO: 1775258 - DNA, 17 bp, Homo sapiens
ataattcagaaggatct

SEQ ID NO: 1775259 - DNA, 13 bp, Homo sapiens
ataattcatttgt

SEQ ID NO: 1775260 - DNA, 12 bp, Homo sapiens
ataattccctat

SEQ ID NO: 1775261 - DNA, 22 bp, Homo sapiens
ataattctcattaaaagaatat

SEQ ID NO: 1775262 - DNA, 23 bp, Homo sapiens
ataattctcattaaaagaatatc

SEQ ID NO: 1775263 - DNA, 20 bp, Homo sapiens
ataattctgagttttgtgtt

SEQ ID NO: 1775264 - DNA, 13 bp, Homo sapiens
ataattctgtaaa

SEQ ID NO: 1775265 - DNA, 15 bp, Homo sapiens
ataattcttttctga

SEQ ID NO: 1775266 - DNA, 15 bp, Homo sapiens
ataattgatcaaatt

SEQ ID NO: 1775267 - DNA, 22 bp, Homo sapiens
ataattgcatcagttcattgac

SEQ ID NO: 1775268 - DNA, 13 bp, Homo sapiens
ataattgcattca

SEQ ID NO: 1775269 - DNA, 21 bp, Homo sapiens
ataattgtacaaaattaagca

SEQ ID NO: 1775270 - DNA, 20 bp, Homo sapiens
ataattgtgaccaatacatt

SEQ ID NO: 1775271 - DNA, 21 bp, Homo sapiens
ataattgtgaccaatacattt

SEQ ID NO: 1775272 - DNA, 20 bp, Homo sapiens
ataattgtgtagtaatgttt

SEQ ID NO: 1775273 - DNA, 15 bp, Homo sapiens
ataattgttctcaga

SEQ ID NO: 1775274 - DNA, 15 bp, Homo sapiens
ataattgttttgcta

SEQ ID NO: 1775275 - DNA, 18 bp, Homo sapiens
ataatttaataaaaagga

SEQ ID NO: 1775276 - DNA, 19 bp, Homo sapiens
ataatttaataaaaaggaa

SEQ ID NO: 1775277 - DNA, 13 bp, Homo sapiens
ataatttacctaa

SEQ ID NO: 1775278 - DNA, 12 bp, Homo sapiens
ataatttctaat

SEQ ID NO: 1775279 - DNA, 23 bp, Homo sapiens
ataatttctactctgtcttaaat

SEQ ID NO: 1775280 - DNA, 11 bp, Homo sapiens
ataatttgaat

SEQ ID NO: 1775281 - DNA, 14 bp, Homo sapiens
ataatttgtacaat

SEQ ID NO: 1775282 - DNA, 22 bp, Homo sapiens
atacatttctcctttgataaaa

SEQ ID NO: 1775283 - DNA, 16 bp, Homo sapiens
atacatttgataaagt

SEQ ID NO: 1775284 - DNA, 13 bp, Homo sapiens
atacatttgtatt

SEQ ID NO: 1775285 - DNA, 14 bp, Homo sapiens
atacatttgtattt

SEQ ID NO: 1775286 - DNA, 14 bp, Homo sapiens
atacattttctaaa

SEQ ID NO: 1775287 - DNA, 17 bp, Homo sapiens
atacattttctaaataa

SEQ ID NO: 1775288 - DNA, 24 bp, Homo sapiens
atacattttctaaataaaaatatg

SEQ ID NO: 1775289 - DNA, 16 bp, Homo sapiens
atacattttttaagct

SEQ ID NO: 1775290 - DNA, 17 bp, Homo sapiens
ataccaaattaaaaaaa

SEQ ID NO: 1775291 - DNA, 22 bp, Homo sapiens
ataccaaggtacaactgtattt

SEQ ID NO: 1775292 - DNA, 22 bp, Homo sapiens
ataccaattacccataaacagc

SEQ ID NO: 1775293 - DNA, 23 bp, Homo sapiens
ataccaattacccataaacagca

SEQ ID NO: 1775294 - DNA, 15 bp, Homo sapiens
ataccacatcaaata

SEQ ID NO: 1775295 - DNA, 19 bp, Homo sapiens
ataccagagccttcaagtg

SEQ ID NO: 1775296 - DNA, 18 bp, Homo sapiens
ataccagcttaatagctg

SEQ ID NO: 1775297 - DNA, 14 bp, Homo sapiens
ataccaggttgaaa

SEQ ID NO: 1775298 - DNA, 12 bp, Homo sapiens
ataccagtgtgg

SEQ ID NO: 1775299 - DNA, 15 bp, Homo sapiens
ataccagttgttcat

SEQ ID NO: 1775300 - DNA, 22 bp, Homo sapiens
ataccatctgctgccccgcttc

SEQ ID NO: 1775301 - DNA, 18 bp, Homo sapiens
ataccatttagtaagaat

SEQ ID NO: 1775302 - DNA, 19 bp, Homo sapiens
atacccatgcacagtacaa

SEQ ID NO: 1775303 - DNA, 13 bp, Homo sapiens
atacccccctctg

SEQ ID NO: 1775304 - DNA, 18 bp, Homo sapiens
ataccgcctcgtgccagc

SEQ ID NO: 1775305 - DNA, 14 bp, Homo sapiens
ataccgctcagtat

SEQ ID NO: 1775306 - DNA, 22 bp, Homo sapiens
ataccgctcagtattttaaatg

SEQ ID NO: 1775307 - DNA, 13 bp, Homo sapiens
atacctaaaagag

SEQ ID NO: 1775308 - DNA, 17 bp, Homo sapiens
atacctaattgtggatg

SEQ ID NO: 1775309 - DNA, 16 bp, Homo sapiens
atacctccattaaatg

SEQ ID NO: 1775310 - DNA, 16 bp, Homo sapiens
atacctctgtgtgctc

SEQ ID NO: 1775311 - DNA, 18 bp, Homo sapiens
atacctcttactttgctt

SEQ ID NO: 1775312 - DNA, 23 bp, Homo sapiens
atacctgagcctcaaccttctgg

SEQ ID NO: 1775313 - DNA, 22 bp, Homo sapiens
atacctgattgatcacacagtg

SEQ ID NO: 1775314 - DNA, 17 bp, Homo sapiens
atacctggcttttactt

SEQ ID NO: 1775315 - DNA, 22 bp, Homo sapiens
atacctggcttttactttatta

SEQ ID NO: 1775316 - DNA, 18 bp, Homo sapiens
atacctggttgagtgtgt

SEQ ID NO: 1775317 - DNA, 13 bp, Homo sapiens
atacctggtttac

SEQ ID NO: 1775318 - DNA, 14 bp, Homo sapiens
atacctgtcaatac

SEQ ID NO: 1775319 - DNA, 14 bp, Homo sapiens
ataccttagaaggt

SEQ ID NO: 1775320 - DNA, 15 bp, Homo sapiens
ataccttatttattt

SEQ ID NO: 1775321 - DNA, 17 bp, Homo sapiens
atacctttttcttaaaa

SEQ ID NO: 1775322 - DNA, 20 bp, Homo sapiens
ataccttttttgttccactt

SEQ ID NO: 1775323 - DNA, 16 bp, Homo sapiens
atacgaaatcagtttc

SEQ ID NO: 1775324 - DNA, 15 bp, Homo sapiens
atacgcttttctttg

SEQ ID NO: 1775325 - DNA, 23 bp, Homo sapiens
atacgtctgtgacttatctacca

SEQ ID NO: 1775326 - DNA, 13 bp, Homo sapiens
atacgtgcacagg

SEQ ID NO: 1775327 - DNA, 20 bp, Homo sapiens
atactaagatgttcactgtg

SEQ ID NO: 1775328 - DNA, 18 bp, Homo sapiens
atactaagggaaagaatt

SEQ ID NO: 1775329 - DNA, 16 bp, Homo sapiens
ataactagtgttgctt

SEQ ID NO: 1775330 - DNA, 19 bp, Homo sapiens
ataactagtgttgcttgga

SEQ ID NO: 1775331 - DNA, 16 bp, Homo sapiens
ataactcatcataaaa

SEQ ID NO: 1775332 - DNA, 17 bp, Homo sapiens
ataactcctgtcccttt

SEQ ID NO: 1775333 - DNA, 18 bp, Homo sapiens
ataactcctgtccctttt

SEQ ID NO: 1775334 - DNA, 19 bp, Homo sapiens
ataactcctgtcccttttc

SEQ ID NO: 1775335 - DNA, 16 bp, Homo sapiens
ataactctctttcctt

SEQ ID NO: 1775336 - DNA, 13 bp, Homo sapiens
ataactgaaaatg

SEQ ID NO: 1775337 - DNA, 18 bp, Homo sapiens
ataactgaaggagaaggt

SEQ ID NO: 1775338 - DNA, 19 bp, Homo sapiens
ataactgatctcaagtata

SEQ ID NO: 1775339 - DNA, 13 bp, Homo sapiens
ataactgcttctt

SEQ ID NO: 1775340 - DNA, 15 bp, Homo sapiens
ataactggaaaacag

SEQ ID NO: 1775341 - DNA, 21 bp, Homo sapiens
ataactggaaaacagaacact

SEQ ID NO: 1775342 - DNA, 15 bp, Homo sapiens
ataactgtatttgaa

SEQ ID NO: 1775343 - DNA, 15 bp, Homo sapiens
ataactgtcttgttt

SEQ ID NO: 1775344 - DNA, 19 bp, Homo sapiens
ataactgtcttgtttcagt

SEQ ID NO: 1775345 - DNA, 22 bp, Homo sapiens
ataactgtcttgtttcagtgag

SEQ ID NO: 1775346 - DNA, 16 bp, Homo sapiens
ataacttaaaatattt

SEQ ID NO: 1775347 - DNA, 14 bp, Homo sapiens
ataacttactgtat

SEQ ID NO: 1775348 - DNA, 16 bp, Homo sapiens
ataacttactgtatat

SEQ ID NO: 1775349 - DNA, 19 bp, Homo sapiens
ataacttactgtatatgta

SEQ ID NO: 1775350 - DNA, 20 bp, Homo sapiens
ataacttactgtatatgtat

SEQ ID NO: 1775351 - DNA, 13 bp, Homo sapiens
ataacttctatat

SEQ ID NO: 1775352 - DNA, 17 bp, Homo sapiens
ataacttggggaggcaa

SEQ ID NO: 1775353 - DNA, 13 bp, Homo sapiens
ataacttgtctaa

SEQ ID NO: 1775354 - DNA, 15 bp, Homo sapiens
ataactttaaatctt

SEQ ID NO: 1775355 - DNA, 24 bp, Homo sapiens
ataactttaaatcttttcttcaac

SEQ ID NO: 1775356 - DNA, 19 bp, Homo sapiens
ataacttttcaccaatgag

SEQ ID NO: 1775357 - DNA, 18 bp, Homo sapiens
ataacttttttatatttg

SEQ ID NO: 1775358 - DNA, 14 bp, Homo sapiens
ataagaaaaacttt

SEQ ID NO: 1775359 - DNA, 16 bp, Homo sapiens
ataagaaaaatcatgt

SEQ ID NO: 1775360 - DNA, 13 bp, Homo sapiens
ataagaaaagcct

SEQ ID NO: 1775361 - DNA, 22 bp, Homo sapiens
ataagaagcaatctttgaaata

SEQ ID NO: 1775362 - DNA, 18 bp, Homo sapiens
ataagaaggcaattttag

SEQ ID NO: 1775363 - DNA, 16 bp, Homo sapiens
ataagaatgctggttt

SEQ ID NO: 1775364 - DNA, 19 bp, Homo sapiens
ataagacaaacactgccat

SEQ ID NO: 1775365 - DNA, 24 bp, Homo sapiens
ataagacaagagatctacacatgt

SEQ ID NO: 1775366 - DNA, 20 bp, Homo sapiens
ataagaccgtgtcccaagga

SEQ ID NO: 1775367 - DNA, 15 bp, Homo sapiens
ataagactattccaa

SEQ ID NO: 1775368 - DNA, 19 bp, Homo sapiens
ataagagagccttggttca

SEQ ID NO: 1775369 - DNA, 16 bp, Homo sapiens
ataagagagtcataaa

SEQ ID NO: 1775370 - DNA, 17 bp, Homo sapiens
ataagagtgattagagc

SEQ ID NO: 1775371 - DNA, 22 bp, Homo sapiens
ataagagttgctttgccagagc

SEQ ID NO: 1775372 - DNA, 16 bp, Homo sapiens
ataagattaaaggaag

SEQ ID NO: 1775373 - DNA, 19 bp, Homo sapiens
ataagattaaaggaaggaa

SEQ ID NO: 1775374 - DNA, 12 bp, Homo sapiens
ataagattctaa

SEQ ID NO: 1775375 - DNA, 18 bp, Homo sapiens
ataagcaaattgcttttt

SEQ ID NO: 1775376 - DNA, 12 bp, Homo sapiens
ataagcaagaga

SEQ ID NO: 1775377 - DNA, 17 bp, Homo sapiens
ataagcaagagagatgt

SEQ ID NO: 1775378 - DNA, 16 bp, Homo sapiens
ataagcaggtggatct

SEQ ID NO: 1775379 - DNA, 17 bp, Homo sapiens
ataagcataaaagatca

SEQ ID NO: 1775380 - DNA, 14 bp, Homo sapiens
ataaggaggaggag

SEQ ID NO: 1775381 - DNA, 22 bp, Homo sapiens
ataaggagggacatgatgggga

SEQ ID NO: 1775382 - DNA, 18 bp, Homo sapiens
ataaggataaggagggaa

SEQ ID NO: 1775383 - DNA, 20 bp, Homo sapiens
ataaggatcagaacagcaga

SEQ ID NO: 1775384 - DNA, 22 bp, Homo sapiens
ataaggatcagaacagcagagg

SEQ ID NO: 1775385 - DNA, 23 bp, Homo sapiens
ataaggcccagagcgaggaaagg

SEQ ID NO: 1775386 - DNA, 16 bp, Homo sapiens
ataaggccttaatatg

SEQ ID NO: 1775387 - DNA, 18 bp, Homo sapiens
ataaggccttaatatgtt

SEQ ID NO: 1775388 - DNA, 11 bp, Homo sapiens
ataaggcttca

SEQ ID NO: 1775389 - DNA, 13 bp, Homo sapiens
ataagggaaaaat

SEQ ID NO: 1775390 - DNA, 15 bp, Homo sapiens
ataagggaaaaatca

SEQ ID NO: 1775391 - DNA, 15 bp, Homo sapiens
ataagggaaaagata

SEQ ID NO: 1775392 - DNA, 23 bp, Homo sapiens
ataagggactgatgtttgtgcag

SEQ ID NO: 1775393 - DNA, 18 bp, Homo sapiens
ataagggagagctgagcc

SEQ ID NO: 1775394 - DNA, 14 bp, Homo sapiens
ataaggttgtctgt

SEQ ID NO: 1775395 - DNA, 19 bp, Homo sapiens
ataaggtttcgtttctgta

SEQ ID NO: 1775396 - DNA, 13 bp, Homo sapiens
ataagtaagtttg

SEQ ID NO: 1775397 - DNA, 22 bp, Homo sapiens
ataagtagtaaatcagaaagta

SEQ ID NO: 1775398 - DNA, 14 bp, Homo sapiens
ataagtagttggtt

SEQ ID NO: 1775399 - DNA, 19 bp, Homo sapiens
ataagtagttggtttgtat

SEQ ID NO: 1775400 - DNA, 20 bp, Homo sapiens
ataagtagttggtttgtatg

SEQ ID NO: 1775401 - DNA, 15 bp, Homo sapiens
ataagtatttataat

SEQ ID NO: 1775402 - DNA, 14 bp, Homo sapiens
ataagtatttctga

SEQ ID NO: 1775403 - DNA, 16 bp, Homo sapiens
ataagtatttggaatt

SEQ ID NO: 1775404 - DNA, 18 bp, Homo sapiens
ataggtgagaaaaaaaca

SEQ ID NO: 1775405 - DNA, 23 bp, Homo sapiens
ataggtgctacaaaaacacagca

SEQ ID NO: 1775406 - DNA, 21 bp, Homo sapiens
ataggttaaaaaaaaaagtca

SEQ ID NO: 1775407 - DNA, 17 bp, Homo sapiens
ataggttagatatagag

SEQ ID NO: 1775408 - DNA, 13 bp, Homo sapiens
ataggttatatgc

SEQ ID NO: 1775409 - DNA, 16 bp, Homo sapiens
ataggttatatgcaag

SEQ ID NO: 1775410 - DNA, 22 bp, Homo sapiens
ataggtttatattattgattca

SEQ ID NO: 1775411 - DNA, 14 bp, Homo sapiens
ataggttttaaatc

SEQ ID NO: 1775412 - DNA, 18 bp, Homo sapiens
atagtaaaagataacaag

SEQ ID NO: 1775413 - DNA, 16 bp, Homo sapiens
atagtaaagtattttt

SEQ ID NO: 1775414 - DNA, 19 bp, Homo sapiens
atagtaagacccccatctc

SEQ ID NO: 1775415 - DNA, 13 bp, Homo sapiens
atagtaatataat

SEQ ID NO: 1775416 - DNA, 18 bp, Homo sapiens
atagtaccttcaatactt

SEQ ID NO: 1775417 - DNA, 18 bp, Homo sapiens
atagtactctttgtagca

SEQ ID NO: 1775418 - DNA, 14 bp, Homo sapiens
atagtactggcatg

SEQ ID NO: 1775419 - DNA, 15 bp, Homo sapiens
atagtagcatacatt

SEQ ID NO: 1775420 - DNA, 17 bp, Homo sapiens
atagtaggcatgttatg

SEQ ID NO: 1775421 - DNA, 17 bp, Homo sapiens
atagtatacattgtctt

SEQ ID NO: 1775422 - DNA, 18 bp, Homo sapiens
atagtatacattgtcttg

SEQ ID NO: 1775423 - DNA, 15 bp, Homo sapiens
atagtatatctggac

SEQ ID NO: 1775424 - DNA, 16 bp, Homo sapiens
atagtatatctggaca

SEQ ID NO: 1775425 - DNA, 17 bp, Homo sapiens
atagtatatctggacaa

SEQ ID NO: 1775426 - DNA, 15 bp, Homo sapiens
atagtatctgtatat

SEQ ID NO: 1775427 - DNA, 17 bp, Homo sapiens
atagtcaatttctactt

SEQ ID NO: 1775428 - DNA, 21 bp, Homo sapiens
atagtcatggggtccctgctg

SEQ ID NO: 1775429 - DNA, 20 bp, Homo sapiens
atagtccagacacttaactc

SEQ ID NO: 1775430 - DNA, 15 bp, Homo sapiens
atagtcgtaagtgga

SEQ ID NO: 1775431 - DNA, 21 bp, Homo sapiens
atagtctaagactatatatat

SEQ ID NO: 1775432 - DNA, 21 bp, Homo sapiens
atagtcttcagtttcattttc

SEQ ID NO: 1775433 - DNA, 22 bp, Homo sapiens
atagtcttggaagctgtttgga

SEQ ID NO: 1775434 - DNA, 13 bp, Homo sapiens
atagtctttcagt

SEQ ID NO: 1775435 - DNA, 16 bp, Homo sapiens
atagtcttttgctttt

SEQ ID NO: 1775436 - DNA, 19 bp, Homo sapiens
atagtgcaacatctctgaa

SEQ ID NO: 1775437 - DNA, 16 bp, Homo sapiens
atagtgcaatagtgca

SEQ ID NO: 1775438 - DNA, 17 bp, Homo sapiens
atagtgcctaaaattgt

SEQ ID NO: 1775439 - DNA, 22 bp, Homo sapiens
atagtgcctaaaattgtatgaa

SEQ ID NO: 1775440 - DNA, 15 bp, Homo sapiens
atagtgggatttcca

SEQ ID NO: 1775441 - DNA, 20 bp, Homo sapiens
atagtgtaagaactgtacat

SEQ ID NO: 1775442 - DNA, 20 bp, Homo sapiens
atagtgtcatataaactcat

SEQ ID NO: 1775443 - DNA, 13 bp, Homo sapiens
atagtgtgaggga

SEQ ID NO: 1775444 - DNA, 14 bp, Homo sapiens
atagtgttcacaaa

SEQ ID NO: 1775445 - DNA, 17 bp, Homo sapiens
atagtgttcacaaactg

SEQ ID NO: 1775446 - DNA, 20 bp, Homo sapiens
atagttaattgtggctttat

SEQ ID NO: 1775447 - DNA, 21 bp, Homo sapiens
atagttaattgtggctttatg

SEQ ID NO: 1775448 - DNA, 13 bp, Homo sapiens
atagttactgtaa

SEQ ID NO: 1775449 - DNA, 18 bp, Homo sapiens
atagttactgtaaaatgc

SEQ ID NO: 1775450 - DNA, 14 bp, Homo sapiens
atagttactgtgta

SEQ ID NO: 1775451 - DNA, 23 bp, Homo sapiens
atagttagatctttgtaaatgca

SEQ ID NO: 1775452 - DNA, 17 bp, Homo sapiens
atagttattattgctgt

SEQ ID NO: 1775453 - DNA, 17 bp, Homo sapiens
atatatgtttacctttt

SEQ ID NO: 1775454 - DNA, 13 bp, Homo sapiens
atatattaaaaca

SEQ ID NO: 1775455 - DNA, 17 bp, Homo sapiens
atatattacaagggata

SEQ ID NO: 1775456 - DNA, 13 bp, Homo sapiens
atatattattata

SEQ ID NO: 1775457 - DNA, 14 bp, Homo sapiens
atatattattataa

SEQ ID NO: 1775458 - DNA, 15 bp, Homo sapiens
atatattcccaatag

SEQ ID NO: 1775459 - DNA, 14 bp, Homo sapiens
atatattcttataa

SEQ ID NO: 1775460 - DNA, 13 bp, Homo sapiens
atatattgaactt

SEQ ID NO: 1775461 - DNA, 17 bp, Homo sapiens
atatattgaacttttgt

SEQ ID NO: 1775462 - DNA, 13 bp, Homo sapiens
atatattgtacaa

SEQ ID NO: 1775463 - DNA, 16 bp, Homo sapiens
atatattgtacaaatg

SEQ ID NO: 1775464 - DNA, 21 bp, Homo sapiens
atatatttaaagggaaattga

SEQ ID NO: 1775465 - DNA, 13 bp, Homo sapiens
atatatttaacaa

SEQ ID NO: 1775466 - DNA, 23 bp, Homo sapiens
atatatttataactcatcataaa

SEQ ID NO: 1775467 - DNA, 13 bp, Homo sapiens
atatatttattga

SEQ ID NO: 1775468 - DNA, 21 bp, Homo sapiens
atatatttattgagtacctac

SEQ ID NO: 1775469 - DNA, 12 bp, Homo sapiens
atatatttcccc

SEQ ID NO: 1775470 - DNA, 12 bp, Homo sapiens
atatatttctat

SEQ ID NO: 1775471 - DNA, 19 bp, Homo sapiens
atatatttgaaatagtata

SEQ ID NO: 1775472 - DNA, 21 bp, Homo sapiens
atatatttgaaatagtataca

SEQ ID NO: 1775473 - DNA, 19 bp, Homo sapiens
atatatttgtttcatttct

SEQ ID NO: 1775474 - DNA, 21 bp, Homo sapiens
atatatttgtttcatttctgc

SEQ ID NO: 1775475 - DNA, 16 bp, Homo sapiens
atatattttacaattt

SEQ ID NO: 1775476 - DNA, 15 bp, Homo sapiens
atatattttcagtac

SEQ ID NO: 1775477 - DNA, 16 bp, Homo sapiens
atatattttgtgtgaa

SEQ ID NO: 1775478 - DNA, 15 bp, Homo sapiens
atatattttgttgtt

SEQ ID NO: 1775479 - DNA, 21 bp, Homo sapiens
atatattttgttgttcctcta

SEQ ID NO: 1775480 - DNA, 15 bp, Homo sapiens
atatatttttggttg

SEQ ID NO: 1775481 - DNA, 20 bp, Homo sapiens
atatatttttggttgtcaat

SEQ ID NO: 1775482 - DNA, 18 bp, Homo sapiens
atatatttttttttggat

SEQ ID NO: 1775483 - DNA, 14 bp, Homo sapiens
atatcaaaattcta

SEQ ID NO: 1775484 - DNA, 14 bp, Homo sapiens
atatcaaataaaat

SEQ ID NO: 1775485 - DNA, 17 bp, Homo sapiens
atatcaaataaaatatc

SEQ ID NO: 1775486 - DNA, 17 bp, Homo sapiens
atatcaacagcttccct

SEQ ID NO: 1775487 - DNA, 14 bp, Homo sapiens
atatcaactctgaa

SEQ ID NO: 1775488 - DNA, 16 bp, Homo sapiens
atatcacccttccctg

SEQ ID NO: 1775489 - DNA, 17 bp, Homo sapiens
atatcacccttccctgc

SEQ ID NO: 1775490 - DNA, 12 bp, Homo sapiens
atatcacctctc

SEQ ID NO: 1775491 - DNA, 19 bp, Homo sapiens
atatcagacaagcactatt

SEQ ID NO: 1775492 - DNA, 18 bp, Homo sapiens
atatcagagctcttaatg

SEQ ID NO: 1775493 - DNA, 18 bp, Homo sapiens
atatcagtattctgacat

SEQ ID NO: 1775494 - DNA, 21 bp, Homo sapiens
atatcagtcgttttagtgtct

SEQ ID NO: 1775495 - DNA, 22 bp, Homo sapiens
atatcagttactcagccctggg

SEQ ID NO: 1775496 - DNA, 14 bp, Homo sapiens
atatcataaagcat

SEQ ID NO: 1775497 - DNA, 16 bp, Homo sapiens
atatcataaagcattt

SEQ ID NO: 1775498 - DNA, 13 bp, Homo sapiens
atatcatacaaat

SEQ ID NO: 1775499 - DNA, 12 bp, Homo sapiens
atatcatatttc

SEQ ID NO: 1775500 - DNA, 22 bp, Homo sapiens
atatcatgttaaattagaatga

SEQ ID NO: 1775501 - DNA, 13 bp, Homo sapiens
atatcattctaaa

SEQ ID NO: 1775502 - DNA, 18 bp, Homo sapiens
atatcattggatgatatg

SEQ ID NO: 1775503 - DNA, 21 bp, Homo sapiens
atatcatttattttttacatt

SEQ ID NO: 1775504 - DNA, 23 bp, Homo sapiens
atatccaagtaccaatgctgttg

SEQ ID NO: 1775505 - DNA, 11 bp, Homo sapiens
atatccacagt

SEQ ID NO: 1775506 - DNA, 13 bp, Homo sapiens
atatccatctttt

SEQ ID NO: 1775507 - DNA, 21 bp, Homo sapiens
atatccatgacctagttttcc

SEQ ID NO: 1775508 - DNA, 23 bp, Homo sapiens
atatccattctgtagacttttga

SEQ ID NO: 1775509 - DNA, 18 bp, Homo sapiens
atatccatttatcttttg

SEQ ID NO: 1775510 - DNA, 14 bp, Homo sapiens
atatccctcttgta

SEQ ID NO: 1775511 - DNA, 14 bp, Homo sapiens
atatcctgagccat

SEQ ID NO: 1775512 - DNA, 15 bp, Homo sapiens
atatcctgagccatc

SEQ ID NO: 1775513 - DNA, 12 bp, Homo sapiens
atatcctgcctc

SEQ ID NO: 1775514 - DNA, 13 bp, Homo sapiens
atatcctgtgact

SEQ ID NO: 1775515 - DNA, 22 bp, Homo sapiens
atatccttctagatcatacaca

SEQ ID NO: 1775516 - DNA, 20 bp, Homo sapiens
atatcgctgatgcagacaca

SEQ ID NO: 1775517 - DNA, 19 bp, Homo sapiens
atatctaatatatatgaat

SEQ ID NO: 1775518 - DNA, 17 bp, Homo sapiens
atatctacaatatatat

SEQ ID NO: 1775519 - DNA, 14 bp, Homo sapiens
atatctacagtact

SEQ ID NO: 1775520 - DNA, 13 bp, Homo sapiens
atatctataaaat

SEQ ID NO: 1775521 - DNA, 14 bp, Homo sapiens
atatctatatcata

SEQ ID NO: 1775522 - DNA, 17 bp, Homo sapiens
atatctatatcatattt

SEQ ID NO: 1775523 - DNA, 12 bp, Homo sapiens
atatctattaat

SEQ ID NO: 1775524 - DNA, 13 bp, Homo sapiens
atatctattaata

SEQ ID NO: 1775525 - DNA, 12 bp, Homo sapiens
atatctattatt

SEQ ID NO: 1775526 - DNA, 12 bp, Homo sapiens
atagaggcccag

SEQ ID NO: 1775527 - DNA, 13 bp, Homo sapiens
atagaggcccagg

SEQ ID NO: 1775528 - DNA, 15 bp, Homo sapiens
atagaggcccaggca

SEQ ID NO: 1775529 - DNA, 19 bp, Homo sapiens
atagaggctagcttctgct

SEQ ID NO: 1775530 - DNA, 18 bp, Homo sapiens
atagaggcttctccgcca

SEQ ID NO: 1775531 - DNA, 23 bp, Homo sapiens
atagaggcttctccgccagcctc

SEQ ID NO: 1775532 - DNA, 16 bp, Homo sapiens
atagagtgtagtttac

SEQ ID NO: 1775533 - DNA, 18 bp, Homo sapiens
atagatataaatttttaa

SEQ ID NO: 1775534 - DNA, 20 bp, Homo sapiens
atagatatgtatatatacat

SEQ ID NO: 1775535 - DNA, 23 bp, Homo sapiens
atagatgctggcccagggcccag

SEQ ID NO: 1775536 - DNA, 18 bp, Homo sapiens
atagatgctgtgtatatg

SEQ ID NO: 1775537 - DNA, 22 bp, Homo sapiens
atagatgtagataaactcagaa

SEQ ID NO: 1775538 - DNA, 23 bp, Homo sapiens
atagatgtccctttcttggccag

SEQ ID NO: 1775539 - DNA, 16 bp, Homo sapiens
atagatgtgagccagc

SEQ ID NO: 1775540 - DNA, 11 bp, Homo sapiens
atagatgtgtg

SEQ ID NO: 1775541 - DNA, 12 bp, Homo sapiens
atagatgtgtgg

SEQ ID NO: 1775542 - DNA, 19 bp, Homo sapiens
atagattaatggcactgat

SEQ ID NO: 1775543 - DNA, 16 bp, Homo sapiens
atagattaggtttgcg

SEQ ID NO: 1775544 - DNA, 14 bp, Homo sapiens
atagattataactt

SEQ ID NO: 1775545 - DNA, 15 bp, Homo sapiens
atagattattataaa

SEQ ID NO: 1775546 - DNA, 12 bp, Homo sapiens
atagattctaaa

SEQ ID NO: 1775547 - DNA, 13 bp, Homo sapiens
atagattctaaag

SEQ ID NO: 1775548 - DNA, 16 bp, Homo sapiens
atagattctaaagatt

SEQ ID NO: 1775549 - DNA, 13 bp, Homo sapiens
atagatttggaat

SEQ ID NO: 1775550 - DNA, 15 bp, Homo sapiens
atagcaaaatcaaga

SEQ ID NO: 1775551 - DNA, 14 bp, Homo sapiens
atagcaaatgacat

SEQ ID NO: 1775552 - DNA, 14 bp, Homo sapiens
atagcaactaatgt

SEQ ID NO: 1775553 - DNA, 16 bp, Homo sapiens
atagcaactaatgttt

SEQ ID NO: 1775554 - DNA, 22 bp, Homo sapiens
atagcaacttttgtgtaatgaa

SEQ ID NO: 1775555 - DNA, 17 bp, Homo sapiens
atagcaagattgcttaa

SEQ ID NO: 1775556 - DNA, 16 bp, Homo sapiens
atagcagacagtgttt

SEQ ID NO: 1775557 - DNA, 21 bp, Homo sapiens
atagcagagagccaaatctga

SEQ ID NO: 1775558 - DNA, 14 bp, Homo sapiens
atagcagattttaa

SEQ ID NO: 1775559 - DNA, 12 bp, Homo sapiens
atagcagctttg

SEQ ID NO: 1775560 - DNA, 18 bp, Homo sapiens
atagcagtatatgttaat

SEQ ID NO: 1775561 - DNA, 15 bp, Homo sapiens
atagcatagccagca

SEQ ID NO: 1775562 - DNA, 22 bp, Homo sapiens
atagcatatgacaaatgtttct

SEQ ID NO: 1775563 - DNA, 18 bp, Homo sapiens
atagcatgaattctgcat

SEQ ID NO: 1775564 - DNA, 23 bp, Homo sapiens
atagcatgcttcctttctctcct

SEQ ID NO: 1775565 - DNA, 16 bp, Homo sapiens
atagcatggggcccct

SEQ ID NO: 1775566 - DNA, 17 bp, Homo sapiens
atagcatggggcccctg

SEQ ID NO: 1775567 - DNA, 22 bp, Homo sapiens
atagcatggggcccctggccca

SEQ ID NO: 1775568 - DNA, 12 bp, Homo sapiens
atagcattgctt

SEQ ID NO: 1775569 - DNA, 19 bp, Homo sapiens
atagccaaaaaggcaaata

SEQ ID NO: 1775570 - DNA, 12 bp, Homo sapiens
atagccaaaaat

SEQ ID NO: 1775571 - DNA, 13 bp, Homo sapiens
atagccaaagcca

SEQ ID NO: 1775572 - DNA, 14 bp, Homo sapiens
atagccaaagccag

SEQ ID NO: 1775573 - DNA, 11 bp, Homo sapiens
atagccagaga

SEQ ID NO: 1775574 - DNA, 13 bp, Homo sapiens
atagccagagagg

SEQ ID NO: 1775575 - DNA, 16 bp, Homo sapiens
atagccagagaggagc

SEQ ID NO: 1775576 - DNA, 21 bp, Homo sapiens
atagccaggcctgacctcaag

SEQ ID NO: 1775577 - DNA, 13 bp, Homo sapiens
atagccctgccct

SEQ ID NO: 1775578 - DNA, 14 bp, Homo sapiens
atatttctattgaa

SEQ ID NO: 1775579 - DNA, 10 bp, Homo sapiens
atatttctga

SEQ ID NO: 1775580 - DNA, 22 bp, Homo sapiens
atatttctgtggagggttgcca

SEQ ID NO: 1775581 - DNA, 24 bp, Homo sapiens
atatttcttcttctaagaagacat

SEQ ID NO: 1775582 - DNA, 15 bp, Homo sapiens
atatttgactattct

SEQ ID NO: 1775583 - DNA, 15 bp, Homo sapiens
atatttgccaataaa

SEQ ID NO: 1775584 - DNA, 18 bp, Homo sapiens
atatttgcctgtctgttt

SEQ ID NO: 1775585 - DNA, 21 bp, Homo sapiens
atatttgctagactctagaca

SEQ ID NO: 1775586 - DNA, 13 bp, Homo sapiens
atatttgcttttt

SEQ ID NO: 1775587 - DNA, 14 bp, Homo sapiens
atatttggaaagag

SEQ ID NO: 1775588 - DNA, 16 bp, Homo sapiens
atatttgtaaagctat

SEQ ID NO: 1775589 - DNA, 18 bp, Homo sapiens
atatttgtaatatatgat

SEQ ID NO: 1775590 - DNA, 13 bp, Homo sapiens
atatttgtacaaa

SEQ ID NO: 1775591 - DNA, 12 bp, Homo sapiens
atatttgtacat

SEQ ID NO: 1775592 - DNA, 17 bp, Homo sapiens
atatttgtactttctgt

SEQ ID NO: 1775593 - DNA, 20 bp, Homo sapiens
atatttgtactttctgttaa

SEQ ID NO: 1775594 - DNA, 21 bp, Homo sapiens
atatttgtactttctgttaaa

SEQ ID NO: 1775595 - DNA, 12 bp, Homo sapiens
atatttgtattt

SEQ ID NO: 1775596 - DNA, 17 bp, Homo sapiens
atatttgtatttattct

SEQ ID NO: 1775597 - DNA, 13 bp, Homo sapiens
atatttgtcttcc

SEQ ID NO: 1775598 - DNA, 21 bp, Homo sapiens
atatttgtgccgtaattatgt

SEQ ID NO: 1775599 - DNA, 15 bp, Homo sapiens
atatttgttatgtag

SEQ ID NO: 1775600 - DNA, 17 bp, Homo sapiens
atattttaaaatttgtt

SEQ ID NO: 1775601 - DNA, 18 bp, Homo sapiens
atattttaaaatttgttc

SEQ ID NO: 1775602 - DNA, 12 bp, Homo sapiens
atattttaactt

SEQ ID NO: 1775603 - DNA, 13 bp, Homo sapiens
atattttaataga

SEQ ID NO: 1775604 - DNA, 17 bp, Homo sapiens
atattttaatagaaata

SEQ ID NO: 1775605 - DNA, 19 bp, Homo sapiens
atattttaatgcagttgct

SEQ ID NO: 1775606 - DNA, 22 bp, Homo sapiens
atattttagcattttaattctc

SEQ ID NO: 1775607 - DNA, 14 bp, Homo sapiens
atattttataattt

SEQ ID NO: 1775608 - DNA, 14 bp, Homo sapiens
atattttatcctgt

SEQ ID NO: 1775609 - DNA, 15 bp, Homo sapiens
atattttatcctgta

SEQ ID NO: 1775610 - DNA, 17 bp, Homo sapiens
atattttatcctgtatt

SEQ ID NO: 1775611 - DNA, 14 bp, Homo sapiens
atattttatgaaca

SEQ ID NO: 1775612 - DNA, 16 bp, Homo sapiens
atattttatgaacatt

SEQ ID NO: 1775613 - DNA, 23 bp, Homo sapiens
atattttatgaacattgtactgt

SEQ ID NO: 1775614 - DNA, 15 bp, Homo sapiens
atattttatgtgaga

SEQ ID NO: 1775615 - DNA, 15 bp, Homo sapiens
atattttattatata

SEQ ID NO: 1775616 - DNA, 19 bp, Homo sapiens
atattttcacactggtaaa

SEQ ID NO: 1775617 - DNA, 22 bp, Homo sapiens
atattttcacactggtaaatgt

SEQ ID NO: 1775618 - DNA, 17 bp, Homo sapiens
atattttccataaattt

SEQ ID NO: 1775619 - DNA, 20 bp, Homo sapiens
atattttccgtcacttaaat

SEQ ID NO: 1775620 - DNA, 11 bp, Homo sapiens
atattttcctg

SEQ ID NO: 1775621 - DNA, 13 bp, Homo sapiens
atattttctattt

SEQ ID NO: 1775622 - DNA, 14 bp, Homo sapiens
atattttctatttt

SEQ ID NO: 1775623 - DNA, 19 bp, Homo sapiens
atattttcttccaagcaaa

SEQ ID NO: 1775624 - DNA, 15 bp, Homo sapiens
atattttgagaaact

SEQ ID NO: 1775625 - DNA, 16 bp, Homo sapiens
atattttgagaaactg

SEQ ID NO: 1775626 - DNA, 21 bp, Homo sapiens
atattttgcacagttagcaaa

SEQ ID NO: 1775627 - DNA, 12 bp, Homo sapiens
atattttgctaa

SEQ ID NO: 1775628 - DNA, 15 bp, Homo sapiens
atattttgctaactg

SEQ ID NO: 1775629 - DNA, 19 bp, Homo sapiens
atattttgctaactggtta

SEQ ID NO: 1775630 - DNA, 21 bp, Homo sapiens
atattttgctaactggttaaa

SEQ ID NO: 1775631 - DNA, 19 bp, Homo sapiens
atatttttatacaagtaat

SEQ ID NO: 1775632 - DNA, 19 bp, Homo sapiens
atatttttatagacaaata

SEQ ID NO: 1775633 - DNA, 12 bp, Homo sapiens
atatttttcaca

SEQ ID NO: 1775634 - DNA, 13 bp, Homo sapiens
atatttttcacat

SEQ ID NO: 1775635 - DNA, 15 bp, Homo sapiens
atatttttcacatat

SEQ ID NO: 1775636 - DNA, 17 bp, Homo sapiens
atatttttcataaacaa

SEQ ID NO: 1775637 - DNA, 17 bp, Homo sapiens
atatttttccatttatt

SEQ ID NO: 1775638 - DNA, 23 bp, Homo sapiens
atatttttccatttatttatgaa

SEQ ID NO: 1775639 - DNA, 19 bp, Homo sapiens
atatttttgctaggagccc

SEQ ID NO: 1775640 - DNA, 15 bp, Homo sapiens
atatttttggggcat

SEQ ID NO: 1775641 - DNA, 18 bp, Homo sapiens
atatttttggttgtcaat

SEQ ID NO: 1775642 - DNA, 13 bp, Homo sapiens
atatttttgtaca

SEQ ID NO: 1775643 - DNA, 14 bp, Homo sapiens
atatttttgtacat

SEQ ID NO: 1775644 - DNA, 16 bp, Homo sapiens
atatttttgtacatat

SEQ ID NO: 1775645 - DNA, 21 bp, Homo sapiens
atatttttgtacatattgtta

SEQ ID NO: 1775646 - DNA, 15 bp, Homo sapiens
atatttttgtagcac

SEQ ID NO: 1775647 - DNA, 16 bp, Homo sapiens
atatttttgtatttct

SEQ ID NO: 1775648 - DNA, 20 bp, Homo sapiens
atattttttaatttgatgaa

SEQ ID NO: 1775649 - DNA, 18 bp, Homo sapiens
atattttttcagaaatat

SEQ ID NO: 1775650 - DNA, 22 bp, Homo sapiens
atatttttttaacctaatatca

SEQ ID NO: 1775651 - DNA, 12 bp, Homo sapiens
atcaaaaagaaa

SEQ ID NO: 1775652 - DNA, 12 bp, Homo sapiens
atcaaaaagcct

SEQ ID NO: 1775653 - DNA, 16 bp, Homo sapiens
atcaaaaataaactag

SEQ ID NO: 1775654 - DNA, 17 bp, Homo sapiens
atcaaaaataaactagt

SEQ ID NO: 1775655 - DNA, 17 bp, Homo sapiens
atcaaaacctgtgccag

SEQ ID NO: 1775656 - DNA, 22 bp, Homo sapiens
atcaaaacctgtgccaggctga

SEQ ID NO: 1775657 - DNA, 14 bp, Homo sapiens
atcaaaaccttcct

SEQ ID NO: 1775658 - DNA, 20 bp, Homo sapiens
atcaaaaccttccttccctg

SEQ ID NO: 1775659 - DNA, 22 bp, Homo sapiens
atcaaaaccttccttccctggc

SEQ ID NO: 1775660 - DNA, 21 bp, Homo sapiens
atcaaaacctttcaaatatca

SEQ ID NO: 1775661 - DNA, 22 bp, Homo sapiens
atcaaaagaaaattgatatttt

SEQ ID NO: 1775662 - DNA, 20 bp, Homo sapiens
atcaaaaggttaataaagta

SEQ ID NO: 1775663 - DNA, 15 bp, Homo sapiens
atcaaactgaagcca

SEQ ID NO: 1775664 - DNA, 16 bp, Homo sapiens
atcaaactgaagccag

SEQ ID NO: 1775665 - DNA, 13 bp, Homo sapiens
atcaaacttatgg

SEQ ID NO: 1775666 - DNA, 19 bp, Homo sapiens
atcaaagaattacagtaca

SEQ ID NO: 1775667 - DNA, 16 bp, Homo sapiens
atccagtggtgggtaa

SEQ ID NO: 1775668 - DNA, 18 bp, Homo sapiens
atccagtggtgggtaatt

SEQ ID NO: 1775669 - DNA, 16 bp, Homo sapiens
atccagttcatgagaa

SEQ ID NO: 1775670 - DNA, 23 bp, Homo sapiens
atccagttgttttccatcatttg

SEQ ID NO: 1775671 - DNA, 16 bp, Homo sapiens
atccagtttctttccc

SEQ ID NO: 1775672 - DNA, 17 bp, Homo sapiens
atccataaactaagaga

SEQ ID NO: 1775673 - DNA, 19 bp, Homo sapiens
atccataaactaagagaaa

SEQ ID NO: 1775674 - DNA, 15 bp, Homo sapiens
atccataaatgtgtt

SEQ ID NO: 1775675 - DNA, 19 bp, Homo sapiens
atccatagcacctccacat

SEQ ID NO: 1775676 - DNA, 20 bp, Homo sapiens
atccatatttaataatgctt

SEQ ID NO: 1775677 - DNA, 20 bp, Homo sapiens
atccatctcctggtgttctg

SEQ ID NO: 1775678 - DNA, 16 bp, Homo sapiens
atccatgcattatata

SEQ ID NO: 1775679 - DNA, 13 bp, Homo sapiens
atccatgggggga

SEQ ID NO: 1775680 - DNA, 15 bp, Homo sapiens
atccatggggggaga

SEQ ID NO: 1775681 - DNA, 18 bp, Homo sapiens
atccattacctccatcca

SEQ ID NO: 1775682 - DNA, 16 bp, Homo sapiens
atccattaggccagca

SEQ ID NO: 1775683 - DNA, 17 bp, Homo sapiens
atccattaggccagcaa

SEQ ID NO: 1775684 - DNA, 18 bp, Homo sapiens
atccattaggccagcaac

SEQ ID NO: 1775685 - DNA, 14 bp, Homo sapiens
atccattcctcagg

SEQ ID NO: 1775686 - DNA, 11 bp, Homo sapiens
atccattgttg

SEQ ID NO: 1775687 - DNA, 22 bp, Homo sapiens
atccatttcatctatttctgag

SEQ ID NO: 1775688 - DNA, 16 bp, Homo sapiens
atccatttccattgct

SEQ ID NO: 1775689 - DNA, 21 bp, Homo sapiens
atcccaatcaaagaattacag

SEQ ID NO: 1775690 - DNA, 22 bp, Homo sapiens
atcccaatcaaagaattacagt

SEQ ID NO: 1775691 - DNA, 12 bp, Homo sapiens
atcccacacagg

SEQ ID NO: 1775692 - DNA, 22 bp, Homo sapiens
atcccacatccaactccagcaa

SEQ ID NO: 1775693 - DNA, 14 bp, Homo sapiens
atcccacccacatg

SEQ ID NO: 1775694 - DNA, 15 bp, Homo sapiens
atcccacccacatgt

SEQ ID NO: 1775695 - DNA, 13 bp, Homo sapiens
atcccacccacct

SEQ ID NO: 1775696 - DNA, 15 bp, Homo sapiens
atcccaccccctcct

SEQ ID NO: 1775697 - DNA, 14 bp, Homo sapiens
atcccaccttccca

SEQ ID NO: 1775698 - DNA, 15 bp, Homo sapiens
atcccaccttcccac

SEQ ID NO: 1775699 - DNA, 14 bp, Homo sapiens
atcccactgactgt

SEQ ID NO: 1775700 - DNA, 23 bp, Homo sapiens
atcccacttagccgcaccctgca

SEQ ID NO: 1775701 - DNA, 12 bp, Homo sapiens
atcccacttcac

SEQ ID NO: 1775702 - DNA, 22 bp, Homo sapiens
atcccactttctatagcagatt

SEQ ID NO: 1775703 - DNA, 20 bp, Homo sapiens
atcccagacattgatgggga

SEQ ID NO: 1775704 - DNA, 23 bp, Homo sapiens
atcccagaggtgggatcctccct

SEQ ID NO: 1775705 - DNA, 13 bp, Homo sapiens
atcccagcacttt

SEQ ID NO: 1775706 - DNA, 21 bp, Homo sapiens
atcccagcactttgggaggcc

SEQ ID NO: 1775707 - DNA, 14 bp, Homo sapiens
atcccagcagcaga

SEQ ID NO: 1775708 - DNA, 18 bp, Homo sapiens
atcccagctactcaggag

SEQ ID NO: 1775709 - DNA, 22 bp, Homo sapiens
atcccagctacttgggaggctg

SEQ ID NO: 1775710 - DNA, 22 bp, Homo sapiens
atcccagcttggttccaggaat

SEQ ID NO: 1775711 - DNA, 18 bp, Homo sapiens
atcccagtcactcctctc

SEQ ID NO: 1775712 - DNA, 16 bp, Homo sapiens
atcccatgaacacact

SEQ ID NO: 1775713 - DNA, 17 bp, Homo sapiens
atcccattgccctggtt

SEQ ID NO: 1775714 - DNA, 20 bp, Homo sapiens
atccccaacatgcactgatg

SEQ ID NO: 1775715 - DNA, 12 bp, Homo sapiens
atccccaactcc

SEQ ID NO: 1775716 - DNA, 21 bp, Homo sapiens
atccccaactccatggggttc

SEQ ID NO: 1775717 - DNA, 17 bp, Homo sapiens
atccccaagaccccctg

SEQ ID NO: 1775718 - DNA, 12 bp, Homo sapiens
atccccaagctg

SEQ ID NO: 1775719 - DNA, 13 bp, Homo sapiens
atccccaagctgg

SEQ ID NO: 1775720 - DNA, 17 bp, Homo sapiens
atccccaagctggccac

SEQ ID NO: 1775721 - DNA, 14 bp, Homo sapiens
atccccaccccacc

SEQ ID NO: 1775722 - DNA, 15 bp, Homo sapiens
atccccaccccaccc

SEQ ID NO: 1775723 - DNA, 14 bp, Homo sapiens
atccccaggccagg

SEQ ID NO: 1775724 - DNA, 22 bp, Homo sapiens
atccccaggccaggtccctgga

SEQ ID NO: 1775725 - DNA, 13 bp, Homo sapiens
atccccagggcag

SEQ ID NO: 1775726 - DNA, 22 bp, Homo sapiens
atccccaggtctctccactgct

SEQ ID NO: 1775727 - DNA, 19 bp, Homo sapiens
atccccatctccctgcctg

SEQ ID NO: 1775728 - DNA, 20 bp, Homo sapiens
atccccatctccctgcctgg

SEQ ID NO: 1775729 - DNA, 13 bp, Homo sapiens
atcccccaaagtt

SEQ ID NO: 1775730 - DNA, 14 bp, Homo sapiens
atcccccactgcca

SEQ ID NO: 1775731 - DNA, 17 bp, Homo sapiens
atccccccatcttgctt

SEQ ID NO: 1775732 - DNA, 17 bp, Homo sapiens
atcccccctgctgccca

SEQ ID NO: 1775733 - DNA, 13 bp, Homo sapiens
atccccctgccct

SEQ ID NO: 1775734 - DNA, 14 bp, Homo sapiens
atccccctgccctc

SEQ ID NO: 1775735 - DNA, 18 bp, Homo sapiens
atccccgcctggccagga

SEQ ID NO: 1775736 - DNA, 13 bp, Homo sapiens
atcccctccccca

SEQ ID NO: 1775737 - DNA, 19 bp, Homo sapiens
atcccctccctgtcaaagc

SEQ ID NO: 1775738 - DNA, 15 bp, Homo sapiens
atcccctccttgggc

SEQ ID NO: 1775739 - DNA, 17 bp, Homo sapiens
atcccctcgtcctgtcc

SEQ ID NO: 1775740 - DNA, 19 bp, Homo sapiens
atcccctcgtcctgtccca

SEQ ID NO: 1775741 - DNA, 20 bp, Homo sapiens
atcccctcgtcctgtcccag

SEQ ID NO: 1775742 - DNA, 12 bp, Homo sapiens
atcccctgcctc

SEQ ID NO: 1775743 - DNA, 14 bp, Homo sapiens
atcccctgcctcct

SEQ ID NO: 1775744 - DNA, 15 bp, Homo sapiens
atcccctgcctcctg

SEQ ID NO: 1775745 - DNA, 20 bp, Homo sapiens
atcccctggaaacccacctc

SEQ ID NO: 1775746 - DNA, 15 bp, Homo sapiens
atccccttctcccct

SEQ ID NO: 1775747 - DNA, 23 bp, Homo sapiens
atccccttctcccctgcactgta

SEQ ID NO: 1775748 - DNA, 19 bp, Homo sapiens
atcccggccggccctggct

SEQ ID NO: 1775749 - DNA, 15 bp, Homo sapiens
atcccggcctcttcc

SEQ ID NO: 1775750 - DNA, 18 bp, Homo sapiens
atcccggcctcttccacc

SEQ ID NO: 1775751 - DNA, 17 bp, Homo sapiens
atcccgtatcacagtgt

SEQ ID NO: 1775752 - DNA, 9 bp, Homo sapiens
atccctaac

SEQ ID NO: 1775753 - DNA, 14 bp, Homo sapiens
atccctacccccta

SEQ ID NO: 1775754 - DNA, 22 bp, Homo sapiens
atccctaccccctaagagccat

SEQ ID NO: 1775755 - DNA, 18 bp, Homo sapiens
atccctcaactgagggcc

SEQ ID NO: 1775756 - DNA, 12 bp, Homo sapiens
atccctcaccca

SEQ ID NO: 1775757 - DNA, 19 bp, Homo sapiens
atccctcacccatcctaga

SEQ ID NO: 1775758 - DNA, 17 bp, Homo sapiens
atccctcaccttctgag

SEQ ID NO: 1775759 - DNA, 19 bp, Homo sapiens
atccctcccccccatgcac

SEQ ID NO: 1775760 - DNA, 22 bp, Homo sapiens
atccctcccccccatgcactgt

SEQ ID NO: 1775761 - DNA, 15 bp, Homo sapiens
atccctctcttcccc

SEQ ID NO: 1775762 - DNA, 22 bp, Homo sapiens
atccctctcttccccttccctt

SEQ ID NO: 1775763 - DNA, 23 bp, Homo sapiens
atccctctcttccccttccctta

SEQ ID NO: 1775764 - DNA, 19 bp, Homo sapiens
atccctgaacccctggcca

SEQ ID NO: 1775765 - DNA, 20 bp, Homo sapiens
atccctgatcccattttcct

SEQ ID NO: 1775766 - DNA, 11 bp, Homo sapiens
atccctgcaga

SEQ ID NO: 1775767 - DNA, 23 bp, Homo sapiens
atccctgctctctgagtttatct

SEQ ID NO: 1775768 - DNA, 17 bp, Homo sapiens
atccctgggcattgctt

SEQ ID NO: 1775769 - DNA, 18 bp, Homo sapiens
atccctgggcattgcttt

SEQ ID NO: 1775770 - DNA, 19 bp, Homo sapiens
atccctgttacccagagaa

SEQ ID NO: 1775771 - DNA, 12 bp, Homo sapiens
atcccttaagaa

SEQ ID NO: 1775772 - DNA, 13 bp, Homo sapiens
atcccttcctgga

SEQ ID NO: 1775773 - DNA, 17 bp, Homo sapiens
atcccttcctggaaaca

SEQ ID NO: 1775774 - DNA, 19 bp, Homo sapiens
atcccttccttttagccta

SEQ ID NO: 1775775 - DNA, 15 bp, Homo sapiens
atccgaagggaatta

SEQ ID NO: 1775776 - DNA, 18 bp, Homo sapiens
atccgcctacctcagcct

SEQ ID NO: 1775777 - DNA, 17 bp, Homo sapiens
atccgcctgcctctgcc

SEQ ID NO: 1775778 - DNA, 13 bp, Homo sapiens
atccgcctgtggg

SEQ ID NO: 1775779 - DNA, 13 bp, Homo sapiens
atccgctgccacc

SEQ ID NO: 1775780 - DNA, 13 bp, Homo sapiens
atccggaaagaag

SEQ ID NO: 1775781 - DNA, 18 bp, Homo sapiens
atctctctgcagctgccg

SEQ ID NO: 1775782 - DNA, 14 bp, Homo sapiens
atctctctgcccaa

SEQ ID NO: 1775783 - DNA, 15 bp, Homo sapiens
atctctcttgtcctc

SEQ ID NO: 1775784 - DNA, 18 bp, Homo sapiens
atctctcttgtcctcttc

SEQ ID NO: 1775785 - DNA, 20 bp, Homo sapiens
atctctcttgtcctcttctg

SEQ ID NO: 1775786 - DNA, 16 bp, Homo sapiens
atctctgaagaaacaa

SEQ ID NO: 1775787 - DNA, 20 bp, Homo sapiens
atctctgattaaatttaata

SEQ ID NO: 1775788 - DNA, 16 bp, Homo sapiens
atctctggaaaaataa

SEQ ID NO: 1775789 - DNA, 22 bp, Homo sapiens
atctctgtagtggccccctcct

SEQ ID NO: 1775790 - DNA, 18 bp, Homo sapiens
atctctgtgccttcgtct

SEQ ID NO: 1775791 - DNA, 17 bp, Homo sapiens
atctctgttacaaaaga

SEQ ID NO: 1775792 - DNA, 18 bp, Homo sapiens
atctctgttacaaaagaa

SEQ ID NO: 1775793 - DNA, 22 bp, Homo sapiens
atctctgttctgtttggcactt

SEQ ID NO: 1775794 - DNA, 22 bp, Homo sapiens
atctcttagctcccctccaacc

SEQ ID NO: 1775795 - DNA, 15 bp, Homo sapiens
atctcttattctaat

SEQ ID NO: 1775796 - DNA, 19 bp, Homo sapiens
atctcttattttacaataa

SEQ ID NO: 1775797 - DNA, 18 bp, Homo sapiens
atctcttcactaccctga

SEQ ID NO: 1775798 - DNA, 14 bp, Homo sapiens
atctcttcaggttc

SEQ ID NO: 1775799 - DNA, 12 bp, Homo sapiens
atctcttcagtc

SEQ ID NO: 1775800 - DNA, 19 bp, Homo sapiens
atctcttcatgcttgacat

SEQ ID NO: 1775801 - DNA, 14 bp, Homo sapiens
atctcttctgcaag

SEQ ID NO: 1775802 - DNA, 15 bp, Homo sapiens
atctcttctgcaagc

SEQ ID NO: 1775803 - DNA, 23 bp, Homo sapiens
atctcttctgcaagcctcatgcc

SEQ ID NO: 1775804 - DNA, 17 bp, Homo sapiens
atctctttgatctactt

SEQ ID NO: 1775805 - DNA, 22 bp, Homo sapiens
atctctttgttctaaagatgga

SEQ ID NO: 1775806 - DNA, 20 bp, Homo sapiens
atctcttttatatttgtagg

SEQ ID NO: 1775807 - DNA, 15 bp, Homo sapiens
atctgaaaagaaatg

SEQ ID NO: 1775808 - DNA, 19 bp, Homo sapiens
atctgaaaagaaatgctaa

SEQ ID NO: 1775809 - DNA, 15 bp, Homo sapiens
atctgaaatccataa

SEQ ID NO: 1775810 - DNA, 18 bp, Homo sapiens
atctgaaatccataaact

SEQ ID NO: 1775811 - DNA, 22 bp, Homo sapiens
atctgaaatccataaactaaga

SEQ ID NO: 1775812 - DNA, 13 bp, Homo sapiens
atctgaacattct

SEQ ID NO: 1775813 - DNA, 21 bp, Homo sapiens
atctgaagagctattatataa

SEQ ID NO: 1775814 - DNA, 23 bp, Homo sapiens
atctgaagagtatccttccttca

SEQ ID NO: 1775815 - DNA, 18 bp, Homo sapiens
atctgaatgatcctgtct

SEQ ID NO: 1775816 - DNA, 18 bp, Homo sapiens
atctgaattaaataaata

SEQ ID NO: 1775817 - DNA, 16 bp, Homo sapiens
atctgaattttgcaat

SEQ ID NO: 1775818 - DNA, 19 bp, Homo sapiens
atctgaattttgcaatgta

SEQ ID NO: 1775819 - DNA, 21 bp, Homo sapiens
atctgacactaccttatcagg

SEQ ID NO: 1775820 - DNA, 12 bp, Homo sapiens
atctgaccatct

SEQ ID NO: 1775821 - DNA, 14 bp, Homo sapiens
atctgaccatctgt

SEQ ID NO: 1775822 - DNA, 12 bp, Homo sapiens
atctgacccagt

SEQ ID NO: 1775823 - DNA, 20 bp, Homo sapiens
atctgacccagtgcccccac

SEQ ID NO: 1775824 - DNA, 18 bp, Homo sapiens
atctgaccgttctattgt

SEQ ID NO: 1775825 - DNA, 22 bp, Homo sapiens
atctgagagacctgtgtgaact

SEQ ID NO: 1775826 - DNA, 15 bp, Homo sapiens
atctgagctcccacc

SEQ ID NO: 1775827 - DNA, 19 bp, Homo sapiens
atgcaggtgatgccattac

SEQ ID NO: 1775828 - DNA, 19 bp, Homo sapiens
atgcagtactaaaattaat

SEQ ID NO: 1775829 - DNA, 20 bp, Homo sapiens
atgcagttagctgaagaatt

SEQ ID NO: 1775830 - DNA, 13 bp, Homo sapiens
atgcagttcctgg

SEQ ID NO: 1775831 - DNA, 14 bp, Homo sapiens
atgcagttttaaga

SEQ ID NO: 1775832 - DNA, 17 bp, Homo sapiens
atgcagttttaagaatt

SEQ ID NO: 1775833 - DNA, 22 bp, Homo sapiens
atgcagttttaatacttgtaat

SEQ ID NO: 1775834 - DNA, 15 bp, Homo sapiens
atgcagttttcctta

SEQ ID NO: 1775835 - DNA, 23 bp, Homo sapiens
atgcatagtcccagctacccagg

SEQ ID NO: 1775836 - DNA, 18 bp, Homo sapiens
atgcatatcctgagccat

SEQ ID NO: 1775837 - DNA, 15 bp, Homo sapiens
atgcatattcaatgt

SEQ ID NO: 1775838 - DNA, 16 bp, Homo sapiens
atgcatatttgtttat

SEQ ID NO: 1775839 - DNA, 16 bp, Homo sapiens
atgcatcacatgatga

SEQ ID NO: 1775840 - DNA, 21 bp, Homo sapiens
atgcatcacgtaccccactgg

SEQ ID NO: 1775841 - DNA, 23 bp, Homo sapiens
atgcatccattcctcagggacag

SEQ ID NO: 1775842 - DNA, 22 bp, Homo sapiens
atgcatctcactggatgcaaag

SEQ ID NO: 1775843 - DNA, 16 bp, Homo sapiens
atgcatcttactgaag

SEQ ID NO: 1775844 - DNA, 18 bp, Homo sapiens
atgcatcttactgaaggt

SEQ ID NO: 1775845 - DNA, 13 bp, Homo sapiens
atgcatgagctcc

SEQ ID NO: 1775846 - DNA, 13 bp, Homo sapiens
atgcatgcaaatg

SEQ ID NO: 1775847 - DNA, 16 bp, Homo sapiens
atgcatggaaacatgg

SEQ ID NO: 1775848 - DNA, 19 bp, Homo sapiens
atgcatgggaggaattcat

SEQ ID NO: 1775849 - DNA, 19 bp, Homo sapiens
atgcatggtgccccaggac

SEQ ID NO: 1775850 - DNA, 17 bp, Homo sapiens
atgcatgtcctgtaaag

SEQ ID NO: 1775851 - DNA, 13 bp, Homo sapiens
atgcattagggaa

SEQ ID NO: 1775852 - DNA, 23 bp, Homo sapiens
atgcattattgacgaactggcta

SEQ ID NO: 1775853 - DNA, 23 bp, Homo sapiens
atgcattcacatttagaaaagtg

SEQ ID NO: 1775854 - DNA, 13 bp, Homo sapiens
atgcattccctga

SEQ ID NO: 1775855 - DNA, 23 bp, Homo sapiens
atgcattgcctgtaacaatgtaa

SEQ ID NO: 1775856 - DNA, 17 bp, Homo sapiens
atgcattggcctctgta

SEQ ID NO: 1775857 - DNA, 22 bp, Homo sapiens
atgcattgttgttctgctcaat

SEQ ID NO: 1775858 - DNA, 17 bp, Homo sapiens
atgcatttaataaagat

SEQ ID NO: 1775859 - DNA, 13 bp, Homo sapiens
atgcatttcattc

SEQ ID NO: 1775860 - DNA, 13 bp, Homo sapiens
atgcatttggaac

SEQ ID NO: 1775861 - DNA, 12 bp, Homo sapiens
atgcattttgca

SEQ ID NO: 1775862 - DNA, 13 bp, Homo sapiens
atgcattttgcag

SEQ ID NO: 1775863 - DNA, 16 bp, Homo sapiens
atgccaaagatcactt

SEQ ID NO: 1775864 - DNA, 16 bp, Homo sapiens
atgccaaggagcccct

SEQ ID NO: 1775865 - DNA, 21 bp, Homo sapiens
atgccaagggggtgactggaa

SEQ ID NO: 1775866 - DNA, 17 bp, Homo sapiens
atgccaatttcctctcc

SEQ ID NO: 1775867 - DNA, 15 bp, Homo sapiens
atgccacacagagtg

SEQ ID NO: 1775868 - DNA, 12 bp, Homo sapiens
atgccaccaccc

SEQ ID NO: 1775869 - DNA, 16 bp, Homo sapiens
atgccaccaggtaaca

SEQ ID NO: 1775870 - DNA, 16 bp, Homo sapiens
atgccacgcctggaag

SEQ ID NO: 1775871 - DNA, 19 bp, Homo sapiens
atgccacgcctggaagggc

SEQ ID NO: 1775872 - DNA, 17 bp, Homo sapiens
atgccacgggaagttta

SEQ ID NO: 1775873 - DNA, 17 bp, Homo sapiens
atgccactcctccctcc

SEQ ID NO: 1775874 - DNA, 16 bp, Homo sapiens
atgccactgccaggca

SEQ ID NO: 1775875 - DNA, 22 bp, Homo sapiens
atgccactgccaggcacctggc

SEQ ID NO: 1775876 - DNA, 15 bp, Homo sapiens
atgccactgggacag

SEQ ID NO: 1775877 - DNA, 20 bp, Homo sapiens
atgccacttccttttaactg

SEQ ID NO: 1775878 - DNA, 11 bp, Homo sapiens
atgccagagcc

SEQ ID NO: 1775879 - DNA, 19 bp, Homo sapiens
atgccagagccaacctgga

SEQ ID NO: 1775880 - DNA, 23 bp, Homo sapiens
atgccagagccaacctggacttc

SEQ ID NO: 1775881 - DNA, 16 bp, Homo sapiens
atgccagctacttcct

SEQ ID NO: 1775882 - DNA, 16 bp, Homo sapiens
atgccagcttctctct

SEQ ID NO: 1775883 - DNA, 13 bp, Homo sapiens
atgccatgaacaa

SEQ ID NO: 1775884 - DNA, 16 bp, Homo sapiens
atgccatgaacaaatt

SEQ ID NO: 1775885 - DNA, 23 bp, Homo sapiens
atgccatgaacaaattctttagt

SEQ ID NO: 1775886 - DNA, 14 bp, Homo sapiens
atgccatgtctgag

SEQ ID NO: 1775887 - DNA, 21 bp, Homo sapiens
atgccatttagaatctagaaa

SEQ ID NO: 1775888 - DNA, 23 bp, Homo sapiens
atgccatttagaatctagaaatg

SEQ ID NO: 1775889 - DNA, 16 bp, Homo sapiens
atgcccacctgcccat

SEQ ID NO: 1775890 - DNA, 20 bp, Homo sapiens
atgcccacctgcccatcaca

SEQ ID NO: 1775891 - DNA, 23 bp, Homo sapiens
atgcccagagggcccaggcaggc

SEQ ID NO: 1775892 - DNA, 13 bp, Homo sapiens
atgcccagatgaa

SEQ ID NO: 1775893 - DNA, 12 bp, Homo sapiens
atgcccagctct

SEQ ID NO: 1775894 - DNA, 15 bp, Homo sapiens
atgcccagctctctg

SEQ ID NO: 1775895 - DNA, 17 bp, Homo sapiens
atgcccagggccactct

SEQ ID NO: 1775896 - DNA, 13 bp, Homo sapiens
atgccccagctct

SEQ ID NO: 1775897 - DNA, 12 bp, Homo sapiens
atgccccaggat

SEQ ID NO: 1775898 - DNA, 21 bp, Homo sapiens
atgcccccctcaaacctcctc

SEQ ID NO: 1775899 - DNA, 22 bp, Homo sapiens
atgcccccctcaaacctcctct

SEQ ID NO: 1775900 - DNA, 24 bp, Homo sapiens
atgccccctccaggagagagccag

SEQ ID NO: 1775901 - DNA, 16 bp, Homo sapiens
atgccccctgcttact

SEQ ID NO: 1775902 - DNA, 17 bp, Homo sapiens
atgcccggcgccgggca

SEQ ID NO: 1775903 - DNA, 20 bp, Homo sapiens
atgccctaagagtgtcactg

SEQ ID NO: 1775904 - DNA, 13 bp, Homo sapiens
atgccctgccatt

SEQ ID NO: 1775905 - DNA, 22 bp, Homo sapiens
atgccctgccttgtccctctca

SEQ ID NO: 1775906 - DNA, 23 bp, Homo sapiens
atgcccttctgattcccctccac

SEQ ID NO: 1775907 - DNA, 18 bp, Homo sapiens
atgccgcgggcggccagg

SEQ ID NO: 1775908 - DNA, 18 bp, Homo sapiens
atgccgctgtctctgagg

SEQ ID NO: 1775909 - DNA, 15 bp, Homo sapiens
atgccggatgtgctt

SEQ ID NO: 1775910 - DNA, 20 bp, Homo sapiens
atgccggttaaattccatat

SEQ ID NO: 1775911 - DNA, 22 bp, Homo sapiens
atgccgtataggatgtcagaca

SEQ ID NO: 1775912 - DNA, 16 bp, Homo sapiens
atgccgttctgttcca

SEQ ID NO: 1775913 - DNA, 15 bp, Homo sapiens
atgcctacagctgtc

SEQ ID NO: 1775914 - DNA, 21 bp, Homo sapiens
atgcctatggtggatccaaac

SEQ ID NO: 1775915 - DNA, 19 bp, Homo sapiens
atgcctatgtagtgtcttt

SEQ ID NO: 1775916 - DNA, 23 bp, Homo sapiens
atgcctcactaatttttgtatta

SEQ ID NO: 1775917 - DNA, 20 bp, Homo sapiens
atgcctccaccccccagaac

SEQ ID NO: 1775918 - DNA, 13 bp, Homo sapiens
atgcctccaccgc

SEQ ID NO: 1775919 - DNA, 14 bp, Homo sapiens
atgcctctcccgca

SEQ ID NO: 1775920 - DNA, 21 bp, Homo sapiens
atgcctctgacagtccacagg

SEQ ID NO: 1775921 - DNA, 19 bp, Homo sapiens
atgcctgactaatttttgt

SEQ ID NO: 1775922 - DNA, 14 bp, Homo sapiens
atgcctgagggtgg

SEQ ID NO: 1775923 - DNA, 17 bp, Homo sapiens
atgcctgagggtggaga

SEQ ID NO: 1775924 - DNA, 13 bp, Homo sapiens
atgcctgctccct

SEQ ID NO: 1775925 - DNA, 14 bp, Homo sapiens
atgcctgctccctg

SEQ ID NO: 1775926 - DNA, 21 bp, Homo sapiens
atgcctgtagctttcctggtc

SEQ ID NO: 1775927 - DNA, 16 bp, Homo sapiens
atgcctgtatttccaa

SEQ ID NO: 1775928 - DNA, 21 bp, Homo sapiens
atgcctgtctctagctgttct

SEQ ID NO: 1775929 - DNA, 22 bp, Homo sapiens
atgcctgtctctgttcagatgt

SEQ ID NO: 1775930 - DNA, 16 bp, Homo sapiens
atgccttaagcagaac

SEQ ID NO: 1775931 - DNA, 16 bp, Homo sapiens
atgccttactcttctt

SEQ ID NO: 1775932 - DNA, 18 bp, Homo sapiens
atgccttactcttcttga

SEQ ID NO: 1775933 - DNA, 19 bp, Homo sapiens
atgccttccagcaccctgc

SEQ ID NO: 1775934 - DNA, 13 bp, Homo sapiens
atgccttgtataa

SEQ ID NO: 1775935 - DNA, 22 bp, Homo sapiens
atgcctttaaagtatgaatcta

SEQ ID NO: 1775936 - DNA, 22 bp, Homo sapiens
atgcctttctagtcctattcta

SEQ ID NO: 1775937 - DNA, 12 bp, Homo sapiens
atgcctttgtaa

SEQ ID NO: 1775938 - DNA, 22 bp, Homo sapiens
atgccttttgaatacatttgta

SEQ ID NO: 1775939 - DNA, 16 bp, Homo sapiens
atgccttttttgtagt

SEQ ID NO: 1775940 - DNA, 22 bp, Homo sapiens
atgcgaggctcggagcaccctt

SEQ ID NO: 1775941 - DNA, 15 bp, Homo sapiens
atgcgcgctgtgggc

SEQ ID NO: 1775942 - DNA, 22 bp, Homo sapiens
atgcgcgctgtgggcaattgtt

SEQ ID NO: 1775943 - DNA, 14 bp, Homo sapiens
atgcggatcctgct

SEQ ID NO: 1775944 - DNA, 16 bp, Homo sapiens
atgcggatcctgctgg

SEQ ID NO: 1775945 - DNA, 17 bp, Homo sapiens
atgcggatcctgctggg

SEQ ID NO: 1775946 - DNA, 21 bp, Homo sapiens
atgcggcccactttcctgagc

SEQ ID NO: 1775947 - DNA, 22 bp, Homo sapiens
atgcggcccactttcctgagct

SEQ ID NO: 1775948 - DNA, 16 bp, Homo sapiens
atgcggcccaggatgg

SEQ ID NO: 1775949 - DNA, 20 bp, Homo sapiens
atgcggcccaggatggcttt

SEQ ID NO: 1775950 - DNA, 21 bp, Homo sapiens
atgcggtgtttggttttttgt

SEQ ID NO: 1775951 - DNA, 14 bp, Homo sapiens
atgcgtatatgtgc

SEQ ID NO: 1775952 - DNA, 13 bp, Homo sapiens
atgcgtcccaaga

SEQ ID NO: 1775953 - DNA, 21 bp, Homo sapiens
atgcgtgccgcctgctcctca

SEQ ID NO: 1775954 - DNA, 18 bp, Homo sapiens
atgcgtgctgagaggcga

SEQ ID NO: 1775955 - DNA, 22 bp, Homo sapiens
atgcgtggccacgggggcagtg

SEQ ID NO: 1775956 - DNA, 22 bp, Homo sapiens
atgcgtgtgtttggtttcccat

SEQ ID NO: 1775957 - DNA, 22 bp, Homo sapiens
atgctaaaccttagtactgagt

SEQ ID NO: 1775958 - DNA, 15 bp, Homo sapiens
atgctaaactgtgaa

SEQ ID NO: 1775959 - DNA, 16 bp, Homo sapiens
atgctaaactgtgaaa

SEQ ID NO: 1775960 - DNA, 17 bp, Homo sapiens
atgctaaagatgatgat

SEQ ID NO: 1775961 - DNA, 14 bp, Homo sapiens
atgctaacgtgtca

SEQ ID NO: 1775962 - DNA, 23 bp, Homo sapiens
atgctaagctgatattatttctt

SEQ ID NO: 1775963 - DNA, 15 bp, Homo sapiens
atgctaatgtaatca

SEQ ID NO: 1775964 - DNA, 23 bp, Homo sapiens
atgctactaaatttttataataa

SEQ ID NO: 1775965 - DNA, 23 bp, Homo sapiens
atgctactgtctcactgaaacat

SEQ ID NO: 1775966 - DNA, 13 bp, Homo sapiens
atgctatttgaac

SEQ ID NO: 1775967 - DNA, 11 bp, Homo sapiens
atgctcagcct

SEQ ID NO: 1775968 - DNA, 19 bp, Homo sapiens
atgctcagccttgctgctc

SEQ ID NO: 1775969 - DNA, 21 bp, Homo sapiens
atgctcagccttgctgctctg

SEQ ID NO: 1775970 - DNA, 13 bp, Homo sapiens
atgctccagggca

SEQ ID NO: 1775971 - DNA, 13 bp, Homo sapiens
atgctccagggtc

SEQ ID NO: 1775972 - DNA, 12 bp, Homo sapiens
atgctccccaca

SEQ ID NO: 1775973 - DNA, 14 bp, Homo sapiens
atgctccctcccct

SEQ ID NO: 1775974 - DNA, 20 bp, Homo sapiens
atgctcctcacctgtctagg

SEQ ID NO: 1775975 - DNA, 23 bp, Homo sapiens
atgctccttgagaggagaaatgc

SEQ ID NO: 1775976 - DNA, 22 bp, Homo sapiens
atgctctcactgtttgttttta

SEQ ID NO: 1775977 - DNA, 21 bp, Homo sapiens
atgctctctgcagccagccca

SEQ ID NO: 1775978 - DNA, 16 bp, Homo sapiens
atgctctggaagcctg

SEQ ID NO: 1775979 - DNA, 15 bp, Homo sapiens
atgctcttctgtgga

SEQ ID NO: 1775980 - DNA, 15 bp, Homo sapiens
atgctcttgtccctg

SEQ ID NO: 1775981 - DNA, 14 bp, Homo sapiens
atgctctttcccag

SEQ ID NO: 1775982 - DNA, 16 bp, Homo sapiens
atgctctttcccagga

SEQ ID NO: 1775983 - DNA, 17 bp, Homo sapiens
atgctgaaaaaacacct

SEQ ID NO: 1775984 - DNA, 14 bp, Homo sapiens
atgctgaaaattgc

SEQ ID NO: 1775985 - DNA, 22 bp, Homo sapiens
atgctgaaaattgcctttctgt

SEQ ID NO: 1775986 - DNA, 23 bp, Homo sapiens
atgctgaaacaatgcctacagct

SEQ ID NO: 1775987 - DNA, 14 bp, Homo sapiens
atgctgaactcctt

SEQ ID NO: 1775988 - DNA, 18 bp, Homo sapiens
atgctgaatatatagaat

SEQ ID NO: 1775989 - DNA, 17 bp, Homo sapiens
atgctgaatgccccctg

SEQ ID NO: 1775990 - DNA, 13 bp, Homo sapiens
atgctgaatttct

SEQ ID NO: 1775991 - DNA, 15 bp, Homo sapiens
atgctgacctcacct

SEQ ID NO: 1775992 - DNA, 15 bp, Homo sapiens
atgctgaggcctggg

SEQ ID NO: 1775993 - DNA, 18 bp, Homo sapiens
atgctgaggcctgggccg

SEQ ID NO: 1775994 - DNA, 17 bp, Homo sapiens
atgctgagggtgtttct

SEQ ID NO: 1775995 - DNA, 20 bp, Homo sapiens
atgctgagggtgtttcttcc

SEQ ID NO: 1775996 - DNA, 23 bp, Homo sapiens
atgctgagggtgtttcttcctgc

SEQ ID NO: 1775997 - DNA, 19 bp, Homo sapiens
atgctgatcatcgccagag

SEQ ID NO: 1775998 - DNA, 18 bp, Homo sapiens
atgctgatcttttaaaat

SEQ ID NO: 1775999 - DNA, 13 bp, Homo sapiens
atgctgatggagc

SEQ ID NO: 1776000 - DNA, 14 bp, Homo sapiens
atgctgccaaattt

SEQ ID NO: 1776001 - DNA, 12 bp, Homo sapiens
atgctgcccctc

SEQ ID NO: 1776002 - DNA, 13 bp, Homo sapiens
atgctgcctgagt

SEQ ID NO: 1776003 - DNA, 11 bp, Homo sapiens
atgctgcctgc

SEQ ID NO: 1776004 - DNA, 23 bp, Homo sapiens
atgctgcctgtatttgagagact

SEQ ID NO: 1776005 - DNA, 17 bp, Homo sapiens
atgctgcgcttcgcttg

SEQ ID NO: 1776006 - DNA, 19 bp, Homo sapiens
atgctgctccgcccgctcc

SEQ ID NO: 1776007 - DNA, 12 bp, Homo sapiens
atgctgctggcc

SEQ ID NO: 1776008 - DNA, 14 bp, Homo sapiens
atgctgctggccaa

SEQ ID NO: 1776009 - DNA, 14 bp, Homo sapiens
atgctgctggggaa

SEQ ID NO: 1776010 - DNA, 23 bp, Homo sapiens
atgctgctttcccctgtggggat

SEQ ID NO: 1776011 - DNA, 12 bp, Homo sapiens
atgctgctttgc

SEQ ID NO: 1776012 - DNA, 12 bp, Homo sapiens
atgctggaaata

SEQ ID NO: 1776013 - DNA, 13 bp, Homo sapiens
atgctggaaataa

SEQ ID NO: 1776014 - DNA, 18 bp, Homo sapiens
atgctggaaataaaacag

SEQ ID NO: 1776015 - DNA, 22 bp, Homo sapiens
atgctggactggaggcccctgg

SEQ ID NO: 1776016 - DNA, 13 bp, Homo sapiens
atgctggagggag

SEQ ID NO: 1776017 - DNA, 17 bp, Homo sapiens
atgctggatgtctgcca

SEQ ID NO: 1776018 - DNA, 20 bp, Homo sapiens
atgctggcccagggcccaga

SEQ ID NO: 1776019 - DNA, 9 bp, Homo sapiens
atgctggga

SEQ ID NO: 1776020 - DNA, 10 bp, Homo sapiens
atgctgggac

SEQ ID NO: 1776021 - DNA, 13 bp, Homo sapiens
atgctgggctggg

SEQ ID NO: 1776022 - DNA, 22 bp, Homo sapiens
atgctgggtttatagatgtgag

SEQ ID NO: 1776023 - DNA, 21 bp, Homo sapiens
atgctggtggttaaggccagg

SEQ ID NO: 1776024 - DNA, 20 bp, Homo sapiens
atgctgtaacttaaaatagg

SEQ ID NO: 1776025 - DNA, 19 bp, Homo sapiens
atgctgtatatcctttcta

SEQ ID NO: 1776026 - DNA, 19 bp, Homo sapiens
atgctgtattcttctttgg

SEQ ID NO: 1776027 - DNA, 20 bp, Homo sapiens
atgctgtgcgcccagggctg

SEQ ID NO: 1776028 - DNA, 23 bp, Homo sapiens
atgctgtgtatatggtatatata

SEQ ID NO: 1776029 - DNA, 18 bp, Homo sapiens
atgctgttatgtccagaa

SEQ ID NO: 1776030 - DNA, 14 bp, Homo sapiens
atgctgttgcctca

SEQ ID NO: 1776031 - DNA, 17 bp, Homo sapiens
atgctgttgcctcatct

SEQ ID NO: 1776032 - DNA, 13 bp, Homo sapiens
atgctgttgctgc

SEQ ID NO: 1776033 - DNA, 14 bp, Homo sapiens
atgctgttgtaaac

SEQ ID NO: 1776034 - DNA, 15 bp, Homo sapiens
atgcttagtcactgc

SEQ ID NO: 1776035 - DNA, 15 bp, Homo sapiens
atgcttagtccctca

SEQ ID NO: 1776036 - DNA, 22 bp, Homo sapiens
atgcttcatcattccctctcat

SEQ ID NO: 1776037 - DNA, 20 bp, Homo sapiens
atgcttcattattcaagaat

SEQ ID NO: 1776038 - DNA, 21 bp, Homo sapiens
atgcttcattcaatattgaca

SEQ ID NO: 1776039 - DNA, 21 bp, Homo sapiens
atgcttcatttgtatgtcaaa

SEQ ID NO: 1776040 - DNA, 23 bp, Homo sapiens
atgcttcctagaagttactgaat

SEQ ID NO: 1776041 - DNA, 22 bp, Homo sapiens
atgcttcctgacaatcaactct

SEQ ID NO: 1776042 - DNA, 13 bp, Homo sapiens
atgcttcctttct

SEQ ID NO: 1776043 - DNA, 16 bp, Homo sapiens
atgcttcctttctctc

SEQ ID NO: 1776044 - DNA, 18 bp, Homo sapiens
atgggaaatagtctgatt

SEQ ID NO: 1776045 - DNA, 17 bp, Homo sapiens
atgggaacaattgaagt

SEQ ID NO: 1776046 - DNA, 14 bp, Homo sapiens
atgggaagacatga

SEQ ID NO: 1776047 - DNA, 14 bp, Homo sapiens
atgggaagactcag

SEQ ID NO: 1776048 - DNA, 18 bp, Homo sapiens
atgggaatgaggtgggag

SEQ ID NO: 1776049 - DNA, 14 bp, Homo sapiens
atgggaatttgtca

SEQ ID NO: 1776050 - DNA, 18 bp, Homo sapiens
atgggacaagcagtccct

SEQ ID NO: 1776051 - DNA, 14 bp, Homo sapiens
atgggacagcaaca

SEQ ID NO: 1776052 - DNA, 15 bp, Homo sapiens
atgggactgatgtca

SEQ ID NO: 1776053 - DNA, 19 bp, Homo sapiens
atgggactgatgtcatctt

SEQ ID NO: 1776054 - DNA, 19 bp, Homo sapiens
atgggactgattctgtggc

SEQ ID NO: 1776055 - DNA, 23 bp, Homo sapiens
atgggactttccttccctctcct

SEQ ID NO: 1776056 - DNA, 15 bp, Homo sapiens
atgggagatggtcag

SEQ ID NO: 1776057 - DNA, 18 bp, Homo sapiens
atgggagccagaattcac

SEQ ID NO: 1776058 - DNA, 12 bp, Homo sapiens
atgggagccagc

SEQ ID NO: 1776059 - DNA, 19 bp, Homo sapiens
atgggagccagctgctttt

SEQ ID NO: 1776060 - DNA, 20 bp, Homo sapiens
atgggagccagctgcttttt

SEQ ID NO: 1776061 - DNA, 13 bp, Homo sapiens
atgggagccagga

SEQ ID NO: 1776062 - DNA, 14 bp, Homo sapiens
atgggaggaattca

SEQ ID NO: 1776063 - DNA, 20 bp, Homo sapiens
atgggatctttctgggagct

SEQ ID NO: 1776064 - DNA, 15 bp, Homo sapiens
atgggcaaagcttgt

SEQ ID NO: 1776065 - DNA, 15 bp, Homo sapiens
atgggcagctggggg

SEQ ID NO: 1776066 - DNA, 15 bp, Homo sapiens
atgggcagtttcagt

SEQ ID NO: 1776067 - DNA, 14 bp, Homo sapiens
atgggcattgggct

SEQ ID NO: 1776068 - DNA, 14 bp, Homo sapiens
atgggcccctggca

SEQ ID NO: 1776069 - DNA, 14 bp, Homo sapiens
atgggcccctggcc

SEQ ID NO: 1776070 - DNA, 13 bp, Homo sapiens
atgggcctgggcc

SEQ ID NO: 1776071 - DNA, 16 bp, Homo sapiens
atgggcctgggcctgc

SEQ ID NO: 1776072 - DNA, 18 bp, Homo sapiens
atgggcctgggcctgctt

SEQ ID NO: 1776073 - DNA, 19 bp, Homo sapiens
atgggccttgctttgggct

SEQ ID NO: 1776074 - DNA, 22 bp, Homo sapiens
atgggccttgctttgggctttg

SEQ ID NO: 1776075 - DNA, 14 bp, Homo sapiens
atgggctgtgtcct

SEQ ID NO: 1776076 - DNA, 23 bp, Homo sapiens
atgggcttggacttcctggggcc

SEQ ID NO: 1776077 - DNA, 18 bp, Homo sapiens
atgggcttgttttcttgc

SEQ ID NO: 1776078 - DNA, 20 bp, Homo sapiens
atggttctccaagaaactga

SEQ ID NO: 1776079 - DNA, 14 bp, Homo sapiens
atggttcttcacct

SEQ ID NO: 1776080 - DNA, 16 bp, Homo sapiens
atggttgatggaaaat

SEQ ID NO: 1776081 - DNA, 19 bp, Homo sapiens
atggttgatggaaaataaa

SEQ ID NO: 1776082 - DNA, 19 bp, Homo sapiens
atggtttaaatatgaatga

SEQ ID NO: 1776083 - DNA, 18 bp, Homo sapiens
atggtttatgcatgtata

SEQ ID NO: 1776084 - DNA, 15 bp, Homo sapiens
atggtttattcccaa

SEQ ID NO: 1776085 - DNA, 16 bp, Homo sapiens
atggttttcaaaataa

SEQ ID NO: 1776086 - DNA, 20 bp, Homo sapiens
atgtaaaaccctttaaatgt

SEQ ID NO: 1776087 - DNA, 13 bp, Homo sapiens
atgtaaaatatgt

SEQ ID NO: 1776088 - DNA, 22 bp, Homo sapiens
atgtaaaatcttgtcatgtgta

SEQ ID NO: 1776089 - DNA, 23 bp, Homo sapiens
atgtaaaatcttgtcatgtgtat

SEQ ID NO: 1776090 - DNA, 16 bp, Homo sapiens
atgtaaaatgaattga

SEQ ID NO: 1776091 - DNA, 21 bp, Homo sapiens
atgtaaacaaaccacagcagg

SEQ ID NO: 1776092 - DNA, 16 bp, Homo sapiens
atgtaaacaaatcttt

SEQ ID NO: 1776093 - DNA, 15 bp, Homo sapiens
atgtaaacagtgcct

SEQ ID NO: 1776094 - DNA, 17 bp, Homo sapiens
atgtaaacagtgtcttc

SEQ ID NO: 1776095 - DNA, 21 bp, Homo sapiens
atgtaaagatatttttatctt

SEQ ID NO: 1776096 - DNA, 19 bp, Homo sapiens
atgtaaagatgatttaagt

SEQ ID NO: 1776097 - DNA, 14 bp, Homo sapiens
atgtaaaggaggga

SEQ ID NO: 1776098 - DNA, 19 bp, Homo sapiens
atgtaaaggtatattgtga

SEQ ID NO: 1776099 - DNA, 16 bp, Homo sapiens
atgtaaagtaagacat

SEQ ID NO: 1776100 - DNA, 22 bp, Homo sapiens
atgtaaagttatgtatttaaag

SEQ ID NO: 1776101 - DNA, 11 bp, Homo sapiens
atgtaaatcct

SEQ ID NO: 1776102 - DNA, 12 bp, Homo sapiens
atgtaaatttgt

SEQ ID NO: 1776103 - DNA, 13 bp, Homo sapiens
atgtaaatttgta

SEQ ID NO: 1776104 - DNA, 14 bp, Homo sapiens
atgtaaatttgtac

SEQ ID NO: 1776105 - DNA, 18 bp, Homo sapiens
atgtaacatcataattac

SEQ ID NO: 1776106 - DNA, 19 bp, Homo sapiens
atgtaacatcataattaca

SEQ ID NO: 1776107 - DNA, 16 bp, Homo sapiens
atgtaaccaagctgta

SEQ ID NO: 1776108 - DNA, 16 bp, Homo sapiens
atgtaactccagatag

SEQ ID NO: 1776109 - DNA, 17 bp, Homo sapiens
atgtaactccagataga

SEQ ID NO: 1776110 - DNA, 21 bp, Homo sapiens
atgtaactccagatagagaaa

SEQ ID NO: 1776111 - DNA, 23 bp, Homo sapiens
atgtaactgcattgagaactgca

SEQ ID NO: 1776112 - DNA, 13 bp, Homo sapiens
atgtaactgctga

SEQ ID NO: 1776113 - DNA, 17 bp, Homo sapiens
atgtaagaacacatttt

SEQ ID NO: 1776114 - DNA, 21 bp, Homo sapiens
atgtaagattatagattctaa

SEQ ID NO: 1776115 - DNA, 22 bp, Homo sapiens
atgtaagattatagattctaaa

SEQ ID NO: 1776116 - DNA, 13 bp, Homo sapiens
atgtcttggacac

SEQ ID NO: 1776117 - DNA, 19 bp, Homo sapiens
atgtcttggacactgtaca

SEQ ID NO: 1776118 - DNA, 19 bp, Homo sapiens
atgtcttgggtaggcggga

SEQ ID NO: 1776119 - DNA, 22 bp, Homo sapiens
atgtcttgtacatgtgtagcct

SEQ ID NO: 1776120 - DNA, 23 bp, Homo sapiens
atgtctttgttggaaaagaatac

SEQ ID NO: 1776121 - DNA, 13 bp, Homo sapiens
atgtcttttaaaa

SEQ ID NO: 1776122 - DNA, 14 bp, Homo sapiens
atgtcttttaaaat

SEQ ID NO: 1776123 - DNA, 15 bp, Homo sapiens
atgtgaaaaaggaat

SEQ ID NO: 1776124 - DNA, 20 bp, Homo sapiens
atgtgaaaaattaacttttt

SEQ ID NO: 1776125 - DNA, 18 bp, Homo sapiens
atgtgaaaggaacatttt

SEQ ID NO: 1776126 - DNA, 17 bp, Homo sapiens
atgtgaaatgctttctg

SEQ ID NO: 1776127 - DNA, 14 bp, Homo sapiens
atgtgaaattcatt

SEQ ID NO: 1776128 - DNA, 23 bp, Homo sapiens
atgtgaaatttacatcatttctt

SEQ ID NO: 1776129 - DNA, 14 bp, Homo sapiens
atgtgaacagcata

SEQ ID NO: 1776130 - DNA, 16 bp, Homo sapiens
atgtgaacagcataag

SEQ ID NO: 1776131 - DNA, 15 bp, Homo sapiens
atgtgaagacatttt

SEQ ID NO: 1776132 - DNA, 22 bp, Homo sapiens
atgtgaagaggtctgattggct

SEQ ID NO: 1776133 - DNA, 23 bp, Homo sapiens
atgtgaagaggtctgattggctg

SEQ ID NO: 1776134 - DNA, 17 bp, Homo sapiens
atgtgaagcatgctttg

SEQ ID NO: 1776135 - DNA, 20 bp, Homo sapiens
atgtgaagcatgctttgctg

SEQ ID NO: 1776136 - DNA, 18 bp, Homo sapiens
atgtgaagttcatcttgc

SEQ ID NO: 1776137 - DNA, 15 bp, Homo sapiens
atgtgaatcgcagct

SEQ ID NO: 1776138 - DNA, 20 bp, Homo sapiens
atgtgaatcgcagctgtggg

SEQ ID NO: 1776139 - DNA, 16 bp, Homo sapiens
atgtgaattattgaca

SEQ ID NO: 1776140 - DNA, 19 bp, Homo sapiens
atgtgaattattgacactg

SEQ ID NO: 1776141 - DNA, 15 bp, Homo sapiens
atgtgacattaacaa

SEQ ID NO: 1776142 - DNA, 18 bp, Homo sapiens
atgtgacattaacaaata

SEQ ID NO: 1776143 - DNA, 21 bp, Homo sapiens
atgtgacattaacaaataaaa

SEQ ID NO: 1776144 - DNA, 16 bp, Homo sapiens
atgtgacccaccagtg

SEQ ID NO: 1776145 - DNA, 19 bp, Homo sapiens
atgtgacccaccagtgcct

SEQ ID NO: 1776146 - DNA, 14 bp, Homo sapiens
atgtgactaaagga

SEQ ID NO: 1776147 - DNA, 18 bp, Homo sapiens
atgtgactgcatcatata

SEQ ID NO: 1776148 - DNA, 20 bp, Homo sapiens
atgtgactgcatcatatatt

SEQ ID NO: 1776149 - DNA, 17 bp, Homo sapiens
atgtgagccaccgctgc

SEQ ID NO: 1776150 - DNA, 22 bp, Homo sapiens
atgtgagccaccgctgccagca

SEQ ID NO: 1776151 - DNA, 14 bp, Homo sapiens
atgtgagctataat

SEQ ID NO: 1776152 - DNA, 14 bp, Homo sapiens
atgtgaggaggaaa

SEQ ID NO: 1776153 - DNA, 15 bp, Homo sapiens
atgtgaggaggaaaa

SEQ ID NO: 1776154 - DNA, 14 bp, Homo sapiens
atgtgagtattctc

SEQ ID NO: 1776155 - DNA, 17 bp, Homo sapiens
atgtgagtattctcatt

SEQ ID NO: 1776156 - DNA, 15 bp, Homo sapiens
atgtgatacattttt

SEQ ID NO: 1776157 - DNA, 20 bp, Homo sapiens
atgtgatattctgttgcttt

SEQ ID NO: 1776158 - DNA, 22 bp, Homo sapiens
atgtgatattctgttgctttac

SEQ ID NO: 1776159 - DNA, 11 bp, Homo sapiens
atgtgatctca

SEQ ID NO: 1776160 - DNA, 14 bp, Homo sapiens
atgtgatgttctaa

SEQ ID NO: 1776161 - DNA, 21 bp, Homo sapiens
atgtgatgttctaaggctctg

SEQ ID NO: 1776162 - DNA, 22 bp, Homo sapiens
atgtgattcactgccttcctct

SEQ ID NO: 1776163 - DNA, 23 bp, Homo sapiens
atgtgattcactgccttcctctc

SEQ ID NO: 1776164 - DNA, 21 bp, Homo sapiens
atgtgcaaacccactcagaga

SEQ ID NO: 1776165 - DNA, 17 bp, Homo sapiens
atgtgcaataatttgta

SEQ ID NO: 1776166 - DNA, 16 bp, Homo sapiens
atgtgcactgcctgca

SEQ ID NO: 1776167 - DNA, 22 bp, Homo sapiens
atgtgcactgcctgcatgagct

SEQ ID NO: 1776168 - DNA, 22 bp, Homo sapiens
atgtgcagaaaatatttaatat

SEQ ID NO: 1776169 - DNA, 12 bp, Homo sapiens
atgtgcagggat

SEQ ID NO: 1776170 - DNA, 12 bp, Homo sapiens
atgtgcagtctt

SEQ ID NO: 1776171 - DNA, 18 bp, Homo sapiens
atgtgcatttcacctgtg

SEQ ID NO: 1776172 - DNA, 17 bp, Homo sapiens
atgtgccaaagctttac

SEQ ID NO: 1776173 - DNA, 16 bp, Homo sapiens
atgtgccacattttct

SEQ ID NO: 1776174 - DNA, 11 bp, Homo sapiens
atgtgccacta

SEQ ID NO: 1776175 - DNA, 19 bp, Homo sapiens
atgtgcctaatggagaaga

SEQ ID NO: 1776176 - DNA, 15 bp, Homo sapiens
atgtgcctgcaccag

SEQ ID NO: 1776177 - DNA, 17 bp, Homo sapiens
atgtgcctgcaccagga

SEQ ID NO: 1776178 - DNA, 13 bp, Homo sapiens
atgtgcctgtcac

SEQ ID NO: 1776179 - DNA, 12 bp, Homo sapiens
atgtgccttaag

SEQ ID NO: 1776180 - DNA, 20 bp, Homo sapiens
atgtgccttgattgattaga

SEQ ID NO: 1776181 - DNA, 21 bp, Homo sapiens
atgtgccttgattgattagat

SEQ ID NO: 1776182 - DNA, 21 bp, Homo sapiens
atgtttacactctttgtaaga

SEQ ID NO: 1776183 - DNA, 18 bp, Homo sapiens
atgtttacaggtttgaat

SEQ ID NO: 1776184 - DNA, 20 bp, Homo sapiens
atgtttacatatcacctcat

SEQ ID NO: 1776185 - DNA, 11 bp, Homo sapiens
atgtttactgt

SEQ ID NO: 1776186 - DNA, 13 bp, Homo sapiens
atgtttactgtaa

SEQ ID NO: 1776187 - DNA, 20 bp, Homo sapiens
atgtttagtgaatgactttt

SEQ ID NO: 1776188 - DNA, 15 bp, Homo sapiens
atgtttatgagccag

SEQ ID NO: 1776189 - DNA, 18 bp, Homo sapiens
atgtttatgcaaggaagg

SEQ ID NO: 1776190 - DNA, 20 bp, Homo sapiens
atgtttatgcaaggaaggaa

SEQ ID NO: 1776191 - DNA, 17 bp, Homo sapiens
atgtttattaaatgctt

SEQ ID NO: 1776192 - DNA, 20 bp, Homo sapiens
atgtttattaaatgcttcat

SEQ ID NO: 1776193 - DNA, 16 bp, Homo sapiens
atgtttattcttctag

SEQ ID NO: 1776194 - DNA, 19 bp, Homo sapiens
atgtttattcttctagagt

SEQ ID NO: 1776195 - DNA, 21 bp, Homo sapiens
atgtttattgttttttaaaga

SEQ ID NO: 1776196 - DNA, 13 bp, Homo sapiens
atgtttatttata

SEQ ID NO: 1776197 - DNA, 21 bp, Homo sapiens
atgtttatttatttccagtgg

SEQ ID NO: 1776198 - DNA, 23 bp, Homo sapiens
atgtttatttcataaagaattgt

SEQ ID NO: 1776199 - DNA, 14 bp, Homo sapiens
atgtttcaaacttt

SEQ ID NO: 1776200 - DNA, 19 bp, Homo sapiens
atgtttcacgaagtttgtt

SEQ ID NO: 1776201 - DNA, 16 bp, Homo sapiens
atgtttccagctgcca

SEQ ID NO: 1776202 - DNA, 22 bp, Homo sapiens
atgtttccgaggcactgtttta

SEQ ID NO: 1776203 - DNA, 13 bp, Homo sapiens
atgtttcctggaa

SEQ ID NO: 1776204 - DNA, 14 bp, Homo sapiens
atgtttcctggaag

SEQ ID NO: 1776205 - DNA, 15 bp, Homo sapiens
atgtttcctggaagc

SEQ ID NO: 1776206 - DNA, 12 bp, Homo sapiens
atgtttccttaa

SEQ ID NO: 1776207 - DNA, 13 bp, Homo sapiens
atgtttccttaaa

SEQ ID NO: 1776208 - DNA, 22 bp, Homo sapiens
atgtttcgctgatatatgtgtt

SEQ ID NO: 1776209 - DNA, 13 bp, Homo sapiens
atgtttctatctg

SEQ ID NO: 1776210 - DNA, 18 bp, Homo sapiens
atgtttctcacattgctg

SEQ ID NO: 1776211 - DNA, 18 bp, Homo sapiens
atgtttctggacattctc

SEQ ID NO: 1776212 - DNA, 21 bp, Homo sapiens
atgtttctggacattctcttt

SEQ ID NO: 1776213 - DNA, 20 bp, Homo sapiens
atgtttctgggtcctgaaga

SEQ ID NO: 1776214 - DNA, 21 bp, Homo sapiens
atgtttctgggtcctgaagaa

SEQ ID NO: 1776215 - DNA, 15 bp, Homo sapiens
atgtttcttctaggt

SEQ ID NO: 1776216 - DNA, 20 bp, Homo sapiens
atgtttcttttcccttaaat

SEQ ID NO: 1776217 - DNA, 19 bp, Homo sapiens
atgtttgaagagttccaag

SEQ ID NO: 1776218 - DNA, 23 bp, Homo sapiens
atgtttgctcttgtttttattaa

SEQ ID NO: 1776219 - DNA, 22 bp, Homo sapiens
atgtttggaaaaaactctgaag

SEQ ID NO: 1776220 - DNA, 20 bp, Homo sapiens
atgtttggaaaccacagtca

SEQ ID NO: 1776221 - DNA, 14 bp, Homo sapiens
atgtttggatggtt

SEQ ID NO: 1776222 - DNA, 13 bp, Homo sapiens
atgtttggctctg

SEQ ID NO: 1776223 - DNA, 12 bp, Homo sapiens
atgtttggggtc

SEQ ID NO: 1776224 - DNA, 21 bp, Homo sapiens
atgtttgtgatattaaatttc

SEQ ID NO: 1776225 - DNA, 13 bp, Homo sapiens
atgtttgtggcct

SEQ ID NO: 1776226 - DNA, 17 bp, Homo sapiens
atgtttgtggcctcaga

SEQ ID NO: 1776227 - DNA, 14 bp, Homo sapiens
atgtttgttaaaaa

SEQ ID NO: 1776228 - DNA, 20 bp, Homo sapiens
atgtttgttatttacactgg

SEQ ID NO: 1776229 - DNA, 17 bp, Homo sapiens
atgttttaaaaaaattt

SEQ ID NO: 1776230 - DNA, 13 bp, Homo sapiens
atgttttaaagaa

SEQ ID NO: 1776231 - DNA, 24 bp, Homo sapiens
atgttttagcatttgtataaagaa

SEQ ID NO: 1776232 - DNA, 16 bp, Homo sapiens
atgttttctttgtttc

SEQ ID NO: 1776233 - DNA, 17 bp, Homo sapiens
atgttttgtacaattac

SEQ ID NO: 1776234 - DNA, 23 bp, Homo sapiens
atgttttgtcccatttccttgga

SEQ ID NO: 1776235 - DNA, 20 bp, Homo sapiens
atgttttgtttctgaaaatt

SEQ ID NO: 1776236 - DNA, 23 bp, Homo sapiens
atgtttttaaaaagagtaatttc

SEQ ID NO: 1776237 - DNA, 12 bp, Homo sapiens
atgtttttatac

SEQ ID NO: 1776238 - DNA, 14 bp, Homo sapiens
atgttttttctgta

SEQ ID NO: 1776239 - DNA, 16 bp, Homo sapiens
atgttttttctgtaat

SEQ ID NO: 1776240 - DNA, 18 bp, Homo sapiens
atgttttttgccacagct

SEQ ID NO: 1776241 - DNA, 19 bp, Homo sapiens
atgttttttgccacagctt

SEQ ID NO: 1776242 - DNA, 17 bp, Homo sapiens
attaaaaaaaaattgta

SEQ ID NO: 1776243 - DNA, 12 bp, Homo sapiens
attaaaaaacaa

SEQ ID NO: 1776244 - DNA, 18 bp, Homo sapiens
attaaaaaagcatacttc

SEQ ID NO: 1776245 - DNA, 19 bp, Homo sapiens
attaaaaaagcatacttct

SEQ ID NO: 1776246 - DNA, 16 bp, Homo sapiens
attaaaaataaaatat

SEQ ID NO: 1776247 - DNA, 21 bp, Homo sapiens
attaaaacaaaagggtgtata

SEQ ID NO: 1776248 - DNA, 20 bp, Homo sapiens
attaaaacaatattgtttct

SEQ ID NO: 1776249 - DNA, 16 bp, Homo sapiens
attaaaacgggaatca

SEQ ID NO: 1776250 - DNA, 16 bp, Homo sapiens
attaaaactgcttttt

SEQ ID NO: 1776251 - DNA, 17 bp, Homo sapiens
attaaaagttgcatttg

SEQ ID NO: 1776252 - DNA, 22 bp, Homo sapiens
attaaaatatggctataaatat

SEQ ID NO: 1776253 - DNA, 11 bp, Homo sapiens
attaaaatctt

SEQ ID NO: 1776254 - DNA, 12 bp, Homo sapiens
attaaacacagg

SEQ ID NO: 1776255 - DNA, 19 bp, Homo sapiens
attaaacagatgtgaatat

SEQ ID NO: 1776256 - DNA, 18 bp, Homo sapiens
attaaacagatttttaca

SEQ ID NO: 1776257 - DNA, 17 bp, Homo sapiens
attaaaccggaccatct

SEQ ID NO: 1776258 - DNA, 18 bp, Homo sapiens
attaaacttttaattcat

SEQ ID NO: 1776259 - DNA, 19 bp, Homo sapiens
attaaacttttaattcatt

SEQ ID NO: 1776260 - DNA, 18 bp, Homo sapiens
attaaagatggtttatgc

SEQ ID NO: 1776261 - DNA, 19 bp, Homo sapiens
attaaaggcataaatgact

SEQ ID NO: 1776262 - DNA, 17 bp, Homo sapiens
attaaagtgctaaggtt

SEQ ID NO: 1776263 - DNA, 21 bp, Homo sapiens
attaaagtgctaaggttctaa

SEQ ID NO: 1776264 - DNA, 22 bp, Homo sapiens
attaaagtgctaaggttctaag

SEQ ID NO: 1776265 - DNA, 21 bp, Homo sapiens
attaaagttctgtaaaatata

SEQ ID NO: 1776266 - DNA, 16 bp, Homo sapiens
attaaagttgtttccc

SEQ ID NO: 1776267 - DNA, 13 bp, Homo sapiens
attaaataaattt

SEQ ID NO: 1776268 - DNA, 16 bp, Homo sapiens
attaaataagattcta

SEQ ID NO: 1776269 - DNA, 17 bp, Homo sapiens
attaaataagattctaa

SEQ ID NO: 1776270 - DNA, 16 bp, Homo sapiens
attaaataataaagta

SEQ ID NO: 1776271 - DNA, 12 bp, Homo sapiens
attaaatacaga

SEQ ID NO: 1776272 - DNA, 20 bp, Homo sapiens
attaaatatgttagcaaaga

SEQ ID NO: 1776273 - DNA, 22 bp, Homo sapiens
attaaatatgttagcaaagagt

SEQ ID NO: 1776274 - DNA, 15 bp, Homo sapiens
attaaatcttaaaca

SEQ ID NO: 1776275 - DNA, 18 bp, Homo sapiens
attaaatcttaaacaatg

SEQ ID NO: 1776276 - DNA, 13 bp, Homo sapiens
attaaatgttgct

SEQ ID NO: 1776277 - DNA, 18 bp, Homo sapiens
attaaattaattgaatct

SEQ ID NO: 1776278 - DNA, 13 bp, Homo sapiens
attaaattaggaa

SEQ ID NO: 1776279 - DNA, 20 bp, Homo sapiens
attaaatttcaaatgcagaa

SEQ ID NO: 1776280 - DNA, 15 bp, Homo sapiens
attaaattttaatgt

SEQ ID NO: 1776281 - DNA, 16 bp, Homo sapiens
attaaattttaatgta

SEQ ID NO: 1776282 - DNA, 19 bp, Homo sapiens
attaaattttaatgtaaaa

SEQ ID NO: 1776283 - DNA, 18 bp, Homo sapiens
attaaattttgagttcta

SEQ ID NO: 1776284 - DNA, 14 bp, Homo sapiens
attaacaaattatg

SEQ ID NO: 1776285 - DNA, 12 bp, Homo sapiens
attaacaatgta

SEQ ID NO: 1776286 - DNA, 19 bp, Homo sapiens
attaacactactcaaagca

SEQ ID NO: 1776287 - DNA, 17 bp, Homo sapiens
attaacatcgtgggtca

SEQ ID NO: 1776288 - DNA, 12 bp, Homo sapiens
attaacatgttt

SEQ ID NO: 1776289 - DNA, 13 bp, Homo sapiens
attaacctctgca

SEQ ID NO: 1776290 - DNA, 14 bp, Homo sapiens
attaacggtgctaa

SEQ ID NO: 1776291 - DNA, 15 bp, Homo sapiens
attaacggtgctaaa

SEQ ID NO: 1776292 - DNA, 13 bp, Homo sapiens
attaactccctcc

SEQ ID NO: 1776293 - DNA, 15 bp, Homo sapiens
attaacttagcatgt

SEQ ID NO: 1776294 - DNA, 12 bp, Homo sapiens
attaagaaagga

SEQ ID NO: 1776295 - DNA, 12 bp, Homo sapiens
attaagaatctc

SEQ ID NO: 1776296 - DNA, 13 bp, Homo sapiens
attaagacagtgt

SEQ ID NO: 1776297 - DNA, 17 bp, Homo sapiens
attaagaggcagaaaat

SEQ ID NO: 1776298 - DNA, 18 bp, Homo sapiens
attaagatctgtgtttta

SEQ ID NO: 1776299 - DNA, 14 bp, Homo sapiens
attaatggcactga

SEQ ID NO: 1776300 - DNA, 22 bp, Homo sapiens
attaatggtttttgttagttca

SEQ ID NO: 1776301 - DNA, 16 bp, Homo sapiens
attaatgtacttgttt

SEQ ID NO: 1776302 - DNA, 23 bp, Homo sapiens
attaatgtacttgtttctctgtt

SEQ ID NO: 1776303 - DNA, 12 bp, Homo sapiens
attaatgttaat

SEQ ID NO: 1776304 - DNA, 13 bp, Homo sapiens
attaatgttaatt

SEQ ID NO: 1776305 - DNA, 16 bp, Homo sapiens
attaatgtttctatct

SEQ ID NO: 1776306 - DNA, 18 bp, Homo sapiens
attaatgtttctatctga

SEQ ID NO: 1776307 - DNA, 17 bp, Homo sapiens
attaatgtttcttaaat

SEQ ID NO: 1776308 - DNA, 15 bp, Homo sapiens
attaatgttttgtac

SEQ ID NO: 1776309 - DNA, 15 bp, Homo sapiens
attaattaatttgga

SEQ ID NO: 1776310 - DNA, 16 bp, Homo sapiens
attaattaatttggag

SEQ ID NO: 1776311 - DNA, 14 bp, Homo sapiens
attaattacataca

SEQ ID NO: 1776312 - DNA, 14 bp, Homo sapiens
attaattactaatt

SEQ ID NO: 1776313 - DNA, 15 bp, Homo sapiens
attaattactaattt

SEQ ID NO: 1776314 - DNA, 19 bp, Homo sapiens
attaattcaccttccagtg

SEQ ID NO: 1776315 - DNA, 13 bp, Homo sapiens
attaattgtaatc

SEQ ID NO: 1776316 - DNA, 20 bp, Homo sapiens
attaattgttttgcactttt

SEQ ID NO: 1776317 - DNA, 21 bp, Homo sapiens
attaatttggagcacaaaatt

SEQ ID NO: 1776318 - DNA, 16 bp, Homo sapiens
attaattttctatgtg

SEQ ID NO: 1776319 - DNA, 15 bp, Homo sapiens
attaattttgtgcat

SEQ ID NO: 1776320 - DNA, 17 bp, Homo sapiens
attaattttgtgcattc

SEQ ID NO: 1776321 - DNA, 14 bp, Homo sapiens
attacaaatcagaa

SEQ ID NO: 1776322 - DNA, 18 bp, Homo sapiens
attacaaatcagaagtca

SEQ ID NO: 1776323 - DNA, 23 bp, Homo sapiens
attacaaatcagaagtcatcttg

SEQ ID NO: 1776324 - DNA, 22 bp, Homo sapiens
attacaaattgcttactttgga

SEQ ID NO: 1776325 - DNA, 23 bp, Homo sapiens
attacaacagtagagagggaaca

SEQ ID NO: 1776326 - DNA, 14 bp, Homo sapiens
attacaacatttat

SEQ ID NO: 1776327 - DNA, 16 bp, Homo sapiens
attacaacatttatgt

SEQ ID NO: 1776328 - DNA, 15 bp, Homo sapiens
attacaacggagtca

SEQ ID NO: 1776329 - DNA, 17 bp, Homo sapiens
attacaacggagtcaaa

SEQ ID NO: 1776330 - DNA, 20 bp, Homo sapiens
attacaagcctggaaaaaaa

SEQ ID NO: 1776331 - DNA, 17 bp, Homo sapiens
attacaagtaatgtaaa

SEQ ID NO: 1776332 - DNA, 21 bp, Homo sapiens
attacaatgtatctttattaa

SEQ ID NO: 1776333 - DNA, 14 bp, Homo sapiens
attacaattttatc

SEQ ID NO: 1776334 - DNA, 18 bp, Homo sapiens
attacaattttatctgtt

SEQ ID NO: 1776335 - DNA, 15 bp, Homo sapiens
attacaattttctgt

SEQ ID NO: 1776336 - DNA, 19 bp, Homo sapiens
attacaattttctgtaaga

SEQ ID NO: 1776337 - DNA, 18 bp, Homo sapiens
attacaatttttaataaa

SEQ ID NO: 1776338 - DNA, 22 bp, Homo sapiens
attacaatttttaataaattga

SEQ ID NO: 1776339 - DNA, 13 bp, Homo sapiens
attacacaaagaa

SEQ ID NO: 1776340 - DNA, 18 bp, Homo sapiens
attacactaaattattag

SEQ ID NO: 1776341 - DNA, 17 bp, Homo sapiens
attacagaaccaaatcg

SEQ ID NO: 1776342 - DNA, 21 bp, Homo sapiens
attacagaggtattaaaacta

SEQ ID NO: 1776343 - DNA, 15 bp, Homo sapiens
attacagatttagtt

SEQ ID NO: 1776344 - DNA, 13 bp, Homo sapiens
attacagcttcac

SEQ ID NO: 1776345 - DNA, 15 bp, Homo sapiens
attacagtgcctaaa

SEQ ID NO: 1776346 - DNA, 19 bp, Homo sapiens
attacagtgcctaaaataa

SEQ ID NO: 1776347 - DNA, 19 bp, Homo sapiens
attacagttctttcctctt

SEQ ID NO: 1776348 - DNA, 14 bp, Homo sapiens
attacatacagatt

SEQ ID NO: 1776349 - DNA, 18 bp, Homo sapiens
attacatctttcacattg

SEQ ID NO: 1776350 - DNA, 19 bp, Homo sapiens
attacatgtaaaacattat

SEQ ID NO: 1776351 - DNA, 22 bp, Homo sapiens
attacattcctaactagaatta

SEQ ID NO: 1776352 - DNA, 17 bp, Homo sapiens
attacattggcacaatg

SEQ ID NO: 1776353 - DNA, 18 bp, Homo sapiens
attacatttatttatcca

SEQ ID NO: 1776354 - DNA, 15 bp, Homo sapiens
attacatttgtaatt

SEQ ID NO: 1776355 - DNA, 18 bp, Homo sapiens
attacatttgtaatttaa

SEQ ID NO: 1776356 - DNA, 23 bp, Homo sapiens
attacattttattaagctttttg

SEQ ID NO: 1776357 - DNA, 21 bp, Homo sapiens
attaccagggactatctttgc

SEQ ID NO: 1776358 - DNA, 13 bp, Homo sapiens
attaccatggaga

SEQ ID NO: 1776359 - DNA, 14 bp, Homo sapiens
attacccataaaca

SEQ ID NO: 1776360 - DNA, 19 bp, Homo sapiens
attaccccctccttcagac

SEQ ID NO: 1776361 - DNA, 13 bp, Homo sapiens
attacctaatttt

SEQ ID NO: 1776362 - DNA, 14 bp, Homo sapiens
attacctccatcca

SEQ ID NO: 1776363 - DNA, 13 bp, Homo sapiens
attacctctgata

SEQ ID NO: 1776364 - DNA, 14 bp, Homo sapiens
attcacccagacag

SEQ ID NO: 1776365 - DNA, 19 bp, Homo sapiens
attcacccagacagctccc

SEQ ID NO: 1776366 - DNA, 22 bp, Homo sapiens
attcaccccctttcctggacac

SEQ ID NO: 1776367 - DNA, 15 bp, Homo sapiens
attcacccctgcccc

SEQ ID NO: 1776368 - DNA, 16 bp, Homo sapiens
attcacccctgccccg

SEQ ID NO: 1776369 - DNA, 18 bp, Homo sapiens
attcacctcagtagaaaa

SEQ ID NO: 1776370 - DNA, 14 bp, Homo sapiens
attcacctcttcct

SEQ ID NO: 1776371 - DNA, 17 bp, Homo sapiens
attcacctcttcctctg

SEQ ID NO: 1776372 - DNA, 14 bp, Homo sapiens
attcacctttttaa

SEQ ID NO: 1776373 - DNA, 15 bp, Homo sapiens
attcacctttttaat

SEQ ID NO: 1776374 - DNA, 23 bp, Homo sapiens
attcacctttttaataaaaatac

SEQ ID NO: 1776375 - DNA, 21 bp, Homo sapiens
attcacgccattggttggaag

SEQ ID NO: 1776376 - DNA, 15 bp, Homo sapiens
attcacgccgtaatt

SEQ ID NO: 1776377 - DNA, 19 bp, Homo sapiens
attcacgccgtaattcttt

SEQ ID NO: 1776378 - DNA, 22 bp, Homo sapiens
attcacgccgtaattctttctg

SEQ ID NO: 1776379 - DNA, 22 bp, Homo sapiens
attcactcactcactcattcct

SEQ ID NO: 1776380 - DNA, 11 bp, Homo sapiens
attcactctcc

SEQ ID NO: 1776381 - DNA, 15 bp, Homo sapiens
attcactgccttcct

SEQ ID NO: 1776382 - DNA, 14 bp, Homo sapiens
attcactgtaagtt

SEQ ID NO: 1776383 - DNA, 19 bp, Homo sapiens
attcacttaagtttttcca

SEQ ID NO: 1776384 - DNA, 13 bp, Homo sapiens
attcagaaatgtt

SEQ ID NO: 1776385 - DNA, 13 bp, Homo sapiens
attcagacaacat

SEQ ID NO: 1776386 - DNA, 11 bp, Homo sapiens
attcagacatc

SEQ ID NO: 1776387 - DNA, 20 bp, Homo sapiens
attcccaacgtgcaaagcca

SEQ ID NO: 1776388 - DNA, 19 bp, Homo sapiens
attcccaagccgaccttcc

SEQ ID NO: 1776389 - DNA, 18 bp, Homo sapiens
attcccaagtatgcctta

SEQ ID NO: 1776390 - DNA, 21 bp, Homo sapiens
attcccactcaccagccctag

SEQ ID NO: 1776391 - DNA, 19 bp, Homo sapiens
attcccagagacaggaaaa

SEQ ID NO: 1776392 - DNA, 23 bp, Homo sapiens
attcccagagacaggaaaatcct

SEQ ID NO: 1776393 - DNA, 12 bp, Homo sapiens
attcccagccca

SEQ ID NO: 1776394 - DNA, 18 bp, Homo sapiens
attcccattttgcaaaat

SEQ ID NO: 1776395 - DNA, 22 bp, Homo sapiens
attccccaggtggctgacccag

SEQ ID NO: 1776396 - DNA, 15 bp, Homo sapiens
attcccctctgctgc

SEQ ID NO: 1776397 - DNA, 23 bp, Homo sapiens
attcccgttttgtcactttttct

SEQ ID NO: 1776398 - DNA, 21 bp, Homo sapiens
attccctatcttttagtttta

SEQ ID NO: 1776399 - DNA, 22 bp, Homo sapiens
attccctatcttttagttttag

SEQ ID NO: 1776400 - DNA, 19 bp, Homo sapiens
attccctgagtcaccagga

SEQ ID NO: 1776401 - DNA, 17 bp, Homo sapiens
attccctgccttgctga

SEQ ID NO: 1776402 - DNA, 12 bp, Homo sapiens
attcccttctgg

SEQ ID NO: 1776403 - DNA, 22 bp, Homo sapiens
attctttccattatgattcttt

SEQ ID NO: 1776404 - DNA, 14 bp, Homo sapiens
attctttccccaga

SEQ ID NO: 1776405 - DNA, 19 bp, Homo sapiens
attctttctcataaaactg

SEQ ID NO: 1776406 - DNA, 16 bp, Homo sapiens
attctttctgtctccc

SEQ ID NO: 1776407 - DNA, 20 bp, Homo sapiens
attctttctgtctcccttct

SEQ ID NO: 1776408 - DNA, 23 bp, Homo sapiens
attctttctgtctcccttctctc

SEQ ID NO: 1776409 - DNA, 11 bp, Homo sapiens
attctttgcta

SEQ ID NO: 1776410 - DNA, 17 bp, Homo sapiens
attctttggttgtgaat

SEQ ID NO: 1776411 - DNA, 13 bp, Homo sapiens
attctttgtacca

SEQ ID NO: 1776412 - DNA, 20 bp, Homo sapiens
attcttttcagcttgtttct

SEQ ID NO: 1776413 - DNA, 19 bp, Homo sapiens
attcttttccaagctcctt

SEQ ID NO: 1776414 - DNA, 19 bp, Homo sapiens
attcttttctcagtgttgg

SEQ ID NO: 1776415 - DNA, 13 bp, Homo sapiens
attctttttgctc

SEQ ID NO: 1776416 - DNA, 14 bp, Homo sapiens
attctttttgctct

SEQ ID NO: 1776417 - DNA, 19 bp, Homo sapiens
attctttttgctctaaaat

SEQ ID NO: 1776418 - DNA, 13 bp, Homo sapiens
attgaaaaacaat

SEQ ID NO: 1776419 - DNA, 15 bp, Homo sapiens
attgaaaaacaattt

SEQ ID NO: 1776420 - DNA, 18 bp, Homo sapiens
attgaaaacacttagtat

SEQ ID NO: 1776421 - DNA, 14 bp, Homo sapiens
attgaaaacagata

SEQ ID NO: 1776422 - DNA, 22 bp, Homo sapiens
attgaaaacagtgtcttgagct

SEQ ID NO: 1776423 - DNA, 15 bp, Homo sapiens
attgaaaagaagaaa

SEQ ID NO: 1776424 - DNA, 18 bp, Homo sapiens
attgaaaagaagaaagtc

SEQ ID NO: 1776425 - DNA, 21 bp, Homo sapiens
attgaaaagttatttcccttt

SEQ ID NO: 1776426 - DNA, 16 bp, Homo sapiens
attgaaaagtttttgt

SEQ ID NO: 1776427 - DNA, 14 bp, Homo sapiens
attgaaaatgaatg

SEQ ID NO: 1776428 - DNA, 13 bp, Homo sapiens
attgaaaatgcat

SEQ ID NO: 1776429 - DNA, 19 bp, Homo sapiens
attgaaaatgcattaggga

SEQ ID NO: 1776430 - DNA, 18 bp, Homo sapiens
attgaaaattgaaaagta

SEQ ID NO: 1776431 - DNA, 15 bp, Homo sapiens
attgaaagagaacca

SEQ ID NO: 1776432 - DNA, 18 bp, Homo sapiens
attgaaaggcattctctg

SEQ ID NO: 1776433 - DNA, 20 bp, Homo sapiens
attgaaaggggacacctgta

SEQ ID NO: 1776434 - DNA, 22 bp, Homo sapiens
attgaaataaataaaaatgcat

SEQ ID NO: 1776435 - DNA, 11 bp, Homo sapiens
attgaaatatc

SEQ ID NO: 1776436 - DNA, 16 bp, Homo sapiens
attgaaattaactttt

SEQ ID NO: 1776437 - DNA, 23 bp, Homo sapiens
attgaacaaaaatgtttccactg

SEQ ID NO: 1776438 - DNA, 22 bp, Homo sapiens
attgaaccatttgggatggaga

SEQ ID NO: 1776439 - DNA, 14 bp, Homo sapiens
attgaacttttgta

SEQ ID NO: 1776440 - DNA, 14 bp, Homo sapiens
attgaagatgctgc

SEQ ID NO: 1776441 - DNA, 22 bp, Homo sapiens
attgaagatgctgcctgtattt

SEQ ID NO: 1776442 - DNA, 21 bp, Homo sapiens
attgaaggttgtatgtaaatc

SEQ ID NO: 1776443 - DNA, 22 bp, Homo sapiens
attgaaggttgtatgtaaatct

SEQ ID NO: 1776444 - DNA, 16 bp, Homo sapiens
attgaagtaaactttt

SEQ ID NO: 1776445 - DNA, 22 bp, Homo sapiens
attgaagtgtataatataaaaa

SEQ ID NO: 1776446 - DNA, 16 bp, Homo sapiens
attgaagtttcaagtt

SEQ ID NO: 1776447 - DNA, 20 bp, Homo sapiens
attgaagtttcaagttttaa

SEQ ID NO: 1776448 - DNA, 20 bp, Homo sapiens
attgaatttttatttttgaa

SEQ ID NO: 1776449 - DNA, 18 bp, Homo sapiens
attgacaataatttcagg

SEQ ID NO: 1776450 - DNA, 14 bp, Homo sapiens
attgacactgaact

SEQ ID NO: 1776451 - DNA, 18 bp, Homo sapiens
attgacactgaacttaat

SEQ ID NO: 1776452 - DNA, 21 bp, Homo sapiens
attgacattgctttactgtca

SEQ ID NO: 1776453 - DNA, 13 bp, Homo sapiens
attgacatttgta

SEQ ID NO: 1776454 - DNA, 22 bp, Homo sapiens
attgacctatttccagaaatac

SEQ ID NO: 1776455 - DNA, 15 bp, Homo sapiens
attgacctcagctgc

SEQ ID NO: 1776456 - DNA, 21 bp, Homo sapiens
attgacctcagctgcacattc

SEQ ID NO: 1776457 - DNA, 16 bp, Homo sapiens
attgacgaactggcta

SEQ ID NO: 1776458 - DNA, 22 bp, Homo sapiens
attgacgaactggctacagtac

SEQ ID NO: 1776459 - DNA, 19 bp, Homo sapiens
attgactaactcaaataca

SEQ ID NO: 1776460 - DNA, 18 bp, Homo sapiens
attgactatcaaactgaa

SEQ ID NO: 1776461 - DNA, 21 bp, Homo sapiens
attgactatcaaactgaagcc

SEQ ID NO: 1776462 - DNA, 17 bp, Homo sapiens
attgactcaaaccatat

SEQ ID NO: 1776463 - DNA, 19 bp, Homo sapiens
attgactgaagcacagcac

SEQ ID NO: 1776464 - DNA, 20 bp, Homo sapiens
attgactgatgattttcctt

SEQ ID NO: 1776465 - DNA, 14 bp, Homo sapiens
attgacttcaatga

SEQ ID NO: 1776466 - DNA, 16 bp, Homo sapiens
attgagaaagaaacta

SEQ ID NO: 1776467 - DNA, 22 bp, Homo sapiens
attgagaactgcatatgtttcg

SEQ ID NO: 1776468 - DNA, 11 bp, Homo sapiens
attgagaagcc

SEQ ID NO: 1776469 - DNA, 13 bp, Homo sapiens
attgagaatttta

SEQ ID NO: 1776470 - DNA, 17 bp, Homo sapiens
attgagaattttaaatt

SEQ ID NO: 1776471 - DNA, 20 bp, Homo sapiens
attgagataatatctgtgag

SEQ ID NO: 1776472 - DNA, 20 bp, Homo sapiens
attgagatactatcattaac

SEQ ID NO: 1776473 - DNA, 22 bp, Homo sapiens
attgagatcagcattcaaaata

SEQ ID NO: 1776474 - DNA, 14 bp, Homo sapiens
attgagcatttgaa

SEQ ID NO: 1776475 - DNA, 20 bp, Homo sapiens
attgagctctctgcccttga

SEQ ID NO: 1776476 - DNA, 17 bp, Homo sapiens
attgagctgcagaaacg

SEQ ID NO: 1776477 - DNA, 19 bp, Homo sapiens
attgagctgcagaaacgaa

SEQ ID NO: 1776478 - DNA, 14 bp, Homo sapiens
attgaggagctgca

SEQ ID NO: 1776479 - DNA, 21 bp, Homo sapiens
attgaggctgcagcaggtgct

SEQ ID NO: 1776480 - DNA, 18 bp, Homo sapiens
attgagggcattagtact

SEQ ID NO: 1776481 - DNA, 17 bp, Homo sapiens
attgaggtttggaagag

SEQ ID NO: 1776482 - DNA, 18 bp, Homo sapiens
attgaggtttggaagagt

SEQ ID NO: 1776483 - DNA, 19 bp, Homo sapiens
attgagtaatggtgtagaa

SEQ ID NO: 1776484 - DNA, 16 bp, Homo sapiens
attgagtattgtttaa

SEQ ID NO: 1776485 - DNA, 20 bp, Homo sapiens
attgagtattgtttaaaatg

SEQ ID NO: 1776486 - DNA, 17 bp, Homo sapiens
attgagttccagttgaa

SEQ ID NO: 1776487 - DNA, 15 bp, Homo sapiens
attgataaaagagtt

SEQ ID NO: 1776488 - DNA, 12 bp, Homo sapiens
attgataagttc

SEQ ID NO: 1776489 - DNA, 18 bp, Homo sapiens
attgtggtgtgagcttca

SEQ ID NO: 1776490 - DNA, 20 bp, Homo sapiens
attgtgtaaaaaatggaaaa

SEQ ID NO: 1776491 - DNA, 17 bp, Homo sapiens
attgtgtaatttaagtg

SEQ ID NO: 1776492 - DNA, 15 bp, Homo sapiens
attgtgtacatagag

SEQ ID NO: 1776493 - DNA, 20 bp, Homo sapiens
attgtgtaccttaagatatt

SEQ ID NO: 1776494 - DNA, 14 bp, Homo sapiens
attgtgtagccttt

SEQ ID NO: 1776495 - DNA, 15 bp, Homo sapiens
attgtgtatatgttg

SEQ ID NO: 1776496 - DNA, 19 bp, Homo sapiens
attgtgtattgatgcaata

SEQ ID NO: 1776497 - DNA, 20 bp, Homo sapiens
attgtgtcagaaacatgaaa

SEQ ID NO: 1776498 - DNA, 20 bp, Homo sapiens
attgtgtgcgctgcctggcc

SEQ ID NO: 1776499 - DNA, 14 bp, Homo sapiens
attgtgtgtctggt

SEQ ID NO: 1776500 - DNA, 15 bp, Homo sapiens
attgtgtgtctggta

SEQ ID NO: 1776501 - DNA, 13 bp, Homo sapiens
attgtgtgtgcaa

SEQ ID NO: 1776502 - DNA, 22 bp, Homo sapiens
attgtgtttctaccggagagag

SEQ ID NO: 1776503 - DNA, 15 bp, Homo sapiens
attgttaaaataact

SEQ ID NO: 1776504 - DNA, 15 bp, Homo sapiens
attgttaaacaaatg

SEQ ID NO: 1776505 - DNA, 16 bp, Homo sapiens
attgttaaacaaatga

SEQ ID NO: 1776506 - DNA, 13 bp, Homo sapiens
attgttaaatcct

SEQ ID NO: 1776507 - DNA, 20 bp, Homo sapiens
attgttagaaaatgacttat

SEQ ID NO: 1776508 - DNA, 22 bp, Homo sapiens
attgttagcaaatgacagattt

SEQ ID NO: 1776509 - DNA, 17 bp, Homo sapiens
attgttagggtcagcca

SEQ ID NO: 1776510 - DNA, 13 bp, Homo sapiens
attgttatttata

SEQ ID NO: 1776511 - DNA, 15 bp, Homo sapiens
attgttcaattccca

SEQ ID NO: 1776512 - DNA, 19 bp, Homo sapiens
attgttgacaactgtgact

SEQ ID NO: 1776513 - DNA, 18 bp, Homo sapiens
attgttgacagttctgaa

SEQ ID NO: 1776514 - DNA, 18 bp, Homo sapiens
attgttgataggaactgt

SEQ ID NO: 1776515 - DNA, 14 bp, Homo sapiens
attgttgggaaagg

SEQ ID NO: 1776516 - DNA, 13 bp, Homo sapiens
attgttgtgtctg

SEQ ID NO: 1776517 - DNA, 17 bp, Homo sapiens
attgttgtttttttaat

SEQ ID NO: 1776518 - DNA, 15 bp, Homo sapiens
attgtttaaaatgta

SEQ ID NO: 1776519 - DNA, 21 bp, Homo sapiens
attgtttaagtgttgtaaata

SEQ ID NO: 1776520 - DNA, 13 bp, Homo sapiens
attgtttagattt

SEQ ID NO: 1776521 - DNA, 16 bp, Homo sapiens
attgtttagattttgt

SEQ ID NO: 1776522 - DNA, 21 bp, Homo sapiens
attgtttatgtgttatgaaca

SEQ ID NO: 1776523 - DNA, 18 bp, Homo sapiens
attgtttatttatcagtg

SEQ ID NO: 1776524 - DNA, 21 bp, Homo sapiens
attgtttatttatcagtgaca

SEQ ID NO: 1776525 - DNA, 16 bp, Homo sapiens
attgtttccaacttgt

SEQ ID NO: 1776526 - DNA, 16 bp, Homo sapiens
attgtttctagaacag

SEQ ID NO: 1776527 - DNA, 19 bp, Homo sapiens
attgtttcttcttcatgct

SEQ ID NO: 1776528 - DNA, 14 bp, Homo sapiens
attgtttcttgaca

SEQ ID NO: 1776529 - DNA, 18 bp, Homo sapiens
attgtttggcttcctcct

SEQ ID NO: 1776530 - DNA, 18 bp, Homo sapiens
attgtttggtaaatgttt

SEQ ID NO: 1776531 - DNA, 19 bp, Homo sapiens
attgtttggtaaatgtttc

SEQ ID NO: 1776532 - DNA, 20 bp, Homo sapiens
attgtttgtctgtcttcata

SEQ ID NO: 1776533 - DNA, 23 bp, Homo sapiens
attgtttgtttgtaagtttgaat

SEQ ID NO: 1776534 - DNA, 23 bp, Homo sapiens
attgttttaaaaagaaacaagat

SEQ ID NO: 1776535 - DNA, 19 bp, Homo sapiens
attgttttcccaagtgtaa

SEQ ID NO: 1776536 - DNA, 20 bp, Homo sapiens
attgttttctgtaaataacc

SEQ ID NO: 1776537 - DNA, 13 bp, Homo sapiens
attgttttggaat

SEQ ID NO: 1776538 - DNA, 16 bp, Homo sapiens
attgttttggaataaa

SEQ ID NO: 1776539 - DNA, 20 bp, Homo sapiens
attgtttttaagaaaaacat

SEQ ID NO: 1776540 - DNA, 19 bp, Homo sapiens
attgtttttgaatttaaat

SEQ ID NO: 1776541 - DNA, 22 bp, Homo sapiens
attgtttttgaatttaaataaa

SEQ ID NO: 1776542 - DNA, 16 bp, Homo sapiens
attgttttttaaagca

SEQ ID NO: 1776543 - DNA, 22 bp, Homo sapiens
attgtttttttatttggcataa

SEQ ID NO: 1776544 - DNA, 15 bp, Homo sapiens
atttaaaaaagaaaa

SEQ ID NO: 1776545 - DNA, 18 bp, Homo sapiens
atttaaaaaagaaaaaag

SEQ ID NO: 1776546 - DNA, 23 bp, Homo sapiens
atttaaaaaagaaaaaagtccag

SEQ ID NO: 1776547 - DNA, 16 bp, Homo sapiens
atttaaaaactggaac

SEQ ID NO: 1776548 - DNA, 19 bp, Homo sapiens
atttcacctgtaaacctga

SEQ ID NO: 1776549 - DNA, 23 bp, Homo sapiens
atttcacctgtgacaaaggatga

SEQ ID NO: 1776550 - DNA, 17 bp, Homo sapiens
atttcactaaatgtaaa

SEQ ID NO: 1776551 - DNA, 20 bp, Homo sapiens
atttcactaggactcagaaa

SEQ ID NO: 1776552 - DNA, 18 bp, Homo sapiens
atttcactttagatgctg

SEQ ID NO: 1776553 - DNA, 19 bp, Homo sapiens
atttcactttagatgctga

SEQ ID NO: 1776554 - DNA, 13 bp, Homo sapiens
atttcagaaatac

SEQ ID NO: 1776555 - DNA, 21 bp, Homo sapiens
atttcagaagttagtttgtat

SEQ ID NO: 1776556 - DNA, 19 bp, Homo sapiens
atttcagaagtttaaatat

SEQ ID NO: 1776557 - DNA, 12 bp, Homo sapiens
atttcagactcc

SEQ ID NO: 1776558 - DNA, 20 bp, Homo sapiens
atttcagactgcagagggga

SEQ ID NO: 1776559 - DNA, 19 bp, Homo sapiens
atttcagatatcaaaattc

SEQ ID NO: 1776560 - DNA, 18 bp, Homo sapiens
atttcagattcccagagc

SEQ ID NO: 1776561 - DNA, 12 bp, Homo sapiens
atttcaggaaaa

SEQ ID NO: 1776562 - DNA, 20 bp, Homo sapiens
atttcaggaaaatgtattga

SEQ ID NO: 1776563 - DNA, 13 bp, Homo sapiens
atttcaggaattt

SEQ ID NO: 1776564 - DNA, 18 bp, Homo sapiens
atttcagtaagtctcata

SEQ ID NO: 1776565 - DNA, 15 bp, Homo sapiens
atttcagtggaatag

SEQ ID NO: 1776566 - DNA, 19 bp, Homo sapiens
atttcagtgtaaagtgtgt

SEQ ID NO: 1776567 - DNA, 14 bp, Homo sapiens
atttcagttcatca

SEQ ID NO: 1776568 - DNA, 14 bp, Homo sapiens
atttcagtttttca

SEQ ID NO: 1776569 - DNA, 18 bp, Homo sapiens
atttcataaacaacttaa

SEQ ID NO: 1776570 - DNA, 19 bp, Homo sapiens
atttcatagatattttata

SEQ ID NO: 1776571 - DNA, 16 bp, Homo sapiens
atttcatatgctgtat

SEQ ID NO: 1776572 - DNA, 20 bp, Homo sapiens
atttcatctatttctgagaa

SEQ ID NO: 1776573 - DNA, 14 bp, Homo sapiens
atttcatctgctct

SEQ ID NO: 1776574 - DNA, 17 bp, Homo sapiens
atttcatctgctctcct

SEQ ID NO: 1776575 - DNA, 15 bp, Homo sapiens
atttcatcttctgga

SEQ ID NO: 1776576 - DNA, 15 bp, Homo sapiens
atttcatgattagaa

SEQ ID NO: 1776577 - DNA, 16 bp, Homo sapiens
atttcatgtttttgat

SEQ ID NO: 1776578 - DNA, 16 bp, Homo sapiens
atttcattcaaatcag

SEQ ID NO: 1776579 - DNA, 12 bp, Homo sapiens
atttcatttctt

SEQ ID NO: 1776580 - DNA, 21 bp, Homo sapiens
atttccaaacctggttcatat

SEQ ID NO: 1776581 - DNA, 21 bp, Homo sapiens
atttccaacaccacagacaca

SEQ ID NO: 1776582 - DNA, 13 bp, Homo sapiens
atttccaacagca

SEQ ID NO: 1776583 - DNA, 18 bp, Homo sapiens
atttccactattttcaaa

SEQ ID NO: 1776584 - DNA, 16 bp, Homo sapiens
atttccactgaacaaa

SEQ ID NO: 1776585 - DNA, 17 bp, Homo sapiens
atttccactgaacaaaa

SEQ ID NO: 1776586 - DNA, 15 bp, Homo sapiens
atttccaggaaaaaa

SEQ ID NO: 1776587 - DNA, 21 bp, Homo sapiens
atttccaggaaaaaataaaaa

SEQ ID NO: 1776588 - DNA, 22 bp, Homo sapiens
atttccaggaaaaaataaaaag

SEQ ID NO: 1776589 - DNA, 23 bp, Homo sapiens
atttccaggaaaaaataaaaaga

SEQ ID NO: 1776590 - DNA, 12 bp, Homo sapiens
atttccaggccc

SEQ ID NO: 1776591 - DNA, 15 bp, Homo sapiens
atttccaggcccctg

SEQ ID NO: 1776592 - DNA, 19 bp, Homo sapiens
atttccaggcccctgagga

SEQ ID NO: 1776593 - DNA, 17 bp, Homo sapiens
atttccatgggccccac

SEQ ID NO: 1776594 - DNA, 18 bp, Homo sapiens
atttccatgggccccacc

SEQ ID NO: 1776595 - DNA, 17 bp, Homo sapiens
atttccatttcttcctc

SEQ ID NO: 1776596 - DNA, 12 bp, Homo sapiens
atttccatttgt

SEQ ID NO: 1776597 - DNA, 14 bp, Homo sapiens
atttcccacatctt

SEQ ID NO: 1776598 - DNA, 20 bp, Homo sapiens
atttcccagcacatgaaacc

SEQ ID NO: 1776599 - DNA, 13 bp, Homo sapiens
atttcccaggacc

SEQ ID NO: 1776600 - DNA, 11 bp, Homo sapiens
atttccccagc

SEQ ID NO: 1776601 - DNA, 20 bp, Homo sapiens
atttccccaggggaaaatga

SEQ ID NO: 1776602 - DNA, 14 bp, Homo sapiens
atttccccctcctc

SEQ ID NO: 1776603 - DNA, 17 bp, Homo sapiens
atttccccctcctcaga

SEQ ID NO: 1776604 - DNA, 19 bp, Homo sapiens
atttccccgatgtcccctg

SEQ ID NO: 1776605 - DNA, 22 bp, Homo sapiens
atttccccgatgtcccctgcgg

SEQ ID NO: 1776606 - DNA, 16 bp, Homo sapiens
atttcccttccaaaga

SEQ ID NO: 1776607 - DNA, 21 bp, Homo sapiens
atttccctttagctgtgttat

SEQ ID NO: 1776608 - DNA, 14 bp, Homo sapiens
atttcctaaacata

SEQ ID NO: 1776609 - DNA, 20 bp, Homo sapiens
atttcctaaacataattgtg

SEQ ID NO: 1776610 - DNA, 17 bp, Homo sapiens
atttcctaatactgtca

SEQ ID NO: 1776611 - DNA, 15 bp, Homo sapiens
atttcctacagaaat

SEQ ID NO: 1776612 - DNA, 24 bp, Homo sapiens
atttcctcaacgttgctccccatc

SEQ ID NO: 1776613 - DNA, 19 bp, Homo sapiens
atttcctcagcttatctct

SEQ ID NO: 1776614 - DNA, 20 bp, Homo sapiens
atttcctcctcccagtgcct

SEQ ID NO: 1776615 - DNA, 23 bp, Homo sapiens
atttcctcctcccagtgccttct

SEQ ID NO: 1776616 - DNA, 11 bp, Homo sapiens
atttcctcctt

SEQ ID NO: 1776617 - DNA, 15 bp, Homo sapiens
atttcctgacttgag

SEQ ID NO: 1776618 - DNA, 16 bp, Homo sapiens
atttcctgttggattt

SEQ ID NO: 1776619 - DNA, 22 bp, Homo sapiens
atttcctgttggatttgtttaa

SEQ ID NO: 1776620 - DNA, 15 bp, Homo sapiens
atttccttcaggttt

SEQ ID NO: 1776621 - DNA, 16 bp, Homo sapiens
atttccttcaggtttt

SEQ ID NO: 1776622 - DNA, 11 bp, Homo sapiens
atttccttgga

SEQ ID NO: 1776623 - DNA, 12 bp, Homo sapiens
atttccttggag

SEQ ID NO: 1776624 - DNA, 15 bp, Homo sapiens
atttccttgtgcaaa

SEQ ID NO: 1776625 - DNA, 13 bp, Homo sapiens
atttcctttataa

SEQ ID NO: 1776626 - DNA, 14 bp, Homo sapiens
atttcctttatgtg

SEQ ID NO: 1776627 - DNA, 17 bp, Homo sapiens
atttcctttatgtgaat

SEQ ID NO: 1776628 - DNA, 19 bp, Homo sapiens
atttcctttatgtgaattt

SEQ ID NO: 1776629 - DNA, 13 bp, Homo sapiens
atttccttttcac

SEQ ID NO: 1776630 - DNA, 22 bp, Homo sapiens
atttccttttcacattagataa

SEQ ID NO: 1776631 - DNA, 19 bp, Homo sapiens
atttccttttttgttatta

SEQ ID NO: 1776632 - DNA, 21 bp, Homo sapiens
atttcgccgttgaagaggaag

SEQ ID NO: 1776633 - DNA, 13 bp, Homo sapiens
atttcgccttaaa

SEQ ID NO: 1776634 - DNA, 16 bp, Homo sapiens
atttcgccttaaactc

SEQ ID NO: 1776635 - DNA, 18 bp, Homo sapiens
atttcgccttaaactctg

SEQ ID NO: 1776636 - DNA, 14 bp, Homo sapiens
atttctaaaaaaca

SEQ ID NO: 1776637 - DNA, 20 bp, Homo sapiens
atttctaaaaaacagaggcc

SEQ ID NO: 1776638 - DNA, 14 bp, Homo sapiens
atttctaaaatctt

SEQ ID NO: 1776639 - DNA, 19 bp, Homo sapiens
atttctaacagtccttgct

SEQ ID NO: 1776640 - DNA, 19 bp, Homo sapiens
atttctaagcgcctattgt

SEQ ID NO: 1776641 - DNA, 16 bp, Homo sapiens
atttctaagcttattt

SEQ ID NO: 1776642 - DNA, 18 bp, Homo sapiens
atttctaagcttatttct

SEQ ID NO: 1776643 - DNA, 22 bp, Homo sapiens
atttctaagcttatttctaact

SEQ ID NO: 1776644 - DNA, 19 bp, Homo sapiens
atttctaatccttttcctt

SEQ ID NO: 1776645 - DNA, 20 bp, Homo sapiens
atttctaatccttttcctta

SEQ ID NO: 1776646 - DNA, 16 bp, Homo sapiens
atttctaattccacag

SEQ ID NO: 1776647 - DNA, 21 bp, Homo sapiens
atttctacaactggagttttt

SEQ ID NO: 1776648 - DNA, 14 bp, Homo sapiens
atttctagaaacaa

SEQ ID NO: 1776649 - DNA, 20 bp, Homo sapiens
atttctagaagcacatgtgt

SEQ ID NO: 1776650 - DNA, 21 bp, Homo sapiens
atttctagactcaaaacctgg

SEQ ID NO: 1776651 - DNA, 13 bp, Homo sapiens
atttctagcagag

SEQ ID NO: 1776652 - DNA, 16 bp, Homo sapiens
atttctagcagagtga

SEQ ID NO: 1776653 - DNA, 14 bp, Homo sapiens
atttctatatttat

SEQ ID NO: 1776654 - DNA, 13 bp, Homo sapiens
atttctatctgca

SEQ ID NO: 1776655 - DNA, 13 bp, Homo sapiens
atttctatgacaa

SEQ ID NO: 1776656 - DNA, 22 bp, Homo sapiens
atttctatgtcatttttaatgt

SEQ ID NO: 1776657 - DNA, 23 bp, Homo sapiens
atttctatgtcatttttaatgta

SEQ ID NO: 1776658 - DNA, 11 bp, Homo sapiens
atttctattaa

SEQ ID NO: 1776659 - DNA, 12 bp, Homo sapiens
atttctatttat

SEQ ID NO: 1776660 - DNA, 18 bp, Homo sapiens
atttctcaatcagtgcag

SEQ ID NO: 1776661 - DNA, 15 bp, Homo sapiens
atttctcattgactt

SEQ ID NO: 1776662 - DNA, 17 bp, Homo sapiens
atttctcattgactttt

SEQ ID NO: 1776663 - DNA, 22 bp, Homo sapiens
atttctcattgacttttataaa

SEQ ID NO: 1776664 - DNA, 18 bp, Homo sapiens
atttctccagttgggact

SEQ ID NO: 1776665 - DNA, 22 bp, Homo sapiens
attttaatgaaatcaaatgtat

SEQ ID NO: 1776666 - DNA, 18 bp, Homo sapiens
attttaatgctgtttcta

SEQ ID NO: 1776667 - DNA, 19 bp, Homo sapiens
attttaatgctgtttctaa

SEQ ID NO: 1776668 - DNA, 21 bp, Homo sapiens
attttaatgctgtttctaaga

SEQ ID NO: 1776669 - DNA, 12 bp, Homo sapiens
attttaatgtaa

SEQ ID NO: 1776670 - DNA, 19 bp, Homo sapiens
attttaatgtaaaattcat

SEQ ID NO: 1776671 - DNA, 15 bp, Homo sapiens
attttaatgtgaaga

SEQ ID NO: 1776672 - DNA, 13 bp, Homo sapiens
attttaattatta

SEQ ID NO: 1776673 - DNA, 12 bp, Homo sapiens
attttaattctc

SEQ ID NO: 1776674 - DNA, 12 bp, Homo sapiens
attttaatttat

SEQ ID NO: 1776675 - DNA, 17 bp, Homo sapiens
attttacaaaagatgta

SEQ ID NO: 1776676 - DNA, 18 bp, Homo sapiens
attttacacagaaacact

SEQ ID NO: 1776677 - DNA, 19 bp, Homo sapiens
attttacacattagatttt

SEQ ID NO: 1776678 - DNA, 20 bp, Homo sapiens
attttacagaaacgtgttaa

SEQ ID NO: 1776679 - DNA, 15 bp, Homo sapiens
attttacagatttct

SEQ ID NO: 1776680 - DNA, 23 bp, Homo sapiens
attttacagctcattaaactttt

SEQ ID NO: 1776681 - DNA, 18 bp, Homo sapiens
attttaccaaagcatcaa

SEQ ID NO: 1776682 - DNA, 21 bp, Homo sapiens
attttaccagatgttttgatg

SEQ ID NO: 1776683 - DNA, 22 bp, Homo sapiens
attttactccataaacagactg

SEQ ID NO: 1776684 - DNA, 13 bp, Homo sapiens
attttacttccat

SEQ ID NO: 1776685 - DNA, 16 bp, Homo sapiens
attttactttttcctg

SEQ ID NO: 1776686 - DNA, 17 bp, Homo sapiens
attttactttttcctgg

SEQ ID NO: 1776687 - DNA, 13 bp, Homo sapiens
attttagaaatat

SEQ ID NO: 1776688 - DNA, 17 bp, Homo sapiens
attttagaaatattcac

SEQ ID NO: 1776689 - DNA, 14 bp, Homo sapiens
attttagatttctt

SEQ ID NO: 1776690 - DNA, 15 bp, Homo sapiens
attttagctgcagaa

SEQ ID NO: 1776691 - DNA, 18 bp, Homo sapiens
attttaggaacttcagag

SEQ ID NO: 1776692 - DNA, 19 bp, Homo sapiens
attttaggaacttcagaga

SEQ ID NO: 1776693 - DNA, 19 bp, Homo sapiens
attttagttcacacttagt

SEQ ID NO: 1776694 - DNA, 15 bp, Homo sapiens
attttagttttgcaa

SEQ ID NO: 1776695 - DNA, 20 bp, Homo sapiens
attttagtttttcattaaat

SEQ ID NO: 1776696 - DNA, 14 bp, Homo sapiens
attttataagaaaa

SEQ ID NO: 1776697 - DNA, 17 bp, Homo sapiens
attttataagaaaaact

SEQ ID NO: 1776698 - DNA, 19 bp, Homo sapiens
attttatagctcagtttat

SEQ ID NO: 1776699 - DNA, 12 bp, Homo sapiens
attttatatctt

SEQ ID NO: 1776700 - DNA, 16 bp, Homo sapiens
attttatatgcttact

SEQ ID NO: 1776701 - DNA, 18 bp, Homo sapiens
attttatatgcttactga

SEQ ID NO: 1776702 - DNA, 23 bp, Homo sapiens
attttatatgcttactgatatat

SEQ ID NO: 1776703 - DNA, 17 bp, Homo sapiens
attttatcattaaaaat

SEQ ID NO: 1776704 - DNA, 19 bp, Homo sapiens
attttatcattaaaaatta

SEQ ID NO: 1776705 - DNA, 18 bp, Homo sapiens
attttatcctgtattctt

SEQ ID NO: 1776706 - DNA, 22 bp, Homo sapiens
attttatcctgtattcttgttt

SEQ ID NO: 1776707 - DNA, 13 bp, Homo sapiens
attttatctttga

SEQ ID NO: 1776708 - DNA, 23 bp, Homo sapiens
attttatctttgattctccttca

SEQ ID NO: 1776709 - DNA, 14 bp, Homo sapiens
attttatgaacatt

SEQ ID NO: 1776710 - DNA, 20 bp, Homo sapiens
attttatgaacattgtactg

SEQ ID NO: 1776711 - DNA, 19 bp, Homo sapiens
attttatgccagttgttaa

SEQ ID NO: 1776712 - DNA, 13 bp, Homo sapiens
attttattaataa

SEQ ID NO: 1776713 - DNA, 15 bp, Homo sapiens
attttattaataata

SEQ ID NO: 1776714 - DNA, 16 bp, Homo sapiens
attttattatgagctt

SEQ ID NO: 1776715 - DNA, 17 bp, Homo sapiens
attttattcttatttca

SEQ ID NO: 1776716 - DNA, 13 bp, Homo sapiens
attttattgtata

SEQ ID NO: 1776717 - DNA, 20 bp, Homo sapiens
attttattgtataaaaagtt

SEQ ID NO: 1776718 - DNA, 14 bp, Homo sapiens
attttatttgacaa

SEQ ID NO: 1776719 - DNA, 12 bp, Homo sapiens
attttatttgta

SEQ ID NO: 1776720 - DNA, 13 bp, Homo sapiens
attttatttgtat

SEQ ID NO: 1776721 - DNA, 15 bp, Homo sapiens
attttatttgtattc

SEQ ID NO: 1776722 - DNA, 14 bp, Homo sapiens
attttattttcatg

SEQ ID NO: 1776723 - DNA, 15 bp, Homo sapiens
attttattttgctga

SEQ ID NO: 1776724 - DNA, 22 bp, Homo sapiens
attttattttgtgctcatttaa

SEQ ID NO: 1776725 - DNA, 22 bp, Homo sapiens
attttcaaagctttttccagag

SEQ ID NO: 1776726 - DNA, 21 bp, Homo sapiens
attttcaaccataaaagaagt

SEQ ID NO: 1776727 - DNA, 14 bp, Homo sapiens
attttcaactgctt

SEQ ID NO: 1776728 - DNA, 24 bp, Homo sapiens
attttcaagaataatcacgctttc

SEQ ID NO: 1776729 - DNA, 20 bp, Homo sapiens
attttcaagactgaattcca

SEQ ID NO: 1776730 - DNA, 17 bp, Homo sapiens
attttcaaggccctcag

SEQ ID NO: 1776731 - DNA, 13 bp, Homo sapiens
attttcaaggcct

SEQ ID NO: 1776732 - DNA, 18 bp, Homo sapiens
attttcaaggccttcagt

SEQ ID NO: 1776733 - DNA, 22 bp, Homo sapiens
attttcaaggccttcagtttat

SEQ ID NO: 1776734 - DNA, 16 bp, Homo sapiens
attttcaagtaattgt

SEQ ID NO: 1776735 - DNA, 19 bp, Homo sapiens
attttcaagtaattgtgaa

SEQ ID NO: 1776736 - DNA, 19 bp, Homo sapiens
attttcacattcttggctt

SEQ ID NO: 1776737 - DNA, 20 bp, Homo sapiens
attttcacattcttggctta

SEQ ID NO: 1776738 - DNA, 18 bp, Homo sapiens
attttcactggaagattt

SEQ ID NO: 1776739 - DNA, 19 bp, Homo sapiens
attttcagcaaactctttt

SEQ ID NO: 1776740 - DNA, 12 bp, Homo sapiens
attttcagcatt

SEQ ID NO: 1776741 - DNA, 19 bp, Homo sapiens
attttcagcattaagctgt

SEQ ID NO: 1776742 - DNA, 11 bp, Homo sapiens
attttcagtac

SEQ ID NO: 1776743 - DNA, 21 bp, Homo sapiens
attttcagtagggctacaaaa

SEQ ID NO: 1776744 - DNA, 22 bp, Homo sapiens
attttcagtagggctacaaaac

SEQ ID NO: 1776745 - DNA, 18 bp, Homo sapiens
attttcagtatactgtgt

SEQ ID NO: 1776746 - DNA, 22 bp, Homo sapiens
attttcagtcccctctctctgg

SEQ ID NO: 1776747 - DNA, 23 bp, Homo sapiens
attttcagtcccctctctctggg

SEQ ID NO: 1776748 - DNA, 15 bp, Homo sapiens
attttcagtcttgta

SEQ ID NO: 1776749 - DNA, 16 bp, Homo sapiens
attttcagtcttgtag

SEQ ID NO: 1776750 - DNA, 18 bp, Homo sapiens
attttcatagatgtgtta

SEQ ID NO: 1776751 - DNA, 21 bp, Homo sapiens
attttcatcccgtatcacagt

SEQ ID NO: 1776752 - DNA, 20 bp, Homo sapiens
attttcatgaaaataccatt

SEQ ID NO: 1776753 - DNA, 17 bp, Homo sapiens
attttcatgaatgtgct

SEQ ID NO: 1776754 - DNA, 19 bp, Homo sapiens
attttcattaaacttgaag

SEQ ID NO: 1776755 - DNA, 17 bp, Homo sapiens
attttccaaatgtaata

SEQ ID NO: 1776756 - DNA, 16 bp, Homo sapiens
attttccaagaacata

SEQ ID NO: 1776757 - DNA, 23 bp, Homo sapiens
attttccacaagattcccagaga

SEQ ID NO: 1776758 - DNA, 17 bp, Homo sapiens
attttccagtataaaac

SEQ ID NO: 1776759 - DNA, 21 bp, Homo sapiens
attttcccccactactgcagc

SEQ ID NO: 1776760 - DNA, 20 bp, Homo sapiens
attttccccccactctcccc

SEQ ID NO: 1776761 - DNA, 22 bp, Homo sapiens
attttccccccactctccccac

SEQ ID NO: 1776762 - DNA, 18 bp, Homo sapiens
attttcctcttgtcctgg

SEQ ID NO: 1776763 - DNA, 21 bp, Homo sapiens
attttcctcttgtcctggccc

SEQ ID NO: 1776764 - DNA, 23 bp, Homo sapiens
attttcctcttgtcctggccctt

SEQ ID NO: 1776765 - DNA, 19 bp, Homo sapiens
attttcctgacatttgttt

SEQ ID NO: 1776766 - DNA, 23 bp, Homo sapiens
attttcctggtgccaatttcaag

SEQ ID NO: 1776767 - DNA, 15 bp, Homo sapiens
attttcctgttcagt

SEQ ID NO: 1776768 - DNA, 19 bp, Homo sapiens
attttctaaaagctttcat

SEQ ID NO: 1776769 - DNA, 21 bp, Homo sapiens
attttctaaaagctttcatgt

SEQ ID NO: 1776770 - DNA, 13 bp, Homo sapiens
attttctaaactg

SEQ ID NO: 1776771 - DNA, 22 bp, Homo sapiens
attttctaaataaaaatatgta

SEQ ID NO: 1776772 - DNA, 14 bp, Homo sapiens
attttctaattaaa

SEQ ID NO: 1776773 - DNA, 16 bp, Homo sapiens
atttttacagcaaaag

SEQ ID NO: 1776774 - DNA, 14 bp, Homo sapiens
atttttacctaatc

SEQ ID NO: 1776775 - DNA, 16 bp, Homo sapiens
caaaaaaaaagtttta

SEQ ID NO: 1776776 - DNA, 19 bp, Homo sapiens
caaaaaaaaagttttattt

SEQ ID NO: 1776777 - DNA, 22 bp, Homo sapiens
caaaaaaaaagttttatttttc

SEQ ID NO: 1776778 - DNA, 19 bp, Homo sapiens
caaaaaaaatttagccggg

SEQ ID NO: 1776779 - DNA, 13 bp, Homo sapiens
caaaaaaagcctc

SEQ ID NO: 1776780 - DNA, 19 bp, Homo sapiens
caaaaaaagcctccaaggg

SEQ ID NO: 1776781 - DNA, 17 bp, Homo sapiens
caaaaaaaggaaaaata

SEQ ID NO: 1776782 - DNA, 22 bp, Homo sapiens
caaaaaaaggaaaaataatcaa

SEQ ID NO: 1776783 - DNA, 18 bp, Homo sapiens
caaaaaaatatatttaat

SEQ ID NO: 1776784 - DNA, 21 bp, Homo sapiens
caaaaaaatatcagacaagca

SEQ ID NO: 1776785 - DNA, 11 bp, Homo sapiens
caaaaaaccca

SEQ ID NO: 1776786 - DNA, 11 bp, Homo sapiens
caaaaaactac

SEQ ID NO: 1776787 - DNA, 23 bp, Homo sapiens
caaaaggatggtggttattttaa

SEQ ID NO: 1776788 - DNA, 15 bp, Homo sapiens
caaaaggctgagaag

SEQ ID NO: 1776789 - DNA, 16 bp, Homo sapiens
caaaaggctgagaagg

SEQ ID NO: 1776790 - DNA, 15 bp, Homo sapiens
caaaagggtgtatag

SEQ ID NO: 1776791 - DNA, 21 bp, Homo sapiens
caaaagggtgtatagtgttca

SEQ ID NO: 1776792 - DNA, 23 bp, Homo sapiens
caaaaggtgcctgtgaggcaggg

SEQ ID NO: 1776793 - DNA, 15 bp, Homo sapiens
caaaaggtttattcc

SEQ ID NO: 1776794 - DNA, 16 bp, Homo sapiens
caaaagttattaaaat

SEQ ID NO: 1776795 - DNA, 22 bp, Homo sapiens
caaaagttattaaaattgttgt

SEQ ID NO: 1776796 - DNA, 14 bp, Homo sapiens
caaaagttccaaga

SEQ ID NO: 1776797 - DNA, 23 bp, Homo sapiens
caaaagttccaagagtctaaaga

SEQ ID NO: 1776798 - DNA, 22 bp, Homo sapiens
caaaataaaaagtgacacagca

SEQ ID NO: 1776799 - DNA, 14 bp, Homo sapiens
caaaataataaaaa

SEQ ID NO: 1776800 - DNA, 18 bp, Homo sapiens
caaaataattttaagaaa

SEQ ID NO: 1776801 - DNA, 16 bp, Homo sapiens
caaaataccagagcct

SEQ ID NO: 1776802 - DNA, 22 bp, Homo sapiens
caaaataccagagccttcaagt

SEQ ID NO: 1776803 - DNA, 13 bp, Homo sapiens
caaaatagagaat

SEQ ID NO: 1776804 - DNA, 14 bp, Homo sapiens
caaaatagttctat

SEQ ID NO: 1776805 - DNA, 18 bp, Homo sapiens
caaaatagttctatttct

SEQ ID NO: 1776806 - DNA, 23 bp, Homo sapiens
caaaatagttctatttctatctg

SEQ ID NO: 1776807 - DNA, 24 bp, Homo sapiens
caaaatagttctatttctatctgc

SEQ ID NO: 1776808 - DNA, 18 bp, Homo sapiens
cacacttatattttatga

SEQ ID NO: 1776809 - DNA, 19 bp, Homo sapiens
cacacttatattttatgaa

SEQ ID NO: 1776810 - DNA, 14 bp, Homo sapiens
cacacttcaggctc

SEQ ID NO: 1776811 - DNA, 17 bp, Homo sapiens
cacacttcaggctcttc

SEQ ID NO: 1776812 - DNA, 21 bp, Homo sapiens
cacacttcaggctcttctcct

SEQ ID NO: 1776813 - DNA, 22 bp, Homo sapiens
cacacttcaggctcttctcctt

SEQ ID NO: 1776814 - DNA, 18 bp, Homo sapiens
cacacttccccatctttg

SEQ ID NO: 1776815 - DNA, 21 bp, Homo sapiens
cacacttgcatacatatatat

SEQ ID NO: 1776816 - DNA, 22 bp, Homo sapiens
cacacttggttgggtcctcaca

SEQ ID NO: 1776817 - DNA, 15 bp, Homo sapiens
cacacttgttccagc

SEQ ID NO: 1776818 - DNA, 20 bp, Homo sapiens
cacacttgttccagctcttt

SEQ ID NO: 1776819 - DNA, 12 bp, Homo sapiens
cacactttccat

SEQ ID NO: 1776820 - DNA, 15 bp, Homo sapiens
cacactttccatctc

SEQ ID NO: 1776821 - DNA, 19 bp, Homo sapiens
cacactttccatctctgcc

SEQ ID NO: 1776822 - DNA, 22 bp, Homo sapiens
cacactttccatctctgcctgt

SEQ ID NO: 1776823 - DNA, 20 bp, Homo sapiens
cacactttttttcctctttc

SEQ ID NO: 1776824 - DNA, 15 bp, Homo sapiens
cacagaaaaagcatg

SEQ ID NO: 1776825 - DNA, 14 bp, Homo sapiens
cacagaaaataagg

SEQ ID NO: 1776826 - DNA, 16 bp, Homo sapiens
cacagaaacactgcct

SEQ ID NO: 1776827 - DNA, 17 bp, Homo sapiens
cacagaaacactgcctt

SEQ ID NO: 1776828 - DNA, 18 bp, Homo sapiens
cacagaaagactgagctc

SEQ ID NO: 1776829 - DNA, 14 bp, Homo sapiens
cacagaaatgctgc

SEQ ID NO: 1776830 - DNA, 16 bp, Homo sapiens
cacagaaatgctgctg

SEQ ID NO: 1776831 - DNA, 12 bp, Homo sapiens
cacagaaattat

SEQ ID NO: 1776832 - DNA, 15 bp, Homo sapiens
cacagaaccttcaac

SEQ ID NO: 1776833 - DNA, 19 bp, Homo sapiens
cacagaaccttcaacccag

SEQ ID NO: 1776834 - DNA, 22 bp, Homo sapiens
cacagaaccttcaacccagtgg

SEQ ID NO: 1776835 - DNA, 18 bp, Homo sapiens
cacagaaggaatctgtgc

SEQ ID NO: 1776836 - DNA, 19 bp, Homo sapiens
cacagaatcatatgattct

SEQ ID NO: 1776837 - DNA, 17 bp, Homo sapiens
cacagacaagcagccct

SEQ ID NO: 1776838 - DNA, 13 bp, Homo sapiens
cacagacacacac

SEQ ID NO: 1776839 - DNA, 15 bp, Homo sapiens
cacagacacgctcgc

SEQ ID NO: 1776840 - DNA, 13 bp, Homo sapiens
cacagacatatat

SEQ ID NO: 1776841 - DNA, 19 bp, Homo sapiens
cacagacattttgtgtgag

SEQ ID NO: 1776842 - DNA, 20 bp, Homo sapiens
cacagacattttgtgtgaga

SEQ ID NO: 1776843 - DNA, 18 bp, Homo sapiens
cacagacctggagcccct

SEQ ID NO: 1776844 - DNA, 22 bp, Homo sapiens
cacagacctggagcccctgggt

SEQ ID NO: 1776845 - DNA, 24 bp, Homo sapiens
cacagacctggagcccctgggtgg

SEQ ID NO: 1776846 - DNA, 19 bp, Homo sapiens
cacagacgccttactggca

SEQ ID NO: 1776847 - DNA, 18 bp, Homo sapiens
cacagacgggcacacaga

SEQ ID NO: 1776848 - DNA, 23 bp, Homo sapiens
cacagactgaactcgcagggaat

SEQ ID NO: 1776849 - DNA, 13 bp, Homo sapiens
cacagactggaga

SEQ ID NO: 1776850 - DNA, 19 bp, Homo sapiens
cacagactggttttgcaac

SEQ ID NO: 1776851 - DNA, 20 bp, Homo sapiens
cacagacttctggaaggctg

SEQ ID NO: 1776852 - DNA, 23 bp, Homo sapiens
cacagacttctggaaggctggct

SEQ ID NO: 1776853 - DNA, 21 bp, Homo sapiens
cacagagaagtttgtagccag

SEQ ID NO: 1776854 - DNA, 18 bp, Homo sapiens
cacagagagacagacttg

SEQ ID NO: 1776855 - DNA, 22 bp, Homo sapiens
cacagagagacagacttgagaa

SEQ ID NO: 1776856 - DNA, 19 bp, Homo sapiens
cacagagaggaggggacca

SEQ ID NO: 1776857 - DNA, 19 bp, Homo sapiens
cacagagagggagagcaga

SEQ ID NO: 1776858 - DNA, 22 bp, Homo sapiens
cacagagagggagagcagagaa

SEQ ID NO: 1776859 - DNA, 23 bp, Homo sapiens
cacagagagggagagcagagaaa

SEQ ID NO: 1776860 - DNA, 16 bp, Homo sapiens
cacagagcacgcctgc

SEQ ID NO: 1776861 - DNA, 13 bp, Homo sapiens
cacagaggaagag

SEQ ID NO: 1776862 - DNA, 21 bp, Homo sapiens
cacagaggcagcccgcacacc

SEQ ID NO: 1776863 - DNA, 16 bp, Homo sapiens
cacagagggcgtgtgc

SEQ ID NO: 1776864 - DNA, 23 bp, Homo sapiens
cacagaggtagtctcactgcttg

SEQ ID NO: 1776865 - DNA, 15 bp, Homo sapiens
cacagagtcaaggcc

SEQ ID NO: 1776866 - DNA, 16 bp, Homo sapiens
cacagagtcaaggcct

SEQ ID NO: 1776867 - DNA, 19 bp, Homo sapiens
cacagagtcaaggcctgct

SEQ ID NO: 1776868 - DNA, 20 bp, Homo sapiens
cacagagtcaaggcctgctc

SEQ ID NO: 1776869 - DNA, 18 bp, Homo sapiens
cacagagtgagccagtga

SEQ ID NO: 1776870 - DNA, 22 bp, Homo sapiens
cacagagtggtctttctggaga

SEQ ID NO: 1776871 - DNA, 19 bp, Homo sapiens
cacagagtgtgctgctatt

SEQ ID NO: 1776872 - DNA, 18 bp, Homo sapiens
cacagatatttccatttc

SEQ ID NO: 1776873 - DNA, 19 bp, Homo sapiens
cacagatcacagcttcagc

SEQ ID NO: 1776874 - DNA, 11 bp, Homo sapiens
cacagatcatg

SEQ ID NO: 1776875 - DNA, 16 bp, Homo sapiens
cacagatcccctggaa

SEQ ID NO: 1776876 - DNA, 15 bp, Homo sapiens
cacagatgccatggc

SEQ ID NO: 1776877 - DNA, 11 bp, Homo sapiens
cacagatgcct

SEQ ID NO: 1776878 - DNA, 12 bp, Homo sapiens
cacagatggatt

SEQ ID NO: 1776879 - DNA, 19 bp, Homo sapiens
cacagatggatttgcctgt

SEQ ID NO: 1776880 - DNA, 19 bp, Homo sapiens
cacagatgggtattaaact

SEQ ID NO: 1776881 - DNA, 20 bp, Homo sapiens
cacagattatgttcctgctg

SEQ ID NO: 1776882 - DNA, 22 bp, Homo sapiens
cacagattatgttcctgctgta

SEQ ID NO: 1776883 - DNA, 23 bp, Homo sapiens
cacagattatgttcctgctgtat

SEQ ID NO: 1776884 - DNA, 17 bp, Homo sapiens
cacagcacaccagccgc

SEQ ID NO: 1776885 - DNA, 19 bp, Homo sapiens
cacagcacaccagccgctg

SEQ ID NO: 1776886 - DNA, 20 bp, Homo sapiens
cacagcacaccagccgctgc

SEQ ID NO: 1776887 - DNA, 16 bp, Homo sapiens
cacagcacagtacaca

SEQ ID NO: 1776888 - DNA, 20 bp, Homo sapiens
cacagcaccgggggagaggg

SEQ ID NO: 1776889 - DNA, 16 bp, Homo sapiens
cacagcactctctaaa

SEQ ID NO: 1776890 - DNA, 21 bp, Homo sapiens
cacagcacttgagtaaaatac

SEQ ID NO: 1776891 - DNA, 18 bp, Homo sapiens
cacagcagcatcttcaaa

SEQ ID NO: 1776892 - DNA, 18 bp, Homo sapiens
cacagcagcttcaccaga

SEQ ID NO: 1776893 - DNA, 13 bp, Homo sapiens
cacagcagtgagt

SEQ ID NO: 1776894 - DNA, 22 bp, Homo sapiens
cacagcagtgtcccctgcccca

SEQ ID NO: 1776895 - DNA, 19 bp, Homo sapiens
cacagcagttgaaaagact

SEQ ID NO: 1776896 - DNA, 14 bp, Homo sapiens
cacagcatgtgcca

SEQ ID NO: 1776897 - DNA, 21 bp, Homo sapiens
cacagcatttgctttcctctg

SEQ ID NO: 1776898 - DNA, 20 bp, Homo sapiens
cacagccaacgagacacatt

SEQ ID NO: 1776899 - DNA, 12 bp, Homo sapiens
cacagccacccg

SEQ ID NO: 1776900 - DNA, 17 bp, Homo sapiens
cacagccactaaaacac

SEQ ID NO: 1776901 - DNA, 20 bp, Homo sapiens
cacagccactaaaacacaaa

SEQ ID NO: 1776902 - DNA, 17 bp, Homo sapiens
cacagccagactggcac

SEQ ID NO: 1776903 - DNA, 21 bp, Homo sapiens
cacaggtacagcaacaggaat

SEQ ID NO: 1776904 - DNA, 18 bp, Homo sapiens
cacaggtcaataaactta

SEQ ID NO: 1776905 - DNA, 22 bp, Homo sapiens
cacaggtcatcagatgcctgct

SEQ ID NO: 1776906 - DNA, 14 bp, Homo sapiens
cacaggtctagact

SEQ ID NO: 1776907 - DNA, 22 bp, Homo sapiens
cacaggtgccgccagctgccgc

SEQ ID NO: 1776908 - DNA, 21 bp, Homo sapiens
cacagtaaaaatggaaactat

SEQ ID NO: 1776909 - DNA, 15 bp, Homo sapiens
cacagtacaataatg

SEQ ID NO: 1776910 - DNA, 18 bp, Homo sapiens
cacagtacacacaaaaac

SEQ ID NO: 1776911 - DNA, 13 bp, Homo sapiens
cacagtacatatg

SEQ ID NO: 1776912 - DNA, 15 bp, Homo sapiens
cacagtacatatgta

SEQ ID NO: 1776913 - DNA, 14 bp, Homo sapiens
cacagtactcactt

SEQ ID NO: 1776914 - DNA, 21 bp, Homo sapiens
cacagtactcactttttccaa

SEQ ID NO: 1776915 - DNA, 22 bp, Homo sapiens
cacagtactcactttttccaaa

SEQ ID NO: 1776916 - DNA, 14 bp, Homo sapiens
cacagtagagccag

SEQ ID NO: 1776917 - DNA, 21 bp, Homo sapiens
cacagtaggtcccggccagct

SEQ ID NO: 1776918 - DNA, 13 bp, Homo sapiens
cacagtattatgc

SEQ ID NO: 1776919 - DNA, 14 bp, Homo sapiens
cacagtatttgtaa

SEQ ID NO: 1776920 - DNA, 14 bp, Homo sapiens
cacagtcactggat

SEQ ID NO: 1776921 - DNA, 23 bp, Homo sapiens
cacagtctctggaaaagctgggg

SEQ ID NO: 1776922 - DNA, 12 bp, Homo sapiens
cacagtcttctg

SEQ ID NO: 1776923 - DNA, 16 bp, Homo sapiens
cacagtgacccttccc

SEQ ID NO: 1776924 - DNA, 15 bp, Homo sapiens
cacagtgacttctga

SEQ ID NO: 1776925 - DNA, 14 bp, Homo sapiens
cacagtgatttttt

SEQ ID NO: 1776926 - DNA, 18 bp, Homo sapiens
cacagtgcattatgtaca

SEQ ID NO: 1776927 - DNA, 13 bp, Homo sapiens
cacagtgccaccc

SEQ ID NO: 1776928 - DNA, 13 bp, Homo sapiens
cacagtgctgctt

SEQ ID NO: 1776929 - DNA, 14 bp, Homo sapiens
cacagtgctgggat

SEQ ID NO: 1776930 - DNA, 16 bp, Homo sapiens
cacagtgcttagaagt

SEQ ID NO: 1776931 - DNA, 23 bp, Homo sapiens
cacagtggactcagcagtgacca

SEQ ID NO: 1776932 - DNA, 16 bp, Homo sapiens
caccaggagcagcagc

SEQ ID NO: 1776933 - DNA, 20 bp, Homo sapiens
caccaggagcagcagccagc

SEQ ID NO: 1776934 - DNA, 21 bp, Homo sapiens
caccaggagcagcagccagca

SEQ ID NO: 1776935 - DNA, 22 bp, Homo sapiens
caccaggagcagcagccagcac

SEQ ID NO: 1776936 - DNA, 23 bp, Homo sapiens
caccaggagcagcagccagcacc

SEQ ID NO: 1776937 - DNA, 17 bp, Homo sapiens
caccaggagtccctggt

SEQ ID NO: 1776938 - DNA, 20 bp, Homo sapiens
caccaggcacgaacccacct

SEQ ID NO: 1776939 - DNA, 23 bp, Homo sapiens
caccaggcacgaacccacctgct

SEQ ID NO: 1776940 - DNA, 22 bp, Homo sapiens
caccaggccacctccccagcat

SEQ ID NO: 1776941 - DNA, 23 bp, Homo sapiens
caccaggccgggcttgggccctg

SEQ ID NO: 1776942 - DNA, 16 bp, Homo sapiens
caccaggccgtcctcc

SEQ ID NO: 1776943 - DNA, 24 bp, Homo sapiens
caccaggcctggcctctgggcagt

SEQ ID NO: 1776944 - DNA, 19 bp, Homo sapiens
caccaggctggcgcagcca

SEQ ID NO: 1776945 - DNA, 20 bp, Homo sapiens
caccaggctggcgcagccaa

SEQ ID NO: 1776946 - DNA, 23 bp, Homo sapiens
caccaggctggcgcagccaaggc

SEQ ID NO: 1776947 - DNA, 13 bp, Homo sapiens
caccagggaagaa

SEQ ID NO: 1776948 - DNA, 14 bp, Homo sapiens
caccaggggaggag

SEQ ID NO: 1776949 - DNA, 18 bp, Homo sapiens
caccaggggaggagcctg

SEQ ID NO: 1776950 - DNA, 22 bp, Homo sapiens
caccagggtccttttgacactg

SEQ ID NO: 1776951 - DNA, 13 bp, Homo sapiens
caccagtctgtct

SEQ ID NO: 1776952 - DNA, 20 bp, Homo sapiens
caccagtctgtctactgtgg

SEQ ID NO: 1776953 - DNA, 16 bp, Homo sapiens
caccagtgaaagaagc

SEQ ID NO: 1776954 - DNA, 23 bp, Homo sapiens
caccatacgagcacctccagcct

SEQ ID NO: 1776955 - DNA, 17 bp, Homo sapiens
caccatactccttgctt

SEQ ID NO: 1776956 - DNA, 22 bp, Homo sapiens
caccatactccttgcttcctga

SEQ ID NO: 1776957 - DNA, 13 bp, Homo sapiens
caccatagcctac

SEQ ID NO: 1776958 - DNA, 21 bp, Homo sapiens
caccatagtgtcacagagagc

SEQ ID NO: 1776959 - DNA, 14 bp, Homo sapiens
caccatatgaattg

SEQ ID NO: 1776960 - DNA, 18 bp, Homo sapiens
caccatatgaattgtaca

SEQ ID NO: 1776961 - DNA, 15 bp, Homo sapiens
caccatcaatcctga

SEQ ID NO: 1776962 - DNA, 15 bp, Homo sapiens
caccatccagtgggc

SEQ ID NO: 1776963 - DNA, 12 bp, Homo sapiens
caccatcctgag

SEQ ID NO: 1776964 - DNA, 18 bp, Homo sapiens
caccatctgattaaaaca

SEQ ID NO: 1776965 - DNA, 14 bp, Homo sapiens
caccatcttcagtg

SEQ ID NO: 1776966 - DNA, 18 bp, Homo sapiens
caccatgatgtgaagagt

SEQ ID NO: 1776967 - DNA, 18 bp, Homo sapiens
caccatgcactcacccct

SEQ ID NO: 1776968 - DNA, 20 bp, Homo sapiens
caccatgcccagctaatttt

SEQ ID NO: 1776969 - DNA, 13 bp, Homo sapiens
caccatggagacg

SEQ ID NO: 1776970 - DNA, 23 bp, Homo sapiens
caccatggagacgtggtgggact

SEQ ID NO: 1776971 - DNA, 12 bp, Homo sapiens
caccatggccag

SEQ ID NO: 1776972 - DNA, 14 bp, Homo sapiens
caccatggtcatca

SEQ ID NO: 1776973 - DNA, 22 bp, Homo sapiens
caccatggtcatcaccaccctt

SEQ ID NO: 1776974 - DNA, 17 bp, Homo sapiens
caccatgtgagctcttc

SEQ ID NO: 1776975 - DNA, 22 bp, Homo sapiens
caccatgtttatttatttccag

SEQ ID NO: 1776976 - DNA, 18 bp, Homo sapiens
caccatgtttgagctcag

SEQ ID NO: 1776977 - DNA, 19 bp, Homo sapiens
caccatgtttgagctcaga

SEQ ID NO: 1776978 - DNA, 12 bp, Homo sapiens
caccattcctgc

SEQ ID NO: 1776979 - DNA, 15 bp, Homo sapiens
caccattcctgcctt

SEQ ID NO: 1776980 - DNA, 15 bp, Homo sapiens
caccattctcctgcc

SEQ ID NO: 1776981 - DNA, 16 bp, Homo sapiens
caccattgaaggctta

SEQ ID NO: 1776982 - DNA, 14 bp, Homo sapiens
caccattgctggaa

SEQ ID NO: 1776983 - DNA, 16 bp, Homo sapiens
caccattgctggaaaa

SEQ ID NO: 1776984 - DNA, 17 bp, Homo sapiens
caccatttggatcctgt

SEQ ID NO: 1776985 - DNA, 15 bp, Homo sapiens
cacccaaacacttct

SEQ ID NO: 1776986 - DNA, 12 bp, Homo sapiens
cacccaaagctg

SEQ ID NO: 1776987 - DNA, 19 bp, Homo sapiens
cacccaagagattgttgtt

SEQ ID NO: 1776988 - DNA, 14 bp, Homo sapiens
cacccaagcctgct

SEQ ID NO: 1776989 - DNA, 21 bp, Homo sapiens
cacccaagcttggcagccgag

SEQ ID NO: 1776990 - DNA, 19 bp, Homo sapiens
cacccaatcaagggaagaa

SEQ ID NO: 1776991 - DNA, 21 bp, Homo sapiens
cacccaatcaagggaagaagg

SEQ ID NO: 1776992 - DNA, 23 bp, Homo sapiens
cacccaattggcccaacactgtc

SEQ ID NO: 1776993 - DNA, 17 bp, Homo sapiens
cacccacacactcgccc

SEQ ID NO: 1776994 - DNA, 23 bp, Homo sapiens
cacccacacactcgcccgcccac

SEQ ID NO: 1776995 - DNA, 15 bp, Homo sapiens
cacccacagccatag

SEQ ID NO: 1776996 - DNA, 16 bp, Homo sapiens
cacccacagccataga

SEQ ID NO: 1776997 - DNA, 11 bp, Homo sapiens
cacccacatga

SEQ ID NO: 1776998 - DNA, 13 bp, Homo sapiens
cacccacatgact

SEQ ID NO: 1776999 - DNA, 13 bp, Homo sapiens
cacccacatgtga

SEQ ID NO: 1777000 - DNA, 12 bp, Homo sapiens
cacccacccctg

SEQ ID NO: 1777001 - DNA, 14 bp, Homo sapiens
cacccacccctgcc

SEQ ID NO: 1777002 - DNA, 13 bp, Homo sapiens
cacccaccgtgga

SEQ ID NO: 1777003 - DNA, 20 bp, Homo sapiens
cacccacctgttttctgaaa

SEQ ID NO: 1777004 - DNA, 12 bp, Homo sapiens
caccctgggtgc

SEQ ID NO: 1777005 - DNA, 14 bp, Homo sapiens
caccctgggtgcca

SEQ ID NO: 1777006 - DNA, 21 bp, Homo sapiens
caccctgtactgttctgtgtc

SEQ ID NO: 1777007 - DNA, 14 bp, Homo sapiens
caccctgtggctca

SEQ ID NO: 1777008 - DNA, 20 bp, Homo sapiens
cacccttcacataccctccc

SEQ ID NO: 1777009 - DNA, 10 bp, Homo sapiens
cacccttccc

SEQ ID NO: 1777010 - DNA, 11 bp, Homo sapiens
cacccttccct

SEQ ID NO: 1777011 - DNA, 13 bp, Homo sapiens
cacccttccctct

SEQ ID NO: 1777012 - DNA, 22 bp, Homo sapiens
cacccttgcaccgtcctcagca

SEQ ID NO: 1777013 - DNA, 14 bp, Homo sapiens
cacccttgcccggc

SEQ ID NO: 1777014 - DNA, 21 bp, Homo sapiens
cacccttggaggctgtcttct

SEQ ID NO: 1777015 - DNA, 18 bp, Homo sapiens
cacccttggcctgtctca

SEQ ID NO: 1777016 - DNA, 21 bp, Homo sapiens
cacccttggcctgtctcatcc

SEQ ID NO: 1777017 - DNA, 23 bp, Homo sapiens
cacccttggcctgtctcatcccc

SEQ ID NO: 1777018 - DNA, 20 bp, Homo sapiens
caccctttgctgtgaggctg

SEQ ID NO: 1777019 - DNA, 15 bp, Homo sapiens
caccgaccaactgcc

SEQ ID NO: 1777020 - DNA, 17 bp, Homo sapiens
caccgaccaactgccct

SEQ ID NO: 1777021 - DNA, 15 bp, Homo sapiens
caccgactagccagg

SEQ ID NO: 1777022 - DNA, 21 bp, Homo sapiens
caccgagagtagccgagagcc

SEQ ID NO: 1777023 - DNA, 14 bp, Homo sapiens
caccgagccagctt

SEQ ID NO: 1777024 - DNA, 14 bp, Homo sapiens
caccgaggggcctt

SEQ ID NO: 1777025 - DNA, 21 bp, Homo sapiens
caccgcagcgtcccccgccgc

SEQ ID NO: 1777026 - DNA, 13 bp, Homo sapiens
caccgcaggggac

SEQ ID NO: 1777027 - DNA, 16 bp, Homo sapiens
caccgccacgtcccag

SEQ ID NO: 1777028 - DNA, 16 bp, Homo sapiens
caccgcccccacccct

SEQ ID NO: 1777029 - DNA, 20 bp, Homo sapiens
caccgcctctggccgccacc

SEQ ID NO: 1777030 - DNA, 15 bp, Homo sapiens
caccgcctgccctcc

SEQ ID NO: 1777031 - DNA, 21 bp, Homo sapiens
caccgcggcgcttcccagcac

SEQ ID NO: 1777032 - DNA, 21 bp, Homo sapiens
caccgctggtccctgccctcc

SEQ ID NO: 1777033 - DNA, 17 bp, Homo sapiens
caccggaggtcactcca

SEQ ID NO: 1777034 - DNA, 23 bp, Homo sapiens
caccggccaggccgcgcccagca

SEQ ID NO: 1777035 - DNA, 13 bp, Homo sapiens
caccggcgctgca

SEQ ID NO: 1777036 - DNA, 15 bp, Homo sapiens
caccggcgctgcagg

SEQ ID NO: 1777037 - DNA, 21 bp, Homo sapiens
caccggctctcacctggccct

SEQ ID NO: 1777038 - DNA, 15 bp, Homo sapiens
caccgggaccccctc

SEQ ID NO: 1777039 - DNA, 19 bp, Homo sapiens
caccgggaccccctcacca

SEQ ID NO: 1777040 - DNA, 13 bp, Homo sapiens
caccgggcagggc

SEQ ID NO: 1777041 - DNA, 20 bp, Homo sapiens
caccggggacaggccgcagc

SEQ ID NO: 1777042 - DNA, 20 bp, Homo sapiens
caccgggttctgcagcggca

SEQ ID NO: 1777043 - DNA, 16 bp, Homo sapiens
caccggtccagctggc

SEQ ID NO: 1777044 - DNA, 17 bp, Homo sapiens
caccggtccagctggcc

SEQ ID NO: 1777045 - DNA, 22 bp, Homo sapiens
caccgtacatctgcaatatgaa

SEQ ID NO: 1777046 - DNA, 16 bp, Homo sapiens
caccgtccgccctgct

SEQ ID NO: 1777047 - DNA, 18 bp, Homo sapiens
caccgttcgtacgcccag

SEQ ID NO: 1777048 - DNA, 17 bp, Homo sapiens
caccgtttcttcctgcc

SEQ ID NO: 1777049 - DNA, 22 bp, Homo sapiens
caccgtttcttcctgccagcag

SEQ ID NO: 1777050 - DNA, 20 bp, Homo sapiens
cacctaaaggtgtatttaaa

SEQ ID NO: 1777051 - DNA, 21 bp, Homo sapiens
cacctaaaggtgtatttaaac

SEQ ID NO: 1777052 - DNA, 17 bp, Homo sapiens
cacctaagtctctgtga

SEQ ID NO: 1777053 - DNA, 17 bp, Homo sapiens
cacctaatccaggcaga

SEQ ID NO: 1777054 - DNA, 22 bp, Homo sapiens
cacctaatccaggcagatccag

SEQ ID NO: 1777055 - DNA, 21 bp, Homo sapiens
cacctaatgtttatgagccag

SEQ ID NO: 1777056 - DNA, 15 bp, Homo sapiens
cacctacacaggagt

SEQ ID NO: 1777057 - DNA, 18 bp, Homo sapiens
cacctacacccctgtgct

SEQ ID NO: 1777058 - DNA, 19 bp, Homo sapiens
cacctacacccctgtgctc

SEQ ID NO: 1777059 - DNA, 14 bp, Homo sapiens
cacctacatcccca

SEQ ID NO: 1777060 - DNA, 16 bp, Homo sapiens
cacctacatccccagg

SEQ ID NO: 1777061 - DNA, 14 bp, Homo sapiens
cacctaccatgctg

SEQ ID NO: 1777062 - DNA, 16 bp, Homo sapiens
cacctaccatgctgct

SEQ ID NO: 1777063 - DNA, 17 bp, Homo sapiens
cacctaccatgctgctt

SEQ ID NO: 1777064 - DNA, 13 bp, Homo sapiens
cacagtggctcac

SEQ ID NO: 1777065 - DNA, 13 bp, Homo sapiens
cacagtggcttct

SEQ ID NO: 1777066 - DNA, 13 bp, Homo sapiens
cacagtgggaact

SEQ ID NO: 1777067 - DNA, 17 bp, Homo sapiens
cacagtgggaagatttt

SEQ ID NO: 1777068 - DNA, 13 bp, Homo sapiens
cacagtgggagct

SEQ ID NO: 1777069 - DNA, 19 bp, Homo sapiens
cacagtgggagctgagctg

SEQ ID NO: 1777070 - DNA, 20 bp, Homo sapiens
cacagtgggatgaaccagcc

SEQ ID NO: 1777071 - DNA, 21 bp, Homo sapiens
cacagtgtaatccaggggtgt

SEQ ID NO: 1777072 - DNA, 18 bp, Homo sapiens
cacagtgtcactggtcag

SEQ ID NO: 1777073 - DNA, 12 bp, Homo sapiens
cacagtgtctgt

SEQ ID NO: 1777074 - DNA, 16 bp, Homo sapiens
cacagtgtctgttcag

SEQ ID NO: 1777075 - DNA, 16 bp, Homo sapiens
cacagtgtgtttgtga

SEQ ID NO: 1777076 - DNA, 17 bp, Homo sapiens
cacagtgttgtgcccct

SEQ ID NO: 1777077 - DNA, 21 bp, Homo sapiens
cacagttagttgtgaaagaaa

SEQ ID NO: 1777078 - DNA, 16 bp, Homo sapiens
cacagttcctcgccct

SEQ ID NO: 1777079 - DNA, 19 bp, Homo sapiens
cacagttcctcgccctggg

SEQ ID NO: 1777080 - DNA, 20 bp, Homo sapiens
cacagttcctcgccctgggt

SEQ ID NO: 1777081 - DNA, 23 bp, Homo sapiens
cacagttctttgggccagacatg

SEQ ID NO: 1777082 - DNA, 18 bp, Homo sapiens
cacagttgaagggagggg

SEQ ID NO: 1777083 - DNA, 12 bp, Homo sapiens
cacagttggcct

SEQ ID NO: 1777084 - DNA, 23 bp, Homo sapiens
cacagttggccttcagaaccatc

SEQ ID NO: 1777085 - DNA, 20 bp, Homo sapiens
cacagttgtctattctgagc

SEQ ID NO: 1777086 - DNA, 23 bp, Homo sapiens
cacagttgtctattctgagcctt

SEQ ID NO: 1777087 - DNA, 24 bp, Homo sapiens
cacagttgtctattctgagccttg

SEQ ID NO: 1777088 - DNA, 20 bp, Homo sapiens
cacagtttagtgctttacat

SEQ ID NO: 1777089 - DNA, 12 bp, Homo sapiens
cacagtttgaac

SEQ ID NO: 1777090 - DNA, 18 bp, Homo sapiens
cacagttttaataagaac

SEQ ID NO: 1777091 - DNA, 15 bp, Homo sapiens
cacagttttgaaaga

SEQ ID NO: 1777092 - DNA, 22 bp, Homo sapiens
cacagttttgaaagaaaaatac

SEQ ID NO: 1777093 - DNA, 15 bp, Homo sapiens
cacataaatctgtct

SEQ ID NO: 1777094 - DNA, 22 bp, Homo sapiens
cacataaatctgtctgattcta

SEQ ID NO: 1777095 - DNA, 13 bp, Homo sapiens
cacataagaaaat

SEQ ID NO: 1777096 - DNA, 13 bp, Homo sapiens
cacataccaggtc

SEQ ID NO: 1777097 - DNA, 15 bp, Homo sapiens
cacataccctccccc

SEQ ID NO: 1777098 - DNA, 19 bp, Homo sapiens
cacataccctcttcatgga

SEQ ID NO: 1777099 - DNA, 19 bp, Homo sapiens
cacatactacctagaagta

SEQ ID NO: 1777100 - DNA, 20 bp, Homo sapiens
cacatactgacttcagtggg

SEQ ID NO: 1777101 - DNA, 16 bp, Homo sapiens
cacatactgtgttcca

SEQ ID NO: 1777102 - DNA, 13 bp, Homo sapiens
cacatagagcttt

SEQ ID NO: 1777103 - DNA, 23 bp, Homo sapiens
cacatagagctttttaatagcac

SEQ ID NO: 1777104 - DNA, 17 bp, Homo sapiens
cacatagcatgcttcct

SEQ ID NO: 1777105 - DNA, 22 bp, Homo sapiens
cacatagcatgcttcctttctc

SEQ ID NO: 1777106 - DNA, 19 bp, Homo sapiens
cacataggctggtggcctt

SEQ ID NO: 1777107 - DNA, 20 bp, Homo sapiens
cacataggctggtggccttg

SEQ ID NO: 1777108 - DNA, 21 bp, Homo sapiens
cacatataaacatcacacaca

SEQ ID NO: 1777109 - DNA, 13 bp, Homo sapiens
cacatatacatat

SEQ ID NO: 1777110 - DNA, 15 bp, Homo sapiens
cacatatacatatga

SEQ ID NO: 1777111 - DNA, 18 bp, Homo sapiens
cacatatgaacacagaca

SEQ ID NO: 1777112 - DNA, 21 bp, Homo sapiens
cacatatgcaccttgtgtctg

SEQ ID NO: 1777113 - DNA, 14 bp, Homo sapiens
cacatattttaaaa

SEQ ID NO: 1777114 - DNA, 17 bp, Homo sapiens
cacatattttaaaattt

SEQ ID NO: 1777115 - DNA, 14 bp, Homo sapiens
cacatcaaataaga

SEQ ID NO: 1777116 - DNA, 15 bp, Homo sapiens
cacatcagaaaggaa

SEQ ID NO: 1777117 - DNA, 13 bp, Homo sapiens
cacatcagcaatt

SEQ ID NO: 1777118 - DNA, 13 bp, Homo sapiens
cacatcagcttgc

SEQ ID NO: 1777119 - DNA, 18 bp, Homo sapiens
cacatccaactccagcaa

SEQ ID NO: 1777120 - DNA, 19 bp, Homo sapiens
cacatccaactccagcaac

SEQ ID NO: 1777121 - DNA, 19 bp, Homo sapiens
cacatccatcagcacccca

SEQ ID NO: 1777122 - DNA, 23 bp, Homo sapiens
cacatccatttcatctatttctg

SEQ ID NO: 1777123 - DNA, 12 bp, Homo sapiens
cacatcccaggc

SEQ ID NO: 1777124 - DNA, 15 bp, Homo sapiens
cacatccccagagcc

SEQ ID NO: 1777125 - DNA, 16 bp, Homo sapiens
cacatccccagagccc

SEQ ID NO: 1777126 - DNA, 22 bp, Homo sapiens
cacatccccagagcccagctct

SEQ ID NO: 1777127 - DNA, 14 bp, Homo sapiens
cacatcccggcctc

SEQ ID NO: 1777128 - DNA, 21 bp, Homo sapiens
cacatcccggcctcttccacc

SEQ ID NO: 1777129 - DNA, 18 bp, Homo sapiens
cacatccgcgtgtgcctg

SEQ ID NO: 1777130 - DNA, 22 bp, Homo sapiens
cacatccgcgtgtgcctgtgtg

SEQ ID NO: 1777131 - DNA, 23 bp, Homo sapiens
cacatccgcgtgtgcctgtgtgc

SEQ ID NO: 1777132 - DNA, 18 bp, Homo sapiens
cacatcctccgtccagcc

SEQ ID NO: 1777133 - DNA, 17 bp, Homo sapiens
cacatcctgtgtttcta

SEQ ID NO: 1777134 - DNA, 14 bp, Homo sapiens
cacatctctggaaa

SEQ ID NO: 1777135 - DNA, 13 bp, Homo sapiens
cacatctgcattt

SEQ ID NO: 1777136 - DNA, 12 bp, Homo sapiens
cacatctgcctt

SEQ ID NO: 1777137 - DNA, 13 bp, Homo sapiens
cacatctgcctta

SEQ ID NO: 1777138 - DNA, 15 bp, Homo sapiens
cacatctggccctga

SEQ ID NO: 1777139 - DNA, 15 bp, Homo sapiens
cacatctgggtgccc

SEQ ID NO: 1777140 - DNA, 16 bp, Homo sapiens
cacatctgggtgccct

SEQ ID NO: 1777141 - DNA, 19 bp, Homo sapiens
cacatctgggtgccctgaa

SEQ ID NO: 1777142 - DNA, 15 bp, Homo sapiens
cacatctgtttcaaa

SEQ ID NO: 1777143 - DNA, 23 bp, Homo sapiens
cacatcttaaagctaaaaatgaa

SEQ ID NO: 1777144 - DNA, 16 bp, Homo sapiens
cactcccccacctgac

SEQ ID NO: 1777145 - DNA, 15 bp, Homo sapiens
cactcccggcctagg

SEQ ID NO: 1777146 - DNA, 20 bp, Homo sapiens
cactcccggcctaggcacct

SEQ ID NO: 1777147 - DNA, 17 bp, Homo sapiens
cactccctctgccttca

SEQ ID NO: 1777148 - DNA, 13 bp, Homo sapiens
cactccctgagct

SEQ ID NO: 1777149 - DNA, 14 bp, Homo sapiens
cactccctggcctt

SEQ ID NO: 1777150 - DNA, 14 bp, Homo sapiens
cactcccttgctgg

SEQ ID NO: 1777151 - DNA, 22 bp, Homo sapiens
cactcccttgctggccccagcc

SEQ ID NO: 1777152 - DNA, 22 bp, Homo sapiens
cactccggtgtgcctgcagccc

SEQ ID NO: 1777153 - DNA, 13 bp, Homo sapiens
cactcctacctgg

SEQ ID NO: 1777154 - DNA, 22 bp, Homo sapiens
cactcctatccccaggccaggt

SEQ ID NO: 1777155 - DNA, 20 bp, Homo sapiens
cactcctctactcttacaga

SEQ ID NO: 1777156 - DNA, 20 bp, Homo sapiens
cactcctctctagggcagaa

SEQ ID NO: 1777157 - DNA, 21 bp, Homo sapiens
cactcctgcttaatcttcaaa

SEQ ID NO: 1777158 - DNA, 13 bp, Homo sapiens
cactcctgtacac

SEQ ID NO: 1777159 - DNA, 16 bp, Homo sapiens
cactcctgtcccgcct

SEQ ID NO: 1777160 - DNA, 18 bp, Homo sapiens
cactcctgtcccgccttc

SEQ ID NO: 1777161 - DNA, 20 bp, Homo sapiens
cactcctgtcccgccttcct

SEQ ID NO: 1777162 - DNA, 14 bp, Homo sapiens
cactcctgtccctg

SEQ ID NO: 1777163 - DNA, 15 bp, Homo sapiens
cactcctgtccctgt

SEQ ID NO: 1777164 - DNA, 23 bp, Homo sapiens
cactcctgtccctgtagctcagt

SEQ ID NO: 1777165 - DNA, 17 bp, Homo sapiens
cactcgagaccatcctg

SEQ ID NO: 1777166 - DNA, 19 bp, Homo sapiens
cactcgagaccatcctggc

SEQ ID NO: 1777167 - DNA, 22 bp, Homo sapiens
cactcgccatttcctcacgtgc

SEQ ID NO: 1777168 - DNA, 17 bp, Homo sapiens
cactcgcccgcccactg

SEQ ID NO: 1777169 - DNA, 18 bp, Homo sapiens
cactcgcccgcccactgt

SEQ ID NO: 1777170 - DNA, 21 bp, Homo sapiens
cactcgcttgccgggcctggg

SEQ ID NO: 1777171 - DNA, 20 bp, Homo sapiens
cactcgtaggggatgtggag

SEQ ID NO: 1777172 - DNA, 15 bp, Homo sapiens
cactctaccctccca

SEQ ID NO: 1777173 - DNA, 16 bp, Homo sapiens
cactctaccctcccac

SEQ ID NO: 1777174 - DNA, 21 bp, Homo sapiens
cactgccaggcacctggcctg

SEQ ID NO: 1777175 - DNA, 23 bp, Homo sapiens
cactgccaggcacctggcctgct

SEQ ID NO: 1777176 - DNA, 18 bp, Homo sapiens
cactgccaggccagcctc

SEQ ID NO: 1777177 - DNA, 20 bp, Homo sapiens
cactgccaggccagcctccg

SEQ ID NO: 1777178 - DNA, 13 bp, Homo sapiens
cactgccatattg

SEQ ID NO: 1777179 - DNA, 18 bp, Homo sapiens
cactgccatattgtgtaa

SEQ ID NO: 1777180 - DNA, 14 bp, Homo sapiens
cactgcccaccccc

SEQ ID NO: 1777181 - DNA, 19 bp, Homo sapiens
cactgccccccgaggctgc

SEQ ID NO: 1777182 - DNA, 22 bp, Homo sapiens
cactgccccccgaggctgctag

SEQ ID NO: 1777183 - DNA, 15 bp, Homo sapiens
cactgcccgaggcgc

SEQ ID NO: 1777184 - DNA, 20 bp, Homo sapiens
cactgccctgcctgcccact

SEQ ID NO: 1777185 - DNA, 20 bp, Homo sapiens
cactgccctttttgaaatca

SEQ ID NO: 1777186 - DNA, 19 bp, Homo sapiens
cactgcctaggaggctggc

SEQ ID NO: 1777187 - DNA, 10 bp, Homo sapiens
cactgcctga

SEQ ID NO: 1777188 - DNA, 23 bp, Homo sapiens
cactgcctgcagaggtctgtgct

SEQ ID NO: 1777189 - DNA, 12 bp, Homo sapiens
cactgcctgggc

SEQ ID NO: 1777190 - DNA, 15 bp, Homo sapiens
cactgcctgggctga

SEQ ID NO: 1777191 - DNA, 20 bp, Homo sapiens
cactgcgaagaccctcttgc

SEQ ID NO: 1777192 - DNA, 18 bp, Homo sapiens
cactgcgcaggtctcttc

SEQ ID NO: 1777193 - DNA, 20 bp, Homo sapiens
cactgcgcaggtctcttctg

SEQ ID NO: 1777194 - DNA, 14 bp, Homo sapiens
cactgcggaagcca

SEQ ID NO: 1777195 - DNA, 15 bp, Homo sapiens
cactgctcacgtctc

SEQ ID NO: 1777196 - DNA, 20 bp, Homo sapiens
cactgctcgtggactgtgct

SEQ ID NO: 1777197 - DNA, 15 bp, Homo sapiens
cactgctgcaaggtg

SEQ ID NO: 1777198 - DNA, 18 bp, Homo sapiens
cactgctgcaccagagtg

SEQ ID NO: 1777199 - DNA, 20 bp, Homo sapiens
cactgctgcaccagagtgaa

SEQ ID NO: 1777200 - DNA, 22 bp, Homo sapiens
cactgctgctgcctctgaaaca

SEQ ID NO: 1777201 - DNA, 13 bp, Homo sapiens
cactgctggacat

SEQ ID NO: 1777202 - DNA, 14 bp, Homo sapiens
cactgctggctgcc

SEQ ID NO: 1777203 - DNA, 13 bp, Homo sapiens
cactgctggggag

SEQ ID NO: 1777204 - DNA, 13 bp, Homo sapiens
cactgctgtaact

SEQ ID NO: 1777205 - DNA, 23 bp, Homo sapiens
cactgctgtccacatgacctcca

SEQ ID NO: 1777206 - DNA, 19 bp, Homo sapiens
cactgctgttcctgctcca

SEQ ID NO: 1777207 - DNA, 21 bp, Homo sapiens
cactgctgttcctgctccatg

SEQ ID NO: 1777208 - DNA, 17 bp, Homo sapiens
cactgcttctcttttga

SEQ ID NO: 1777209 - DNA, 16 bp, Homo sapiens
cactgctttccagcct

SEQ ID NO: 1777210 - DNA, 12 bp, Homo sapiens
cactggaaaggg

SEQ ID NO: 1777211 - DNA, 18 bp, Homo sapiens
cactggaaaggggagagc

SEQ ID NO: 1777212 - DNA, 12 bp, Homo sapiens
cactggaaggag

SEQ ID NO: 1777213 - DNA, 14 bp, Homo sapiens
cactggaaggagca

SEQ ID NO: 1777214 - DNA, 15 bp, Homo sapiens
cactggaaggagcac

SEQ ID NO: 1777215 - DNA, 17 bp, Homo sapiens
cactggaaggagcacat

SEQ ID NO: 1777216 - DNA, 23 bp, Homo sapiens
cactggaaggagcacatactacc

SEQ ID NO: 1777217 - DNA, 23 bp, Homo sapiens
cactggactgcatggggaggcag

SEQ ID NO: 1777218 - DNA, 16 bp, Homo sapiens
cactggagcaccaggc

SEQ ID NO: 1777219 - DNA, 17 bp, Homo sapiens
cactggagcaccaggca

SEQ ID NO: 1777220 - DNA, 20 bp, Homo sapiens
cactggagccatctcttcct

SEQ ID NO: 1777221 - DNA, 13 bp, Homo sapiens
cactggagcccag

SEQ ID NO: 1777222 - DNA, 14 bp, Homo sapiens
cactggagcccagg

SEQ ID NO: 1777223 - DNA, 15 bp, Homo sapiens
cactggagcccagga

SEQ ID NO: 1777224 - DNA, 14 bp, Homo sapiens
cactggaggagcag

SEQ ID NO: 1777225 - DNA, 16 bp, Homo sapiens
cactggaggagcagct

SEQ ID NO: 1777226 - DNA, 18 bp, Homo sapiens
cactggaggggcccaccc

SEQ ID NO: 1777227 - DNA, 23 bp, Homo sapiens
cactggaggggcccacccacatg

SEQ ID NO: 1777228 - DNA, 21 bp, Homo sapiens
cactggaggttgaagccaagt

SEQ ID NO: 1777229 - DNA, 16 bp, Homo sapiens
cactggagtgcaggga

SEQ ID NO: 1777230 - DNA, 21 bp, Homo sapiens
cactggattgactttgctgtc

SEQ ID NO: 1777231 - DNA, 20 bp, Homo sapiens
cactggcatagccctcctga

SEQ ID NO: 1777232 - DNA, 17 bp, Homo sapiens
cactggccaccaggctg

SEQ ID NO: 1777233 - DNA, 19 bp, Homo sapiens
cactggccaccaggctggc

SEQ ID NO: 1777234 - DNA, 20 bp, Homo sapiens
cactggccaccaggctggcg

SEQ ID NO: 1777235 - DNA, 15 bp, Homo sapiens
cactggccagagagg

SEQ ID NO: 1777236 - DNA, 21 bp, Homo sapiens
cactggccagagagggcccag

SEQ ID NO: 1777237 - DNA, 22 bp, Homo sapiens
cactggcctgggtctccctggt

SEQ ID NO: 1777238 - DNA, 23 bp, Homo sapiens
cactggcgcatcatatgcagtga

SEQ ID NO: 1777239 - DNA, 15 bp, Homo sapiens
cactggcgccttctc

SEQ ID NO: 1777240 - DNA, 18 bp, Homo sapiens
cactggcgccttctcgga

SEQ ID NO: 1777241 - DNA, 15 bp, Homo sapiens
cactggctctccaag

SEQ ID NO: 1777242 - DNA, 17 bp, Homo sapiens
cactggctctccaagtg

SEQ ID NO: 1777243 - DNA, 19 bp, Homo sapiens
cactggctggggcagaggg

SEQ ID NO: 1777244 - DNA, 22 bp, Homo sapiens
cactggctgtcagtatgacatt

SEQ ID NO: 1777245 - DNA, 19 bp, Homo sapiens
cactgggaagaagcaaggg

SEQ ID NO: 1777246 - DNA, 14 bp, Homo sapiens
cactgggacagctg

SEQ ID NO: 1777247 - DNA, 20 bp, Homo sapiens
cactgggcacctgcgcacag

SEQ ID NO: 1777248 - DNA, 21 bp, Homo sapiens
cactgggcacctgcgcacagg

SEQ ID NO: 1777249 - DNA, 16 bp, Homo sapiens
cactgggcagcaaggc

SEQ ID NO: 1777250 - DNA, 19 bp, Homo sapiens
cactgggccacggaggagg

SEQ ID NO: 1777251 - DNA, 19 bp, Homo sapiens
cactgggccagccctgcag

SEQ ID NO: 1777252 - DNA, 21 bp, Homo sapiens
cactgggccagccctgcagcc

SEQ ID NO: 1777253 - DNA, 23 bp, Homo sapiens
cactgggccagccctgcagccca

SEQ ID NO: 1777254 - DNA, 14 bp, Homo sapiens
cactgggcctggag

SEQ ID NO: 1777255 - DNA, 15 bp, Homo sapiens
cactgggcctggagc

SEQ ID NO: 1777256 - DNA, 18 bp, Homo sapiens
cactggggactttattta

SEQ ID NO: 1777257 - DNA, 16 bp, Homo sapiens
cactggggcctacagc

SEQ ID NO: 1777258 - DNA, 15 bp, Homo sapiens
cactggggtcctggg

SEQ ID NO: 1777259 - DNA, 20 bp, Homo sapiens
cactgggtctcactcctgag

SEQ ID NO: 1777260 - DNA, 18 bp, Homo sapiens
cactgggtgcgtctccag

SEQ ID NO: 1777261 - DNA, 19 bp, Homo sapiens
cactgggtggggtgaggac

SEQ ID NO: 1777262 - DNA, 14 bp, Homo sapiens
cactggtaaatgtt

SEQ ID NO: 1777263 - DNA, 22 bp, Homo sapiens
cactggtccccaacaatgtgag

SEQ ID NO: 1777264 - DNA, 17 bp, Homo sapiens
cactggtgaactgagct

SEQ ID NO: 1777265 - DNA, 21 bp, Homo sapiens
cactggtggcccgacagcctg

SEQ ID NO: 1777266 - DNA, 23 bp, Homo sapiens
cactggtggcccgacagcctggc

SEQ ID NO: 1777267 - DNA, 19 bp, Homo sapiens
cactggtgtgaactcaccc

SEQ ID NO: 1777268 - DNA, 15 bp, Homo sapiens
cactgtatgagtgga

SEQ ID NO: 1777269 - DNA, 21 bp, Homo sapiens
cactgtattagagcgccagct

SEQ ID NO: 1777270 - DNA, 14 bp, Homo sapiens
cactgtcaagatga

SEQ ID NO: 1777271 - DNA, 15 bp, Homo sapiens
cactgtcaggaagaa

SEQ ID NO: 1777272 - DNA, 16 bp, Homo sapiens
cactgtcatgcttcat

SEQ ID NO: 1777273 - DNA, 12 bp, Homo sapiens
cactgtcccttg

SEQ ID NO: 1777274 - DNA, 18 bp, Homo sapiens
cactgtcccttgcctcaa

SEQ ID NO: 1777275 - DNA, 11 bp, Homo sapiens
cactgtcctgg

SEQ ID NO: 1777276 - DNA, 18 bp, Homo sapiens
cactgtcctgggcctgca

SEQ ID NO: 1777277 - DNA, 19 bp, Homo sapiens
cactgtcctgggcgccctg

SEQ ID NO: 1777278 - DNA, 14 bp, Homo sapiens
cactgtccttccct

SEQ ID NO: 1777279 - DNA, 18 bp, Homo sapiens
cactgtccttccctgcca

SEQ ID NO: 1777280 - DNA, 19 bp, Homo sapiens
cactgtccttccctgccac

SEQ ID NO: 1777281 - DNA, 19 bp, Homo sapiens
cactgtcgcccaggctgga

SEQ ID NO: 1777282 - DNA, 22 bp, Homo sapiens
cactgtgaactcaatctccagg

SEQ ID NO: 1777283 - DNA, 19 bp, Homo sapiens
cactgtgaagacccagcag

SEQ ID NO: 1777284 - DNA, 15 bp, Homo sapiens
cactgtgaaggaccc

SEQ ID NO: 1777285 - DNA, 20 bp, Homo sapiens
cactgtgaatcctggcaaga

SEQ ID NO: 1777286 - DNA, 16 bp, Homo sapiens
cactgtgaccttgact

SEQ ID NO: 1777287 - DNA, 20 bp, Homo sapiens
cactgtgaggggaaggcctt

SEQ ID NO: 1777288 - DNA, 15 bp, Homo sapiens
cactgtgcacaccca

SEQ ID NO: 1777289 - DNA, 17 bp, Homo sapiens
cactgtgcccagcccgg

SEQ ID NO: 1777290 - DNA, 22 bp, Homo sapiens
cactgtgcccagcccggacctt

SEQ ID NO: 1777291 - DNA, 14 bp, Homo sapiens
cactgtgccctggt

SEQ ID NO: 1777292 - DNA, 16 bp, Homo sapiens
cactgtgccctggtgg

SEQ ID NO: 1777293 - DNA, 17 bp, Homo sapiens
cactgtgccctggtgga

SEQ ID NO: 1777294 - DNA, 13 bp, Homo sapiens
cactgtgcctcag

SEQ ID NO: 1777295 - DNA, 17 bp, Homo sapiens
cactgtgcctcagagac

SEQ ID NO: 1777296 - DNA, 16 bp, Homo sapiens
cactgtgctccaacct

SEQ ID NO: 1777297 - DNA, 15 bp, Homo sapiens
cactgtggccacagc

SEQ ID NO: 1777298 - DNA, 16 bp, Homo sapiens
cactgtggccagagct

SEQ ID NO: 1777299 - DNA, 19 bp, Homo sapiens
cactgtggccagagctgga

SEQ ID NO: 1777300 - DNA, 23 bp, Homo sapiens
cactgtggccagagctggaaggc

SEQ ID NO: 1777301 - DNA, 19 bp, Homo sapiens
cactgtggcgttctgctgc

SEQ ID NO: 1777302 - DNA, 20 bp, Homo sapiens
cactgtggcgttctgctgcc

SEQ ID NO: 1777303 - DNA, 22 bp, Homo sapiens
cactgtgtaagaagctgtgaat

SEQ ID NO: 1777304 - DNA, 21 bp, Homo sapiens
cactgtgtcacccagactgga

SEQ ID NO: 1777305 - DNA, 12 bp, Homo sapiens
cactgtgtcctg

SEQ ID NO: 1777306 - DNA, 15 bp, Homo sapiens
cactgtgtgctgact

SEQ ID NO: 1777307 - DNA, 18 bp, Homo sapiens
cactgtgttactgctttg

SEQ ID NO: 1777308 - DNA, 23 bp, Homo sapiens
cactgttactttcgtacattggc

SEQ ID NO: 1777309 - DNA, 13 bp, Homo sapiens
cactgttccctct

SEQ ID NO: 1777310 - DNA, 23 bp, Homo sapiens
cactgttgagccccagtgctgga

SEQ ID NO: 1777311 - DNA, 16 bp, Homo sapiens
cactgttttatagaaa

SEQ ID NO: 1777312 - DNA, 18 bp, Homo sapiens
cactgttttatctctgtg

SEQ ID NO: 1777313 - DNA, 22 bp, Homo sapiens
cactgttttgaatctcataatt

SEQ ID NO: 1777314 - DNA, 13 bp, Homo sapiens
cacttaacagatg

SEQ ID NO: 1777315 - DNA, 18 bp, Homo sapiens
cacttaagtgcacttttt

SEQ ID NO: 1777316 - DNA, 19 bp, Homo sapiens
cacttaagtgcactttttt

SEQ ID NO: 1777317 - DNA, 17 bp, Homo sapiens
cacttaagttagcctcc

SEQ ID NO: 1777318 - DNA, 13 bp, Homo sapiens
cacttaataattt

SEQ ID NO: 1777319 - DNA, 16 bp, Homo sapiens
cacttacactttatgc

SEQ ID NO: 1777320 - DNA, 18 bp, Homo sapiens
cacttacactttatgcac

SEQ ID NO: 1777321 - DNA, 19 bp, Homo sapiens
cacttagccgcaccctgca

SEQ ID NO: 1777322 - DNA, 22 bp, Homo sapiens
cacttagccgtccatggcacca

SEQ ID NO: 1777323 - DNA, 16 bp, Homo sapiens
cacttatattttatga

SEQ ID NO: 1777324 - DNA, 15 bp, Homo sapiens
cacttatcagcatga

SEQ ID NO: 1777325 - DNA, 14 bp, Homo sapiens
cacttatcttctgg

SEQ ID NO: 1777326 - DNA, 15 bp, Homo sapiens
cacttatcttctgga

SEQ ID NO: 1777327 - DNA, 17 bp, Homo sapiens
cacttatcttctggatt

SEQ ID NO: 1777328 - DNA, 13 bp, Homo sapiens
cacttatttgtca

SEQ ID NO: 1777329 - DNA, 12 bp, Homo sapiens
cacttattttct

SEQ ID NO: 1777330 - DNA, 13 bp, Homo sapiens
cacttcaaccccc

SEQ ID NO: 1777331 - DNA, 22 bp, Homo sapiens
cacttcaacccccagctaataa

SEQ ID NO: 1777332 - DNA, 14 bp, Homo sapiens
cacttcacccccaa

SEQ ID NO: 1777333 - DNA, 15 bp, Homo sapiens
cacttcactgtgagg

SEQ ID NO: 1777334 - DNA, 15 bp, Homo sapiens
cacttcaggctcttc

SEQ ID NO: 1777335 - DNA, 23 bp, Homo sapiens
cacttcaggctcttctcctttca

SEQ ID NO: 1777336 - DNA, 19 bp, Homo sapiens
cacttcatggaccaagaat

SEQ ID NO: 1777337 - DNA, 22 bp, Homo sapiens
cacttcattcttgaaagctgtg

SEQ ID NO: 1777338 - DNA, 15 bp, Homo sapiens
cacttccaccagcct

SEQ ID NO: 1777339 - DNA, 16 bp, Homo sapiens
cacttccaccagcctg

SEQ ID NO: 1777340 - DNA, 12 bp, Homo sapiens
cacttccagggg

SEQ ID NO: 1777341 - DNA, 17 bp, Homo sapiens
cacttccaggggaacct

SEQ ID NO: 1777342 - DNA, 13 bp, Homo sapiens
cacttccagggtt

SEQ ID NO: 1777343 - DNA, 12 bp, Homo sapiens
cacttccagtgt

SEQ ID NO: 1777344 - DNA, 20 bp, Homo sapiens
cacttccagtgttggctgtg

SEQ ID NO: 1777345 - DNA, 23 bp, Homo sapiens
cacttccagtgttggctgtgtga

SEQ ID NO: 1777346 - DNA, 16 bp, Homo sapiens
cacttcccaccctgcc

SEQ ID NO: 1777347 - DNA, 12 bp, Homo sapiens
cacttcccagga

SEQ ID NO: 1777348 - DNA, 14 bp, Homo sapiens
cacttccccctctt

SEQ ID NO: 1777349 - DNA, 21 bp, Homo sapiens
cacttccccctcttcttctga

SEQ ID NO: 1777350 - DNA, 20 bp, Homo sapiens
cacttcccctccaagaccct

SEQ ID NO: 1777351 - DNA, 17 bp, Homo sapiens
cacttcccgtctcagaa

SEQ ID NO: 1777352 - DNA, 16 bp, Homo sapiens
cacttccctacatgga

SEQ ID NO: 1777353 - DNA, 15 bp, Homo sapiens
cacttccctctgttt

SEQ ID NO: 1777354 - DNA, 18 bp, Homo sapiens
cacttccctgcttaaatt

SEQ ID NO: 1777355 - DNA, 13 bp, Homo sapiens
cacttcctgccta

SEQ ID NO: 1777356 - DNA, 19 bp, Homo sapiens
cacttctaagaaaagccta

SEQ ID NO: 1777357 - DNA, 18 bp, Homo sapiens
cacttctagatctcagcc

SEQ ID NO: 1777358 - DNA, 13 bp, Homo sapiens
cacttctatgcaa

SEQ ID NO: 1777359 - DNA, 12 bp, Homo sapiens
cacttctattta

SEQ ID NO: 1777360 - DNA, 16 bp, Homo sapiens
cacttctatttaatgc

SEQ ID NO: 1777361 - DNA, 17 bp, Homo sapiens
cacttctcatcatattg

SEQ ID NO: 1777362 - DNA, 23 bp, Homo sapiens
cacttctcatcatattgtatgta

SEQ ID NO: 1777363 - DNA, 12 bp, Homo sapiens
cacttctgcttt

SEQ ID NO: 1777364 - DNA, 14 bp, Homo sapiens
cacttctgctttca

SEQ ID NO: 1777365 - DNA, 20 bp, Homo sapiens
cacttctgggcttcatctgg

SEQ ID NO: 1777366 - DNA, 19 bp, Homo sapiens
cacttctgggtggggcagt

SEQ ID NO: 1777367 - DNA, 17 bp, Homo sapiens
cacttctgtctcctgtc

SEQ ID NO: 1777368 - DNA, 21 bp, Homo sapiens
cacttctgtctcctgtcttca

SEQ ID NO: 1777369 - DNA, 24 bp, Homo sapiens
cacttctgtctcctgtcttcagag

SEQ ID NO: 1777370 - DNA, 22 bp, Homo sapiens
cacttctgtgagacccccacac

SEQ ID NO: 1777371 - DNA, 15 bp, Homo sapiens
cagagaattctctta

SEQ ID NO: 1777372 - DNA, 13 bp, Homo sapiens
cagagaatttcta

SEQ ID NO: 1777373 - DNA, 12 bp, Homo sapiens
cagagacaaaat

SEQ ID NO: 1777374 - DNA, 14 bp, Homo sapiens
cagagacaacaggt

SEQ ID NO: 1777375 - DNA, 20 bp, Homo sapiens
cagagacaagaaaggcagac

SEQ ID NO: 1777376 - DNA, 13 bp, Homo sapiens
cagagacaaggag

SEQ ID NO: 1777377 - DNA, 20 bp, Homo sapiens
cagagacaaggagggcacag

SEQ ID NO: 1777378 - DNA, 22 bp, Homo sapiens
cagagacacctgcacctccccc

SEQ ID NO: 1777379 - DNA, 15 bp, Homo sapiens
cagagacaggaaaat

SEQ ID NO: 1777380 - DNA, 23 bp, Homo sapiens
cagagacaggaaaatcctctggc

SEQ ID NO: 1777381 - DNA, 14 bp, Homo sapiens
cagagacaggccca

SEQ ID NO: 1777382 - DNA, 19 bp, Homo sapiens
cagagacaggcccaagaga

SEQ ID NO: 1777383 - DNA, 22 bp, Homo sapiens
cagagacagggaaaggtcagcc

SEQ ID NO: 1777384 - DNA, 15 bp, Homo sapiens
cagagacaggtggcc

SEQ ID NO: 1777385 - DNA, 15 bp, Homo sapiens
cagagacatacttga

SEQ ID NO: 1777386 - DNA, 14 bp, Homo sapiens
cagagaccagcact

SEQ ID NO: 1777387 - DNA, 15 bp, Homo sapiens
cagagaccagcactc

SEQ ID NO: 1777388 - DNA, 12 bp, Homo sapiens
cagagaccaggg

SEQ ID NO: 1777389 - DNA, 21 bp, Homo sapiens
cagagaccagggctccagccc

SEQ ID NO: 1777390 - DNA, 17 bp, Homo sapiens
cagagacccaacagcag

SEQ ID NO: 1777391 - DNA, 21 bp, Homo sapiens
cagagacccagatctcatgga

SEQ ID NO: 1777392 - DNA, 18 bp, Homo sapiens
cagagcctagccacctcc

SEQ ID NO: 1777393 - DNA, 20 bp, Homo sapiens
cagagcctagccacctccca

SEQ ID NO: 1777394 - DNA, 22 bp, Homo sapiens
cagagcctagccacctcccacc

SEQ ID NO: 1777395 - DNA, 15 bp, Homo sapiens
cagagccttctcaga

SEQ ID NO: 1777396 - DNA, 19 bp, Homo sapiens
cagagccttctcagaagca

SEQ ID NO: 1777397 - DNA, 20 bp, Homo sapiens
cagagcgagactccatctct

SEQ ID NO: 1777398 - DNA, 20 bp, Homo sapiens
cagagcgagactccgtctca

SEQ ID NO: 1777399 - DNA, 20 bp, Homo sapiens
cagagcgagagtctgtctca

SEQ ID NO: 1777400 - DNA, 20 bp, Homo sapiens
cagagcgaggaaaggatttt

SEQ ID NO: 1777401 - DNA, 13 bp, Homo sapiens
cagagcgcacagg

SEQ ID NO: 1777402 - DNA, 22 bp, Homo sapiens
cagagcgtccttccccctgtag

SEQ ID NO: 1777403 - DNA, 21 bp, Homo sapiens
cagagctaaactccttcctgg

SEQ ID NO: 1777404 - DNA, 22 bp, Homo sapiens
cagagctaaactccttcctggc

SEQ ID NO: 1777405 - DNA, 22 bp, Homo sapiens
cagagctaactgggttacagtg

SEQ ID NO: 1777406 - DNA, 16 bp, Homo sapiens
cagagctactgagact

SEQ ID NO: 1777407 - DNA, 23 bp, Homo sapiens
cagagctctcccctcctgctggg

SEQ ID NO: 1777408 - DNA, 13 bp, Homo sapiens
cagagctctgggt

SEQ ID NO: 1777409 - DNA, 22 bp, Homo sapiens
cagagctcttcaagctgtcccc

SEQ ID NO: 1777410 - DNA, 13 bp, Homo sapiens
cagagctgaccca

SEQ ID NO: 1777411 - DNA, 18 bp, Homo sapiens
cagagctgagggccctgt

SEQ ID NO: 1777412 - DNA, 20 bp, Homo sapiens
cagagctgagggccctgtgg

SEQ ID NO: 1777413 - DNA, 21 bp, Homo sapiens
cagagctgagggccctgtgga

SEQ ID NO: 1777414 - DNA, 13 bp, Homo sapiens
cagagctggaagg

SEQ ID NO: 1777415 - DNA, 16 bp, Homo sapiens
cagagctggaaggcag

SEQ ID NO: 1777416 - DNA, 21 bp, Homo sapiens
cagagctggaaggcagggcag

SEQ ID NO: 1777417 - DNA, 13 bp, Homo sapiens
cagagctggctct

SEQ ID NO: 1777418 - DNA, 13 bp, Homo sapiens
cagagctgtgcca

SEQ ID NO: 1777419 - DNA, 17 bp, Homo sapiens
cagagctgtgccagcag

SEQ ID NO: 1777420 - DNA, 17 bp, Homo sapiens
cagattcccagagcaaa

SEQ ID NO: 1777421 - DNA, 19 bp, Homo sapiens
cagattcccagagcaaaat

SEQ ID NO: 1777422 - DNA, 21 bp, Homo sapiens
cagattcccagagcaaaataa

SEQ ID NO: 1777423 - DNA, 21 bp, Homo sapiens
cagattcctgggcctgtcccc

SEQ ID NO: 1777424 - DNA, 17 bp, Homo sapiens
cagattcctttgtatca

SEQ ID NO: 1777425 - DNA, 13 bp, Homo sapiens
cagattctcttga

SEQ ID NO: 1777426 - DNA, 17 bp, Homo sapiens
cagattggctcacactg

SEQ ID NO: 1777427 - DNA, 20 bp, Homo sapiens
cagattggctcacactgaga

SEQ ID NO: 1777428 - DNA, 16 bp, Homo sapiens
cagattgggataaggc

SEQ ID NO: 1777429 - DNA, 12 bp, Homo sapiens
cagattgtgtac

SEQ ID NO: 1777430 - DNA, 13 bp, Homo sapiens
cagattgtgtaca

SEQ ID NO: 1777431 - DNA, 19 bp, Homo sapiens
cagatttaagccttacaaa

SEQ ID NO: 1777432 - DNA, 13 bp, Homo sapiens
cagatttaataca

SEQ ID NO: 1777433 - DNA, 17 bp, Homo sapiens
cagatttctggttgatt

SEQ ID NO: 1777434 - DNA, 13 bp, Homo sapiens
cagatttctgtaa

SEQ ID NO: 1777435 - DNA, 15 bp, Homo sapiens
cagatttgaggctgg

SEQ ID NO: 1777436 - DNA, 21 bp, Homo sapiens
cagattttaaattttatgtca

SEQ ID NO: 1777437 - DNA, 22 bp, Homo sapiens
cagattttaagggggaaaactg

SEQ ID NO: 1777438 - DNA, 16 bp, Homo sapiens
cagattttacaaaaga

SEQ ID NO: 1777439 - DNA, 17 bp, Homo sapiens
cagattttacaaaagat

SEQ ID NO: 1777440 - DNA, 15 bp, Homo sapiens
cagattttatttgta

SEQ ID NO: 1777441 - DNA, 15 bp, Homo sapiens
cagattttcagcaaa

SEQ ID NO: 1777442 - DNA, 19 bp, Homo sapiens
cagattttcagcaaactct

SEQ ID NO: 1777443 - DNA, 13 bp, Homo sapiens
cagcaaaagacca

SEQ ID NO: 1777444 - DNA, 14 bp, Homo sapiens
cagcaaacaggtgc

SEQ ID NO: 1777445 - DNA, 11 bp, Homo sapiens
cagcaaaccat

SEQ ID NO: 1777446 - DNA, 12 bp, Homo sapiens
cagcaaaccatt

SEQ ID NO: 1777447 - DNA, 21 bp, Homo sapiens
cagcaaaccatttttaaagta

SEQ ID NO: 1777448 - DNA, 23 bp, Homo sapiens
cagcaaagcaaatgttgggaaag

SEQ ID NO: 1777449 - DNA, 14 bp, Homo sapiens
cagcaaagcagctg

SEQ ID NO: 1777450 - DNA, 15 bp, Homo sapiens
cagcaaagcttggtg

SEQ ID NO: 1777451 - DNA, 14 bp, Homo sapiens
cagcaaaggaaact

SEQ ID NO: 1777452 - DNA, 23 bp, Homo sapiens
cagcaaaggaaactttgcagatg

SEQ ID NO: 1777453 - DNA, 13 bp, Homo sapiens
cagcaaaggaact

SEQ ID NO: 1777454 - DNA, 22 bp, Homo sapiens
cagcaaatgcaaaaactctttg

SEQ ID NO: 1777455 - DNA, 15 bp, Homo sapiens
cagcaacaagactgc

SEQ ID NO: 1777456 - DNA, 13 bp, Homo sapiens
cagcaacagaaaa

SEQ ID NO: 1777457 - DNA, 14 bp, Homo sapiens
cagcaacagaaaaa

SEQ ID NO: 1777458 - DNA, 19 bp, Homo sapiens
cagcaacaggaatctcaga

SEQ ID NO: 1777459 - DNA, 21 bp, Homo sapiens
cagcaacaggaatctcagaga

SEQ ID NO: 1777460 - DNA, 23 bp, Homo sapiens
cagcaacaggaatctcagagaca

SEQ ID NO: 1777461 - DNA, 18 bp, Homo sapiens
cagcaacatctcgagccc

SEQ ID NO: 1777462 - DNA, 13 bp, Homo sapiens
cagcaacgcccct

SEQ ID NO: 1777463 - DNA, 16 bp, Homo sapiens
cagcaacgcccctcca

SEQ ID NO: 1777464 - DNA, 18 bp, Homo sapiens
cagcaacgcttgtagaac

SEQ ID NO: 1777465 - DNA, 20 bp, Homo sapiens
cagcaacggcacagctaatt

SEQ ID NO: 1777466 - DNA, 18 bp, Homo sapiens
cagcaacttgtctttttc

SEQ ID NO: 1777467 - DNA, 19 bp, Homo sapiens
cagcaacttgtctttttct

SEQ ID NO: 1777468 - DNA, 22 bp, Homo sapiens
cagcaacttgtctttttctgga

SEQ ID NO: 1777469 - DNA, 12 bp, Homo sapiens
cagcaagaagct

SEQ ID NO: 1777470 - DNA, 15 bp, Homo sapiens
cagcaagaatattgt

SEQ ID NO: 1777471 - DNA, 13 bp, Homo sapiens
cagcaagacctca

SEQ ID NO: 1777472 - DNA, 16 bp, Homo sapiens
cagcaagagcacaaga

SEQ ID NO: 1777473 - DNA, 14 bp, Homo sapiens
cagcaagaggagga

SEQ ID NO: 1777474 - DNA, 16 bp, Homo sapiens
cagcaagagtaagcag

SEQ ID NO: 1777475 - DNA, 19 bp, Homo sapiens
cagcaagccctacagagct

SEQ ID NO: 1777476 - DNA, 11 bp, Homo sapiens
cagcactgaaa

SEQ ID NO: 1777477 - DNA, 17 bp, Homo sapiens
cagcactgaggaagaac

SEQ ID NO: 1777478 - DNA, 18 bp, Homo sapiens
cagcactgatggaaaata

SEQ ID NO: 1777479 - DNA, 21 bp, Homo sapiens
cagcactggaggggcccaccc

SEQ ID NO: 1777480 - DNA, 22 bp, Homo sapiens
cagcactggaggggcccaccca

SEQ ID NO: 1777481 - DNA, 14 bp, Homo sapiens
cagcactgtccctt

SEQ ID NO: 1777482 - DNA, 20 bp, Homo sapiens
cagcactttagatcacttga

SEQ ID NO: 1777483 - DNA, 23 bp, Homo sapiens
cagcactttgagaggctgaggtg

SEQ ID NO: 1777484 - DNA, 20 bp, Homo sapiens
cagcactttgggaggcaggg

SEQ ID NO: 1777485 - DNA, 22 bp, Homo sapiens
cagcactttgggaggccaagga

SEQ ID NO: 1777486 - DNA, 23 bp, Homo sapiens
cagcactttgggaggctgaggcg

SEQ ID NO: 1777487 - DNA, 18 bp, Homo sapiens
cagcagaacctgcacaca

SEQ ID NO: 1777488 - DNA, 19 bp, Homo sapiens
cagcagaacctgcacacag

SEQ ID NO: 1777489 - DNA, 21 bp, Homo sapiens
cagcagaacctgcacacagga

SEQ ID NO: 1777490 - DNA, 15 bp, Homo sapiens
cagcagaatggaggc

SEQ ID NO: 1777491 - DNA, 14 bp, Homo sapiens
cagcagacagagcc

SEQ ID NO: 1777492 - DNA, 21 bp, Homo sapiens
cagcagacagagccaggagaa

SEQ ID NO: 1777493 - DNA, 17 bp, Homo sapiens
cagcagagaaccatcaa

SEQ ID NO: 1777494 - DNA, 14 bp, Homo sapiens
cagcagagcggggt

SEQ ID NO: 1777495 - DNA, 22 bp, Homo sapiens
cagcagaggcgtactacccagc

SEQ ID NO: 1777496 - DNA, 16 bp, Homo sapiens
cagcagagtgagcaag

SEQ ID NO: 1777497 - DNA, 22 bp, Homo sapiens
cagcagagttattgaatcttaa

SEQ ID NO: 1777498 - DNA, 15 bp, Homo sapiens
cagcagatcccagct

SEQ ID NO: 1777499 - DNA, 12 bp, Homo sapiens
cagcagcacacc

SEQ ID NO: 1777500 - DNA, 14 bp, Homo sapiens
cagcagcaccaacc

SEQ ID NO: 1777501 - DNA, 14 bp, Homo sapiens
cagcagcagcaggt

SEQ ID NO: 1777502 - DNA, 16 bp, Homo sapiens
cagcagcagcaggtga

SEQ ID NO: 1777503 - DNA, 16 bp, Homo sapiens
cagcagcagcccaagc

SEQ ID NO: 1777504 - DNA, 13 bp, Homo sapiens
cagcagcaggtga

SEQ ID NO: 1777505 - DNA, 16 bp, Homo sapiens
cagcagccactgcaca

SEQ ID NO: 1777506 - DNA, 13 bp, Homo sapiens
cagcagccagtct

SEQ ID NO: 1777507 - DNA, 15 bp, Homo sapiens
cagcagccagtctca

SEQ ID NO: 1777508 - DNA, 24 bp, Homo sapiens
cagcagccagtctcagagaccagc

SEQ ID NO: 1777509 - DNA, 18 bp, Homo sapiens
cagcagccatcataggaa

SEQ ID NO: 1777510 - DNA, 22 bp, Homo sapiens
cagcagccatcataggaaggga

SEQ ID NO: 1777511 - DNA, 22 bp, Homo sapiens
cagcatgtgtatttccagtgca

SEQ ID NO: 1777512 - DNA, 18 bp, Homo sapiens
cagcatgttgctgaggag

SEQ ID NO: 1777513 - DNA, 22 bp, Homo sapiens
cagcattcaaaatagttctatt

SEQ ID NO: 1777514 - DNA, 12 bp, Homo sapiens
cagcattccagc

SEQ ID NO: 1777515 - DNA, 17 bp, Homo sapiens
cagcattccagctctgc

SEQ ID NO: 1777516 - DNA, 15 bp, Homo sapiens
cagcattctcactcc

SEQ ID NO: 1777517 - DNA, 13 bp, Homo sapiens
cagcattctggag

SEQ ID NO: 1777518 - DNA, 16 bp, Homo sapiens
cagcattgctggttct

SEQ ID NO: 1777519 - DNA, 14 bp, Homo sapiens
cagcattgtctttg

SEQ ID NO: 1777520 - DNA, 22 bp, Homo sapiens
cagcattgtctttgctgtactc

SEQ ID NO: 1777521 - DNA, 13 bp, Homo sapiens
cagcatttactat

SEQ ID NO: 1777522 - DNA, 23 bp, Homo sapiens
cagcatttactatgcacaacaga

SEQ ID NO: 1777523 - DNA, 21 bp, Homo sapiens
cagcatttagctggccacatg

SEQ ID NO: 1777524 - DNA, 16 bp, Homo sapiens
cagcatttcttttctg

SEQ ID NO: 1777525 - DNA, 19 bp, Homo sapiens
cagcatttgctttcctctg

SEQ ID NO: 1777526 - DNA, 14 bp, Homo sapiens
cagcatttggtttt

SEQ ID NO: 1777527 - DNA, 20 bp, Homo sapiens
cagcattttaaggttctcag

SEQ ID NO: 1777528 - DNA, 16 bp, Homo sapiens
cagccaaaccctgtct

SEQ ID NO: 1777529 - DNA, 16 bp, Homo sapiens
cagccaacgagacaca

SEQ ID NO: 1777530 - DNA, 17 bp, Homo sapiens
cagccaacgagacacat

SEQ ID NO: 1777531 - DNA, 20 bp, Homo sapiens
cagccaacgagacacattgc

SEQ ID NO: 1777532 - DNA, 23 bp, Homo sapiens
cagccaacgagacacattgcctt

SEQ ID NO: 1777533 - DNA, 16 bp, Homo sapiens
cagccaactagcccct

SEQ ID NO: 1777534 - DNA, 19 bp, Homo sapiens
cagccaactagcccctggg

SEQ ID NO: 1777535 - DNA, 15 bp, Homo sapiens
cagccaagcacctcc

SEQ ID NO: 1777536 - DNA, 21 bp, Homo sapiens
cagccaaggccgaagctctgg

SEQ ID NO: 1777537 - DNA, 16 bp, Homo sapiens
cagccaaggccgccag

SEQ ID NO: 1777538 - DNA, 21 bp, Homo sapiens
cagcctgctctagtgggacag

SEQ ID NO: 1777539 - DNA, 13 bp, Homo sapiens
cagcctgctgaca

SEQ ID NO: 1777540 - DNA, 20 bp, Homo sapiens
cagcctgctgacagacacta

SEQ ID NO: 1777541 - DNA, 22 bp, Homo sapiens
cagcctggactttggttctctc

SEQ ID NO: 1777542 - DNA, 17 bp, Homo sapiens
cagcctggatctcctca

SEQ ID NO: 1777543 - DNA, 10 bp, Homo sapiens
cagcctggca

SEQ ID NO: 1777544 - DNA, 20 bp, Homo sapiens
cagcctggcacagggcagtg

SEQ ID NO: 1777545 - DNA, 20 bp, Homo sapiens
cagcctggccaacatgctga

SEQ ID NO: 1777546 - DNA, 17 bp, Homo sapiens
cagcctggccacgcagc

SEQ ID NO: 1777547 - DNA, 20 bp, Homo sapiens
cagcctggccacgcagccag

SEQ ID NO: 1777548 - DNA, 13 bp, Homo sapiens
cagcctggccaga

SEQ ID NO: 1777549 - DNA, 20 bp, Homo sapiens
cagcctggccagacacaggc

SEQ ID NO: 1777550 - DNA, 13 bp, Homo sapiens
cagcctggctccc

SEQ ID NO: 1777551 - DNA, 19 bp, Homo sapiens
cagcctggctcccaggaca

SEQ ID NO: 1777552 - DNA, 21 bp, Homo sapiens
cagcctggctcccaggacacg

SEQ ID NO: 1777553 - DNA, 18 bp, Homo sapiens
cagcctggctctgccccc

SEQ ID NO: 1777554 - DNA, 22 bp, Homo sapiens
cagcctggctctgccccctccc

SEQ ID NO: 1777555 - DNA, 21 bp, Homo sapiens
cagcctggcttctggagccct

SEQ ID NO: 1777556 - DNA, 20 bp, Homo sapiens
cagcctgggactcccagtga

SEQ ID NO: 1777557 - DNA, 19 bp, Homo sapiens
cagcctgggagcccagagg

SEQ ID NO: 1777558 - DNA, 17 bp, Homo sapiens
cagcctgggcagccagg

SEQ ID NO: 1777559 - DNA, 21 bp, Homo sapiens
cagcctgggcagccaggctgc

SEQ ID NO: 1777560 - DNA, 12 bp, Homo sapiens
cagcctgggccc

SEQ ID NO: 1777561 - DNA, 15 bp, Homo sapiens
cagcctgggccccag

SEQ ID NO: 1777562 - DNA, 19 bp, Homo sapiens
cagcctgggcgacaaaaac

SEQ ID NO: 1777563 - DNA, 18 bp, Homo sapiens
cagcctggggaccccact

SEQ ID NO: 1777564 - DNA, 12 bp, Homo sapiens
cagcctggggct

SEQ ID NO: 1777565 - DNA, 16 bp, Homo sapiens
cagcctggggctccct

SEQ ID NO: 1777566 - DNA, 15 bp, Homo sapiens
cagcctggtgcccat

SEQ ID NO: 1777567 - DNA, 23 bp, Homo sapiens
cagcctggtgggcctcctctgtc

SEQ ID NO: 1777568 - DNA, 17 bp, Homo sapiens
cagcctgtgcctgcctt

SEQ ID NO: 1777569 - DNA, 16 bp, Homo sapiens
cagcctgtgctgcccg

SEQ ID NO: 1777570 - DNA, 21 bp, Homo sapiens
cagcctgtggcatctttgcct

SEQ ID NO: 1777571 - DNA, 18 bp, Homo sapiens
cagcctgtggcggtgcct

SEQ ID NO: 1777572 - DNA, 21 bp, Homo sapiens
cagcctgtggcggtgcctggg

SEQ ID NO: 1777573 - DNA, 20 bp, Homo sapiens
cagcctgtggttacagtgca

SEQ ID NO: 1777574 - DNA, 22 bp, Homo sapiens
cagccttcaagaatcagaagaa

SEQ ID NO: 1777575 - DNA, 19 bp, Homo sapiens
cagccttcacttttctgag

SEQ ID NO: 1777576 - DNA, 18 bp, Homo sapiens
cagccttcagcagcagct

SEQ ID NO: 1777577 - DNA, 14 bp, Homo sapiens
cagccttccccctc

SEQ ID NO: 1777578 - DNA, 18 bp, Homo sapiens
cagctcttctcttcctag

SEQ ID NO: 1777579 - DNA, 16 bp, Homo sapiens
cagctcttgcccttcc

SEQ ID NO: 1777580 - DNA, 20 bp, Homo sapiens
cagctcttgcccttccctgt

SEQ ID NO: 1777581 - DNA, 16 bp, Homo sapiens
cagctcttggcccctg

SEQ ID NO: 1777582 - DNA, 18 bp, Homo sapiens
cagctctttccaaattaa

SEQ ID NO: 1777583 - DNA, 14 bp, Homo sapiens
cagctgaaggcagt

SEQ ID NO: 1777584 - DNA, 20 bp, Homo sapiens
cagctgaagtcaaaatatgt

SEQ ID NO: 1777585 - DNA, 22 bp, Homo sapiens
cagctgaagtcaaaatatgtaa

SEQ ID NO: 1777586 - DNA, 21 bp, Homo sapiens
cagctgacatcttgaatcctt

SEQ ID NO: 1777587 - DNA, 13 bp, Homo sapiens
cagctgactaaac

SEQ ID NO: 1777588 - DNA, 13 bp, Homo sapiens
cagctgactgtgg

SEQ ID NO: 1777589 - DNA, 16 bp, Homo sapiens
cagctgactgtggccc

SEQ ID NO: 1777590 - DNA, 20 bp, Homo sapiens
cagctgagagccctgctgtg

SEQ ID NO: 1777591 - DNA, 14 bp, Homo sapiens
cagctgagatgtgg

SEQ ID NO: 1777592 - DNA, 20 bp, Homo sapiens
cagctgagcttgagctcccc

SEQ ID NO: 1777593 - DNA, 12 bp, Homo sapiens
cagctgaggctg

SEQ ID NO: 1777594 - DNA, 18 bp, Homo sapiens
cagctgagtgaaaaatct

SEQ ID NO: 1777595 - DNA, 18 bp, Homo sapiens
cagctgagttatgatgta

SEQ ID NO: 1777596 - DNA, 20 bp, Homo sapiens
cagctgatccataggactac

SEQ ID NO: 1777597 - DNA, 17 bp, Homo sapiens
cagctgatgcctccttg

SEQ ID NO: 1777598 - DNA, 20 bp, Homo sapiens
cagctgatgttggaagagaa

SEQ ID NO: 1777599 - DNA, 14 bp, Homo sapiens
cagctgcacattcc

SEQ ID NO: 1777600 - DNA, 18 bp, Homo sapiens
cagctgcacctgccagcc

SEQ ID NO: 1777601 - DNA, 14 bp, Homo sapiens
cagctgcagaccat

SEQ ID NO: 1777602 - DNA, 17 bp, Homo sapiens
cagctgcagctgatcca

SEQ ID NO: 1777603 - DNA, 15 bp, Homo sapiens
cagctgcagctgggc

SEQ ID NO: 1777604 - DNA, 15 bp, Homo sapiens
cagctgcagtcaaca

SEQ ID NO: 1777605 - DNA, 16 bp, Homo sapiens
cagctgcattccgcag

SEQ ID NO: 1777606 - DNA, 23 bp, Homo sapiens
cagctgcatttcacatgccttgc

SEQ ID NO: 1777607 - DNA, 12 bp, Homo sapiens
cagctgccaagc

SEQ ID NO: 1777608 - DNA, 11 bp, Homo sapiens
cagctgcccag

SEQ ID NO: 1777609 - DNA, 13 bp, Homo sapiens
cagctgcccagac

SEQ ID NO: 1777610 - DNA, 14 bp, Homo sapiens
cagctgcccagaca

SEQ ID NO: 1777611 - DNA, 15 bp, Homo sapiens
cagctgcccagacac

SEQ ID NO: 1777612 - DNA, 16 bp, Homo sapiens
cagctgcccagacaca

SEQ ID NO: 1777613 - DNA, 20 bp, Homo sapiens
cagctgcccagacacatggg

SEQ ID NO: 1777614 - DNA, 20 bp, Homo sapiens
cagctgccccgggatgcgag

SEQ ID NO: 1777615 - DNA, 22 bp, Homo sapiens
cagctgccccgggatgcgaggc

SEQ ID NO: 1777616 - DNA, 16 bp, Homo sapiens
cagctgcccctggcac

SEQ ID NO: 1777617 - DNA, 18 bp, Homo sapiens
cagctgccctatgggcct

SEQ ID NO: 1777618 - DNA, 17 bp, Homo sapiens
cagctgccgaccagagc

SEQ ID NO: 1777619 - DNA, 18 bp, Homo sapiens
cagctgccgaccagagcc

SEQ ID NO: 1777620 - DNA, 16 bp, Homo sapiens
cagctgccgcaccagc

SEQ ID NO: 1777621 - DNA, 22 bp, Homo sapiens
cagctgccgggcctgatttggt

SEQ ID NO: 1777622 - DNA, 14 bp, Homo sapiens
cagctgcctaccta

SEQ ID NO: 1777623 - DNA, 14 bp, Homo sapiens
cagctgcctcactt

SEQ ID NO: 1777624 - DNA, 16 bp, Homo sapiens
cagctgcctctgctcc

SEQ ID NO: 1777625 - DNA, 17 bp, Homo sapiens
cagctgcgcttgctttt

SEQ ID NO: 1777626 - DNA, 19 bp, Homo sapiens
cagctgcgcttgcttttct

SEQ ID NO: 1777627 - DNA, 12 bp, Homo sapiens
caggcacacagc

SEQ ID NO: 1777628 - DNA, 18 bp, Homo sapiens
caggcacagcagctgcag

SEQ ID NO: 1777629 - DNA, 19 bp, Homo sapiens
caggcacagcagctgcagg

SEQ ID NO: 1777630 - DNA, 16 bp, Homo sapiens
caggcacagctgagtt

SEQ ID NO: 1777631 - DNA, 13 bp, Homo sapiens
caggcacaggaca

SEQ ID NO: 1777632 - DNA, 15 bp, Homo sapiens
caggcacagggcccg

SEQ ID NO: 1777633 - DNA, 23 bp, Homo sapiens
caggcacagggcccgcagtgctg

SEQ ID NO: 1777634 - DNA, 14 bp, Homo sapiens
caggcaccaccagg

SEQ ID NO: 1777635 - DNA, 23 bp, Homo sapiens
caggcaccaccaggagcagcagc

SEQ ID NO: 1777636 - DNA, 16 bp, Homo sapiens
caggcacccatgtggg

SEQ ID NO: 1777637 - DNA, 17 bp, Homo sapiens
caggcaccgagaatgtt

SEQ ID NO: 1777638 - DNA, 20 bp, Homo sapiens
caggcaccgccacgtcccag

SEQ ID NO: 1777639 - DNA, 22 bp, Homo sapiens
caggcaccgccacgtcccagca

SEQ ID NO: 1777640 - DNA, 24 bp, Homo sapiens
caggcaccgccacgtcccagcatc

SEQ ID NO: 1777641 - DNA, 15 bp, Homo sapiens
caggcacctggcctg

SEQ ID NO: 1777642 - DNA, 16 bp, Homo sapiens
caggcacgaacccacc

SEQ ID NO: 1777643 - DNA, 21 bp, Homo sapiens
caggcacgaacccacctgctg

SEQ ID NO: 1777644 - DNA, 23 bp, Homo sapiens
caggcacgggtggtccccgttcc

SEQ ID NO: 1777645 - DNA, 17 bp, Homo sapiens
caggcactggtggcatc

SEQ ID NO: 1777646 - DNA, 14 bp, Homo sapiens
caggcagacaagag

SEQ ID NO: 1777647 - DNA, 23 bp, Homo sapiens
caggcagacaagagctgctgtcc

SEQ ID NO: 1777648 - DNA, 12 bp, Homo sapiens
caggcagagctg

SEQ ID NO: 1777649 - DNA, 12 bp, Homo sapiens
caggcagaggtt

SEQ ID NO: 1777650 - DNA, 22 bp, Homo sapiens
caggcagaggttttaatgtctg

SEQ ID NO: 1777651 - DNA, 22 bp, Homo sapiens
caggcagataagttggagcagg

SEQ ID NO: 1777652 - DNA, 13 bp, Homo sapiens
caggcagatccag

SEQ ID NO: 1777653 - DNA, 15 bp, Homo sapiens
caggcagatccagga

SEQ ID NO: 1777654 - DNA, 17 bp, Homo sapiens
caggcagatccaggact

SEQ ID NO: 1777655 - DNA, 13 bp, Homo sapiens
caggcagatctgt

SEQ ID NO: 1777656 - DNA, 22 bp, Homo sapiens
caggcagatctgtgccccatgc

SEQ ID NO: 1777657 - DNA, 13 bp, Homo sapiens
caggcagcaccac

SEQ ID NO: 1777658 - DNA, 15 bp, Homo sapiens
caggcagcctccttt

SEQ ID NO: 1777659 - DNA, 13 bp, Homo sapiens
caggcagcctctg

SEQ ID NO: 1777660 - DNA, 18 bp, Homo sapiens
caggcagcctctgtcagg

SEQ ID NO: 1777661 - DNA, 12 bp, Homo sapiens
caggagggaggg

SEQ ID NO: 1777662 - DNA, 12 bp, Homo sapiens
caggagggccct

SEQ ID NO: 1777663 - DNA, 22 bp, Homo sapiens
caggagggtctcgaactcctgg

SEQ ID NO: 1777664 - DNA, 23 bp, Homo sapiens
caggagggtctcgaactcctggc

SEQ ID NO: 1777665 - DNA, 20 bp, Homo sapiens
caggagggtgacgcccagct

SEQ ID NO: 1777666 - DNA, 16 bp, Homo sapiens
caggaggtgcttgagg

SEQ ID NO: 1777667 - DNA, 19 bp, Homo sapiens
caggaggtgcttgaggccc

SEQ ID NO: 1777668 - DNA, 14 bp, Homo sapiens
caggaggtggagaa

SEQ ID NO: 1777669 - DNA, 18 bp, Homo sapiens
caggaggtggctatggcc

SEQ ID NO: 1777670 - DNA, 18 bp, Homo sapiens
caggaggttggtgactga

SEQ ID NO: 1777671 - DNA, 21 bp, Homo sapiens
caggagtcccaaggaaagccc

SEQ ID NO: 1777672 - DNA, 15 bp, Homo sapiens
caggagtctgtgctc

SEQ ID NO: 1777673 - DNA, 17 bp, Homo sapiens
caggagtgccaggacca

SEQ ID NO: 1777674 - DNA, 19 bp, Homo sapiens
caggagtgccaggaccagc

SEQ ID NO: 1777675 - DNA, 21 bp, Homo sapiens
caggagtgccaggaccagcct

SEQ ID NO: 1777676 - DNA, 19 bp, Homo sapiens
caggagtgtcctcttccct

SEQ ID NO: 1777677 - DNA, 21 bp, Homo sapiens
caggagtgtcctcttccctct

SEQ ID NO: 1777678 - DNA, 17 bp, Homo sapiens
caggagtgtcctgccca

SEQ ID NO: 1777679 - DNA, 22 bp, Homo sapiens
caggagtgtcctgcccatgccc

SEQ ID NO: 1777680 - DNA, 16 bp, Homo sapiens
caggagttagaggcca

SEQ ID NO: 1777681 - DNA, 21 bp, Homo sapiens
caggagttagaggccagcctg

SEQ ID NO: 1777682 - DNA, 22 bp, Homo sapiens
caggagttagaggccagcctgg

SEQ ID NO: 1777683 - DNA, 18 bp, Homo sapiens
caggagttcaagaccagc

SEQ ID NO: 1777684 - DNA, 19 bp, Homo sapiens
caggagttcaagaccagcc

SEQ ID NO: 1777685 - DNA, 20 bp, Homo sapiens
caggagttcaagaccagcct

SEQ ID NO: 1777686 - DNA, 17 bp, Homo sapiens
caggagttcaagactag

SEQ ID NO: 1777687 - DNA, 18 bp, Homo sapiens
caggagttcgaggctgca

SEQ ID NO: 1777688 - DNA, 21 bp, Homo sapiens
caggagttggagaccaggcct

SEQ ID NO: 1777689 - DNA, 24 bp, Homo sapiens
caggagtttgagacaagccctggc

SEQ ID NO: 1777690 - DNA, 18 bp, Homo sapiens
caggagtttgagaccagg

SEQ ID NO: 1777691 - DNA, 20 bp, Homo sapiens
caggagtttgagaccaggct

SEQ ID NO: 1777692 - DNA, 21 bp, Homo sapiens
caggagtttgagaccaggctg

SEQ ID NO: 1777693 - DNA, 18 bp, Homo sapiens
caggagtttgaggctgca

SEQ ID NO: 1777694 - DNA, 17 bp, Homo sapiens
caggatactggcacaga

SEQ ID NO: 1777695 - DNA, 23 bp, Homo sapiens
caggatatcacattggagtcact

SEQ ID NO: 1777696 - DNA, 19 bp, Homo sapiens
caggatattggttcttccc

SEQ ID NO: 1777697 - DNA, 13 bp, Homo sapiens
caggatcagatga

SEQ ID NO: 1777698 - DNA, 17 bp, Homo sapiens
caggatccaagctaagc

SEQ ID NO: 1777699 - DNA, 15 bp, Homo sapiens
caggatccctcctga

SEQ ID NO: 1777700 - DNA, 17 bp, Homo sapiens
caggatccctcctgagc

SEQ ID NO: 1777701 - DNA, 18 bp, Homo sapiens
caggatccctcctgagct

SEQ ID NO: 1777702 - DNA, 15 bp, Homo sapiens
caggatccgctgcca

SEQ ID NO: 1777703 - DNA, 16 bp, Homo sapiens
caggatccgctgccac

SEQ ID NO: 1777704 - DNA, 17 bp, Homo sapiens
caggatccgctgccacc

SEQ ID NO: 1777705 - DNA, 19 bp, Homo sapiens
caggatccgctgccaccac

SEQ ID NO: 1777706 - DNA, 13 bp, Homo sapiens
caggatcctgcag

SEQ ID NO: 1777707 - DNA, 14 bp, Homo sapiens
caggatctgctcca

SEQ ID NO: 1777708 - DNA, 17 bp, Homo sapiens
caggatctttgactgaa

SEQ ID NO: 1777709 - DNA, 15 bp, Homo sapiens
caggatgaattttct

SEQ ID NO: 1777710 - DNA, 15 bp, Homo sapiens
caggatgaggacaga

SEQ ID NO: 1777711 - DNA, 16 bp, Homo sapiens
caggatgcacatttct

SEQ ID NO: 1777712 - DNA, 19 bp, Homo sapiens
caggatgcacatttctgga

SEQ ID NO: 1777713 - DNA, 20 bp, Homo sapiens
caggatgccacgcctggaag

SEQ ID NO: 1777714 - DNA, 22 bp, Homo sapiens
caggatgccacgcctggaaggg

SEQ ID NO: 1777715 - DNA, 13 bp, Homo sapiens
caggatgcccaga

SEQ ID NO: 1777716 - DNA, 17 bp, Homo sapiens
caggatgcccagggcca

SEQ ID NO: 1777717 - DNA, 22 bp, Homo sapiens
caggatgcccagggccactctg

SEQ ID NO: 1777718 - DNA, 24 bp, Homo sapiens
caggatgcccagggccactctgcc

SEQ ID NO: 1777719 - DNA, 16 bp, Homo sapiens
caggatggggttctgg

SEQ ID NO: 1777720 - DNA, 17 bp, Homo sapiens
caggatggggttctgga

SEQ ID NO: 1777721 - DNA, 18 bp, Homo sapiens
caggatggggttctggaa

SEQ ID NO: 1777722 - DNA, 20 bp, Homo sapiens
caggattcccttctgggctt

SEQ ID NO: 1777723 - DNA, 12 bp, Homo sapiens
caggattctgca

SEQ ID NO: 1777724 - DNA, 19 bp, Homo sapiens
caggattcttcccgctccc

SEQ ID NO: 1777725 - DNA, 21 bp, Homo sapiens
caggattcttcccgctcccca

SEQ ID NO: 1777726 - DNA, 16 bp, Homo sapiens
caggattgatcattct

SEQ ID NO: 1777727 - DNA, 15 bp, Homo sapiens
caggatttaaaaact

SEQ ID NO: 1777728 - DNA, 22 bp, Homo sapiens
caggattttaatttcaggaaaa

SEQ ID NO: 1777729 - DNA, 18 bp, Homo sapiens
caggcaaaatccttgctt

SEQ ID NO: 1777730 - DNA, 18 bp, Homo sapiens
caggcaacctcccatccc

SEQ ID NO: 1777731 - DNA, 22 bp, Homo sapiens
caggcaacctcccatcccaccc

SEQ ID NO: 1777732 - DNA, 18 bp, Homo sapiens
caggcaactgaggcagac

SEQ ID NO: 1777733 - DNA, 19 bp, Homo sapiens
caggcaactgaggcagaca

SEQ ID NO: 1777734 - DNA, 20 bp, Homo sapiens
caggcaactgaggcagacag

SEQ ID NO: 1777735 - DNA, 14 bp, Homo sapiens
caggggcagcaagg

SEQ ID NO: 1777736 - DNA, 19 bp, Homo sapiens
caggggcagcaaggccttg

SEQ ID NO: 1777737 - DNA, 14 bp, Homo sapiens
caggggcaggactg

SEQ ID NO: 1777738 - DNA, 13 bp, Homo sapiens
caggggcaggcct

SEQ ID NO: 1777739 - DNA, 16 bp, Homo sapiens
caggggcaggcctggg

SEQ ID NO: 1777740 - DNA, 21 bp, Homo sapiens
caggggcatgtattggcctgg

SEQ ID NO: 1777741 - DNA, 12 bp, Homo sapiens
caggggccccag

SEQ ID NO: 1777742 - DNA, 16 bp, Homo sapiens
caggggccccagatct

SEQ ID NO: 1777743 - DNA, 21 bp, Homo sapiens
caggggccccagatctgcctg

SEQ ID NO: 1777744 - DNA, 13 bp, Homo sapiens
caggggcctctgt

SEQ ID NO: 1777745 - DNA, 13 bp, Homo sapiens
caggggcctgcag

SEQ ID NO: 1777746 - DNA, 14 bp, Homo sapiens
caggggcctgcaga

SEQ ID NO: 1777747 - DNA, 12 bp, Homo sapiens
caggggcctgga

SEQ ID NO: 1777748 - DNA, 15 bp, Homo sapiens
caggggcctggagat

SEQ ID NO: 1777749 - DNA, 15 bp, Homo sapiens
caggggcctggaggt

SEQ ID NO: 1777750 - DNA, 22 bp, Homo sapiens
caggggctctgcttcctcagcc

SEQ ID NO: 1777751 - DNA, 15 bp, Homo sapiens
caggggcttgagaag

SEQ ID NO: 1777752 - DNA, 20 bp, Homo sapiens
cagggggccccgccagggct

SEQ ID NO: 1777753 - DNA, 22 bp, Homo sapiens
cagggggccccgccagggctgg

SEQ ID NO: 1777754 - DNA, 21 bp, Homo sapiens
cagggggcccgaacagggact

SEQ ID NO: 1777755 - DNA, 22 bp, Homo sapiens
cagggggcccgaacagggactt

SEQ ID NO: 1777756 - DNA, 14 bp, Homo sapiens
cagggggccctgcc

SEQ ID NO: 1777757 - DNA, 14 bp, Homo sapiens
cagggggcctggag

SEQ ID NO: 1777758 - DNA, 13 bp, Homo sapiens
caggggggagaag

SEQ ID NO: 1777759 - DNA, 13 bp, Homo sapiens
caggggggctgtg

SEQ ID NO: 1777760 - DNA, 15 bp, Homo sapiens
caggggggctgtgcc

SEQ ID NO: 1777761 - DNA, 22 bp, Homo sapiens
caggggggctgtgccaacctgt

SEQ ID NO: 1777762 - DNA, 16 bp, Homo sapiens
cagggggtgtgtctgc

SEQ ID NO: 1777763 - DNA, 23 bp, Homo sapiens
caggggtcaggtgtcaggcccgt

SEQ ID NO: 1777764 - DNA, 21 bp, Homo sapiens
caggggtcagtgcagcagagg

SEQ ID NO: 1777765 - DNA, 18 bp, Homo sapiens
caggggtcccagccaccc

SEQ ID NO: 1777766 - DNA, 20 bp, Homo sapiens
caggggtcccagccaccccg

SEQ ID NO: 1777767 - DNA, 16 bp, Homo sapiens
caggggtcccccctca

SEQ ID NO: 1777768 - DNA, 14 bp, Homo sapiens
caggggtcctgcag

SEQ ID NO: 1777769 - DNA, 15 bp, Homo sapiens
caggggtcctgcagg

SEQ ID NO: 1777770 - DNA, 16 bp, Homo sapiens
caggggtcctgcaggt

SEQ ID NO: 1777771 - DNA, 19 bp, Homo sapiens
caggggtcctgcaggtcct

SEQ ID NO: 1777772 - DNA, 16 bp, Homo sapiens
caggggtctccctggc

SEQ ID NO: 1777773 - DNA, 20 bp, Homo sapiens
caggggtctccctggctccc

SEQ ID NO: 1777774 - DNA, 22 bp, Homo sapiens
caggggtctccctggctccctc

SEQ ID NO: 1777775 - DNA, 17 bp, Homo sapiens
caggggtgccccctcct

SEQ ID NO: 1777776 - DNA, 20 bp, Homo sapiens
caggggtgccccctcctctc

SEQ ID NO: 1777777 - DNA, 23 bp, Homo sapiens
caggggtgccccctcctctccca

SEQ ID NO: 1777778 - DNA, 15 bp, Homo sapiens
caggggtgctgtgga

SEQ ID NO: 1777779 - DNA, 23 bp, Homo sapiens
caggggtgctgtggacatgtggg

SEQ ID NO: 1777780 - DNA, 20 bp, Homo sapiens
caggggtgggggtggaggct

SEQ ID NO: 1777781 - DNA, 18 bp, Homo sapiens
cagggtacccgcctgagc

SEQ ID NO: 1777782 - DNA, 13 bp, Homo sapiens
cagggtataaatt

SEQ ID NO: 1777783 - DNA, 14 bp, Homo sapiens
cagggtcaagcctc

SEQ ID NO: 1777784 - DNA, 19 bp, Homo sapiens
cagggtcactgaaccactg

SEQ ID NO: 1777785 - DNA, 14 bp, Homo sapiens
cagggtcaggagag

SEQ ID NO: 1777786 - DNA, 14 bp, Homo sapiens
cagggtcaggcgga

SEQ ID NO: 1777787 - DNA, 16 bp, Homo sapiens
cagggtccacgcctct

SEQ ID NO: 1777788 - DNA, 15 bp, Homo sapiens
cagggtccctctgtg

SEQ ID NO: 1777789 - DNA, 18 bp, Homo sapiens
cagggtccgcaccagctg

SEQ ID NO: 1777790 - DNA, 21 bp, Homo sapiens
cagggtccgcaccagctgctc

SEQ ID NO: 1777791 - DNA, 19 bp, Homo sapiens
cagggtcctctagcccact

SEQ ID NO: 1777792 - DNA, 23 bp, Homo sapiens
cagggtcctctagcccactccct

SEQ ID NO: 1777793 - DNA, 20 bp, Homo sapiens
cagggtcctcttctgggcct

SEQ ID NO: 1777794 - DNA, 12 bp, Homo sapiens
cagggtcctgtg

SEQ ID NO: 1777795 - DNA, 15 bp, Homo sapiens
cagggtcctgtgcct

SEQ ID NO: 1777796 - DNA, 22 bp, Homo sapiens
cagggtcggtactgatggaggc

SEQ ID NO: 1777797 - DNA, 20 bp, Homo sapiens
cagggtctcgctctgttgcc

SEQ ID NO: 1777798 - DNA, 17 bp, Homo sapiens
cagggtctgctctttct

SEQ ID NO: 1777799 - DNA, 22 bp, Homo sapiens
cagggtctgctctttctctgcc

SEQ ID NO: 1777800 - DNA, 14 bp, Homo sapiens
cagggtctgggaca

SEQ ID NO: 1777801 - DNA, 13 bp, Homo sapiens
cagggtcttccct

SEQ ID NO: 1777802 - DNA, 21 bp, Homo sapiens
cagggtcttccctacctcagg

SEQ ID NO: 1777803 - DNA, 22 bp, Homo sapiens
cagggtcttgggctactggcag

SEQ ID NO: 1777804 - DNA, 17 bp, Homo sapiens
cagggtgaactgcaaag

SEQ ID NO: 1777805 - DNA, 12 bp, Homo sapiens
cagggtgggaag

SEQ ID NO: 1777806 - DNA, 16 bp, Homo sapiens
cagggtgggaagagaa

SEQ ID NO: 1777807 - DNA, 18 bp, Homo sapiens
cagggtgggatggaggag

SEQ ID NO: 1777808 - DNA, 11 bp, Homo sapiens
cagggtggggg

SEQ ID NO: 1777809 - DNA, 14 bp, Homo sapiens
caggtgtcgaggcc

SEQ ID NO: 1777810 - DNA, 16 bp, Homo sapiens
caggtgtgcctgtgct

SEQ ID NO: 1777811 - DNA, 18 bp, Homo sapiens
caggtgtgcctgtgctcc

SEQ ID NO: 1777812 - DNA, 20 bp, Homo sapiens
caggtgtggggacacagcag

SEQ ID NO: 1777813 - DNA, 19 bp, Homo sapiens
caggtgtggtggctcatgg

SEQ ID NO: 1777814 - DNA, 23 bp, Homo sapiens
caggtgttgccatttctctgctt

SEQ ID NO: 1777815 - DNA, 16 bp, Homo sapiens
caggtgttgggacctg

SEQ ID NO: 1777816 - DNA, 16 bp, Homo sapiens
caggtgtttagttgca

SEQ ID NO: 1777817 - DNA, 17 bp, Homo sapiens
caggttacgaagacaaa

SEQ ID NO: 1777818 - DNA, 17 bp, Homo sapiens
caggttataacagtgtt

SEQ ID NO: 1777819 - DNA, 17 bp, Homo sapiens
caggttatactcctcct

SEQ ID NO: 1777820 - DNA, 19 bp, Homo sapiens
caggttatgtcagcagctc

SEQ ID NO: 1777821 - DNA, 22 bp, Homo sapiens
caggttattgcaataaagtata

SEQ ID NO: 1777822 - DNA, 18 bp, Homo sapiens
caggttcaagctattctc

SEQ ID NO: 1777823 - DNA, 16 bp, Homo sapiens
caggttcagtattatg

SEQ ID NO: 1777824 - DNA, 19 bp, Homo sapiens
caggttccatccaccacct

SEQ ID NO: 1777825 - DNA, 22 bp, Homo sapiens
caggttccatccaccaccttgc

SEQ ID NO: 1777826 - DNA, 14 bp, Homo sapiens
caggttccatcccg

SEQ ID NO: 1777827 - DNA, 21 bp, Homo sapiens
caggttccccaagggccctgg

SEQ ID NO: 1777828 - DNA, 16 bp, Homo sapiens
caggttcccccagcaa

SEQ ID NO: 1777829 - DNA, 15 bp, Homo sapiens
caggttccctcccag

SEQ ID NO: 1777830 - DNA, 18 bp, Homo sapiens
caggttccctcccagagg

SEQ ID NO: 1777831 - DNA, 20 bp, Homo sapiens
caggttcctgtactactgcc

SEQ ID NO: 1777832 - DNA, 21 bp, Homo sapiens
caggttctccgttagctcctg

SEQ ID NO: 1777833 - DNA, 24 bp, Homo sapiens
caggttctccgttagctcctgtgg

SEQ ID NO: 1777834 - DNA, 15 bp, Homo sapiens
caggttctgcctgct

SEQ ID NO: 1777835 - DNA, 22 bp, Homo sapiens
caggttgaggtgcgctcacctc

SEQ ID NO: 1777836 - DNA, 15 bp, Homo sapiens
caggttgcagctgct

SEQ ID NO: 1777837 - DNA, 17 bp, Homo sapiens
caggttgcagctgctct

SEQ ID NO: 1777838 - DNA, 19 bp, Homo sapiens
caggttgggaacatgctgg

SEQ ID NO: 1777839 - DNA, 15 bp, Homo sapiens
caggttgttttctac

SEQ ID NO: 1777840 - DNA, 19 bp, Homo sapiens
caggtttgagaaaaaggaa

SEQ ID NO: 1777841 - DNA, 22 bp, Homo sapiens
caggtttgatgcctgtgaagaa

SEQ ID NO: 1777842 - DNA, 14 bp, Homo sapiens
caggtttgccagtg

SEQ ID NO: 1777843 - DNA, 23 bp, Homo sapiens
caggtttgcccacttgattgaga

SEQ ID NO: 1777844 - DNA, 15 bp, Homo sapiens
caggtttgtcctggt

SEQ ID NO: 1777845 - DNA, 16 bp, Homo sapiens
caggtttgtcctggtc

SEQ ID NO: 1777846 - DNA, 21 bp, Homo sapiens
caggttttcaccatagcctac

SEQ ID NO: 1777847 - DNA, 15 bp, Homo sapiens
caggttttgtaaaga

SEQ ID NO: 1777848 - DNA, 18 bp, Homo sapiens
cagtaaaaacttgtacta

SEQ ID NO: 1777849 - DNA, 20 bp, Homo sapiens
cagtaaaaacttgtactatg

SEQ ID NO: 1777850 - DNA, 18 bp, Homo sapiens
cagtaaaagccttattct

SEQ ID NO: 1777851 - DNA, 21 bp, Homo sapiens
cagtaaaatactattgcctca

SEQ ID NO: 1777852 - DNA, 14 bp, Homo sapiens
cagtaaaccactga

SEQ ID NO: 1777853 - DNA, 18 bp, Homo sapiens
cagtaaaccactgaaaaa

SEQ ID NO: 1777854 - DNA, 23 bp, Homo sapiens
cagtaaacgggaacatgccccct

SEQ ID NO: 1777855 - DNA, 17 bp, Homo sapiens
cagtaacatttctgttc

SEQ ID NO: 1777856 - DNA, 20 bp, Homo sapiens
cagtaacatttctgttctca

SEQ ID NO: 1777857 - DNA, 18 bp, Homo sapiens
cagtaacgcgtcttcctg

SEQ ID NO: 1777858 - DNA, 18 bp, Homo sapiens
cagtaactgttttttaag

SEQ ID NO: 1777859 - DNA, 14 bp, Homo sapiens
cagtaactttatgt

SEQ ID NO: 1777860 - DNA, 17 bp, Homo sapiens
cagtaacttttttgtgt

SEQ ID NO: 1777861 - DNA, 18 bp, Homo sapiens
cagtaacttttttgtgta

SEQ ID NO: 1777862 - DNA, 21 bp, Homo sapiens
cagtaacttttttgtgtatgt

SEQ ID NO: 1777863 - DNA, 22 bp, Homo sapiens
cagtaacttttttgtgtatgta

SEQ ID NO: 1777864 - DNA, 20 bp, Homo sapiens
cagtaatcccatttcccaaa

SEQ ID NO: 1777865 - DNA, 21 bp, Homo sapiens
cagtaattggtccgatctttg

SEQ ID NO: 1777866 - DNA, 18 bp, Homo sapiens
catagtaccaatcatttt

SEQ ID NO: 1777867 - DNA, 13 bp, Homo sapiens
catagtagttttt

SEQ ID NO: 1777868 - DNA, 20 bp, Homo sapiens
catagtatactgatttaatt

SEQ ID NO: 1777869 - DNA, 11 bp, Homo sapiens
catagtcttga

SEQ ID NO: 1777870 - DNA, 20 bp, Homo sapiens
catagtcttgaaatgaaagg

SEQ ID NO: 1777871 - DNA, 22 bp, Homo sapiens
catagtcttgaaatgaaaggga

SEQ ID NO: 1777872 - DNA, 19 bp, Homo sapiens
catagtgaaaattgtttag

SEQ ID NO: 1777873 - DNA, 20 bp, Homo sapiens
catagtgacttttcaagtat

SEQ ID NO: 1777874 - DNA, 15 bp, Homo sapiens
catagtgagatccca

SEQ ID NO: 1777875 - DNA, 19 bp, Homo sapiens
catagtggggcctgggagg

SEQ ID NO: 1777876 - DNA, 16 bp, Homo sapiens
catagtgtcacagaga

SEQ ID NO: 1777877 - DNA, 17 bp, Homo sapiens
catagtgtcacagagag

SEQ ID NO: 1777878 - DNA, 22 bp, Homo sapiens
catagtgtctgctgctgcctcc

SEQ ID NO: 1777879 - DNA, 20 bp, Homo sapiens
catagttggtaatgcttgga

SEQ ID NO: 1777880 - DNA, 20 bp, Homo sapiens
catagttgtagacaaagtac

SEQ ID NO: 1777881 - DNA, 19 bp, Homo sapiens
catataaacatcacacaca

SEQ ID NO: 1777882 - DNA, 20 bp, Homo sapiens
catataaacatcacacacac

SEQ ID NO: 1777883 - DNA, 14 bp, Homo sapiens
catataagtttgaa

SEQ ID NO: 1777884 - DNA, 21 bp, Homo sapiens
catataagtttgaaggaaaca

SEQ ID NO: 1777885 - DNA, 22 bp, Homo sapiens
catataagtttgaaggaaacag

SEQ ID NO: 1777886 - DNA, 20 bp, Homo sapiens
catatacaacaccaaaaaat

SEQ ID NO: 1777887 - DNA, 17 bp, Homo sapiens
catatacatattgtata

SEQ ID NO: 1777888 - DNA, 22 bp, Homo sapiens
catatactttaatgttttaact

SEQ ID NO: 1777889 - DNA, 16 bp, Homo sapiens
catatagacacataca

SEQ ID NO: 1777890 - DNA, 20 bp, Homo sapiens
catatagttgaggccgagga

SEQ ID NO: 1777891 - DNA, 11 bp, Homo sapiens
catatatatat

SEQ ID NO: 1777892 - DNA, 13 bp, Homo sapiens
catatatattaca

SEQ ID NO: 1777893 - DNA, 16 bp, Homo sapiens
catatatattacaagg

SEQ ID NO: 1777894 - DNA, 17 bp, Homo sapiens
catatatgaggacttgt

SEQ ID NO: 1777895 - DNA, 12 bp, Homo sapiens
catatatgtata

SEQ ID NO: 1777896 - DNA, 13 bp, Homo sapiens
catatatgtataa

SEQ ID NO: 1777897 - DNA, 15 bp, Homo sapiens
catatatttaacaat

SEQ ID NO: 1777898 - DNA, 20 bp, Homo sapiens
catatatttaacaatgacaa

SEQ ID NO: 1777899 - DNA, 22 bp, Homo sapiens
catatatttaacaatgacaaga

SEQ ID NO: 1777900 - DNA, 20 bp, Homo sapiens
catatcaagtccatgttatt

SEQ ID NO: 1777901 - DNA, 16 bp, Homo sapiens
catatcacccttccct

SEQ ID NO: 1777902 - DNA, 21 bp, Homo sapiens
catatcacccttccctgctcc

SEQ ID NO: 1777903 - DNA, 18 bp, Homo sapiens
catatccatagtgacttt

SEQ ID NO: 1777904 - DNA, 15 bp, Homo sapiens
catatcctgagccat

SEQ ID NO: 1777905 - DNA, 13 bp, Homo sapiens
catatcctgcctc

SEQ ID NO: 1777906 - DNA, 15 bp, Homo sapiens
catatcctgcctcag

SEQ ID NO: 1777907 - DNA, 14 bp, Homo sapiens
catatctaaagtca

SEQ ID NO: 1777908 - DNA, 21 bp, Homo sapiens
catatctagtatgaaattata

SEQ ID NO: 1777909 - DNA, 14 bp, Homo sapiens
catatctccttccc

SEQ ID NO: 1777910 - DNA, 17 bp, Homo sapiens
catatctggagcctgat

SEQ ID NO: 1777911 - DNA, 19 bp, Homo sapiens
catatctggagcctgatgt

SEQ ID NO: 1777912 - DNA, 19 bp, Homo sapiens
catatcttctatatctgaa

SEQ ID NO: 1777913 - DNA, 14 bp, Homo sapiens
catatgacaaatgt

SEQ ID NO: 1777914 - DNA, 17 bp, Homo sapiens
catatgacaaatgtttc

SEQ ID NO: 1777915 - DNA, 22 bp, Homo sapiens
catatgaccattgagtccctgc

SEQ ID NO: 1777916 - DNA, 22 bp, Homo sapiens
catatgagaatataccttattt

SEQ ID NO: 1777917 - DNA, 16 bp, Homo sapiens
catatgagcctgccct

SEQ ID NO: 1777918 - DNA, 14 bp, Homo sapiens
catatgattgaaaa

SEQ ID NO: 1777919 - DNA, 15 bp, Homo sapiens
catatgattgaaaag

SEQ ID NO: 1777920 - DNA, 17 bp, Homo sapiens
catatgattgaaaagaa

SEQ ID NO: 1777921 - DNA, 20 bp, Homo sapiens
catatgattgaaaagaagaa

SEQ ID NO: 1777922 - DNA, 20 bp, Homo sapiens
catatgcaccttgtgtctgt

SEQ ID NO: 1777923 - DNA, 14 bp, Homo sapiens
catatgcagaaata

SEQ ID NO: 1777924 - DNA, 23 bp, Homo sapiens
catatgctgatcttttaaaatca

SEQ ID NO: 1777925 - DNA, 18 bp, Homo sapiens
catatggactctgcacat

SEQ ID NO: 1777926 - DNA, 20 bp, Homo sapiens
catatggactctgcacatga

SEQ ID NO: 1777927 - DNA, 16 bp, Homo sapiens
catatggcccagtgtc

SEQ ID NO: 1777928 - DNA, 20 bp, Homo sapiens
catatgggatattcccaagc

SEQ ID NO: 1777929 - DNA, 21 bp, Homo sapiens
catatgggtgggattttgcaa

SEQ ID NO: 1777930 - DNA, 17 bp, Homo sapiens
catatgtacttgtttgc

SEQ ID NO: 1777931 - DNA, 12 bp, Homo sapiens
catatgtagata

SEQ ID NO: 1777932 - DNA, 15 bp, Homo sapiens
catattaagacagtg

SEQ ID NO: 1777933 - DNA, 22 bp, Homo sapiens
catattaagacagtgtacaaaa

SEQ ID NO: 1777934 - DNA, 23 bp, Homo sapiens
catattaagacagtgtacaaaac

SEQ ID NO: 1777935 - DNA, 14 bp, Homo sapiens
catattaatatatt

SEQ ID NO: 1777936 - DNA, 19 bp, Homo sapiens
catattaatatatttccat

SEQ ID NO: 1777937 - DNA, 15 bp, Homo sapiens
catattacctggatt

SEQ ID NO: 1777938 - DNA, 12 bp, Homo sapiens
catattcaatgt

SEQ ID NO: 1777939 - DNA, 16 bp, Homo sapiens
catattccatatttat

SEQ ID NO: 1777940 - DNA, 17 bp, Homo sapiens
catattctaaaaccatt

SEQ ID NO: 1777941 - DNA, 12 bp, Homo sapiens
catattcttgct

SEQ ID NO: 1777942 - DNA, 21 bp, Homo sapiens
catattcttgctttcacaaat

SEQ ID NO: 1777943 - DNA, 21 bp, Homo sapiens
catattgagatcagcattcaa

SEQ ID NO: 1777944 - DNA, 17 bp, Homo sapiens
catattgtaaaacaggt

SEQ ID NO: 1777945 - DNA, 19 bp, Homo sapiens
catattgtaaaacaggtag

SEQ ID NO: 1777946 - DNA, 13 bp, Homo sapiens
catattgtatgta

SEQ ID NO: 1777947 - DNA, 15 bp, Homo sapiens
catattgtatgtaag

SEQ ID NO: 1777948 - DNA, 18 bp, Homo sapiens
catattgtgattctgcct

SEQ ID NO: 1777949 - DNA, 22 bp, Homo sapiens
catattgtgtaatttaagtgac

SEQ ID NO: 1777950 - DNA, 13 bp, Homo sapiens
catatttactctt

SEQ ID NO: 1777951 - DNA, 18 bp, Homo sapiens
catatttactctttctaa

SEQ ID NO: 1777952 - DNA, 20 bp, Homo sapiens
catatttacttcttatacat

SEQ ID NO: 1777953 - DNA, 13 bp, Homo sapiens
catatttatactt

SEQ ID NO: 1777954 - DNA, 21 bp, Homo sapiens
catatttatccaaaatgtgta

SEQ ID NO: 1777955 - DNA, 20 bp, Homo sapiens
catatttattgcattgctgg

SEQ ID NO: 1777956 - DNA, 21 bp, Homo sapiens
catatttattgcattgctggt

SEQ ID NO: 1777957 - DNA, 13 bp, Homo sapiens
catatttctgtgg

SEQ ID NO: 1777958 - DNA, 16 bp, Homo sapiens
catatttgaagggtct

SEQ ID NO: 1777959 - DNA, 15 bp, Homo sapiens
catatttgagactag

SEQ ID NO: 1777960 - DNA, 18 bp, Homo sapiens
catatttgccaataaagc

SEQ ID NO: 1777961 - DNA, 20 bp, Homo sapiens
catatttgccaataaagctt

SEQ ID NO: 1777962 - DNA, 14 bp, Homo sapiens
catatttgtacttt

SEQ ID NO: 1777963 - DNA, 23 bp, Homo sapiens
catatttgtactttctgttaaaa

SEQ ID NO: 1777964 - DNA, 18 bp, Homo sapiens
catatttgtatagttgct

SEQ ID NO: 1777965 - DNA, 12 bp, Homo sapiens
catattttgctg

SEQ ID NO: 1777966 - DNA, 14 bp, Homo sapiens
catatttttatact

SEQ ID NO: 1777967 - DNA, 17 bp, Homo sapiens
catatttttatacttta

SEQ ID NO: 1777968 - DNA, 21 bp, Homo sapiens
catatttttcacatatctagt

SEQ ID NO: 1777969 - DNA, 18 bp, Homo sapiens
catattttttatgatgga

SEQ ID NO: 1777970 - DNA, 14 bp, Homo sapiens
cagtgtcctttcca

SEQ ID NO: 1777971 - DNA, 12 bp, Homo sapiens
cagtgtctccac

SEQ ID NO: 1777972 - DNA, 17 bp, Homo sapiens
cagtgtctccacctaca

SEQ ID NO: 1777973 - DNA, 22 bp, Homo sapiens
cagtgtctgtatcggagacagt

SEQ ID NO: 1777974 - DNA, 23 bp, Homo sapiens
cagtgtctgtatcggagacagtg

SEQ ID NO: 1777975 - DNA, 23 bp, Homo sapiens
cagtgtcttccataatgtataaa

SEQ ID NO: 1777976 - DNA, 17 bp, Homo sapiens
cagtgtgagtcagaatg

SEQ ID NO: 1777977 - DNA, 18 bp, Homo sapiens
cagtgtgatcccaagtgc

SEQ ID NO: 1777978 - DNA, 20 bp, Homo sapiens
cagtgtgcacgcctgcaggc

SEQ ID NO: 1777979 - DNA, 14 bp, Homo sapiens
cagtgtggagaggg

SEQ ID NO: 1777980 - DNA, 15 bp, Homo sapiens
cagtgtggagagggg

SEQ ID NO: 1777981 - DNA, 17 bp, Homo sapiens
cagtgtggagaggggtg

SEQ ID NO: 1777982 - DNA, 22 bp, Homo sapiens
cagtgtggagttcaccttggaa

SEQ ID NO: 1777983 - DNA, 12 bp, Homo sapiens
cagtgtggcctc

SEQ ID NO: 1777984 - DNA, 17 bp, Homo sapiens
cagtgttacctgtgtgc

SEQ ID NO: 1777985 - DNA, 18 bp, Homo sapiens
cagtgttacctgtgtgct

SEQ ID NO: 1777986 - DNA, 21 bp, Homo sapiens
cagtgttacctgttagctccc

SEQ ID NO: 1777987 - DNA, 16 bp, Homo sapiens
cagtgttacttgcagg

SEQ ID NO: 1777988 - DNA, 15 bp, Homo sapiens
cagtgttagagaaat

SEQ ID NO: 1777989 - DNA, 18 bp, Homo sapiens
cagtgttgagccttttcc

SEQ ID NO: 1777990 - DNA, 19 bp, Homo sapiens
cagtgttgcatatgagcct

SEQ ID NO: 1777991 - DNA, 20 bp, Homo sapiens
cagtgttgcatatgagcctg

SEQ ID NO: 1777992 - DNA, 17 bp, Homo sapiens
cagtgttgtttgtaaat

SEQ ID NO: 1777993 - DNA, 20 bp, Homo sapiens
cagtgttgtttgtaaataag

SEQ ID NO: 1777994 - DNA, 21 bp, Homo sapiens
cagtgtttcccataattttct

SEQ ID NO: 1777995 - DNA, 19 bp, Homo sapiens
cagtgttttcattttagac

SEQ ID NO: 1777996 - DNA, 12 bp, Homo sapiens
cagttaaaatgt

SEQ ID NO: 1777997 - DNA, 12 bp, Homo sapiens
cagttaaagcca

SEQ ID NO: 1777998 - DNA, 21 bp, Homo sapiens
cagttaaagtagatcacctcc

SEQ ID NO: 1777999 - DNA, 22 bp, Homo sapiens
cagttaaagtagatcacctcct

SEQ ID NO: 1778000 - DNA, 15 bp, Homo sapiens
cagttaacaggatat

SEQ ID NO: 1778001 - DNA, 20 bp, Homo sapiens
cagttaactttcagaagaga

SEQ ID NO: 1778002 - DNA, 21 bp, Homo sapiens
cagttaatactccagagacag

SEQ ID NO: 1778003 - DNA, 14 bp, Homo sapiens
cagttaatttttcc

SEQ ID NO: 1778004 - DNA, 14 bp, Homo sapiens
cagttacaaattat

SEQ ID NO: 1778005 - DNA, 13 bp, Homo sapiens
cagttacagctct

SEQ ID NO: 1778006 - DNA, 17 bp, Homo sapiens
cagttactcagccctgg

SEQ ID NO: 1778007 - DNA, 16 bp, Homo sapiens
cagttactctgaaggg

SEQ ID NO: 1778008 - DNA, 15 bp, Homo sapiens
cagttagcaaacttt

SEQ ID NO: 1778009 - DNA, 16 bp, Homo sapiens
cagttagcaaactttg

SEQ ID NO: 1778010 - DNA, 15 bp, Homo sapiens
cagttagcagggatg

SEQ ID NO: 1778011 - DNA, 19 bp, Homo sapiens
cagttagggttgagttact

SEQ ID NO: 1778012 - DNA, 19 bp, Homo sapiens
cagttagggttttgcaata

SEQ ID NO: 1778013 - DNA, 22 bp, Homo sapiens
cagttagggttttgcaataact

SEQ ID NO: 1778014 - DNA, 23 bp, Homo sapiens
cagttagggttttgcaataactt

SEQ ID NO: 1778015 - DNA, 20 bp, Homo sapiens
cagttaggtgctgaatgaag

SEQ ID NO: 1778016 - DNA, 22 bp, Homo sapiens
cagttaggtgctgaatgaagct

SEQ ID NO: 1778017 - DNA, 19 bp, Homo sapiens
cagttagttgtgaaagaaa

SEQ ID NO: 1778018 - DNA, 20 bp, Homo sapiens
cagttagttgtgaaagaaag

SEQ ID NO: 1778019 - DNA, 12 bp, Homo sapiens
cagttatatttt

SEQ ID NO: 1778020 - DNA, 22 bp, Homo sapiens
cagttatgatttttttttcata

SEQ ID NO: 1778021 - DNA, 20 bp, Homo sapiens
cagttatggctataggtgct

SEQ ID NO: 1778022 - DNA, 17 bp, Homo sapiens
cagttatggtgatgact

SEQ ID NO: 1778023 - DNA, 23 bp, Homo sapiens
cagttatttctgtttcctattta

SEQ ID NO: 1778024 - DNA, 17 bp, Homo sapiens
cagttcaaagtgtatat

SEQ ID NO: 1778025 - DNA, 20 bp, Homo sapiens
cagttcaaagtgtatattta

SEQ ID NO: 1778026 - DNA, 18 bp, Homo sapiens
cagttcaaatcctcacca

SEQ ID NO: 1778027 - DNA, 22 bp, Homo sapiens
cagttcaatctcccgctgctgc

SEQ ID NO: 1778028 - DNA, 22 bp, Homo sapiens
cagttcagaatggcagtcctgg

SEQ ID NO: 1778029 - DNA, 16 bp, Homo sapiens
cagttcagcaccaccc

SEQ ID NO: 1778030 - DNA, 17 bp, Homo sapiens
cagttcagcaccaccct

SEQ ID NO: 1778031 - DNA, 17 bp, Homo sapiens
cagttcatgtctgaaac

SEQ ID NO: 1778032 - DNA, 18 bp, Homo sapiens
cagttcccagctcccccc

SEQ ID NO: 1778033 - DNA, 19 bp, Homo sapiens
cagttcccggagcacagcc

SEQ ID NO: 1778034 - DNA, 19 bp, Homo sapiens
cagttcccgtgacgaggct

SEQ ID NO: 1778035 - DNA, 14 bp, Homo sapiens
cagttcccttggcc

SEQ ID NO: 1778036 - DNA, 18 bp, Homo sapiens
cagttcctatgacacagt

SEQ ID NO: 1778037 - DNA, 21 bp, Homo sapiens
cagttcctatgacacagttat

SEQ ID NO: 1778038 - DNA, 14 bp, Homo sapiens
cagttcctggccca

SEQ ID NO: 1778039 - DNA, 18 bp, Homo sapiens
cagttctctcccttcctc

SEQ ID NO: 1778040 - DNA, 23 bp, Homo sapiens
cagttctctcccttcctctctcc

SEQ ID NO: 1778041 - DNA, 12 bp, Homo sapiens
cagttctctggg

SEQ ID NO: 1778042 - DNA, 11 bp, Homo sapiens
cagttctctgt

SEQ ID NO: 1778043 - DNA, 12 bp, Homo sapiens
cagttctctgtg

SEQ ID NO: 1778044 - DNA, 21 bp, Homo sapiens
cagttctctgtggaagcaagg

SEQ ID NO: 1778045 - DNA, 17 bp, Homo sapiens
cagttctgagctgtaat

SEQ ID NO: 1778046 - DNA, 13 bp, Homo sapiens
cagttctttcctc

SEQ ID NO: 1778047 - DNA, 19 bp, Homo sapiens
cagttctttcctctttctg

SEQ ID NO: 1778048 - DNA, 21 bp, Homo sapiens
cagttctttcctctttctgct

SEQ ID NO: 1778049 - DNA, 18 bp, Homo sapiens
cagttctttgggccagac

SEQ ID NO: 1778050 - DNA, 22 bp, Homo sapiens
cagttgaaaagactccaaagaa

SEQ ID NO: 1778051 - DNA, 19 bp, Homo sapiens
cagttgaagggaggggctg

SEQ ID NO: 1778052 - DNA, 14 bp, Homo sapiens
cagttgctgtgaac

SEQ ID NO: 1778053 - DNA, 13 bp, Homo sapiens
cagttgcttgtct

SEQ ID NO: 1778054 - DNA, 16 bp, Homo sapiens
cagttggactctcagg

SEQ ID NO: 1778055 - DNA, 19 bp, Homo sapiens
cagttggactctcagggat

SEQ ID NO: 1778056 - DNA, 22 bp, Homo sapiens
cagttggcagaaaggatgtttt

SEQ ID NO: 1778057 - DNA, 15 bp, Homo sapiens
cagttggcagagaag

SEQ ID NO: 1778058 - DNA, 22 bp, Homo sapiens
cagttggcagagaaggcctctt

SEQ ID NO: 1778059 - DNA, 16 bp, Homo sapiens
cagttggccttcagaa

SEQ ID NO: 1778060 - DNA, 18 bp, Homo sapiens
cagttgggagcactggag

SEQ ID NO: 1778061 - DNA, 21 bp, Homo sapiens
cagttggtgactgggaaagtt

SEQ ID NO: 1778062 - DNA, 17 bp, Homo sapiens
cagttggtgattttaga

SEQ ID NO: 1778063 - DNA, 21 bp, Homo sapiens
cagttgtatttaacagaaatt

SEQ ID NO: 1778064 - DNA, 19 bp, Homo sapiens
cagttgtccttaaatttgt

SEQ ID NO: 1778065 - DNA, 22 bp, Homo sapiens
cagttgtctattctgagccttg

SEQ ID NO: 1778066 - DNA, 23 bp, Homo sapiens
cagttgtctattctgagccttga

SEQ ID NO: 1778067 - DNA, 22 bp, Homo sapiens
cagttgtgaatacattctttgc

SEQ ID NO: 1778068 - DNA, 23 bp, Homo sapiens
cagttgtgaatacattctttgct

SEQ ID NO: 1778069 - DNA, 12 bp, Homo sapiens
cagttgtgattt

SEQ ID NO: 1778070 - DNA, 16 bp, Homo sapiens
cagttgtgatttctgt

SEQ ID NO: 1778071 - DNA, 22 bp, Homo sapiens
cagttgtgatttctgtggatcc

SEQ ID NO: 1778072 - DNA, 21 bp, Homo sapiens
cagttgtggtactgtcattga

SEQ ID NO: 1778073 - DNA, 21 bp, Homo sapiens
cagttgttaagtccttggctt

SEQ ID NO: 1778074 - DNA, 23 bp, Homo sapiens
cagttgttcaataataaatattt

SEQ ID NO: 1778075 - DNA, 20 bp, Homo sapiens
cagttgttggcctccggcct

SEQ ID NO: 1778076 - DNA, 16 bp, Homo sapiens
cagttgtttgcttctt

SEQ ID NO: 1778077 - DNA, 22 bp, Homo sapiens
catctcgccacccctccttcct

SEQ ID NO: 1778078 - DNA, 16 bp, Homo sapiens
catctctcatcctcca

SEQ ID NO: 1778079 - DNA, 14 bp, Homo sapiens
catctctgcctgtc

SEQ ID NO: 1778080 - DNA, 15 bp, Homo sapiens
catctctgcctgtca

SEQ ID NO: 1778081 - DNA, 16 bp, Homo sapiens
catctcttagctcccc

SEQ ID NO: 1778082 - DNA, 19 bp, Homo sapiens
catctcttagctcccctcc

SEQ ID NO: 1778083 - DNA, 23 bp, Homo sapiens
catctcttagctcccctccaacc

SEQ ID NO: 1778084 - DNA, 11 bp, Homo sapiens
catctcttcag

SEQ ID NO: 1778085 - DNA, 22 bp, Homo sapiens
catctcttgaaacctgttaaaa

SEQ ID NO: 1778086 - DNA, 13 bp, Homo sapiens
catctgaaaagaa

SEQ ID NO: 1778087 - DNA, 13 bp, Homo sapiens
catctgaaagcca

SEQ ID NO: 1778088 - DNA, 15 bp, Homo sapiens
catctgaagagcaga

SEQ ID NO: 1778089 - DNA, 16 bp, Homo sapiens
catctgaccatctgtg

SEQ ID NO: 1778090 - DNA, 17 bp, Homo sapiens
catctgaccatctgtga

SEQ ID NO: 1778091 - DNA, 16 bp, Homo sapiens
catctgactgccaagc

SEQ ID NO: 1778092 - DNA, 18 bp, Homo sapiens
catctgagaggctctccg

SEQ ID NO: 1778093 - DNA, 21 bp, Homo sapiens
catctgagaggctctccgtgc

SEQ ID NO: 1778094 - DNA, 18 bp, Homo sapiens
catctgatgccgtgatcc

SEQ ID NO: 1778095 - DNA, 21 bp, Homo sapiens
catctgatttacttaattcag

SEQ ID NO: 1778096 - DNA, 16 bp, Homo sapiens
catctgcaccccttct

SEQ ID NO: 1778097 - DNA, 23 bp, Homo sapiens
catctgcaccccttctctcctcc

SEQ ID NO: 1778098 - DNA, 11 bp, Homo sapiens
catctgcatca

SEQ ID NO: 1778099 - DNA, 13 bp, Homo sapiens
catctgcatgtct

SEQ ID NO: 1778100 - DNA, 15 bp, Homo sapiens
catctgcattcctga

SEQ ID NO: 1778101 - DNA, 19 bp, Homo sapiens
catctgcattttcacccca

SEQ ID NO: 1778102 - DNA, 17 bp, Homo sapiens
catctgcccctccccca

SEQ ID NO: 1778103 - DNA, 20 bp, Homo sapiens
catctgccgtgcctggatcc

SEQ ID NO: 1778104 - DNA, 23 bp, Homo sapiens
catctgctctagattcataaata

SEQ ID NO: 1778105 - DNA, 22 bp, Homo sapiens
catctgctctagggaatctgga

SEQ ID NO: 1778106 - DNA, 20 bp, Homo sapiens
catctgctctccttcctgga

SEQ ID NO: 1778107 - DNA, 18 bp, Homo sapiens
catctgcttggttggctg

SEQ ID NO: 1778108 - DNA, 15 bp, Homo sapiens
catctggatgtaaat

SEQ ID NO: 1778109 - DNA, 20 bp, Homo sapiens
catctggcaacatctttatc

SEQ ID NO: 1778110 - DNA, 14 bp, Homo sapiens
catctggccctgac

SEQ ID NO: 1778111 - DNA, 18 bp, Homo sapiens
catctggctctaattcac

SEQ ID NO: 1778112 - DNA, 18 bp, Homo sapiens
catctggctgtctagaat

SEQ ID NO: 1778113 - DNA, 20 bp, Homo sapiens
catctggctgtctagaatgt

SEQ ID NO: 1778114 - DNA, 19 bp, Homo sapiens
catctggctttttctgcca

SEQ ID NO: 1778115 - DNA, 17 bp, Homo sapiens
catctgggtgccctgaa

SEQ ID NO: 1778116 - DNA, 18 bp, Homo sapiens
catctggtgtaggaagtt

SEQ ID NO: 1778117 - DNA, 14 bp, Homo sapiens
catctgtaagagct

SEQ ID NO: 1778118 - DNA, 17 bp, Homo sapiens
catctgtaagagcttgc

SEQ ID NO: 1778119 - DNA, 22 bp, Homo sapiens
catctgtaagagcttgctccag

SEQ ID NO: 1778120 - DNA, 22 bp, Homo sapiens
catctgtccacatccccagagc

SEQ ID NO: 1778121 - DNA, 23 bp, Homo sapiens
catctgtccacatccccagagcc

SEQ ID NO: 1778122 - DNA, 22 bp, Homo sapiens
catctgtcttgccagccagaag

SEQ ID NO: 1778123 - DNA, 17 bp, Homo sapiens
catctgtgactataaag

SEQ ID NO: 1778124 - DNA, 23 bp, Homo sapiens
catctgtgactataaagctgtta

SEQ ID NO: 1778125 - DNA, 15 bp, Homo sapiens
catctgtgattccct

SEQ ID NO: 1778126 - DNA, 13 bp, Homo sapiens
catctgtggagct

SEQ ID NO: 1778127 - DNA, 15 bp, Homo sapiens
catctgtggagctgc

SEQ ID NO: 1778128 - DNA, 19 bp, Homo sapiens
catctgtgtttcaagtggg

SEQ ID NO: 1778129 - DNA, 19 bp, Homo sapiens
catctgtttaatttacaca

SEQ ID NO: 1778130 - DNA, 21 bp, Homo sapiens
catctgtttcaaactgaattt

SEQ ID NO: 1778131 - DNA, 12 bp, Homo sapiens
catcttaaacta

SEQ ID NO: 1778132 - DNA, 22 bp, Homo sapiens
catcttaaatctaaacaaaaaa

SEQ ID NO: 1778133 - DNA, 16 bp, Homo sapiens
catgcaatgacatctt

SEQ ID NO: 1778134 - DNA, 11 bp, Homo sapiens
catgcacacac

SEQ ID NO: 1778135 - DNA, 12 bp, Homo sapiens
catgcacacggc

SEQ ID NO: 1778136 - DNA, 23 bp, Homo sapiens
catgcacacggctggtcactctg

SEQ ID NO: 1778137 - DNA, 23 bp, Homo sapiens
catgcacagctgcttgtcctgct

SEQ ID NO: 1778138 - DNA, 22 bp, Homo sapiens
catgcacagtacaataatgtac

SEQ ID NO: 1778139 - DNA, 17 bp, Homo sapiens
catgcacagtatttgta

SEQ ID NO: 1778140 - DNA, 15 bp, Homo sapiens
catgcacatttatat

SEQ ID NO: 1778141 - DNA, 17 bp, Homo sapiens
catgcacatttatatat

SEQ ID NO: 1778142 - DNA, 15 bp, Homo sapiens
catgcacattttgta

SEQ ID NO: 1778143 - DNA, 17 bp, Homo sapiens
catgcacctcccttccc

SEQ ID NO: 1778144 - DNA, 22 bp, Homo sapiens
catgcacgggcatgcacacggc

SEQ ID NO: 1778145 - DNA, 16 bp, Homo sapiens
catgcactcaccccta

SEQ ID NO: 1778146 - DNA, 12 bp, Homo sapiens
catgcactgacc

SEQ ID NO: 1778147 - DNA, 22 bp, Homo sapiens
catgcactgacccttccagaca

SEQ ID NO: 1778148 - DNA, 17 bp, Homo sapiens
catgcactgtgaaggac

SEQ ID NO: 1778149 - DNA, 12 bp, Homo sapiens
catgcagaacac

SEQ ID NO: 1778150 - DNA, 18 bp, Homo sapiens
catgcagacaaagccctg

SEQ ID NO: 1778151 - DNA, 21 bp, Homo sapiens
catgcagacaaagccctgtcc

SEQ ID NO: 1778152 - DNA, 22 bp, Homo sapiens
catgcagacaaagccctgtcct

SEQ ID NO: 1778153 - DNA, 23 bp, Homo sapiens
catgcagacaaagccctgtcctt

SEQ ID NO: 1778154 - DNA, 21 bp, Homo sapiens
catgcagacctcatgcccagc

SEQ ID NO: 1778155 - DNA, 17 bp, Homo sapiens
catgcagactcctcaga

SEQ ID NO: 1778156 - DNA, 22 bp, Homo sapiens
catgcagactcctcagatctga

SEQ ID NO: 1778157 - DNA, 17 bp, Homo sapiens
catgcagagtatttcta

SEQ ID NO: 1778158 - DNA, 17 bp, Homo sapiens
catgcagccgtgatcaa

SEQ ID NO: 1778159 - DNA, 22 bp, Homo sapiens
catgcagcctaaggctgtatga

SEQ ID NO: 1778160 - DNA, 18 bp, Homo sapiens
catgcaggaagaggccca

SEQ ID NO: 1778161 - DNA, 19 bp, Homo sapiens
catgcaggaagaggcccac

SEQ ID NO: 1778162 - DNA, 11 bp, Homo sapiens
catgcaggagg

SEQ ID NO: 1778163 - DNA, 12 bp, Homo sapiens
catgcaggaggt

SEQ ID NO: 1778164 - DNA, 23 bp, Homo sapiens
catgcagtctaaaatgcttcagt

SEQ ID NO: 1778165 - DNA, 17 bp, Homo sapiens
catgcatagtcccagct

SEQ ID NO: 1778166 - DNA, 14 bp, Homo sapiens
catgcatgacactt

SEQ ID NO: 1778167 - DNA, 17 bp, Homo sapiens
catgcatgtcctgtaaa

SEQ ID NO: 1778168 - DNA, 20 bp, Homo sapiens
catgcattttgcagcagtga

SEQ ID NO: 1778169 - DNA, 19 bp, Homo sapiens
catgccaccacccacccca

SEQ ID NO: 1778170 - DNA, 21 bp, Homo sapiens
catgccaccatggccagccaa

SEQ ID NO: 1778171 - DNA, 20 bp, Homo sapiens
catgccacgccccgtgtctg

SEQ ID NO: 1778172 - DNA, 19 bp, Homo sapiens
catgccactacactccagc

SEQ ID NO: 1778173 - DNA, 14 bp, Homo sapiens
catgccactgccag

SEQ ID NO: 1778174 - DNA, 15 bp, Homo sapiens
catgccactgccagg

SEQ ID NO: 1778175 - DNA, 18 bp, Homo sapiens
catgccactgccaggcac

SEQ ID NO: 1778176 - DNA, 20 bp, Homo sapiens
catgccaggacccgccagcc

SEQ ID NO: 1778177 - DNA, 23 bp, Homo sapiens
catgccaggacccgccagccccg

SEQ ID NO: 1778178 - DNA, 19 bp, Homo sapiens
catgccagtatttttaaag

SEQ ID NO: 1778179 - DNA, 14 bp, Homo sapiens
catgccatctgttt

SEQ ID NO: 1778180 - DNA, 21 bp, Homo sapiens
catgccattctgcctcagcct

SEQ ID NO: 1778181 - DNA, 19 bp, Homo sapiens
catgcccaccccctgccct

SEQ ID NO: 1778182 - DNA, 21 bp, Homo sapiens
catgcccacctgcccatcaca

SEQ ID NO: 1778183 - DNA, 13 bp, Homo sapiens
catgcccagctct

SEQ ID NO: 1778184 - DNA, 15 bp, Homo sapiens
catgcccagctctct

SEQ ID NO: 1778185 - DNA, 17 bp, Homo sapiens
catgccccagctctgga

SEQ ID NO: 1778186 - DNA, 18 bp, Homo sapiens
catgccccagctctggat

SEQ ID NO: 1778187 - DNA, 13 bp, Homo sapiens
catgccccaggat

SEQ ID NO: 1778188 - DNA, 21 bp, Homo sapiens
catgccctaagagtgtcactg

SEQ ID NO: 1778189 - DNA, 12 bp, Homo sapiens
catgccctcctg

SEQ ID NO: 1778190 - DNA, 15 bp, Homo sapiens
catgccctcctggac

SEQ ID NO: 1778191 - DNA, 17 bp, Homo sapiens
catgccctgtgtggctg

SEQ ID NO: 1778192 - DNA, 22 bp, Homo sapiens
catgccgcgggcggccaggcaa

SEQ ID NO: 1778193 - DNA, 18 bp, Homo sapiens
catgccgcgtccctgccc

SEQ ID NO: 1778194 - DNA, 23 bp, Homo sapiens
catgccgggcccctccatccacc

SEQ ID NO: 1778195 - DNA, 14 bp, Homo sapiens
catgccgggcgcag

SEQ ID NO: 1778196 - DNA, 18 bp, Homo sapiens
catgcctcactaattttt

SEQ ID NO: 1778197 - DNA, 13 bp, Homo sapiens
catgcctcatgcc

SEQ ID NO: 1778198 - DNA, 14 bp, Homo sapiens
catgcctcatgcca

SEQ ID NO: 1778199 - DNA, 11 bp, Homo sapiens
catgcctgagg

SEQ ID NO: 1778200 - DNA, 15 bp, Homo sapiens
catgcctgagggtgg

SEQ ID NO: 1778201 - DNA, 17 bp, Homo sapiens
catgcctgctccctgtc

SEQ ID NO: 1778202 - DNA, 19 bp, Homo sapiens
catgcctgctccctgtctg

SEQ ID NO: 1778203 - DNA, 18 bp, Homo sapiens
catgcctggtattttcaa

SEQ ID NO: 1778204 - DNA, 23 bp, Homo sapiens
catgcctgtaatcccagaacttt

SEQ ID NO: 1778205 - DNA, 20 bp, Homo sapiens
catgcctgtagctttcctgg

SEQ ID NO: 1778206 - DNA, 16 bp, Homo sapiens
catgcctgtagtctca

SEQ ID NO: 1778207 - DNA, 15 bp, Homo sapiens
catgctgctttgcca

SEQ ID NO: 1778208 - DNA, 13 bp, Homo sapiens
catgctggaaata

SEQ ID NO: 1778209 - DNA, 14 bp, Homo sapiens
catgctggaaataa

SEQ ID NO: 1778210 - DNA, 18 bp, Homo sapiens
catgctggagggaggctg

SEQ ID NO: 1778211 - DNA, 21 bp, Homo sapiens
catgctgggccactggggact

SEQ ID NO: 1778212 - DNA, 19 bp, Homo sapiens
catgcttagtcactgcctg

SEQ ID NO: 1778213 - DNA, 16 bp, Homo sapiens
catgcttcacaatgtt

SEQ ID NO: 1778214 - DNA, 16 bp, Homo sapiens
catgcttcctttctct

SEQ ID NO: 1778215 - DNA, 14 bp, Homo sapiens
catgcttcttctca

SEQ ID NO: 1778216 - DNA, 14 bp, Homo sapiens
catgcttgggctga

SEQ ID NO: 1778217 - DNA, 21 bp, Homo sapiens
catgcttgggctgacccagca

SEQ ID NO: 1778218 - DNA, 23 bp, Homo sapiens
catgcttgggctgacccagcatc

SEQ ID NO: 1778219 - DNA, 14 bp, Homo sapiens
catgctttccattt

SEQ ID NO: 1778220 - DNA, 19 bp, Homo sapiens
catgctttgctgctatgaa

SEQ ID NO: 1778221 - DNA, 14 bp, Homo sapiens
catggaaaaatact

SEQ ID NO: 1778222 - DNA, 15 bp, Homo sapiens
catggaaaaatggtt

SEQ ID NO: 1778223 - DNA, 23 bp, Homo sapiens
catggaaaaatggttgatggaaa

SEQ ID NO: 1778224 - DNA, 15 bp, Homo sapiens
catggaacacttcga

SEQ ID NO: 1778225 - DNA, 16 bp, Homo sapiens
catggaactcattcct

SEQ ID NO: 1778226 - DNA, 21 bp, Homo sapiens
catggaaggggcttctggacc

SEQ ID NO: 1778227 - DNA, 18 bp, Homo sapiens
catggaatcgaagtgttt

SEQ ID NO: 1778228 - DNA, 23 bp, Homo sapiens
catggaatggcaggtgtcatatg

SEQ ID NO: 1778229 - DNA, 18 bp, Homo sapiens
catggacatgatcttctt

SEQ ID NO: 1778230 - DNA, 18 bp, Homo sapiens
catggacatttagaagaa

SEQ ID NO: 1778231 - DNA, 20 bp, Homo sapiens
catggacatttagaagaaag

SEQ ID NO: 1778232 - DNA, 19 bp, Homo sapiens
catggactgagctggggga

SEQ ID NO: 1778233 - DNA, 15 bp, Homo sapiens
catggacttcacata

SEQ ID NO: 1778234 - DNA, 12 bp, Homo sapiens
catggacttgta

SEQ ID NO: 1778235 - DNA, 22 bp, Homo sapiens
catggacttgtatatttgtaca

SEQ ID NO: 1778236 - DNA, 14 bp, Homo sapiens
catggagaaaccct

SEQ ID NO: 1778237 - DNA, 16 bp, Homo sapiens
catggagaaaccctgt

SEQ ID NO: 1778238 - DNA, 16 bp, Homo sapiens
catggagactcctgcc

SEQ ID NO: 1778239 - DNA, 15 bp, Homo sapiens
catggagctgggcta

SEQ ID NO: 1778240 - DNA, 14 bp, Homo sapiens
catggaggagcttg

SEQ ID NO: 1778241 - DNA, 23 bp, Homo sapiens
catggaggaggagggaggcgctg

SEQ ID NO: 1778242 - DNA, 15 bp, Homo sapiens
catggaggttctaag

SEQ ID NO: 1778243 - DNA, 14 bp, Homo sapiens
catggatgcatgcc

SEQ ID NO: 1778244 - DNA, 16 bp, Homo sapiens
catggatgcatgccct

SEQ ID NO: 1778245 - DNA, 23 bp, Homo sapiens
catggattgattcagtcttctgg

SEQ ID NO: 1778246 - DNA, 19 bp, Homo sapiens
catggcaccaaagccacca

SEQ ID NO: 1778247 - DNA, 12 bp, Homo sapiens
catggcaccagc

SEQ ID NO: 1778248 - DNA, 22 bp, Homo sapiens
catggcaccagccccctggatg

SEQ ID NO: 1778249 - DNA, 21 bp, Homo sapiens
catggcagaataatctttggg

SEQ ID NO: 1778250 - DNA, 17 bp, Homo sapiens
catggcagagtttgtgt

SEQ ID NO: 1778251 - DNA, 19 bp, Homo sapiens
catggcagcagccagggac

SEQ ID NO: 1778252 - DNA, 17 bp, Homo sapiens
catggcagctgtttctc

SEQ ID NO: 1778253 - DNA, 13 bp, Homo sapiens
catggcatatttt

SEQ ID NO: 1778254 - DNA, 15 bp, Homo sapiens
catggcatatttttc

SEQ ID NO: 1778255 - DNA, 19 bp, Homo sapiens
catggcatatttttcacat

SEQ ID NO: 1778256 - DNA, 15 bp, Homo sapiens
catggcatccaagac

SEQ ID NO: 1778257 - DNA, 19 bp, Homo sapiens
catggcatgcttaaatttt

SEQ ID NO: 1778258 - DNA, 21 bp, Homo sapiens
catggcatggttttgtgccat

SEQ ID NO: 1778259 - DNA, 12 bp, Homo sapiens
catggccacccc

SEQ ID NO: 1778260 - DNA, 22 bp, Homo sapiens
catggccacttgggtcttccct

SEQ ID NO: 1778261 - DNA, 15 bp, Homo sapiens
catggccccaggccc

SEQ ID NO: 1778262 - DNA, 14 bp, Homo sapiens
catggcccccaata

SEQ ID NO: 1778263 - DNA, 22 bp, Homo sapiens
catggcccccaataaaggcagc

SEQ ID NO: 1778264 - DNA, 20 bp, Homo sapiens
catggcccccaggggcagga

SEQ ID NO: 1778265 - DNA, 12 bp, Homo sapiens
catggcccctct

SEQ ID NO: 1778266 - DNA, 20 bp, Homo sapiens
catggccgaagccccttgga

SEQ ID NO: 1778267 - DNA, 22 bp, Homo sapiens
catggccgggccctctgtagct

SEQ ID NO: 1778268 - DNA, 16 bp, Homo sapiens
catggcctatgcacat

SEQ ID NO: 1778269 - DNA, 17 bp, Homo sapiens
catggcctatgcacata

SEQ ID NO: 1778270 - DNA, 20 bp, Homo sapiens
catggcctattatattaaaa

SEQ ID NO: 1778271 - DNA, 18 bp, Homo sapiens
catggcctctggccaggc

SEQ ID NO: 1778272 - DNA, 20 bp, Homo sapiens
catggcctgagatgcaggtg

SEQ ID NO: 1778273 - DNA, 19 bp, Homo sapiens
catggcctggactgactgc

SEQ ID NO: 1778274 - DNA, 23 bp, Homo sapiens
catggcctggactgactgcagcc

SEQ ID NO: 1778275 - DNA, 13 bp, Homo sapiens
catggcctgtgct

SEQ ID NO: 1778276 - DNA, 19 bp, Homo sapiens
catggccttatgaggcagg

SEQ ID NO: 1778277 - DNA, 17 bp, Homo sapiens
catggcgtaatgggcct

SEQ ID NO: 1778278 - DNA, 18 bp, Homo sapiens
catggcgtaatgggcctg

SEQ ID NO: 1778279 - DNA, 20 bp, Homo sapiens
catggcgtaatgggcctgcc

SEQ ID NO: 1778280 - DNA, 21 bp, Homo sapiens
catggcgtaatgggcctgccc

SEQ ID NO: 1778281 - DNA, 23 bp, Homo sapiens
catggcgtaatgggcctgcccaa

SEQ ID NO: 1778282 - DNA, 20 bp, Homo sapiens
catggcgtggaggaggaggg

SEQ ID NO: 1778283 - DNA, 19 bp, Homo sapiens
catggcgtgtccctctcgg

SEQ ID NO: 1778284 - DNA, 14 bp, Homo sapiens
catggctaactggc

SEQ ID NO: 1778285 - DNA, 16 bp, Homo sapiens
catggctaactggcga

SEQ ID NO: 1778286 - DNA, 22 bp, Homo sapiens
catggctcagatcggccacagg

SEQ ID NO: 1778287 - DNA, 18 bp, Homo sapiens
catggctcaggcaagccc

SEQ ID NO: 1778288 - DNA, 17 bp, Homo sapiens
catggctccagaaatgt

SEQ ID NO: 1778289 - DNA, 16 bp, Homo sapiens
catggctcctgtctgg

SEQ ID NO: 1778290 - DNA, 18 bp, Homo sapiens
catggggaggcagcagag

SEQ ID NO: 1778291 - DNA, 23 bp, Homo sapiens
catggggagggattctggttcca

SEQ ID NO: 1778292 - DNA, 20 bp, Homo sapiens
catggggcatgtcctttcca

SEQ ID NO: 1778293 - DNA, 14 bp, Homo sapiens
catggggcccctgg

SEQ ID NO: 1778294 - DNA, 15 bp, Homo sapiens
catggggcgctccca

SEQ ID NO: 1778295 - DNA, 19 bp, Homo sapiens
catggggcgctcccactca

SEQ ID NO: 1778296 - DNA, 21 bp, Homo sapiens
catggggcgctcccactcaga

SEQ ID NO: 1778297 - DNA, 23 bp, Homo sapiens
catggggctggggtcctcctgtg

SEQ ID NO: 1778298 - DNA, 17 bp, Homo sapiens
catgggggcacttgagt

SEQ ID NO: 1778299 - DNA, 13 bp, Homo sapiens
catgggggctgcc

SEQ ID NO: 1778300 - DNA, 15 bp, Homo sapiens
catgggggctgccag

SEQ ID NO: 1778301 - DNA, 17 bp, Homo sapiens
catggggtccttggagt

SEQ ID NO: 1778302 - DNA, 19 bp, Homo sapiens
catggggtccttggagtga

SEQ ID NO: 1778303 - DNA, 16 bp, Homo sapiens
catggggttcctggtt

SEQ ID NO: 1778304 - DNA, 14 bp, Homo sapiens
catggggttcgaga

SEQ ID NO: 1778305 - DNA, 22 bp, Homo sapiens
catggggtttggttgtgctgat

SEQ ID NO: 1778306 - DNA, 16 bp, Homo sapiens
catgggtccagggcct

SEQ ID NO: 1778307 - DNA, 21 bp, Homo sapiens
catgggtccagggcctgacac

SEQ ID NO: 1778308 - DNA, 22 bp, Homo sapiens
catgggtgaagggagagccagc

SEQ ID NO: 1778309 - DNA, 13 bp, Homo sapiens
catgggtggaggg

SEQ ID NO: 1778310 - DNA, 15 bp, Homo sapiens
catggtactgtagca

SEQ ID NO: 1778311 - DNA, 14 bp, Homo sapiens
catggtatcatata

SEQ ID NO: 1778312 - DNA, 16 bp, Homo sapiens
catggtcatcaccacc

SEQ ID NO: 1778313 - DNA, 18 bp, Homo sapiens
catggtcctttctggaag

SEQ ID NO: 1778314 - DNA, 20 bp, Homo sapiens
catggtgaaacccccatctc

SEQ ID NO: 1778315 - DNA, 19 bp, Homo sapiens
catggtgaaaccccgtctc

SEQ ID NO: 1778316 - DNA, 16 bp, Homo sapiens
catggtgatcagtgca

SEQ ID NO: 1778317 - DNA, 16 bp, Homo sapiens
catggtgccccaggac

SEQ ID NO: 1778318 - DNA, 18 bp, Homo sapiens
catggtgccccaggacca

SEQ ID NO: 1778319 - DNA, 13 bp, Homo sapiens
catggtgcctgag

SEQ ID NO: 1778320 - DNA, 14 bp, Homo sapiens
catggtgcctgaga

SEQ ID NO: 1778321 - DNA, 15 bp, Homo sapiens
catggtgcctgagag

SEQ ID NO: 1778322 - DNA, 19 bp, Homo sapiens
catggtgcctgagaggcag

SEQ ID NO: 1778323 - DNA, 22 bp, Homo sapiens
catggtgcctgagaggcaggca

SEQ ID NO: 1778324 - DNA, 13 bp, Homo sapiens
catggtgctagga

SEQ ID NO: 1778325 - DNA, 22 bp, Homo sapiens
catggtgctaggaagaggagtg

SEQ ID NO: 1778326 - DNA, 22 bp, Homo sapiens
catggtggacccagcgggcagg

SEQ ID NO: 1778327 - DNA, 17 bp, Homo sapiens
catggtggcgcaagcct

SEQ ID NO: 1778328 - DNA, 12 bp, Homo sapiens
catggtgggtag

SEQ ID NO: 1778329 - DNA, 16 bp, Homo sapiens
catggtgtggggggct

SEQ ID NO: 1778330 - DNA, 21 bp, Homo sapiens
catggtgtggggggctggggg

SEQ ID NO: 1778331 - DNA, 23 bp, Homo sapiens
catggtgtggggggctgggggag

SEQ ID NO: 1778332 - DNA, 23 bp, Homo sapiens
catggtgtgtggtgctacaggga

SEQ ID NO: 1778333 - DNA, 16 bp, Homo sapiens
catggttaagagtcca

SEQ ID NO: 1778334 - DNA, 21 bp, Homo sapiens
catggtttaaatatgaatgaa

SEQ ID NO: 1778335 - DNA, 16 bp, Homo sapiens
catggtttgactctgg

SEQ ID NO: 1778336 - DNA, 13 bp, Homo sapiens
catggtttgatat

SEQ ID NO: 1778337 - DNA, 14 bp, Homo sapiens
catgtaaaagagtc

SEQ ID NO: 1778338 - DNA, 12 bp, Homo sapiens
catgtaaaatat

SEQ ID NO: 1778339 - DNA, 13 bp, Homo sapiens
catgtaaaatatg

SEQ ID NO: 1778340 - DNA, 23 bp, Homo sapiens
catgtaaatactttccatgtttt

SEQ ID NO: 1778341 - DNA, 16 bp, Homo sapiens
catgtaaattttgtat

SEQ ID NO: 1778342 - DNA, 9 bp, Homo sapiens
catgtaaca

SEQ ID NO: 1778343 - DNA, 22 bp, Homo sapiens
catgtaaccggcatgtttccag

SEQ ID NO: 1778344 - DNA, 18 bp, Homo sapiens
catgtaactatttcttca

SEQ ID NO: 1778345 - DNA, 19 bp, Homo sapiens
catgtaactatttcttcag

SEQ ID NO: 1778346 - DNA, 17 bp, Homo sapiens
catgtaagaaaatgtta

SEQ ID NO: 1778347 - DNA, 18 bp, Homo sapiens
catgtaagaaaatgttac

SEQ ID NO: 1778348 - DNA, 16 bp, Homo sapiens
catgtaataaattcaa

SEQ ID NO: 1778349 - DNA, 22 bp, Homo sapiens
catgtaatatatttcagacatt

SEQ ID NO: 1778350 - DNA, 21 bp, Homo sapiens
catgtaatggtatcttaaagt

SEQ ID NO: 1778351 - DNA, 23 bp, Homo sapiens
catgtaatgttaatgttatatca

SEQ ID NO: 1778352 - DNA, 21 bp, Homo sapiens
catgtacaaaatcgattggct

SEQ ID NO: 1778353 - DNA, 21 bp, Homo sapiens
catgtacatagtaaagtattt

SEQ ID NO: 1778354 - DNA, 15 bp, Homo sapiens
catgtacatgaagaa

SEQ ID NO: 1778355 - DNA, 21 bp, Homo sapiens
catgtactacagctatatttg

SEQ ID NO: 1778356 - DNA, 21 bp, Homo sapiens
catgtactatcttatctcaga

SEQ ID NO: 1778357 - DNA, 19 bp, Homo sapiens
catgtactgagccttgtaa

SEQ ID NO: 1778358 - DNA, 22 bp, Homo sapiens
catgtactttttagtaatttct

SEQ ID NO: 1778359 - DNA, 16 bp, Homo sapiens
catgtagaactcagca

SEQ ID NO: 1778360 - DNA, 21 bp, Homo sapiens
catgtagaactcagcagttga

SEQ ID NO: 1778361 - DNA, 19 bp, Homo sapiens
catgtagtaacactaatat

SEQ ID NO: 1778362 - DNA, 23 bp, Homo sapiens
catgtagtaacactaatatattt

SEQ ID NO: 1778363 - DNA, 21 bp, Homo sapiens
catgtatcccaactcctataa

SEQ ID NO: 1778364 - DNA, 18 bp, Homo sapiens
catgtatgaatgtaagga

SEQ ID NO: 1778365 - DNA, 18 bp, Homo sapiens
catgtatgtcttggacac

SEQ ID NO: 1778366 - DNA, 21 bp, Homo sapiens
catgtattcacacacccctca

SEQ ID NO: 1778367 - DNA, 14 bp, Homo sapiens
catgtatttgagca

SEQ ID NO: 1778368 - DNA, 14 bp, Homo sapiens
catgtatttgttat

SEQ ID NO: 1778369 - DNA, 17 bp, Homo sapiens
catgtatttgttatata

SEQ ID NO: 1778370 - DNA, 13 bp, Homo sapiens
catgtattttgtt

SEQ ID NO: 1778371 - DNA, 13 bp, Homo sapiens
catgtcaaacatg

SEQ ID NO: 1778372 - DNA, 21 bp, Homo sapiens
catgtcaattcataaaaacaa

SEQ ID NO: 1778373 - DNA, 16 bp, Homo sapiens
catgtcacctcagctg

SEQ ID NO: 1778374 - DNA, 20 bp, Homo sapiens
catgtcactaaacaagaaat

SEQ ID NO: 1778375 - DNA, 10 bp, Homo sapiens
catgtcatgt

SEQ ID NO: 1778376 - DNA, 18 bp, Homo sapiens
catgtcatttcagaagtt

SEQ ID NO: 1778377 - DNA, 14 bp, Homo sapiens
catgtcccacccac

SEQ ID NO: 1778378 - DNA, 10 bp, Homo sapiens
catgtccccc

SEQ ID NO: 1778379 - DNA, 17 bp, Homo sapiens
catgtccctacacccct

SEQ ID NO: 1778380 - DNA, 23 bp, Homo sapiens
catgtccctaccgagtctcttct

SEQ ID NO: 1778381 - DNA, 13 bp, Homo sapiens
catgtcctgccta

SEQ ID NO: 1778382 - DNA, 14 bp, Homo sapiens
catgtcctgtaaag

SEQ ID NO: 1778383 - DNA, 11 bp, Homo sapiens
catttctgttc

SEQ ID NO: 1778384 - DNA, 16 bp, Homo sapiens
catttctgttctcatt

SEQ ID NO: 1778385 - DNA, 15 bp, Homo sapiens
catttcttcacttca

SEQ ID NO: 1778386 - DNA, 18 bp, Homo sapiens
catttctttgtgctttgg

SEQ ID NO: 1778387 - DNA, 19 bp, Homo sapiens
catttgacacaaagcttct

SEQ ID NO: 1778388 - DNA, 19 bp, Homo sapiens
catttgagggcccagccag

SEQ ID NO: 1778389 - DNA, 22 bp, Homo sapiens
catttgagttattttaattatc

SEQ ID NO: 1778390 - DNA, 23 bp, Homo sapiens
catttgagtttagggttctggtg

SEQ ID NO: 1778391 - DNA, 18 bp, Homo sapiens
catttgatatttttccat

SEQ ID NO: 1778392 - DNA, 16 bp, Homo sapiens
catttgatgctaaata

SEQ ID NO: 1778393 - DNA, 14 bp, Homo sapiens
catttgatgtacat

SEQ ID NO: 1778394 - DNA, 15 bp, Homo sapiens
catttgatgtacatg

SEQ ID NO: 1778395 - DNA, 17 bp, Homo sapiens
catttgattaacatttg

SEQ ID NO: 1778396 - DNA, 21 bp, Homo sapiens
catttgatttccatgggcccc

SEQ ID NO: 1778397 - DNA, 14 bp, Homo sapiens
catttgcagggtcc

SEQ ID NO: 1778398 - DNA, 22 bp, Homo sapiens
catttgcagggtcctcttctgg

SEQ ID NO: 1778399 - DNA, 21 bp, Homo sapiens
catttgcgaatggttccattc

SEQ ID NO: 1778400 - DNA, 15 bp, Homo sapiens
catttgctactgttg

SEQ ID NO: 1778401 - DNA, 20 bp, Homo sapiens
catttgctagttctgctgcc

SEQ ID NO: 1778402 - DNA, 12 bp, Homo sapiens
catttgctttaa

SEQ ID NO: 1778403 - DNA, 14 bp, Homo sapiens
catttgctttcctc

SEQ ID NO: 1778404 - DNA, 16 bp, Homo sapiens
catttgctttttcacc

SEQ ID NO: 1778405 - DNA, 15 bp, Homo sapiens
catttggagctcttg

SEQ ID NO: 1778406 - DNA, 23 bp, Homo sapiens
catttggagctcttgggtcagag

SEQ ID NO: 1778407 - DNA, 21 bp, Homo sapiens
catttggatcctgtgtggaga

SEQ ID NO: 1778408 - DNA, 22 bp, Homo sapiens
catttgggctcagggttggcca

SEQ ID NO: 1778409 - DNA, 20 bp, Homo sapiens
catttggggtttgtgtttga

SEQ ID NO: 1778410 - DNA, 20 bp, Homo sapiens
catttgggttggttccaagt

SEQ ID NO: 1778411 - DNA, 23 bp, Homo sapiens
catttggtagatgttcttttcta

SEQ ID NO: 1778412 - DNA, 23 bp, Homo sapiens
catttggtctcactacttgacca

SEQ ID NO: 1778413 - DNA, 16 bp, Homo sapiens
catttggtctcaggca

SEQ ID NO: 1778414 - DNA, 17 bp, Homo sapiens
catttggtctgccagaa

SEQ ID NO: 1778415 - DNA, 22 bp, Homo sapiens
catttggtgagagtcaaagctg

SEQ ID NO: 1778416 - DNA, 17 bp, Homo sapiens
catttggtgttcctgga

SEQ ID NO: 1778417 - DNA, 19 bp, Homo sapiens
catttggtgttcctggaag

SEQ ID NO: 1778418 - DNA, 20 bp, Homo sapiens
catttggttttacacaggaa

SEQ ID NO: 1778419 - DNA, 22 bp, Homo sapiens
catttgtaagtgtaaaaaatgt

SEQ ID NO: 1778420 - DNA, 14 bp, Homo sapiens
catttgtaataaag

SEQ ID NO: 1778421 - DNA, 16 bp, Homo sapiens
catttgtaataaagta

SEQ ID NO: 1778422 - DNA, 17 bp, Homo sapiens
catttgtaataaagtat

SEQ ID NO: 1778423 - DNA, 12 bp, Homo sapiens
catttgtaattt

SEQ ID NO: 1778424 - DNA, 17 bp, Homo sapiens
catttgtacaaggtaat

SEQ ID NO: 1778425 - DNA, 21 bp, Homo sapiens
catttgtacaaggtaattgtt

SEQ ID NO: 1778426 - DNA, 23 bp, Homo sapiens
catttgtacaaggtaattgtttt

SEQ ID NO: 1778427 - DNA, 19 bp, Homo sapiens
catttgtatgtcaaagctt

SEQ ID NO: 1778428 - DNA, 22 bp, Homo sapiens
catttgtattactgcttcccat

SEQ ID NO: 1778429 - DNA, 20 bp, Homo sapiens
catttgtattgcttatttta

SEQ ID NO: 1778430 - DNA, 16 bp, Homo sapiens
catttgtctgtgtttg

SEQ ID NO: 1778431 - DNA, 15 bp, Homo sapiens
catttgtgaggccca

SEQ ID NO: 1778432 - DNA, 16 bp, Homo sapiens
catttgtgccagagga

SEQ ID NO: 1778433 - DNA, 16 bp, Homo sapiens
catttgtgctagaaat

SEQ ID NO: 1778434 - DNA, 23 bp, Homo sapiens
catttgtggcagtcccttataat

SEQ ID NO: 1778435 - DNA, 19 bp, Homo sapiens
catttgtggtaatctacac

SEQ ID NO: 1778436 - DNA, 14 bp, Homo sapiens
catttgtgtggaaa

SEQ ID NO: 1778437 - DNA, 22 bp, Homo sapiens
catttgtgttttgaaagcccaa

SEQ ID NO: 1778438 - DNA, 15 bp, Homo sapiens
catttgttaaaatta

SEQ ID NO: 1778439 - DNA, 22 bp, Homo sapiens
catttgttcactgaaggtgatt

SEQ ID NO: 1778440 - DNA, 16 bp, Homo sapiens
catttgtttgtattca

SEQ ID NO: 1778441 - DNA, 17 bp, Homo sapiens
catttgtttgtattcat

SEQ ID NO: 1778442 - DNA, 19 bp, Homo sapiens
catttgtttgtattcatgt

SEQ ID NO: 1778443 - DNA, 18 bp, Homo sapiens
catttgttttgcttttgt

SEQ ID NO: 1778444 - DNA, 21 bp, Homo sapiens
cattttaaaaacatagaaaaa

SEQ ID NO: 1778445 - DNA, 16 bp, Homo sapiens
cattttaactttatca

SEQ ID NO: 1778446 - DNA, 14 bp, Homo sapiens
cattttaattctct

SEQ ID NO: 1778447 - DNA, 19 bp, Homo sapiens
cattttaattttaaccaaa

SEQ ID NO: 1778448 - DNA, 16 bp, Homo sapiens
cattttacatagcaca

SEQ ID NO: 1778449 - DNA, 12 bp, Homo sapiens
cattttagccca

SEQ ID NO: 1778450 - DNA, 20 bp, Homo sapiens
cattttatatttttgtacat

SEQ ID NO: 1778451 - DNA, 18 bp, Homo sapiens
cattttatcattaaaaat

SEQ ID NO: 1778452 - DNA, 23 bp, Homo sapiens
cattttattaagctttttggaat

SEQ ID NO: 1778453 - DNA, 13 bp, Homo sapiens
cattttattaata

SEQ ID NO: 1778454 - DNA, 14 bp, Homo sapiens
cattgcaacaaaat

SEQ ID NO: 1778455 - DNA, 15 bp, Homo sapiens
cattgcaacaaaata

SEQ ID NO: 1778456 - DNA, 18 bp, Homo sapiens
cattgcacctgcaggctt

SEQ ID NO: 1778457 - DNA, 13 bp, Homo sapiens
cattgccaccagg

SEQ ID NO: 1778458 - DNA, 16 bp, Homo sapiens
cattgccaccaggaga

SEQ ID NO: 1778459 - DNA, 21 bp, Homo sapiens
cattgccacggaaacatacag

SEQ ID NO: 1778460 - DNA, 19 bp, Homo sapiens
cattgcccatggctgggaa

SEQ ID NO: 1778461 - DNA, 23 bp, Homo sapiens
cattgcccctccgatgctgaggc

SEQ ID NO: 1778462 - DNA, 16 bp, Homo sapiens
cattgcctcctgttct

SEQ ID NO: 1778463 - DNA, 20 bp, Homo sapiens
cattgcctgtaacaatgtaa

SEQ ID NO: 1778464 - DNA, 15 bp, Homo sapiens
cattgcctgttctgc

SEQ ID NO: 1778465 - DNA, 12 bp, Homo sapiens
cattgctaaaaa

SEQ ID NO: 1778466 - DNA, 12 bp, Homo sapiens
cattgctaccac

SEQ ID NO: 1778467 - DNA, 18 bp, Homo sapiens
cattgctaccacagactt

SEQ ID NO: 1778468 - DNA, 14 bp, Homo sapiens
cattgctcagcccg

SEQ ID NO: 1778469 - DNA, 15 bp, Homo sapiens
cattgctcagcccgc

SEQ ID NO: 1778470 - DNA, 20 bp, Homo sapiens
cattgctctatgtctgcctt

SEQ ID NO: 1778471 - DNA, 13 bp, Homo sapiens
cattgctctctgg

SEQ ID NO: 1778472 - DNA, 15 bp, Homo sapiens
cattgctctctgggc

SEQ ID NO: 1778473 - DNA, 18 bp, Homo sapiens
cattgctgcatatttgac

SEQ ID NO: 1778474 - DNA, 22 bp, Homo sapiens
cattgctgccaaggtggaggga

SEQ ID NO: 1778475 - DNA, 23 bp, Homo sapiens
cattgctgccaaggtggagggaa

SEQ ID NO: 1778476 - DNA, 13 bp, Homo sapiens
cattgctgctgct

SEQ ID NO: 1778477 - DNA, 22 bp, Homo sapiens
cattgctgctgctaccagcgcc

SEQ ID NO: 1778478 - DNA, 14 bp, Homo sapiens
cattgctggctgcc

SEQ ID NO: 1778479 - DNA, 17 bp, Homo sapiens
cattgcttaccttggtt

SEQ ID NO: 1778480 - DNA, 14 bp, Homo sapiens
cattgctttctgaa

SEQ ID NO: 1778481 - DNA, 19 bp, Homo sapiens
cattgcttttgtttcttaa

SEQ ID NO: 1778482 - DNA, 18 bp, Homo sapiens
cattggacccacatgagg

SEQ ID NO: 1778483 - DNA, 16 bp, Homo sapiens
cattggagctgactgt

SEQ ID NO: 1778484 - DNA, 12 bp, Homo sapiens
cattggcctctg

SEQ ID NO: 1778485 - DNA, 18 bp, Homo sapiens
cattggcctggcctccag

SEQ ID NO: 1778486 - DNA, 19 bp, Homo sapiens
cattggctcagcccgctga

SEQ ID NO: 1778487 - DNA, 23 bp, Homo sapiens
cattgggaccctccagtgctgga

SEQ ID NO: 1778488 - DNA, 15 bp, Homo sapiens
cattgggctgacacc

SEQ ID NO: 1778489 - DNA, 16 bp, Homo sapiens
cattggttcacctgtg

SEQ ID NO: 1778490 - DNA, 18 bp, Homo sapiens
cattggttcacctgtgac

SEQ ID NO: 1778491 - DNA, 14 bp, Homo sapiens
cattgtaaaataaa

SEQ ID NO: 1778492 - DNA, 15 bp, Homo sapiens
cattgtaaaataatt

SEQ ID NO: 1778493 - DNA, 19 bp, Homo sapiens
cattgtaaatagtatttga

SEQ ID NO: 1778494 - DNA, 21 bp, Homo sapiens
cattgtaaatgtgcttttaaa

SEQ ID NO: 1778495 - DNA, 14 bp, Homo sapiens
cattgtaatgttgt

SEQ ID NO: 1778496 - DNA, 23 bp, Homo sapiens
cattgtaatgttgtgaataatta

SEQ ID NO: 1778497 - DNA, 14 bp, Homo sapiens
cattgtactccagc

SEQ ID NO: 1778498 - DNA, 16 bp, Homo sapiens
cattgtactccagcct

SEQ ID NO: 1778499 - DNA, 22 bp, Homo sapiens
cattgtactgttgctttaatat

SEQ ID NO: 1778500 - DNA, 18 bp, Homo sapiens
cattgtatgcagggagca

SEQ ID NO: 1778501 - DNA, 13 bp, Homo sapiens
cattgtccaaagt

SEQ ID NO: 1778502 - DNA, 14 bp, Homo sapiens
cattgtccaaagtt

SEQ ID NO: 1778503 - DNA, 13 bp, Homo sapiens
ccaaagcacagct

SEQ ID NO: 1778504 - DNA, 17 bp, Homo sapiens
ccaaagcacagctgggc

SEQ ID NO: 1778505 - DNA, 13 bp, Homo sapiens
ccaaagccaccag

SEQ ID NO: 1778506 - DNA, 16 bp, Homo sapiens
ccaaagccactggaag

SEQ ID NO: 1778507 - DNA, 21 bp, Homo sapiens
ccaaagccactggaaggagca

SEQ ID NO: 1778508 - DNA, 15 bp, Homo sapiens
ccaaagccagaacca

SEQ ID NO: 1778509 - DNA, 16 bp, Homo sapiens
ccaaagccaggcctga

SEQ ID NO: 1778510 - DNA, 13 bp, Homo sapiens
ccaaagctttcct

SEQ ID NO: 1778511 - DNA, 17 bp, Homo sapiens
ccaaagctttcctgccc

SEQ ID NO: 1778512 - DNA, 20 bp, Homo sapiens
ccaaagctttcctgccccag

SEQ ID NO: 1778513 - DNA, 16 bp, Homo sapiens
ccaaaggaacactgac

SEQ ID NO: 1778514 - DNA, 12 bp, Homo sapiens
ccaaaggaggct

SEQ ID NO: 1778515 - DNA, 18 bp, Homo sapiens
ccaaaggaggctggcagg

SEQ ID NO: 1778516 - DNA, 23 bp, Homo sapiens
ccaaagggcacacccctggggct

SEQ ID NO: 1778517 - DNA, 14 bp, Homo sapiens
ccaaagggcctcct

SEQ ID NO: 1778518 - DNA, 14 bp, Homo sapiens
ccaaaggggctgct

SEQ ID NO: 1778519 - DNA, 15 bp, Homo sapiens
ccaaaggggctgctg

SEQ ID NO: 1778520 - DNA, 16 bp, Homo sapiens
ccaaaggggctgctgg

SEQ ID NO: 1778521 - DNA, 20 bp, Homo sapiens
ccaaaggggctgctggggca

SEQ ID NO: 1778522 - DNA, 14 bp, Homo sapiens
ccaaagtcacagga

SEQ ID NO: 1778523 - DNA, 14 bp, Homo sapiens
ccaaagtcctctgc

SEQ ID NO: 1778524 - DNA, 16 bp, Homo sapiens
ccaaagtctctaattc

SEQ ID NO: 1778525 - DNA, 18 bp, Homo sapiens
ccaaagtgctgggattaa

SEQ ID NO: 1778526 - DNA, 15 bp, Homo sapiens
ccaaagtggagctgg

SEQ ID NO: 1778527 - DNA, 16 bp, Homo sapiens
ccaaagtggagctggg

SEQ ID NO: 1778528 - DNA, 18 bp, Homo sapiens
ccaaagtggagctgggag

SEQ ID NO: 1778529 - DNA, 14 bp, Homo sapiens
ccaaagttctaata

SEQ ID NO: 1778530 - DNA, 19 bp, Homo sapiens
ccaaagttctaataatttc

SEQ ID NO: 1778531 - DNA, 15 bp, Homo sapiens
ccaaagttgttgtaa

SEQ ID NO: 1778532 - DNA, 23 bp, Homo sapiens
ccaaagttgttgtaacctgctgt

SEQ ID NO: 1778533 - DNA, 15 bp, Homo sapiens
ccaaataatgtctct

SEQ ID NO: 1778534 - DNA, 17 bp, Homo sapiens
ccaaataatgtctctgt

SEQ ID NO: 1778535 - DNA, 15 bp, Homo sapiens
ccaaatagccccaga

SEQ ID NO: 1778536 - DNA, 20 bp, Homo sapiens
ccaaataggagggagactgt

SEQ ID NO: 1778537 - DNA, 20 bp, Homo sapiens
ccaaatattattcaagtgcc

SEQ ID NO: 1778538 - DNA, 21 bp, Homo sapiens
ccaaatattattcaagtgcct

SEQ ID NO: 1778539 - DNA, 23 bp, Homo sapiens
ccaaatattattcaagtgcctct

SEQ ID NO: 1778540 - DNA, 23 bp, Homo sapiens
ccaaatcagctgctactactcct

SEQ ID NO: 1778541 - DNA, 21 bp, Homo sapiens
ccaaatccttggagtcccagg

SEQ ID NO: 1778542 - DNA, 15 bp, Homo sapiens
ccaaatctcagttgt

SEQ ID NO: 1778543 - DNA, 21 bp, Homo sapiens
ccaaatctcagttgtttgctt

SEQ ID NO: 1778544 - DNA, 10 bp, Homo sapiens
ccaaatctga

SEQ ID NO: 1778545 - DNA, 19 bp, Homo sapiens
ccaaatgaccgagccctgg

SEQ ID NO: 1778546 - DNA, 21 bp, Homo sapiens
ccaaatgaccgagccctggag

SEQ ID NO: 1778547 - DNA, 17 bp, Homo sapiens
ccaaatgcacaagctca

SEQ ID NO: 1778548 - DNA, 23 bp, Homo sapiens
ccaaatgcagggaggggaggcag

SEQ ID NO: 1778549 - DNA, 15 bp, Homo sapiens
ccaaatgttcatcct

SEQ ID NO: 1778550 - DNA, 21 bp, Homo sapiens
ccaaattagtgaaccaaaaat

SEQ ID NO: 1778551 - DNA, 21 bp, Homo sapiens
ccaaattatcctggtcttttt

SEQ ID NO: 1778552 - DNA, 23 bp, Homo sapiens
ccaaattgagtttaacaataata

SEQ ID NO: 1778553 - DNA, 20 bp, Homo sapiens
ccaaattgctgggattacag

SEQ ID NO: 1778554 - DNA, 18 bp, Homo sapiens
ccaaatttaaaactgttg

SEQ ID NO: 1778555 - DNA, 21 bp, Homo sapiens
ccaaattttggccaaagtgtt

SEQ ID NO: 1778556 - DNA, 11 bp, Homo sapiens
ccaacaaacca

SEQ ID NO: 1778557 - DNA, 12 bp, Homo sapiens
ccaacaaaccat

SEQ ID NO: 1778558 - DNA, 16 bp, Homo sapiens
ccaacaaaccatccag

SEQ ID NO: 1778559 - DNA, 12 bp, Homo sapiens
ccaacaagaatg

SEQ ID NO: 1778560 - DNA, 23 bp, Homo sapiens
ccaacaataaacaggaattttat

SEQ ID NO: 1778561 - DNA, 14 bp, Homo sapiens
ccaacaatggggtg

SEQ ID NO: 1778562 - DNA, 18 bp, Homo sapiens
ccaacaatggggtgggcc

SEQ ID NO: 1778563 - DNA, 16 bp, Homo sapiens
ccaacaccacagacac

SEQ ID NO: 1778564 - DNA, 17 bp, Homo sapiens
ccaacaccacagacaca

SEQ ID NO: 1778565 - DNA, 23 bp, Homo sapiens
ccaacaccacagacacacacacg

SEQ ID NO: 1778566 - DNA, 20 bp, Homo sapiens
ccaacacccaaagcatggac

SEQ ID NO: 1778567 - DNA, 21 bp, Homo sapiens
ccaacaccccgcctgcctcct

SEQ ID NO: 1778568 - DNA, 22 bp, Homo sapiens
ccaacactgtccttccctgcca

SEQ ID NO: 1778569 - DNA, 17 bp, Homo sapiens
ccaacactgtctgcccc

SEQ ID NO: 1778570 - DNA, 15 bp, Homo sapiens
ccaacactgtgccct

SEQ ID NO: 1778571 - DNA, 16 bp, Homo sapiens
ccaacactgtgccctg

SEQ ID NO: 1778572 - DNA, 13 bp, Homo sapiens
ccaacacttccag

SEQ ID NO: 1778573 - DNA, 20 bp, Homo sapiens
ccaacagcaagggagatttt

SEQ ID NO: 1778574 - DNA, 15 bp, Homo sapiens
ccaacagcacctccc

SEQ ID NO: 1778575 - DNA, 13 bp, Homo sapiens
ccaacagccatgc

SEQ ID NO: 1778576 - DNA, 17 bp, Homo sapiens
ccaacagttgtatgttt

SEQ ID NO: 1778577 - DNA, 14 bp, Homo sapiens
ccaacataaaacaa

SEQ ID NO: 1778578 - DNA, 22 bp, Homo sapiens
ccaacatatatttattgagtac

SEQ ID NO: 1778579 - DNA, 16 bp, Homo sapiens
ccaacatcaacatctt

SEQ ID NO: 1778580 - DNA, 18 bp, Homo sapiens
ccaacatcacagcccagc

SEQ ID NO: 1778581 - DNA, 21 bp, Homo sapiens
ccaacatcccattgccctggt

SEQ ID NO: 1778582 - DNA, 20 bp, Homo sapiens
ccaacatctttgcgaaaaga

SEQ ID NO: 1778583 - DNA, 15 bp, Homo sapiens
ccaacatgaggacag

SEQ ID NO: 1778584 - DNA, 13 bp, Homo sapiens
ccaacatgcactg

SEQ ID NO: 1778585 - DNA, 17 bp, Homo sapiens
ccaacatgcactgatgt

SEQ ID NO: 1778586 - DNA, 23 bp, Homo sapiens
ccaaccaacttggttctgcttca

SEQ ID NO: 1778587 - DNA, 16 bp, Homo sapiens
ccaaccactgtgccac

SEQ ID NO: 1778588 - DNA, 21 bp, Homo sapiens
ccaaccactgtgccactgact

SEQ ID NO: 1778589 - DNA, 12 bp, Homo sapiens
ccaaccagcctt

SEQ ID NO: 1778590 - DNA, 13 bp, Homo sapiens
ccaaccagccttt

SEQ ID NO: 1778591 - DNA, 13 bp, Homo sapiens
ccaacccccatct

SEQ ID NO: 1778592 - DNA, 15 bp, Homo sapiens
ccaacccccatctcc

SEQ ID NO: 1778593 - DNA, 17 bp, Homo sapiens
ccaaccccccagcactg

SEQ ID NO: 1778594 - DNA, 18 bp, Homo sapiens
ccaaccccccagcactga

SEQ ID NO: 1778595 - DNA, 19 bp, Homo sapiens
ccaaccccccagcactgag

SEQ ID NO: 1778596 - DNA, 19 bp, Homo sapiens
ccaacccccctcctgctcc

SEQ ID NO: 1778597 - DNA, 21 bp, Homo sapiens
ccaacccccctcctgctcctc

SEQ ID NO: 1778598 - DNA, 21 bp, Homo sapiens
ccaaccccgcggtgctctggc

SEQ ID NO: 1778599 - DNA, 22 bp, Homo sapiens
ccaacccctgacctaccccagc

SEQ ID NO: 1778600 - DNA, 22 bp, Homo sapiens
ccaacccgtctggcccaccagg

SEQ ID NO: 1778601 - DNA, 23 bp, Homo sapiens
ccaaccctatctcctgacagaag

SEQ ID NO: 1778602 - DNA, 14 bp, Homo sapiens
ccaaccctgtgggc

SEQ ID NO: 1778603 - DNA, 16 bp, Homo sapiens
ccaacctcaatgccct

SEQ ID NO: 1778604 - DNA, 15 bp, Homo sapiens
ccaacctcacttccc

SEQ ID NO: 1778605 - DNA, 14 bp, Homo sapiens
ccaacctcagggct

SEQ ID NO: 1778606 - DNA, 18 bp, Homo sapiens
ccaacctcagggctccca

SEQ ID NO: 1778607 - DNA, 14 bp, Homo sapiens
ccaacctcctgacc

SEQ ID NO: 1778608 - DNA, 19 bp, Homo sapiens
ccaacctcctgctctggga

SEQ ID NO: 1778609 - DNA, 21 bp, Homo sapiens
ccaacctcctgctctgggacg

SEQ ID NO: 1778610 - DNA, 14 bp, Homo sapiens
ccaacctctggagc

SEQ ID NO: 1778611 - DNA, 12 bp, Homo sapiens
ccaacctgctga

SEQ ID NO: 1778612 - DNA, 17 bp, Homo sapiens
ccaacctggacttcctg

SEQ ID NO: 1778613 - DNA, 19 bp, Homo sapiens
ccaacctggacttcctgtc

SEQ ID NO: 1778614 - DNA, 18 bp, Homo sapiens
ccaacctgttcttagagt

SEQ ID NO: 1778615 - DNA, 20 bp, Homo sapiens
ccaacgaagccggacacggc

SEQ ID NO: 1778616 - DNA, 20 bp, Homo sapiens
ccaacgagacacattgcctt

SEQ ID NO: 1778617 - DNA, 21 bp, Homo sapiens
ccaacgagacacattgccttc

SEQ ID NO: 1778618 - DNA, 23 bp, Homo sapiens
ccaacgcccctgtggccaactgc

SEQ ID NO: 1778619 - DNA, 18 bp, Homo sapiens
ccaggcacgaacccacct

SEQ ID NO: 1778620 - DNA, 13 bp, Homo sapiens
ccaggcagagctg

SEQ ID NO: 1778621 - DNA, 20 bp, Homo sapiens
ccaggcagagctgagggccc

SEQ ID NO: 1778622 - DNA, 17 bp, Homo sapiens
ccaggcagatctgtgcc

SEQ ID NO: 1778623 - DNA, 20 bp, Homo sapiens
ccaggcagatctgtgcccca

SEQ ID NO: 1778624 - DNA, 22 bp, Homo sapiens
ccaggcagcctctgtcaggcct

SEQ ID NO: 1778625 - DNA, 23 bp, Homo sapiens
ccaggcagcctctgtcaggcctt

SEQ ID NO: 1778626 - DNA, 14 bp, Homo sapiens
ccaggcagctccct

SEQ ID NO: 1778627 - DNA, 23 bp, Homo sapiens
ccaggcagctccctcctgcacac

SEQ ID NO: 1778628 - DNA, 18 bp, Homo sapiens
ccaggcaggagcccttct

SEQ ID NO: 1778629 - DNA, 10 bp, Homo sapiens
ccaggcaggg

SEQ ID NO: 1778630 - DNA, 12 bp, Homo sapiens
ccaggcagggag

SEQ ID NO: 1778631 - DNA, 17 bp, Homo sapiens
ccaggcagggagtgtct

SEQ ID NO: 1778632 - DNA, 19 bp, Homo sapiens
ccaggcagtcgggggctgg

SEQ ID NO: 1778633 - DNA, 21 bp, Homo sapiens
ccaggcagtcgggggctggcc

SEQ ID NO: 1778634 - DNA, 16 bp, Homo sapiens
ccaggccacctcccca

SEQ ID NO: 1778635 - DNA, 12 bp, Homo sapiens
ccaggccactgt

SEQ ID NO: 1778636 - DNA, 14 bp, Homo sapiens
ccaggccactgtgg

SEQ ID NO: 1778637 - DNA, 19 bp, Homo sapiens
ccaggccactgtggccaga

SEQ ID NO: 1778638 - DNA, 21 bp, Homo sapiens
ccaggccactgtggccagagc

SEQ ID NO: 1778639 - DNA, 11 bp, Homo sapiens
ccaggccagcc

SEQ ID NO: 1778640 - DNA, 13 bp, Homo sapiens
ccaggccagcctc

SEQ ID NO: 1778641 - DNA, 14 bp, Homo sapiens
ccaggccagcctcc

SEQ ID NO: 1778642 - DNA, 16 bp, Homo sapiens
ccaggccagcctccga

SEQ ID NO: 1778643 - DNA, 13 bp, Homo sapiens
ccaggccagggct

SEQ ID NO: 1778644 - DNA, 15 bp, Homo sapiens
ccaggccagggctcc

SEQ ID NO: 1778645 - DNA, 20 bp, Homo sapiens
ccaggccaggggacccctgc

SEQ ID NO: 1778646 - DNA, 13 bp, Homo sapiens
ccaggccaggtgg

SEQ ID NO: 1778647 - DNA, 15 bp, Homo sapiens
ccaggcccaaggctc

SEQ ID NO: 1778648 - DNA, 17 bp, Homo sapiens
ccaggcccaccatcacc

SEQ ID NO: 1778649 - DNA, 13 bp, Homo sapiens
ccaggcccatctc

SEQ ID NO: 1778650 - DNA, 14 bp, Homo sapiens
ccaggcccatctca

SEQ ID NO: 1778651 - DNA, 16 bp, Homo sapiens
ccaggcccatctcagg

SEQ ID NO: 1778652 - DNA, 19 bp, Homo sapiens
ccaggccccaccggccagg

SEQ ID NO: 1778653 - DNA, 12 bp, Homo sapiens
ccaggcccctga

SEQ ID NO: 1778654 - DNA, 17 bp, Homo sapiens
ccaggcccctgaggact

SEQ ID NO: 1778655 - DNA, 22 bp, Homo sapiens
ccaggcccctgaggactggaga

SEQ ID NO: 1778656 - DNA, 16 bp, Homo sapiens
ccaggcccggggctgg

SEQ ID NO: 1778657 - DNA, 19 bp, Homo sapiens
ccaggccctccatgggcta

SEQ ID NO: 1778658 - DNA, 17 bp, Homo sapiens
ccaggccctgtggcagg

SEQ ID NO: 1778659 - DNA, 13 bp, Homo sapiens
ccaggccctttgg

SEQ ID NO: 1778660 - DNA, 20 bp, Homo sapiens
ccaggccctttggcttctga

SEQ ID NO: 1778661 - DNA, 21 bp, Homo sapiens
ccaggccgcgcccagcagagg

SEQ ID NO: 1778662 - DNA, 14 bp, Homo sapiens
ccaggccggagccc

SEQ ID NO: 1778663 - DNA, 15 bp, Homo sapiens
ccaggccggagccca

SEQ ID NO: 1778664 - DNA, 19 bp, Homo sapiens
ccaggccgtcctcccgggc

SEQ ID NO: 1778665 - DNA, 14 bp, Homo sapiens
ccaggcctccagcc

SEQ ID NO: 1778666 - DNA, 18 bp, Homo sapiens
ccaggcctccagcctctc

SEQ ID NO: 1778667 - DNA, 12 bp, Homo sapiens
ccaggcctccct

SEQ ID NO: 1778668 - DNA, 16 bp, Homo sapiens
ccaggcctccctgcag

SEQ ID NO: 1778669 - DNA, 19 bp, Homo sapiens
ccaggcctgaaagaggctg

SEQ ID NO: 1778670 - DNA, 14 bp, Homo sapiens
ccaggcctgaccag

SEQ ID NO: 1778671 - DNA, 17 bp, Homo sapiens
ccaggcctgaccagggg

SEQ ID NO: 1778672 - DNA, 16 bp, Homo sapiens
ccaggcctgcaggggc

SEQ ID NO: 1778673 - DNA, 13 bp, Homo sapiens
ccaggcctgcctc

SEQ ID NO: 1778674 - DNA, 21 bp, Homo sapiens
ccagtgcactccggtcccaaa

SEQ ID NO: 1778675 - DNA, 15 bp, Homo sapiens
ccagtgcagaatgta

SEQ ID NO: 1778676 - DNA, 14 bp, Homo sapiens
ccagtgcagccact

SEQ ID NO: 1778677 - DNA, 15 bp, Homo sapiens
ccagtgcagccactg

SEQ ID NO: 1778678 - DNA, 17 bp, Homo sapiens
ccagtgcagccactggc

SEQ ID NO: 1778679 - DNA, 19 bp, Homo sapiens
ccagtgcatatgcaatgta

SEQ ID NO: 1778680 - DNA, 15 bp, Homo sapiens
ccagtgcatggtggc

SEQ ID NO: 1778681 - DNA, 18 bp, Homo sapiens
ccagtgccactgcccccc

SEQ ID NO: 1778682 - DNA, 13 bp, Homo sapiens
ccagtgcctgcca

SEQ ID NO: 1778683 - DNA, 17 bp, Homo sapiens
ccagtgccttacctcct

SEQ ID NO: 1778684 - DNA, 20 bp, Homo sapiens
ccagtgccttacctcctgcc

SEQ ID NO: 1778685 - DNA, 16 bp, Homo sapiens
ccagtgcgattctgga

SEQ ID NO: 1778686 - DNA, 21 bp, Homo sapiens
ccagtgcggttcctcatctga

SEQ ID NO: 1778687 - DNA, 16 bp, Homo sapiens
ccagtgctcagctgtg

SEQ ID NO: 1778688 - DNA, 17 bp, Homo sapiens
ccagtgctcagctgtgg

SEQ ID NO: 1778689 - DNA, 21 bp, Homo sapiens
ccagtgctcagctgtggctgg

SEQ ID NO: 1778690 - DNA, 22 bp, Homo sapiens
ccagtgctcagctgtggctgga

SEQ ID NO: 1778691 - DNA, 22 bp, Homo sapiens
ccagtgctgaatttccctctct

SEQ ID NO: 1778692 - DNA, 14 bp, Homo sapiens
ccagtgctgccatg

SEQ ID NO: 1778693 - DNA, 15 bp, Homo sapiens
ccagtgctgccatgc

SEQ ID NO: 1778694 - DNA, 16 bp, Homo sapiens
ccagtgctgccatgcc

SEQ ID NO: 1778695 - DNA, 17 bp, Homo sapiens
ccagtgctgccatgcca

SEQ ID NO: 1778696 - DNA, 19 bp, Homo sapiens
ccagtgctgccatgccact

SEQ ID NO: 1778697 - DNA, 21 bp, Homo sapiens
ccagtgctgccatgccactgc

SEQ ID NO: 1778698 - DNA, 13 bp, Homo sapiens
ccagtgctggaag

SEQ ID NO: 1778699 - DNA, 23 bp, Homo sapiens
ccagtggaaggagaatttaataa

SEQ ID NO: 1778700 - DNA, 22 bp, Homo sapiens
ccagtggaggagttcatggaag

SEQ ID NO: 1778701 - DNA, 24 bp, Homo sapiens
cccagtagtcagaagcaggttctt

SEQ ID NO: 1778702 - DNA, 19 bp, Homo sapiens
cccagtccaaatgtcctcc

SEQ ID NO: 1778703 - DNA, 13 bp, Homo sapiens
cccagtccatgct

SEQ ID NO: 1778704 - DNA, 18 bp, Homo sapiens
cccagtccccacccctgc

SEQ ID NO: 1778705 - DNA, 23 bp, Homo sapiens
cccagtccccacccctgccccca

SEQ ID NO: 1778706 - DNA, 23 bp, Homo sapiens
cccagtccccgtgccccgcctcc

SEQ ID NO: 1778707 - DNA, 12 bp, Homo sapiens
cccagtccctgg

SEQ ID NO: 1778708 - DNA, 16 bp, Homo sapiens
cccagtccctggagct

SEQ ID NO: 1778709 - DNA, 22 bp, Homo sapiens
cccagtcggccccatctctcat

SEQ ID NO: 1778710 - DNA, 14 bp, Homo sapiens
cccagtctcctctc

SEQ ID NO: 1778711 - DNA, 20 bp, Homo sapiens
cccagtgaatccctgggagc

SEQ ID NO: 1778712 - DNA, 16 bp, Homo sapiens
cccagtgcaaaccact

SEQ ID NO: 1778713 - DNA, 10 bp, Homo sapiens
cccagtgcag

SEQ ID NO: 1778714 - DNA, 18 bp, Homo sapiens
cccagtgcatggtggcca

SEQ ID NO: 1778715 - DNA, 22 bp, Homo sapiens
cccagtgcatggtggccagagg

SEQ ID NO: 1778716 - DNA, 18 bp, Homo sapiens
cccagtgccactgccccc

SEQ ID NO: 1778717 - DNA, 14 bp, Homo sapiens
cccagtgcccccac

SEQ ID NO: 1778718 - DNA, 20 bp, Homo sapiens
cccagtgcccccactgacca

SEQ ID NO: 1778719 - DNA, 22 bp, Homo sapiens
cccagtgcccccactgaccaga

SEQ ID NO: 1778720 - DNA, 15 bp, Homo sapiens
cccagtgccctgggg

SEQ ID NO: 1778721 - DNA, 11 bp, Homo sapiens
cccagtgccta

SEQ ID NO: 1778722 - DNA, 16 bp, Homo sapiens
cccagtgcctgccact

SEQ ID NO: 1778723 - DNA, 17 bp, Homo sapiens
cccagtgcctgccactc

SEQ ID NO: 1778724 - DNA, 11 bp, Homo sapiens
cccagtgcctt

SEQ ID NO: 1778725 - DNA, 15 bp, Homo sapiens
cccagtgctgccatg

SEQ ID NO: 1778726 - DNA, 18 bp, Homo sapiens
cccagtgctgccatgcca

SEQ ID NO: 1778727 - DNA, 22 bp, Homo sapiens
cccagtgctgccatgccactgc

SEQ ID NO: 1778728 - DNA, 18 bp, Homo sapiens
cccagtggctgttctgga

SEQ ID NO: 1778729 - DNA, 18 bp, Homo sapiens
cccagtgggagcttcccg

SEQ ID NO: 1778730 - DNA, 20 bp, Homo sapiens
cccagtgggaggggcaggct

SEQ ID NO: 1778731 - DNA, 21 bp, Homo sapiens
cccagtgggaggggcaggctg

SEQ ID NO: 1778732 - DNA, 21 bp, Homo sapiens
cccagtgtcaagttgtgcttg

SEQ ID NO: 1778733 - DNA, 19 bp, Homo sapiens
cccagtgtcccctttcttc

SEQ ID NO: 1778734 - DNA, 23 bp, Homo sapiens
cccagtgtccttccatcttcaca

SEQ ID NO: 1778735 - DNA, 20 bp, Homo sapiens
cccagtgtgagaccccaaag

SEQ ID NO: 1778736 - DNA, 16 bp, Homo sapiens
cccagtgttgtttgta

SEQ ID NO: 1778737 - DNA, 21 bp, Homo sapiens
cccagtgttgtttgtaaataa

SEQ ID NO: 1778738 - DNA, 14 bp, Homo sapiens
cccagttcaccctg

SEQ ID NO: 1778739 - DNA, 22 bp, Homo sapiens
cccagttcccgtgacgaggctc

SEQ ID NO: 1778740 - DNA, 18 bp, Homo sapiens
cccagttcctatgacaca

SEQ ID NO: 1778741 - DNA, 18 bp, Homo sapiens
cccagttcctgtggctcc

SEQ ID NO: 1778742 - DNA, 19 bp, Homo sapiens
cccagttgtggcaactaaa

SEQ ID NO: 1778743 - DNA, 22 bp, Homo sapiens
cccagtttatggatatgctgct

SEQ ID NO: 1778744 - DNA, 22 bp, Homo sapiens
cccagtttgcagaaaagcacct

SEQ ID NO: 1778745 - DNA, 19 bp, Homo sapiens
cccagttttgttgccccag

SEQ ID NO: 1778746 - DNA, 15 bp, Homo sapiens
cccataaacagcaca

SEQ ID NO: 1778747 - DNA, 16 bp, Homo sapiens
cccataaacagcacac

SEQ ID NO: 1778748 - DNA, 22 bp, Homo sapiens
cccataagacaaacactgccat

SEQ ID NO: 1778749 - DNA, 21 bp, Homo sapiens
cccataatagttagccctcag

SEQ ID NO: 1778750 - DNA, 16 bp, Homo sapiens
cccatacaatgtatgt

SEQ ID NO: 1778751 - DNA, 22 bp, Homo sapiens
cccatacaatgtatgtacaata

SEQ ID NO: 1778752 - DNA, 19 bp, Homo sapiens
cccatagaaacatgacact

SEQ ID NO: 1778753 - DNA, 23 bp, Homo sapiens
cccatagaaacatgacactgacc

SEQ ID NO: 1778754 - DNA, 16 bp, Homo sapiens
cccatagatcttctga

SEQ ID NO: 1778755 - DNA, 18 bp, Homo sapiens
cccatagtttatttttct

SEQ ID NO: 1778756 - DNA, 21 bp, Homo sapiens
cccatcacagggttgggccca

SEQ ID NO: 1778757 - DNA, 14 bp, Homo sapiens
cccatcacccaagc

SEQ ID NO: 1778758 - DNA, 19 bp, Homo sapiens
cccatcatgtggccccacc

SEQ ID NO: 1778759 - DNA, 22 bp, Homo sapiens
cccatcattgcacctgcaggct

SEQ ID NO: 1778760 - DNA, 22 bp, Homo sapiens
cccatccagacctggctccact

SEQ ID NO: 1778761 - DNA, 13 bp, Homo sapiens
cccatccagccag

SEQ ID NO: 1778762 - DNA, 14 bp, Homo sapiens
cccatccagcctcc

SEQ ID NO: 1778763 - DNA, 14 bp, Homo sapiens
cccatccagttcat

SEQ ID NO: 1778764 - DNA, 19 bp, Homo sapiens
cccatccattaggccagca

SEQ ID NO: 1778765 - DNA, 15 bp, Homo sapiens
cccatcccacaccct

SEQ ID NO: 1778766 - DNA, 15 bp, Homo sapiens
cccatcccccactgc

SEQ ID NO: 1778767 - DNA, 16 bp, Homo sapiens
cccatccccctgccct

SEQ ID NO: 1778768 - DNA, 17 bp, Homo sapiens
cccatccccctgccctc

SEQ ID NO: 1778769 - DNA, 17 bp, Homo sapiens
cccatcccgaagccatc

SEQ ID NO: 1778770 - DNA, 15 bp, Homo sapiens
cccatccctccccag

SEQ ID NO: 1778771 - DNA, 17 bp, Homo sapiens
cccatccctcggaccca

SEQ ID NO: 1778772 - DNA, 23 bp, Homo sapiens
cccatcctaccctcgggcccacc

SEQ ID NO: 1778773 - DNA, 14 bp, Homo sapiens
cccatcctagaggc

SEQ ID NO: 1778774 - DNA, 18 bp, Homo sapiens
cccatcctcatccctgac

SEQ ID NO: 1778775 - DNA, 16 bp, Homo sapiens
cccatcctggggcagc

SEQ ID NO: 1778776 - DNA, 22 bp, Homo sapiens
cccatcgtctcggccttcacaa

SEQ ID NO: 1778777 - DNA, 18 bp, Homo sapiens
cccatcgtgaagaagcct

SEQ ID NO: 1778778 - DNA, 14 bp, Homo sapiens
cccatctcatcctg

SEQ ID NO: 1778779 - DNA, 18 bp, Homo sapiens
cccatctcatcctggcac

SEQ ID NO: 1778780 - DNA, 16 bp, Homo sapiens
cccatctccccaggcc

SEQ ID NO: 1778781 - DNA, 12 bp, Homo sapiens
cccatctccccc

SEQ ID NO: 1778782 - DNA, 14 bp, Homo sapiens
cccatctccctgcc

SEQ ID NO: 1778783 - DNA, 17 bp, Homo sapiens
cccatctccctgcctgg

SEQ ID NO: 1778784 - DNA, 18 bp, Homo sapiens
cccatctccctgcctggc

SEQ ID NO: 1778785 - DNA, 12 bp, Homo sapiens
cccatctcctga

SEQ ID NO: 1778786 - DNA, 14 bp, Homo sapiens
ccccagactgagct

SEQ ID NO: 1778787 - DNA, 19 bp, Homo sapiens
ccccagactgagctctcca

SEQ ID NO: 1778788 - DNA, 22 bp, Homo sapiens
ccccagactgggcccaggcagg

SEQ ID NO: 1778789 - DNA, 12 bp, Homo sapiens
ccccagagagac

SEQ ID NO: 1778790 - DNA, 21 bp, Homo sapiens
ccccagagcccagctcttgct

SEQ ID NO: 1778791 - DNA, 12 bp, Homo sapiens
ccccagagctgt

SEQ ID NO: 1778792 - DNA, 23 bp, Homo sapiens
ccccagagctgtttatggcctca

SEQ ID NO: 1778793 - DNA, 12 bp, Homo sapiens
ccccagaggcag

SEQ ID NO: 1778794 - DNA, 17 bp, Homo sapiens
ccccagaggccctggag

SEQ ID NO: 1778795 - DNA, 17 bp, Homo sapiens
ccccagaggtcgcagct

SEQ ID NO: 1778796 - DNA, 19 bp, Homo sapiens
ccccagatctgcctgggcc

SEQ ID NO: 1778797 - DNA, 21 bp, Homo sapiens
ccccagatctgcctgggcctg

SEQ ID NO: 1778798 - DNA, 19 bp, Homo sapiens
ccccagattcttcagcttg

SEQ ID NO: 1778799 - DNA, 13 bp, Homo sapiens
ccccagcactgag

SEQ ID NO: 1778800 - DNA, 22 bp, Homo sapiens
ccccagcagaatggaggcaggg

SEQ ID NO: 1778801 - DNA, 19 bp, Homo sapiens
ccccagcattccagcccct

SEQ ID NO: 1778802 - DNA, 16 bp, Homo sapiens
ccccagcattccagct

SEQ ID NO: 1778803 - DNA, 22 bp, Homo sapiens
ccccagcattccagctctgccc

SEQ ID NO: 1778804 - DNA, 16 bp, Homo sapiens
ccccagccacaggcca

SEQ ID NO: 1778805 - DNA, 12 bp, Homo sapiens
ccccagcccagg

SEQ ID NO: 1778806 - DNA, 14 bp, Homo sapiens
ccccagcccagggc

SEQ ID NO: 1778807 - DNA, 23 bp, Homo sapiens
ccccagcccatccattaggccag

SEQ ID NO: 1778808 - DNA, 16 bp, Homo sapiens
ccccagccctgctggg

SEQ ID NO: 1778809 - DNA, 17 bp, Homo sapiens
ccccagccctgctgggg

SEQ ID NO: 1778810 - DNA, 17 bp, Homo sapiens
ccccagcccttctgcct

SEQ ID NO: 1778811 - DNA, 14 bp, Homo sapiens
ccccagcctctggc

SEQ ID NO: 1778812 - DNA, 15 bp, Homo sapiens
ccccagcctctggca

SEQ ID NO: 1778813 - DNA, 16 bp, Homo sapiens
ccccagcctctggcat

SEQ ID NO: 1778814 - DNA, 16 bp, Homo sapiens
ccccagcctggccacg

SEQ ID NO: 1778815 - DNA, 23 bp, Homo sapiens
ccccagcctggccacgcagccag

SEQ ID NO: 1778816 - DNA, 19 bp, Homo sapiens
ccccagcctgtagggaact

SEQ ID NO: 1778817 - DNA, 15 bp, Homo sapiens
ccccagcctgtcctt

SEQ ID NO: 1778818 - DNA, 23 bp, Homo sapiens
ccccagcgtcccagtctctggca

SEQ ID NO: 1778819 - DNA, 15 bp, Homo sapiens
ccccagcgtcttgac

SEQ ID NO: 1778820 - DNA, 21 bp, Homo sapiens
ccccagctaagaacctggaac

SEQ ID NO: 1778821 - DNA, 14 bp, Homo sapiens
ccccagctcaatgg

SEQ ID NO: 1778822 - DNA, 18 bp, Homo sapiens
ccccagctcgctggcttt

SEQ ID NO: 1778823 - DNA, 22 bp, Homo sapiens
ccccagctctggtgagtcttgg

SEQ ID NO: 1778824 - DNA, 17 bp, Homo sapiens
ccccagctcttctcttc

SEQ ID NO: 1778825 - DNA, 16 bp, Homo sapiens
ccccagctgacatgga

SEQ ID NO: 1778826 - DNA, 22 bp, Homo sapiens
ccccagctgggaggcaagaggg

SEQ ID NO: 1778827 - DNA, 12 bp, Homo sapiens
ccccagcttcct

SEQ ID NO: 1778828 - DNA, 11 bp, Homo sapiens
ccccaggacca

SEQ ID NO: 1778829 - DNA, 13 bp, Homo sapiens
ccccaggaccagc

SEQ ID NO: 1778830 - DNA, 18 bp, Homo sapiens
ccccaggaccagctcagg

SEQ ID NO: 1778831 - DNA, 19 bp, Homo sapiens
ccccaggaccagctcagga

SEQ ID NO: 1778832 - DNA, 14 bp, Homo sapiens
ccccaggactgggc

SEQ ID NO: 1778833 - DNA, 16 bp, Homo sapiens
ccccaggactgggcca

SEQ ID NO: 1778834 - DNA, 18 bp, Homo sapiens
ccccaggatcactctctg

SEQ ID NO: 1778835 - DNA, 22 bp, Homo sapiens
ccccaggatcactctctgctgg

SEQ ID NO: 1778836 - DNA, 23 bp, Homo sapiens
ccccaggccaggtccctggacca

SEQ ID NO: 1778837 - DNA, 22 bp, Homo sapiens
ccccaggccctactacccattg

SEQ ID NO: 1778838 - DNA, 16 bp, Homo sapiens
ccccaggccggagccc

SEQ ID NO: 1778839 - DNA, 23 bp, Homo sapiens
ccccaggcctgtccaccctgcca

SEQ ID NO: 1778840 - DNA, 15 bp, Homo sapiens
ccccaggctcgtgga

SEQ ID NO: 1778841 - DNA, 17 bp, Homo sapiens
ccccaggctgagagcca

SEQ ID NO: 1778842 - DNA, 22 bp, Homo sapiens
ccccaggcttgtcactagcagc

SEQ ID NO: 1778843 - DNA, 18 bp, Homo sapiens
ccccagggaaggaaaaat

SEQ ID NO: 1778844 - DNA, 19 bp, Homo sapiens
ccccagggcccccacaggc

SEQ ID NO: 1778845 - DNA, 20 bp, Homo sapiens
ccccagggcccccacaggcc

SEQ ID NO: 1778846 - DNA, 17 bp, Homo sapiens
ccccagggcctccaggg

SEQ ID NO: 1778847 - DNA, 12 bp, Homo sapiens
ccccagggcctg

SEQ ID NO: 1778848 - DNA, 13 bp, Homo sapiens
ccccagggcctgg

SEQ ID NO: 1778849 - DNA, 19 bp, Homo sapiens
ccccagggctatagcagaa

SEQ ID NO: 1778850 - DNA, 13 bp, Homo sapiens
ccccaggggcagc

SEQ ID NO: 1778851 - DNA, 17 bp, Homo sapiens
ccccaggggcaggactg

SEQ ID NO: 1778852 - DNA, 18 bp, Homo sapiens
ccccagggtagccatggc

SEQ ID NO: 1778853 - DNA, 17 bp, Homo sapiens
ccccaggtccagctctg

SEQ ID NO: 1778854 - DNA, 14 bp, Homo sapiens
ccccaggtgccagt

SEQ ID NO: 1778855 - DNA, 23 bp, Homo sapiens
ccccaggtggctgacccagtccc

SEQ ID NO: 1778856 - DNA, 18 bp, Homo sapiens
ccccagtacctccaagca

SEQ ID NO: 1778857 - DNA, 22 bp, Homo sapiens
ccccagtgcggttcctcatctg

SEQ ID NO: 1778858 - DNA, 23 bp, Homo sapiens
ccccagttaatactccagagaca

SEQ ID NO: 1778859 - DNA, 22 bp, Homo sapiens
ccccagttcctgtggctccctc

SEQ ID NO: 1778860 - DNA, 18 bp, Homo sapiens
ccccatcacccaagccac

SEQ ID NO: 1778861 - DNA, 19 bp, Homo sapiens
ccccatcattgcacctgca

SEQ ID NO: 1778862 - DNA, 16 bp, Homo sapiens
ccccatccagcctcca

SEQ ID NO: 1778863 - DNA, 19 bp, Homo sapiens
ccccatccagcctccaggg

SEQ ID NO: 1778864 - DNA, 13 bp, Homo sapiens
ccccgagacacca

SEQ ID NO: 1778865 - DNA, 18 bp, Homo sapiens
ccccgagacaccatcctg

SEQ ID NO: 1778866 - DNA, 17 bp, Homo sapiens
ccccgatggactcctga

SEQ ID NO: 1778867 - DNA, 16 bp, Homo sapiens
ccccgcacagccaccc

SEQ ID NO: 1778868 - DNA, 19 bp, Homo sapiens
ccccgcacagccacccgtg

SEQ ID NO: 1778869 - DNA, 13 bp, Homo sapiens
ccccgcagcccgc

SEQ ID NO: 1778870 - DNA, 13 bp, Homo sapiens
ccccgcagccctg

SEQ ID NO: 1778871 - DNA, 17 bp, Homo sapiens
ccccgcaggatccctcc

SEQ ID NO: 1778872 - DNA, 19 bp, Homo sapiens
ccccgcaggatccctcctg

SEQ ID NO: 1778873 - DNA, 15 bp, Homo sapiens
ccccgcagtccccag

SEQ ID NO: 1778874 - DNA, 19 bp, Homo sapiens
ccccgcagtccccagccct

SEQ ID NO: 1778875 - DNA, 21 bp, Homo sapiens
ccccgcagtccccagcccttc

SEQ ID NO: 1778876 - DNA, 17 bp, Homo sapiens
ccccgccacctcagggc

SEQ ID NO: 1778877 - DNA, 14 bp, Homo sapiens
ccccgccagggctg

SEQ ID NO: 1778878 - DNA, 16 bp, Homo sapiens
ccccgccagggctggg

SEQ ID NO: 1778879 - DNA, 23 bp, Homo sapiens
ccccgcccagctgcacctgccag

SEQ ID NO: 1778880 - DNA, 21 bp, Homo sapiens
ccccgcccccacccctacagc

SEQ ID NO: 1778881 - DNA, 12 bp, Homo sapiens
ccccgcccccag

SEQ ID NO: 1778882 - DNA, 17 bp, Homo sapiens
ccccgccgcgccagtcc

SEQ ID NO: 1778883 - DNA, 18 bp, Homo sapiens
ccccgcctgccctcatgg

SEQ ID NO: 1778884 - DNA, 16 bp, Homo sapiens
ccccgcgggttctaga

SEQ ID NO: 1778885 - DNA, 16 bp, Homo sapiens
ccccgcggtgctctgg

SEQ ID NO: 1778886 - DNA, 19 bp, Homo sapiens
ccccgctcaggggcctgga

SEQ ID NO: 1778887 - DNA, 20 bp, Homo sapiens
ccccgctcaggggcctggag

SEQ ID NO: 1778888 - DNA, 12 bp, Homo sapiens
ccccgctccgtc

SEQ ID NO: 1778889 - DNA, 12 bp, Homo sapiens
ccccgctctccc

SEQ ID NO: 1778890 - DNA, 17 bp, Homo sapiens
ccccgctgatggagccc

SEQ ID NO: 1778891 - DNA, 20 bp, Homo sapiens
ccccgctgatggagccccac

SEQ ID NO: 1778892 - DNA, 19 bp, Homo sapiens
ccccgcttccccacagaac

SEQ ID NO: 1778893 - DNA, 17 bp, Homo sapiens
ccccgcttcctccctct

SEQ ID NO: 1778894 - DNA, 18 bp, Homo sapiens
ccccgcttgtccagcgcc

SEQ ID NO: 1778895 - DNA, 20 bp, Homo sapiens
ccccgggctctggccaccct

SEQ ID NO: 1778896 - DNA, 20 bp, Homo sapiens
ccccgggctggagaaagagc

SEQ ID NO: 1778897 - DNA, 21 bp, Homo sapiens
ccccgggctggagaaagagct

SEQ ID NO: 1778898 - DNA, 22 bp, Homo sapiens
ccccggggtgagtccattctcc

SEQ ID NO: 1778899 - DNA, 16 bp, Homo sapiens
ccccggtcccttgaga

SEQ ID NO: 1778900 - DNA, 24 bp, Homo sapiens
ccccggtcccttgagacctcagcc

SEQ ID NO: 1778901 - DNA, 14 bp, Homo sapiens
ccccgtctctacta

SEQ ID NO: 1778902 - DNA, 13 bp, Homo sapiens
ccccgtggggcag

SEQ ID NO: 1778903 - DNA, 21 bp, Homo sapiens
ccccgtgtaaaaagcctcctt

SEQ ID NO: 1778904 - DNA, 20 bp, Homo sapiens
cccctaaccctactttgctt

SEQ ID NO: 1778905 - DNA, 23 bp, Homo sapiens
cccgagatgtgacccaccagtgc

SEQ ID NO: 1778906 - DNA, 12 bp, Homo sapiens
cccgagcccagc

SEQ ID NO: 1778907 - DNA, 21 bp, Homo sapiens
cccgagcccagctacattcct

SEQ ID NO: 1778908 - DNA, 20 bp, Homo sapiens
cccgaggaactcgcctcagc

SEQ ID NO: 1778909 - DNA, 21 bp, Homo sapiens
cccgaggagctgggcccctgc

SEQ ID NO: 1778910 - DNA, 22 bp, Homo sapiens
cccgaggagctgggcccctgca

SEQ ID NO: 1778911 - DNA, 12 bp, Homo sapiens
cccgaggctgcc

SEQ ID NO: 1778912 - DNA, 13 bp, Homo sapiens
cccgaggctgccc

SEQ ID NO: 1778913 - DNA, 19 bp, Homo sapiens
cccgaggctgccccaggcc

SEQ ID NO: 1778914 - DNA, 13 bp, Homo sapiens
cccgagggatggt

SEQ ID NO: 1778915 - DNA, 15 bp, Homo sapiens
cccgagttcctctgg

SEQ ID NO: 1778916 - DNA, 22 bp, Homo sapiens
cccgatgagggaaggagcccag

SEQ ID NO: 1778917 - DNA, 20 bp, Homo sapiens
cccgatgctgctttcccctg

SEQ ID NO: 1778918 - DNA, 22 bp, Homo sapiens
cccgatgctgctttcccctgtg

SEQ ID NO: 1778919 - DNA, 15 bp, Homo sapiens
cccgatgtcccctgc

SEQ ID NO: 1778920 - DNA, 16 bp, Homo sapiens
cccgatgtcccctgcg

SEQ ID NO: 1778921 - DNA, 16 bp, Homo sapiens
cccgcaacccacagct

SEQ ID NO: 1778922 - DNA, 12 bp, Homo sapiens
cccgcacacctg

SEQ ID NO: 1778923 - DNA, 15 bp, Homo sapiens
cccgcaccctggcct

SEQ ID NO: 1778924 - DNA, 18 bp, Homo sapiens
cccgcaccttcctcctcc

SEQ ID NO: 1778925 - DNA, 17 bp, Homo sapiens
cccgcactctgccccca

SEQ ID NO: 1778926 - DNA, 16 bp, Homo sapiens
cccgcagcccgcctgc

SEQ ID NO: 1778927 - DNA, 13 bp, Homo sapiens
cccgcagccctgg

SEQ ID NO: 1778928 - DNA, 16 bp, Homo sapiens
cccgcagccctggcag

SEQ ID NO: 1778929 - DNA, 17 bp, Homo sapiens
cccgcaggatccctcct

SEQ ID NO: 1778930 - DNA, 15 bp, Homo sapiens
cccgcagggccatgc

SEQ ID NO: 1778931 - DNA, 23 bp, Homo sapiens
cccgcaggttatgtcagcagctc

SEQ ID NO: 1778932 - DNA, 14 bp, Homo sapiens
cccgcagtccccag

SEQ ID NO: 1778933 - DNA, 23 bp, Homo sapiens
cccgcatatactttaatgtttta

SEQ ID NO: 1778934 - DNA, 16 bp, Homo sapiens
cccgccacggccaccc

SEQ ID NO: 1778935 - DNA, 13 bp, Homo sapiens
cccgccagccccg

SEQ ID NO: 1778936 - DNA, 16 bp, Homo sapiens
cccgccagcctcagtg

SEQ ID NO: 1778937 - DNA, 13 bp, Homo sapiens
cccgccagggctg

SEQ ID NO: 1778938 - DNA, 16 bp, Homo sapiens
cccgccagggctgggg

SEQ ID NO: 1778939 - DNA, 17 bp, Homo sapiens
cccgccagggctgggga

SEQ ID NO: 1778940 - DNA, 16 bp, Homo sapiens
cccgcccacccacgca

SEQ ID NO: 1778941 - DNA, 15 bp, Homo sapiens
cccgcccctcccacg

SEQ ID NO: 1778942 - DNA, 14 bp, Homo sapiens
cccgcccctcgctg

SEQ ID NO: 1778943 - DNA, 23 bp, Homo sapiens
cccgcccctgggctaccatctgc

SEQ ID NO: 1778944 - DNA, 21 bp, Homo sapiens
cccgcccgagggatggtgccc

SEQ ID NO: 1778945 - DNA, 14 bp, Homo sapiens
cccgcccgcacagc

SEQ ID NO: 1778946 - DNA, 17 bp, Homo sapiens
cccgccctttccttgcc

SEQ ID NO: 1778947 - DNA, 12 bp, Homo sapiens
cccgcctcagcc

SEQ ID NO: 1778948 - DNA, 18 bp, Homo sapiens
cccgcctcagcctcctga

SEQ ID NO: 1778949 - DNA, 13 bp, Homo sapiens
cccgcctccctct

SEQ ID NO: 1778950 - DNA, 23 bp, Homo sapiens
cccgcctcgacctccccacccgc

SEQ ID NO: 1778951 - DNA, 13 bp, Homo sapiens
cccgcctctcccg

SEQ ID NO: 1778952 - DNA, 21 bp, Homo sapiens
cccgcctctcccgtcagggcc

SEQ ID NO: 1778953 - DNA, 12 bp, Homo sapiens
cccgcctgccct

SEQ ID NO: 1778954 - DNA, 16 bp, Homo sapiens
cccacagctcagctgc

SEQ ID NO: 1778955 - DNA, 17 bp, Homo sapiens
cccacagctcagctgcc

SEQ ID NO: 1778956 - DNA, 12 bp, Homo sapiens
cccacagctccc

SEQ ID NO: 1778957 - DNA, 15 bp, Homo sapiens
cccacagctcccacc

SEQ ID NO: 1778958 - DNA, 20 bp, Homo sapiens
cccacagctcccaccccacc

SEQ ID NO: 1778959 - DNA, 21 bp, Homo sapiens
cccacaggagggccagcgctg

SEQ ID NO: 1778960 - DNA, 22 bp, Homo sapiens
cccacataaaagccccagcttg

SEQ ID NO: 1778961 - DNA, 14 bp, Homo sapiens
cccacatcccaggc

SEQ ID NO: 1778962 - DNA, 11 bp, Homo sapiens
cccacatcttt

SEQ ID NO: 1778963 - DNA, 16 bp, Homo sapiens
cccacatctttcctca

SEQ ID NO: 1778964 - DNA, 18 bp, Homo sapiens
cccacatgaggccatctc

SEQ ID NO: 1778965 - DNA, 20 bp, Homo sapiens
cccacatgaggccatctcag

SEQ ID NO: 1778966 - DNA, 15 bp, Homo sapiens
cccacatggccgggc

SEQ ID NO: 1778967 - DNA, 16 bp, Homo sapiens
cccaccaaactgcaca

SEQ ID NO: 1778968 - DNA, 17 bp, Homo sapiens
cccaccaactctgcact

SEQ ID NO: 1778969 - DNA, 14 bp, Homo sapiens
cccaccacactgaa

SEQ ID NO: 1778970 - DNA, 19 bp, Homo sapiens
cccaccacctaggccactc

SEQ ID NO: 1778971 - DNA, 23 bp, Homo sapiens
cccaccactaggactctgaggct

SEQ ID NO: 1778972 - DNA, 20 bp, Homo sapiens
cccaccagagccgggaggaa

SEQ ID NO: 1778973 - DNA, 11 bp, Homo sapiens
cccaccagcct

SEQ ID NO: 1778974 - DNA, 13 bp, Homo sapiens
cccaccaggctgc

SEQ ID NO: 1778975 - DNA, 16 bp, Homo sapiens
cccaccaggctgctca

SEQ ID NO: 1778976 - DNA, 13 bp, Homo sapiens
cccaccagtgcct

SEQ ID NO: 1778977 - DNA, 14 bp, Homo sapiens
cccaccagtgcctt

SEQ ID NO: 1778978 - DNA, 16 bp, Homo sapiens
cccaccatatgaattg

SEQ ID NO: 1778979 - DNA, 17 bp, Homo sapiens
cccaccatcaccaccgc

SEQ ID NO: 1778980 - DNA, 13 bp, Homo sapiens
cccaccattcctg

SEQ ID NO: 1778981 - DNA, 18 bp, Homo sapiens
cccaccattcctgccttt

SEQ ID NO: 1778982 - DNA, 16 bp, Homo sapiens
cccaccattctacctg

SEQ ID NO: 1778983 - DNA, 17 bp, Homo sapiens
cccaccattctacctga

SEQ ID NO: 1778984 - DNA, 18 bp, Homo sapiens
cccacccacacagctgcc

SEQ ID NO: 1778985 - DNA, 14 bp, Homo sapiens
cccacccacatgtg

SEQ ID NO: 1778986 - DNA, 23 bp, Homo sapiens
cccacccagtccatgctccaggg

SEQ ID NO: 1778987 - DNA, 17 bp, Homo sapiens
cccacccatcttcctgc

SEQ ID NO: 1778988 - DNA, 21 bp, Homo sapiens
cccacccatcttcctgctgct

SEQ ID NO: 1778989 - DNA, 22 bp, Homo sapiens
cccacccatcttcctgctgctg

SEQ ID NO: 1778990 - DNA, 23 bp, Homo sapiens
cccaccccaactctccccagtgc

SEQ ID NO: 1778991 - DNA, 17 bp, Homo sapiens
cccaccccaccccaccc

SEQ ID NO: 1778992 - DNA, 18 bp, Homo sapiens
cccaccccatccagccag

SEQ ID NO: 1778993 - DNA, 22 bp, Homo sapiens
cccaccccatccagccagaccc

SEQ ID NO: 1778994 - DNA, 13 bp, Homo sapiens
cccacccccaagg

SEQ ID NO: 1778995 - DNA, 20 bp, Homo sapiens
cccacccccgaccctgccct

SEQ ID NO: 1778996 - DNA, 14 bp, Homo sapiens
cccaccccctgccc

SEQ ID NO: 1778997 - DNA, 16 bp, Homo sapiens
cccaccccctgccctg

SEQ ID NO: 1778998 - DNA, 18 bp, Homo sapiens
cccaccccctgccctgca

SEQ ID NO: 1778999 - DNA, 19 bp, Homo sapiens
cccaccccctgccctgcac

SEQ ID NO: 1779000 - DNA, 19 bp, Homo sapiens
cccacccccttctctgctc

SEQ ID NO: 1779001 - DNA, 22 bp, Homo sapiens
cccacccccttctctgctccac

SEQ ID NO: 1779002 - DNA, 14 bp, Homo sapiens
cccaccccggggac

SEQ ID NO: 1779003 - DNA, 17 bp, Homo sapiens
cccacccctaagtgccc

SEQ ID NO: 1779004 - DNA, 20 bp, Homo sapiens
cccacccctaagtgcccaaa

SEQ ID NO: 1779005 - DNA, 16 bp, Homo sapiens
cccacccctacagcct

SEQ ID NO: 1779006 - DNA, 11 bp, Homo sapiens
cccacccctca

SEQ ID NO: 1779007 - DNA, 12 bp, Homo sapiens
cccacccctcac

SEQ ID NO: 1779008 - DNA, 14 bp, Homo sapiens
cccacccctcactc

SEQ ID NO: 1779009 - DNA, 17 bp, Homo sapiens
cccacccctcactcccc

SEQ ID NO: 1779010 - DNA, 21 bp, Homo sapiens
cccacccctcactccccaggg

SEQ ID NO: 1779011 - DNA, 15 bp, Homo sapiens
cccacccctgcacag

SEQ ID NO: 1779012 - DNA, 16 bp, Homo sapiens
cccacccctgccccca

SEQ ID NO: 1779013 - DNA, 16 bp, Homo sapiens
cccacccctgtgctcc

SEQ ID NO: 1779014 - DNA, 20 bp, Homo sapiens
cccaccccttggaggagaga

SEQ ID NO: 1779015 - DNA, 23 bp, Homo sapiens
cccaccccttggaggagagagac

SEQ ID NO: 1779016 - DNA, 16 bp, Homo sapiens
cccacccgatgctgct

SEQ ID NO: 1779017 - DNA, 16 bp, Homo sapiens
cccacccggccacagc

SEQ ID NO: 1779018 - DNA, 13 bp, Homo sapiens
cccacccggtggg

SEQ ID NO: 1779019 - DNA, 17 bp, Homo sapiens
cccaccctcagcacccc

SEQ ID NO: 1779020 - DNA, 13 bp, Homo sapiens
cccaccctccact

SEQ ID NO: 1779021 - DNA, 14 bp, Homo sapiens
cccaccctccactc

SEQ ID NO: 1779022 - DNA, 15 bp, Homo sapiens
cccaccctccatgct

SEQ ID NO: 1779023 - DNA, 13 bp, Homo sapiens
cccaccctgggcc

SEQ ID NO: 1779024 - DNA, 13 bp, Homo sapiens
cccaccctgggct

SEQ ID NO: 1779025 - DNA, 14 bp, Homo sapiens
cccaccctgggctc

SEQ ID NO: 1779026 - DNA, 18 bp, Homo sapiens
cccaccctggtgggccaa

SEQ ID NO: 1779027 - DNA, 13 bp, Homo sapiens
cccaccgcagcgt

SEQ ID NO: 1779028 - DNA, 21 bp, Homo sapiens
cccaccgtccgccctgctcct

SEQ ID NO: 1779029 - DNA, 20 bp, Homo sapiens
cccaccgtggaggaggaagg

SEQ ID NO: 1779030 - DNA, 20 bp, Homo sapiens
cccaccgtgggcagtgccac

SEQ ID NO: 1779031 - DNA, 16 bp, Homo sapiens
cccacctacccagctg

SEQ ID NO: 1779032 - DNA, 16 bp, Homo sapiens
cccacctactgcactt

SEQ ID NO: 1779033 - DNA, 14 bp, Homo sapiens
cccacctagtgccc

SEQ ID NO: 1779034 - DNA, 20 bp, Homo sapiens
cccacctagtgccccagact

SEQ ID NO: 1779035 - DNA, 13 bp, Homo sapiens
cccacctccccct

SEQ ID NO: 1779036 - DNA, 15 bp, Homo sapiens
cccacctcccttccc

SEQ ID NO: 1779037 - DNA, 21 bp, Homo sapiens
cccacctgacaatggcagcta

SEQ ID NO: 1779038 - DNA, 20 bp, Homo sapiens
cccacctgcccatcacaggg

SEQ ID NO: 1779039 - DNA, 16 bp, Homo sapiens
cccacctgcctggtgc

SEQ ID NO: 1779040 - DNA, 12 bp, Homo sapiens
cccacctgctga

SEQ ID NO: 1779041 - DNA, 13 bp, Homo sapiens
cccacctggccac

SEQ ID NO: 1779042 - DNA, 17 bp, Homo sapiens
cccacctggccacctga

SEQ ID NO: 1779043 - DNA, 20 bp, Homo sapiens
cccacctggccacctgaggt

SEQ ID NO: 1779044 - DNA, 21 bp, Homo sapiens
cccacctggtactgacccagg

SEQ ID NO: 1779045 - DNA, 23 bp, Homo sapiens
cccacctggtactgacccaggac

SEQ ID NO: 1779046 - DNA, 16 bp, Homo sapiens
cccacctgttttctga

SEQ ID NO: 1779047 - DNA, 21 bp, Homo sapiens
cccaccttcaattcctgggcc

SEQ ID NO: 1779048 - DNA, 13 bp, Homo sapiens
cccaccttggcct

SEQ ID NO: 1779049 - DNA, 18 bp, Homo sapiens
cccaccttgttggagcct

SEQ ID NO: 1779050 - DNA, 19 bp, Homo sapiens
cccaccttgttggagcctg

SEQ ID NO: 1779051 - DNA, 19 bp, Homo sapiens
cccacgagtcacctgcaag

SEQ ID NO: 1779052 - DNA, 13 bp, Homo sapiens
cccacgatcccct

SEQ ID NO: 1779053 - DNA, 16 bp, Homo sapiens
cccacgttctcacacc

SEQ ID NO: 1779054 - DNA, 20 bp, Homo sapiens
cccacgttctcacacccacc

SEQ ID NO: 1779055 - DNA, 23 bp, Homo sapiens
cccactacccttctcctttcctt

SEQ ID NO: 1779056 - DNA, 17 bp, Homo sapiens
cccactagagggcccat

SEQ ID NO: 1779057 - DNA, 12 bp, Homo sapiens
cccactcaccag

SEQ ID NO: 1779058 - DNA, 14 bp, Homo sapiens
cccactcaccagcc

SEQ ID NO: 1779059 - DNA, 15 bp, Homo sapiens
cccactcaccagggt

SEQ ID NO: 1779060 - DNA, 14 bp, Homo sapiens
cccgtgtcctctcc

SEQ ID NO: 1779061 - DNA, 20 bp, Homo sapiens
cccgtgtcctctccctgcca

SEQ ID NO: 1779062 - DNA, 16 bp, Homo sapiens
cccgtgttcaggacac

SEQ ID NO: 1779063 - DNA, 18 bp, Homo sapiens
cccgttccaccccaagag

SEQ ID NO: 1779064 - DNA, 12 bp, Homo sapiens
cccgtttctcca

SEQ ID NO: 1779065 - DNA, 16 bp, Homo sapiens
cccgtttctccaccta

SEQ ID NO: 1779066 - DNA, 13 bp, Homo sapiens
cccgttttgtcac

SEQ ID NO: 1779067 - DNA, 15 bp, Homo sapiens
ccctaaccaagttcc

SEQ ID NO: 1779068 - DNA, 17 bp, Homo sapiens
ccctaacctcttttctg

SEQ ID NO: 1779069 - DNA, 16 bp, Homo sapiens
ccctaagcccccaggg

SEQ ID NO: 1779070 - DNA, 17 bp, Homo sapiens
ccctaagtggctgcctt

SEQ ID NO: 1779071 - DNA, 21 bp, Homo sapiens
ccctaattctcttcgctgtga

SEQ ID NO: 1779072 - DNA, 13 bp, Homo sapiens
ccctacagcctag

SEQ ID NO: 1779073 - DNA, 15 bp, Homo sapiens
ccctacagcctaggg

SEQ ID NO: 1779074 - DNA, 17 bp, Homo sapiens
ccctacagcctgcacac

SEQ ID NO: 1779075 - DNA, 19 bp, Homo sapiens
ccctacagcctgcacacac

SEQ ID NO: 1779076 - DNA, 20 bp, Homo sapiens
ccctacagcctgcacacacc

SEQ ID NO: 1779077 - DNA, 21 bp, Homo sapiens
ccctacagcctgcacacacct

SEQ ID NO: 1779078 - DNA, 22 bp, Homo sapiens
ccctaccagcgcccgctgggct

SEQ ID NO: 1779079 - DNA, 15 bp, Homo sapiens
ccctacccaaccctg

SEQ ID NO: 1779080 - DNA, 19 bp, Homo sapiens
ccctaccccacaccaggcc

SEQ ID NO: 1779081 - DNA, 14 bp, Homo sapiens
ccctaccccaccac

SEQ ID NO: 1779082 - DNA, 23 bp, Homo sapiens
ccctacctgattggtgcaaccct

SEQ ID NO: 1779083 - DNA, 14 bp, Homo sapiens
ccctacctgtgcct

SEQ ID NO: 1779084 - DNA, 13 bp, Homo sapiens
ccctaccttcccc

SEQ ID NO: 1779085 - DNA, 14 bp, Homo sapiens
ccctaccttgcctc

SEQ ID NO: 1779086 - DNA, 19 bp, Homo sapiens
ccctacgggcgctgcagcc

SEQ ID NO: 1779087 - DNA, 18 bp, Homo sapiens
ccctactccactgccctg

SEQ ID NO: 1779088 - DNA, 21 bp, Homo sapiens
ccctactccactgccctggca

SEQ ID NO: 1779089 - DNA, 15 bp, Homo sapiens
ccctactccctgcag

SEQ ID NO: 1779090 - DNA, 16 bp, Homo sapiens
ccctactccctgcaga

SEQ ID NO: 1779091 - DNA, 19 bp, Homo sapiens
ccctactccctgcagatgc

SEQ ID NO: 1779092 - DNA, 18 bp, Homo sapiens
ccctacttccaagaaaaa

SEQ ID NO: 1779093 - DNA, 22 bp, Homo sapiens
ccctactttgcttccgccactc

SEQ ID NO: 1779094 - DNA, 20 bp, Homo sapiens
ccctagagacagtgatgcct

SEQ ID NO: 1779095 - DNA, 23 bp, Homo sapiens
ccctagagacagtgatgcctgcc

SEQ ID NO: 1779096 - DNA, 17 bp, Homo sapiens
ccctagagagaataaat

SEQ ID NO: 1779097 - DNA, 18 bp, Homo sapiens
ccctagagagaataaatt

SEQ ID NO: 1779098 - DNA, 19 bp, Homo sapiens
ccctagagagaataaattg

SEQ ID NO: 1779099 - DNA, 21 bp, Homo sapiens
ccctagaggcgagccaggcaa

SEQ ID NO: 1779100 - DNA, 20 bp, Homo sapiens
ccctagccaatgtctcctcc

SEQ ID NO: 1779101 - DNA, 14 bp, Homo sapiens
ccctagccctggtt

SEQ ID NO: 1779102 - DNA, 14 bp, Homo sapiens
ccctagccttgctt

SEQ ID NO: 1779103 - DNA, 19 bp, Homo sapiens
ccctagctcaccaggcctg

SEQ ID NO: 1779104 - DNA, 21 bp, Homo sapiens
ccctagctttacgctcatcac

SEQ ID NO: 1779105 - DNA, 18 bp, Homo sapiens
ccctagctttagaccctg

SEQ ID NO: 1779106 - DNA, 16 bp, Homo sapiens
ccctaggatgctgcag

SEQ ID NO: 1779107 - DNA, 12 bp, Homo sapiens
ccctcccagccc

SEQ ID NO: 1779108 - DNA, 17 bp, Homo sapiens
ccctcccagcccattgc

SEQ ID NO: 1779109 - DNA, 18 bp, Homo sapiens
ccctcccaggggagccag

SEQ ID NO: 1779110 - DNA, 14 bp, Homo sapiens
ccctcccatctggg

SEQ ID NO: 1779111 - DNA, 17 bp, Homo sapiens
ccctcccatctgggagt

SEQ ID NO: 1779112 - DNA, 13 bp, Homo sapiens
ccctcccattagg

SEQ ID NO: 1779113 - DNA, 15 bp, Homo sapiens
ccctcccattaggac

SEQ ID NO: 1779114 - DNA, 15 bp, Homo sapiens
ccctccccaactccc

SEQ ID NO: 1779115 - DNA, 19 bp, Homo sapiens
ccctccccacacctcccta

SEQ ID NO: 1779116 - DNA, 21 bp, Homo sapiens
ccctccccacacctccctact

SEQ ID NO: 1779117 - DNA, 12 bp, Homo sapiens
ccctccccaggg

SEQ ID NO: 1779118 - DNA, 16 bp, Homo sapiens
ccctccccattcacag

SEQ ID NO: 1779119 - DNA, 21 bp, Homo sapiens
ccctcccccattccctccatt

SEQ ID NO: 1779120 - DNA, 16 bp, Homo sapiens
ccctccccctcctgct

SEQ ID NO: 1779121 - DNA, 18 bp, Homo sapiens
ccctccccctcctgctgt

SEQ ID NO: 1779122 - DNA, 13 bp, Homo sapiens
ccctcccccttgt

SEQ ID NO: 1779123 - DNA, 15 bp, Homo sapiens
ccctcccccttgtcc

SEQ ID NO: 1779124 - DNA, 19 bp, Homo sapiens
ccctccccggccctaccag

SEQ ID NO: 1779125 - DNA, 14 bp, Homo sapiens
ccctcccctctctt

SEQ ID NO: 1779126 - DNA, 15 bp, Homo sapiens
ccctcccctctcttg

SEQ ID NO: 1779127 - DNA, 16 bp, Homo sapiens
ccctcccctctcttgc

SEQ ID NO: 1779128 - DNA, 24 bp, Homo sapiens
ccctcccctctcttgcacccgcct

SEQ ID NO: 1779129 - DNA, 13 bp, Homo sapiens
ccctccccttccc

SEQ ID NO: 1779130 - DNA, 19 bp, Homo sapiens
ccctcccgcaccttcctcc

SEQ ID NO: 1779131 - DNA, 16 bp, Homo sapiens
ccctccctaccctaac

SEQ ID NO: 1779132 - DNA, 14 bp, Homo sapiens
ccctccctctgccc

SEQ ID NO: 1779133 - DNA, 16 bp, Homo sapiens
ccctccctctgcccca

SEQ ID NO: 1779134 - DNA, 20 bp, Homo sapiens
ccctccctgcttgcacactt

SEQ ID NO: 1779135 - DNA, 16 bp, Homo sapiens
ccctccctggctccca

SEQ ID NO: 1779136 - DNA, 19 bp, Homo sapiens
ccctccctggctcccatga

SEQ ID NO: 1779137 - DNA, 13 bp, Homo sapiens
ccctccctggctg

SEQ ID NO: 1779138 - DNA, 14 bp, Homo sapiens
ccctccctgtccca

SEQ ID NO: 1779139 - DNA, 13 bp, Homo sapiens
ccctccctgtcct

SEQ ID NO: 1779140 - DNA, 19 bp, Homo sapiens
ccctccctgttccccagag

SEQ ID NO: 1779141 - DNA, 20 bp, Homo sapiens
ccctccctgttccccagaga

SEQ ID NO: 1779142 - DNA, 14 bp, Homo sapiens
ccctcccttcaacc

SEQ ID NO: 1779143 - DNA, 22 bp, Homo sapiens
ccctcccttggaaacctgccct

SEQ ID NO: 1779144 - DNA, 13 bp, Homo sapiens
ccctccctttctc

SEQ ID NO: 1779145 - DNA, 14 bp, Homo sapiens
ccctccctttctcc

SEQ ID NO: 1779146 - DNA, 16 bp, Homo sapiens
ccctccgatgctgagg

SEQ ID NO: 1779147 - DNA, 23 bp, Homo sapiens
ccctccgcagcagggaagctctt

SEQ ID NO: 1779148 - DNA, 14 bp, Homo sapiens
ccctccgccattct

SEQ ID NO: 1779149 - DNA, 16 bp, Homo sapiens
ccctccgccctgccac

SEQ ID NO: 1779150 - DNA, 17 bp, Homo sapiens
ccctccgtgatccatcc

SEQ ID NO: 1779151 - DNA, 19 bp, Homo sapiens
cctactccactgccctggc

SEQ ID NO: 1779152 - DNA, 14 bp, Homo sapiens
cctactcccctggg

SEQ ID NO: 1779153 - DNA, 20 bp, Homo sapiens
cctactccctcttcactgtg

SEQ ID NO: 1779154 - DNA, 17 bp, Homo sapiens
cctactccgctcactga

SEQ ID NO: 1779155 - DNA, 21 bp, Homo sapiens
cctactctccttgagtgtatg

SEQ ID NO: 1779156 - DNA, 15 bp, Homo sapiens
cctactcttcagggt

SEQ ID NO: 1779157 - DNA, 16 bp, Homo sapiens
cctactgaagtggctg

SEQ ID NO: 1779158 - DNA, 13 bp, Homo sapiens
cctactgcccaca

SEQ ID NO: 1779159 - DNA, 16 bp, Homo sapiens
cctactgcccacattt

SEQ ID NO: 1779160 - DNA, 16 bp, Homo sapiens
cctactggacgctgcc

SEQ ID NO: 1779161 - DNA, 19 bp, Homo sapiens
cctactggacgctgccctg

SEQ ID NO: 1779162 - DNA, 22 bp, Homo sapiens
cctactgtccctctcagtgcct

SEQ ID NO: 1779163 - DNA, 23 bp, Homo sapiens
cctactgttctaaagctctgaca

SEQ ID NO: 1779164 - DNA, 22 bp, Homo sapiens
cctacttcttttgctcttagct

SEQ ID NO: 1779165 - DNA, 21 bp, Homo sapiens
cctacttgataatattagtga

SEQ ID NO: 1779166 - DNA, 15 bp, Homo sapiens
cctactttagccact

SEQ ID NO: 1779167 - DNA, 16 bp, Homo sapiens
cctactttagccactg

SEQ ID NO: 1779168 - DNA, 23 bp, Homo sapiens
cctagaaatatctttctcttacc

SEQ ID NO: 1779169 - DNA, 19 bp, Homo sapiens
cctagaaccaagcttcaga

SEQ ID NO: 1779170 - DNA, 20 bp, Homo sapiens
cctagaaccaagcttcagag

SEQ ID NO: 1779171 - DNA, 21 bp, Homo sapiens
cctagaaccaagcttcagagc

SEQ ID NO: 1779172 - DNA, 15 bp, Homo sapiens
cctagaactgtgcct

SEQ ID NO: 1779173 - DNA, 16 bp, Homo sapiens
cctagaagtaagaaga

SEQ ID NO: 1779174 - DNA, 23 bp, Homo sapiens
cctagaagtaagaagaggagcct

SEQ ID NO: 1779175 - DNA, 22 bp, Homo sapiens
cctagaagtctccctgcacagc

SEQ ID NO: 1779176 - DNA, 15 bp, Homo sapiens
cctagacccaggtgg

SEQ ID NO: 1779177 - DNA, 20 bp, Homo sapiens
cctagactctgtctacctgg

SEQ ID NO: 1779178 - DNA, 18 bp, Homo sapiens
cctagactgttactttgg

SEQ ID NO: 1779179 - DNA, 17 bp, Homo sapiens
cctagagagaataaatt

SEQ ID NO: 1779180 - DNA, 20 bp, Homo sapiens
cctagaggcgagccaggcaa

SEQ ID NO: 1779181 - DNA, 17 bp, Homo sapiens
cctagataaaaagatgg

SEQ ID NO: 1779182 - DNA, 19 bp, Homo sapiens
cctagatccacacacagag

SEQ ID NO: 1779183 - DNA, 20 bp, Homo sapiens
cctagatccacacacagagg

SEQ ID NO: 1779184 - DNA, 14 bp, Homo sapiens
cctagatcctaagg

SEQ ID NO: 1779185 - DNA, 16 bp, Homo sapiens
cctagatcctaagggt

SEQ ID NO: 1779186 - DNA, 21 bp, Homo sapiens
cctagatgcacgtggggccca

SEQ ID NO: 1779187 - DNA, 22 bp, Homo sapiens
cctagcagcccaccctgctgct

SEQ ID NO: 1779188 - DNA, 23 bp, Homo sapiens
cctagcagcccaccctgctgctg

SEQ ID NO: 1779189 - DNA, 15 bp, Homo sapiens
cctagccacctccca

SEQ ID NO: 1779190 - DNA, 19 bp, Homo sapiens
cctagccacctcccacccc

SEQ ID NO: 1779191 - DNA, 19 bp, Homo sapiens
cctagccgacctcagcctt

SEQ ID NO: 1779192 - DNA, 17 bp, Homo sapiens
cctagccttgcactttc

SEQ ID NO: 1779193 - DNA, 14 bp, Homo sapiens
cctagccttgcttg

SEQ ID NO: 1779194 - DNA, 21 bp, Homo sapiens
cctagcgatctctcctggcct

SEQ ID NO: 1779195 - DNA, 15 bp, Homo sapiens
cctagcggagcccag

SEQ ID NO: 1779196 - DNA, 18 bp, Homo sapiens
cctagcggagcccagcct

SEQ ID NO: 1779197 - DNA, 14 bp, Homo sapiens
cctagctcaccagg

SEQ ID NO: 1779198 - DNA, 20 bp, Homo sapiens
cctagctcctcctcctgggc

SEQ ID NO: 1779199 - DNA, 24 bp, Homo sapiens
cctagctctttgggcctctcctgc

SEQ ID NO: 1779200 - DNA, 18 bp, Homo sapiens
cctagctttagaccctgg

SEQ ID NO: 1779201 - DNA, 23 bp, Homo sapiens
cctagctttagaccctgggtggg

SEQ ID NO: 1779202 - DNA, 18 bp, Homo sapiens
cctagctttttcctggaa

SEQ ID NO: 1779203 - DNA, 14 bp, Homo sapiens
cctaggaagtgatt

SEQ ID NO: 1779204 - DNA, 17 bp, Homo sapiens
cctaggaattcccagcc

SEQ ID NO: 1779205 - DNA, 19 bp, Homo sapiens
cctaggagatatctgaggg

SEQ ID NO: 1779206 - DNA, 14 bp, Homo sapiens
cctaggagctggct

SEQ ID NO: 1779207 - DNA, 21 bp, Homo sapiens
cctaggagctggctggcaggt

SEQ ID NO: 1779208 - DNA, 13 bp, Homo sapiens
cctaggagggtgt

SEQ ID NO: 1779209 - DNA, 23 bp, Homo sapiens
cctaggcacctccccgctctccc

SEQ ID NO: 1779210 - DNA, 19 bp, Homo sapiens
cctaggcattgcaggacct

SEQ ID NO: 1779211 - DNA, 17 bp, Homo sapiens
cctaggccactcctcca

SEQ ID NO: 1779212 - DNA, 20 bp, Homo sapiens
cctaggccactcctccaaag

SEQ ID NO: 1779213 - DNA, 15 bp, Homo sapiens
cctaggcccctccta

SEQ ID NO: 1779214 - DNA, 18 bp, Homo sapiens
cctaggcccctcctagac

SEQ ID NO: 1779215 - DNA, 22 bp, Homo sapiens
cctaggcccctcctagacccag

SEQ ID NO: 1779216 - DNA, 15 bp, Homo sapiens
cctaggctccacccc

SEQ ID NO: 1779217 - DNA, 19 bp, Homo sapiens
cctaggctggaaataggat

SEQ ID NO: 1779218 - DNA, 11 bp, Homo sapiens
cctagggagcc

SEQ ID NO: 1779219 - DNA, 13 bp, Homo sapiens
cctagggatctga

SEQ ID NO: 1779220 - DNA, 17 bp, Homo sapiens
cctagggatctgaaatc

SEQ ID NO: 1779221 - DNA, 21 bp, Homo sapiens
cctaggggtgcgctcacctgc

SEQ ID NO: 1779222 - DNA, 14 bp, Homo sapiens
cctaggtctccagt

SEQ ID NO: 1779223 - DNA, 18 bp, Homo sapiens
cctaggtgcccagggcca

SEQ ID NO: 1779224 - DNA, 20 bp, Homo sapiens
cctaggttttggagagtttg

SEQ ID NO: 1779225 - DNA, 21 bp, Homo sapiens
cctagtaattgcctagaaata

SEQ ID NO: 1779226 - DNA, 15 bp, Homo sapiens
cctagtactctctgc

SEQ ID NO: 1779227 - DNA, 16 bp, Homo sapiens
cctagtactctctgct

SEQ ID NO: 1779228 - DNA, 19 bp, Homo sapiens
cctagtactctctgctcta

SEQ ID NO: 1779229 - DNA, 20 bp, Homo sapiens
cctagtactctctgctctag

SEQ ID NO: 1779230 - DNA, 21 bp, Homo sapiens
cctagtactctctgctctagc

SEQ ID NO: 1779231 - DNA, 22 bp, Homo sapiens
cctagtactctctgctctagcc

SEQ ID NO: 1779232 - DNA, 23 bp, Homo sapiens
cctagtactctctgctctagcca

SEQ ID NO: 1779233 - DNA, 23 bp, Homo sapiens
cctagtattcctaacctgtcaga

SEQ ID NO: 1779234 - DNA, 14 bp, Homo sapiens
cctagtgccccaga

SEQ ID NO: 1779235 - DNA, 24 bp, Homo sapiens
cctagtgccccagactgagctctc

SEQ ID NO: 1779236 - DNA, 15 bp, Homo sapiens
cctagtgcttccact

SEQ ID NO: 1779237 - DNA, 20 bp, Homo sapiens
cctagttaaagaaaggaaaa

SEQ ID NO: 1779238 - DNA, 16 bp, Homo sapiens
cctagttagcatccag

SEQ ID NO: 1779239 - DNA, 21 bp, Homo sapiens
cctagttagcatccaggctgg

SEQ ID NO: 1779240 - DNA, 17 bp, Homo sapiens
cctagttcctgtggcca

SEQ ID NO: 1779241 - DNA, 12 bp, Homo sapiens
cctagttttcca

SEQ ID NO: 1779242 - DNA, 15 bp, Homo sapiens
cctagttttccatgc

SEQ ID NO: 1779243 - DNA, 18 bp, Homo sapiens
cctagttttctcctccca

SEQ ID NO: 1779244 - DNA, 16 bp, Homo sapiens
cctataaagggcccac

SEQ ID NO: 1779245 - DNA, 14 bp, Homo sapiens
cctataagaagcct

SEQ ID NO: 1779246 - DNA, 15 bp, Homo sapiens
cctatacctgagcct

SEQ ID NO: 1779247 - DNA, 21 bp, Homo sapiens
cctatagagagggggctctcc

SEQ ID NO: 1779248 - DNA, 13 bp, Homo sapiens
cctatagtcccag

SEQ ID NO: 1779249 - DNA, 14 bp, Homo sapiens
cctatagtcccagc

SEQ ID NO: 1779250 - DNA, 15 bp, Homo sapiens
cctatagtcccagct

SEQ ID NO: 1779251 - DNA, 18 bp, Homo sapiens
cctatattgttttcagtg

SEQ ID NO: 1779252 - DNA, 12 bp, Homo sapiens
cctatccaccca

SEQ ID NO: 1779253 - DNA, 18 bp, Homo sapiens
cctatccacccagcccat

SEQ ID NO: 1779254 - DNA, 18 bp, Homo sapiens
cctatccccaggccaggt

SEQ ID NO: 1779255 - DNA, 19 bp, Homo sapiens
cctatccccaggccaggtc

SEQ ID NO: 1779256 - DNA, 18 bp, Homo sapiens
cctatccgctgccagcct

SEQ ID NO: 1779257 - DNA, 17 bp, Homo sapiens
cctatccttccagtggc

SEQ ID NO: 1779258 - DNA, 16 bp, Homo sapiens
cctatgacacagttat

SEQ ID NO: 1779259 - DNA, 15 bp, Homo sapiens
cctatgatcccagca

SEQ ID NO: 1779260 - DNA, 17 bp, Homo sapiens
cctatggaagtggttct

SEQ ID NO: 1779261 - DNA, 15 bp, Homo sapiens
cctatggctgcctgc

SEQ ID NO: 1779262 - DNA, 17 bp, Homo sapiens
cctatgggcctgccggg

SEQ ID NO: 1779263 - DNA, 22 bp, Homo sapiens
cctatggtataatggttgactg

SEQ ID NO: 1779264 - DNA, 22 bp, Homo sapiens
cctatgtaagaattcagaagac

SEQ ID NO: 1779265 - DNA, 14 bp, Homo sapiens
cctatgtatttgca

SEQ ID NO: 1779266 - DNA, 15 bp, Homo sapiens
cctatgtcctaagga

SEQ ID NO: 1779267 - DNA, 14 bp, Homo sapiens
cctccagaagctgc

SEQ ID NO: 1779268 - DNA, 17 bp, Homo sapiens
cctccagagacaacagg

SEQ ID NO: 1779269 - DNA, 11 bp, Homo sapiens
cctccagagcc

SEQ ID NO: 1779270 - DNA, 13 bp, Homo sapiens
cctccagagccag

SEQ ID NO: 1779271 - DNA, 14 bp, Homo sapiens
cctccagagccagc

SEQ ID NO: 1779272 - DNA, 15 bp, Homo sapiens
cctccagagccagcc

SEQ ID NO: 1779273 - DNA, 18 bp, Homo sapiens
cctccagagccagcctgg

SEQ ID NO: 1779274 - DNA, 19 bp, Homo sapiens
cctccagagccagcctggg

SEQ ID NO: 1779275 - DNA, 22 bp, Homo sapiens
cctccagagccagcctgggact

SEQ ID NO: 1779276 - DNA, 23 bp, Homo sapiens
cctccagagccagcctgggactc

SEQ ID NO: 1779277 - DNA, 17 bp, Homo sapiens
cctccagcctccctgtc

SEQ ID NO: 1779278 - DNA, 13 bp, Homo sapiens
cctccagcctctc

SEQ ID NO: 1779279 - DNA, 16 bp, Homo sapiens
cctccagcctctcccg

SEQ ID NO: 1779280 - DNA, 11 bp, Homo sapiens
cctccagctca

SEQ ID NO: 1779281 - DNA, 12 bp, Homo sapiens
cctccagctccc

SEQ ID NO: 1779282 - DNA, 17 bp, Homo sapiens
cctccaggaagaagcag

SEQ ID NO: 1779283 - DNA, 20 bp, Homo sapiens
cctccaggaagaagcagggg

SEQ ID NO: 1779284 - DNA, 22 bp, Homo sapiens
cctccaggaatgatctcttctt

SEQ ID NO: 1779285 - DNA, 14 bp, Homo sapiens
cctccaggagagag

SEQ ID NO: 1779286 - DNA, 15 bp, Homo sapiens
cctccaggagagagc

SEQ ID NO: 1779287 - DNA, 16 bp, Homo sapiens
cctccaggagagagcc

SEQ ID NO: 1779288 - DNA, 13 bp, Homo sapiens
cctccaggagcct

SEQ ID NO: 1779289 - DNA, 19 bp, Homo sapiens
cctccaggcaggccaggct

SEQ ID NO: 1779290 - DNA, 17 bp, Homo sapiens
cctccaggcccatctca

SEQ ID NO: 1779291 - DNA, 17 bp, Homo sapiens
cctccaggcctgcaggg

SEQ ID NO: 1779292 - DNA, 16 bp, Homo sapiens
cctccaggcctgcctc

SEQ ID NO: 1779293 - DNA, 21 bp, Homo sapiens
cctccaggcctgcctcccact

SEQ ID NO: 1779294 - DNA, 17 bp, Homo sapiens
cctccaggcctgttgct

SEQ ID NO: 1779295 - DNA, 21 bp, Homo sapiens
cctccagggcattgctcagcc

SEQ ID NO: 1779296 - DNA, 13 bp, Homo sapiens
cctccagggctgg

SEQ ID NO: 1779297 - DNA, 16 bp, Homo sapiens
cctccagggctggact

SEQ ID NO: 1779298 - DNA, 18 bp, Homo sapiens
cctccagggctggactga

SEQ ID NO: 1779299 - DNA, 20 bp, Homo sapiens
cctccagggctggactgagg

SEQ ID NO: 1779300 - DNA, 22 bp, Homo sapiens
cctccaggtcggagtgcctgga

SEQ ID NO: 1779301 - DNA, 14 bp, Homo sapiens
cctcccctctcaga

SEQ ID NO: 1779302 - DNA, 16 bp, Homo sapiens
cctcccctctcttgca

SEQ ID NO: 1779303 - DNA, 14 bp, Homo sapiens
cctcccctgggcag

SEQ ID NO: 1779304 - DNA, 23 bp, Homo sapiens
cctccccttgggcggctgagagc

SEQ ID NO: 1779305 - DNA, 15 bp, Homo sapiens
cctcccgaagccacc

SEQ ID NO: 1779306 - DNA, 14 bp, Homo sapiens
cctcccgagctcct

SEQ ID NO: 1779307 - DNA, 19 bp, Homo sapiens
cctcccgagctcctcttcc

SEQ ID NO: 1779308 - DNA, 14 bp, Homo sapiens
cctcccgcaccttc

SEQ ID NO: 1779309 - DNA, 21 bp, Homo sapiens
cctcccgggccctcccttgga

SEQ ID NO: 1779310 - DNA, 22 bp, Homo sapiens
cctccctaccctaaccaagttc

SEQ ID NO: 1779311 - DNA, 17 bp, Homo sapiens
cctccctacttccaaga

SEQ ID NO: 1779312 - DNA, 13 bp, Homo sapiens
cctccctcccaag

SEQ ID NO: 1779313 - DNA, 14 bp, Homo sapiens
cctccctccttcct

SEQ ID NO: 1779314 - DNA, 23 bp, Homo sapiens
cctccctctcagaggcctgctgc

SEQ ID NO: 1779315 - DNA, 14 bp, Homo sapiens
cctccctctccata

SEQ ID NO: 1779316 - DNA, 13 bp, Homo sapiens
cctccctctctct

SEQ ID NO: 1779317 - DNA, 13 bp, Homo sapiens
cctccctctgccc

SEQ ID NO: 1779318 - DNA, 22 bp, Homo sapiens
cctccctctgccccaagcagcc

SEQ ID NO: 1779319 - DNA, 19 bp, Homo sapiens
cctccctgaagcctttgca

SEQ ID NO: 1779320 - DNA, 15 bp, Homo sapiens
cctccctgcccccca

SEQ ID NO: 1779321 - DNA, 18 bp, Homo sapiens
cctccctgccccccaagg

SEQ ID NO: 1779322 - DNA, 18 bp, Homo sapiens
cctccctgcccctccctt

SEQ ID NO: 1779323 - DNA, 12 bp, Homo sapiens
cctccctgctgt

SEQ ID NO: 1779324 - DNA, 23 bp, Homo sapiens
cctccctgctgtgccatgctggg

SEQ ID NO: 1779325 - DNA, 17 bp, Homo sapiens
cctccctggcagacaca

SEQ ID NO: 1779326 - DNA, 13 bp, Homo sapiens
cctccctggctcc

SEQ ID NO: 1779327 - DNA, 14 bp, Homo sapiens
cctccctggctccc

SEQ ID NO: 1779328 - DNA, 12 bp, Homo sapiens
cctccctggctg

SEQ ID NO: 1779329 - DNA, 15 bp, Homo sapiens
cctccctggctgccc

SEQ ID NO: 1779330 - DNA, 17 bp, Homo sapiens
cctccctggctgccctg

SEQ ID NO: 1779331 - DNA, 23 bp, Homo sapiens
cctccctggctgccctggccctg

SEQ ID NO: 1779332 - DNA, 17 bp, Homo sapiens
cctccctgggggcccca

SEQ ID NO: 1779333 - DNA, 14 bp, Homo sapiens
cctccctgggttca

SEQ ID NO: 1779334 - DNA, 23 bp, Homo sapiens
cctccctgtcaaagctgtcactt

SEQ ID NO: 1779335 - DNA, 12 bp, Homo sapiens
cctccctgtcct

SEQ ID NO: 1779336 - DNA, 15 bp, Homo sapiens
cctccctgtcctcct

SEQ ID NO: 1779337 - DNA, 22 bp, Homo sapiens
cctccctgtctccagctgcctg

SEQ ID NO: 1779338 - DNA, 23 bp, Homo sapiens
cctccctgtctccagctgcctgg

SEQ ID NO: 1779339 - DNA, 11 bp, Homo sapiens
cctcccttccc

SEQ ID NO: 1779340 - DNA, 16 bp, Homo sapiens
cctcccttcccaggag

SEQ ID NO: 1779341 - DNA, 22 bp, Homo sapiens
cctcccttccttttccctgctt

SEQ ID NO: 1779342 - DNA, 21 bp, Homo sapiens
cctcccttggaaacctgccct

SEQ ID NO: 1779343 - DNA, 15 bp, Homo sapiens
cctcccttggcgtgg

SEQ ID NO: 1779344 - DNA, 14 bp, Homo sapiens
cctccctttctccc

SEQ ID NO: 1779345 - DNA, 18 bp, Homo sapiens
cctccctttctctctcca

SEQ ID NO: 1779346 - DNA, 19 bp, Homo sapiens
cctccctttctctctccac

SEQ ID NO: 1779347 - DNA, 22 bp, Homo sapiens
cctccgaccacttccaggggaa

SEQ ID NO: 1779348 - DNA, 19 bp, Homo sapiens
cctccgacgctgcctctca

SEQ ID NO: 1779349 - DNA, 20 bp, Homo sapiens
cctccgaggctccccgcctc

SEQ ID NO: 1779350 - DNA, 18 bp, Homo sapiens
cctccgatgctgaggcca

SEQ ID NO: 1779351 - DNA, 20 bp, Homo sapiens
cctccgatgctgaggccacc

SEQ ID NO: 1779352 - DNA, 22 bp, Homo sapiens
cctccgatgctgaggccaccca

SEQ ID NO: 1779353 - DNA, 19 bp, Homo sapiens
cctccgcagcagggaagct

SEQ ID NO: 1779354 - DNA, 18 bp, Homo sapiens
cctccgcagtgtctccac

SEQ ID NO: 1779355 - DNA, 16 bp, Homo sapiens
cctccgccctgccact

SEQ ID NO: 1779356 - DNA, 13 bp, Homo sapiens
cctccgccgtgcc

SEQ ID NO: 1779357 - DNA, 18 bp, Homo sapiens
cctccgcctactgtccct

SEQ ID NO: 1779358 - DNA, 23 bp, Homo sapiens
cctccgcctactgtccctctcag

SEQ ID NO: 1779359 - DNA, 13 bp, Homo sapiens
cctccgcctggga

SEQ ID NO: 1779360 - DNA, 19 bp, Homo sapiens
cctccgccttcactccggt

SEQ ID NO: 1779361 - DNA, 17 bp, Homo sapiens
cctccgccttctcccac

SEQ ID NO: 1779362 - DNA, 13 bp, Homo sapiens
cctccgctgggct

SEQ ID NO: 1779363 - DNA, 21 bp, Homo sapiens
cctccgctgggcttcattccg

SEQ ID NO: 1779364 - DNA, 18 bp, Homo sapiens
cctccggccagcgagtgg

SEQ ID NO: 1779365 - DNA, 18 bp, Homo sapiens
cctccggccatactgcct

SEQ ID NO: 1779366 - DNA, 12 bp, Homo sapiens
cctccggcctcc

SEQ ID NO: 1779367 - DNA, 15 bp, Homo sapiens
cctccggcctcccct

SEQ ID NO: 1779368 - DNA, 16 bp, Homo sapiens
cctccggcctcccctc

SEQ ID NO: 1779369 - DNA, 20 bp, Homo sapiens
cctccggcgggtgacagctc

SEQ ID NO: 1779370 - DNA, 16 bp, Homo sapiens
cctccgggcaggcaag

SEQ ID NO: 1779371 - DNA, 17 bp, Homo sapiens
cctccgtccacccaggc

SEQ ID NO: 1779372 - DNA, 18 bp, Homo sapiens
cctccgtttatgggcctt

SEQ ID NO: 1779373 - DNA, 19 bp, Homo sapiens
cctccgtttatgggccttg

SEQ ID NO: 1779374 - DNA, 20 bp, Homo sapiens
cctccgtttatgggccttgc

SEQ ID NO: 1779375 - DNA, 14 bp, Homo sapiens
cctcctaaagctga

SEQ ID NO: 1779376 - DNA, 20 bp, Homo sapiens
cctcctagaggtgggcagct

SEQ ID NO: 1779377 - DNA, 18 bp, Homo sapiens
cctcctatctccctggct

SEQ ID NO: 1779378 - DNA, 16 bp, Homo sapiens
cctcctcacccccagc

SEQ ID NO: 1779379 - DNA, 14 bp, Homo sapiens
cctcctcacctctg

SEQ ID NO: 1779380 - DNA, 15 bp, Homo sapiens
cctcctcacctctgg

SEQ ID NO: 1779381 - DNA, 20 bp, Homo sapiens
cctcctcatgtacataccct

SEQ ID NO: 1779382 - DNA, 20 bp, Homo sapiens
cctcctccacagtgctgctt

SEQ ID NO: 1779383 - DNA, 15 bp, Homo sapiens
cctcctccacccacc

SEQ ID NO: 1779384 - DNA, 14 bp, Homo sapiens
cctcctccactcac

SEQ ID NO: 1779385 - DNA, 16 bp, Homo sapiens
cctcctccactctccc

SEQ ID NO: 1779386 - DNA, 16 bp, Homo sapiens
cctcctccagcccctg

SEQ ID NO: 1779387 - DNA, 16 bp, Homo sapiens
cctcctcccacccggc

SEQ ID NO: 1779388 - DNA, 15 bp, Homo sapiens
cctcctcccagtgcc

SEQ ID NO: 1779389 - DNA, 15 bp, Homo sapiens
cctcctccccagctc

SEQ ID NO: 1779390 - DNA, 18 bp, Homo sapiens
cctcctccccagctcttc

SEQ ID NO: 1779391 - DNA, 15 bp, Homo sapiens
cctcctcccccagtg

SEQ ID NO: 1779392 - DNA, 12 bp, Homo sapiens
cctcctccccct

SEQ ID NO: 1779393 - DNA, 14 bp, Homo sapiens
cctcctcccctcct

SEQ ID NO: 1779394 - DNA, 18 bp, Homo sapiens
cctcctcccctcctcttc

SEQ ID NO: 1779395 - DNA, 12 bp, Homo sapiens
cctcctcctgac

SEQ ID NO: 1779396 - DNA, 19 bp, Homo sapiens
cctcctcggagagcagcag

SEQ ID NO: 1779397 - DNA, 20 bp, Homo sapiens
cctcctcggagagcagcagc

SEQ ID NO: 1779398 - DNA, 21 bp, Homo sapiens
cctcctcgggccgaggcccag

SEQ ID NO: 1779399 - DNA, 19 bp, Homo sapiens
cctcctctaaggttgggca

SEQ ID NO: 1779400 - DNA, 19 bp, Homo sapiens
cctcctctcccatccccct

SEQ ID NO: 1779401 - DNA, 19 bp, Homo sapiens
cctcctctcccatccttga

SEQ ID NO: 1779402 - DNA, 20 bp, Homo sapiens
cctcctctgccacctcccct

SEQ ID NO: 1779403 - DNA, 22 bp, Homo sapiens
cctcctctggacggcaggctca

SEQ ID NO: 1779404 - DNA, 20 bp, Homo sapiens
cctcctgaaccgcacagctc

SEQ ID NO: 1779405 - DNA, 20 bp, Homo sapiens
cctcctgagaaggcgaggag

SEQ ID NO: 1779406 - DNA, 12 bp, Homo sapiens
cctcctgagctc

SEQ ID NO: 1779407 - DNA, 18 bp, Homo sapiens
cctcctgagtagctggga

SEQ ID NO: 1779408 - DNA, 20 bp, Homo sapiens
cctcctgatggccaagagca

SEQ ID NO: 1779409 - DNA, 18 bp, Homo sapiens
cctcctgcaggctggctg

SEQ ID NO: 1779410 - DNA, 22 bp, Homo sapiens
cctcctgcaggctggctgttgg

SEQ ID NO: 1779411 - DNA, 13 bp, Homo sapiens
cctcctgcccagg

SEQ ID NO: 1779412 - DNA, 15 bp, Homo sapiens
cctcctgcccaggag

SEQ ID NO: 1779413 - DNA, 19 bp, Homo sapiens
cctcctgcccaggagagcc

SEQ ID NO: 1779414 - DNA, 23 bp, Homo sapiens
cctcctgcccaggagagccagcc

SEQ ID NO: 1779415 - DNA, 11 bp, Homo sapiens
cctcctgctca

SEQ ID NO: 1779416 - DNA, 15 bp, Homo sapiens
cctcctgctcctcac

SEQ ID NO: 1779417 - DNA, 20 bp, Homo sapiens
cctcctgctcctcacccctg

SEQ ID NO: 1779418 - DNA, 16 bp, Homo sapiens
cctcctgctcctccct

SEQ ID NO: 1779419 - DNA, 12 bp, Homo sapiens
cctcctgctggg

SEQ ID NO: 1779420 - DNA, 12 bp, Homo sapiens
cctcctgctgtg

SEQ ID NO: 1779421 - DNA, 20 bp, Homo sapiens
cctcctggctcaggcccagc

SEQ ID NO: 1779422 - DNA, 11 bp, Homo sapiens
cctcctggctg

SEQ ID NO: 1779423 - DNA, 22 bp, Homo sapiens
cctcctggctgtgacacctggt

SEQ ID NO: 1779424 - DNA, 19 bp, Homo sapiens
cctcctgggaaggccacct

SEQ ID NO: 1779425 - DNA, 20 bp, Homo sapiens
cctcctgggaaggccacctc

SEQ ID NO: 1779426 - DNA, 22 bp, Homo sapiens
cctcctgtaaatggtgtacata

SEQ ID NO: 1779427 - DNA, 16 bp, Homo sapiens
cctcctgtgctatttg

SEQ ID NO: 1779428 - DNA, 15 bp, Homo sapiens
cctccttcagacacc

SEQ ID NO: 1779429 - DNA, 13 bp, Homo sapiens
cctccttcccgcc

SEQ ID NO: 1779430 - DNA, 21 bp, Homo sapiens
cctccttcccgccgcccgacc

SEQ ID NO: 1779431 - DNA, 15 bp, Homo sapiens
cctccttctcccttt

SEQ ID NO: 1779432 - DNA, 17 bp, Homo sapiens
cctccttctcccttttt

SEQ ID NO: 1779433 - DNA, 16 bp, Homo sapiens
cctccttggccaccag

SEQ ID NO: 1779434 - DNA, 19 bp, Homo sapiens
cctccttggccaccagacc

SEQ ID NO: 1779435 - DNA, 23 bp, Homo sapiens
cctccttggctttatgcaaatac

SEQ ID NO: 1779436 - DNA, 20 bp, Homo sapiens
cctccttgggcactttttaa

SEQ ID NO: 1779437 - DNA, 17 bp, Homo sapiens
cctccttggtgcctggc

SEQ ID NO: 1779438 - DNA, 19 bp, Homo sapiens
cctcctttcatcacactgg

SEQ ID NO: 1779439 - DNA, 21 bp, Homo sapiens
cctcctttgtttaataaaggc

SEQ ID NO: 1779440 - DNA, 19 bp, Homo sapiens
cctctccactgctggacat

SEQ ID NO: 1779441 - DNA, 18 bp, Homo sapiens
cctctccagtttgcacct

SEQ ID NO: 1779442 - DNA, 21 bp, Homo sapiens
cctctccagtttgcacctgtc

SEQ ID NO: 1779443 - DNA, 23 bp, Homo sapiens
cctctccagtttgcacctgtccc

SEQ ID NO: 1779444 - DNA, 17 bp, Homo sapiens
cctctccatatctcctt

SEQ ID NO: 1779445 - DNA, 17 bp, Homo sapiens
cctctcccacccggcca

SEQ ID NO: 1779446 - DNA, 14 bp, Homo sapiens
cctctcccaggacc

SEQ ID NO: 1779447 - DNA, 19 bp, Homo sapiens
cctctcccatccccctgcc

SEQ ID NO: 1779448 - DNA, 22 bp, Homo sapiens
cctctcccatccccctgccctc

SEQ ID NO: 1779449 - DNA, 16 bp, Homo sapiens
cctctccccagcccag

SEQ ID NO: 1779450 - DNA, 17 bp, Homo sapiens
cctctccccagcccaga

SEQ ID NO: 1779451 - DNA, 19 bp, Homo sapiens
cctctccccagcccagaga

SEQ ID NO: 1779452 - DNA, 20 bp, Homo sapiens
cctctccccagcccagagac

SEQ ID NO: 1779453 - DNA, 21 bp, Homo sapiens
cctctccccaggtccagctct

SEQ ID NO: 1779454 - DNA, 12 bp, Homo sapiens
cctctcccggct

SEQ ID NO: 1779455 - DNA, 20 bp, Homo sapiens
cctctcccggctgcctgccg

SEQ ID NO: 1779456 - DNA, 18 bp, Homo sapiens
cctctgtcaggccttcag

SEQ ID NO: 1779457 - DNA, 15 bp, Homo sapiens
cctctgtcatcactc

SEQ ID NO: 1779458 - DNA, 16 bp, Homo sapiens
cctctgtccacatgtg

SEQ ID NO: 1779459 - DNA, 14 bp, Homo sapiens
cctctgtccagggc

SEQ ID NO: 1779460 - DNA, 18 bp, Homo sapiens
cctctgtccagggccctg

SEQ ID NO: 1779461 - DNA, 20 bp, Homo sapiens
cctctgtccagggccctgag

SEQ ID NO: 1779462 - DNA, 18 bp, Homo sapiens
cctctgtccccttctctc

SEQ ID NO: 1779463 - DNA, 22 bp, Homo sapiens
cctctgtccccttctctcatct

SEQ ID NO: 1779464 - DNA, 22 bp, Homo sapiens
cctctgtctaggactgcagtgt

SEQ ID NO: 1779465 - DNA, 13 bp, Homo sapiens
cctctgtgctgtg

SEQ ID NO: 1779466 - DNA, 22 bp, Homo sapiens
cctctgtgcttcgactactgct

SEQ ID NO: 1779467 - DNA, 22 bp, Homo sapiens
cctctgtgtagccgccctgaga

SEQ ID NO: 1779468 - DNA, 20 bp, Homo sapiens
cctctgttcacaaactacct

SEQ ID NO: 1779469 - DNA, 20 bp, Homo sapiens
cctctgttcctttctctggg

SEQ ID NO: 1779470 - DNA, 19 bp, Homo sapiens
cctcttaaattatatattt

SEQ ID NO: 1779471 - DNA, 21 bp, Homo sapiens
cctcttaatgtatgattacat

SEQ ID NO: 1779472 - DNA, 17 bp, Homo sapiens
cctcttactttgcttga

SEQ ID NO: 1779473 - DNA, 12 bp, Homo sapiens
cctcttagcctc

SEQ ID NO: 1779474 - DNA, 20 bp, Homo sapiens
cctcttagcctctggatcta

SEQ ID NO: 1779475 - DNA, 19 bp, Homo sapiens
cctcttagtgattgtgtct

SEQ ID NO: 1779476 - DNA, 19 bp, Homo sapiens
cctcttattccaggagaag

SEQ ID NO: 1779477 - DNA, 18 bp, Homo sapiens
cctcttcatggatggggg

SEQ ID NO: 1779478 - DNA, 19 bp, Homo sapiens
cctcttccactccttctct

SEQ ID NO: 1779479 - DNA, 17 bp, Homo sapiens
cctcttccagtgaacat

SEQ ID NO: 1779480 - DNA, 18 bp, Homo sapiens
cctcttccagtgaacatt

SEQ ID NO: 1779481 - DNA, 16 bp, Homo sapiens
cctcttccatgctgtg

SEQ ID NO: 1779482 - DNA, 11 bp, Homo sapiens
cctcttcccca

SEQ ID NO: 1779483 - DNA, 13 bp, Homo sapiens
cctcttccccaga

SEQ ID NO: 1779484 - DNA, 16 bp, Homo sapiens
cctcttcccccaagat

SEQ ID NO: 1779485 - DNA, 18 bp, Homo sapiens
cctcttccctctgggcct

SEQ ID NO: 1779486 - DNA, 16 bp, Homo sapiens
cctcttccgaatgggt

SEQ ID NO: 1779487 - DNA, 14 bp, Homo sapiens
cctcttcctgccct

SEQ ID NO: 1779488 - DNA, 16 bp, Homo sapiens
cctcttcctgcccttg

SEQ ID NO: 1779489 - DNA, 17 bp, Homo sapiens
cctcttctattttgtaa

SEQ ID NO: 1779490 - DNA, 18 bp, Homo sapiens
cctcttctgacgtgcctt

SEQ ID NO: 1779491 - DNA, 16 bp, Homo sapiens
cctcttctgctctttt

SEQ ID NO: 1779492 - DNA, 19 bp, Homo sapiens
cctcttctgctcttttcct

SEQ ID NO: 1779493 - DNA, 20 bp, Homo sapiens
cctcttctgctcttttcctg

SEQ ID NO: 1779494 - DNA, 15 bp, Homo sapiens
cctcttctggctcaa

SEQ ID NO: 1779495 - DNA, 13 bp, Homo sapiens
cctcttcttctga

SEQ ID NO: 1779496 - DNA, 15 bp, Homo sapiens
cctcttcttcttcag

SEQ ID NO: 1779497 - DNA, 17 bp, Homo sapiens
cctcttcttcttcagaa

SEQ ID NO: 1779498 - DNA, 14 bp, Homo sapiens
cctcttcttctttc

SEQ ID NO: 1779499 - DNA, 19 bp, Homo sapiens
cctcttctttgtgcctttg

SEQ ID NO: 1779500 - DNA, 21 bp, Homo sapiens
cctcttctttgtgcctttggc

SEQ ID NO: 1779501 - DNA, 14 bp, Homo sapiens
cctcttgaccaggc

SEQ ID NO: 1779502 - DNA, 15 bp, Homo sapiens
cctcttgaccaggct

SEQ ID NO: 1779503 - DNA, 14 bp, Homo sapiens
cctcttgagcagtg

SEQ ID NO: 1779504 - DNA, 15 bp, Homo sapiens
cctcttgagcagtgg

SEQ ID NO: 1779505 - DNA, 19 bp, Homo sapiens
cctcttgagcagtggctgg

SEQ ID NO: 1779506 - DNA, 24 bp, Homo sapiens
cctcttgagcagtggctggtccag

SEQ ID NO: 1779507 - DNA, 18 bp, Homo sapiens
cctcttgcgggcctggac

SEQ ID NO: 1779508 - DNA, 22 bp, Homo sapiens
cctcttgctcagagctaggccc

SEQ ID NO: 1779509 - DNA, 18 bp, Homo sapiens
cctcttggagaagtctca

SEQ ID NO: 1779510 - DNA, 19 bp, Homo sapiens
cctcttggagaagtctcag

SEQ ID NO: 1779511 - DNA, 15 bp, Homo sapiens
cctcttggccatcct

SEQ ID NO: 1779512 - DNA, 23 bp, Homo sapiens
cctcttggctatttctgtgtcca

SEQ ID NO: 1779513 - DNA, 14 bp, Homo sapiens
cctcttggtgggtg

SEQ ID NO: 1779514 - DNA, 16 bp, Homo sapiens
cctcttgtcctggccc

SEQ ID NO: 1779515 - DNA, 19 bp, Homo sapiens
cctcttgtcttcctatttc

SEQ ID NO: 1779516 - DNA, 20 bp, Homo sapiens
cctcttgtgtaactaatttg

SEQ ID NO: 1779517 - DNA, 22 bp, Homo sapiens
cctcttgtgtaactaatttgtg

SEQ ID NO: 1779518 - DNA, 12 bp, Homo sapiens
cctctttaagag

SEQ ID NO: 1779519 - DNA, 22 bp, Homo sapiens
cctctttactcccttcctggcc

SEQ ID NO: 1779520 - DNA, 23 bp, Homo sapiens
cctctttactcccttcctggcct

SEQ ID NO: 1779521 - DNA, 14 bp, Homo sapiens
cctctttactctct

SEQ ID NO: 1779522 - DNA, 23 bp, Homo sapiens
cctctttagtttttggttgggaa

SEQ ID NO: 1779523 - DNA, 16 bp, Homo sapiens
cctctttccctgcgag

SEQ ID NO: 1779524 - DNA, 16 bp, Homo sapiens
cctctttcgtctactg

SEQ ID NO: 1779525 - DNA, 15 bp, Homo sapiens
cctctttctgctctg

SEQ ID NO: 1779526 - DNA, 21 bp, Homo sapiens
cctctttcttgtttgtcagca

SEQ ID NO: 1779527 - DNA, 11 bp, Homo sapiens
cctctttgctc

SEQ ID NO: 1779528 - DNA, 14 bp, Homo sapiens
cctctttggctccc

SEQ ID NO: 1779529 - DNA, 12 bp, Homo sapiens
cctgaaaaactg

SEQ ID NO: 1779530 - DNA, 11 bp, Homo sapiens
cctgaaaaggg

SEQ ID NO: 1779531 - DNA, 22 bp, Homo sapiens
cctgaaaagggcggaagagtta

SEQ ID NO: 1779532 - DNA, 22 bp, Homo sapiens
cctgaaaatgtttttctgccag

SEQ ID NO: 1779533 - DNA, 15 bp, Homo sapiens
cctgaaacaacttgg

SEQ ID NO: 1779534 - DNA, 19 bp, Homo sapiens
cctgaaacgctcctttgtg

SEQ ID NO: 1779535 - DNA, 21 bp, Homo sapiens
cctgaaacgctcctttgtgtg

SEQ ID NO: 1779536 - DNA, 22 bp, Homo sapiens
cctgaaagaggctgaggcctgg

SEQ ID NO: 1779537 - DNA, 14 bp, Homo sapiens
cctgaaagcctcac

SEQ ID NO: 1779538 - DNA, 13 bp, Homo sapiens
cctgaaagggccc

SEQ ID NO: 1779539 - DNA, 18 bp, Homo sapiens
cctgaaagggcccttccc

SEQ ID NO: 1779540 - DNA, 14 bp, Homo sapiens
cctgaaattccaaa

SEQ ID NO: 1779541 - DNA, 14 bp, Homo sapiens
cctgaaatttcaga

SEQ ID NO: 1779542 - DNA, 15 bp, Homo sapiens
cctgaaatttcagat

SEQ ID NO: 1779543 - DNA, 15 bp, Homo sapiens
cctgaacaagaattg

SEQ ID NO: 1779544 - DNA, 14 bp, Homo sapiens
cctgaacagaagct

SEQ ID NO: 1779545 - DNA, 15 bp, Homo sapiens
cctgaaccccagagg

SEQ ID NO: 1779546 - DNA, 17 bp, Homo sapiens
cctgaaccccagaggca

SEQ ID NO: 1779547 - DNA, 15 bp, Homo sapiens
cctgaaccccatggg

SEQ ID NO: 1779548 - DNA, 23 bp, Homo sapiens
cctgaaccccatgggcttggact

SEQ ID NO: 1779549 - DNA, 14 bp, Homo sapiens
cctgaacccctggc

SEQ ID NO: 1779550 - DNA, 17 bp, Homo sapiens
cctgaacccctggccag

SEQ ID NO: 1779551 - DNA, 22 bp, Homo sapiens
cctgaacccctggccagctctg

SEQ ID NO: 1779552 - DNA, 18 bp, Homo sapiens
cctgaaccgcacagctca

SEQ ID NO: 1779553 - DNA, 20 bp, Homo sapiens
cctgaaccgcacagctcagg

SEQ ID NO: 1779554 - DNA, 21 bp, Homo sapiens
cctgaacgttttcttctttcc

SEQ ID NO: 1779555 - DNA, 21 bp, Homo sapiens
cctgaactcattctcttcttg

SEQ ID NO: 1779556 - DNA, 17 bp, Homo sapiens
cctgaactgaacaccat

SEQ ID NO: 1779557 - DNA, 17 bp, Homo sapiens
cctgaagaggcgggcca

SEQ ID NO: 1779558 - DNA, 19 bp, Homo sapiens
cctgaagaggcgggccagc

SEQ ID NO: 1779559 - DNA, 20 bp, Homo sapiens
cctgaagaggcgggccagcc

SEQ ID NO: 1779560 - DNA, 22 bp, Homo sapiens
cctgaagaggcgggccagccag

SEQ ID NO: 1779561 - DNA, 17 bp, Homo sapiens
cctgaagatgggagcct

SEQ ID NO: 1779562 - DNA, 10 bp, Homo sapiens
cctgaagcaa

SEQ ID NO: 1779563 - DNA, 14 bp, Homo sapiens
cctgaagcctggat

SEQ ID NO: 1779564 - DNA, 16 bp, Homo sapiens
cctgaagcctggattc

SEQ ID NO: 1779565 - DNA, 15 bp, Homo sapiens
cctgaggctgtggtc

SEQ ID NO: 1779566 - DNA, 18 bp, Homo sapiens
cctgagggcccctctgcc

SEQ ID NO: 1779567 - DNA, 19 bp, Homo sapiens
cctgagggcccctctgccc

SEQ ID NO: 1779568 - DNA, 19 bp, Homo sapiens
cctgaggggcatctgcccc

SEQ ID NO: 1779569 - DNA, 19 bp, Homo sapiens
cctgagggtccacctggag

SEQ ID NO: 1779570 - DNA, 15 bp, Homo sapiens
cctgagggtggagac

SEQ ID NO: 1779571 - DNA, 17 bp, Homo sapiens
cctgaggtcactgctag

SEQ ID NO: 1779572 - DNA, 13 bp, Homo sapiens
cctgaggtcagga

SEQ ID NO: 1779573 - DNA, 15 bp, Homo sapiens
cctgaggtgggccca

SEQ ID NO: 1779574 - DNA, 18 bp, Homo sapiens
cctgaggtgggcccagga

SEQ ID NO: 1779575 - DNA, 16 bp, Homo sapiens
cctgaggtgggctggg

SEQ ID NO: 1779576 - DNA, 19 bp, Homo sapiens
cctgaggtgggctggggct

SEQ ID NO: 1779577 - DNA, 17 bp, Homo sapiens
cctgaggtgtgggggct

SEQ ID NO: 1779578 - DNA, 20 bp, Homo sapiens
cctgagtagctggattacag

SEQ ID NO: 1779579 - DNA, 14 bp, Homo sapiens
cctgagtcaccagg

SEQ ID NO: 1779580 - DNA, 15 bp, Homo sapiens
cctgagtcacccatg

SEQ ID NO: 1779581 - DNA, 16 bp, Homo sapiens
cctgagtcagtgctct

SEQ ID NO: 1779582 - DNA, 21 bp, Homo sapiens
cctgagtcctggtttcctggc

SEQ ID NO: 1779583 - DNA, 14 bp, Homo sapiens
cctgagtcggcccc

SEQ ID NO: 1779584 - DNA, 22 bp, Homo sapiens
cctgagtcggccccacatggga

SEQ ID NO: 1779585 - DNA, 19 bp, Homo sapiens
cctgagtcgtacagaaagc

SEQ ID NO: 1779586 - DNA, 15 bp, Homo sapiens
cctgagtctcctgtg

SEQ ID NO: 1779587 - DNA, 13 bp, Homo sapiens
cctgagtctgggc

SEQ ID NO: 1779588 - DNA, 24 bp, Homo sapiens
cctgagtgtcatgaagtgcacagg

SEQ ID NO: 1779589 - DNA, 18 bp, Homo sapiens
cctgagttaggctttctc

SEQ ID NO: 1779590 - DNA, 19 bp, Homo sapiens
cctgagttataaatatttt

SEQ ID NO: 1779591 - DNA, 14 bp, Homo sapiens
cctgagttcatcca

SEQ ID NO: 1779592 - DNA, 15 bp, Homo sapiens
cctgagttgaagagg

SEQ ID NO: 1779593 - DNA, 18 bp, Homo sapiens
cctgagttgaagagggga

SEQ ID NO: 1779594 - DNA, 18 bp, Homo sapiens
cctgataaagcacagctg

SEQ ID NO: 1779595 - DNA, 19 bp, Homo sapiens
cctgataagcttcaaagct

SEQ ID NO: 1779596 - DNA, 17 bp, Homo sapiens
cctgataataattgatc

SEQ ID NO: 1779597 - DNA, 23 bp, Homo sapiens
cctgatcaggcttcctggtgaga

SEQ ID NO: 1779598 - DNA, 14 bp, Homo sapiens
cctgatcccacccc

SEQ ID NO: 1779599 - DNA, 21 bp, Homo sapiens
cctgatccctgaacccctggc

SEQ ID NO: 1779600 - DNA, 13 bp, Homo sapiens
cctgatcctggag

SEQ ID NO: 1779601 - DNA, 15 bp, Homo sapiens
cctgatcctggaggc

SEQ ID NO: 1779602 - DNA, 18 bp, Homo sapiens
cctgatctctcagcccca

SEQ ID NO: 1779603 - DNA, 16 bp, Homo sapiens
cctgatcttgcctgtc

SEQ ID NO: 1779604 - DNA, 17 bp, Homo sapiens
cctgatctttctagagc

SEQ ID NO: 1779605 - DNA, 14 bp, Homo sapiens
cctgatgacccagg

SEQ ID NO: 1779606 - DNA, 17 bp, Homo sapiens
cctgatgacccaggctg

SEQ ID NO: 1779607 - DNA, 16 bp, Homo sapiens
cctgatgcccctgaca

SEQ ID NO: 1779608 - DNA, 14 bp, Homo sapiens
cctgatgctccctc

SEQ ID NO: 1779609 - DNA, 20 bp, Homo sapiens
cctgatgctccctcccctgc

SEQ ID NO: 1779610 - DNA, 23 bp, Homo sapiens
cctgatgctccctcccctgccct

SEQ ID NO: 1779611 - DNA, 14 bp, Homo sapiens
cctgatgctgcccc

SEQ ID NO: 1779612 - DNA, 16 bp, Homo sapiens
cctgatggagtgtgca

SEQ ID NO: 1779613 - DNA, 12 bp, Homo sapiens
cctgatggccaa

SEQ ID NO: 1779614 - DNA, 16 bp, Homo sapiens
cctgatggccaagagc

SEQ ID NO: 1779615 - DNA, 19 bp, Homo sapiens
cctgatggccaagagcatc

SEQ ID NO: 1779616 - DNA, 21 bp, Homo sapiens
cctgatgtgtcctcagggagc

SEQ ID NO: 1779617 - DNA, 18 bp, Homo sapiens
cctgatgttttgccgtgg

SEQ ID NO: 1779618 - DNA, 15 bp, Homo sapiens
cctgattccaaatat

SEQ ID NO: 1779619 - DNA, 22 bp, Homo sapiens
cctgattcttgattcctggctc

SEQ ID NO: 1779620 - DNA, 20 bp, Homo sapiens
cctgattgatcacacagtgt

SEQ ID NO: 1779621 - DNA, 22 bp, Homo sapiens
cctgattgtattttttttttaa

SEQ ID NO: 1779622 - DNA, 18 bp, Homo sapiens
cctgattgtgccagtgca

SEQ ID NO: 1779623 - DNA, 19 bp, Homo sapiens
cctgatttaggagaagcca

SEQ ID NO: 1779624 - DNA, 20 bp, Homo sapiens
cctgatttaggagaagccag

SEQ ID NO: 1779625 - DNA, 17 bp, Homo sapiens
cctgatttctctgaaca

SEQ ID NO: 1779626 - DNA, 15 bp, Homo sapiens
cctgattttgtagtt

SEQ ID NO: 1779627 - DNA, 23 bp, Homo sapiens
cctgcaaaaatgagttgtcacag

SEQ ID NO: 1779628 - DNA, 14 bp, Homo sapiens
cctgcaaactcact

SEQ ID NO: 1779629 - DNA, 17 bp, Homo sapiens
cctgcaactcaaggact

SEQ ID NO: 1779630 - DNA, 18 bp, Homo sapiens
cctgcaactcaaggactt

SEQ ID NO: 1779631 - DNA, 20 bp, Homo sapiens
cctgcaactcaaggactttg

SEQ ID NO: 1779632 - DNA, 15 bp, Homo sapiens
cctgcaagagaatct

SEQ ID NO: 1779633 - DNA, 15 bp, Homo sapiens
cctgcaagatggaca

SEQ ID NO: 1779634 - DNA, 14 bp, Homo sapiens
cctgcaagccccag

SEQ ID NO: 1779635 - DNA, 16 bp, Homo sapiens
cctgcaagccccaggg

SEQ ID NO: 1779636 - DNA, 17 bp, Homo sapiens
cctgcaagccccagggc

SEQ ID NO: 1779637 - DNA, 19 bp, Homo sapiens
cctgcaatttcatatgctg

SEQ ID NO: 1779638 - DNA, 20 bp, Homo sapiens
cctgcacaataaaaatgttt

SEQ ID NO: 1779639 - DNA, 16 bp, Homo sapiens
cctgcacacacctgcc

SEQ ID NO: 1779640 - DNA, 11 bp, Homo sapiens
cctgcacacag

SEQ ID NO: 1779641 - DNA, 22 bp, Homo sapiens
cctgcacacagaatgctcaggg

SEQ ID NO: 1779642 - DNA, 19 bp, Homo sapiens
cctgcacacaggacagcgg

SEQ ID NO: 1779643 - DNA, 22 bp, Homo sapiens
cctgcacaggcacacagggccc

SEQ ID NO: 1779644 - DNA, 18 bp, Homo sapiens
cctgcacagtgacttctg

SEQ ID NO: 1779645 - DNA, 19 bp, Homo sapiens
cctgcaccatgctgctggg

SEQ ID NO: 1779646 - DNA, 12 bp, Homo sapiens
cctgcacccacc

SEQ ID NO: 1779647 - DNA, 14 bp, Homo sapiens
cctgcacccacccc

SEQ ID NO: 1779648 - DNA, 20 bp, Homo sapiens
cctgcacccacccctgccca

SEQ ID NO: 1779649 - DNA, 21 bp, Homo sapiens
cctgcacccacccctgcccag

SEQ ID NO: 1779650 - DNA, 12 bp, Homo sapiens
cctgcaccccag

SEQ ID NO: 1779651 - DNA, 13 bp, Homo sapiens
cctgcaccccagc

SEQ ID NO: 1779652 - DNA, 22 bp, Homo sapiens
cctgcaccccagcattccagct

SEQ ID NO: 1779653 - DNA, 13 bp, Homo sapiens
cctgcacccttcc

SEQ ID NO: 1779654 - DNA, 15 bp, Homo sapiens
cctgcacccttccct

SEQ ID NO: 1779655 - DNA, 16 bp, Homo sapiens
cctgcacccttccctc

SEQ ID NO: 1779656 - DNA, 18 bp, Homo sapiens
cctgcacctccccccact

SEQ ID NO: 1779657 - DNA, 20 bp, Homo sapiens
cctgcacctccccccactgc

SEQ ID NO: 1779658 - DNA, 23 bp, Homo sapiens
cctgcacctggcctgggccacac

SEQ ID NO: 1779659 - DNA, 15 bp, Homo sapiens
cctgcacctgtgcag

SEQ ID NO: 1779660 - DNA, 23 bp, Homo sapiens
cctgcacgtcatgggagggggct

SEQ ID NO: 1779661 - DNA, 17 bp, Homo sapiens
cctgcactaacagagtg

SEQ ID NO: 1779662 - DNA, 17 bp, Homo sapiens
cctgcactccctcctgg

SEQ ID NO: 1779663 - DNA, 15 bp, Homo sapiens
cctgcactccctggc

SEQ ID NO: 1779664 - DNA, 16 bp, Homo sapiens
cctgcactccctggcc

SEQ ID NO: 1779665 - DNA, 19 bp, Homo sapiens
cctgcactccctggccttg

SEQ ID NO: 1779666 - DNA, 23 bp, Homo sapiens
cctgcactcctcagggcagcctc

SEQ ID NO: 1779667 - DNA, 11 bp, Homo sapiens
cctgcactgta

SEQ ID NO: 1779668 - DNA, 15 bp, Homo sapiens
cctgcactgtaaaat

SEQ ID NO: 1779669 - DNA, 17 bp, Homo sapiens
cctgcacttcagacacc

SEQ ID NO: 1779670 - DNA, 17 bp, Homo sapiens
cctgcagaaggaaagaa

SEQ ID NO: 1779671 - DNA, 18 bp, Homo sapiens
cctgcagaaggaaagaag

SEQ ID NO: 1779672 - DNA, 12 bp, Homo sapiens
cctgcagactcc

SEQ ID NO: 1779673 - DNA, 14 bp, Homo sapiens
cctgcagagcagga

SEQ ID NO: 1779674 - DNA, 18 bp, Homo sapiens
cctgcagaggaaagacag

SEQ ID NO: 1779675 - DNA, 18 bp, Homo sapiens
cctgcagaggtctgtgct

SEQ ID NO: 1779676 - DNA, 19 bp, Homo sapiens
cctgcagaggtctgtgctg

SEQ ID NO: 1779677 - DNA, 13 bp, Homo sapiens
cctgctccagcag

SEQ ID NO: 1779678 - DNA, 14 bp, Homo sapiens
cctgctccagcagc

SEQ ID NO: 1779679 - DNA, 15 bp, Homo sapiens
cctgctccagcagca

SEQ ID NO: 1779680 - DNA, 15 bp, Homo sapiens
cctgctcccagcagc

SEQ ID NO: 1779681 - DNA, 12 bp, Homo sapiens
cctgctcccagg

SEQ ID NO: 1779682 - DNA, 16 bp, Homo sapiens
cctgctcccccacccc

SEQ ID NO: 1779683 - DNA, 11 bp, Homo sapiens
cctgctccctg

SEQ ID NO: 1779684 - DNA, 15 bp, Homo sapiens
cctgctccgtggact

SEQ ID NO: 1779685 - DNA, 13 bp, Homo sapiens
cctgctcctccct

SEQ ID NO: 1779686 - DNA, 16 bp, Homo sapiens
cctgctcctccctgcc

SEQ ID NO: 1779687 - DNA, 15 bp, Homo sapiens
cctgctcctccctgg

SEQ ID NO: 1779688 - DNA, 16 bp, Homo sapiens
cctgctcctccctggc

SEQ ID NO: 1779689 - DNA, 18 bp, Homo sapiens
cctgctcctccctggctg

SEQ ID NO: 1779690 - DNA, 17 bp, Homo sapiens
cctgctctagtgggaca

SEQ ID NO: 1779691 - DNA, 19 bp, Homo sapiens
cctgctctagtgggacagc

SEQ ID NO: 1779692 - DNA, 23 bp, Homo sapiens
cctgctctcttcaggaggccctg

SEQ ID NO: 1779693 - DNA, 12 bp, Homo sapiens
cctgctctggga

SEQ ID NO: 1779694 - DNA, 13 bp, Homo sapiens
cctgctctgggac

SEQ ID NO: 1779695 - DNA, 18 bp, Homo sapiens
cctgctcttttgtgatga

SEQ ID NO: 1779696 - DNA, 20 bp, Homo sapiens
cctgctgaacacagtgtctg

SEQ ID NO: 1779697 - DNA, 23 bp, Homo sapiens
cctgctgaatgcctcgctccctt

SEQ ID NO: 1779698 - DNA, 19 bp, Homo sapiens
cctgctgacctcactgtcc

SEQ ID NO: 1779699 - DNA, 17 bp, Homo sapiens
cctgctgagagacccaa

SEQ ID NO: 1779700 - DNA, 21 bp, Homo sapiens
cctgctgagggaccagccaag

SEQ ID NO: 1779701 - DNA, 21 bp, Homo sapiens
cctgctgcaaaggacagtggg

SEQ ID NO: 1779702 - DNA, 12 bp, Homo sapiens
cctgctgcaccc

SEQ ID NO: 1779703 - DNA, 14 bp, Homo sapiens
cctgctgcaccctg

SEQ ID NO: 1779704 - DNA, 20 bp, Homo sapiens
cctgctgccagtgcagccac

SEQ ID NO: 1779705 - DNA, 21 bp, Homo sapiens
cctgctgccagtgcagccact

SEQ ID NO: 1779706 - DNA, 22 bp, Homo sapiens
cctgctgccagtgcagccactg

SEQ ID NO: 1779707 - DNA, 22 bp, Homo sapiens
cctgctgccatgtggactggtg

SEQ ID NO: 1779708 - DNA, 13 bp, Homo sapiens
cctgctgcccagt

SEQ ID NO: 1779709 - DNA, 22 bp, Homo sapiens
cctgctgccccagctgactgtg

SEQ ID NO: 1779710 - DNA, 11 bp, Homo sapiens
cctgctgccct

SEQ ID NO: 1779711 - DNA, 20 bp, Homo sapiens
cctgctgccctcccacagcc

SEQ ID NO: 1779712 - DNA, 16 bp, Homo sapiens
cctgctgccttttctg

SEQ ID NO: 1779713 - DNA, 18 bp, Homo sapiens
cctgctgccttttctgga

SEQ ID NO: 1779714 - DNA, 19 bp, Homo sapiens
cctgctgccttttctggag

SEQ ID NO: 1779715 - DNA, 17 bp, Homo sapiens
cctgctgcggaggagct

SEQ ID NO: 1779716 - DNA, 15 bp, Homo sapiens
cctgctgcgtcccca

SEQ ID NO: 1779717 - DNA, 18 bp, Homo sapiens
cctgctgcgtccccactc

SEQ ID NO: 1779718 - DNA, 18 bp, Homo sapiens
cctggccacctgaggtgg

SEQ ID NO: 1779719 - DNA, 19 bp, Homo sapiens
cctggccacgcagccagga

SEQ ID NO: 1779720 - DNA, 21 bp, Homo sapiens
cctggccactaaagcttcaga

SEQ ID NO: 1779721 - DNA, 16 bp, Homo sapiens
cctggccagacacagg

SEQ ID NO: 1779722 - DNA, 18 bp, Homo sapiens
cctggccagacacaggcc

SEQ ID NO: 1779723 - DNA, 16 bp, Homo sapiens
cctggccagctctgag

SEQ ID NO: 1779724 - DNA, 17 bp, Homo sapiens
cctggccagctctgagg

SEQ ID NO: 1779725 - DNA, 11 bp, Homo sapiens
cctggccagga

SEQ ID NO: 1779726 - DNA, 15 bp, Homo sapiens
cctggccaggaccct

SEQ ID NO: 1779727 - DNA, 16 bp, Homo sapiens
cctggccaggagcagg

SEQ ID NO: 1779728 - DNA, 14 bp, Homo sapiens
cctggccaggagct

SEQ ID NO: 1779729 - DNA, 16 bp, Homo sapiens
cctggccaggagctct

SEQ ID NO: 1779730 - DNA, 21 bp, Homo sapiens
cctggccaggagctcttcagg

SEQ ID NO: 1779731 - DNA, 14 bp, Homo sapiens
cctggccaggccct

SEQ ID NO: 1779732 - DNA, 17 bp, Homo sapiens
cctggccagtcctggtc

SEQ ID NO: 1779733 - DNA, 21 bp, Homo sapiens
cctggcccagcggcccctccc

SEQ ID NO: 1779734 - DNA, 13 bp, Homo sapiens
cctggcccataga

SEQ ID NO: 1779735 - DNA, 18 bp, Homo sapiens
cctggcccatagaaacat

SEQ ID NO: 1779736 - DNA, 23 bp, Homo sapiens
cctggcccatagaaacatgacac

SEQ ID NO: 1779737 - DNA, 17 bp, Homo sapiens
cctggcccatcaactgt

SEQ ID NO: 1779738 - DNA, 14 bp, Homo sapiens
cctggccccatgtc

SEQ ID NO: 1779739 - DNA, 15 bp, Homo sapiens
cctggccccatgtct

SEQ ID NO: 1779740 - DNA, 18 bp, Homo sapiens
cctggccccatgtctctc

SEQ ID NO: 1779741 - DNA, 23 bp, Homo sapiens
cctggcccccaacctcagggctc

SEQ ID NO: 1779742 - DNA, 22 bp, Homo sapiens
cctggccccgggctctggccac

SEQ ID NO: 1779743 - DNA, 21 bp, Homo sapiens
cctggcccctccagaccctgc

SEQ ID NO: 1779744 - DNA, 16 bp, Homo sapiens
cctggccctgaggtgt

SEQ ID NO: 1779745 - DNA, 16 bp, Homo sapiens
cctggccctgcccagc

SEQ ID NO: 1779746 - DNA, 13 bp, Homo sapiens
cctggccctgctt

SEQ ID NO: 1779747 - DNA, 21 bp, Homo sapiens
cctggccctgcttcctgcttg

SEQ ID NO: 1779748 - DNA, 23 bp, Homo sapiens
cctggccctgttctcctccccaa

SEQ ID NO: 1779749 - DNA, 15 bp, Homo sapiens
cctggccgccccctg

SEQ ID NO: 1779750 - DNA, 15 bp, Homo sapiens
cctggccgcctccag

SEQ ID NO: 1779751 - DNA, 17 bp, Homo sapiens
cctggccgcctccagga

SEQ ID NO: 1779752 - DNA, 20 bp, Homo sapiens
cctggccgcctccaggagcc

SEQ ID NO: 1779753 - DNA, 16 bp, Homo sapiens
cctggccggctccagt

SEQ ID NO: 1779754 - DNA, 16 bp, Homo sapiens
cctggcctagaccagc

SEQ ID NO: 1779755 - DNA, 21 bp, Homo sapiens
cctggcctatccgctgccagc

SEQ ID NO: 1779756 - DNA, 16 bp, Homo sapiens
cctggcctcactggct

SEQ ID NO: 1779757 - DNA, 17 bp, Homo sapiens
cctggcctcactggctg

SEQ ID NO: 1779758 - DNA, 15 bp, Homo sapiens
cctggcctccagctc

SEQ ID NO: 1779759 - DNA, 12 bp, Homo sapiens
cctggcctctgg

SEQ ID NO: 1779760 - DNA, 13 bp, Homo sapiens
cctggcctctgtg

SEQ ID NO: 1779761 - DNA, 21 bp, Homo sapiens
cctggcctgaactgaggagat

SEQ ID NO: 1779762 - DNA, 16 bp, Homo sapiens
cctggcctgagagtca

SEQ ID NO: 1779763 - DNA, 13 bp, Homo sapiens
cctggcctgagct

SEQ ID NO: 1779764 - DNA, 15 bp, Homo sapiens
cctggcctgagctgg

SEQ ID NO: 1779765 - DNA, 16 bp, Homo sapiens
cctggcctgagctggg

SEQ ID NO: 1779766 - DNA, 12 bp, Homo sapiens
cctggcctgctg

SEQ ID NO: 1779767 - DNA, 12 bp, Homo sapiens
cctggcctggca

SEQ ID NO: 1779768 - DNA, 15 bp, Homo sapiens
cctggcctggcacac

SEQ ID NO: 1779769 - DNA, 15 bp, Homo sapiens
cctggcctgggccac

SEQ ID NO: 1779770 - DNA, 17 bp, Homo sapiens
cctggcctgggccacac

SEQ ID NO: 1779771 - DNA, 14 bp, Homo sapiens
cctggcctgtgcct

SEQ ID NO: 1779772 - DNA, 17 bp, Homo sapiens
cctggccttaaaagggg

SEQ ID NO: 1779773 - DNA, 18 bp, Homo sapiens
cctggccttaaagaggga

SEQ ID NO: 1779774 - DNA, 14 bp, Homo sapiens
cctggccttctgaa

SEQ ID NO: 1779775 - DNA, 16 bp, Homo sapiens
cctggccttctgaact

SEQ ID NO: 1779776 - DNA, 23 bp, Homo sapiens
cctggcgagttctctttggaaat

SEQ ID NO: 1779777 - DNA, 22 bp, Homo sapiens
cctggcgcaggtgggctggact

SEQ ID NO: 1779778 - DNA, 23 bp, Homo sapiens
cctggcgcaggtgggctggactt

SEQ ID NO: 1779779 - DNA, 15 bp, Homo sapiens
cctggctcaggccca

SEQ ID NO: 1779780 - DNA, 21 bp, Homo sapiens
cctggctccccacgagtcacc

SEQ ID NO: 1779781 - DNA, 12 bp, Homo sapiens
cctggctccctc

SEQ ID NO: 1779782 - DNA, 20 bp, Homo sapiens
cctggctccctcctccaggc

SEQ ID NO: 1779783 - DNA, 13 bp, Homo sapiens
cctggctctgccc

SEQ ID NO: 1779784 - DNA, 19 bp, Homo sapiens
cctggctctgccccctccc

SEQ ID NO: 1779785 - DNA, 19 bp, Homo sapiens
cctgtgtccatgcgctcag

SEQ ID NO: 1779786 - DNA, 13 bp, Homo sapiens
cctgtgtcccatg

SEQ ID NO: 1779787 - DNA, 22 bp, Homo sapiens
cctgtgtcccatgacccacccc

SEQ ID NO: 1779788 - DNA, 23 bp, Homo sapiens
cctgtgtcccatgacccacccct

SEQ ID NO: 1779789 - DNA, 22 bp, Homo sapiens
cctgtgtccccgatgctgacct

SEQ ID NO: 1779790 - DNA, 16 bp, Homo sapiens
cctgtgtcctccacca

SEQ ID NO: 1779791 - DNA, 13 bp, Homo sapiens
cctgtgtcctgaa

SEQ ID NO: 1779792 - DNA, 13 bp, Homo sapiens
cctgtgtgcccag

SEQ ID NO: 1779793 - DNA, 20 bp, Homo sapiens
cctgtgtgcccagcacctgg

SEQ ID NO: 1779794 - DNA, 12 bp, Homo sapiens
cctgtgtggaga

SEQ ID NO: 1779795 - DNA, 13 bp, Homo sapiens
cctgtgtggagag

SEQ ID NO: 1779796 - DNA, 16 bp, Homo sapiens
cctgtgtggagaggga

SEQ ID NO: 1779797 - DNA, 23 bp, Homo sapiens
cctgtgtggagagggaatgtgaa

SEQ ID NO: 1779798 - DNA, 15 bp, Homo sapiens
cctgtgtgtggaagg

SEQ ID NO: 1779799 - DNA, 16 bp, Homo sapiens
cctgtgttgtctctag

SEQ ID NO: 1779800 - DNA, 21 bp, Homo sapiens
cctgttaacgtcatctcaggg

SEQ ID NO: 1779801 - DNA, 13 bp, Homo sapiens
cctgttacactgg

SEQ ID NO: 1779802 - DNA, 14 bp, Homo sapiens
cctgttacactggg

SEQ ID NO: 1779803 - DNA, 15 bp, Homo sapiens
cctgttacactgggc

SEQ ID NO: 1779804 - DNA, 18 bp, Homo sapiens
cctgttacctactttgac

SEQ ID NO: 1779805 - DNA, 15 bp, Homo sapiens
cctgttacttgcttc

SEQ ID NO: 1779806 - DNA, 23 bp, Homo sapiens
cctgttagacgtcctccgtccat

SEQ ID NO: 1779807 - DNA, 19 bp, Homo sapiens
cctgttatttttctgccct

SEQ ID NO: 1779808 - DNA, 19 bp, Homo sapiens
cctgttcagtgtcccgggc

SEQ ID NO: 1779809 - DNA, 16 bp, Homo sapiens
cctgttccccagagaa

SEQ ID NO: 1779810 - DNA, 14 bp, Homo sapiens
cctgttccctagag

SEQ ID NO: 1779811 - DNA, 20 bp, Homo sapiens
cctgttccctagagagaata

SEQ ID NO: 1779812 - DNA, 12 bp, Homo sapiens
cctgttccctgg

SEQ ID NO: 1779813 - DNA, 14 bp, Homo sapiens
cctgttccctggag

SEQ ID NO: 1779814 - DNA, 21 bp, Homo sapiens
cctgttccttgctagccctgg

SEQ ID NO: 1779815 - DNA, 16 bp, Homo sapiens
cctgttctcctgtccc

SEQ ID NO: 1779816 - DNA, 19 bp, Homo sapiens
cctgttctcctgtccctcc

SEQ ID NO: 1779817 - DNA, 21 bp, Homo sapiens
cctgttctcctgtccctccat

SEQ ID NO: 1779818 - DNA, 14 bp, Homo sapiens
cctgttctgcgctg

SEQ ID NO: 1779819 - DNA, 16 bp, Homo sapiens
cctgttctgcgctgtg

SEQ ID NO: 1779820 - DNA, 21 bp, Homo sapiens
cctgttctgcttcgaagtatt

SEQ ID NO: 1779821 - DNA, 22 bp, Homo sapiens
cctgttgaattttgttctctgg

SEQ ID NO: 1779822 - DNA, 13 bp, Homo sapiens
cctgttgatggga

SEQ ID NO: 1779823 - DNA, 18 bp, Homo sapiens
cctgttgattatcttcag

SEQ ID NO: 1779824 - DNA, 17 bp, Homo sapiens
cctgttggatttgttta

SEQ ID NO: 1779825 - DNA, 19 bp, Homo sapiens
cctgtttaaataaaattta

SEQ ID NO: 1779826 - DNA, 18 bp, Homo sapiens
cctgtttcagaccccccc

SEQ ID NO: 1779827 - DNA, 17 bp, Homo sapiens
cctgtttcccaggccca

SEQ ID NO: 1779828 - DNA, 13 bp, Homo sapiens
cctgtttctctgc

SEQ ID NO: 1779829 - DNA, 13 bp, Homo sapiens
cctgtttgatgta

SEQ ID NO: 1779830 - DNA, 21 bp, Homo sapiens
cctgtttgatgtatgtgtgaa

SEQ ID NO: 1779831 - DNA, 23 bp, Homo sapiens
cctgtttgatgtatgtgtgaaac

SEQ ID NO: 1779832 - DNA, 16 bp, Homo sapiens
cctgtttggcctctct

SEQ ID NO: 1779833 - DNA, 20 bp, Homo sapiens
cctgtttggcctctctatcc

SEQ ID NO: 1779834 - DNA, 23 bp, Homo sapiens
cctgtttgggaagagcttagaaa

SEQ ID NO: 1779835 - DNA, 22 bp, Homo sapiens
cctgtttgggaatgaggcactt

SEQ ID NO: 1779836 - DNA, 13 bp, Homo sapiens
cctgttttctgaa

SEQ ID NO: 1779837 - DNA, 14 bp, Homo sapiens
ccttattttgagta

SEQ ID NO: 1779838 - DNA, 15 bp, Homo sapiens
ccttattttgtatta

SEQ ID NO: 1779839 - DNA, 15 bp, Homo sapiens
ccttattttttccca

SEQ ID NO: 1779840 - DNA, 15 bp, Homo sapiens
ccttcaacccagtgg

SEQ ID NO: 1779841 - DNA, 13 bp, Homo sapiens
ccttcaagtgcca

SEQ ID NO: 1779842 - DNA, 19 bp, Homo sapiens
ccttcaagttagctcagga

SEQ ID NO: 1779843 - DNA, 17 bp, Homo sapiens
ccttcaccgtggctacc

SEQ ID NO: 1779844 - DNA, 19 bp, Homo sapiens
ccttcacctcggagggatg

SEQ ID NO: 1779845 - DNA, 17 bp, Homo sapiens
ccttcacctttggtgca

SEQ ID NO: 1779846 - DNA, 20 bp, Homo sapiens
ccttcactccggtgtgcctg

SEQ ID NO: 1779847 - DNA, 15 bp, Homo sapiens
ccttcactgccatga

SEQ ID NO: 1779848 - DNA, 15 bp, Homo sapiens
ccttcactggcgcct

SEQ ID NO: 1779849 - DNA, 19 bp, Homo sapiens
ccttcactggcgccttctc

SEQ ID NO: 1779850 - DNA, 20 bp, Homo sapiens
ccttcactggcgccttctcg

SEQ ID NO: 1779851 - DNA, 22 bp, Homo sapiens
ccttcactggcgccttctcgga

SEQ ID NO: 1779852 - DNA, 19 bp, Homo sapiens
ccttcactgtcaccaccct

SEQ ID NO: 1779853 - DNA, 14 bp, Homo sapiens
ccttcactgttccc

SEQ ID NO: 1779854 - DNA, 18 bp, Homo sapiens
ccttcacttttctgagtt

SEQ ID NO: 1779855 - DNA, 18 bp, Homo sapiens
ccttcagaaccatccata

SEQ ID NO: 1779856 - DNA, 18 bp, Homo sapiens
ccttcagactttgcttcc

SEQ ID NO: 1779857 - DNA, 19 bp, Homo sapiens
ccttcagagccagccggct

SEQ ID NO: 1779858 - DNA, 11 bp, Homo sapiens
ccttcagaggc

SEQ ID NO: 1779859 - DNA, 11 bp, Homo sapiens
ccttcagcacg

SEQ ID NO: 1779860 - DNA, 16 bp, Homo sapiens
ccttcagcagcagctc

SEQ ID NO: 1779861 - DNA, 18 bp, Homo sapiens
ccttcagcagcagctcac

SEQ ID NO: 1779862 - DNA, 13 bp, Homo sapiens
ccttcagcccacc

SEQ ID NO: 1779863 - DNA, 13 bp, Homo sapiens
ccttcagccctca

SEQ ID NO: 1779864 - DNA, 14 bp, Homo sapiens
ccttcagccctcac

SEQ ID NO: 1779865 - DNA, 18 bp, Homo sapiens
ccttcagccctcacccct

SEQ ID NO: 1779866 - DNA, 18 bp, Homo sapiens
ccttcagggccagaagga

SEQ ID NO: 1779867 - DNA, 15 bp, Homo sapiens
ccttcagtctgctcc

SEQ ID NO: 1779868 - DNA, 17 bp, Homo sapiens
ccttcagtctgctccac

SEQ ID NO: 1779869 - DNA, 18 bp, Homo sapiens
ccttcagtctgctccacc

SEQ ID NO: 1779870 - DNA, 11 bp, Homo sapiens
ccttcagtgcc

SEQ ID NO: 1779871 - DNA, 15 bp, Homo sapiens
ccttcagtgcccacc

SEQ ID NO: 1779872 - DNA, 16 bp, Homo sapiens
ccttcagtgcccacca

SEQ ID NO: 1779873 - DNA, 19 bp, Homo sapiens
ccttcagtgctacattttg

SEQ ID NO: 1779874 - DNA, 18 bp, Homo sapiens
ccttcagttatgattttt

SEQ ID NO: 1779875 - DNA, 13 bp, Homo sapiens
ccttcagtttatt

SEQ ID NO: 1779876 - DNA, 19 bp, Homo sapiens
ccttcataccgcctcgtgc

SEQ ID NO: 1779877 - DNA, 20 bp, Homo sapiens
ccttcataccgcctcgtgcc

SEQ ID NO: 1779878 - DNA, 17 bp, Homo sapiens
ccttcatccgcctgtgg

SEQ ID NO: 1779879 - DNA, 14 bp, Homo sapiens
ccttcatctccagg

SEQ ID NO: 1779880 - DNA, 15 bp, Homo sapiens
ccttcatcttcctgt

SEQ ID NO: 1779881 - DNA, 17 bp, Homo sapiens
ccttcatcttcctgtgt

SEQ ID NO: 1779882 - DNA, 18 bp, Homo sapiens
ccttcatcttcctgtgtc

SEQ ID NO: 1779883 - DNA, 20 bp, Homo sapiens
ccttcatcttcctgtgtcct

SEQ ID NO: 1779884 - DNA, 17 bp, Homo sapiens
ccttcatgacagcctcc

SEQ ID NO: 1779885 - DNA, 18 bp, Homo sapiens
ccttcatgacagcctcca

SEQ ID NO: 1779886 - DNA, 20 bp, Homo sapiens
ccttcattgccttaactgga

SEQ ID NO: 1779887 - DNA, 21 bp, Homo sapiens
ccttccaaaacctgcttcctt

SEQ ID NO: 1779888 - DNA, 22 bp, Homo sapiens
ccttccaaaacctgcttccttc

SEQ ID NO: 1779889 - DNA, 13 bp, Homo sapiens
ccttccaacattt

SEQ ID NO: 1779890 - DNA, 17 bp, Homo sapiens
ccttccacctcctagag

SEQ ID NO: 1779891 - DNA, 22 bp, Homo sapiens
ccttccagacatacgaaacaca

SEQ ID NO: 1779892 - DNA, 16 bp, Homo sapiens
ccttccagcaccctgc

SEQ ID NO: 1779893 - DNA, 17 bp, Homo sapiens
ccttccagcaccctgca

SEQ ID NO: 1779894 - DNA, 13 bp, Homo sapiens
ccttccagctcct

SEQ ID NO: 1779895 - DNA, 12 bp, Homo sapiens
ccttccagctgc

SEQ ID NO: 1779896 - DNA, 15 bp, Homo sapiens
ccttccagctgctgt

SEQ ID NO: 1779897 - DNA, 13 bp, Homo sapiens
ccttccaggcccc

SEQ ID NO: 1779898 - DNA, 11 bp, Homo sapiens
ccttccataat

SEQ ID NO: 1779899 - DNA, 23 bp, Homo sapiens
ccttccatccatctttccatcca

SEQ ID NO: 1779900 - DNA, 12 bp, Homo sapiens
ccttccatgccc

SEQ ID NO: 1779901 - DNA, 22 bp, Homo sapiens
ccttccatgtgcctttctttgc

SEQ ID NO: 1779902 - DNA, 16 bp, Homo sapiens
ccttccattcacacca

SEQ ID NO: 1779903 - DNA, 19 bp, Homo sapiens
ccttccattttcccccact

SEQ ID NO: 1779904 - DNA, 17 bp, Homo sapiens
ccttcccaatcagcact

SEQ ID NO: 1779905 - DNA, 20 bp, Homo sapiens
ccttcccacctactgcactt

SEQ ID NO: 1779906 - DNA, 23 bp, Homo sapiens
ccttcccacctactgcactttcc

SEQ ID NO: 1779907 - DNA, 13 bp, Homo sapiens
ccttcccagacca

SEQ ID NO: 1779908 - DNA, 12 bp, Homo sapiens
ccttcccagctc

SEQ ID NO: 1779909 - DNA, 17 bp, Homo sapiens
ccttcccagctctccct

SEQ ID NO: 1779910 - DNA, 18 bp, Homo sapiens
ccttcccagctctccctc

SEQ ID NO: 1779911 - DNA, 14 bp, Homo sapiens
ccttcccaggccct

SEQ ID NO: 1779912 - DNA, 15 bp, Homo sapiens
ccttcccaggccctt

SEQ ID NO: 1779913 - DNA, 14 bp, Homo sapiens
ccttcccatcgctg

SEQ ID NO: 1779914 - DNA, 18 bp, Homo sapiens
ccttcccatttctctaca

SEQ ID NO: 1779915 - DNA, 14 bp, Homo sapiens
ccttcccatttctt

SEQ ID NO: 1779916 - DNA, 21 bp, Homo sapiens
ccttccccaacttccctagtc

SEQ ID NO: 1779917 - DNA, 13 bp, Homo sapiens
ccttccccagact

SEQ ID NO: 1779918 - DNA, 21 bp, Homo sapiens
ccttccccagacttgcactgg

SEQ ID NO: 1779919 - DNA, 15 bp, Homo sapiens
ccttccccagcctct

SEQ ID NO: 1779920 - DNA, 17 bp, Homo sapiens
ccttccccaggcccacc

SEQ ID NO: 1779921 - DNA, 13 bp, Homo sapiens
ccttcccccagcc

SEQ ID NO: 1779922 - DNA, 18 bp, Homo sapiens
ccttcccccagcccaata

SEQ ID NO: 1779923 - DNA, 21 bp, Homo sapiens
ccttcccccagcccaataaag

SEQ ID NO: 1779924 - DNA, 16 bp, Homo sapiens
ccttccccctcccagg

SEQ ID NO: 1779925 - DNA, 19 bp, Homo sapiens
ccttccccctgtagactag

SEQ ID NO: 1779926 - DNA, 20 bp, Homo sapiens
ccttccccctgtagactagt

SEQ ID NO: 1779927 - DNA, 15 bp, Homo sapiens
ccttcccctacacct

SEQ ID NO: 1779928 - DNA, 19 bp, Homo sapiens
ccttcccctccctggctcc

SEQ ID NO: 1779929 - DNA, 22 bp, Homo sapiens
ccttcccctccctggctcccat

SEQ ID NO: 1779930 - DNA, 14 bp, Homo sapiens
ccttcccctgcacc

SEQ ID NO: 1779931 - DNA, 17 bp, Homo sapiens
ccttcccctgcacctgg

SEQ ID NO: 1779932 - DNA, 20 bp, Homo sapiens
ccttcccctttactcagccc

SEQ ID NO: 1779933 - DNA, 23 bp, Homo sapiens
ccttcccctttactcagcccagc

SEQ ID NO: 1779934 - DNA, 24 bp, Homo sapiens
ccttcccctttactcagcccagct

SEQ ID NO: 1779935 - DNA, 19 bp, Homo sapiens
ccttccccttttgcctggc

SEQ ID NO: 1779936 - DNA, 20 bp, Homo sapiens
ccttcccgccgcccgacccc

SEQ ID NO: 1779937 - DNA, 13 bp, Homo sapiens
ccttcccgcctcg

SEQ ID NO: 1779938 - DNA, 24 bp, Homo sapiens
ccttccctcaccttggcaccagac

SEQ ID NO: 1779939 - DNA, 18 bp, Homo sapiens
ccttccctccatagccac

SEQ ID NO: 1779940 - DNA, 11 bp, Homo sapiens
ccttccctcct

SEQ ID NO: 1779941 - DNA, 15 bp, Homo sapiens
ccttccctcctttgt

SEQ ID NO: 1779942 - DNA, 14 bp, Homo sapiens
ccttccctctcctg

SEQ ID NO: 1779943 - DNA, 15 bp, Homo sapiens
ccttccctcttccct

SEQ ID NO: 1779944 - DNA, 17 bp, Homo sapiens
ccttccctcttccctct

SEQ ID NO: 1779945 - DNA, 19 bp, Homo sapiens
ccttccctggctacttccc

SEQ ID NO: 1779946 - DNA, 24 bp, Homo sapiens
ccttccctggctacttcccttcct

SEQ ID NO: 1779947 - DNA, 19 bp, Homo sapiens
ccttccctgggctgtgcta

SEQ ID NO: 1779948 - DNA, 12 bp, Homo sapiens
ccttccctgtcc

SEQ ID NO: 1779949 - DNA, 15 bp, Homo sapiens
ccttccctgtccctc

SEQ ID NO: 1779950 - DNA, 17 bp, Homo sapiens
ccttccctgtccctcta

SEQ ID NO: 1779951 - DNA, 15 bp, Homo sapiens
ccttcccttctcttg

SEQ ID NO: 1779952 - DNA, 18 bp, Homo sapiens
ccttccgatgacagtgct

SEQ ID NO: 1779953 - DNA, 16 bp, Homo sapiens
ccttcctcatccaccc

SEQ ID NO: 1779954 - DNA, 20 bp, Homo sapiens
ccttctccccagccagaggt

SEQ ID NO: 1779955 - DNA, 23 bp, Homo sapiens
ccttctcccctgcactgtaaaat

SEQ ID NO: 1779956 - DNA, 24 bp, Homo sapiens
ccttctcccctgcactgtaaaatg

SEQ ID NO: 1779957 - DNA, 14 bp, Homo sapiens
ccttctcccctgcc

SEQ ID NO: 1779958 - DNA, 17 bp, Homo sapiens
ccttctccctagctcct

SEQ ID NO: 1779959 - DNA, 11 bp, Homo sapiens
ccttctccctt

SEQ ID NO: 1779960 - DNA, 18 bp, Homo sapiens
ccttctcccttgccctcc

SEQ ID NO: 1779961 - DNA, 22 bp, Homo sapiens
ccttctccttcccatttctcta

SEQ ID NO: 1779962 - DNA, 16 bp, Homo sapiens
ccttctcctttccttc

SEQ ID NO: 1779963 - DNA, 18 bp, Homo sapiens
ccttctcggagctggccc

SEQ ID NO: 1779964 - DNA, 20 bp, Homo sapiens
ccttctctcagctcccaggc

SEQ ID NO: 1779965 - DNA, 14 bp, Homo sapiens
ccttctctcatctc

SEQ ID NO: 1779966 - DNA, 13 bp, Homo sapiens
ccttctctgctcc

SEQ ID NO: 1779967 - DNA, 20 bp, Homo sapiens
ccttctctgctccaccacat

SEQ ID NO: 1779968 - DNA, 20 bp, Homo sapiens
ccttctgaaaaagtatcctg

SEQ ID NO: 1779969 - DNA, 13 bp, Homo sapiens
ccttctgaactcc

SEQ ID NO: 1779970 - DNA, 23 bp, Homo sapiens
ccttctgcacataaactctttta

SEQ ID NO: 1779971 - DNA, 16 bp, Homo sapiens
ccttctggatccatgg

SEQ ID NO: 1779972 - DNA, 18 bp, Homo sapiens
ccttctggatccatgggg

SEQ ID NO: 1779973 - DNA, 20 bp, Homo sapiens
ccttctggccggtgctgggt

SEQ ID NO: 1779974 - DNA, 20 bp, Homo sapiens
ccttctgggcagaccttgac

SEQ ID NO: 1779975 - DNA, 15 bp, Homo sapiens
ccttcttcacccagc

SEQ ID NO: 1779976 - DNA, 19 bp, Homo sapiens
ccttcttcacccagctaat

SEQ ID NO: 1779977 - DNA, 18 bp, Homo sapiens
ccttgaaactttgggaaa

SEQ ID NO: 1779978 - DNA, 13 bp, Homo sapiens
ccttgaaaggaag

SEQ ID NO: 1779979 - DNA, 20 bp, Homo sapiens
ccttgaacactgggggaggg

SEQ ID NO: 1779980 - DNA, 12 bp, Homo sapiens
ccttgaagacag

SEQ ID NO: 1779981 - DNA, 16 bp, Homo sapiens
ccttgaagactccctg

SEQ ID NO: 1779982 - DNA, 14 bp, Homo sapiens
ccttgaagccactg

SEQ ID NO: 1779983 - DNA, 19 bp, Homo sapiens
ccttgaagccactgaagct

SEQ ID NO: 1779984 - DNA, 23 bp, Homo sapiens
ccttgaatcttctcccttgtcct

SEQ ID NO: 1779985 - DNA, 16 bp, Homo sapiens
ccttgaatgctgccag

SEQ ID NO: 1779986 - DNA, 17 bp, Homo sapiens
ccttgacagagcagcta

SEQ ID NO: 1779987 - DNA, 12 bp, Homo sapiens
ccttgaccagca

SEQ ID NO: 1779988 - DNA, 20 bp, Homo sapiens
ccttgaccagcagatcccag

SEQ ID NO: 1779989 - DNA, 14 bp, Homo sapiens
ccttgagaaacctt

SEQ ID NO: 1779990 - DNA, 17 bp, Homo sapiens
ccttgagacctcagcca

SEQ ID NO: 1779991 - DNA, 13 bp, Homo sapiens
ccttgagccctgg

SEQ ID NO: 1779992 - DNA, 17 bp, Homo sapiens
ccttgagccctggctgt

SEQ ID NO: 1779993 - DNA, 23 bp, Homo sapiens
ccttgaggatggagagcagccag

SEQ ID NO: 1779994 - DNA, 21 bp, Homo sapiens
ccttgagggtttgagagcccg

SEQ ID NO: 1779995 - DNA, 15 bp, Homo sapiens
ccttgagtaaaaagg

SEQ ID NO: 1779996 - DNA, 22 bp, Homo sapiens
ccttgagtggggttatctctgt

SEQ ID NO: 1779997 - DNA, 15 bp, Homo sapiens
ccttgatatttgtat

SEQ ID NO: 1779998 - DNA, 14 bp, Homo sapiens
ccttgatgccagag

SEQ ID NO: 1779999 - DNA, 16 bp, Homo sapiens
ccttgatgccagaggg

SEQ ID NO: 1780000 - DNA, 19 bp, Homo sapiens
ccttgatggagatatttac

SEQ ID NO: 1780001 - DNA, 13 bp, Homo sapiens
ccttgattggaag

SEQ ID NO: 1780002 - DNA, 19 bp, Homo sapiens
ccttgatttaaacacacag

SEQ ID NO: 1780003 - DNA, 22 bp, Homo sapiens
ccttgcacactcccctgcactg

SEQ ID NO: 1780004 - DNA, 16 bp, Homo sapiens
ccttgcacctgcatcc

SEQ ID NO: 1780005 - DNA, 13 bp, Homo sapiens
ccttgcactttca

SEQ ID NO: 1780006 - DNA, 12 bp, Homo sapiens
ccttgcagctgg

SEQ ID NO: 1780007 - DNA, 19 bp, Homo sapiens
ccttgcaggggtcccccct

SEQ ID NO: 1780008 - DNA, 19 bp, Homo sapiens
ccttgcagtgtaggaattc

SEQ ID NO: 1780009 - DNA, 20 bp, Homo sapiens
ccttgcagttcagcaccacc

SEQ ID NO: 1780010 - DNA, 12 bp, Homo sapiens
ccttgccagaga

SEQ ID NO: 1780011 - DNA, 18 bp, Homo sapiens
ccttgccatccattctgg

SEQ ID NO: 1780012 - DNA, 19 bp, Homo sapiens
ccttgcccagagatgcctc

SEQ ID NO: 1780013 - DNA, 23 bp, Homo sapiens
ccttgcccagagatgcctccacc

SEQ ID NO: 1780014 - DNA, 22 bp, Homo sapiens
ccttgcccagggctcagcctgg

SEQ ID NO: 1780015 - DNA, 19 bp, Homo sapiens
ccttgcccggattctggga

SEQ ID NO: 1780016 - DNA, 22 bp, Homo sapiens
ccttgccctccctttctctctc

SEQ ID NO: 1780017 - DNA, 17 bp, Homo sapiens
ccttgccctccgcctgg

SEQ ID NO: 1780018 - DNA, 15 bp, Homo sapiens
ccttgcccttggagc

SEQ ID NO: 1780019 - DNA, 19 bp, Homo sapiens
ccttgcccttggagctgcc

SEQ ID NO: 1780020 - DNA, 16 bp, Homo sapiens
ccttgcctcaatgcca

SEQ ID NO: 1780021 - DNA, 19 bp, Homo sapiens
ccttgcctcaatgccagta

SEQ ID NO: 1780022 - DNA, 12 bp, Homo sapiens
ccttgcctcccc

SEQ ID NO: 1780023 - DNA, 12 bp, Homo sapiens
ccttgccttaat

SEQ ID NO: 1780024 - DNA, 22 bp, Homo sapiens
ccttgccttatgggctgaagtg

SEQ ID NO: 1780025 - DNA, 16 bp, Homo sapiens
ccttgctaaattgatt

SEQ ID NO: 1780026 - DNA, 17 bp, Homo sapiens
ccttgctacctcaaggg

SEQ ID NO: 1780027 - DNA, 17 bp, Homo sapiens
ccttgctcttctttctg

SEQ ID NO: 1780028 - DNA, 15 bp, Homo sapiens
ccttgctgacaataa

SEQ ID NO: 1780029 - DNA, 18 bp, Homo sapiens
ccttgctgacaataaaga

SEQ ID NO: 1780030 - DNA, 16 bp, Homo sapiens
ccttggagaggagagt

SEQ ID NO: 1780031 - DNA, 17 bp, Homo sapiens
ccttggaggagagagac

SEQ ID NO: 1780032 - DNA, 19 bp, Homo sapiens
ccttggaggagagagaccc

SEQ ID NO: 1780033 - DNA, 20 bp, Homo sapiens
ccttggaggagagagacccc

SEQ ID NO: 1780034 - DNA, 12 bp, Homo sapiens
ccttggaggcca

SEQ ID NO: 1780035 - DNA, 16 bp, Homo sapiens
ccttggaggccttccc

SEQ ID NO: 1780036 - DNA, 16 bp, Homo sapiens
ccttggagtcccaggg

SEQ ID NO: 1780037 - DNA, 18 bp, Homo sapiens
ccttggataatgctgttg

SEQ ID NO: 1780038 - DNA, 22 bp, Homo sapiens
ccttggatcgctaagctggctc

SEQ ID NO: 1780039 - DNA, 20 bp, Homo sapiens
ccttggcaccagacacccag

SEQ ID NO: 1780040 - DNA, 19 bp, Homo sapiens
ccttggcatcacagggcag

SEQ ID NO: 1780041 - DNA, 17 bp, Homo sapiens
ccttggccatgcagaaa

SEQ ID NO: 1780042 - DNA, 20 bp, Homo sapiens
ccttggcccacactgaggct

SEQ ID NO: 1780043 - DNA, 14 bp, Homo sapiens
ccttggcccagaga

SEQ ID NO: 1780044 - DNA, 23 bp, Homo sapiens
ccttggccgcacctaaagcagcc

SEQ ID NO: 1780045 - DNA, 11 bp, Homo sapiens
ccttggcctca

SEQ ID NO: 1780046 - DNA, 15 bp, Homo sapiens
ccttggcctcccaga

SEQ ID NO: 1780047 - DNA, 15 bp, Homo sapiens
ccttggcctgtctca

SEQ ID NO: 1780048 - DNA, 23 bp, Homo sapiens
ccttggcctgtctcatccccagg

SEQ ID NO: 1780049 - DNA, 17 bp, Homo sapiens
ccttggccttgcagctg

SEQ ID NO: 1780050 - DNA, 21 bp, Homo sapiens
ccttggccttgcagctggccc

SEQ ID NO: 1780051 - DNA, 20 bp, Homo sapiens
ccttggctgtctgtgggccg

SEQ ID NO: 1780052 - DNA, 17 bp, Homo sapiens
ccttggcttctgtgatg

SEQ ID NO: 1780053 - DNA, 19 bp, Homo sapiens
ccttggctttcagagccag

SEQ ID NO: 1780054 - DNA, 17 bp, Homo sapiens
ccttgggcatccaccca

SEQ ID NO: 1780055 - DNA, 22 bp, Homo sapiens
ccttgggcatccacccagtgct

SEQ ID NO: 1780056 - DNA, 16 bp, Homo sapiens
ccttgggccacgctct

SEQ ID NO: 1780057 - DNA, 22 bp, Homo sapiens
ccttgggccagaagtaccagac

SEQ ID NO: 1780058 - DNA, 19 bp, Homo sapiens
ccttgggcctggccagtct

SEQ ID NO: 1780059 - DNA, 16 bp, Homo sapiens
ccttgggctcctggct

SEQ ID NO: 1780060 - DNA, 17 bp, Homo sapiens
ccttgggctcctggctg

SEQ ID NO: 1780061 - DNA, 18 bp, Homo sapiens
ccttgggctcctggctgc

SEQ ID NO: 1780062 - DNA, 21 bp, Homo sapiens
ccttgggctcctggctgccag

SEQ ID NO: 1780063 - DNA, 22 bp, Homo sapiens
ccttgggctcctggctgccagg

SEQ ID NO: 1780064 - DNA, 23 bp, Homo sapiens
ccttgggctcctggctgccaggc

SEQ ID NO: 1780065 - DNA, 15 bp, Homo sapiens
ccttgggctgctcct

SEQ ID NO: 1780066 - DNA, 17 bp, Homo sapiens
ccttgggctgctcctca

SEQ ID NO: 1780067 - DNA, 22 bp, Homo sapiens
ccttggggaatttcctctattg

SEQ ID NO: 1780068 - DNA, 22 bp, Homo sapiens
ccttggggcagggcctgggcct

SEQ ID NO: 1780069 - DNA, 17 bp, Homo sapiens
ccttggggcctggcttg

SEQ ID NO: 1780070 - DNA, 22 bp, Homo sapiens
ccttggggcctggcttgctcca

SEQ ID NO: 1780071 - DNA, 22 bp, Homo sapiens
ccttggggggtgggggctgtcc

SEQ ID NO: 1780072 - DNA, 21 bp, Homo sapiens
ccttggggtaagccagagcct

SEQ ID NO: 1780073 - DNA, 23 bp, Homo sapiens
ccttggggtaagccagagcctgg

SEQ ID NO: 1780074 - DNA, 16 bp, Homo sapiens
ccttggggtccctcca

SEQ ID NO: 1780075 - DNA, 19 bp, Homo sapiens
ccttggggtccctccaccc

SEQ ID NO: 1780076 - DNA, 20 bp, Homo sapiens
ccttggggtccctccacccc

SEQ ID NO: 1780077 - DNA, 18 bp, Homo sapiens
ccttggtagcagcctggg

SEQ ID NO: 1780078 - DNA, 18 bp, Homo sapiens
ccttggtcccaagcctga

SEQ ID NO: 1780079 - DNA, 14 bp, Homo sapiens
ccttggtgctgtgt

SEQ ID NO: 1780080 - DNA, 16 bp, Homo sapiens
ccttggtgctgtgtgc

SEQ ID NO: 1780081 - DNA, 21 bp, Homo sapiens
ccttggtgctgtgtgccccac

SEQ ID NO: 1780082 - DNA, 18 bp, Homo sapiens
ccttggtggagcagccag

SEQ ID NO: 1780083 - DNA, 20 bp, Homo sapiens
ccttggtggagcagccagag

SEQ ID NO: 1780084 - DNA, 22 bp, Homo sapiens
ccttggtggagcagccagagct

SEQ ID NO: 1780085 - DNA, 16 bp, Homo sapiens
ccttggtgtccacctg

SEQ ID NO: 1780086 - DNA, 19 bp, Homo sapiens
ccttggtgtccacctggcc

SEQ ID NO: 1780087 - DNA, 13 bp, Homo sapiens
ccttggttggaag

SEQ ID NO: 1780088 - DNA, 11 bp, Homo sapiens
ccttgtaaaaa

SEQ ID NO: 1780089 - DNA, 17 bp, Homo sapiens
ccttgtaaaaaaagcaa

SEQ ID NO: 1780090 - DNA, 15 bp, Homo sapiens
ccttgtaaatgctct

SEQ ID NO: 1780091 - DNA, 19 bp, Homo sapiens
ccttgtagaggagcagggt

SEQ ID NO: 1780092 - DNA, 21 bp, Homo sapiens
ccttgtatttaaatattaaat

SEQ ID NO: 1780093 - DNA, 16 bp, Homo sapiens
ccttgtcactggtaga

SEQ ID NO: 1780094 - DNA, 17 bp, Homo sapiens
ccttgtcatctctctgc

SEQ ID NO: 1780095 - DNA, 16 bp, Homo sapiens
ccttgtcctgccagct

SEQ ID NO: 1780096 - DNA, 20 bp, Homo sapiens
ccttgtcctgccagctgcct

SEQ ID NO: 1780097 - DNA, 21 bp, Homo sapiens
ccttgtcctgccagctgcctt

SEQ ID NO: 1780098 - DNA, 14 bp, Homo sapiens
ccttgtcctttccc

SEQ ID NO: 1780099 - DNA, 13 bp, Homo sapiens
ccttgtcgtggga

SEQ ID NO: 1780100 - DNA, 19 bp, Homo sapiens
ccttgtctttactgacaag

SEQ ID NO: 1780101 - DNA, 16 bp, Homo sapiens
ccttgtcttttgagct

SEQ ID NO: 1780102 - DNA, 16 bp, Homo sapiens
ccttgtgagagcccat

SEQ ID NO: 1780103 - DNA, 16 bp, Homo sapiens
ccttgtgcaattgtct

SEQ ID NO: 1780104 - DNA, 13 bp, Homo sapiens
ccttgtgccctgc

SEQ ID NO: 1780105 - DNA, 18 bp, Homo sapiens
ccttgtgccctgccccca

SEQ ID NO: 1780106 - DNA, 16 bp, Homo sapiens
ccttgtgccctgcctc

SEQ ID NO: 1780107 - DNA, 11 bp, Homo sapiens
ccttgtgcctg

SEQ ID NO: 1780108 - DNA, 15 bp, Homo sapiens
ccttgtgcctggggt

SEQ ID NO: 1780109 - DNA, 21 bp, Homo sapiens
ccttgtgcttggtggggctcg

SEQ ID NO: 1780110 - DNA, 22 bp, Homo sapiens
ccttgtgggaccagtcccacac

SEQ ID NO: 1780111 - DNA, 15 bp, Homo sapiens
ccttgtgtcactggc

SEQ ID NO: 1780112 - DNA, 18 bp, Homo sapiens
ccttgtgtgtcaggccct

SEQ ID NO: 1780113 - DNA, 23 bp, Homo sapiens
ccttgtgtgtcaggccctctgcc

SEQ ID NO: 1780114 - DNA, 13 bp, Homo sapiens
ccttgttctctgc

SEQ ID NO: 1780115 - DNA, 12 bp, Homo sapiens
ccttgttgcctg

SEQ ID NO: 1780116 - DNA, 14 bp, Homo sapiens
ccttgttgcctgca

SEQ ID NO: 1780117 - DNA, 16 bp, Homo sapiens
ccttgttggagcctgc

SEQ ID NO: 1780118 - DNA, 17 bp, Homo sapiens
ccttgttgtttcttgcc

SEQ ID NO: 1780119 - DNA, 11 bp, Homo sapiens
ccttgtttcag

SEQ ID NO: 1780120 - DNA, 21 bp, Homo sapiens
ccttgtttctcttcctttctt

SEQ ID NO: 1780121 - DNA, 16 bp, Homo sapiens
ccttgtttctgttgtt

SEQ ID NO: 1780122 - DNA, 19 bp, Homo sapiens
ccttgtttctgttgttccc

SEQ ID NO: 1780123 - DNA, 16 bp, Homo sapiens
cctttaactcatgagg

SEQ ID NO: 1780124 - DNA, 22 bp, Homo sapiens
cctttaacttttttttctctct

SEQ ID NO: 1780125 - DNA, 23 bp, Homo sapiens
cctttaagatatccatctttttc

SEQ ID NO: 1780126 - DNA, 22 bp, Homo sapiens
cctttaagccaaagaaacaagc

SEQ ID NO: 1780127 - DNA, 23 bp, Homo sapiens
cctttaagccaaagaaacaagct

SEQ ID NO: 1780128 - DNA, 21 bp, Homo sapiens
cctttactcagcccagctggc

SEQ ID NO: 1780129 - DNA, 20 bp, Homo sapiens
cctttagaaactcaaaaact

SEQ ID NO: 1780130 - DNA, 15 bp, Homo sapiens
cctttaggtctggtt

SEQ ID NO: 1780131 - DNA, 19 bp, Homo sapiens
cctttagtacctgaaaagt

SEQ ID NO: 1780132 - DNA, 22 bp, Homo sapiens
cctttataatgaggatgattat

SEQ ID NO: 1780133 - DNA, 22 bp, Homo sapiens
cctttatcacctcattctgaac

SEQ ID NO: 1780134 - DNA, 14 bp, Homo sapiens
cctttatgtgaatt

SEQ ID NO: 1780135 - DNA, 17 bp, Homo sapiens
cctttatgtgaattttt

SEQ ID NO: 1780136 - DNA, 23 bp, Homo sapiens
cctttatgtgaatttttaagctg

SEQ ID NO: 1780137 - DNA, 19 bp, Homo sapiens
cctttatgtggaaaacaga

SEQ ID NO: 1780138 - DNA, 23 bp, Homo sapiens
cctttattaccccctccttcaga

SEQ ID NO: 1780139 - DNA, 16 bp, Homo sapiens
cctttattcacccctg

SEQ ID NO: 1780140 - DNA, 13 bp, Homo sapiens
cctttattttaga

SEQ ID NO: 1780141 - DNA, 15 bp, Homo sapiens
cctttcacaaccttc

SEQ ID NO: 1780142 - DNA, 21 bp, Homo sapiens
cctttcagatgtcttctgcct

SEQ ID NO: 1780143 - DNA, 13 bp, Homo sapiens
cctttcagccaca

SEQ ID NO: 1780144 - DNA, 23 bp, Homo sapiens
cctttcagccacatgccccaggc

SEQ ID NO: 1780145 - DNA, 15 bp, Homo sapiens
cctttcaggccaagg

SEQ ID NO: 1780146 - DNA, 20 bp, Homo sapiens
cctttcatctctctacctcc

SEQ ID NO: 1780147 - DNA, 21 bp, Homo sapiens
cctttcatctctctacctcca

SEQ ID NO: 1780148 - DNA, 22 bp, Homo sapiens
cctttcatctctctacctccac

SEQ ID NO: 1780149 - DNA, 23 bp, Homo sapiens
cctttcatctctctacctccacc

SEQ ID NO: 1780150 - DNA, 20 bp, Homo sapiens
cctttcatcttgaagttttt

SEQ ID NO: 1780151 - DNA, 17 bp, Homo sapiens
cctttccaacctcactt

SEQ ID NO: 1780152 - DNA, 19 bp, Homo sapiens
cctttccaacctcacttcc

SEQ ID NO: 1780153 - DNA, 23 bp, Homo sapiens
cctttccaccacagccagcacct

SEQ ID NO: 1780154 - DNA, 15 bp, Homo sapiens
cctttccatctgtcc

SEQ ID NO: 1780155 - DNA, 22 bp, Homo sapiens
cctttccatctgtccacatccc

SEQ ID NO: 1780156 - DNA, 15 bp, Homo sapiens
cctttcccaccattc

SEQ ID NO: 1780157 - DNA, 18 bp, Homo sapiens
cctttcccaccattcctg

SEQ ID NO: 1780158 - DNA, 20 bp, Homo sapiens
cctttccccgacgcccaccc

SEQ ID NO: 1780159 - DNA, 14 bp, Homo sapiens
cctttccctaaaga

SEQ ID NO: 1780160 - DNA, 13 bp, Homo sapiens
cctttcctgatgc

SEQ ID NO: 1780161 - DNA, 22 bp, Homo sapiens
cctttcctggacactcagacct

SEQ ID NO: 1780162 - DNA, 11 bp, Homo sapiens
cctttcctgtc

SEQ ID NO: 1780163 - DNA, 14 bp, Homo sapiens
cctttcctgtccca

SEQ ID NO: 1780164 - DNA, 18 bp, Homo sapiens
cctttccttccatcccta

SEQ ID NO: 1780165 - DNA, 16 bp, Homo sapiens
cctttccttcccaggc

SEQ ID NO: 1780166 - DNA, 17 bp, Homo sapiens
cctttccttcccaggcc

SEQ ID NO: 1780167 - DNA, 19 bp, Homo sapiens
cctttccttcccaggccct

SEQ ID NO: 1780168 - DNA, 20 bp, Homo sapiens
cctttccttcccaggccctt

SEQ ID NO: 1780169 - DNA, 23 bp, Homo sapiens
cctttccttcccaggccctttgg

SEQ ID NO: 1780170 - DNA, 21 bp, Homo sapiens
cctttccttccttccctggct

SEQ ID NO: 1780171 - DNA, 16 bp, Homo sapiens
cctttccttgccttct

SEQ ID NO: 1780172 - DNA, 15 bp, Homo sapiens
cctttctaaacaaga

SEQ ID NO: 1780173 - DNA, 13 bp, Homo sapiens
cctttctccagcc

SEQ ID NO: 1780174 - DNA, 17 bp, Homo sapiens
cctttctccagccagca

SEQ ID NO: 1780175 - DNA, 18 bp, Homo sapiens
cctttctccagccagcaa

SEQ ID NO: 1780176 - DNA, 22 bp, Homo sapiens
cctttctccagccagcaatgat

SEQ ID NO: 1780177 - DNA, 14 bp, Homo sapiens
cctttctcctgccc

SEQ ID NO: 1780178 - DNA, 13 bp, Homo sapiens
cctttctctcctg

SEQ ID NO: 1780179 - DNA, 16 bp, Homo sapiens
cctttctctgggctta

SEQ ID NO: 1780180 - DNA, 13 bp, Homo sapiens
cctttctggaagt

SEQ ID NO: 1780181 - DNA, 20 bp, Homo sapiens
cctttctggaagtttctggt

SEQ ID NO: 1780182 - DNA, 22 bp, Homo sapiens
cctttctggaagtttctggtgc

SEQ ID NO: 1780183 - DNA, 14 bp, Homo sapiens
cctttctgtagcct

SEQ ID NO: 1780184 - DNA, 18 bp, Homo sapiens
cctttcttattctgtgag

SEQ ID NO: 1780185 - DNA, 16 bp, Homo sapiens
cctttcttcctattta

SEQ ID NO: 1780186 - DNA, 11 bp, Homo sapiens
cctttcttctg

SEQ ID NO: 1780187 - DNA, 23 bp, Homo sapiens
cctttcttgtagccatggctggg

SEQ ID NO: 1780188 - DNA, 15 bp, Homo sapiens
cctttctttgcctct

SEQ ID NO: 1780189 - DNA, 18 bp, Homo sapiens
cctttctttgcctctgca

SEQ ID NO: 1780190 - DNA, 15 bp, Homo sapiens
cctttctttttcttc

SEQ ID NO: 1780191 - DNA, 17 bp, Homo sapiens
cctttgaacgtgcttct

SEQ ID NO: 1780192 - DNA, 18 bp, Homo sapiens
cctttgaacgtgcttctt

SEQ ID NO: 1780193 - DNA, 20 bp, Homo sapiens
cctttgaacgtgcttctttg

SEQ ID NO: 1780194 - DNA, 22 bp, Homo sapiens
cctttgaacgtgcttctttgta

SEQ ID NO: 1780195 - DNA, 22 bp, Homo sapiens
cctttgagatctggggaggcag

SEQ ID NO: 1780196 - DNA, 15 bp, Homo sapiens
cctttgcacctgaga

SEQ ID NO: 1780197 - DNA, 16 bp, Homo sapiens
cctttgcactgagggc

SEQ ID NO: 1780198 - DNA, 18 bp, Homo sapiens
cctttgcactgagggcca

SEQ ID NO: 1780199 - DNA, 14 bp, Homo sapiens
cctttgctatgtaa

SEQ ID NO: 1780200 - DNA, 13 bp, Homo sapiens
cctttgctcttgc

SEQ ID NO: 1780201 - DNA, 14 bp, Homo sapiens
cctttgctcttgcc

SEQ ID NO: 1780202 - DNA, 16 bp, Homo sapiens
cctttgcttcattcca

SEQ ID NO: 1780203 - DNA, 21 bp, Homo sapiens
cctttggaaagctctgaccac

SEQ ID NO: 1780204 - DNA, 15 bp, Homo sapiens
cctttggagatgctg

SEQ ID NO: 1780205 - DNA, 20 bp, Homo sapiens
cctttggagatgctgagggt

SEQ ID NO: 1780206 - DNA, 18 bp, Homo sapiens
cctttggcaaaaggcatg

SEQ ID NO: 1780207 - DNA, 15 bp, Homo sapiens
cctttggccattcca

SEQ ID NO: 1780208 - DNA, 23 bp, Homo sapiens
cctttggcctggggtgcatctcc

SEQ ID NO: 1780209 - DNA, 21 bp, Homo sapiens
cctttggctggtagcagcagg

SEQ ID NO: 1780210 - DNA, 19 bp, Homo sapiens
cctttgggtcctgggcagg

SEQ ID NO: 1780211 - DNA, 16 bp, Homo sapiens
cctttggtttttttct

SEQ ID NO: 1780212 - DNA, 16 bp, Homo sapiens
cctttgtaagacattt

SEQ ID NO: 1780213 - DNA, 18 bp, Homo sapiens
cctttgtaagacatttgt

SEQ ID NO: 1780214 - DNA, 19 bp, Homo sapiens
cctttgtaagacatttgta

SEQ ID NO: 1780215 - DNA, 20 bp, Homo sapiens
cctttgtaagacatttgtat

SEQ ID NO: 1780216 - DNA, 14 bp, Homo sapiens
cctttgtaagttat

SEQ ID NO: 1780217 - DNA, 23 bp, Homo sapiens
cctttgtcatctttcttctattt

SEQ ID NO: 1780218 - DNA, 13 bp, Homo sapiens
cctttgtgagtca

SEQ ID NO: 1780219 - DNA, 16 bp, Homo sapiens
cctttgtgagtcaata

SEQ ID NO: 1780220 - DNA, 14 bp, Homo sapiens
cctttgtgctctat

SEQ ID NO: 1780221 - DNA, 16 bp, Homo sapiens
cctttgtgtggctgcc

SEQ ID NO: 1780222 - DNA, 15 bp, Homo sapiens
cctttgttctgagca

SEQ ID NO: 1780223 - DNA, 15 bp, Homo sapiens
cctttgttctggggg

SEQ ID NO: 1780224 - DNA, 17 bp, Homo sapiens
cctttgttgaactgtta

SEQ ID NO: 1780225 - DNA, 14 bp, Homo sapiens
cctttgttgctcag

SEQ ID NO: 1780226 - DNA, 16 bp, Homo sapiens
cctttgtttaataaag

SEQ ID NO: 1780227 - DNA, 23 bp, Homo sapiens
cctttgttttgatgtttgtggcc

SEQ ID NO: 1780228 - DNA, 20 bp, Homo sapiens
ccttttaatctagagaaggc

SEQ ID NO: 1780229 - DNA, 17 bp, Homo sapiens
ccttttacatactgctg

SEQ ID NO: 1780230 - DNA, 18 bp, Homo sapiens
ccttttacatactgctgt

SEQ ID NO: 1780231 - DNA, 19 bp, Homo sapiens
ccttttacattgtgactgt

SEQ ID NO: 1780232 - DNA, 17 bp, Homo sapiens
ccttttacttttttata

SEQ ID NO: 1780233 - DNA, 22 bp, Homo sapiens
ccttttataggtgagaaaaaaa

SEQ ID NO: 1780234 - DNA, 16 bp, Homo sapiens
ccttttatgaatcaaa

SEQ ID NO: 1780235 - DNA, 19 bp, Homo sapiens
ccttttatgaatcaaatat

SEQ ID NO: 1780236 - DNA, 12 bp, Homo sapiens
cgatgctgacct

SEQ ID NO: 1780237 - DNA, 16 bp, Homo sapiens
cgatgctgaggccacc

SEQ ID NO: 1780238 - DNA, 12 bp, Homo sapiens
cgatgctgcttt

SEQ ID NO: 1780239 - DNA, 18 bp, Homo sapiens
cgatgctggaggccctcg

SEQ ID NO: 1780240 - DNA, 18 bp, Homo sapiens
cgatgggcccctggcccc

SEQ ID NO: 1780241 - DNA, 20 bp, Homo sapiens
cgatggggcaagacagaaaa

SEQ ID NO: 1780242 - DNA, 13 bp, Homo sapiens
cgatgtcccctgc

SEQ ID NO: 1780243 - DNA, 23 bp, Homo sapiens
cgatgtgactgcatcatatattt

SEQ ID NO: 1780244 - DNA, 15 bp, Homo sapiens
cgatgtgcaggaaga

SEQ ID NO: 1780245 - DNA, 13 bp, Homo sapiens
cgatgtgctcagc

SEQ ID NO: 1780246 - DNA, 16 bp, Homo sapiens
cgatgtgctcagccaa

SEQ ID NO: 1780247 - DNA, 15 bp, Homo sapiens
cgatgtggccctggc

SEQ ID NO: 1780248 - DNA, 18 bp, Homo sapiens
cgatgtggccctggcctg

SEQ ID NO: 1780249 - DNA, 15 bp, Homo sapiens
cgatgttgtcaagga

SEQ ID NO: 1780250 - DNA, 21 bp, Homo sapiens
cgattaagagacagagaatct

SEQ ID NO: 1780251 - DNA, 16 bp, Homo sapiens
cgattcaccctgtcca

SEQ ID NO: 1780252 - DNA, 21 bp, Homo sapiens
cgattcaccctgtccaaactg

SEQ ID NO: 1780253 - DNA, 11 bp, Homo sapiens
cgattccactg

SEQ ID NO: 1780254 - DNA, 13 bp, Homo sapiens
cgattctcctgtc

SEQ ID NO: 1780255 - DNA, 23 bp, Homo sapiens
cgatttgcaggattcccttctgg

SEQ ID NO: 1780256 - DNA, 13 bp, Homo sapiens
cgcaacccacagc

SEQ ID NO: 1780257 - DNA, 14 bp, Homo sapiens
cgcaacccacagct

SEQ ID NO: 1780258 - DNA, 15 bp, Homo sapiens
cgcaacccacagctc

SEQ ID NO: 1780259 - DNA, 17 bp, Homo sapiens
cgcaacccacagctcag

SEQ ID NO: 1780260 - DNA, 13 bp, Homo sapiens
cgcaagctctcag

SEQ ID NO: 1780261 - DNA, 12 bp, Homo sapiens
cgcaaggcactt

SEQ ID NO: 1780262 - DNA, 17 bp, Homo sapiens
cgcaatagttttttact

SEQ ID NO: 1780263 - DNA, 15 bp, Homo sapiens
cgcaatgtggagcag

SEQ ID NO: 1780264 - DNA, 21 bp, Homo sapiens
cgcacaaggctgaccaagaga

SEQ ID NO: 1780265 - DNA, 15 bp, Homo sapiens
cgcacagccacccgt

SEQ ID NO: 1780266 - DNA, 14 bp, Homo sapiens
cgcacagctcccgg

SEQ ID NO: 1780267 - DNA, 16 bp, Homo sapiens
cgcacatggtgtgggg

SEQ ID NO: 1780268 - DNA, 13 bp, Homo sapiens
cgcaccactgctt

SEQ ID NO: 1780269 - DNA, 17 bp, Homo sapiens
cgcaccactgcttccca

SEQ ID NO: 1780270 - DNA, 20 bp, Homo sapiens
cgcaccagcccgaacaccat

SEQ ID NO: 1780271 - DNA, 13 bp, Homo sapiens
cgcaccagctgct

SEQ ID NO: 1780272 - DNA, 19 bp, Homo sapiens
cgcaccattgcactccagc

SEQ ID NO: 1780273 - DNA, 14 bp, Homo sapiens
cgcaccccagagtg

SEQ ID NO: 1780274 - DNA, 16 bp, Homo sapiens
cgcaccccggcctcag

SEQ ID NO: 1780275 - DNA, 21 bp, Homo sapiens
cgcaccccggcctcagggcgc

SEQ ID NO: 1780276 - DNA, 14 bp, Homo sapiens
cgcaccctgcacct

SEQ ID NO: 1780277 - DNA, 18 bp, Homo sapiens
cgcaccctgcacctgctg

SEQ ID NO: 1780278 - DNA, 20 bp, Homo sapiens
cgcacctaaagcagccagcc

SEQ ID NO: 1780279 - DNA, 17 bp, Homo sapiens
cgcacctgccccctggt

SEQ ID NO: 1780280 - DNA, 13 bp, Homo sapiens
cgcaccttcctcc

SEQ ID NO: 1780281 - DNA, 22 bp, Homo sapiens
cgcaccttgtcatgtaccatca

SEQ ID NO: 1780282 - DNA, 11 bp, Homo sapiens
cgcacgcacac

SEQ ID NO: 1780283 - DNA, 13 bp, Homo sapiens
cgcacgcacacac

SEQ ID NO: 1780284 - DNA, 14 bp, Homo sapiens
cgcacgcacacaca

SEQ ID NO: 1780285 - DNA, 18 bp, Homo sapiens
cgcacgtccgcgggtccc

SEQ ID NO: 1780286 - DNA, 18 bp, Homo sapiens
cgcactctccccgctcag

SEQ ID NO: 1780287 - DNA, 20 bp, Homo sapiens
cgcactctccccgctcaggg

SEQ ID NO: 1780288 - DNA, 13 bp, Homo sapiens
cgcactgtcccag

SEQ ID NO: 1780289 - DNA, 22 bp, Homo sapiens
cgcactgtcccagtagccaagg

SEQ ID NO: 1780290 - DNA, 23 bp, Homo sapiens
cgcacttgcctgttggctgctgc

SEQ ID NO: 1780291 - DNA, 15 bp, Homo sapiens
cgcagacgggcacag

SEQ ID NO: 1780292 - DNA, 17 bp, Homo sapiens
cgcagacgggcacagac

SEQ ID NO: 1780293 - DNA, 13 bp, Homo sapiens
cgcagagccctcc

SEQ ID NO: 1780294 - DNA, 18 bp, Homo sapiens
cgcagagccctccaggcc

SEQ ID NO: 1780295 - DNA, 19 bp, Homo sapiens
cgcagagccctccaggcct

SEQ ID NO: 1780296 - DNA, 10 bp, Homo sapiens
cgcagcagct

SEQ ID NO: 1780297 - DNA, 20 bp, Homo sapiens
cgcagcagctgggacccctc

SEQ ID NO: 1780298 - DNA, 16 bp, Homo sapiens
cgcagcagggaagctc

SEQ ID NO: 1780299 - DNA, 15 bp, Homo sapiens
cgcagccaggacacc

SEQ ID NO: 1780300 - DNA, 12 bp, Homo sapiens
cgcagcccgtga

SEQ ID NO: 1780301 - DNA, 19 bp, Homo sapiens
cgcagcccgtgaagcagtg

SEQ ID NO: 1780302 - DNA, 20 bp, Homo sapiens
cgcagcccgtgaagcagtgc

SEQ ID NO: 1780303 - DNA, 16 bp, Homo sapiens
cgcagccctggcaggg

SEQ ID NO: 1780304 - DNA, 18 bp, Homo sapiens
cgcagccggagggaggca

SEQ ID NO: 1780305 - DNA, 13 bp, Homo sapiens
cgcagcctgaagc

SEQ ID NO: 1780306 - DNA, 16 bp, Homo sapiens
cgcagcgtcccccgcc

SEQ ID NO: 1780307 - DNA, 16 bp, Homo sapiens
cgcagctaccctcagc

SEQ ID NO: 1780308 - DNA, 19 bp, Homo sapiens
cgcagctaccctcagcctc

SEQ ID NO: 1780309 - DNA, 20 bp, Homo sapiens
cgcagctaccctcagcctcc

SEQ ID NO: 1780310 - DNA, 23 bp, Homo sapiens
cgcagctcttgcccttccctgtc

SEQ ID NO: 1780311 - DNA, 20 bp, Homo sapiens
cgcaggaactgggctgggcc

SEQ ID NO: 1780312 - DNA, 11 bp, Homo sapiens
cgcaggaatgg

SEQ ID NO: 1780313 - DNA, 20 bp, Homo sapiens
cgcaggatccctcctgagct

SEQ ID NO: 1780314 - DNA, 21 bp, Homo sapiens
cgcaggatccctcctgagctc

SEQ ID NO: 1780315 - DNA, 18 bp, Homo sapiens
cgcaggatccgctgccac

SEQ ID NO: 1780316 - DNA, 22 bp, Homo sapiens
cgcaggcccggactcaccaact

SEQ ID NO: 1780317 - DNA, 21 bp, Homo sapiens
cgcaggctatttgttcagaga

SEQ ID NO: 1780318 - DNA, 18 bp, Homo sapiens
cgcaggctgagtccagag

SEQ ID NO: 1780319 - DNA, 16 bp, Homo sapiens
cgcagggccatgcaga

SEQ ID NO: 1780320 - DNA, 16 bp, Homo sapiens
cgcagggtgcaggagc

SEQ ID NO: 1780321 - DNA, 21 bp, Homo sapiens
cgcaggtctcttctgggcgtc

SEQ ID NO: 1780322 - DNA, 15 bp, Homo sapiens
cgcaggtgccatgcc

SEQ ID NO: 1780323 - DNA, 17 bp, Homo sapiens
cgcaggtgccatgcctg

SEQ ID NO: 1780324 - DNA, 21 bp, Homo sapiens
cgcaggtgccatgcctgctcc

SEQ ID NO: 1780325 - DNA, 22 bp, Homo sapiens
cgcaggtgccatgcctgctccc

SEQ ID NO: 1780326 - DNA, 23 bp, Homo sapiens
cgcaggtgccatgcctgctccct

SEQ ID NO: 1780327 - DNA, 14 bp, Homo sapiens
cgcaggtgggctgg

SEQ ID NO: 1780328 - DNA, 23 bp, Homo sapiens
cgcagtcgcaggatccgctgcca

SEQ ID NO: 1780329 - DNA, 13 bp, Homo sapiens
cgcagtctggcct

SEQ ID NO: 1780330 - DNA, 22 bp, Homo sapiens
cgcagtctggcctgggcgacag

SEQ ID NO: 1780331 - DNA, 19 bp, Homo sapiens
cgcagtgctgggaccagag

SEQ ID NO: 1780332 - DNA, 21 bp, Homo sapiens
cgcagtgctgggaccagagcc

SEQ ID NO: 1780333 - DNA, 19 bp, Homo sapiens
cgcagtgcttctctacaga

SEQ ID NO: 1780334 - DNA, 15 bp, Homo sapiens
cgcagtggccctgag

SEQ ID NO: 1780335 - DNA, 11 bp, Homo sapiens
cgcagtgtctc

SEQ ID NO: 1780336 - DNA, 14 bp, Homo sapiens
cgcatcctcttcca

SEQ ID NO: 1780337 - DNA, 15 bp, Homo sapiens
cgcatgccctcaatc

SEQ ID NO: 1780338 - DNA, 14 bp, Homo sapiens
cgcctgcctgccac

SEQ ID NO: 1780339 - DNA, 19 bp, Homo sapiens
cgcctgcctttggcactct

SEQ ID NO: 1780340 - DNA, 15 bp, Homo sapiens
cgcctgctccctgca

SEQ ID NO: 1780341 - DNA, 13 bp, Homo sapiens
cgcctgctcctca

SEQ ID NO: 1780342 - DNA, 22 bp, Homo sapiens
cgcctggccggctccagtttcc

SEQ ID NO: 1780343 - DNA, 19 bp, Homo sapiens
cgcctgtaatcccagcact

SEQ ID NO: 1780344 - DNA, 18 bp, Homo sapiens
cgcctgtaatcccagcag

SEQ ID NO: 1780345 - DNA, 17 bp, Homo sapiens
cgcctgtagtcctagcc

SEQ ID NO: 1780346 - DNA, 20 bp, Homo sapiens
cgcctgtagtcctagccact

SEQ ID NO: 1780347 - DNA, 17 bp, Homo sapiens
cgcctgtgatgctgggc

SEQ ID NO: 1780348 - DNA, 22 bp, Homo sapiens
cgccttcactccggtgtgcctg

SEQ ID NO: 1780349 - DNA, 22 bp, Homo sapiens
cgccttcctcctccacagtgct

SEQ ID NO: 1780350 - DNA, 20 bp, Homo sapiens
cgccttctcccacatgaggc

SEQ ID NO: 1780351 - DNA, 23 bp, Homo sapiens
cgccttctcggagctggcccagg

SEQ ID NO: 1780352 - DNA, 15 bp, Homo sapiens
cgccttggccttgca

SEQ ID NO: 1780353 - DNA, 20 bp, Homo sapiens
cgccttggccttgcagctgg

SEQ ID NO: 1780354 - DNA, 18 bp, Homo sapiens
cgccttgttcctgctctt

SEQ ID NO: 1780355 - DNA, 11 bp, Homo sapiens
cgctggcccag

SEQ ID NO: 1780356 - DNA, 21 bp, Homo sapiens
cgctgggatttcttcgctgct

SEQ ID NO: 1780357 - DNA, 14 bp, Homo sapiens
cgctgggctgagcc

SEQ ID NO: 1780358 - DNA, 15 bp, Homo sapiens
cgctgggctgagccc

SEQ ID NO: 1780359 - DNA, 20 bp, Homo sapiens
cgctggggtccgtcttcaca

SEQ ID NO: 1780360 - DNA, 19 bp, Homo sapiens
cgctgggtggtaccctctg

SEQ ID NO: 1780361 - DNA, 18 bp, Homo sapiens
cgctggtccctgccctcc

SEQ ID NO: 1780362 - DNA, 19 bp, Homo sapiens
cgctggtccctgccctccc

SEQ ID NO: 1780363 - DNA, 21 bp, Homo sapiens
cgctgtaccctttaagatatc

SEQ ID NO: 1780364 - DNA, 13 bp, Homo sapiens
cgctgtcacaggc

SEQ ID NO: 1780365 - DNA, 11 bp, Homo sapiens
cgctgtcccct

SEQ ID NO: 1780366 - DNA, 15 bp, Homo sapiens
cgctgtcccctcagc

SEQ ID NO: 1780367 - DNA, 17 bp, Homo sapiens
cggggtggggtgcactc

SEQ ID NO: 1780368 - DNA, 16 bp, Homo sapiens
cggggtggtggacagg

SEQ ID NO: 1780369 - DNA, 20 bp, Homo sapiens
cggggtgtaacttcctgctg

SEQ ID NO: 1780370 - DNA, 22 bp, Homo sapiens
cggggtgtaacttcctgctgca

SEQ ID NO: 1780371 - DNA, 23 bp, Homo sapiens
cggggtgtaacttcctgctgcac

SEQ ID NO: 1780372 - DNA, 23 bp, Homo sapiens
cggggttccccacacagggcact

SEQ ID NO: 1780373 - DNA, 21 bp, Homo sapiens
cggggttggctgttccagact

SEQ ID NO: 1780374 - DNA, 22 bp, Homo sapiens
cgggtcatctgtacctctgcct

SEQ ID NO: 1780375 - DNA, 14 bp, Homo sapiens
cgggtctcctccca

SEQ ID NO: 1780376 - DNA, 20 bp, Homo sapiens
cgggtctcgcagcctgaagc

SEQ ID NO: 1780377 - DNA, 24 bp, Homo sapiens
cgggtgcccgtaatcccagctact

SEQ ID NO: 1780378 - DNA, 18 bp, Homo sapiens
cgggtggatcacctgagg

SEQ ID NO: 1780379 - DNA, 15 bp, Homo sapiens
cgggtgggcctggcc

SEQ ID NO: 1780380 - DNA, 16 bp, Homo sapiens
cgggtgggcctggcct

SEQ ID NO: 1780381 - DNA, 19 bp, Homo sapiens
cgggtgggcctggcctgag

SEQ ID NO: 1780382 - DNA, 20 bp, Homo sapiens
cgggtgggcctggcctgagc

SEQ ID NO: 1780383 - DNA, 22 bp, Homo sapiens
cgggtgggcctggcctgagctg

SEQ ID NO: 1780384 - DNA, 17 bp, Homo sapiens
cgggttcaccatgttgc

SEQ ID NO: 1780385 - DNA, 22 bp, Homo sapiens
cgggttctagacgcccctccca

SEQ ID NO: 1780386 - DNA, 22 bp, Homo sapiens
cgggttctgcagcggcagagca

SEQ ID NO: 1780387 - DNA, 17 bp, Homo sapiens
cgggttgtgtgtctgtt

SEQ ID NO: 1780388 - DNA, 13 bp, Homo sapiens
cggtaactgtcct

SEQ ID NO: 1780389 - DNA, 17 bp, Homo sapiens
cggtaactgtcctgtcc

SEQ ID NO: 1780390 - DNA, 15 bp, Homo sapiens
cggtaagtgttctca

SEQ ID NO: 1780391 - DNA, 12 bp, Homo sapiens
cggtactcccat

SEQ ID NO: 1780392 - DNA, 15 bp, Homo sapiens
cggtagctgtgcgtg

SEQ ID NO: 1780393 - DNA, 20 bp, Homo sapiens
cggtatctggcttccctgga

SEQ ID NO: 1780394 - DNA, 22 bp, Homo sapiens
cggtatctggcttccctggaag

SEQ ID NO: 1780395 - DNA, 23 bp, Homo sapiens
cggtatctggcttccctggaagc

SEQ ID NO: 1780396 - DNA, 19 bp, Homo sapiens
cggtcactcaggcctctgc

SEQ ID NO: 1780397 - DNA, 12 bp, Homo sapiens
cggtcactgatg

SEQ ID NO: 1780398 - DNA, 15 bp, Homo sapiens
cggtcatgtgtgcat

SEQ ID NO: 1780399 - DNA, 18 bp, Homo sapiens
cggtcatgtgtgcatgtg

SEQ ID NO: 1780400 - DNA, 14 bp, Homo sapiens
cggtccaacgccgc

SEQ ID NO: 1780401 - DNA, 14 bp, Homo sapiens
cggtccagctggcc

SEQ ID NO: 1780402 - DNA, 16 bp, Homo sapiens
cggtccagctggcctg

SEQ ID NO: 1780403 - DNA, 20 bp, Homo sapiens
cggtcccccatgccaccacc

SEQ ID NO: 1780404 - DNA, 14 bp, Homo sapiens
cggtctgctttgga

SEQ ID NO: 1780405 - DNA, 21 bp, Homo sapiens
cggtctgttctgtttcaaggc

SEQ ID NO: 1780406 - DNA, 12 bp, Homo sapiens
cggtgagccggg

SEQ ID NO: 1780407 - DNA, 23 bp, Homo sapiens
cggtgcccaagccagaggctggg

SEQ ID NO: 1780408 - DNA, 20 bp, Homo sapiens
cggtgcctgggtggggctgc

SEQ ID NO: 1780409 - DNA, 14 bp, Homo sapiens
cggtgcgcacaccg

SEQ ID NO: 1780410 - DNA, 17 bp, Homo sapiens
cggtgcgtggctgtggc

SEQ ID NO: 1780411 - DNA, 15 bp, Homo sapiens
cggtgcgttctcctg

SEQ ID NO: 1780412 - DNA, 23 bp, Homo sapiens
cggtgctccatctccgcctccac

SEQ ID NO: 1780413 - DNA, 13 bp, Homo sapiens
cggtgctctggcg

SEQ ID NO: 1780414 - DNA, 14 bp, Homo sapiens
cggtgctgactgag

SEQ ID NO: 1780415 - DNA, 21 bp, Homo sapiens
cggtgctgactgaggcctgct

SEQ ID NO: 1780416 - DNA, 23 bp, Homo sapiens
cggtgcttccaacaaggacagcc

SEQ ID NO: 1780417 - DNA, 14 bp, Homo sapiens
cggtggaccaaagg

SEQ ID NO: 1780418 - DNA, 16 bp, Homo sapiens
cggtggacccagacac

SEQ ID NO: 1780419 - DNA, 17 bp, Homo sapiens
cggtggcggccccagca

SEQ ID NO: 1780420 - DNA, 22 bp, Homo sapiens
cggtggctcacgcctgtaatcc

SEQ ID NO: 1780421 - DNA, 14 bp, Homo sapiens
cggtggctgccccg

SEQ ID NO: 1780422 - DNA, 13 bp, Homo sapiens
cggtggctgggca

SEQ ID NO: 1780423 - DNA, 21 bp, Homo sapiens
cggtggctgggcagagctgca

SEQ ID NO: 1780424 - DNA, 15 bp, Homo sapiens
cggtgggccagagct

SEQ ID NO: 1780425 - DNA, 14 bp, Homo sapiens
cggtggtgcccgtg

SEQ ID NO: 1780426 - DNA, 24 bp, Homo sapiens
cggtgtcgccgcctgctccctgca

SEQ ID NO: 1780427 - DNA, 20 bp, Homo sapiens
cggtgtgcctgcagccccgc

SEQ ID NO: 1780428 - DNA, 22 bp, Homo sapiens
cggtgtgtggccgcctggcagg

SEQ ID NO: 1780429 - DNA, 21 bp, Homo sapiens
cggtgttaattttgctaactg

SEQ ID NO: 1780430 - DNA, 13 bp, Homo sapiens
cggtgttctaaga

SEQ ID NO: 1780431 - DNA, 17 bp, Homo sapiens
cggttaagaaagcactt

SEQ ID NO: 1780432 - DNA, 21 bp, Homo sapiens
cggttataaaaaatggttcag

SEQ ID NO: 1780433 - DNA, 13 bp, Homo sapiens
cggttcaccagcc

SEQ ID NO: 1780434 - DNA, 15 bp, Homo sapiens
cggttcaccagcctc

SEQ ID NO: 1780435 - DNA, 19 bp, Homo sapiens
cggttcagacccctgcctg

SEQ ID NO: 1780436 - DNA, 19 bp, Homo sapiens
cggttccacgtccccctgg

SEQ ID NO: 1780437 - DNA, 22 bp, Homo sapiens
cggttccccgcaacccacagct

SEQ ID NO: 1780438 - DNA, 23 bp, Homo sapiens
cggttccccgcaacccacagctc

SEQ ID NO: 1780439 - DNA, 17 bp, Homo sapiens
cggttcttacagcacat

SEQ ID NO: 1780440 - DNA, 12 bp, Homo sapiens
cggtttctgagc

SEQ ID NO: 1780441 - DNA, 20 bp, Homo sapiens
cggtttgccatgttgccaga

SEQ ID NO: 1780442 - DNA, 21 bp, Homo sapiens
cggtttggggagcagagacac

SEQ ID NO: 1780443 - DNA, 23 bp, Homo sapiens
cggtttttttctttggctgcagg

SEQ ID NO: 1780444 - DNA, 14 bp, Homo sapiens
cgtaaagaattttc

SEQ ID NO: 1780445 - DNA, 15 bp, Homo sapiens
cgtaacccaccccca

SEQ ID NO: 1780446 - DNA, 13 bp, Homo sapiens
cgtaagcagtata

SEQ ID NO: 1780447 - DNA, 16 bp, Homo sapiens
cgtaagtttaaaggat

SEQ ID NO: 1780448 - DNA, 14 bp, Homo sapiens
cgtaatagctcaga

SEQ ID NO: 1780449 - DNA, 14 bp, Homo sapiens
cgtaatagcttctg

SEQ ID NO: 1780450 - DNA, 16 bp, Homo sapiens
cgtaatagcttctgtg

SEQ ID NO: 1780451 - DNA, 17 bp, Homo sapiens
cgtaatagcttctgtgt

SEQ ID NO: 1780452 - DNA, 18 bp, Homo sapiens
cgtaatagcttctgtgtg

SEQ ID NO: 1780453 - DNA, 13 bp, Homo sapiens
cgtaatgggcctg

SEQ ID NO: 1780454 - DNA, 14 bp, Homo sapiens
cgtaatgggcctgc

SEQ ID NO: 1780455 - DNA, 14 bp, Homo sapiens
cgtaattaaatcca

SEQ ID NO: 1780456 - DNA, 14 bp, Homo sapiens
cgtaattctttctg

SEQ ID NO: 1780457 - DNA, 17 bp, Homo sapiens
cgtaattctttctgtct

SEQ ID NO: 1780458 - DNA, 18 bp, Homo sapiens
cgtaattctttctgtctc

SEQ ID NO: 1780459 - DNA, 23 bp, Homo sapiens
cgtaattctttctgtctcccttc

SEQ ID NO: 1780460 - DNA, 17 bp, Homo sapiens
cgtacaaaactctgtat

SEQ ID NO: 1780461 - DNA, 13 bp, Homo sapiens
cgtacacagagaa

SEQ ID NO: 1780462 - DNA, 23 bp, Homo sapiens
cgtacacagagaaggctatgtaa

SEQ ID NO: 1780463 - DNA, 21 bp, Homo sapiens
cgtgagagaaagagagaagcc

SEQ ID NO: 1780464 - DNA, 23 bp, Homo sapiens
cgtgagagaaagagagaagccag

SEQ ID NO: 1780465 - DNA, 17 bp, Homo sapiens
cgtgagagaatctgcct

SEQ ID NO: 1780466 - DNA, 14 bp, Homo sapiens
cgtgagccaccgcg

SEQ ID NO: 1780467 - DNA, 22 bp, Homo sapiens
cgtgagctatgattatgccact

SEQ ID NO: 1780468 - DNA, 15 bp, Homo sapiens
cgtgagggggagctg

SEQ ID NO: 1780469 - DNA, 20 bp, Homo sapiens
cgtgagttgggggagggaag

SEQ ID NO: 1780470 - DNA, 17 bp, Homo sapiens
cgtgatccacccgcctc

SEQ ID NO: 1780471 - DNA, 14 bp, Homo sapiens
cgtgatctcagctc

SEQ ID NO: 1780472 - DNA, 15 bp, Homo sapiens
cgtgatctcagctca

SEQ ID NO: 1780473 - DNA, 13 bp, Homo sapiens
cgtgatcttggct

SEQ ID NO: 1780474 - DNA, 22 bp, Homo sapiens
cgtgatgtggaggaagagccac

SEQ ID NO: 1780475 - DNA, 20 bp, Homo sapiens
cgtgcacgtggagagctggt

SEQ ID NO: 1780476 - DNA, 21 bp, Homo sapiens
cgtgcacgtggagagctggtg

SEQ ID NO: 1780477 - DNA, 17 bp, Homo sapiens
cgtgcactctgctaatc

SEQ ID NO: 1780478 - DNA, 12 bp, Homo sapiens
cgtgcactgtga

SEQ ID NO: 1780479 - DNA, 14 bp, Homo sapiens
cgtgcagtatctca

SEQ ID NO: 1780480 - DNA, 17 bp, Homo sapiens
cgtgcatccctgagaca

SEQ ID NO: 1780481 - DNA, 22 bp, Homo sapiens
cgtgcatggctcctgtctggct

SEQ ID NO: 1780482 - DNA, 21 bp, Homo sapiens
cgtgcattggaagaccccacc

SEQ ID NO: 1780483 - DNA, 14 bp, Homo sapiens
cgtgccagcagcct

SEQ ID NO: 1780484 - DNA, 19 bp, Homo sapiens
cgtgccaggcccggggctg

SEQ ID NO: 1780485 - DNA, 22 bp, Homo sapiens
ctaagactcaaatgttctaagt

SEQ ID NO: 1780486 - DNA, 22 bp, Homo sapiens
ctaagacttactctaagatctt

SEQ ID NO: 1780487 - DNA, 16 bp, Homo sapiens
ctaagagaaactgtgt

SEQ ID NO: 1780488 - DNA, 17 bp, Homo sapiens
ctaagagaaactgtgta

SEQ ID NO: 1780489 - DNA, 14 bp, Homo sapiens
ctaagagaaggcct

SEQ ID NO: 1780490 - DNA, 19 bp, Homo sapiens
ctaagagaagttattttct

SEQ ID NO: 1780491 - DNA, 15 bp, Homo sapiens
ctaagagaatgaatt

SEQ ID NO: 1780492 - DNA, 21 bp, Homo sapiens
ctaagagacacatacagagtg

SEQ ID NO: 1780493 - DNA, 19 bp, Homo sapiens
ctaagagacagttctctgt

SEQ ID NO: 1780494 - DNA, 18 bp, Homo sapiens
ctaagagctagcgctgcc

SEQ ID NO: 1780495 - DNA, 22 bp, Homo sapiens
ctaagagtgctgggcattttta

SEQ ID NO: 1780496 - DNA, 16 bp, Homo sapiens
ctaagagtggaggagg

SEQ ID NO: 1780497 - DNA, 19 bp, Homo sapiens
ctaagagtgtcactgagct

SEQ ID NO: 1780498 - DNA, 20 bp, Homo sapiens
ctaagagtgtcactgagctg

SEQ ID NO: 1780499 - DNA, 22 bp, Homo sapiens
ctaagagtgtcactgagctgtg

SEQ ID NO: 1780500 - DNA, 16 bp, Homo sapiens
ctaagatagaaagctg

SEQ ID NO: 1780501 - DNA, 17 bp, Homo sapiens
ctaagatagaaagctgg

SEQ ID NO: 1780502 - DNA, 20 bp, Homo sapiens
ctaagatagaaagctggact

SEQ ID NO: 1780503 - DNA, 12 bp, Homo sapiens
ctaagatcttag

SEQ ID NO: 1780504 - DNA, 17 bp, Homo sapiens
ctaagatcttagattct

SEQ ID NO: 1780505 - DNA, 21 bp, Homo sapiens
ctaagatgagatttgccagca

SEQ ID NO: 1780506 - DNA, 24 bp, Homo sapiens
ctaagatgagatttgccagcacag

SEQ ID NO: 1780507 - DNA, 19 bp, Homo sapiens
ctaagatgtgatattctaa

SEQ ID NO: 1780508 - DNA, 20 bp, Homo sapiens
ctaagatgtgatattctaag

SEQ ID NO: 1780509 - DNA, 19 bp, Homo sapiens
ctaagattacaaatcagaa

SEQ ID NO: 1780510 - DNA, 21 bp, Homo sapiens
ctaagattctaatgatgatca

SEQ ID NO: 1780511 - DNA, 13 bp, Homo sapiens
ctaagattctaga

SEQ ID NO: 1780512 - DNA, 15 bp, Homo sapiens
ctaagattctagatc

SEQ ID NO: 1780513 - DNA, 18 bp, Homo sapiens
ctaagattctagatcaga

SEQ ID NO: 1780514 - DNA, 15 bp, Homo sapiens
ctaagatttctgtct

SEQ ID NO: 1780515 - DNA, 16 bp, Homo sapiens
ctaagcaacagaaata

SEQ ID NO: 1780516 - DNA, 14 bp, Homo sapiens
ctaagcaagatgtt

SEQ ID NO: 1780517 - DNA, 14 bp, Homo sapiens
ctaagcaatgcaaa

SEQ ID NO: 1780518 - DNA, 20 bp, Homo sapiens
ctaagcaatgcaaatgtcta

SEQ ID NO: 1780519 - DNA, 14 bp, Homo sapiens
ctaagcatctaagt

SEQ ID NO: 1780520 - DNA, 18 bp, Homo sapiens
ctaagccagttttcattt

SEQ ID NO: 1780521 - DNA, 16 bp, Homo sapiens
ctaagcccccagggcc

SEQ ID NO: 1780522 - DNA, 18 bp, Homo sapiens
ctaagcccccagggcctc

SEQ ID NO: 1780523 - DNA, 18 bp, Homo sapiens
ctaagccctcgaaccaag

SEQ ID NO: 1780524 - DNA, 16 bp, Homo sapiens
ctaagcctttccataa

SEQ ID NO: 1780525 - DNA, 17 bp, Homo sapiens
ctaagcctttccataag

SEQ ID NO: 1780526 - DNA, 17 bp, Homo sapiens
ctaagctaggaatgaaa

SEQ ID NO: 1780527 - DNA, 23 bp, Homo sapiens
ctaagctgatattatttcttctc

SEQ ID NO: 1780528 - DNA, 19 bp, Homo sapiens
ctaagctggagctcttgga

SEQ ID NO: 1780529 - DNA, 21 bp, Homo sapiens
ctaagctggagctcttggaag

SEQ ID NO: 1780530 - DNA, 24 bp, Homo sapiens
ctaagctggagctcttggaagagc

SEQ ID NO: 1780531 - DNA, 17 bp, Homo sapiens
ctaagctggctctgttt

SEQ ID NO: 1780532 - DNA, 13 bp, Homo sapiens
ctaagcttatttc

SEQ ID NO: 1780533 - DNA, 14 bp, Homo sapiens
ctaaggacacacta

SEQ ID NO: 1780534 - DNA, 16 bp, Homo sapiens
ctaaggacatttccca

SEQ ID NO: 1780535 - DNA, 16 bp, Homo sapiens
ctaaggagcagcggga

SEQ ID NO: 1780536 - DNA, 20 bp, Homo sapiens
ctaaggataatgaaataatc

SEQ ID NO: 1780537 - DNA, 17 bp, Homo sapiens
ctaaggatctctcagga

SEQ ID NO: 1780538 - DNA, 22 bp, Homo sapiens
ctaaggcctaggattctaaaat

SEQ ID NO: 1780539 - DNA, 14 bp, Homo sapiens
ctaaggctcctcct

SEQ ID NO: 1780540 - DNA, 16 bp, Homo sapiens
ctaaggctcctgtttt

SEQ ID NO: 1780541 - DNA, 21 bp, Homo sapiens
ctaaggctctatgagtctaga

SEQ ID NO: 1780542 - DNA, 14 bp, Homo sapiens
ctaaggctctgaga

SEQ ID NO: 1780543 - DNA, 22 bp, Homo sapiens
ctaagggaaagaattgaggaat

SEQ ID NO: 1780544 - DNA, 17 bp, Homo sapiens
ctaagggtcgaaagctc

SEQ ID NO: 1780545 - DNA, 18 bp, Homo sapiens
ctaagggtcgaaagctct

SEQ ID NO: 1780546 - DNA, 19 bp, Homo sapiens
ctaagggtcgaaagctcta

SEQ ID NO: 1780547 - DNA, 21 bp, Homo sapiens
ctaagggtcgaaagctctaga

SEQ ID NO: 1780548 - DNA, 19 bp, Homo sapiens
ctaaggtccggtgttctaa

SEQ ID NO: 1780549 - DNA, 12 bp, Homo sapiens
ctaaggtcctaa

SEQ ID NO: 1780550 - DNA, 13 bp, Homo sapiens
ctaaggtcctaag

SEQ ID NO: 1780551 - DNA, 11 bp, Homo sapiens
ctaaggttcta

SEQ ID NO: 1780552 - DNA, 13 bp, Homo sapiens
ctaaggttctaag

SEQ ID NO: 1780553 - DNA, 17 bp, Homo sapiens
ctaaggttctaaggcct

SEQ ID NO: 1780554 - DNA, 14 bp, Homo sapiens
ctaaggttctcata

SEQ ID NO: 1780555 - DNA, 22 bp, Homo sapiens
ctaagtaaaaccacagcagttg

SEQ ID NO: 1780556 - DNA, 23 bp, Homo sapiens
ctaagtaaaaccacagcagttga

SEQ ID NO: 1780557 - DNA, 17 bp, Homo sapiens
ctaagtaggggcagtga

SEQ ID NO: 1780558 - DNA, 14 bp, Homo sapiens
ctaagtatttccca

SEQ ID NO: 1780559 - DNA, 17 bp, Homo sapiens
ctaagtatttcccagca

SEQ ID NO: 1780560 - DNA, 13 bp, Homo sapiens
ctaagtcaggtaa

SEQ ID NO: 1780561 - DNA, 17 bp, Homo sapiens
ctaagtcaggtaatata

SEQ ID NO: 1780562 - DNA, 19 bp, Homo sapiens
ctaagtccagtgtttcttt

SEQ ID NO: 1780563 - DNA, 18 bp, Homo sapiens
ctaagtccttccacctgc

SEQ ID NO: 1780564 - DNA, 13 bp, Homo sapiens
ctaagtctctgtg

SEQ ID NO: 1780565 - DNA, 14 bp, Homo sapiens
ctaagtctctgtga

SEQ ID NO: 1780566 - DNA, 14 bp, Homo sapiens
ctaagtgaaaaggt

SEQ ID NO: 1780567 - DNA, 11 bp, Homo sapiens
ctaagtgccca

SEQ ID NO: 1780568 - DNA, 15 bp, Homo sapiens
ctaagtgcccaaagt

SEQ ID NO: 1780569 - DNA, 21 bp, Homo sapiens
ctaagtgcttattacatttta

SEQ ID NO: 1780570 - DNA, 14 bp, Homo sapiens
ctaagtggctgcct

SEQ ID NO: 1780571 - DNA, 15 bp, Homo sapiens
ctaagtggctgcctt

SEQ ID NO: 1780572 - DNA, 17 bp, Homo sapiens
ctaagtggctgccttct

SEQ ID NO: 1780573 - DNA, 20 bp, Homo sapiens
ctaagtggctgccttctttc

SEQ ID NO: 1780574 - DNA, 23 bp, Homo sapiens
ctaagtgggcattgccatgtgga

SEQ ID NO: 1780575 - DNA, 21 bp, Homo sapiens
ctaagttataagactctcaca

SEQ ID NO: 1780576 - DNA, 22 bp, Homo sapiens
ctaagttatttactcctcctgc

SEQ ID NO: 1780577 - DNA, 15 bp, Homo sapiens
ctaagttcagttctg

SEQ ID NO: 1780578 - DNA, 15 bp, Homo sapiens
ctaagtttctaagat

SEQ ID NO: 1780579 - DNA, 17 bp, Homo sapiens
ctaagtttctaagattc

SEQ ID NO: 1780580 - DNA, 18 bp, Homo sapiens
ctaagtttctaagattct

SEQ ID NO: 1780581 - DNA, 21 bp, Homo sapiens
ctaagttttagggtacatgtg

SEQ ID NO: 1780582 - DNA, 15 bp, Homo sapiens
ctaataaaataagtg

SEQ ID NO: 1780583 - DNA, 19 bp, Homo sapiens
ctaataaaattcgctttct

SEQ ID NO: 1780584 - DNA, 14 bp, Homo sapiens
ctaataaacactgt

SEQ ID NO: 1780585 - DNA, 12 bp, Homo sapiens
ctaataaacttt

SEQ ID NO: 1780586 - DNA, 14 bp, Homo sapiens
ctaataaactttat

SEQ ID NO: 1780587 - DNA, 17 bp, Homo sapiens
ctaataatttctaatgt

SEQ ID NO: 1780588 - DNA, 18 bp, Homo sapiens
ctaataatttctaatgtt

SEQ ID NO: 1780589 - DNA, 20 bp, Homo sapiens
ctaatacctcttactttgct

SEQ ID NO: 1780590 - DNA, 18 bp, Homo sapiens
ctaatagactaaatgaaa

SEQ ID NO: 1780591 - DNA, 17 bp, Homo sapiens
ctaatagcttttcctgt

SEQ ID NO: 1780592 - DNA, 14 bp, Homo sapiens
ctaatatatacata

SEQ ID NO: 1780593 - DNA, 13 bp, Homo sapiens
ctaatatatatga

SEQ ID NO: 1780594 - DNA, 16 bp, Homo sapiens
ctaatatatattttaa

SEQ ID NO: 1780595 - DNA, 19 bp, Homo sapiens
ctaatatatattttaaggt

SEQ ID NO: 1780596 - DNA, 23 bp, Homo sapiens
ctaatatatattttaaggttgca

SEQ ID NO: 1780597 - DNA, 16 bp, Homo sapiens
ctaatatatttaaaaa

SEQ ID NO: 1780598 - DNA, 15 bp, Homo sapiens
ctaatcacagtgttg

SEQ ID NO: 1780599 - DNA, 15 bp, Homo sapiens
ctaatcaccatgtaa

SEQ ID NO: 1780600 - DNA, 19 bp, Homo sapiens
ctaatcaccatgtaagcac

SEQ ID NO: 1780601 - DNA, 17 bp, Homo sapiens
ctaatcagcattctcac

SEQ ID NO: 1780602 - DNA, 20 bp, Homo sapiens
ctaatcagcattctcactcc

SEQ ID NO: 1780603 - DNA, 21 bp, Homo sapiens
ctaatcagcattctcactcct

SEQ ID NO: 1780604 - DNA, 18 bp, Homo sapiens
ctaatccaggcagatcca

SEQ ID NO: 1780605 - DNA, 15 bp, Homo sapiens
ctaatccccttctcc

SEQ ID NO: 1780606 - DNA, 18 bp, Homo sapiens
ctaatccccttctcccct

SEQ ID NO: 1780607 - DNA, 20 bp, Homo sapiens
ctaatccccttctcccctgc

SEQ ID NO: 1780608 - DNA, 17 bp, Homo sapiens
ctaatccttttccttat

SEQ ID NO: 1780609 - DNA, 22 bp, Homo sapiens
ctaatccttttccttatttgcc

SEQ ID NO: 1780610 - DNA, 21 bp, Homo sapiens
ctaatctcatacctctgacca

SEQ ID NO: 1780611 - DNA, 15 bp, Homo sapiens
ctaatctcttattct

SEQ ID NO: 1780612 - DNA, 20 bp, Homo sapiens
ctaatcttaaccctgtgctg

SEQ ID NO: 1780613 - DNA, 21 bp, Homo sapiens
ctaatcttgaatgtttgtgat

SEQ ID NO: 1780614 - DNA, 11 bp, Homo sapiens
ctaatctttca

SEQ ID NO: 1780615 - DNA, 19 bp, Homo sapiens
ctaatctttcacttgaaag

SEQ ID NO: 1780616 - DNA, 14 bp, Homo sapiens
ctaatgaagagaaa

SEQ ID NO: 1780617 - DNA, 23 bp, Homo sapiens
ctaatgaagggaaaggatatttt

SEQ ID NO: 1780618 - DNA, 19 bp, Homo sapiens
ctaatgatcaaaacatgct

SEQ ID NO: 1780619 - DNA, 16 bp, Homo sapiens
ctaatgcctcttcatt

SEQ ID NO: 1780620 - DNA, 14 bp, Homo sapiens
ctaatgctaagaaa

SEQ ID NO: 1780621 - DNA, 14 bp, Homo sapiens
ctaatggagaagac

SEQ ID NO: 1780622 - DNA, 19 bp, Homo sapiens
ctaatgggtatttaaacaa

SEQ ID NO: 1780623 - DNA, 18 bp, Homo sapiens
ctaatggtagtcagattt

SEQ ID NO: 1780624 - DNA, 19 bp, Homo sapiens
ctaatgtaataactgtgaa

SEQ ID NO: 1780625 - DNA, 19 bp, Homo sapiens
ctaatgtaatcatttatct

SEQ ID NO: 1780626 - DNA, 15 bp, Homo sapiens
ctaatgtctgcagct

SEQ ID NO: 1780627 - DNA, 17 bp, Homo sapiens
ctaatgtttatgagcca

SEQ ID NO: 1780628 - DNA, 20 bp, Homo sapiens
ctaatgtttatgagccagac

SEQ ID NO: 1780629 - DNA, 15 bp, Homo sapiens
ctaatgtttgaacaa

SEQ ID NO: 1780630 - DNA, 21 bp, Homo sapiens
ctaattaatatattaaaattc

SEQ ID NO: 1780631 - DNA, 16 bp, Homo sapiens
ctaattatactacttt

SEQ ID NO: 1780632 - DNA, 14 bp, Homo sapiens
ctaattatatattt

SEQ ID NO: 1780633 - DNA, 17 bp, Homo sapiens
ctaattatatattttgt

SEQ ID NO: 1780634 - DNA, 21 bp, Homo sapiens
ctaattattgtaatgtaataa

SEQ ID NO: 1780635 - DNA, 18 bp, Homo sapiens
ctaattcaaggaatttct

SEQ ID NO: 1780636 - DNA, 22 bp, Homo sapiens
ctaattcacacaaagactcctt

SEQ ID NO: 1780637 - DNA, 15 bp, Homo sapiens
ctaattcacagtgct

SEQ ID NO: 1780638 - DNA, 16 bp, Homo sapiens
ctaattcacagtgctc

SEQ ID NO: 1780639 - DNA, 16 bp, Homo sapiens
ctaattcagtgtcaca

SEQ ID NO: 1780640 - DNA, 20 bp, Homo sapiens
ctaattcccattttgcaaaa

SEQ ID NO: 1780641 - DNA, 21 bp, Homo sapiens
ctaattcccattttgcaaaat

SEQ ID NO: 1780642 - DNA, 16 bp, Homo sapiens
ctaattctattaaagt

SEQ ID NO: 1780643 - DNA, 17 bp, Homo sapiens
ctaattctcttcgctgt

SEQ ID NO: 1780644 - DNA, 16 bp, Homo sapiens
ctaattcttctgtcct

SEQ ID NO: 1780645 - DNA, 14 bp, Homo sapiens
ctaattctttgcaa

SEQ ID NO: 1780646 - DNA, 15 bp, Homo sapiens
ctaattctttgcaaa

SEQ ID NO: 1780647 - DNA, 18 bp, Homo sapiens
ctaattctttgcaaaaat

SEQ ID NO: 1780648 - DNA, 16 bp, Homo sapiens
ctaattgcatctcaaa

SEQ ID NO: 1780649 - DNA, 20 bp, Homo sapiens
ctaattgcatctcaaaatta

SEQ ID NO: 1780650 - DNA, 22 bp, Homo sapiens
ctaattgctgtgtgtcccaggc

SEQ ID NO: 1780651 - DNA, 16 bp, Homo sapiens
ctaattggacttttat

SEQ ID NO: 1780652 - DNA, 21 bp, Homo sapiens
ctaattggtacttttaaaaac

SEQ ID NO: 1780653 - DNA, 20 bp, Homo sapiens
ctaattgtaagtgaaattaa

SEQ ID NO: 1780654 - DNA, 21 bp, Homo sapiens
ctaattgtaagtgaaattaag

SEQ ID NO: 1780655 - DNA, 14 bp, Homo sapiens
ctaatttaaagaga

SEQ ID NO: 1780656 - DNA, 15 bp, Homo sapiens
ctaatttaaagagac

SEQ ID NO: 1780657 - DNA, 19 bp, Homo sapiens
ctaatttcaaaaatataac

SEQ ID NO: 1780658 - DNA, 15 bp, Homo sapiens
ctaatttctcctccc

SEQ ID NO: 1780659 - DNA, 13 bp, Homo sapiens
ctaatttgtggta

SEQ ID NO: 1780660 - DNA, 21 bp, Homo sapiens
ctaatttgtggtaaagtagtt

SEQ ID NO: 1780661 - DNA, 15 bp, Homo sapiens
ctaattttaaataat

SEQ ID NO: 1780662 - DNA, 14 bp, Homo sapiens
cggcagcagccatc

SEQ ID NO: 1780663 - DNA, 14 bp, Homo sapiens
cggcagcgggcgga

SEQ ID NO: 1780664 - DNA, 13 bp, Homo sapiens
cggcagctggggc

SEQ ID NO: 1780665 - DNA, 18 bp, Homo sapiens
cggcaggcctgagaatga

SEQ ID NO: 1780666 - DNA, 18 bp, Homo sapiens
cggcaggctcactgccag

SEQ ID NO: 1780667 - DNA, 23 bp, Homo sapiens
cggcaggctcactgccaggccag

SEQ ID NO: 1780668 - DNA, 17 bp, Homo sapiens
cggcaggggcctggaga

SEQ ID NO: 1780669 - DNA, 18 bp, Homo sapiens
cggcaggggcctggagat

SEQ ID NO: 1780670 - DNA, 19 bp, Homo sapiens
cggcatctcccctagctca

SEQ ID NO: 1780671 - DNA, 21 bp, Homo sapiens
cggcatctcccctagctcacc

SEQ ID NO: 1780672 - DNA, 22 bp, Homo sapiens
cggcatctcccctagctcacca

SEQ ID NO: 1780673 - DNA, 18 bp, Homo sapiens
cggcatgagactcagtgc

SEQ ID NO: 1780674 - DNA, 20 bp, Homo sapiens
cggcatgagactcagtgcag

SEQ ID NO: 1780675 - DNA, 15 bp, Homo sapiens
cggcatgccaggacc

SEQ ID NO: 1780676 - DNA, 20 bp, Homo sapiens
cggccaaggtgccaccaccc

SEQ ID NO: 1780677 - DNA, 11 bp, Homo sapiens
cggccaccctc

SEQ ID NO: 1780678 - DNA, 21 bp, Homo sapiens
cggccacgcactgggccacgg

SEQ ID NO: 1780679 - DNA, 14 bp, Homo sapiens
cggccagcgggcac

SEQ ID NO: 1780680 - DNA, 20 bp, Homo sapiens
cggccagcgggcacagggca

SEQ ID NO: 1780681 - DNA, 18 bp, Homo sapiens
cggccagcgtcccagggt

SEQ ID NO: 1780682 - DNA, 11 bp, Homo sapiens
cggccaggcac

SEQ ID NO: 1780683 - DNA, 13 bp, Homo sapiens
cggccaggcacag

SEQ ID NO: 1780684 - DNA, 16 bp, Homo sapiens
cggccaggcacagggc

SEQ ID NO: 1780685 - DNA, 19 bp, Homo sapiens
cggccaggcacagggcccg

SEQ ID NO: 1780686 - DNA, 14 bp, Homo sapiens
cggccaggcaccca

SEQ ID NO: 1780687 - DNA, 15 bp, Homo sapiens
cggccaggcacccat

SEQ ID NO: 1780688 - DNA, 11 bp, Homo sapiens
cggccaggcat

SEQ ID NO: 1780689 - DNA, 20 bp, Homo sapiens
cggccaggccgcgcccagca

SEQ ID NO: 1780690 - DNA, 22 bp, Homo sapiens
cggccaggccgcgcccagcaga

SEQ ID NO: 1780691 - DNA, 22 bp, Homo sapiens
cggcccaagcccgacttgctgt

SEQ ID NO: 1780692 - DNA, 17 bp, Homo sapiens
cggcccacaattaattt

SEQ ID NO: 1780693 - DNA, 21 bp, Homo sapiens
cggcccactttcctgagctgt

SEQ ID NO: 1780694 - DNA, 13 bp, Homo sapiens
cggcccagtgcca

SEQ ID NO: 1780695 - DNA, 17 bp, Homo sapiens
cggcccagtgccactgc

SEQ ID NO: 1780696 - DNA, 18 bp, Homo sapiens
cggcccagtgccactgcc

SEQ ID NO: 1780697 - DNA, 20 bp, Homo sapiens
cggccccccgcacagccacc

SEQ ID NO: 1780698 - DNA, 21 bp, Homo sapiens
cggccccccgcacagccaccc

SEQ ID NO: 1780699 - DNA, 20 bp, Homo sapiens
cggcccccgcgcgcgtcccc

SEQ ID NO: 1780700 - DNA, 12 bp, Homo sapiens
cggccccctgcc

SEQ ID NO: 1780701 - DNA, 14 bp, Homo sapiens
cggcccggccagcg

SEQ ID NO: 1780702 - DNA, 21 bp, Homo sapiens
cggccctaccagcgcccgctg

SEQ ID NO: 1780703 - DNA, 14 bp, Homo sapiens
cggccctagcattg

SEQ ID NO: 1780704 - DNA, 19 bp, Homo sapiens
cggccctgcagccagctca

SEQ ID NO: 1780705 - DNA, 15 bp, Homo sapiens
cggccctgtgtgcag

SEQ ID NO: 1780706 - DNA, 17 bp, Homo sapiens
cggcccttctgactgtt

SEQ ID NO: 1780707 - DNA, 18 bp, Homo sapiens
cggcccttctgactgttt

SEQ ID NO: 1780708 - DNA, 17 bp, Homo sapiens
cggccgaccaggctgga

SEQ ID NO: 1780709 - DNA, 18 bp, Homo sapiens
cggccgccgccaggactg

SEQ ID NO: 1780710 - DNA, 15 bp, Homo sapiens
cggccgctccaccag

SEQ ID NO: 1780711 - DNA, 15 bp, Homo sapiens
cggccggccctggct

SEQ ID NO: 1780712 - DNA, 16 bp, Homo sapiens
cggccggccctggctt

SEQ ID NO: 1780713 - DNA, 20 bp, Homo sapiens
cggcctaggcacctccccgc

SEQ ID NO: 1780714 - DNA, 15 bp, Homo sapiens
cggcctcagggcgct

SEQ ID NO: 1780715 - DNA, 21 bp, Homo sapiens
cggcctcagggcgctcagacg

SEQ ID NO: 1780716 - DNA, 18 bp, Homo sapiens
cggcctcccacagtgctg

SEQ ID NO: 1780717 - DNA, 17 bp, Homo sapiens
cggcctccgaggctccc

SEQ ID NO: 1780718 - DNA, 20 bp, Homo sapiens
cggcctccgaggctccccgc

SEQ ID NO: 1780719 - DNA, 22 bp, Homo sapiens
cggcctccgtccaggagcctgg

SEQ ID NO: 1780720 - DNA, 17 bp, Homo sapiens
cggcctcctcggagagc

SEQ ID NO: 1780721 - DNA, 22 bp, Homo sapiens
cggcctcctcggagagcagcag

SEQ ID NO: 1780722 - DNA, 17 bp, Homo sapiens
cggcctcggcctcccaa

SEQ ID NO: 1780723 - DNA, 14 bp, Homo sapiens
cggcctctctggcc

SEQ ID NO: 1780724 - DNA, 21 bp, Homo sapiens
cggcctctctggcctcccacc

SEQ ID NO: 1780725 - DNA, 12 bp, Homo sapiens
cggcctcttcca

SEQ ID NO: 1780726 - DNA, 13 bp, Homo sapiens
cggcctcttccac

SEQ ID NO: 1780727 - DNA, 17 bp, Homo sapiens
cggcctcttccacccat

SEQ ID NO: 1780728 - DNA, 22 bp, Homo sapiens
cggcctctttttttcttttctt

SEQ ID NO: 1780729 - DNA, 14 bp, Homo sapiens
cggcctgctcccag

SEQ ID NO: 1780730 - DNA, 20 bp, Homo sapiens
cggccttccgggtctcgcag

SEQ ID NO: 1780731 - DNA, 20 bp, Homo sapiens
cggcgcagagccctccaggc

SEQ ID NO: 1780732 - DNA, 23 bp, Homo sapiens
cggcgcagagccctccaggcctg

SEQ ID NO: 1780733 - DNA, 15 bp, Homo sapiens
cggcgcccccagtgt

SEQ ID NO: 1780734 - DNA, 17 bp, Homo sapiens
cggcgcccccagtgtgc

SEQ ID NO: 1780735 - DNA, 13 bp, Homo sapiens
cggcgcggtggct

SEQ ID NO: 1780736 - DNA, 13 bp, Homo sapiens
cggcgctgcaggt

SEQ ID NO: 1780737 - DNA, 15 bp, Homo sapiens
cggcggaaagcctct

SEQ ID NO: 1780738 - DNA, 15 bp, Homo sapiens
cggcggccacgcact

SEQ ID NO: 1780739 - DNA, 13 bp, Homo sapiens
cggcggccaggca

SEQ ID NO: 1780740 - DNA, 17 bp, Homo sapiens
cggcggccaggcacagg

SEQ ID NO: 1780741 - DNA, 18 bp, Homo sapiens
cggcggccaggcacaggg

SEQ ID NO: 1780742 - DNA, 20 bp, Homo sapiens
cggcggccaggcacagggcc

SEQ ID NO: 1780743 - DNA, 22 bp, Homo sapiens
cggcggccaggcacagggcccg

SEQ ID NO: 1780744 - DNA, 12 bp, Homo sapiens
cggcggcgccgg

SEQ ID NO: 1780745 - DNA, 23 bp, Homo sapiens
cggcgggatcctccacagagagg

SEQ ID NO: 1780746 - DNA, 18 bp, Homo sapiens
cggcgggtgacagctccg

SEQ ID NO: 1780747 - DNA, 18 bp, Homo sapiens
cggcgtcttgcccagcag

SEQ ID NO: 1780748 - DNA, 13 bp, Homo sapiens
cggctacatcagc

SEQ ID NO: 1780749 - DNA, 19 bp, Homo sapiens
cggctcactgcaacctccg

SEQ ID NO: 1780750 - DNA, 21 bp, Homo sapiens
cggctcccggggcagggcagc

SEQ ID NO: 1780751 - DNA, 19 bp, Homo sapiens
cggctcctcggactctgct

SEQ ID NO: 1780752 - DNA, 16 bp, Homo sapiens
cggctcgtgtatttat

SEQ ID NO: 1780753 - DNA, 20 bp, Homo sapiens
cggctcgtgtatttattacc

SEQ ID NO: 1780754 - DNA, 16 bp, Homo sapiens
cggctctcacctggcc

SEQ ID NO: 1780755 - DNA, 11 bp, Homo sapiens
cggctctggag

SEQ ID NO: 1780756 - DNA, 17 bp, Homo sapiens
cggctctgggcctgagg

SEQ ID NO: 1780757 - DNA, 14 bp, Homo sapiens
cggctgaccatgct

SEQ ID NO: 1780758 - DNA, 16 bp, Homo sapiens
cggctgaccatgctca

SEQ ID NO: 1780759 - DNA, 22 bp, Homo sapiens
cggctgaccatgctcatctgct

SEQ ID NO: 1780760 - DNA, 11 bp, Homo sapiens
cggctgagagc

SEQ ID NO: 1780761 - DNA, 20 bp, Homo sapiens
cggctgagagccccagctga

SEQ ID NO: 1780762 - DNA, 14 bp, Homo sapiens
cggctgagcccccc

SEQ ID NO: 1780763 - DNA, 18 bp, Homo sapiens
cggctgagccccccatgc

SEQ ID NO: 1780764 - DNA, 22 bp, Homo sapiens
cggctgagtcatgatctccctg

SEQ ID NO: 1780765 - DNA, 16 bp, Homo sapiens
cggctgatgtggactg

SEQ ID NO: 1780766 - DNA, 20 bp, Homo sapiens
cggctgcagaggccagaggc

SEQ ID NO: 1780767 - DNA, 11 bp, Homo sapiens
cggctgcctgc

SEQ ID NO: 1780768 - DNA, 11 bp, Homo sapiens
cggctgggcct

SEQ ID NO: 1780769 - DNA, 18 bp, Homo sapiens
cggctggggactgctacc

SEQ ID NO: 1780770 - DNA, 14 bp, Homo sapiens
cggctggtcactct

SEQ ID NO: 1780771 - DNA, 23 bp, Homo sapiens
cggctggtcactctgccctctgc

SEQ ID NO: 1780772 - DNA, 23 bp, Homo sapiens
cggctggttttgtaagatgctgg

SEQ ID NO: 1780773 - DNA, 16 bp, Homo sapiens
cggctgtgacgcagcc

SEQ ID NO: 1780774 - DNA, 23 bp, Homo sapiens
cggctgtgattgctgccaggcac

SEQ ID NO: 1780775 - DNA, 19 bp, Homo sapiens
cggcttcatgccagctact

SEQ ID NO: 1780776 - DNA, 15 bp, Homo sapiens
cggcttcctgtccac

SEQ ID NO: 1780777 - DNA, 19 bp, Homo sapiens
ctaattttacatgtttata

SEQ ID NO: 1780778 - DNA, 20 bp, Homo sapiens
ctaattttacatgtttataa

SEQ ID NO: 1780779 - DNA, 17 bp, Homo sapiens
ctaattttctatcagaa

SEQ ID NO: 1780780 - DNA, 17 bp, Homo sapiens
ctaattttgttgaaaat

SEQ ID NO: 1780781 - DNA, 17 bp, Homo sapiens
ctaatttttaagcaaaa

SEQ ID NO: 1780782 - DNA, 22 bp, Homo sapiens
ctaatttttattaattttagtt

SEQ ID NO: 1780783 - DNA, 21 bp, Homo sapiens
ctaatttttggagaaatgtca

SEQ ID NO: 1780784 - DNA, 11 bp, Homo sapiens
ctaatttttgt

SEQ ID NO: 1780785 - DNA, 20 bp, Homo sapiens
ctaatttttgtatttttagt

SEQ ID NO: 1780786 - DNA, 21 bp, Homo sapiens
ctaatttttgtattttttagt

SEQ ID NO: 1780787 - DNA, 14 bp, Homo sapiens
ctaatttttttcct

SEQ ID NO: 1780788 - DNA, 15 bp, Homo sapiens
ctaatttttttcctg

SEQ ID NO: 1780789 - DNA, 13 bp, Homo sapiens
ctaatttttttgt

SEQ ID NO: 1780790 - DNA, 22 bp, Homo sapiens
ctaatttttttttatttttagt

SEQ ID NO: 1780791 - DNA, 18 bp, Homo sapiens
ctacaaaaacacagcaag

SEQ ID NO: 1780792 - DNA, 21 bp, Homo sapiens
ctacaaaacctgatgttaaaa

SEQ ID NO: 1780793 - DNA, 16 bp, Homo sapiens
ctacaaagctttgcta

SEQ ID NO: 1780794 - DNA, 18 bp, Homo sapiens
ctacaaagctttgctaca

SEQ ID NO: 1780795 - DNA, 15 bp, Homo sapiens
ctacaaatttatgca

SEQ ID NO: 1780796 - DNA, 17 bp, Homo sapiens
ctacaaatttatgcatt

SEQ ID NO: 1780797 - DNA, 19 bp, Homo sapiens
ctacaaatttatgcatttc

SEQ ID NO: 1780798 - DNA, 22 bp, Homo sapiens
ctacaaatttatgcatttcatt

SEQ ID NO: 1780799 - DNA, 22 bp, Homo sapiens
ctacaacatcactaatttggct

SEQ ID NO: 1780800 - DNA, 13 bp, Homo sapiens
ctacaaccaagct

SEQ ID NO: 1780801 - DNA, 20 bp, Homo sapiens
ctacaaccaagctctctgca

SEQ ID NO: 1780802 - DNA, 18 bp, Homo sapiens
ctacaaccctaccctggc

SEQ ID NO: 1780803 - DNA, 23 bp, Homo sapiens
ctacaagagcagcctgtggcatc

SEQ ID NO: 1780804 - DNA, 19 bp, Homo sapiens
ctacaagctaaaattagat

SEQ ID NO: 1780805 - DNA, 18 bp, Homo sapiens
ctacaataaaaagaaatt

SEQ ID NO: 1780806 - DNA, 13 bp, Homo sapiens
ctacaatatatat

SEQ ID NO: 1780807 - DNA, 22 bp, Homo sapiens
ctacaatatgtacatttctaag

SEQ ID NO: 1780808 - DNA, 23 bp, Homo sapiens
ctacaatcatggtcaagttccca

SEQ ID NO: 1780809 - DNA, 21 bp, Homo sapiens
ctacaatctctttttgtttgc

SEQ ID NO: 1780810 - DNA, 21 bp, Homo sapiens
ctacaattaatagtttgtcta

SEQ ID NO: 1780811 - DNA, 22 bp, Homo sapiens
ctacaattaatagtttgtctat

SEQ ID NO: 1780812 - DNA, 20 bp, Homo sapiens
ctacacaatacagtattata

SEQ ID NO: 1780813 - DNA, 18 bp, Homo sapiens
ctacacagcacaccagcc

SEQ ID NO: 1780814 - DNA, 12 bp, Homo sapiens
ctacacagcctg

SEQ ID NO: 1780815 - DNA, 17 bp, Homo sapiens
ctacacaggagtcttca

SEQ ID NO: 1780816 - DNA, 21 bp, Homo sapiens
ctacacagtgggaactctgac

SEQ ID NO: 1780817 - DNA, 13 bp, Homo sapiens
ctacaccaatgaa

SEQ ID NO: 1780818 - DNA, 15 bp, Homo sapiens
ctacacccctgtgct

SEQ ID NO: 1780819 - DNA, 16 bp, Homo sapiens
ctacacccctgtgctc

SEQ ID NO: 1780820 - DNA, 15 bp, Homo sapiens
ctacactcacctgca

SEQ ID NO: 1780821 - DNA, 17 bp, Homo sapiens
ctacactccagcctgag

SEQ ID NO: 1780822 - DNA, 23 bp, Homo sapiens
ctacactcttgtaataaaatgtc

SEQ ID NO: 1780823 - DNA, 22 bp, Homo sapiens
ctacagaaatactgctctgaat

SEQ ID NO: 1780824 - DNA, 20 bp, Homo sapiens
ctacagaaattaagatgttg

SEQ ID NO: 1780825 - DNA, 19 bp, Homo sapiens
ctacagaacttcagaaaga

SEQ ID NO: 1780826 - DNA, 20 bp, Homo sapiens
ctacagaacttcagaaagac

SEQ ID NO: 1780827 - DNA, 20 bp, Homo sapiens
ctacagaagtggaagtgctt

SEQ ID NO: 1780828 - DNA, 14 bp, Homo sapiens
ctacagaataatgt

SEQ ID NO: 1780829 - DNA, 14 bp, Homo sapiens
ctacagacctggct

SEQ ID NO: 1780830 - DNA, 16 bp, Homo sapiens
ctacagacctggctct

SEQ ID NO: 1780831 - DNA, 21 bp, Homo sapiens
ctacagacctggctctcagag

SEQ ID NO: 1780832 - DNA, 20 bp, Homo sapiens
ctacagactccatctcttct

SEQ ID NO: 1780833 - DNA, 16 bp, Homo sapiens
ctacagacttctccag

SEQ ID NO: 1780834 - DNA, 14 bp, Homo sapiens
ctacagagctgtgg

SEQ ID NO: 1780835 - DNA, 12 bp, Homo sapiens
ctacagatgtgg

SEQ ID NO: 1780836 - DNA, 20 bp, Homo sapiens
ctacagccgtcccgcgttca

SEQ ID NO: 1780837 - DNA, 21 bp, Homo sapiens
ctacagcctagggcagacaat

SEQ ID NO: 1780838 - DNA, 18 bp, Homo sapiens
ctacagcctgcacacacc

SEQ ID NO: 1780839 - DNA, 18 bp, Homo sapiens
ctacagccttgtccccct

SEQ ID NO: 1780840 - DNA, 18 bp, Homo sapiens
ctacaggaagcaccccat

SEQ ID NO: 1780841 - DNA, 21 bp, Homo sapiens
ctacaggagagggaagagtgc

SEQ ID NO: 1780842 - DNA, 18 bp, Homo sapiens
ctacaggggaaggtggcc

SEQ ID NO: 1780843 - DNA, 22 bp, Homo sapiens
ctacaggggaaggtggcctctg

SEQ ID NO: 1780844 - DNA, 17 bp, Homo sapiens
ctacagtacttccagat

SEQ ID NO: 1780845 - DNA, 18 bp, Homo sapiens
ctacagtagctgctacct

SEQ ID NO: 1780846 - DNA, 23 bp, Homo sapiens
ctacagtgatgattgaattctaa

SEQ ID NO: 1780847 - DNA, 13 bp, Homo sapiens
ctacagtgctgtg

SEQ ID NO: 1780848 - DNA, 14 bp, Homo sapiens
ctacagtggtttta

SEQ ID NO: 1780849 - DNA, 18 bp, Homo sapiens
ctacagttttaactgtgg

SEQ ID NO: 1780850 - DNA, 14 bp, Homo sapiens
ctacatcccagcct

SEQ ID NO: 1780851 - DNA, 19 bp, Homo sapiens
ctacatcccagcctgtggt

SEQ ID NO: 1780852 - DNA, 18 bp, Homo sapiens
ctacatgaaacagaaaca

SEQ ID NO: 1780853 - DNA, 22 bp, Homo sapiens
ctacatgacgggttgtgagact

SEQ ID NO: 1780854 - DNA, 21 bp, Homo sapiens
ctacatgaggaactgtagatg

SEQ ID NO: 1780855 - DNA, 21 bp, Homo sapiens
ctacatgcagcccatgcccac

SEQ ID NO: 1780856 - DNA, 15 bp, Homo sapiens
ctacatgctggggtc

SEQ ID NO: 1780857 - DNA, 18 bp, Homo sapiens
ctacattcctcagctgcc

SEQ ID NO: 1780858 - DNA, 19 bp, Homo sapiens
ctacattcctcagctgcca

SEQ ID NO: 1780859 - DNA, 21 bp, Homo sapiens
ctacattggaagctttgagtt

SEQ ID NO: 1780860 - DNA, 21 bp, Homo sapiens
ctacatttgcagatgttcaaa

SEQ ID NO: 1780861 - DNA, 16 bp, Homo sapiens
ctacatttgtttgtat

SEQ ID NO: 1780862 - DNA, 23 bp, Homo sapiens
ctacatttgtttgtattcatgtt

SEQ ID NO: 1780863 - DNA, 14 bp, Homo sapiens
ctacattttgaggt

SEQ ID NO: 1780864 - DNA, 14 bp, Homo sapiens
ctacattttgcaac

SEQ ID NO: 1780865 - DNA, 20 bp, Homo sapiens
ctaccaaggtcttcttaata

SEQ ID NO: 1780866 - DNA, 13 bp, Homo sapiens
ctaccacaaggaa

SEQ ID NO: 1780867 - DNA, 16 bp, Homo sapiens
ctaccacaaggaaaat

SEQ ID NO: 1780868 - DNA, 17 bp, Homo sapiens
ctaccacagacttgcac

SEQ ID NO: 1780869 - DNA, 15 bp, Homo sapiens
ctaccacagtgtctg

SEQ ID NO: 1780870 - DNA, 15 bp, Homo sapiens
ctaccagagctctat

SEQ ID NO: 1780871 - DNA, 17 bp, Homo sapiens
ctaccagccagcctcag

SEQ ID NO: 1780872 - DNA, 22 bp, Homo sapiens
ctaccagccagcctcagaaggc

SEQ ID NO: 1780873 - DNA, 20 bp, Homo sapiens
ctaccagcgccaaatgttca

SEQ ID NO: 1780874 - DNA, 17 bp, Homo sapiens
ctaccaggatgctaaag

SEQ ID NO: 1780875 - DNA, 15 bp, Homo sapiens
ctaccaggcaaattc

SEQ ID NO: 1780876 - DNA, 19 bp, Homo sapiens
ctaccagtatttagaagcc

SEQ ID NO: 1780877 - DNA, 16 bp, Homo sapiens
ctaccataagtgacac

SEQ ID NO: 1780878 - DNA, 14 bp, Homo sapiens
ctaccatctgcatg

SEQ ID NO: 1780879 - DNA, 15 bp, Homo sapiens
ctaccatctgcatgg

SEQ ID NO: 1780880 - DNA, 13 bp, Homo sapiens
ctaccatttcaga

SEQ ID NO: 1780881 - DNA, 13 bp, Homo sapiens
ctacccaaccact

SEQ ID NO: 1780882 - DNA, 14 bp, Homo sapiens
ctacccaaccactc

SEQ ID NO: 1780883 - DNA, 15 bp, Homo sapiens
ctacccaaccctgcc

SEQ ID NO: 1780884 - DNA, 14 bp, Homo sapiens
ctacccacttctaa

SEQ ID NO: 1780885 - DNA, 22 bp, Homo sapiens
ctacccacttctaaatagcaat

SEQ ID NO: 1780886 - DNA, 18 bp, Homo sapiens
ctacccagcgtggcctcc

SEQ ID NO: 1780887 - DNA, 20 bp, Homo sapiens
ctacccaggaggctgaggtg

SEQ ID NO: 1780888 - DNA, 18 bp, Homo sapiens
ctacccatttacaaataa

SEQ ID NO: 1780889 - DNA, 15 bp, Homo sapiens
ctaccccaaggccag

SEQ ID NO: 1780890 - DNA, 12 bp, Homo sapiens
ctaccccacacc

SEQ ID NO: 1780891 - DNA, 17 bp, Homo sapiens
ctaccccacaccaggcc

SEQ ID NO: 1780892 - DNA, 14 bp, Homo sapiens
ctaccccaccacga

SEQ ID NO: 1780893 - DNA, 12 bp, Homo sapiens
ctaccccagcca

SEQ ID NO: 1780894 - DNA, 14 bp, Homo sapiens
ctaccccagccagg

SEQ ID NO: 1780895 - DNA, 20 bp, Homo sapiens
ctaccccgcagacaccttgg

SEQ ID NO: 1780896 - DNA, 16 bp, Homo sapiens
ctaccccttgattttc

SEQ ID NO: 1780897 - DNA, 14 bp, Homo sapiens
ctacccgagcccag

SEQ ID NO: 1780898 - DNA, 16 bp, Homo sapiens
ctacccgagcccagct

SEQ ID NO: 1780899 - DNA, 18 bp, Homo sapiens
ctaccctagccattcctg

SEQ ID NO: 1780900 - DNA, 13 bp, Homo sapiens
ctaccctcagcct

SEQ ID NO: 1780901 - DNA, 14 bp, Homo sapiens
ctaccctcccaccc

SEQ ID NO: 1780902 - DNA, 16 bp, Homo sapiens
ctaccctcccaccccc

SEQ ID NO: 1780903 - DNA, 16 bp, Homo sapiens
ctaccctcgggcccac

SEQ ID NO: 1780904 - DNA, 19 bp, Homo sapiens
ctaccctcgggcccacctg

SEQ ID NO: 1780905 - DNA, 13 bp, Homo sapiens
ctaccctgagatc

SEQ ID NO: 1780906 - DNA, 19 bp, Homo sapiens
ctaccctgagatctgcaca

SEQ ID NO: 1780907 - DNA, 14 bp, Homo sapiens
ctaccctggcaggg

SEQ ID NO: 1780908 - DNA, 21 bp, Homo sapiens
ctaccctggcagggacctgag

SEQ ID NO: 1780909 - DNA, 16 bp, Homo sapiens
ctaccctttttctcca

SEQ ID NO: 1780910 - DNA, 17 bp, Homo sapiens
ctaccgaagtaaactga

SEQ ID NO: 1780911 - DNA, 15 bp, Homo sapiens
ctaccgctggccctg

SEQ ID NO: 1780912 - DNA, 16 bp, Homo sapiens
ctaccgtcttttcctg

SEQ ID NO: 1780913 - DNA, 15 bp, Homo sapiens
ctaccgtggatctcc

SEQ ID NO: 1780914 - DNA, 16 bp, Homo sapiens
ctaccgtggatctcct

SEQ ID NO: 1780915 - DNA, 23 bp, Homo sapiens
ctacctacgtttgcaccgcctgc

SEQ ID NO: 1780916 - DNA, 16 bp, Homo sapiens
ctacctcacctgggca

SEQ ID NO: 1780917 - DNA, 11 bp, Homo sapiens
ctacctcagcc

SEQ ID NO: 1780918 - DNA, 12 bp, Homo sapiens
ctacctcagcct

SEQ ID NO: 1780919 - DNA, 13 bp, Homo sapiens
ctacctcagcctc

SEQ ID NO: 1780920 - DNA, 13 bp, Homo sapiens
ctacctcaggcag

SEQ ID NO: 1780921 - DNA, 17 bp, Homo sapiens
ctacctcaggcagctca

SEQ ID NO: 1780922 - DNA, 14 bp, Homo sapiens
ctacctccaccctg

SEQ ID NO: 1780923 - DNA, 17 bp, Homo sapiens
ctacctccaccctgcat

SEQ ID NO: 1780924 - DNA, 16 bp, Homo sapiens
ctacctcccttgcctt

SEQ ID NO: 1780925 - DNA, 14 bp, Homo sapiens
ctacctctctgtcc

SEQ ID NO: 1780926 - DNA, 20 bp, Homo sapiens
ctacctctctgtcccttgct

SEQ ID NO: 1780927 - DNA, 13 bp, Homo sapiens
ctacctctgagaa

SEQ ID NO: 1780928 - DNA, 15 bp, Homo sapiens
ctacctctgagaaga

SEQ ID NO: 1780929 - DNA, 23 bp, Homo sapiens
ctacctcttttgagactttgccc

SEQ ID NO: 1780930 - DNA, 14 bp, Homo sapiens
ctacctgagctaaa

SEQ ID NO: 1780931 - DNA, 15 bp, Homo sapiens
ctacctgaggccagg

SEQ ID NO: 1780932 - DNA, 12 bp, Homo sapiens
ctacctgtgcct

SEQ ID NO: 1780933 - DNA, 16 bp, Homo sapiens
ctacctgttcagtgtc

SEQ ID NO: 1780934 - DNA, 21 bp, Homo sapiens
ctacctgttcagtgtcccggg

SEQ ID NO: 1780935 - DNA, 19 bp, Homo sapiens
ctaccttccactctggaac

SEQ ID NO: 1780936 - DNA, 11 bp, Homo sapiens
ctaccttcccc

SEQ ID NO: 1780937 - DNA, 18 bp, Homo sapiens
ctaccttccccagacttg

SEQ ID NO: 1780938 - DNA, 22 bp, Homo sapiens
ctaccttccccagacttgcact

SEQ ID NO: 1780939 - DNA, 23 bp, Homo sapiens
ctaccttccccagacttgcactg

SEQ ID NO: 1780940 - DNA, 16 bp, Homo sapiens
ctacctttcaaagctt

SEQ ID NO: 1780941 - DNA, 19 bp, Homo sapiens
ctacggagggtgggctctg

SEQ ID NO: 1780942 - DNA, 17 bp, Homo sapiens
ctacgggcgctgcagcc

SEQ ID NO: 1780943 - DNA, 13 bp, Homo sapiens
ctactaagaataa

SEQ ID NO: 1780944 - DNA, 21 bp, Homo sapiens
ctactaagaataaataaagaa

SEQ ID NO: 1780945 - DNA, 14 bp, Homo sapiens
ctactaatgatgtt

SEQ ID NO: 1780946 - DNA, 16 bp, Homo sapiens
ctactaccacaaggaa

SEQ ID NO: 1780947 - DNA, 17 bp, Homo sapiens
ctactacccgagcccag

SEQ ID NO: 1780948 - DNA, 19 bp, Homo sapiens
ctactacccgagcccagct

SEQ ID NO: 1780949 - DNA, 20 bp, Homo sapiens
ctactagagatattcttatt

SEQ ID NO: 1780950 - DNA, 16 bp, Homo sapiens
ctactcaaagcaaaag

SEQ ID NO: 1780951 - DNA, 19 bp, Homo sapiens
ctactcagaagcctgaggc

SEQ ID NO: 1780952 - DNA, 15 bp, Homo sapiens
ctactcagcagccct

SEQ ID NO: 1780953 - DNA, 13 bp, Homo sapiens
ctactcaggaggc

SEQ ID NO: 1780954 - DNA, 15 bp, Homo sapiens
ctactcaggaggctg

SEQ ID NO: 1780955 - DNA, 16 bp, Homo sapiens
ctactcaggaggctga

SEQ ID NO: 1780956 - DNA, 20 bp, Homo sapiens
ctactcaggaggctgagaca

SEQ ID NO: 1780957 - DNA, 21 bp, Homo sapiens
ctactcaggaggctgagacag

SEQ ID NO: 1780958 - DNA, 21 bp, Homo sapiens
ctactcagtggggctggcatc

SEQ ID NO: 1780959 - DNA, 21 bp, Homo sapiens
ctactcatacttaagcaaaag

SEQ ID NO: 1780960 - DNA, 12 bp, Homo sapiens
ctactccactgc

SEQ ID NO: 1780961 - DNA, 13 bp, Homo sapiens
ctactccactgcc

SEQ ID NO: 1780962 - DNA, 11 bp, Homo sapiens
ctactccctct

SEQ ID NO: 1780963 - DNA, 14 bp, Homo sapiens
ctactccctgcaga

SEQ ID NO: 1780964 - DNA, 15 bp, Homo sapiens
ctactcctacctcag

SEQ ID NO: 1780965 - DNA, 17 bp, Homo sapiens
ctactcctacctcagcc

SEQ ID NO: 1780966 - DNA, 14 bp, Homo sapiens
ctactcctagaaga

SEQ ID NO: 1780967 - DNA, 18 bp, Homo sapiens
ctactcctagaagaacca

SEQ ID NO: 1780968 - DNA, 15 bp, Homo sapiens
ctactcctctgcagt

SEQ ID NO: 1780969 - DNA, 20 bp, Homo sapiens
ctactcctctgcagtgcctt

SEQ ID NO: 1780970 - DNA, 16 bp, Homo sapiens
ctactcctgtgctctg

SEQ ID NO: 1780971 - DNA, 23 bp, Homo sapiens
ctactcgggaggctgaggcagga

SEQ ID NO: 1780972 - DNA, 21 bp, Homo sapiens
ctactcgggaggctgaggcgg

SEQ ID NO: 1780973 - DNA, 17 bp, Homo sapiens
ctactctaaagaaaaat

SEQ ID NO: 1780974 - DNA, 23 bp, Homo sapiens
ctactctaaagaaaaatgcctgt

SEQ ID NO: 1780975 - DNA, 16 bp, Homo sapiens
ctactctgtccaggcc

SEQ ID NO: 1780976 - DNA, 18 bp, Homo sapiens
ctactctgtccaggccac

SEQ ID NO: 1780977 - DNA, 16 bp, Homo sapiens
ctactctgttccttca

SEQ ID NO: 1780978 - DNA, 22 bp, Homo sapiens
ctactctgttccttcacatcct

SEQ ID NO: 1780979 - DNA, 13 bp, Homo sapiens
ctactgaaacaga

SEQ ID NO: 1780980 - DNA, 20 bp, Homo sapiens
ctactgaaacagatttcata

SEQ ID NO: 1780981 - DNA, 20 bp, Homo sapiens
ctactgaacacatgtgtatg

SEQ ID NO: 1780982 - DNA, 15 bp, Homo sapiens
ctactgaatgtgttt

SEQ ID NO: 1780983 - DNA, 16 bp, Homo sapiens
ctactgaattggcttc

SEQ ID NO: 1780984 - DNA, 14 bp, Homo sapiens
ctactgacatgtgg

SEQ ID NO: 1780985 - DNA, 15 bp, Homo sapiens
ctactgacatgtggg

SEQ ID NO: 1780986 - DNA, 14 bp, Homo sapiens
ctactgaggtgcta

SEQ ID NO: 1780987 - DNA, 17 bp, Homo sapiens
ctactgcactccagcct

SEQ ID NO: 1780988 - DNA, 21 bp, Homo sapiens
ctactgcactttcccccttcc

SEQ ID NO: 1780989 - DNA, 13 bp, Homo sapiens
ctactgcagcacc

SEQ ID NO: 1780990 - DNA, 14 bp, Homo sapiens
ctactgcccacatt

SEQ ID NO: 1780991 - DNA, 22 bp, Homo sapiens
ctactgcccacatttgggctca

SEQ ID NO: 1780992 - DNA, 16 bp, Homo sapiens
ctactgccctcccctt

SEQ ID NO: 1780993 - DNA, 15 bp, Homo sapiens
ctactgctaaatcct

SEQ ID NO: 1780994 - DNA, 21 bp, Homo sapiens
ctactgctcctgtggcaggag

SEQ ID NO: 1780995 - DNA, 23 bp, Homo sapiens
ctactgctgctgctgctgccgcc

SEQ ID NO: 1780996 - DNA, 11 bp, Homo sapiens
ctactgctgtg

SEQ ID NO: 1780997 - DNA, 14 bp, Homo sapiens
ctactggaatggtg

SEQ ID NO: 1780998 - DNA, 21 bp, Homo sapiens
ctactggaatggtgttttgtc

SEQ ID NO: 1780999 - DNA, 18 bp, Homo sapiens
ctactggggaggctgagg

SEQ ID NO: 1781000 - DNA, 19 bp, Homo sapiens
ctactggggaggctgaggc

SEQ ID NO: 1781001 - DNA, 16 bp, Homo sapiens
ctactggtgatgccta

SEQ ID NO: 1781002 - DNA, 23 bp, Homo sapiens
ctactggtgatgcctaattatga

SEQ ID NO: 1781003 - DNA, 23 bp, Homo sapiens
ctactgtctaagcagttttgtaa

SEQ ID NO: 1781004 - DNA, 12 bp, Homo sapiens
ctactgttctaa

SEQ ID NO: 1781005 - DNA, 18 bp, Homo sapiens
ctactgttctaaagctct

SEQ ID NO: 1781006 - DNA, 20 bp, Homo sapiens
ctactgttctaaagctctga

SEQ ID NO: 1781007 - DNA, 22 bp, Homo sapiens
ctacttccctgccggaatgaac

SEQ ID NO: 1781008 - DNA, 13 bp, Homo sapiens
ctacttcctcctc

SEQ ID NO: 1781009 - DNA, 13 bp, Homo sapiens
ctacttctgactt

SEQ ID NO: 1781010 - DNA, 15 bp, Homo sapiens
ctacttctgggaaaa

SEQ ID NO: 1781011 - DNA, 17 bp, Homo sapiens
ctacttctgtaattgtg

SEQ ID NO: 1781012 - DNA, 20 bp, Homo sapiens
ctacttgataatattagtga

SEQ ID NO: 1781013 - DNA, 12 bp, Homo sapiens
ctacttgggagg

SEQ ID NO: 1781014 - DNA, 20 bp, Homo sapiens
ctacttgggaggctgaggca

SEQ ID NO: 1781015 - DNA, 15 bp, Homo sapiens
ctacttggtttgtgt

SEQ ID NO: 1781016 - DNA, 17 bp, Homo sapiens
ctacttgtgactgaagg

SEQ ID NO: 1781017 - DNA, 18 bp, Homo sapiens
ctacttgtgactgaaggg

SEQ ID NO: 1781018 - DNA, 19 bp, Homo sapiens
ctactttataactaacatg

SEQ ID NO: 1781019 - DNA, 13 bp, Homo sapiens
ctactttatgtaa

SEQ ID NO: 1781020 - DNA, 17 bp, Homo sapiens
ctactttatgtaaatca

SEQ ID NO: 1781021 - DNA, 16 bp, Homo sapiens
ctactttcatcttaaa

SEQ ID NO: 1781022 - DNA, 22 bp, Homo sapiens
ctactttcatcttaaactaata

SEQ ID NO: 1781023 - DNA, 23 bp, Homo sapiens
ctactttcatcttaaactaatac

SEQ ID NO: 1781024 - DNA, 13 bp, Homo sapiens
ctactttgcccct

SEQ ID NO: 1781025 - DNA, 20 bp, Homo sapiens
ctactttgcccctttcagta

SEQ ID NO: 1781026 - DNA, 24 bp, Homo sapiens
ctactttggcattgctgcatattt

SEQ ID NO: 1781027 - DNA, 20 bp, Homo sapiens
ctactttgtcctttttgtta

SEQ ID NO: 1781028 - DNA, 21 bp, Homo sapiens
ctagaaaaaagggctgagagg

SEQ ID NO: 1781029 - DNA, 17 bp, Homo sapiens
ctagaaaaataaaatgt

SEQ ID NO: 1781030 - DNA, 24 bp, Homo sapiens
ctagaaaacctctcgcttcctcag

SEQ ID NO: 1781031 - DNA, 22 bp, Homo sapiens
ctagaaaatgagaaaattgtct

SEQ ID NO: 1781032 - DNA, 23 bp, Homo sapiens
ctagaaaatgagaaaattgtctg

SEQ ID NO: 1781033 - DNA, 20 bp, Homo sapiens
ctagaaagttagggggttct

SEQ ID NO: 1781034 - DNA, 15 bp, Homo sapiens
ctagaaataaatgtt

SEQ ID NO: 1781035 - DNA, 13 bp, Homo sapiens
ctagaaatatgat

SEQ ID NO: 1781036 - DNA, 15 bp, Homo sapiens
ctagaaatatgattt

SEQ ID NO: 1781037 - DNA, 20 bp, Homo sapiens
ctagaaattgacacaagtgg

SEQ ID NO: 1781038 - DNA, 19 bp, Homo sapiens
ctagaacacaggcaaaatc

SEQ ID NO: 1781039 - DNA, 22 bp, Homo sapiens
ctagaacacaggcaaaatcctt

SEQ ID NO: 1781040 - DNA, 16 bp, Homo sapiens
ctagaacactaactca

SEQ ID NO: 1781041 - DNA, 22 bp, Homo sapiens
ctagaacactaactcaccagcc

SEQ ID NO: 1781042 - DNA, 22 bp, Homo sapiens
ctagaacatgcacatttatata

SEQ ID NO: 1781043 - DNA, 20 bp, Homo sapiens
ctagaaccaagcttcagagc

SEQ ID NO: 1781044 - DNA, 13 bp, Homo sapiens
ctagaagaaaagc

SEQ ID NO: 1781045 - DNA, 18 bp, Homo sapiens
ctagaagaaccaaatacc

SEQ ID NO: 1781046 - DNA, 22 bp, Homo sapiens
ctagaagaaccaaatacctcaa

SEQ ID NO: 1781047 - DNA, 20 bp, Homo sapiens
ctagaagatgaatacaaaca

SEQ ID NO: 1781048 - DNA, 14 bp, Homo sapiens
ctagaagatgtgta

SEQ ID NO: 1781049 - DNA, 16 bp, Homo sapiens
ctagaagatgtgtaaa

SEQ ID NO: 1781050 - DNA, 11 bp, Homo sapiens
ctagaagcaca

SEQ ID NO: 1781051 - DNA, 16 bp, Homo sapiens
ctagaagcacatgtgt

SEQ ID NO: 1781052 - DNA, 20 bp, Homo sapiens
ctagaagccaagggaaaggg

SEQ ID NO: 1781053 - DNA, 22 bp, Homo sapiens
ctagaaggcttctctccacagt

SEQ ID NO: 1781054 - DNA, 20 bp, Homo sapiens
ctagaaggtctccaagacaa

SEQ ID NO: 1781055 - DNA, 18 bp, Homo sapiens
ctagaagtaagaagagga

SEQ ID NO: 1781056 - DNA, 21 bp, Homo sapiens
ctagaagtatttttgtctctt

SEQ ID NO: 1781057 - DNA, 16 bp, Homo sapiens
ctagaagttactgaat

SEQ ID NO: 1781058 - DNA, 20 bp, Homo sapiens
ctagaagttactgaatgcac

SEQ ID NO: 1781059 - DNA, 14 bp, Homo sapiens
ctagaatacttttt

SEQ ID NO: 1781060 - DNA, 14 bp, Homo sapiens
ctagaatcccagca

SEQ ID NO: 1781061 - DNA, 17 bp, Homo sapiens
ctagaatcccagcagca

SEQ ID NO: 1781062 - DNA, 22 bp, Homo sapiens
ctagaatgtaaagttatgtatt

SEQ ID NO: 1781063 - DNA, 15 bp, Homo sapiens
ctagaatgtggattt

SEQ ID NO: 1781064 - DNA, 16 bp, Homo sapiens
ctagaattctagtgct

SEQ ID NO: 1781065 - DNA, 20 bp, Homo sapiens
ctagaattctagtgctgctg

SEQ ID NO: 1781066 - DNA, 13 bp, Homo sapiens
ctagaatttattc

SEQ ID NO: 1781067 - DNA, 23 bp, Homo sapiens
ctagaatttattcaattcctctg

SEQ ID NO: 1781068 - DNA, 13 bp, Homo sapiens
ctagaattttata

SEQ ID NO: 1781069 - DNA, 17 bp, Homo sapiens
ctagacaacctttctgt

SEQ ID NO: 1781070 - DNA, 18 bp, Homo sapiens
ctagacaacctttctgta

SEQ ID NO: 1781071 - DNA, 19 bp, Homo sapiens
ctagacaacctttctgtag

SEQ ID NO: 1781072 - DNA, 18 bp, Homo sapiens
ctagacaagatattgtac

SEQ ID NO: 1781073 - DNA, 20 bp, Homo sapiens
ctagacaagatattgtacat

SEQ ID NO: 1781074 - DNA, 23 bp, Homo sapiens
ctagacaagatattgtacataaa

SEQ ID NO: 1781075 - DNA, 15 bp, Homo sapiens
ctagacacaatttca

SEQ ID NO: 1781076 - DNA, 16 bp, Homo sapiens
ctagacacaatttcat

SEQ ID NO: 1781077 - DNA, 18 bp, Homo sapiens
ctagacacaatttcattt

SEQ ID NO: 1781078 - DNA, 19 bp, Homo sapiens
ctagacacaatttcatttc

SEQ ID NO: 1781079 - DNA, 14 bp, Homo sapiens
ctagacacatgaag

SEQ ID NO: 1781080 - DNA, 22 bp, Homo sapiens
ctagacacatgaaggtaaataa

SEQ ID NO: 1781081 - DNA, 23 bp, Homo sapiens
ctagacacatgaaggtaaataaa

SEQ ID NO: 1781082 - DNA, 18 bp, Homo sapiens
ctagacaccaaagttcta

SEQ ID NO: 1781083 - DNA, 16 bp, Homo sapiens
ctagacaggaaccctt

SEQ ID NO: 1781084 - DNA, 17 bp, Homo sapiens
ctagacatggaggttct

SEQ ID NO: 1781085 - DNA, 18 bp, Homo sapiens
ctagacatggaggttcta

SEQ ID NO: 1781086 - DNA, 18 bp, Homo sapiens
ctagaccagcagacagag

SEQ ID NO: 1781087 - DNA, 15 bp, Homo sapiens
ctagacccaggtgga

SEQ ID NO: 1781088 - DNA, 23 bp, Homo sapiens
ctagacccaggtggagggcacag

SEQ ID NO: 1781089 - DNA, 17 bp, Homo sapiens
ctagacgcccctcccaa

SEQ ID NO: 1781090 - DNA, 18 bp, Homo sapiens
ctagacgcccctcccaag

SEQ ID NO: 1781091 - DNA, 19 bp, Homo sapiens
ctagactagcaatctcttc

SEQ ID NO: 1781092 - DNA, 13 bp, Homo sapiens
ctagactcctcag

SEQ ID NO: 1781093 - DNA, 17 bp, Homo sapiens
ctagactgttactttgg

SEQ ID NO: 1781094 - DNA, 18 bp, Homo sapiens
ctagagaaatcagctgct

SEQ ID NO: 1781095 - DNA, 12 bp, Homo sapiens
ctagagacacat

SEQ ID NO: 1781096 - DNA, 19 bp, Homo sapiens
ctagagacagtgatgcctg

SEQ ID NO: 1781097 - DNA, 17 bp, Homo sapiens
ctagagacgctgatcca

SEQ ID NO: 1781098 - DNA, 12 bp, Homo sapiens
ctagagagaata

SEQ ID NO: 1781099 - DNA, 21 bp, Homo sapiens
ctagagagaataaattggatt

SEQ ID NO: 1781100 - DNA, 14 bp, Homo sapiens
ctagagataaaaca

SEQ ID NO: 1781101 - DNA, 14 bp, Homo sapiens
ctagagcagggatt

SEQ ID NO: 1781102 - DNA, 16 bp, Homo sapiens
ctagagccgaggggag

SEQ ID NO: 1781103 - DNA, 14 bp, Homo sapiens
ctagagctttcttt

SEQ ID NO: 1781104 - DNA, 22 bp, Homo sapiens
ctagagctttctttcacaaaaa

SEQ ID NO: 1781105 - DNA, 14 bp, Homo sapiens
ctagaggcaagcct

SEQ ID NO: 1781106 - DNA, 16 bp, Homo sapiens
ctagaggcaagcctgg

SEQ ID NO: 1781107 - DNA, 15 bp, Homo sapiens
ctagaggcagggagg

SEQ ID NO: 1781108 - DNA, 19 bp, Homo sapiens
ctagaggcagggaggggac

SEQ ID NO: 1781109 - DNA, 12 bp, Homo sapiens
ctagaggccacc

SEQ ID NO: 1781110 - DNA, 18 bp, Homo sapiens
ctagaggccagccccacc

SEQ ID NO: 1781111 - DNA, 12 bp, Homo sapiens
ctagaggcctga

SEQ ID NO: 1781112 - DNA, 22 bp, Homo sapiens
ctagaggcctgaggatgagctg

SEQ ID NO: 1781113 - DNA, 18 bp, Homo sapiens
ctagaggggcaccttttc

SEQ ID NO: 1781114 - DNA, 16 bp, Homo sapiens
ctagaggtagagaaac

SEQ ID NO: 1781115 - DNA, 14 bp, Homo sapiens
ctagaggtgggcag

SEQ ID NO: 1781116 - DNA, 20 bp, Homo sapiens
ctagaggtgggcagctgggc

SEQ ID NO: 1781117 - DNA, 19 bp, Homo sapiens
ctagaggtgttacagagga

SEQ ID NO: 1781118 - DNA, 20 bp, Homo sapiens
ctagagtccaaggtttaaag

SEQ ID NO: 1781119 - DNA, 19 bp, Homo sapiens
ctagagtcctcactcccag

SEQ ID NO: 1781120 - DNA, 23 bp, Homo sapiens
ctagagtgtagcctaaagggcag

SEQ ID NO: 1781121 - DNA, 19 bp, Homo sapiens
ctagagttcggtctgacag

SEQ ID NO: 1781122 - DNA, 18 bp, Homo sapiens
ctagagtttatacagtgt

SEQ ID NO: 1781123 - DNA, 18 bp, Homo sapiens
ctagagttttatagcctg

SEQ ID NO: 1781124 - DNA, 16 bp, Homo sapiens
ctagagttttatcaac

SEQ ID NO: 1781125 - DNA, 15 bp, Homo sapiens
ctagataaaaagatg

SEQ ID NO: 1781126 - DNA, 21 bp, Homo sapiens
ctagataacgaagtgcactta

SEQ ID NO: 1781127 - DNA, 17 bp, Homo sapiens
ctagatacagaataatg

SEQ ID NO: 1781128 - DNA, 14 bp, Homo sapiens
ctagatactggaaa

SEQ ID NO: 1781129 - DNA, 16 bp, Homo sapiens
ctagataggaggatgg

SEQ ID NO: 1781130 - DNA, 22 bp, Homo sapiens
ctagatcataaggcttcaaaat

SEQ ID NO: 1781131 - DNA, 17 bp, Homo sapiens
ctagatccacacacaga

SEQ ID NO: 1781132 - DNA, 16 bp, Homo sapiens
ctagatcctaagggtc

SEQ ID NO: 1781133 - DNA, 20 bp, Homo sapiens
ctagatcctgcaccccagca

SEQ ID NO: 1781134 - DNA, 22 bp, Homo sapiens
ctagatgacataaaatttacat

SEQ ID NO: 1781135 - DNA, 17 bp, Homo sapiens
ctagatgattttttgaa

SEQ ID NO: 1781136 - DNA, 20 bp, Homo sapiens
ctagatgattttttgaaagt

SEQ ID NO: 1781137 - DNA, 18 bp, Homo sapiens
ctagatggaatggaaaag

SEQ ID NO: 1781138 - DNA, 13 bp, Homo sapiens
ctagatggacctg

SEQ ID NO: 1781139 - DNA, 16 bp, Homo sapiens
ctagatggacctgcct

SEQ ID NO: 1781140 - DNA, 16 bp, Homo sapiens
ctagatgtagtatttt

SEQ ID NO: 1781141 - DNA, 16 bp, Homo sapiens
ctagatgtttaacaaa

SEQ ID NO: 1781142 - DNA, 21 bp, Homo sapiens
ctagatgtttattcttctaga

SEQ ID NO: 1781143 - DNA, 23 bp, Homo sapiens
ctagattaagatctgtgttttag

SEQ ID NO: 1781144 - DNA, 19 bp, Homo sapiens
ctagattaggtagactttg

SEQ ID NO: 1781145 - DNA, 21 bp, Homo sapiens
ctagattaggtagactttgct

SEQ ID NO: 1781146 - DNA, 22 bp, Homo sapiens
ctagattaggtagactttgctt

SEQ ID NO: 1781147 - DNA, 18 bp, Homo sapiens
ctagattcataaatacaa

SEQ ID NO: 1781148 - DNA, 14 bp, Homo sapiens
ctagatttgtcctt

SEQ ID NO: 1781149 - DNA, 16 bp, Homo sapiens
ctagattttaatttat

SEQ ID NO: 1781150 - DNA, 17 bp, Homo sapiens
ctagattttaatttatt

SEQ ID NO: 1781151 - DNA, 18 bp, Homo sapiens
ctagattttaatttattt

SEQ ID NO: 1781152 - DNA, 22 bp, Homo sapiens
ctagattttaatttatttgttt

SEQ ID NO: 1781153 - DNA, 23 bp, Homo sapiens
ctagattttaatttatttgtttc

SEQ ID NO: 1781154 - DNA, 22 bp, Homo sapiens
ctagcaaaacatcttttcctga

SEQ ID NO: 1781155 - DNA, 13 bp, Homo sapiens
ctagcaagaagat

SEQ ID NO: 1781156 - DNA, 17 bp, Homo sapiens
ctagcaattttctttgt

SEQ ID NO: 1781157 - DNA, 22 bp, Homo sapiens
ctagcaattttctttgtttctt

SEQ ID NO: 1781158 - DNA, 17 bp, Homo sapiens
ctagcacaatttgcact

SEQ ID NO: 1781159 - DNA, 21 bp, Homo sapiens
ctagcactttgggaggccaag

SEQ ID NO: 1781160 - DNA, 17 bp, Homo sapiens
ctagcagaaatctagaa

SEQ ID NO: 1781161 - DNA, 15 bp, Homo sapiens
ctagcaggcacagga

SEQ ID NO: 1781162 - DNA, 17 bp, Homo sapiens
ctagcagtaaaagatga

SEQ ID NO: 1781163 - DNA, 17 bp, Homo sapiens
ctagcatgggtattttt

SEQ ID NO: 1781164 - DNA, 18 bp, Homo sapiens
ctagcatgggtattttta

SEQ ID NO: 1781165 - DNA, 23 bp, Homo sapiens
ctagcattgtaaaattatttcat

SEQ ID NO: 1781166 - DNA, 16 bp, Homo sapiens
ctagccaaaccaggac

SEQ ID NO: 1781167 - DNA, 15 bp, Homo sapiens
ctagccacctcccac

SEQ ID NO: 1781168 - DNA, 23 bp, Homo sapiens
ctagccacctcccaccccactcc

SEQ ID NO: 1781169 - DNA, 15 bp, Homo sapiens
ctagccactcctgcc

SEQ ID NO: 1781170 - DNA, 21 bp, Homo sapiens
ctagccagacaaaatttgaga

SEQ ID NO: 1781171 - DNA, 19 bp, Homo sapiens
ctagccagacactctgctc

SEQ ID NO: 1781172 - DNA, 23 bp, Homo sapiens
ctagccagagcccttcactgcca

SEQ ID NO: 1781173 - DNA, 18 bp, Homo sapiens
ctagccagcccctcttcc

SEQ ID NO: 1781174 - DNA, 22 bp, Homo sapiens
ctagccaggaagtacttccacc

SEQ ID NO: 1781175 - DNA, 23 bp, Homo sapiens
ctagccaggaagtacttccacct

SEQ ID NO: 1781176 - DNA, 12 bp, Homo sapiens
ctagccaggagt

SEQ ID NO: 1781177 - DNA, 14 bp, Homo sapiens
ctagccaggagtct

SEQ ID NO: 1781178 - DNA, 15 bp, Homo sapiens
ctagccattcctggt

SEQ ID NO: 1781179 - DNA, 20 bp, Homo sapiens
ctagccattcctggtaccca

SEQ ID NO: 1781180 - DNA, 17 bp, Homo sapiens
ctagcccactccctgcc

SEQ ID NO: 1781181 - DNA, 14 bp, Homo sapiens
ctagcccatggact

SEQ ID NO: 1781182 - DNA, 18 bp, Homo sapiens
ctagccctctcacattta

SEQ ID NO: 1781183 - DNA, 19 bp, Homo sapiens
ctagccctctcacatttat

SEQ ID NO: 1781184 - DNA, 16 bp, Homo sapiens
ctagccctgcggagcc

SEQ ID NO: 1781185 - DNA, 22 bp, Homo sapiens
ctagccctggggtggcgtctgc

SEQ ID NO: 1781186 - DNA, 21 bp, Homo sapiens
ctagccctggttagctgacag

SEQ ID NO: 1781187 - DNA, 14 bp, Homo sapiens
ctagccgacctcag

SEQ ID NO: 1781188 - DNA, 16 bp, Homo sapiens
ctagccgacctcagcc

SEQ ID NO: 1781189 - DNA, 20 bp, Homo sapiens
ctagccgacctcagccttcc

SEQ ID NO: 1781190 - DNA, 20 bp, Homo sapiens
ctagcctgatgagattttta

SEQ ID NO: 1781191 - DNA, 15 bp, Homo sapiens
ctagcctgggccaga

SEQ ID NO: 1781192 - DNA, 17 bp, Homo sapiens
ctagcctgggccagaga

SEQ ID NO: 1781193 - DNA, 21 bp, Homo sapiens
ctagcctgtgcctctgggact

SEQ ID NO: 1781194 - DNA, 22 bp, Homo sapiens
ctagcctgtgcctctgggactg

SEQ ID NO: 1781195 - DNA, 11 bp, Homo sapiens
ctagccttgct

SEQ ID NO: 1781196 - DNA, 16 bp, Homo sapiens
ctagcgatctctcctg

SEQ ID NO: 1781197 - DNA, 18 bp, Homo sapiens
ctagcgatctctcctggc

SEQ ID NO: 1781198 - DNA, 20 bp, Homo sapiens
ctagcgatctctcctggcct

SEQ ID NO: 1781199 - DNA, 14 bp, Homo sapiens
ctagcggagcccag

SEQ ID NO: 1781200 - DNA, 15 bp, Homo sapiens
ctagcggagcccagc

SEQ ID NO: 1781201 - DNA, 20 bp, Homo sapiens
ctagcggagcccagcctggg

SEQ ID NO: 1781202 - DNA, 22 bp, Homo sapiens
ctagctaatgtaataactgtga

SEQ ID NO: 1781203 - DNA, 15 bp, Homo sapiens
ctagctagaaatatg

SEQ ID NO: 1781204 - DNA, 17 bp, Homo sapiens
ctagctagaaatatgat

SEQ ID NO: 1781205 - DNA, 13 bp, Homo sapiens
ctagctcaccagg

SEQ ID NO: 1781206 - DNA, 15 bp, Homo sapiens
ctagctcaccaggcc

SEQ ID NO: 1781207 - DNA, 16 bp, Homo sapiens
ctagctcaccaggcct

SEQ ID NO: 1781208 - DNA, 17 bp, Homo sapiens
ctagctcctgccacatg

SEQ ID NO: 1781209 - DNA, 21 bp, Homo sapiens
ctagctcctgccacatggagc

SEQ ID NO: 1781210 - DNA, 14 bp, Homo sapiens
ctagctcgtgattg

SEQ ID NO: 1781211 - DNA, 20 bp, Homo sapiens
ctagctctatgtttacaaat

SEQ ID NO: 1781212 - DNA, 23 bp, Homo sapiens
ctagctctatgtttacaaatgga

SEQ ID NO: 1781213 - DNA, 14 bp, Homo sapiens
ctagctctttgggc

SEQ ID NO: 1781214 - DNA, 20 bp, Homo sapiens
ctagctgaccccgagaagtg

SEQ ID NO: 1781215 - DNA, 23 bp, Homo sapiens
ctagctgagaagcaatgggtcac

SEQ ID NO: 1781216 - DNA, 19 bp, Homo sapiens
ctagctgcagatgcctctg

SEQ ID NO: 1781217 - DNA, 12 bp, Homo sapiens
ctagctgccact

SEQ ID NO: 1781218 - DNA, 16 bp, Homo sapiens
ctagctgccactttca

SEQ ID NO: 1781219 - DNA, 14 bp, Homo sapiens
ctagctggcaggac

SEQ ID NO: 1781220 - DNA, 24 bp, Homo sapiens
ctagctgtattttttgtatgctta

SEQ ID NO: 1781221 - DNA, 18 bp, Homo sapiens
ctagctgttgagctgttt

SEQ ID NO: 1781222 - DNA, 16 bp, Homo sapiens
ctagcttctgcttttc

SEQ ID NO: 1781223 - DNA, 23 bp, Homo sapiens
ctaggaagagcaggactccaggc

SEQ ID NO: 1781224 - DNA, 16 bp, Homo sapiens
ctaggaagaggagtgg

SEQ ID NO: 1781225 - DNA, 17 bp, Homo sapiens
ctaggaatgaaatcctg

SEQ ID NO: 1781226 - DNA, 15 bp, Homo sapiens
ctaggaattcccagc

SEQ ID NO: 1781227 - DNA, 19 bp, Homo sapiens
ctaggacacagttcctggg

SEQ ID NO: 1781228 - DNA, 20 bp, Homo sapiens
ctaggacacagttcctggga

SEQ ID NO: 1781229 - DNA, 21 bp, Homo sapiens
ctaggaccatggttaagagtc

SEQ ID NO: 1781230 - DNA, 12 bp, Homo sapiens
ctaggactctga

SEQ ID NO: 1781231 - DNA, 13 bp, Homo sapiens
ctaggacttaaaa

SEQ ID NO: 1781232 - DNA, 21 bp, Homo sapiens
ctaggagaaccaaatctggaa

SEQ ID NO: 1781233 - DNA, 22 bp, Homo sapiens
ctaggagacagagccaagcact

SEQ ID NO: 1781234 - DNA, 16 bp, Homo sapiens
ctaggagaccaaggcg

SEQ ID NO: 1781235 - DNA, 20 bp, Homo sapiens
ctaggagagactgaaagcag

SEQ ID NO: 1781236 - DNA, 21 bp, Homo sapiens
ctaggagagactgaaagcagc

SEQ ID NO: 1781237 - DNA, 19 bp, Homo sapiens
ctaggagatatctgaggga

SEQ ID NO: 1781238 - DNA, 21 bp, Homo sapiens
ctaggagatatctgagggagg

SEQ ID NO: 1781239 - DNA, 16 bp, Homo sapiens
ctaggagctggctggc

SEQ ID NO: 1781240 - DNA, 19 bp, Homo sapiens
ctaggagctggctggcagg

SEQ ID NO: 1781241 - DNA, 21 bp, Homo sapiens
ctaggagctggctggcaggtg

SEQ ID NO: 1781242 - DNA, 17 bp, Homo sapiens
ctagtttactgttttga

SEQ ID NO: 1781243 - DNA, 21 bp, Homo sapiens
ctagtttcagtaaataatgaa

SEQ ID NO: 1781244 - DNA, 13 bp, Homo sapiens
ctagtttccagtg

SEQ ID NO: 1781245 - DNA, 14 bp, Homo sapiens
ctagtttccagtgg

SEQ ID NO: 1781246 - DNA, 12 bp, Homo sapiens
ctagtttgcata

SEQ ID NO: 1781247 - DNA, 20 bp, Homo sapiens
ctagtttgcatacttcctgg

SEQ ID NO: 1781248 - DNA, 14 bp, Homo sapiens
ctagttttacagat

SEQ ID NO: 1781249 - DNA, 20 bp, Homo sapiens
ctagttttagttttctctta

SEQ ID NO: 1781250 - DNA, 19 bp, Homo sapiens
ctagttttcagccttggga

SEQ ID NO: 1781251 - DNA, 13 bp, Homo sapiens
ctataaaactctg

SEQ ID NO: 1781252 - DNA, 21 bp, Homo sapiens
ctataaaatagatataaattt

SEQ ID NO: 1781253 - DNA, 14 bp, Homo sapiens
ctataaaattaaat

SEQ ID NO: 1781254 - DNA, 17 bp, Homo sapiens
ctataaaattaaatgcc

SEQ ID NO: 1781255 - DNA, 21 bp, Homo sapiens
ctataaaattaaatgccttgt

SEQ ID NO: 1781256 - DNA, 20 bp, Homo sapiens
ctataaacctgacctccttt

SEQ ID NO: 1781257 - DNA, 19 bp, Homo sapiens
ctataaagagaagacgaaa

SEQ ID NO: 1781258 - DNA, 16 bp, Homo sapiens
ctataaagcagtattt

SEQ ID NO: 1781259 - DNA, 19 bp, Homo sapiens
ctataaagctgttattctt

SEQ ID NO: 1781260 - DNA, 16 bp, Homo sapiens
ctataaatcagtattt

SEQ ID NO: 1781261 - DNA, 17 bp, Homo sapiens
ctataaatgccagagcc

SEQ ID NO: 1781262 - DNA, 18 bp, Homo sapiens
ctataacaactctatttt

SEQ ID NO: 1781263 - DNA, 21 bp, Homo sapiens
ctataagaagccttaatttgc

SEQ ID NO: 1781264 - DNA, 23 bp, Homo sapiens
ctataagggagtaggctgtattt

SEQ ID NO: 1781265 - DNA, 12 bp, Homo sapiens
ctataaggtgcc

SEQ ID NO: 1781266 - DNA, 15 bp, Homo sapiens
ctataaggtgcctca

SEQ ID NO: 1781267 - DNA, 21 bp, Homo sapiens
ctataaggtgctctctttctg

SEQ ID NO: 1781268 - DNA, 12 bp, Homo sapiens
ctataagtgctc

SEQ ID NO: 1781269 - DNA, 14 bp, Homo sapiens
ctataatcattagt

SEQ ID NO: 1781270 - DNA, 21 bp, Homo sapiens
ctataatcattagttttagag

SEQ ID NO: 1781271 - DNA, 17 bp, Homo sapiens
ctataatggaaacattt

SEQ ID NO: 1781272 - DNA, 16 bp, Homo sapiens
ctataatgtaagctct

SEQ ID NO: 1781273 - DNA, 22 bp, Homo sapiens
ctataattccctatcttttagt

SEQ ID NO: 1781274 - DNA, 22 bp, Homo sapiens
ctataatttacctaagattaca

SEQ ID NO: 1781275 - DNA, 15 bp, Homo sapiens
ctatacacacacaca

SEQ ID NO: 1781276 - DNA, 13 bp, Homo sapiens
ctataccaataaa

SEQ ID NO: 1781277 - DNA, 14 bp, Homo sapiens
ctataccaataaag

SEQ ID NO: 1781278 - DNA, 15 bp, Homo sapiens
ctataccaataaagt

SEQ ID NO: 1781279 - DNA, 16 bp, Homo sapiens
ctataccaataaagtg

SEQ ID NO: 1781280 - DNA, 16 bp, Homo sapiens
ctatacccacccagaa

SEQ ID NO: 1781281 - DNA, 15 bp, Homo sapiens
ctatacctgagcctc

SEQ ID NO: 1781282 - DNA, 17 bp, Homo sapiens
ctatactgcatactttt

SEQ ID NO: 1781283 - DNA, 13 bp, Homo sapiens
ctatactgcctct

SEQ ID NO: 1781284 - DNA, 14 bp, Homo sapiens
ctatactttacagg

SEQ ID NO: 1781285 - DNA, 15 bp, Homo sapiens
ctatactttgttctg

SEQ ID NO: 1781286 - DNA, 14 bp, Homo sapiens
ctatagagaggggg

SEQ ID NO: 1781287 - DNA, 15 bp, Homo sapiens
ctatagctacatgtt

SEQ ID NO: 1781288 - DNA, 12 bp, Homo sapiens
ctataggcagct

SEQ ID NO: 1781289 - DNA, 17 bp, Homo sapiens
ctatagggatgaacttt

SEQ ID NO: 1781290 - DNA, 15 bp, Homo sapiens
ctataggtgctacaa

SEQ ID NO: 1781291 - DNA, 13 bp, Homo sapiens
ctatagtcccagc

SEQ ID NO: 1781292 - DNA, 13 bp, Homo sapiens
ctatagttctaga

SEQ ID NO: 1781293 - DNA, 19 bp, Homo sapiens
ctatataagacaagaactc

SEQ ID NO: 1781294 - DNA, 22 bp, Homo sapiens
ctatatagttccttgccttaat

SEQ ID NO: 1781295 - DNA, 16 bp, Homo sapiens
ctatatagtttattga

SEQ ID NO: 1781296 - DNA, 22 bp, Homo sapiens
ctatatataaaacggtgctgtg

SEQ ID NO: 1781297 - DNA, 17 bp, Homo sapiens
ctatatatacatatgta

SEQ ID NO: 1781298 - DNA, 14 bp, Homo sapiens
ctatatatataaat

SEQ ID NO: 1781299 - DNA, 20 bp, Homo sapiens
ctatatatcttttgtaagac

SEQ ID NO: 1781300 - DNA, 15 bp, Homo sapiens
ctatatcctgtgact

SEQ ID NO: 1781301 - DNA, 19 bp, Homo sapiens
ctatatctatttgagagca

SEQ ID NO: 1781302 - DNA, 14 bp, Homo sapiens
ctatatctgagaga

SEQ ID NO: 1781303 - DNA, 19 bp, Homo sapiens
ctatatctgtatataaaat

SEQ ID NO: 1781304 - DNA, 15 bp, Homo sapiens
ctatatgaatttaaa

SEQ ID NO: 1781305 - DNA, 23 bp, Homo sapiens
ctatatgaatttaaatataattc

SEQ ID NO: 1781306 - DNA, 19 bp, Homo sapiens
ctatatgtagtgcattttt

SEQ ID NO: 1781307 - DNA, 22 bp, Homo sapiens
ctatatgtagtgcatttttaaa

SEQ ID NO: 1781308 - DNA, 19 bp, Homo sapiens
ctatatgtgaaacattttt

SEQ ID NO: 1781309 - DNA, 21 bp, Homo sapiens
ctatatgtgaaacattttttc

SEQ ID NO: 1781310 - DNA, 22 bp, Homo sapiens
ctatatgtgaaacattttttct

SEQ ID NO: 1781311 - DNA, 17 bp, Homo sapiens
ctatattatgtcttctt

SEQ ID NO: 1781312 - DNA, 23 bp, Homo sapiens
ctatattggtttatgtagtcagt

SEQ ID NO: 1781313 - DNA, 13 bp, Homo sapiens
ctatatttacatg

SEQ ID NO: 1781314 - DNA, 14 bp, Homo sapiens
ctatatttcatatt

SEQ ID NO: 1781315 - DNA, 22 bp, Homo sapiens
ctatatttgctagactctagac

SEQ ID NO: 1781316 - DNA, 12 bp, Homo sapiens
ctatatttgggc

SEQ ID NO: 1781317 - DNA, 15 bp, Homo sapiens
ctatatttgtcttcc

SEQ ID NO: 1781318 - DNA, 13 bp, Homo sapiens
ctatattttcctg

SEQ ID NO: 1781319 - DNA, 18 bp, Homo sapiens
ctatattttttcttttga

SEQ ID NO: 1781320 - DNA, 22 bp, Homo sapiens
ctatattttttcttttgacata

SEQ ID NO: 1781321 - DNA, 19 bp, Homo sapiens
ctatcaacaataaaatttt

SEQ ID NO: 1781322 - DNA, 19 bp, Homo sapiens
ctatcaacctaagcaacag

SEQ ID NO: 1781323 - DNA, 13 bp, Homo sapiens
ctatcacctgtca

SEQ ID NO: 1781324 - DNA, 14 bp, Homo sapiens
ctatcagaaataca

SEQ ID NO: 1781325 - DNA, 19 bp, Homo sapiens
ctatcagaaatacaaaaaa

SEQ ID NO: 1781326 - DNA, 16 bp, Homo sapiens
ctatcagaagttgtat

SEQ ID NO: 1781327 - DNA, 13 bp, Homo sapiens
ctatcagccttgc

SEQ ID NO: 1781328 - DNA, 13 bp, Homo sapiens
ctatcattccaat

SEQ ID NO: 1781329 - DNA, 18 bp, Homo sapiens
ctatcattgcttcctcct

SEQ ID NO: 1781330 - DNA, 16 bp, Homo sapiens
ctatccacccagccca

SEQ ID NO: 1781331 - DNA, 22 bp, Homo sapiens
ctatccagtggaaggagaattt

SEQ ID NO: 1781332 - DNA, 16 bp, Homo sapiens
ctatccatctcctggt

SEQ ID NO: 1781333 - DNA, 16 bp, Homo sapiens
ctatcccaatcaaaga

SEQ ID NO: 1781334 - DNA, 23 bp, Homo sapiens
ctatcccaatcaaagaattacag

SEQ ID NO: 1781335 - DNA, 14 bp, Homo sapiens
ctatccccaagctg

SEQ ID NO: 1781336 - DNA, 19 bp, Homo sapiens
ctatccccatctccctgcc

SEQ ID NO: 1781337 - DNA, 22 bp, Homo sapiens
ctatccccatctccctgcctgg

SEQ ID NO: 1781338 - DNA, 14 bp, Homo sapiens
ctatccgctgccag

SEQ ID NO: 1781339 - DNA, 22 bp, Homo sapiens
ctatccgctgccagccttgagc

SEQ ID NO: 1781340 - DNA, 17 bp, Homo sapiens
ctatcctagtcttcaca

SEQ ID NO: 1781341 - DNA, 15 bp, Homo sapiens
ctatcctgattccaa

SEQ ID NO: 1781342 - DNA, 16 bp, Homo sapiens
ctatcctgattccaaa

SEQ ID NO: 1781343 - DNA, 21 bp, Homo sapiens
ctatccttttgcctgcaggtc

SEQ ID NO: 1781344 - DNA, 22 bp, Homo sapiens
ctatcgaaatgacggtgttaat

SEQ ID NO: 1781345 - DNA, 14 bp, Homo sapiens
ctatcgagtttgca

SEQ ID NO: 1781346 - DNA, 15 bp, Homo sapiens
ctatcgccctccttt

SEQ ID NO: 1781347 - DNA, 18 bp, Homo sapiens
ctatcgccctcctttccc

SEQ ID NO: 1781348 - DNA, 19 bp, Homo sapiens
ctatcgccctcctttccct

SEQ ID NO: 1781349 - DNA, 15 bp, Homo sapiens
ctatctatcttccaa

SEQ ID NO: 1781350 - DNA, 21 bp, Homo sapiens
ctatctccagcggccctgtca

SEQ ID NO: 1781351 - DNA, 23 bp, Homo sapiens
ctatctccgttccatctgggctt

SEQ ID NO: 1781352 - DNA, 15 bp, Homo sapiens
ctatctgcaaatagt

SEQ ID NO: 1781353 - DNA, 20 bp, Homo sapiens
ctatctgcaaatagtttcaa

SEQ ID NO: 1781354 - DNA, 18 bp, Homo sapiens
ctatctgcttatgcagtt

SEQ ID NO: 1781355 - DNA, 12 bp, Homo sapiens
ctatctgtattc

SEQ ID NO: 1781356 - DNA, 17 bp, Homo sapiens
ctatctgtattcccaaa

SEQ ID NO: 1781357 - DNA, 11 bp, Homo sapiens
ctatctgtctg

SEQ ID NO: 1781358 - DNA, 14 bp, Homo sapiens
ctatctgtctggtg

SEQ ID NO: 1781359 - DNA, 22 bp, Homo sapiens
ctaggagctggctggcaggtgt

SEQ ID NO: 1781360 - DNA, 16 bp, Homo sapiens
ctaggaggaaaaagaa

SEQ ID NO: 1781361 - DNA, 17 bp, Homo sapiens
ctaggaggaaaaagaaa

SEQ ID NO: 1781362 - DNA, 20 bp, Homo sapiens
ctaggaggagctagtaggaa

SEQ ID NO: 1781363 - DNA, 15 bp, Homo sapiens
ctaggaggctggcca

SEQ ID NO: 1781364 - DNA, 16 bp, Homo sapiens
ctaggaggctggccaa

SEQ ID NO: 1781365 - DNA, 19 bp, Homo sapiens
ctaggagggagccttgtga

SEQ ID NO: 1781366 - DNA, 21 bp, Homo sapiens
ctaggatgctgcagcagagtg

SEQ ID NO: 1781367 - DNA, 14 bp, Homo sapiens
ctaggatggttctg

SEQ ID NO: 1781368 - DNA, 16 bp, Homo sapiens
ctaggatggttctgtg

SEQ ID NO: 1781369 - DNA, 13 bp, Homo sapiens
ctaggattctaaa

SEQ ID NO: 1781370 - DNA, 11 bp, Homo sapiens
ctaggcacctc

SEQ ID NO: 1781371 - DNA, 23 bp, Homo sapiens
ctaggcacctccccgctctccct

SEQ ID NO: 1781372 - DNA, 20 bp, Homo sapiens
ctaggcactgtagttctaag

SEQ ID NO: 1781373 - DNA, 14 bp, Homo sapiens
ctaggcatcccagg

SEQ ID NO: 1781374 - DNA, 19 bp, Homo sapiens
ctaggcatcccaggggacc

SEQ ID NO: 1781375 - DNA, 22 bp, Homo sapiens
ctaggcattgcaggaccttggg

SEQ ID NO: 1781376 - DNA, 19 bp, Homo sapiens
ctaggccaaatgcacaagc

SEQ ID NO: 1781377 - DNA, 20 bp, Homo sapiens
ctaggccaaatgcacaagct

SEQ ID NO: 1781378 - DNA, 15 bp, Homo sapiens
ctaggccactcctcc

SEQ ID NO: 1781379 - DNA, 16 bp, Homo sapiens
ctaggccccagaggcc

SEQ ID NO: 1781380 - DNA, 18 bp, Homo sapiens
ctaggccccagaggccct

SEQ ID NO: 1781381 - DNA, 19 bp, Homo sapiens
ctaggccccagaggccctg

SEQ ID NO: 1781382 - DNA, 15 bp, Homo sapiens
ctaggcccccaaatt

SEQ ID NO: 1781383 - DNA, 15 bp, Homo sapiens
ctaggcccccacttg

SEQ ID NO: 1781384 - DNA, 16 bp, Homo sapiens
ctaggcccccacttgc

SEQ ID NO: 1781385 - DNA, 19 bp, Homo sapiens
ctaggcccccacttgcctc

SEQ ID NO: 1781386 - DNA, 22 bp, Homo sapiens
ctaggcccccacttgcctcttc

SEQ ID NO: 1781387 - DNA, 15 bp, Homo sapiens
ctaggcccctcctag

SEQ ID NO: 1781388 - DNA, 17 bp, Homo sapiens
ctaggcccctcctagac

SEQ ID NO: 1781389 - DNA, 21 bp, Homo sapiens
ctaggcccctcctagacccag

SEQ ID NO: 1781390 - DNA, 19 bp, Homo sapiens
ctaggcctggcatggcacc

SEQ ID NO: 1781391 - DNA, 20 bp, Homo sapiens
ctaggcctggcatggcacct

SEQ ID NO: 1781392 - DNA, 17 bp, Homo sapiens
ctaggcgcgatggctgt

SEQ ID NO: 1781393 - DNA, 13 bp, Homo sapiens
ctaggctccaccc

SEQ ID NO: 1781394 - DNA, 22 bp, Homo sapiens
ctaggctcttatgtgtgccttt

SEQ ID NO: 1781395 - DNA, 13 bp, Homo sapiens
ctaggctgccccg

SEQ ID NO: 1781396 - DNA, 23 bp, Homo sapiens
ctaggctgccccgggtccccagc

SEQ ID NO: 1781397 - DNA, 16 bp, Homo sapiens
ctaggctggaagagcc

SEQ ID NO: 1781398 - DNA, 19 bp, Homo sapiens
ctaggctggaagagccaaa

SEQ ID NO: 1781399 - DNA, 16 bp, Homo sapiens
ctagggaaatttttca

SEQ ID NO: 1781400 - DNA, 19 bp, Homo sapiens
ctagggactgccaggctgt

SEQ ID NO: 1781401 - DNA, 14 bp, Homo sapiens
ctagggagagaccc

SEQ ID NO: 1781402 - DNA, 15 bp, Homo sapiens
ctagggattcaggct

SEQ ID NO: 1781403 - DNA, 20 bp, Homo sapiens
ctagggattcaggctgcttg

SEQ ID NO: 1781404 - DNA, 14 bp, Homo sapiens
ctagggcacccctt

SEQ ID NO: 1781405 - DNA, 13 bp, Homo sapiens
ctagggcagacaa

SEQ ID NO: 1781406 - DNA, 19 bp, Homo sapiens
ctagggttaggaggtcctt

SEQ ID NO: 1781407 - DNA, 19 bp, Homo sapiens
ctaggtacgatgacagtgt

SEQ ID NO: 1781408 - DNA, 16 bp, Homo sapiens
ctaggtaggaagagcc

SEQ ID NO: 1781409 - DNA, 13 bp, Homo sapiens
ctaggtctccagt

SEQ ID NO: 1781410 - DNA, 14 bp, Homo sapiens
ctaggtgcccaggg

SEQ ID NO: 1781411 - DNA, 19 bp, Homo sapiens
ctaggtgcccagggccagt

SEQ ID NO: 1781412 - DNA, 22 bp, Homo sapiens
ctaggtgtccccaacgtcccct

SEQ ID NO: 1781413 - DNA, 17 bp, Homo sapiens
ctaggtgtttcaacaga

SEQ ID NO: 1781414 - DNA, 13 bp, Homo sapiens
ctaggttctaaaa

SEQ ID NO: 1781415 - DNA, 21 bp, Homo sapiens
ctaggttggacagcccccttc

SEQ ID NO: 1781416 - DNA, 21 bp, Homo sapiens
ctaggtttcagcaacaagact

SEQ ID NO: 1781417 - DNA, 22 bp, Homo sapiens
ctaggtttttcctactgtcctc

SEQ ID NO: 1781418 - DNA, 13 bp, Homo sapiens
ctagtaagaagac

SEQ ID NO: 1781419 - DNA, 20 bp, Homo sapiens
ctagtaatatatttaaaggg

SEQ ID NO: 1781420 - DNA, 16 bp, Homo sapiens
ctagtactatttctta

SEQ ID NO: 1781421 - DNA, 16 bp, Homo sapiens
ctagtactctctgctc

SEQ ID NO: 1781422 - DNA, 22 bp, Homo sapiens
ctagtacttgggagacctgtaa

SEQ ID NO: 1781423 - DNA, 16 bp, Homo sapiens
ctagtagcaatgtgcc

SEQ ID NO: 1781424 - DNA, 18 bp, Homo sapiens
ctagtagcaatgtgcctt

SEQ ID NO: 1781425 - DNA, 18 bp, Homo sapiens
ctagtaggaatgtacatg

SEQ ID NO: 1781426 - DNA, 23 bp, Homo sapiens
ctagtaggcagcaaaagaccaaa

SEQ ID NO: 1781427 - DNA, 18 bp, Homo sapiens
ctagtcacaaagactcct

SEQ ID NO: 1781428 - DNA, 18 bp, Homo sapiens
ctagtcacataaatggat

SEQ ID NO: 1781429 - DNA, 19 bp, Homo sapiens
ctagtcaccgacagcggcc

SEQ ID NO: 1781430 - DNA, 23 bp, Homo sapiens
ctagtcaccgacagcggccttga

SEQ ID NO: 1781431 - DNA, 21 bp, Homo sapiens
ctagtcacgcatgcagtgttg

SEQ ID NO: 1781432 - DNA, 18 bp, Homo sapiens
ctagtcactggcagcctg

SEQ ID NO: 1781433 - DNA, 20 bp, Homo sapiens
ctagtcactggcagcctgca

SEQ ID NO: 1781434 - DNA, 22 bp, Homo sapiens
ctagtcccccaaagggcctcct

SEQ ID NO: 1781435 - DNA, 15 bp, Homo sapiens
ctagtcccttcccct

SEQ ID NO: 1781436 - DNA, 22 bp, Homo sapiens
ctagtcccttcccctccctggc

SEQ ID NO: 1781437 - DNA, 17 bp, Homo sapiens
ctagtctctgatttgca

SEQ ID NO: 1781438 - DNA, 20 bp, Homo sapiens
ctagtcttcccttacctcaa

SEQ ID NO: 1781439 - DNA, 19 bp, Homo sapiens
ctagtgaaagaggcagctt

SEQ ID NO: 1781440 - DNA, 19 bp, Homo sapiens
ctagtgaatttctgaaaga

SEQ ID NO: 1781441 - DNA, 20 bp, Homo sapiens
ctagtgaccccttccctgtc

SEQ ID NO: 1781442 - DNA, 19 bp, Homo sapiens
ctagtgacttgtgtcccat

SEQ ID NO: 1781443 - DNA, 19 bp, Homo sapiens
ctagtgagtcagcaccttg

SEQ ID NO: 1781444 - DNA, 19 bp, Homo sapiens
ctagtgatacactgtatct

SEQ ID NO: 1781445 - DNA, 21 bp, Homo sapiens
ctagtgatacactgtatctaa

SEQ ID NO: 1781446 - DNA, 15 bp, Homo sapiens
ctagtgatggtcaga

SEQ ID NO: 1781447 - DNA, 16 bp, Homo sapiens
ctagtgcagctgaaat

SEQ ID NO: 1781448 - DNA, 16 bp, Homo sapiens
ctagtgccccagactg

SEQ ID NO: 1781449 - DNA, 18 bp, Homo sapiens
ctagtgccctccacagcc

SEQ ID NO: 1781450 - DNA, 18 bp, Homo sapiens
ctagtggggtctccctct

SEQ ID NO: 1781451 - DNA, 20 bp, Homo sapiens
ctagtggggtgaacagctgg

SEQ ID NO: 1781452 - DNA, 21 bp, Homo sapiens
ctagtgtaacactgcaagaag

SEQ ID NO: 1781453 - DNA, 23 bp, Homo sapiens
ctagtgtacctcctctcagtgtt

SEQ ID NO: 1781454 - DNA, 21 bp, Homo sapiens
ctagtgtagagcaagccagtg

SEQ ID NO: 1781455 - DNA, 18 bp, Homo sapiens
ctagtgtgagtggcagcc

SEQ ID NO: 1781456 - DNA, 19 bp, Homo sapiens
ctagtgtggtctgtaatat

SEQ ID NO: 1781457 - DNA, 15 bp, Homo sapiens
ctagtgtgtgtgctt

SEQ ID NO: 1781458 - DNA, 18 bp, Homo sapiens
ctagttaaagaaaggaaa

SEQ ID NO: 1781459 - DNA, 21 bp, Homo sapiens
ctagttaacctagaagtattt

SEQ ID NO: 1781460 - DNA, 20 bp, Homo sapiens
ctagttaaggtgtgcaaaga

SEQ ID NO: 1781461 - DNA, 19 bp, Homo sapiens
ctagttagcatccaggctg

SEQ ID NO: 1781462 - DNA, 20 bp, Homo sapiens
ctagttcagacactttggaa

SEQ ID NO: 1781463 - DNA, 12 bp, Homo sapiens
ctagttcatcca

SEQ ID NO: 1781464 - DNA, 19 bp, Homo sapiens
ctagttcatccaatcctca

SEQ ID NO: 1781465 - DNA, 21 bp, Homo sapiens
ctagttcatccaatcctcact

SEQ ID NO: 1781466 - DNA, 22 bp, Homo sapiens
ctagttccagaaaacctctcct

SEQ ID NO: 1781467 - DNA, 16 bp, Homo sapiens
ctagttctaacagtga

SEQ ID NO: 1781468 - DNA, 12 bp, Homo sapiens
ctagttctagat

SEQ ID NO: 1781469 - DNA, 13 bp, Homo sapiens
ctagttctagatg

SEQ ID NO: 1781470 - DNA, 16 bp, Homo sapiens
ctagttctgctgccct

SEQ ID NO: 1781471 - DNA, 21 bp, Homo sapiens
ctagttgccctctacctgact

SEQ ID NO: 1781472 - DNA, 20 bp, Homo sapiens
ctagttgggagagttggaga

SEQ ID NO: 1781473 - DNA, 17 bp, Homo sapiens
ctagttggggagctaag

SEQ ID NO: 1781474 - DNA, 16 bp, Homo sapiens
ctatctgtctggtggc

SEQ ID NO: 1781475 - DNA, 12 bp, Homo sapiens
ctatctgtgcta

SEQ ID NO: 1781476 - DNA, 13 bp, Homo sapiens
ctatcttccaaat

SEQ ID NO: 1781477 - DNA, 21 bp, Homo sapiens
ctatcttggagagctggggac

SEQ ID NO: 1781478 - DNA, 18 bp, Homo sapiens
ctatgaagtatataatgg

SEQ ID NO: 1781479 - DNA, 21 bp, Homo sapiens
ctatgaagttgctgtttattt

SEQ ID NO: 1781480 - DNA, 20 bp, Homo sapiens
ctatgaatctattatactgt

SEQ ID NO: 1781481 - DNA, 17 bp, Homo sapiens
ctatgacaaattcaaga

SEQ ID NO: 1781482 - DNA, 16 bp, Homo sapiens
ctatgactacattttg

SEQ ID NO: 1781483 - DNA, 11 bp, Homo sapiens
ctatgagaaaa

SEQ ID NO: 1781484 - DNA, 15 bp, Homo sapiens
ctatgagtctagatg

SEQ ID NO: 1781485 - DNA, 16 bp, Homo sapiens
ctatgagtctagatgt

SEQ ID NO: 1781486 - DNA, 17 bp, Homo sapiens
ctatgagtctagatgtt

SEQ ID NO: 1781487 - DNA, 19 bp, Homo sapiens
ctatgagtctagatgttta

SEQ ID NO: 1781488 - DNA, 15 bp, Homo sapiens
ctatgagttggactt

SEQ ID NO: 1781489 - DNA, 15 bp, Homo sapiens
ctatgatcacagtga

SEQ ID NO: 1781490 - DNA, 13 bp, Homo sapiens
ctatgatggtgac

SEQ ID NO: 1781491 - DNA, 14 bp, Homo sapiens
ctatgatgtttctt

SEQ ID NO: 1781492 - DNA, 20 bp, Homo sapiens
ctatgatgtttcttttgcaa

SEQ ID NO: 1781493 - DNA, 18 bp, Homo sapiens
ctatgcacatatggactc

SEQ ID NO: 1781494 - DNA, 19 bp, Homo sapiens
ctatgcatggtgccccagg

SEQ ID NO: 1781495 - DNA, 22 bp, Homo sapiens
ctatgcatggtgccccaggacc

SEQ ID NO: 1781496 - DNA, 19 bp, Homo sapiens
ctatgccagctcagtccca

SEQ ID NO: 1781497 - DNA, 18 bp, Homo sapiens
ctatgccgtcttctgccc

SEQ ID NO: 1781498 - DNA, 18 bp, Homo sapiens
ctatgcctgtatttccaa

SEQ ID NO: 1781499 - DNA, 23 bp, Homo sapiens
ctatgcggaggaaagcaagtgtt

SEQ ID NO: 1781500 - DNA, 21 bp, Homo sapiens
ctatgctaaacctcctgcctc

SEQ ID NO: 1781501 - DNA, 14 bp, Homo sapiens
ctatgctgcttcca

SEQ ID NO: 1781502 - DNA, 20 bp, Homo sapiens
ctatgctggtagatgctgag

SEQ ID NO: 1781503 - DNA, 19 bp, Homo sapiens
ctatggaacataaagttgt

SEQ ID NO: 1781504 - DNA, 22 bp, Homo sapiens
ctatggaacataaagttgtatt

SEQ ID NO: 1781505 - DNA, 16 bp, Homo sapiens
ctatggatggcttcta

SEQ ID NO: 1781506 - DNA, 21 bp, Homo sapiens
ctatggatttggggtgttaca

SEQ ID NO: 1781507 - DNA, 16 bp, Homo sapiens
ctatggcagaaaaaat

SEQ ID NO: 1781508 - DNA, 20 bp, Homo sapiens
ctatggcaggataagaaagc

SEQ ID NO: 1781509 - DNA, 20 bp, Homo sapiens
ctatggcagtccagccagct

SEQ ID NO: 1781510 - DNA, 16 bp, Homo sapiens
ctatggcttatttcta

SEQ ID NO: 1781511 - DNA, 21 bp, Homo sapiens
ctatggcttatttctatgaca

SEQ ID NO: 1781512 - DNA, 13 bp, Homo sapiens
ctatgggaacaat

SEQ ID NO: 1781513 - DNA, 17 bp, Homo sapiens
ctatgggagccccaggg

SEQ ID NO: 1781514 - DNA, 22 bp, Homo sapiens
ctatgggaggcagccgaggcct

SEQ ID NO: 1781515 - DNA, 19 bp, Homo sapiens
ctatggggatagatgtgtg

SEQ ID NO: 1781516 - DNA, 18 bp, Homo sapiens
ctatggttcccaataaaa

SEQ ID NO: 1781517 - DNA, 22 bp, Homo sapiens
ctatggttcccaataaaagtga

SEQ ID NO: 1781518 - DNA, 22 bp, Homo sapiens
ctatgtaaacaaaccacagcag

SEQ ID NO: 1781519 - DNA, 21 bp, Homo sapiens
ctatgtaactgcattgagaac

SEQ ID NO: 1781520 - DNA, 14 bp, Homo sapiens
ctatgtagaactgt

SEQ ID NO: 1781521 - DNA, 19 bp, Homo sapiens
ctatgtagaactgttcatt

SEQ ID NO: 1781522 - DNA, 18 bp, Homo sapiens
ctatgtataaaatacata

SEQ ID NO: 1781523 - DNA, 24 bp, Homo sapiens
ctatgtataaaatacatagtgaaa

SEQ ID NO: 1781524 - DNA, 19 bp, Homo sapiens
ctatgtatcaatgagtaac

SEQ ID NO: 1781525 - DNA, 18 bp, Homo sapiens
ctatgtatgttaatttat

SEQ ID NO: 1781526 - DNA, 20 bp, Homo sapiens
ctatgtatgttaatttattt

SEQ ID NO: 1781527 - DNA, 22 bp, Homo sapiens
ctatgtatttgcagttcacctg

SEQ ID NO: 1781528 - DNA, 13 bp, Homo sapiens
ctatgtcattttt

SEQ ID NO: 1781529 - DNA, 18 bp, Homo sapiens
ctatgtcatttttaatgt

SEQ ID NO: 1781530 - DNA, 15 bp, Homo sapiens
ctatgtccaacagag

SEQ ID NO: 1781531 - DNA, 18 bp, Homo sapiens
ctatgtcctaaggacaca

SEQ ID NO: 1781532 - DNA, 22 bp, Homo sapiens
ctatgtcctaaggacacactaa

SEQ ID NO: 1781533 - DNA, 17 bp, Homo sapiens
ctatgtcgagagctggc

SEQ ID NO: 1781534 - DNA, 14 bp, Homo sapiens
ctatgtctcaggag

SEQ ID NO: 1781535 - DNA, 18 bp, Homo sapiens
ctatgttactattttcta

SEQ ID NO: 1781536 - DNA, 22 bp, Homo sapiens
ctatgttactattttctacaat

SEQ ID NO: 1781537 - DNA, 20 bp, Homo sapiens
ctatgttcaaagactgtgaa

SEQ ID NO: 1781538 - DNA, 20 bp, Homo sapiens
ctatgtttacaaatggacat

SEQ ID NO: 1781539 - DNA, 16 bp, Homo sapiens
ctatgtttctcagatt

SEQ ID NO: 1781540 - DNA, 20 bp, Homo sapiens
ctattaaaaatagacagtaa

SEQ ID NO: 1781541 - DNA, 19 bp, Homo sapiens
ctattaaaattctgatgtt

SEQ ID NO: 1781542 - DNA, 21 bp, Homo sapiens
ctattaaaattctgatgtttc

SEQ ID NO: 1781543 - DNA, 19 bp, Homo sapiens
ctattaagaaaatcacatt

SEQ ID NO: 1781544 - DNA, 16 bp, Homo sapiens
ctattaagatttccaa

SEQ ID NO: 1781545 - DNA, 17 bp, Homo sapiens
ctattaagatttccaag

SEQ ID NO: 1781546 - DNA, 16 bp, Homo sapiens
ctattaagcaagaatg

SEQ ID NO: 1781547 - DNA, 20 bp, Homo sapiens
ctattaagcaagaatgcagt

SEQ ID NO: 1781548 - DNA, 21 bp, Homo sapiens
ctattaagcagtaaaaactgt

SEQ ID NO: 1781549 - DNA, 22 bp, Homo sapiens
ctattaagcagtaaaaactgtt

SEQ ID NO: 1781550 - DNA, 22 bp, Homo sapiens
ctattaagtttgaaaatagtta

SEQ ID NO: 1781551 - DNA, 17 bp, Homo sapiens
ctattaatatatgtatt

SEQ ID NO: 1781552 - DNA, 23 bp, Homo sapiens
ctattaatatcaactctgaagct

SEQ ID NO: 1781553 - DNA, 15 bp, Homo sapiens
ctattaatcaagaga

SEQ ID NO: 1781554 - DNA, 14 bp, Homo sapiens
ctattaattactgt

SEQ ID NO: 1781555 - DNA, 20 bp, Homo sapiens
ctattacgtgggtgccctct

SEQ ID NO: 1781556 - DNA, 12 bp, Homo sapiens
ctattagacttt

SEQ ID NO: 1781557 - DNA, 20 bp, Homo sapiens
ctattagactttagaaataa

SEQ ID NO: 1781558 - DNA, 21 bp, Homo sapiens
ctattagactttagaaataaa

SEQ ID NO: 1781559 - DNA, 22 bp, Homo sapiens
ctattagactttagaaataaat

SEQ ID NO: 1781560 - DNA, 18 bp, Homo sapiens
ctattagagtatttccct

SEQ ID NO: 1781561 - DNA, 16 bp, Homo sapiens
ctattagccacaaaat

SEQ ID NO: 1781562 - DNA, 15 bp, Homo sapiens
ctattataatttaat

SEQ ID NO: 1781563 - DNA, 16 bp, Homo sapiens
ctattataatttaatg

SEQ ID NO: 1781564 - DNA, 16 bp, Homo sapiens
ctattatactgtatta

SEQ ID NO: 1781565 - DNA, 12 bp, Homo sapiens
ctattatcacat

SEQ ID NO: 1781566 - DNA, 22 bp, Homo sapiens
ctattatttattgtattaggaa

SEQ ID NO: 1781567 - DNA, 23 bp, Homo sapiens
ctattcaaacagtctcaggaaat

SEQ ID NO: 1781568 - DNA, 15 bp, Homo sapiens
ctattcaccctccac

SEQ ID NO: 1781569 - DNA, 20 bp, Homo sapiens
ctattcaccctccacttccc

SEQ ID NO: 1781570 - DNA, 14 bp, Homo sapiens
ctattcagacaagc

SEQ ID NO: 1781571 - DNA, 23 bp, Homo sapiens
ctattcagcttcgtttattttca

SEQ ID NO: 1781572 - DNA, 17 bp, Homo sapiens
ctattcagtaataactc

SEQ ID NO: 1781573 - DNA, 23 bp, Homo sapiens
ctattcagtaataactctaccct

SEQ ID NO: 1781574 - DNA, 22 bp, Homo sapiens
ctattcatgtgggaaaaaaaga

SEQ ID NO: 1781575 - DNA, 23 bp, Homo sapiens
ctattccaactgggcatttcaat

SEQ ID NO: 1781576 - DNA, 12 bp, Homo sapiens
ctattccaataa

SEQ ID NO: 1781577 - DNA, 19 bp, Homo sapiens
ctattccaggaattcctct

SEQ ID NO: 1781578 - DNA, 18 bp, Homo sapiens
ctattccttttctgtata

SEQ ID NO: 1781579 - DNA, 22 bp, Homo sapiens
ctattctataaaactctgcatg

SEQ ID NO: 1781580 - DNA, 13 bp, Homo sapiens
ctattctctaaac

SEQ ID NO: 1781581 - DNA, 14 bp, Homo sapiens
ctattctctccaaa

SEQ ID NO: 1781582 - DNA, 16 bp, Homo sapiens
ctattctgagccttga

SEQ ID NO: 1781583 - DNA, 21 bp, Homo sapiens
ctattctgatgaatctcaaag

SEQ ID NO: 1781584 - DNA, 15 bp, Homo sapiens
ctattctgtgttgaa

SEQ ID NO: 1781585 - DNA, 16 bp, Homo sapiens
ctattctgtgttttat

SEQ ID NO: 1781586 - DNA, 16 bp, Homo sapiens
ctattcttgatgtaaa

SEQ ID NO: 1781587 - DNA, 20 bp, Homo sapiens
ctattcttgatgtaaaatct

SEQ ID NO: 1781588 - DNA, 14 bp, Homo sapiens
ctattgaaaacagt

SEQ ID NO: 1781589 - DNA, 15 bp, Homo sapiens
ctattgaaaacagtg

SEQ ID NO: 1781590 - DNA, 13 bp, Homo sapiens
ctattgaagatgc

SEQ ID NO: 1781591 - DNA, 16 bp, Homo sapiens
ctattgaagatgctgc

SEQ ID NO: 1781592 - DNA, 17 bp, Homo sapiens
ctattgaccatgtggtt

SEQ ID NO: 1781593 - DNA, 13 bp, Homo sapiens
ctattgacttcaa

SEQ ID NO: 1781594 - DNA, 16 bp, Homo sapiens
ctattgacttcaatga

SEQ ID NO: 1781595 - DNA, 14 bp, Homo sapiens
ctattgcttcacca

SEQ ID NO: 1781596 - DNA, 21 bp, Homo sapiens
ctattggaatttttttttcct

SEQ ID NO: 1781597 - DNA, 21 bp, Homo sapiens
ctattggctgatctatgcctt

SEQ ID NO: 1781598 - DNA, 20 bp, Homo sapiens
ctattgtaatcgtgtgccat

SEQ ID NO: 1781599 - DNA, 22 bp, Homo sapiens
ctattgtcccctagcaaggcat

SEQ ID NO: 1781600 - DNA, 23 bp, Homo sapiens
ctattgtgcacaagtctttccag

SEQ ID NO: 1781601 - DNA, 20 bp, Homo sapiens
ctattgtgtggatgaccaca

SEQ ID NO: 1781602 - DNA, 20 bp, Homo sapiens
ctattgttaaacaaatgatt

SEQ ID NO: 1781603 - DNA, 16 bp, Homo sapiens
ctattgttgtgggctt

SEQ ID NO: 1781604 - DNA, 15 bp, Homo sapiens
ctattgtttgtaaaa

SEQ ID NO: 1781605 - DNA, 15 bp, Homo sapiens
ctatttaaaaaagag

SEQ ID NO: 1781606 - DNA, 13 bp, Homo sapiens
ctatttaactgac

SEQ ID NO: 1781607 - DNA, 14 bp, Homo sapiens
ctatttaactgact

SEQ ID NO: 1781608 - DNA, 14 bp, Homo sapiens
ctatttaagatgtg

SEQ ID NO: 1781609 - DNA, 15 bp, Homo sapiens
ctatttaagatgtga

SEQ ID NO: 1781610 - DNA, 16 bp, Homo sapiens
ctatttaagattccca

SEQ ID NO: 1781611 - DNA, 14 bp, Homo sapiens
ctatttaatacagc

SEQ ID NO: 1781612 - DNA, 12 bp, Homo sapiens
ctatttaatgga

SEQ ID NO: 1781613 - DNA, 13 bp, Homo sapiens
ctatttaatgttt

SEQ ID NO: 1781614 - DNA, 13 bp, Homo sapiens
ctatttataagtg

SEQ ID NO: 1781615 - DNA, 21 bp, Homo sapiens
ctatttataatacagaatctt

SEQ ID NO: 1781616 - DNA, 22 bp, Homo sapiens
ctatttatctgtgtttttgaaa

SEQ ID NO: 1781617 - DNA, 11 bp, Homo sapiens
ctatttatgca

SEQ ID NO: 1781618 - DNA, 19 bp, Homo sapiens
ctatttattaaaaacatga

SEQ ID NO: 1781619 - DNA, 20 bp, Homo sapiens
ctatttattaatatttaaca

SEQ ID NO: 1781620 - DNA, 14 bp, Homo sapiens
ctatttattcctgt

SEQ ID NO: 1781621 - DNA, 16 bp, Homo sapiens
ctatttattcctgtta

SEQ ID NO: 1781622 - DNA, 15 bp, Homo sapiens
ctatttattgacttt

SEQ ID NO: 1781623 - DNA, 16 bp, Homo sapiens
ctatttattgactttg

SEQ ID NO: 1781624 - DNA, 14 bp, Homo sapiens
ctatttatttactg

SEQ ID NO: 1781625 - DNA, 15 bp, Homo sapiens
ctatttatttactga

SEQ ID NO: 1781626 - DNA, 22 bp, Homo sapiens
ctatttatttttgcaaaccctg

SEQ ID NO: 1781627 - DNA, 16 bp, Homo sapiens
ctatttcaaaatgtcc

SEQ ID NO: 1781628 - DNA, 11 bp, Homo sapiens
ctatttcagaa

SEQ ID NO: 1781629 - DNA, 12 bp, Homo sapiens
ctatttcagaag

SEQ ID NO: 1781630 - DNA, 15 bp, Homo sapiens
ctatttcatgttttt

SEQ ID NO: 1781631 - DNA, 17 bp, Homo sapiens
ctatttcatgtttttga

SEQ ID NO: 1781632 - DNA, 23 bp, Homo sapiens
ctatttccccaggggaaaatgaa

SEQ ID NO: 1781633 - DNA, 20 bp, Homo sapiens
ctatttcctgaacctggaaa

SEQ ID NO: 1781634 - DNA, 23 bp, Homo sapiens
ctatttcgagtgttgtgttaaaa

SEQ ID NO: 1781635 - DNA, 22 bp, Homo sapiens
ctatttctacacagtgggaact

SEQ ID NO: 1781636 - DNA, 12 bp, Homo sapiens
ctatttctatct

SEQ ID NO: 1781637 - DNA, 16 bp, Homo sapiens
ctatttctatgtcatt

SEQ ID NO: 1781638 - DNA, 14 bp, Homo sapiens
ctatttctctcccc

SEQ ID NO: 1781639 - DNA, 16 bp, Homo sapiens
ctatttctctccccac

SEQ ID NO: 1781640 - DNA, 22 bp, Homo sapiens
ctatttctgggtcttttgctac

SEQ ID NO: 1781641 - DNA, 16 bp, Homo sapiens
ctatttgacccccaca

SEQ ID NO: 1781642 - DNA, 14 bp, Homo sapiens
ctatttgagaagtt

SEQ ID NO: 1781643 - DNA, 21 bp, Homo sapiens
ctatttgagaagttctcagaa

SEQ ID NO: 1781644 - DNA, 20 bp, Homo sapiens
ctatttgagcatgcacagct

SEQ ID NO: 1781645 - DNA, 14 bp, Homo sapiens
ctatttgctaatgt

SEQ ID NO: 1781646 - DNA, 19 bp, Homo sapiens
ctatttgcttatttaataa

SEQ ID NO: 1781647 - DNA, 21 bp, Homo sapiens
ctatttgtaaatctgccacaa

SEQ ID NO: 1781648 - DNA, 14 bp, Homo sapiens
ctatttgtacaaat

SEQ ID NO: 1781649 - DNA, 16 bp, Homo sapiens
ctatttgtacaaataa

SEQ ID NO: 1781650 - DNA, 17 bp, Homo sapiens
ctatttgtacaaataaa

SEQ ID NO: 1781651 - DNA, 14 bp, Homo sapiens
ctatttgtacaatt

SEQ ID NO: 1781652 - DNA, 16 bp, Homo sapiens
ctattttaaagtaaaa

SEQ ID NO: 1781653 - DNA, 14 bp, Homo sapiens
ctattttaattact

SEQ ID NO: 1781654 - DNA, 23 bp, Homo sapiens
ctattttatatgatgggggaaaa

SEQ ID NO: 1781655 - DNA, 12 bp, Homo sapiens
ctattttattcc

SEQ ID NO: 1781656 - DNA, 13 bp, Homo sapiens
ctattttcataat

SEQ ID NO: 1781657 - DNA, 21 bp, Homo sapiens
ctattttcataatcagtaaat

SEQ ID NO: 1781658 - DNA, 14 bp, Homo sapiens
ctattttcatttgt

SEQ ID NO: 1781659 - DNA, 15 bp, Homo sapiens
ctattttcatttgta

SEQ ID NO: 1781660 - DNA, 15 bp, Homo sapiens
ctattttgtatattt

SEQ ID NO: 1781661 - DNA, 19 bp, Homo sapiens
ctatttttaatgtttgtac

SEQ ID NO: 1781662 - DNA, 17 bp, Homo sapiens
ctatttttatcatgaat

SEQ ID NO: 1781663 - DNA, 15 bp, Homo sapiens
ctatttttatttata

SEQ ID NO: 1781664 - DNA, 16 bp, Homo sapiens
ctatttttatttatat

SEQ ID NO: 1781665 - DNA, 21 bp, Homo sapiens
ctatttttggcagtctgaatt

SEQ ID NO: 1781666 - DNA, 22 bp, Homo sapiens
ctatttttggcagtctgaattt

SEQ ID NO: 1781667 - DNA, 17 bp, Homo sapiens
ctatttttttagattga

SEQ ID NO: 1781668 - DNA, 23 bp, Homo sapiens
ctcaaaaaaaaaaaagagagaga

SEQ ID NO: 1781669 - DNA, 23 bp, Homo sapiens
ctcaaaaagcagaaggagagtga

SEQ ID NO: 1781670 - DNA, 16 bp, Homo sapiens
ctcaaaagaggttact

SEQ ID NO: 1781671 - DNA, 17 bp, Homo sapiens
ctcaaaagaggttactt

SEQ ID NO: 1781672 - DNA, 13 bp, Homo sapiens
ctcaaaaggaaac

SEQ ID NO: 1781673 - DNA, 14 bp, Homo sapiens
ctcaaactcctgac

SEQ ID NO: 1781674 - DNA, 19 bp, Homo sapiens
ctcaaactgaggaatttca

SEQ ID NO: 1781675 - DNA, 17 bp, Homo sapiens
ctcaaagaaagtgtatt

SEQ ID NO: 1781676 - DNA, 12 bp, Homo sapiens
ctcaaagcaaaa

SEQ ID NO: 1781677 - DNA, 14 bp, Homo sapiens
ctcaaaggagaaaa

SEQ ID NO: 1781678 - DNA, 15 bp, Homo sapiens
ctcaaaggagaaaaa

SEQ ID NO: 1781679 - DNA, 17 bp, Homo sapiens
ctcaaaggagaaaaaaa

SEQ ID NO: 1781680 - DNA, 18 bp, Homo sapiens
ctcaaaggtttggaagga

SEQ ID NO: 1781681 - DNA, 22 bp, Homo sapiens
ctcaaaggtttggaaggagcag

SEQ ID NO: 1781682 - DNA, 19 bp, Homo sapiens
ctcaaagtatgcaatgctt

SEQ ID NO: 1781683 - DNA, 21 bp, Homo sapiens
ctcaaagtttgacaggaacct

SEQ ID NO: 1781684 - DNA, 17 bp, Homo sapiens
ctcaaatacacatttgc

SEQ ID NO: 1781685 - DNA, 18 bp, Homo sapiens
ctcaaatacacatttgct

SEQ ID NO: 1781686 - DNA, 14 bp, Homo sapiens
ctcaaatccctctc

SEQ ID NO: 1781687 - DNA, 19 bp, Homo sapiens
ctcaaatcgtccagcgacc

SEQ ID NO: 1781688 - DNA, 15 bp, Homo sapiens
ctcaaatctattcag

SEQ ID NO: 1781689 - DNA, 16 bp, Homo sapiens
ctcaaatctattcaga

SEQ ID NO: 1781690 - DNA, 15 bp, Homo sapiens
ctcaaatctgaggga

SEQ ID NO: 1781691 - DNA, 16 bp, Homo sapiens
ctcaaatgagtaacat

SEQ ID NO: 1781692 - DNA, 20 bp, Homo sapiens
ctcaaatgatcctcccacct

SEQ ID NO: 1781693 - DNA, 17 bp, Homo sapiens
ctcaaatggggccagat

SEQ ID NO: 1781694 - DNA, 19 bp, Homo sapiens
ctcaaatggggccagatcc

SEQ ID NO: 1781695 - DNA, 17 bp, Homo sapiens
ctcaaatgttctaagtt

SEQ ID NO: 1781696 - DNA, 21 bp, Homo sapiens
ctcaaccccaccatatgaatt

SEQ ID NO: 1781697 - DNA, 22 bp, Homo sapiens
ctcaaccccaccatatgaattg

SEQ ID NO: 1781698 - DNA, 19 bp, Homo sapiens
ctcaacccccatttctatt

SEQ ID NO: 1781699 - DNA, 16 bp, Homo sapiens
ctcaaccttaagacct

SEQ ID NO: 1781700 - DNA, 18 bp, Homo sapiens
ctcaacgttgctccccat

SEQ ID NO: 1781701 - DNA, 13 bp, Homo sapiens
ctcaactccagga

SEQ ID NO: 1781702 - DNA, 20 bp, Homo sapiens
ctcaactctacccctgctcc

SEQ ID NO: 1781703 - DNA, 18 bp, Homo sapiens
ctcaactctgagcccata

SEQ ID NO: 1781704 - DNA, 23 bp, Homo sapiens
ctcaactgaaggggtgcacccac

SEQ ID NO: 1781705 - DNA, 21 bp, Homo sapiens
ctcaactgagggccagggacc

SEQ ID NO: 1781706 - DNA, 15 bp, Homo sapiens
ctcaactgcctactc

SEQ ID NO: 1781707 - DNA, 23 bp, Homo sapiens
ctcaactgcctactccaaaatgt

SEQ ID NO: 1781708 - DNA, 17 bp, Homo sapiens
ctcaactgggtccagaa

SEQ ID NO: 1781709 - DNA, 22 bp, Homo sapiens
ctcaagaaagccctcattttta

SEQ ID NO: 1781710 - DNA, 15 bp, Homo sapiens
ctcaagaacaaacac

SEQ ID NO: 1781711 - DNA, 21 bp, Homo sapiens
ctcaagaagacatggagactc

SEQ ID NO: 1781712 - DNA, 15 bp, Homo sapiens
ctcaagacaaggctg

SEQ ID NO: 1781713 - DNA, 15 bp, Homo sapiens
ctcaagaccaggctg

SEQ ID NO: 1781714 - DNA, 20 bp, Homo sapiens
ctcaagaccaggctgcagcc

SEQ ID NO: 1781715 - DNA, 22 bp, Homo sapiens
ctcaagactttagcttttcctt

SEQ ID NO: 1781716 - DNA, 20 bp, Homo sapiens
ctcaagaggaatctgtttct

SEQ ID NO: 1781717 - DNA, 17 bp, Homo sapiens
ctcaagaggctgaggca

SEQ ID NO: 1781718 - DNA, 21 bp, Homo sapiens
ctcaagagggcactggtggcc

SEQ ID NO: 1781719 - DNA, 15 bp, Homo sapiens
ctcaagatgacagct

SEQ ID NO: 1781720 - DNA, 20 bp, Homo sapiens
ctcaagatgggggcagggct

SEQ ID NO: 1781721 - DNA, 22 bp, Homo sapiens
ctcaagcagcgaccgccccctc

SEQ ID NO: 1781722 - DNA, 23 bp, Homo sapiens
ctcaagcagcgaccgccccctcc

SEQ ID NO: 1781723 - DNA, 22 bp, Homo sapiens
ctcaagccagccccctccagct

SEQ ID NO: 1781724 - DNA, 16 bp, Homo sapiens
ctcaagccgcaagctc

SEQ ID NO: 1781725 - DNA, 17 bp, Homo sapiens
ctcaagccgcaagctct

SEQ ID NO: 1781726 - DNA, 19 bp, Homo sapiens
ctcaagccgcaagctctca

SEQ ID NO: 1781727 - DNA, 22 bp, Homo sapiens
ctcaagccgcaagctctcagca

SEQ ID NO: 1781728 - DNA, 17 bp, Homo sapiens
ctcaagctagccagagg

SEQ ID NO: 1781729 - DNA, 14 bp, Homo sapiens
ctcaagctgcgttt

SEQ ID NO: 1781730 - DNA, 16 bp, Homo sapiens
ctcaaggacaaagtct

SEQ ID NO: 1781731 - DNA, 20 bp, Homo sapiens
ctcaaggacaaagtctccag

SEQ ID NO: 1781732 - DNA, 21 bp, Homo sapiens
ctcaaggacaaagtctccagc

SEQ ID NO: 1781733 - DNA, 14 bp, Homo sapiens
ctcaagggtggcag

SEQ ID NO: 1781734 - DNA, 19 bp, Homo sapiens
ctcaaggtgggccttgcta

SEQ ID NO: 1781735 - DNA, 22 bp, Homo sapiens
ctcaaggttactgggagtgtgg

SEQ ID NO: 1781736 - DNA, 22 bp, Homo sapiens
ctcaaggttttaggttctaaag

SEQ ID NO: 1781737 - DNA, 14 bp, Homo sapiens
ctcaagtgtcctga

SEQ ID NO: 1781738 - DNA, 18 bp, Homo sapiens
ctcaagttctaagattct

SEQ ID NO: 1781739 - DNA, 20 bp, Homo sapiens
ctcaagttctaagattctaa

SEQ ID NO: 1781740 - DNA, 16 bp, Homo sapiens
ctcaatattcctgaat

SEQ ID NO: 1781741 - DNA, 15 bp, Homo sapiens
ctcaatcaagaaaat

SEQ ID NO: 1781742 - DNA, 20 bp, Homo sapiens
ctcaatcagtgcagtgatac

SEQ ID NO: 1781743 - DNA, 19 bp, Homo sapiens
ctcaatctccagggctcca

SEQ ID NO: 1781744 - DNA, 20 bp, Homo sapiens
ctcaatgaaccataaattca

SEQ ID NO: 1781745 - DNA, 22 bp, Homo sapiens
ctcaatgcagttagctgaagaa

SEQ ID NO: 1781746 - DNA, 20 bp, Homo sapiens
ctcaatgcattgtcttgtgg

SEQ ID NO: 1781747 - DNA, 18 bp, Homo sapiens
ctcaatgccctgccatta

SEQ ID NO: 1781748 - DNA, 17 bp, Homo sapiens
ctcaatggactggaagg

SEQ ID NO: 1781749 - DNA, 20 bp, Homo sapiens
ctcaatgtgaatcagaccct

SEQ ID NO: 1781750 - DNA, 21 bp, Homo sapiens
ctcaatgtttctggacattct

SEQ ID NO: 1781751 - DNA, 22 bp, Homo sapiens
ctcaattatttgcatattttga

SEQ ID NO: 1781752 - DNA, 23 bp, Homo sapiens
ctcaattttatgtattctttctg

SEQ ID NO: 1781753 - DNA, 21 bp, Homo sapiens
ctcacaaaaaggcaaatattg

SEQ ID NO: 1781754 - DNA, 22 bp, Homo sapiens
ctcacaaaaaggcaaatattga

SEQ ID NO: 1781755 - DNA, 23 bp, Homo sapiens
ctcacaaaaaggcaaatattgaa

SEQ ID NO: 1781756 - DNA, 16 bp, Homo sapiens
ctcacaaagtgctggg

SEQ ID NO: 1781757 - DNA, 15 bp, Homo sapiens
ctcacaaggcccagg

SEQ ID NO: 1781758 - DNA, 16 bp, Homo sapiens
ctcacaaggcccagga

SEQ ID NO: 1781759 - DNA, 13 bp, Homo sapiens
ctcacaccaaatt

SEQ ID NO: 1781760 - DNA, 23 bp, Homo sapiens
ctcacacccaccgtccgccctgc

SEQ ID NO: 1781761 - DNA, 19 bp, Homo sapiens
ctcacacccctgtcccacc

SEQ ID NO: 1781762 - DNA, 19 bp, Homo sapiens
ctcacaccctaccttcccc

SEQ ID NO: 1781763 - DNA, 21 bp, Homo sapiens
ctcacaccctaccttccccag

SEQ ID NO: 1781764 - DNA, 22 bp, Homo sapiens
ctcacaccctaccttccccaga

SEQ ID NO: 1781765 - DNA, 15 bp, Homo sapiens
ctcacacctgaactg

SEQ ID NO: 1781766 - DNA, 18 bp, Homo sapiens
ctcacactcccctagggg

SEQ ID NO: 1781767 - DNA, 14 bp, Homo sapiens
ctcacactgagaat

SEQ ID NO: 1781768 - DNA, 14 bp, Homo sapiens
ctcacactggccac

SEQ ID NO: 1781769 - DNA, 14 bp, Homo sapiens
ctcacagacctgga

SEQ ID NO: 1781770 - DNA, 23 bp, Homo sapiens
ctcacagacctggagcccctggg

SEQ ID NO: 1781771 - DNA, 12 bp, Homo sapiens
ctcacagagaag

SEQ ID NO: 1781772 - DNA, 14 bp, Homo sapiens
ctcacagagaagct

SEQ ID NO: 1781773 - DNA, 15 bp, Homo sapiens
ctcacagagaagctc

SEQ ID NO: 1781774 - DNA, 19 bp, Homo sapiens
ctcacagagtcaaggcctg

SEQ ID NO: 1781775 - DNA, 19 bp, Homo sapiens
ctcacagattgctgcctca

SEQ ID NO: 1781776 - DNA, 22 bp, Homo sapiens
ctcacagctactcagtggggct

SEQ ID NO: 1781777 - DNA, 17 bp, Homo sapiens
ctcacagcttctccaag

SEQ ID NO: 1781778 - DNA, 12 bp, Homo sapiens
ctcacaggctga

SEQ ID NO: 1781779 - DNA, 14 bp, Homo sapiens
ctcacaggctgaga

SEQ ID NO: 1781780 - DNA, 20 bp, Homo sapiens
ctcacagtctctttaatctt

SEQ ID NO: 1781781 - DNA, 12 bp, Homo sapiens
ctcacagtgacc

SEQ ID NO: 1781782 - DNA, 19 bp, Homo sapiens
ctcacagtgacccttccca

SEQ ID NO: 1781783 - DNA, 15 bp, Homo sapiens
ctcacagtgctttta

SEQ ID NO: 1781784 - DNA, 18 bp, Homo sapiens
ctcacagtgggagccagg

SEQ ID NO: 1781785 - DNA, 21 bp, Homo sapiens
ctcacagtgttgcccaggctg

SEQ ID NO: 1781786 - DNA, 21 bp, Homo sapiens
ctcacagttcctcgccctggg

SEQ ID NO: 1781787 - DNA, 14 bp, Homo sapiens
ctcaccaccacact

SEQ ID NO: 1781788 - DNA, 14 bp, Homo sapiens
ctcaccacccactt

SEQ ID NO: 1781789 - DNA, 21 bp, Homo sapiens
ctcaccagccccactgccagc

SEQ ID NO: 1781790 - DNA, 23 bp, Homo sapiens
ctcaccagccccactgccagcag

SEQ ID NO: 1781791 - DNA, 14 bp, Homo sapiens
ctcaccaggcctgg

SEQ ID NO: 1781792 - DNA, 20 bp, Homo sapiens
ctcaccaggcctggcctctg

SEQ ID NO: 1781793 - DNA, 21 bp, Homo sapiens
ctcaccaggcctggcctctgg

SEQ ID NO: 1781794 - DNA, 22 bp, Homo sapiens
ctcaccagggtccgcaccagct

SEQ ID NO: 1781795 - DNA, 23 bp, Homo sapiens
ctcaccagggtccgcaccagctg

SEQ ID NO: 1781796 - DNA, 15 bp, Homo sapiens
ctcaccatccagtgg

SEQ ID NO: 1781797 - DNA, 17 bp, Homo sapiens
ctcaccatttggatcct

SEQ ID NO: 1781798 - DNA, 17 bp, Homo sapiens
ctcacccacccctgcac

SEQ ID NO: 1781799 - DNA, 16 bp, Homo sapiens
ctcacccagtccccac

SEQ ID NO: 1781800 - DNA, 13 bp, Homo sapiens
ctcaccccaggat

SEQ ID NO: 1781801 - DNA, 19 bp, Homo sapiens
ctcaccccatcccacaccc

SEQ ID NO: 1781802 - DNA, 14 bp, Homo sapiens
ctcacccccagctt

SEQ ID NO: 1781803 - DNA, 14 bp, Homo sapiens
ctcacccccatccc

SEQ ID NO: 1781804 - DNA, 17 bp, Homo sapiens
ctcacccctgccctggg

SEQ ID NO: 1781805 - DNA, 14 bp, Homo sapiens
ctcacccctggttc

SEQ ID NO: 1781806 - DNA, 15 bp, Homo sapiens
ctcacccctgtaggg

SEQ ID NO: 1781807 - DNA, 16 bp, Homo sapiens
ctcaccctcataccat

SEQ ID NO: 1781808 - DNA, 23 bp, Homo sapiens
ctcaccctgcccgctcccaaccc

SEQ ID NO: 1781809 - DNA, 15 bp, Homo sapiens
ctcaccctgggagcc

SEQ ID NO: 1781810 - DNA, 13 bp, Homo sapiens
ctcaccgcccatc

SEQ ID NO: 1781811 - DNA, 21 bp, Homo sapiens
ctcaccggctctcacctggcc

SEQ ID NO: 1781812 - DNA, 23 bp, Homo sapiens
ctcacctaatgtttatgagccag

SEQ ID NO: 1781813 - DNA, 14 bp, Homo sapiens
ctcacctcagagca

SEQ ID NO: 1781814 - DNA, 20 bp, Homo sapiens
ctcacctcagagcagggcca

SEQ ID NO: 1781815 - DNA, 14 bp, Homo sapiens
ctcacctcatgccc

SEQ ID NO: 1781816 - DNA, 14 bp, Homo sapiens
ctcacctctccctc

SEQ ID NO: 1781817 - DNA, 17 bp, Homo sapiens
ctcacctctgaggacag

SEQ ID NO: 1781818 - DNA, 16 bp, Homo sapiens
ctcacctgagacctcc

SEQ ID NO: 1781819 - DNA, 17 bp, Homo sapiens
ctcacctgagacctcca

SEQ ID NO: 1781820 - DNA, 19 bp, Homo sapiens
ctcacctgagtcaccctac

SEQ ID NO: 1781821 - DNA, 17 bp, Homo sapiens
ctcacctgcactaacag

SEQ ID NO: 1781822 - DNA, 20 bp, Homo sapiens
ctcacctgcactaacagagt

SEQ ID NO: 1781823 - DNA, 12 bp, Homo sapiens
ctcacctggact

SEQ ID NO: 1781824 - DNA, 17 bp, Homo sapiens
ctcacctggtacctgga

SEQ ID NO: 1781825 - DNA, 13 bp, Homo sapiens
ctcacctggtcct

SEQ ID NO: 1781826 - DNA, 23 bp, Homo sapiens
ctcacctggtcctccgcctactg

SEQ ID NO: 1781827 - DNA, 21 bp, Homo sapiens
ctcacctgtactattgcagac

SEQ ID NO: 1781828 - DNA, 21 bp, Homo sapiens
ctcaccttctgagtacagagt

SEQ ID NO: 1781829 - DNA, 18 bp, Homo sapiens
ctcacctttctccactgg

SEQ ID NO: 1781830 - DNA, 13 bp, Homo sapiens
ctcacgcaggctg

SEQ ID NO: 1781831 - DNA, 23 bp, Homo sapiens
ctcacgcctgtaatcccagcact

SEQ ID NO: 1781832 - DNA, 23 bp, Homo sapiens
ctcacggggttggctgttccaga

SEQ ID NO: 1781833 - DNA, 20 bp, Homo sapiens
ctcacgtaatgcattgcctg

SEQ ID NO: 1781834 - DNA, 19 bp, Homo sapiens
ctcacgtatttcacagagc

SEQ ID NO: 1781835 - DNA, 14 bp, Homo sapiens
ctcacgtcctgaga

SEQ ID NO: 1781836 - DNA, 15 bp, Homo sapiens
ctcacgtgcaggaca

SEQ ID NO: 1781837 - DNA, 16 bp, Homo sapiens
ctcacgtgcaggacag

SEQ ID NO: 1781838 - DNA, 21 bp, Homo sapiens
ctcacgtgtcagaagcctcca

SEQ ID NO: 1781839 - DNA, 19 bp, Homo sapiens
ctcactaaagcatgaaatg

SEQ ID NO: 1781840 - DNA, 13 bp, Homo sapiens
ctcactactgaac

SEQ ID NO: 1781841 - DNA, 23 bp, Homo sapiens
ctcactaggcccccacttgcctc

SEQ ID NO: 1781842 - DNA, 21 bp, Homo sapiens
ctcactcaccccagcgagctc

SEQ ID NO: 1781843 - DNA, 21 bp, Homo sapiens
ctcactcagccaccctgagtt

SEQ ID NO: 1781844 - DNA, 18 bp, Homo sapiens
ctcactccacagagtgag

SEQ ID NO: 1781845 - DNA, 14 bp, Homo sapiens
ctcactccagccca

SEQ ID NO: 1781846 - DNA, 14 bp, Homo sapiens
ctcactcccacctg

SEQ ID NO: 1781847 - DNA, 18 bp, Homo sapiens
ctcactccccacatccca

SEQ ID NO: 1781848 - DNA, 19 bp, Homo sapiens
ctcactccccagccccacc

SEQ ID NO: 1781849 - DNA, 20 bp, Homo sapiens
ctcactccccagccccaccc

SEQ ID NO: 1781850 - DNA, 14 bp, Homo sapiens
ctcactccccaggg

SEQ ID NO: 1781851 - DNA, 15 bp, Homo sapiens
ctcactcctacctgg

SEQ ID NO: 1781852 - DNA, 17 bp, Homo sapiens
ctcactcctacctggta

SEQ ID NO: 1781853 - DNA, 19 bp, Homo sapiens
ctcactcctacctggtaat

SEQ ID NO: 1781854 - DNA, 13 bp, Homo sapiens
ctcactcctgagt

SEQ ID NO: 1781855 - DNA, 12 bp, Homo sapiens
ctcactcctgtt

SEQ ID NO: 1781856 - DNA, 12 bp, Homo sapiens
ctcactctgggc

SEQ ID NO: 1781857 - DNA, 14 bp, Homo sapiens
ctcactctgggctg

SEQ ID NO: 1781858 - DNA, 15 bp, Homo sapiens
ctcactctgtttcct

SEQ ID NO: 1781859 - DNA, 19 bp, Homo sapiens
ctcactcttgaagtccagg

SEQ ID NO: 1781860 - DNA, 22 bp, Homo sapiens
ctcactcttgaagtccaggact

SEQ ID NO: 1781861 - DNA, 14 bp, Homo sapiens
ctcactgaactcca

SEQ ID NO: 1781862 - DNA, 16 bp, Homo sapiens
ctcactgaactccacc

SEQ ID NO: 1781863 - DNA, 22 bp, Homo sapiens
ctcactgcaacctccgcctccc

SEQ ID NO: 1781864 - DNA, 22 bp, Homo sapiens
ctcactgcaacttccgcctcct

SEQ ID NO: 1781865 - DNA, 22 bp, Homo sapiens
ctcactgccaggccagcctccg

SEQ ID NO: 1781866 - DNA, 23 bp, Homo sapiens
ctcactgcctaggaggctggcca

SEQ ID NO: 1781867 - DNA, 12 bp, Homo sapiens
ctcactgctcaa

SEQ ID NO: 1781868 - DNA, 14 bp, Homo sapiens
ctcactgctcaaga

SEQ ID NO: 1781869 - DNA, 20 bp, Homo sapiens
ctcactgctcaagaagacat

SEQ ID NO: 1781870 - DNA, 18 bp, Homo sapiens
ctcactgctggggagtcc

SEQ ID NO: 1781871 - DNA, 19 bp, Homo sapiens
ctcactgctggggagtccc

SEQ ID NO: 1781872 - DNA, 20 bp, Homo sapiens
ctcactgctggggagtccct

SEQ ID NO: 1781873 - DNA, 20 bp, Homo sapiens
ctcactggaggagcagcttc

SEQ ID NO: 1781874 - DNA, 16 bp, Homo sapiens
ctcactggctggggca

SEQ ID NO: 1781875 - DNA, 20 bp, Homo sapiens
ctcactggggtcctggggcc

SEQ ID NO: 1781876 - DNA, 16 bp, Homo sapiens
ctcactgtcctgtgaa

SEQ ID NO: 1781877 - DNA, 18 bp, Homo sapiens
ctcactgtgttactgctt

SEQ ID NO: 1781878 - DNA, 21 bp, Homo sapiens
ctcactgtgttactgctttgc

SEQ ID NO: 1781879 - DNA, 18 bp, Homo sapiens
ctcactgttgcagtggcc

SEQ ID NO: 1781880 - DNA, 18 bp, Homo sapiens
ctcacttctagatctcag

SEQ ID NO: 1781881 - DNA, 15 bp, Homo sapiens
ctcacttctgtctcc

SEQ ID NO: 1781882 - DNA, 13 bp, Homo sapiens
ctcactttaaacc

SEQ ID NO: 1781883 - DNA, 20 bp, Homo sapiens
ctcactttcccttgtgtcaa

SEQ ID NO: 1781884 - DNA, 13 bp, Homo sapiens
ctcactttttcca

SEQ ID NO: 1781885 - DNA, 21 bp, Homo sapiens
ctcagaaacgagatcgggaag

SEQ ID NO: 1781886 - DNA, 14 bp, Homo sapiens
ctcagaaagggatt

SEQ ID NO: 1781887 - DNA, 15 bp, Homo sapiens
ctcagaaagtgcctg

SEQ ID NO: 1781888 - DNA, 17 bp, Homo sapiens
ctcagaaccaaatcttt

SEQ ID NO: 1781889 - DNA, 15 bp, Homo sapiens
ctcagaactcctgtg

SEQ ID NO: 1781890 - DNA, 14 bp, Homo sapiens
ctcagaactctcca

SEQ ID NO: 1781891 - DNA, 17 bp, Homo sapiens
ctcagaactctccaggg

SEQ ID NO: 1781892 - DNA, 19 bp, Homo sapiens
ctcagaactctccagggag

SEQ ID NO: 1781893 - DNA, 14 bp, Homo sapiens
ctcagaacttgctg

SEQ ID NO: 1781894 - DNA, 17 bp, Homo sapiens
ctcagaagaaaacaaag

SEQ ID NO: 1781895 - DNA, 13 bp, Homo sapiens
ctcagaagaaaga

SEQ ID NO: 1781896 - DNA, 15 bp, Homo sapiens
ctcagaagcctgagg

SEQ ID NO: 1781897 - DNA, 16 bp, Homo sapiens
ctcagaagcctgaggc

SEQ ID NO: 1781898 - DNA, 18 bp, Homo sapiens
ctcagaagcctgaggctg

SEQ ID NO: 1781899 - DNA, 21 bp, Homo sapiens
ctcagaaggaatggtgcgtgg

SEQ ID NO: 1781900 - DNA, 15 bp, Homo sapiens
ctcagaaggccccag

SEQ ID NO: 1781901 - DNA, 16 bp, Homo sapiens
ctcagaaggccccaga

SEQ ID NO: 1781902 - DNA, 18 bp, Homo sapiens
ctcagaaggccccagaga

SEQ ID NO: 1781903 - DNA, 21 bp, Homo sapiens
ctcagaaggccccagagagac

SEQ ID NO: 1781904 - DNA, 16 bp, Homo sapiens
ctcagaaggtattcct

SEQ ID NO: 1781905 - DNA, 19 bp, Homo sapiens
ctcagaaggtattcctttt

SEQ ID NO: 1781906 - DNA, 20 bp, Homo sapiens
ctcagaataactacctcctc

SEQ ID NO: 1781907 - DNA, 15 bp, Homo sapiens
ctcagaatccaaaga

SEQ ID NO: 1781908 - DNA, 18 bp, Homo sapiens
ctcagaatccaaagatca

SEQ ID NO: 1781909 - DNA, 23 bp, Homo sapiens
ctcagaatccaagtgaacactag

SEQ ID NO: 1781910 - DNA, 17 bp, Homo sapiens
ctcagaatgtaaaagaa

SEQ ID NO: 1781911 - DNA, 20 bp, Homo sapiens
ctcagaattcggtgtgctgc

SEQ ID NO: 1781912 - DNA, 22 bp, Homo sapiens
ctcagaattcggtgtgctgcca

SEQ ID NO: 1781913 - DNA, 21 bp, Homo sapiens
ctcagacccaacagcaaagga

SEQ ID NO: 1781914 - DNA, 22 bp, Homo sapiens
ctcagacccccactctcattcc

SEQ ID NO: 1781915 - DNA, 11 bp, Homo sapiens
ctcagacctcc

SEQ ID NO: 1781916 - DNA, 19 bp, Homo sapiens
ctcagagaaaaatgctccc

SEQ ID NO: 1781917 - DNA, 12 bp, Homo sapiens
ctcagagacacc

SEQ ID NO: 1781918 - DNA, 21 bp, Homo sapiens
ctcagagacaccaaactgcca

SEQ ID NO: 1781919 - DNA, 14 bp, Homo sapiens
ctcagagaccagca

SEQ ID NO: 1781920 - DNA, 16 bp, Homo sapiens
ctcagagaccagggct

SEQ ID NO: 1781921 - DNA, 14 bp, Homo sapiens
ctcagagcacagag

SEQ ID NO: 1781922 - DNA, 13 bp, Homo sapiens
ctcagagcagagc

SEQ ID NO: 1781923 - DNA, 15 bp, Homo sapiens
ctcagagctctctct

SEQ ID NO: 1781924 - DNA, 19 bp, Homo sapiens
ctcagaggaccctttccag

SEQ ID NO: 1781925 - DNA, 22 bp, Homo sapiens
ctcagatagtctctttctctga

SEQ ID NO: 1781926 - DNA, 22 bp, Homo sapiens
ctcagatataagagaagtctca

SEQ ID NO: 1781927 - DNA, 16 bp, Homo sapiens
ctcagatatttgcacc

SEQ ID NO: 1781928 - DNA, 19 bp, Homo sapiens
ctcagatccttgtttcaaa

SEQ ID NO: 1781929 - DNA, 12 bp, Homo sapiens
ctcagatctgaa

SEQ ID NO: 1781930 - DNA, 12 bp, Homo sapiens
ctcagatctgat

SEQ ID NO: 1781931 - DNA, 17 bp, Homo sapiens
ctcagattatttttcct

SEQ ID NO: 1781932 - DNA, 22 bp, Homo sapiens
ctcagattcttcattgaggatt

SEQ ID NO: 1781933 - DNA, 21 bp, Homo sapiens
ctcagatttaagccttacaaa

SEQ ID NO: 1781934 - DNA, 17 bp, Homo sapiens
ctcagcaagtgcccagt

SEQ ID NO: 1781935 - DNA, 22 bp, Homo sapiens
ctcagcacattcgggaccaata

SEQ ID NO: 1781936 - DNA, 20 bp, Homo sapiens
ctcagcaccaagagcagctg

SEQ ID NO: 1781937 - DNA, 15 bp, Homo sapiens
ctcagcaccccttcc

SEQ ID NO: 1781938 - DNA, 16 bp, Homo sapiens
ctcagcaccccttcca

SEQ ID NO: 1781939 - DNA, 13 bp, Homo sapiens
ctcagcagccagt

SEQ ID NO: 1781940 - DNA, 21 bp, Homo sapiens
ctcagcagccagtctcagaga

SEQ ID NO: 1781941 - DNA, 23 bp, Homo sapiens
ctcagcagccagtctcagagacc

SEQ ID NO: 1781942 - DNA, 18 bp, Homo sapiens
ctcagcagccctcctcac

SEQ ID NO: 1781943 - DNA, 22 bp, Homo sapiens
ctcagcagccgccttaagctga

SEQ ID NO: 1781944 - DNA, 20 bp, Homo sapiens
ctcagcagctggtaatcttg

SEQ ID NO: 1781945 - DNA, 18 bp, Homo sapiens
ctcagcagttgacatcca

SEQ ID NO: 1781946 - DNA, 18 bp, Homo sapiens
ctcagcatagcctgcctg

SEQ ID NO: 1781947 - DNA, 16 bp, Homo sapiens
ctcagcatatttgtat

SEQ ID NO: 1781948 - DNA, 18 bp, Homo sapiens
ctcagcatatttgtatag

SEQ ID NO: 1781949 - DNA, 23 bp, Homo sapiens
ctcagcatatttgtatagttgct

SEQ ID NO: 1781950 - DNA, 14 bp, Homo sapiens
ctcagcatttgatt

SEQ ID NO: 1781951 - DNA, 17 bp, Homo sapiens
ctcagccaaatttcctg

SEQ ID NO: 1781952 - DNA, 19 bp, Homo sapiens
ctcagccaaatttcctgtt

SEQ ID NO: 1781953 - DNA, 15 bp, Homo sapiens
ctcagccacagcctg

SEQ ID NO: 1781954 - DNA, 16 bp, Homo sapiens
ctcagccaccctgagt

SEQ ID NO: 1781955 - DNA, 17 bp, Homo sapiens
ctcagccaccctgagtt

SEQ ID NO: 1781956 - DNA, 18 bp, Homo sapiens
ctcagccaccctgagttg

SEQ ID NO: 1781957 - DNA, 15 bp, Homo sapiens
ctcagccagtgggga

SEQ ID NO: 1781958 - DNA, 22 bp, Homo sapiens
ctcagccatttccccctcctca

SEQ ID NO: 1781959 - DNA, 19 bp, Homo sapiens
ctcagcccacatagtgatg

SEQ ID NO: 1781960 - DNA, 21 bp, Homo sapiens
ctcagcccacatagtgatggt

SEQ ID NO: 1781961 - DNA, 12 bp, Homo sapiens
ctcagcccagct

SEQ ID NO: 1781962 - DNA, 22 bp, Homo sapiens
ctcagcccagctggccacctag

SEQ ID NO: 1781963 - DNA, 23 bp, Homo sapiens
ctcagcccagctggccacctaga

SEQ ID NO: 1781964 - DNA, 22 bp, Homo sapiens
ctcagccccaaacacccaccca

SEQ ID NO: 1781965 - DNA, 16 bp, Homo sapiens
ctcagcccgcttggcc

SEQ ID NO: 1781966 - DNA, 19 bp, Homo sapiens
ctcagcccgcttggccacc

SEQ ID NO: 1781967 - DNA, 21 bp, Homo sapiens
ctcagccctccctgcccctcc

SEQ ID NO: 1781968 - DNA, 11 bp, Homo sapiens
ctcagccctgg

SEQ ID NO: 1781969 - DNA, 12 bp, Homo sapiens
ctcagccctggc

SEQ ID NO: 1781970 - DNA, 14 bp, Homo sapiens
ctcagccctggccc

SEQ ID NO: 1781971 - DNA, 15 bp, Homo sapiens
ctcagccctggccct

SEQ ID NO: 1781972 - DNA, 13 bp, Homo sapiens
ctcagccctgggc

SEQ ID NO: 1781973 - DNA, 19 bp, Homo sapiens
ctcagccctgggccccacc

SEQ ID NO: 1781974 - DNA, 18 bp, Homo sapiens
ctcagcccttgcccccat

SEQ ID NO: 1781975 - DNA, 20 bp, Homo sapiens
ctcagccgtagggtggcact

SEQ ID NO: 1781976 - DNA, 15 bp, Homo sapiens
ctcagcctcattcag

SEQ ID NO: 1781977 - DNA, 19 bp, Homo sapiens
ctcagcctcattcagcatg

SEQ ID NO: 1781978 - DNA, 20 bp, Homo sapiens
ctcagcctcattcagcatgg

SEQ ID NO: 1781979 - DNA, 23 bp, Homo sapiens
ctcagcctccaaagtggagctgg

SEQ ID NO: 1781980 - DNA, 15 bp, Homo sapiens
ctcagcctccaatgc

SEQ ID NO: 1781981 - DNA, 19 bp, Homo sapiens
ctcagcctccaatgcattg

SEQ ID NO: 1781982 - DNA, 22 bp, Homo sapiens
ctcagcctccaatgcattggcc

SEQ ID NO: 1781983 - DNA, 17 bp, Homo sapiens
ctcagcctcccaaagtg

SEQ ID NO: 1781984 - DNA, 18 bp, Homo sapiens
ctcagcctcccaagtaac

SEQ ID NO: 1781985 - DNA, 21 bp, Homo sapiens
ctcagcctcctgagtagctgg

SEQ ID NO: 1781986 - DNA, 22 bp, Homo sapiens
ctcagcctcctgagtagctgga

SEQ ID NO: 1781987 - DNA, 15 bp, Homo sapiens
ctcagcctctgccag

SEQ ID NO: 1781988 - DNA, 22 bp, Homo sapiens
ctcagcctgatcaggcttcctg

SEQ ID NO: 1781989 - DNA, 15 bp, Homo sapiens
ctcagcctggccaga

SEQ ID NO: 1781990 - DNA, 16 bp, Homo sapiens
ctcagcctggtgggcc

SEQ ID NO: 1781991 - DNA, 13 bp, Homo sapiens
ctcagcctgtgct

SEQ ID NO: 1781992 - DNA, 16 bp, Homo sapiens
ctcagcctgtgctgcc

SEQ ID NO: 1781993 - DNA, 18 bp, Homo sapiens
ctcagcctgtgctgcccg

SEQ ID NO: 1781994 - DNA, 16 bp, Homo sapiens
ctcagccttcagacag

SEQ ID NO: 1781995 - DNA, 19 bp, Homo sapiens
ctcagccttcagacagaga

SEQ ID NO: 1781996 - DNA, 23 bp, Homo sapiens
ctcagccttccccttgcccaggg

SEQ ID NO: 1781997 - DNA, 21 bp, Homo sapiens
ctcagccttgaaaaacaagtc

SEQ ID NO: 1781998 - DNA, 19 bp, Homo sapiens
ctcagccttgccagagatc

SEQ ID NO: 1781999 - DNA, 22 bp, Homo sapiens
ctcagccttgccagagatccaa

SEQ ID NO: 1782000 - DNA, 13 bp, Homo sapiens
ctcagccttgctg

SEQ ID NO: 1782001 - DNA, 16 bp, Homo sapiens
ctcagccttgctgctc

SEQ ID NO: 1782002 - DNA, 18 bp, Homo sapiens
ctcagccttgctgctctg

SEQ ID NO: 1782003 - DNA, 13 bp, Homo sapiens
ctcagcgcttaaa

SEQ ID NO: 1782004 - DNA, 21 bp, Homo sapiens
ctcagcgggggccttgaagac

SEQ ID NO: 1782005 - DNA, 17 bp, Homo sapiens
ctcagctataattctgt

SEQ ID NO: 1782006 - DNA, 14 bp, Homo sapiens
ctcagctcccaggc

SEQ ID NO: 1782007 - DNA, 15 bp, Homo sapiens
ctcagctctctggga

SEQ ID NO: 1782008 - DNA, 19 bp, Homo sapiens
ctcagctgagaaggccagc

SEQ ID NO: 1782009 - DNA, 18 bp, Homo sapiens
ctcagctgcacattcctg

SEQ ID NO: 1782010 - DNA, 21 bp, Homo sapiens
ctcagctgcacattcctggcc

SEQ ID NO: 1782011 - DNA, 22 bp, Homo sapiens
ctcagctgcacattcctggccc

SEQ ID NO: 1782012 - DNA, 11 bp, Homo sapiens
ctcagctgcat

SEQ ID NO: 1782013 - DNA, 12 bp, Homo sapiens
ctcagctgccca

SEQ ID NO: 1782014 - DNA, 20 bp, Homo sapiens
ctcagctgcccatcccagtc

SEQ ID NO: 1782015 - DNA, 15 bp, Homo sapiens
ctcagctggcagtgc

SEQ ID NO: 1782016 - DNA, 17 bp, Homo sapiens
ctcagctggcagtgcaa

SEQ ID NO: 1782017 - DNA, 19 bp, Homo sapiens
ctcagctgtcctgcagcaa

SEQ ID NO: 1782018 - DNA, 14 bp, Homo sapiens
ctcagctgtggctg

SEQ ID NO: 1782019 - DNA, 18 bp, Homo sapiens
ctcagctgtggctggagg

SEQ ID NO: 1782020 - DNA, 19 bp, Homo sapiens
ctcagctgtggctggagga

SEQ ID NO: 1782021 - DNA, 14 bp, Homo sapiens
ctcagcttatctct

SEQ ID NO: 1782022 - DNA, 12 bp, Homo sapiens
ctcagctttgag

SEQ ID NO: 1782023 - DNA, 22 bp, Homo sapiens
ctcagctttgagaagccttcag

SEQ ID NO: 1782024 - DNA, 13 bp, Homo sapiens
ctcaggaactttt

SEQ ID NO: 1782025 - DNA, 14 bp, Homo sapiens
ctcaggaagagcta

SEQ ID NO: 1782026 - DNA, 23 bp, Homo sapiens
ctcaggaagggggccgccaccct

SEQ ID NO: 1782027 - DNA, 15 bp, Homo sapiens
ctcaggaccagatgt

SEQ ID NO: 1782028 - DNA, 13 bp, Homo sapiens
ctcaggacccagg

SEQ ID NO: 1782029 - DNA, 15 bp, Homo sapiens
ctcaggacccaggcc

SEQ ID NO: 1782030 - DNA, 19 bp, Homo sapiens
ctcaggacccaggccctcc

SEQ ID NO: 1782031 - DNA, 23 bp, Homo sapiens
ctcaggacccaggccctccatgg

SEQ ID NO: 1782032 - DNA, 14 bp, Homo sapiens
ctcaggacctctgt

SEQ ID NO: 1782033 - DNA, 20 bp, Homo sapiens
ctcaggacctctgtaggcag

SEQ ID NO: 1782034 - DNA, 23 bp, Homo sapiens
ctcaggacctctgtaggcagcag

SEQ ID NO: 1782035 - DNA, 18 bp, Homo sapiens
ctcaggagatggagggct

SEQ ID NO: 1782036 - DNA, 19 bp, Homo sapiens
ctcaggagatggagggctt

SEQ ID NO: 1782037 - DNA, 20 bp, Homo sapiens
ctcaggagatggagggcttg

SEQ ID NO: 1782038 - DNA, 14 bp, Homo sapiens
ctcaggagcacagg

SEQ ID NO: 1782039 - DNA, 17 bp, Homo sapiens
ctcaggagcacaggcag

SEQ ID NO: 1782040 - DNA, 17 bp, Homo sapiens
ctcaggaggcaggacct

SEQ ID NO: 1782041 - DNA, 20 bp, Homo sapiens
ctcaggaggcgcccttggct

SEQ ID NO: 1782042 - DNA, 13 bp, Homo sapiens
ctcaggaggctga

SEQ ID NO: 1782043 - DNA, 14 bp, Homo sapiens
ctcaggaggctgag

SEQ ID NO: 1782044 - DNA, 17 bp, Homo sapiens
ctcaggaggctgagaca

SEQ ID NO: 1782045 - DNA, 20 bp, Homo sapiens
ctcaggaggctgagacagga

SEQ ID NO: 1782046 - DNA, 22 bp, Homo sapiens
ctcaggaggctgagacaggaga

SEQ ID NO: 1782047 - DNA, 15 bp, Homo sapiens
ctcaggaggctgagg

SEQ ID NO: 1782048 - DNA, 19 bp, Homo sapiens
ctcaggaggctgaggcagg

SEQ ID NO: 1782049 - DNA, 23 bp, Homo sapiens
ctcaggaggctgaggcaggagga

SEQ ID NO: 1782050 - DNA, 19 bp, Homo sapiens
ctcaggagggtgacgccca

SEQ ID NO: 1782051 - DNA, 20 bp, Homo sapiens
ctcaggagggtgacgcccag

SEQ ID NO: 1782052 - DNA, 21 bp, Homo sapiens
ctcaggagggtgacgcccagc

SEQ ID NO: 1782053 - DNA, 15 bp, Homo sapiens
ctcaggagtctgcca

SEQ ID NO: 1782054 - DNA, 20 bp, Homo sapiens
ctcaggagtttgagaccagg

SEQ ID NO: 1782055 - DNA, 12 bp, Homo sapiens
ctcaggatccaa

SEQ ID NO: 1782056 - DNA, 22 bp, Homo sapiens
ctcaggatgcccagggccactc

SEQ ID NO: 1782057 - DNA, 22 bp, Homo sapiens
ctcaggcaagcccctcagccct

SEQ ID NO: 1782058 - DNA, 23 bp, Homo sapiens
ctcaggcaagcccctcagccctt

SEQ ID NO: 1782059 - DNA, 14 bp, Homo sapiens
ctcaggcacacagc

SEQ ID NO: 1782060 - DNA, 16 bp, Homo sapiens
ctcaggcacacagcta

SEQ ID NO: 1782061 - DNA, 19 bp, Homo sapiens
ctcaggcagacaagagctg

SEQ ID NO: 1782062 - DNA, 16 bp, Homo sapiens
ctcaggcagcaccaca

SEQ ID NO: 1782063 - DNA, 17 bp, Homo sapiens
ctcaggcagcaccacac

SEQ ID NO: 1782064 - DNA, 22 bp, Homo sapiens
ctcaggcagcgtgtgggtcccg

SEQ ID NO: 1782065 - DNA, 17 bp, Homo sapiens
ctcaggcataggcctgg

SEQ ID NO: 1782066 - DNA, 20 bp, Homo sapiens
ctcaggcataggcctgggtg

SEQ ID NO: 1782067 - DNA, 21 bp, Homo sapiens
ctcaggcataggcctgggtgc

SEQ ID NO: 1782068 - DNA, 15 bp, Homo sapiens
ctcaggccagggctc

SEQ ID NO: 1782069 - DNA, 18 bp, Homo sapiens
ctcaggccaggtgcagtg

SEQ ID NO: 1782070 - DNA, 13 bp, Homo sapiens
ctcaggcccagct

SEQ ID NO: 1782071 - DNA, 23 bp, Homo sapiens
ctcaggccgaaggaggagtcagg

SEQ ID NO: 1782072 - DNA, 20 bp, Homo sapiens
ctcaggcctgactctcagca

SEQ ID NO: 1782073 - DNA, 14 bp, Homo sapiens
ctcaggctctgcac

SEQ ID NO: 1782074 - DNA, 23 bp, Homo sapiens
ctcaggctctgcacagacaagca

SEQ ID NO: 1782075 - DNA, 17 bp, Homo sapiens
ctcaggctctgccctgc

SEQ ID NO: 1782076 - DNA, 19 bp, Homo sapiens
ctcaggctctgccctgccc

SEQ ID NO: 1782077 - DNA, 22 bp, Homo sapiens
ctcaggctctgccctgccctag

SEQ ID NO: 1782078 - DNA, 22 bp, Homo sapiens
ctcaggctttcactatttcctt

SEQ ID NO: 1782079 - DNA, 14 bp, Homo sapiens
ctcagggaagccca

SEQ ID NO: 1782080 - DNA, 19 bp, Homo sapiens
ctcagggaagcccagctcc

SEQ ID NO: 1782081 - DNA, 20 bp, Homo sapiens
ctcagggacagagacacctg

SEQ ID NO: 1782082 - DNA, 22 bp, Homo sapiens
ctcagggacagagacacctgca

SEQ ID NO: 1782083 - DNA, 11 bp, Homo sapiens
ctcagggaccg

SEQ ID NO: 1782084 - DNA, 22 bp, Homo sapiens
ctcagggaccggtgctgcagga

SEQ ID NO: 1782085 - DNA, 18 bp, Homo sapiens
ctcagggagcagggaagg

SEQ ID NO: 1782086 - DNA, 19 bp, Homo sapiens
ctcagggagcagggaaggc

SEQ ID NO: 1782087 - DNA, 23 bp, Homo sapiens
ctcagggagcagggaaggcctga

SEQ ID NO: 1782088 - DNA, 14 bp, Homo sapiens
ctcagggcagacag

SEQ ID NO: 1782089 - DNA, 21 bp, Homo sapiens
ctcagggcagcctcccccggc

SEQ ID NO: 1782090 - DNA, 15 bp, Homo sapiens
ctcagggccatgctg

SEQ ID NO: 1782091 - DNA, 18 bp, Homo sapiens
ctcagggccatgctgagg

SEQ ID NO: 1782092 - DNA, 12 bp, Homo sapiens
ctcagggcccca

SEQ ID NO: 1782093 - DNA, 19 bp, Homo sapiens
ctcagggcgctcagacggc

SEQ ID NO: 1782094 - DNA, 11 bp, Homo sapiens
ctcagggctgg

SEQ ID NO: 1782095 - DNA, 15 bp, Homo sapiens
ctcagggctggagtg

SEQ ID NO: 1782096 - DNA, 16 bp, Homo sapiens
ctcagggctggagtgc

SEQ ID NO: 1782097 - DNA, 20 bp, Homo sapiens
ctcaggggcctggaggtctg

SEQ ID NO: 1782098 - DNA, 18 bp, Homo sapiens
ctcagggtcaaagacaga

SEQ ID NO: 1782099 - DNA, 14 bp, Homo sapiens
ctcagggtcactga

SEQ ID NO: 1782100 - DNA, 14 bp, Homo sapiens
ctcagggtgggggg

SEQ ID NO: 1782101 - DNA, 17 bp, Homo sapiens
ctcagggtggggggtga

SEQ ID NO: 1782102 - DNA, 21 bp, Homo sapiens
ctcaggtacggagaagaatag

SEQ ID NO: 1782103 - DNA, 17 bp, Homo sapiens
ctcaggtagaaggttga

SEQ ID NO: 1782104 - DNA, 19 bp, Homo sapiens
ctcaggtcacataaaactt

SEQ ID NO: 1782105 - DNA, 13 bp, Homo sapiens
ctcaggtgccact

SEQ ID NO: 1782106 - DNA, 14 bp, Homo sapiens
ctcaggtgccactc

SEQ ID NO: 1782107 - DNA, 17 bp, Homo sapiens
ctcaggtgccactccct

SEQ ID NO: 1782108 - DNA, 19 bp, Homo sapiens
ctcaggtgccactccctga

SEQ ID NO: 1782109 - DNA, 12 bp, Homo sapiens
ctcaggtgcctt

SEQ ID NO: 1782110 - DNA, 14 bp, Homo sapiens
ctcaggtgctgtcc

SEQ ID NO: 1782111 - DNA, 21 bp, Homo sapiens
ctcaggtggccagcctggatc

SEQ ID NO: 1782112 - DNA, 15 bp, Homo sapiens
ctcaggttccagaac

SEQ ID NO: 1782113 - DNA, 14 bp, Homo sapiens
ctcaggttgtctga

SEQ ID NO: 1782114 - DNA, 16 bp, Homo sapiens
ctcaggtttgtcctgg

SEQ ID NO: 1782115 - DNA, 23 bp, Homo sapiens
ctcaggtttgtcctggtcatgca

SEQ ID NO: 1782116 - DNA, 12 bp, Homo sapiens
ctcagtaaacgg

SEQ ID NO: 1782117 - DNA, 22 bp, Homo sapiens
ctcagtaacataactgcttctt

SEQ ID NO: 1782118 - DNA, 18 bp, Homo sapiens
ctcagtaacatttctgtt

SEQ ID NO: 1782119 - DNA, 19 bp, Homo sapiens
ctcagtaacatttctgttc

SEQ ID NO: 1782120 - DNA, 13 bp, Homo sapiens
ctcagtagtccct

SEQ ID NO: 1782121 - DNA, 20 bp, Homo sapiens
ctcagtatgctttccctgag

SEQ ID NO: 1782122 - DNA, 23 bp, Homo sapiens
ctcagtatgctttccctgaggaa

SEQ ID NO: 1782123 - DNA, 17 bp, Homo sapiens
ctcagtcatcaaagcag

SEQ ID NO: 1782124 - DNA, 15 bp, Homo sapiens
ctcagtctaaggtct

SEQ ID NO: 1782125 - DNA, 14 bp, Homo sapiens
ctcagtctcaggag

SEQ ID NO: 1782126 - DNA, 15 bp, Homo sapiens
ctcagtctcaggagc

SEQ ID NO: 1782127 - DNA, 14 bp, Homo sapiens
ctcagtgaaggtgg

SEQ ID NO: 1782128 - DNA, 19 bp, Homo sapiens
ctcagtgaaggtggtgggg

SEQ ID NO: 1782129 - DNA, 20 bp, Homo sapiens
ctcagtgaaggtggtggggc

SEQ ID NO: 1782130 - DNA, 22 bp, Homo sapiens
ctcagtgaagtacacctgtgtg

SEQ ID NO: 1782131 - DNA, 14 bp, Homo sapiens
ctcagtgagctggg

SEQ ID NO: 1782132 - DNA, 22 bp, Homo sapiens
ctcagtgatacgtacagccaaa

SEQ ID NO: 1782133 - DNA, 10 bp, Homo sapiens
ctcagtgcag

SEQ ID NO: 1782134 - DNA, 15 bp, Homo sapiens
ctcagtgcagatgga

SEQ ID NO: 1782135 - DNA, 12 bp, Homo sapiens
ctcagtgccact

SEQ ID NO: 1782136 - DNA, 13 bp, Homo sapiens
ctcagtgccactt

SEQ ID NO: 1782137 - DNA, 15 bp, Homo sapiens
ctcagtgccttcctc

SEQ ID NO: 1782138 - DNA, 17 bp, Homo sapiens
ctcagtgccttctctca

SEQ ID NO: 1782139 - DNA, 18 bp, Homo sapiens
ctcagtgccttctctcag

SEQ ID NO: 1782140 - DNA, 21 bp, Homo sapiens
ctcagtgccttctctcagctc

SEQ ID NO: 1782141 - DNA, 11 bp, Homo sapiens
gaggagtaaca

SEQ ID NO: 1782142 - DNA, 12 bp, Homo sapiens
gaggagtaacaa

SEQ ID NO: 1782143 - DNA, 21 bp, Homo sapiens
gaggagtaacaatacaaatgg

SEQ ID NO: 1782144 - DNA, 14 bp, Homo sapiens
gaggatacagagga

SEQ ID NO: 1782145 - DNA, 17 bp, Homo sapiens
gaggatacagaggagat

SEQ ID NO: 1782146 - DNA, 14 bp, Homo sapiens
gaggatacagctct

SEQ ID NO: 1782147 - DNA, 20 bp, Homo sapiens
gaggatagtagttaaataac

SEQ ID NO: 1782148 - DNA, 22 bp, Homo sapiens
gaggatgaatagatgtgatcac

SEQ ID NO: 1782149 - DNA, 13 bp, Homo sapiens
gaggatgagcaga

SEQ ID NO: 1782150 - DNA, 14 bp, Homo sapiens
gaggatgagcagag

SEQ ID NO: 1782151 - DNA, 13 bp, Homo sapiens
gaggatgcctttt

SEQ ID NO: 1782152 - DNA, 20 bp, Homo sapiens
gaggatgctctttcccagga

SEQ ID NO: 1782153 - DNA, 16 bp, Homo sapiens
gaggatgctgcagtga

SEQ ID NO: 1782154 - DNA, 14 bp, Homo sapiens
gaggatggagagag

SEQ ID NO: 1782155 - DNA, 15 bp, Homo sapiens
gaggatgtctgggcc

SEQ ID NO: 1782156 - DNA, 17 bp, Homo sapiens
gaggattctttccccag

SEQ ID NO: 1782157 - DNA, 18 bp, Homo sapiens
gaggattgcttgagccca

SEQ ID NO: 1782158 - DNA, 20 bp, Homo sapiens
gaggatttaagggatggaaa

SEQ ID NO: 1782159 - DNA, 19 bp, Homo sapiens
gaggcaacactgctgtcca

SEQ ID NO: 1782160 - DNA, 14 bp, Homo sapiens
gaggcaagaaaagg

SEQ ID NO: 1782161 - DNA, 15 bp, Homo sapiens
gaggcacactttctg

SEQ ID NO: 1782162 - DNA, 19 bp, Homo sapiens
gaggcacactttctggcaa

SEQ ID NO: 1782163 - DNA, 20 bp, Homo sapiens
gaggcaccagctctgtggcc

SEQ ID NO: 1782164 - DNA, 19 bp, Homo sapiens
gaggcaccagtgtcctccc

SEQ ID NO: 1782165 - DNA, 13 bp, Homo sapiens
gaggcacctccag

SEQ ID NO: 1782166 - DNA, 17 bp, Homo sapiens
gaggcacctccaggcag

SEQ ID NO: 1782167 - DNA, 22 bp, Homo sapiens
gaggcacctccaggcaggccag

SEQ ID NO: 1782168 - DNA, 16 bp, Homo sapiens
gaggcactagtcaccg

SEQ ID NO: 1782169 - DNA, 20 bp, Homo sapiens
gaggcagacagcagctcagg

SEQ ID NO: 1782170 - DNA, 21 bp, Homo sapiens
gaggcagcatgcttgggctga

SEQ ID NO: 1782171 - DNA, 12 bp, Homo sapiens
gaggcagccagg

SEQ ID NO: 1782172 - DNA, 18 bp, Homo sapiens
gaggcaggagaatcactt

SEQ ID NO: 1782173 - DNA, 16 bp, Homo sapiens
gaggcaggcatggccc

SEQ ID NO: 1782174 - DNA, 19 bp, Homo sapiens
gaggcaggcatggccctgg

SEQ ID NO: 1782175 - DNA, 19 bp, Homo sapiens
gaggcagggcaaatgacat

SEQ ID NO: 1782176 - DNA, 23 bp, Homo sapiens
gaggcagggcaaatgacatgcac

SEQ ID NO: 1782177 - DNA, 17 bp, Homo sapiens
gaggcagggccttgccc

SEQ ID NO: 1782178 - DNA, 18 bp, Homo sapiens
gaggcagggccttgccca

SEQ ID NO: 1782179 - DNA, 23 bp, Homo sapiens
gaggcagggccttgcccagagat

SEQ ID NO: 1782180 - DNA, 15 bp, Homo sapiens
gaggcaggggcggag

SEQ ID NO: 1782181 - DNA, 15 bp, Homo sapiens
gaggcaggggctctg

SEQ ID NO: 1782182 - DNA, 11 bp, Homo sapiens
gaggcaggtga

SEQ ID NO: 1782183 - DNA, 19 bp, Homo sapiens
gaggcaggtggatcacctg

SEQ ID NO: 1782184 - DNA, 21 bp, Homo sapiens
gaggcagtgatgacttgctgt

SEQ ID NO: 1782185 - DNA, 19 bp, Homo sapiens
gaggcatcctacccttttc

SEQ ID NO: 1782186 - DNA, 14 bp, Homo sapiens
gaggcatcttttct

SEQ ID NO: 1782187 - DNA, 15 bp, Homo sapiens
gaggcatggctgggg

SEQ ID NO: 1782188 - DNA, 18 bp, Homo sapiens
gaggcatggggcatgtcc

SEQ ID NO: 1782189 - DNA, 13 bp, Homo sapiens
gaggcatggtgtg

SEQ ID NO: 1782190 - DNA, 16 bp, Homo sapiens
gaggcattcggggaag

SEQ ID NO: 1782191 - DNA, 17 bp, Homo sapiens
gaggcattcggggaagc

SEQ ID NO: 1782192 - DNA, 23 bp, Homo sapiens
gaggcattgttagtttagtgtgt

SEQ ID NO: 1782193 - DNA, 12 bp, Homo sapiens
gaggcattgttt

SEQ ID NO: 1782194 - DNA, 18 bp, Homo sapiens
gaggccaaaggctggtgg

SEQ ID NO: 1782195 - DNA, 14 bp, Homo sapiens
gaggccaaccagcc

SEQ ID NO: 1782196 - DNA, 20 bp, Homo sapiens
gaggccaaccagcccgacag

SEQ ID NO: 1782197 - DNA, 12 bp, Homo sapiens
gaggccaaggca

SEQ ID NO: 1782198 - DNA, 14 bp, Homo sapiens
gaggccaaggcagg

SEQ ID NO: 1782199 - DNA, 19 bp, Homo sapiens
gaggccacattgctggctg

SEQ ID NO: 1782200 - DNA, 14 bp, Homo sapiens
gaggccacccactg

SEQ ID NO: 1782201 - DNA, 21 bp, Homo sapiens
gaggccaccgggacagacctg

SEQ ID NO: 1782202 - DNA, 15 bp, Homo sapiens
gaggccacctatgcc

SEQ ID NO: 1782203 - DNA, 16 bp, Homo sapiens
gaggccacctctccaa

SEQ ID NO: 1782204 - DNA, 16 bp, Homo sapiens
gaggccacttagggaa

SEQ ID NO: 1782205 - DNA, 13 bp, Homo sapiens
gaggccagcccca

SEQ ID NO: 1782206 - DNA, 14 bp, Homo sapiens
gaggccagccccac

SEQ ID NO: 1782207 - DNA, 13 bp, Homo sapiens
gaggccagcctgg

SEQ ID NO: 1782208 - DNA, 12 bp, Homo sapiens
gaggccaggagt

SEQ ID NO: 1782209 - DNA, 15 bp, Homo sapiens
gaggccagggcagca

SEQ ID NO: 1782210 - DNA, 16 bp, Homo sapiens
gaggccataaaataag

SEQ ID NO: 1782211 - DNA, 18 bp, Homo sapiens
gaggcccaagagccctgt

SEQ ID NO: 1782212 - DNA, 12 bp, Homo sapiens
gaggcccaagga

SEQ ID NO: 1782213 - DNA, 23 bp, Homo sapiens
gaggcccaaggagcttacccaag

SEQ ID NO: 1782214 - DNA, 17 bp, Homo sapiens
gaggcccactagagggc

SEQ ID NO: 1782215 - DNA, 16 bp, Homo sapiens
gaggcccagccctcag

SEQ ID NO: 1782216 - DNA, 20 bp, Homo sapiens
gaggcccagcgggcagatgg

SEQ ID NO: 1782217 - DNA, 20 bp, Homo sapiens
gaggcccagttcaccctgat

SEQ ID NO: 1782218 - DNA, 22 bp, Homo sapiens
gaggcctgggccgctgccacgt

SEQ ID NO: 1782219 - DNA, 13 bp, Homo sapiens
gaggcctgggctg

SEQ ID NO: 1782220 - DNA, 17 bp, Homo sapiens
gaggcctgggctgggaa

SEQ ID NO: 1782221 - DNA, 18 bp, Homo sapiens
gaggcctgggggacccct

SEQ ID NO: 1782222 - DNA, 20 bp, Homo sapiens
gaggccttatcattcattct

SEQ ID NO: 1782223 - DNA, 14 bp, Homo sapiens
gaggccttccagct

SEQ ID NO: 1782224 - DNA, 15 bp, Homo sapiens
gaggccttccagctg

SEQ ID NO: 1782225 - DNA, 18 bp, Homo sapiens
gaggccttgtgtgtcagg

SEQ ID NO: 1782226 - DNA, 21 bp, Homo sapiens
gaggccttgtgtgtcaggccc

SEQ ID NO: 1782227 - DNA, 16 bp, Homo sapiens
gaggcgatgccagcct

SEQ ID NO: 1782228 - DNA, 18 bp, Homo sapiens
gaggcggcccggccagcg

SEQ ID NO: 1782229 - DNA, 14 bp, Homo sapiens
gaggcgggccagcc

SEQ ID NO: 1782230 - DNA, 15 bp, Homo sapiens
gaggcgggccagcca

SEQ ID NO: 1782231 - DNA, 20 bp, Homo sapiens
gaggcgggccagccaggcgg

SEQ ID NO: 1782232 - DNA, 19 bp, Homo sapiens
gaggcgggtggatcacttg

SEQ ID NO: 1782233 - DNA, 21 bp, Homo sapiens
gaggcgggtggatcacttgag

SEQ ID NO: 1782234 - DNA, 14 bp, Homo sapiens
gaggcgtgcccccc

SEQ ID NO: 1782235 - DNA, 21 bp, Homo sapiens
gaggcgtgcccccctcctcca

SEQ ID NO: 1782236 - DNA, 21 bp, Homo sapiens
gaggctaattcagtgtcacat

SEQ ID NO: 1782237 - DNA, 20 bp, Homo sapiens
gaggctattattttcactgt

SEQ ID NO: 1782238 - DNA, 17 bp, Homo sapiens
gaggctgacatgctcac

SEQ ID NO: 1782239 - DNA, 18 bp, Homo sapiens
gaggctgacttttccaaa

SEQ ID NO: 1782240 - DNA, 12 bp, Homo sapiens
gaggctgaggca

SEQ ID NO: 1782241 - DNA, 14 bp, Homo sapiens
gaggctgaggcaga

SEQ ID NO: 1782242 - DNA, 16 bp, Homo sapiens
gaggctgaggcagaag

SEQ ID NO: 1782243 - DNA, 18 bp, Homo sapiens
gaggctgaggcagaagaa

SEQ ID NO: 1782244 - DNA, 16 bp, Homo sapiens
gaggctgaggcaggag

SEQ ID NO: 1782245 - DNA, 18 bp, Homo sapiens
gaggctgaggcaggagaa

SEQ ID NO: 1782246 - DNA, 14 bp, Homo sapiens
gaggctgaggcctg

SEQ ID NO: 1782247 - DNA, 18 bp, Homo sapiens
gaggctgaggcctggact

SEQ ID NO: 1782248 - DNA, 19 bp, Homo sapiens
gaggctgaggcctggactt

SEQ ID NO: 1782249 - DNA, 15 bp, Homo sapiens
gaggctgagttctgg

SEQ ID NO: 1782250 - DNA, 19 bp, Homo sapiens
gaggctgcaatgagccatg

SEQ ID NO: 1782251 - DNA, 15 bp, Homo sapiens
gaggctgcagtcagc

SEQ ID NO: 1782252 - DNA, 19 bp, Homo sapiens
gaggctgcagtcagccctg

SEQ ID NO: 1782253 - DNA, 17 bp, Homo sapiens
gaggctgcatgctctgg

SEQ ID NO: 1782254 - DNA, 15 bp, Homo sapiens
gaggctgccccaggc

SEQ ID NO: 1782255 - DNA, 18 bp, Homo sapiens
gaggctgccccaggccgg

SEQ ID NO: 1782256 - DNA, 23 bp, Homo sapiens
gaggctgccgagacagaccctct

SEQ ID NO: 1782257 - DNA, 15 bp, Homo sapiens
gaggctgcctcagcc

SEQ ID NO: 1782258 - DNA, 24 bp, Homo sapiens
gaggctgcctcagccagtggcaca

SEQ ID NO: 1782259 - DNA, 14 bp, Homo sapiens
gaggctgcctctcc

SEQ ID NO: 1782260 - DNA, 11 bp, Homo sapiens
gaggctgctag

SEQ ID NO: 1782261 - DNA, 12 bp, Homo sapiens
gaggctgctgtg

SEQ ID NO: 1782262 - DNA, 12 bp, Homo sapiens
gaggctgctttc

SEQ ID NO: 1782263 - DNA, 14 bp, Homo sapiens
gaggctggaggcag

SEQ ID NO: 1782264 - DNA, 19 bp, Homo sapiens
gaggctggaggcagggcct

SEQ ID NO: 1782265 - DNA, 12 bp, Homo sapiens
gaggctggcagg

SEQ ID NO: 1782266 - DNA, 12 bp, Homo sapiens
gaggctggccaa

SEQ ID NO: 1782267 - DNA, 17 bp, Homo sapiens
gaggctgggggagagcc

SEQ ID NO: 1782268 - DNA, 12 bp, Homo sapiens
gaggctgtcctg

SEQ ID NO: 1782269 - DNA, 14 bp, Homo sapiens
gaggctgtcctgta

SEQ ID NO: 1782270 - DNA, 23 bp, Homo sapiens
gaggctgtggtcacagcggaggt

SEQ ID NO: 1782271 - DNA, 17 bp, Homo sapiens
gaggctgttcccaccag

SEQ ID NO: 1782272 - DNA, 13 bp, Homo sapiens
gaggcttcacgcc

SEQ ID NO: 1782273 - DNA, 16 bp, Homo sapiens
gaggcttccaggctct

SEQ ID NO: 1782274 - DNA, 15 bp, Homo sapiens
gaggcttctccgcca

SEQ ID NO: 1782275 - DNA, 23 bp, Homo sapiens
gaggcttgtttacctttctctct

SEQ ID NO: 1782276 - DNA, 18 bp, Homo sapiens
gaggcttttcccaccagc

SEQ ID NO: 1782277 - DNA, 20 bp, Homo sapiens
gaggcttttcccaccagctc

SEQ ID NO: 1782278 - DNA, 23 bp, Homo sapiens
gaggcttttcccaccagctccca

SEQ ID NO: 1782279 - DNA, 15 bp, Homo sapiens
gagggaacagacagg

SEQ ID NO: 1782280 - DNA, 22 bp, Homo sapiens
gagggaacatcctaagacagag

SEQ ID NO: 1782281 - DNA, 14 bp, Homo sapiens
gagggaagaccaga

SEQ ID NO: 1782282 - DNA, 13 bp, Homo sapiens
gagggaagctggc

SEQ ID NO: 1782283 - DNA, 18 bp, Homo sapiens
gagggaagctggctgggc

SEQ ID NO: 1782284 - DNA, 21 bp, Homo sapiens
gagggaatgttccctgcaccc

SEQ ID NO: 1782285 - DNA, 15 bp, Homo sapiens
gagggacactcctcc

SEQ ID NO: 1782286 - DNA, 13 bp, Homo sapiens
gagggacaggctg

SEQ ID NO: 1782287 - DNA, 20 bp, Homo sapiens
gagggacaggctgaagagag

SEQ ID NO: 1782288 - DNA, 12 bp, Homo sapiens
gagggaccagcc

SEQ ID NO: 1782289 - DNA, 16 bp, Homo sapiens
gagggcccctctgccc

SEQ ID NO: 1782290 - DNA, 18 bp, Homo sapiens
gagggcccctctgcccag

SEQ ID NO: 1782291 - DNA, 13 bp, Homo sapiens
gagggcccctgcg

SEQ ID NO: 1782292 - DNA, 19 bp, Homo sapiens
gagggcccctgcgtggggg

SEQ ID NO: 1782293 - DNA, 14 bp, Homo sapiens
gagggccgcccgct

SEQ ID NO: 1782294 - DNA, 18 bp, Homo sapiens
gagggcctctgcctggga

SEQ ID NO: 1782295 - DNA, 16 bp, Homo sapiens
gagggcctgcagtgat

SEQ ID NO: 1782296 - DNA, 19 bp, Homo sapiens
gagggcggcaggggcctgg

SEQ ID NO: 1782297 - DNA, 14 bp, Homo sapiens
gagggctcactcag

SEQ ID NO: 1782298 - DNA, 17 bp, Homo sapiens
gagggctcactcagcca

SEQ ID NO: 1782299 - DNA, 14 bp, Homo sapiens
gagggctctgtttg

SEQ ID NO: 1782300 - DNA, 16 bp, Homo sapiens
gagggctggaggccca

SEQ ID NO: 1782301 - DNA, 17 bp, Homo sapiens
gagggctggaggcccag

SEQ ID NO: 1782302 - DNA, 20 bp, Homo sapiens
gagggctggaggcccaggct

SEQ ID NO: 1782303 - DNA, 16 bp, Homo sapiens
gagggctggctggcct

SEQ ID NO: 1782304 - DNA, 16 bp, Homo sapiens
gaggggaagaggcctg

SEQ ID NO: 1782305 - DNA, 14 bp, Homo sapiens
gaggggaaggggct

SEQ ID NO: 1782306 - DNA, 18 bp, Homo sapiens
gaggggaataatagaaga

SEQ ID NO: 1782307 - DNA, 19 bp, Homo sapiens
gaggggaataatagaagaa

SEQ ID NO: 1782308 - DNA, 22 bp, Homo sapiens
gaggggactatttatgaaggca

SEQ ID NO: 1782309 - DNA, 12 bp, Homo sapiens
gaggggagaagc

SEQ ID NO: 1782310 - DNA, 14 bp, Homo sapiens
gaggggatatttag

SEQ ID NO: 1782311 - DNA, 13 bp, Homo sapiens
gaggggatccagc

SEQ ID NO: 1782312 - DNA, 18 bp, Homo sapiens
gaggggatggggatagag

SEQ ID NO: 1782313 - DNA, 19 bp, Homo sapiens
gaggggcagcgcatgtgtg

SEQ ID NO: 1782314 - DNA, 23 bp, Homo sapiens
gaggggcaggtctagtgttcctg

SEQ ID NO: 1782315 - DNA, 17 bp, Homo sapiens
gaggggcatctgcccct

SEQ ID NO: 1782316 - DNA, 21 bp, Homo sapiens
gaggggccggccctgtgtgca

SEQ ID NO: 1782317 - DNA, 15 bp, Homo sapiens
gaggggcctagggag

SEQ ID NO: 1782318 - DNA, 17 bp, Homo sapiens
gaggggcctagggagcc

SEQ ID NO: 1782319 - DNA, 18 bp, Homo sapiens
gaggggcctggcagccgt

SEQ ID NO: 1782320 - DNA, 19 bp, Homo sapiens
gaggggcgctggcccagcc

SEQ ID NO: 1782321 - DNA, 20 bp, Homo sapiens
gaggggcgctggcccagccg

SEQ ID NO: 1782322 - DNA, 21 bp, Homo sapiens
gaggggcggcaggagggaggt

SEQ ID NO: 1782323 - DNA, 23 bp, Homo sapiens
gaggggctggggacttgtgtctg

SEQ ID NO: 1782324 - DNA, 21 bp, Homo sapiens
gagggggccgggcgcggtggc

SEQ ID NO: 1782325 - DNA, 21 bp, Homo sapiens
gagggggcttgaagccaaaga

SEQ ID NO: 1782326 - DNA, 23 bp, Homo sapiens
gaggggggtgctggcccccagga

SEQ ID NO: 1782327 - DNA, 13 bp, Homo sapiens
gagggggtggagg

SEQ ID NO: 1782328 - DNA, 23 bp, Homo sapiens
gaggggtgagtcccctactccct

SEQ ID NO: 1782329 - DNA, 15 bp, Homo sapiens
gaggggtggggagct

SEQ ID NO: 1782330 - DNA, 18 bp, Homo sapiens
gaggggtggggagctaga

SEQ ID NO: 1782331 - DNA, 18 bp, Homo sapiens
gaggggtgtggcagtggt

SEQ ID NO: 1782332 - DNA, 17 bp, Homo sapiens
gagggtccacctggaga

SEQ ID NO: 1782333 - DNA, 18 bp, Homo sapiens
gagggtccctaattctct

SEQ ID NO: 1782334 - DNA, 15 bp, Homo sapiens
gagggtcctggctcc

SEQ ID NO: 1782335 - DNA, 15 bp, Homo sapiens
gagggtctggagaag

SEQ ID NO: 1782336 - DNA, 19 bp, Homo sapiens
gagggtgacgcccagctcc

SEQ ID NO: 1782337 - DNA, 13 bp, Homo sapiens
gagggtggagact

SEQ ID NO: 1782338 - DNA, 20 bp, Homo sapiens
gagggtggatcacacctcag

SEQ ID NO: 1782339 - DNA, 13 bp, Homo sapiens
gagggtgggaagg

SEQ ID NO: 1782340 - DNA, 19 bp, Homo sapiens
gagggtgggagagcccagc

SEQ ID NO: 1782341 - DNA, 18 bp, Homo sapiens
gagggtgtatctagctct

SEQ ID NO: 1782342 - DNA, 17 bp, Homo sapiens
gagggttcccctggcct

SEQ ID NO: 1782343 - DNA, 17 bp, Homo sapiens
gagggttggggaggggc

SEQ ID NO: 1782344 - DNA, 18 bp, Homo sapiens
gagggtttgagagcccgc

SEQ ID NO: 1782345 - DNA, 21 bp, Homo sapiens
gagggttttaggtagaaaaac

SEQ ID NO: 1782346 - DNA, 20 bp, Homo sapiens
gaggtactggtcccttcctt

SEQ ID NO: 1782347 - DNA, 21 bp, Homo sapiens
gaggtaggtggatcacctgag

SEQ ID NO: 1782348 - DNA, 17 bp, Homo sapiens
gaggtataaagacaagt

SEQ ID NO: 1782349 - DNA, 15 bp, Homo sapiens
gaggtcaacagagaa

SEQ ID NO: 1782350 - DNA, 22 bp, Homo sapiens
gaggtcaacagagaaggcagga

SEQ ID NO: 1782351 - DNA, 13 bp, Homo sapiens
gaggtcaccagct

SEQ ID NO: 1782352 - DNA, 18 bp, Homo sapiens
gaggtcaccagctgctgt

SEQ ID NO: 1782353 - DNA, 16 bp, Homo sapiens
gaggtcaccaggggag

SEQ ID NO: 1782354 - DNA, 20 bp, Homo sapiens
gaggtcaccaggggaggagc

SEQ ID NO: 1782355 - DNA, 14 bp, Homo sapiens
gaggttaaggtggg

SEQ ID NO: 1782356 - DNA, 21 bp, Homo sapiens
gaggttaaggtgggtccagga

SEQ ID NO: 1782357 - DNA, 13 bp, Homo sapiens
gaggttataggtc

SEQ ID NO: 1782358 - DNA, 13 bp, Homo sapiens
gaggttatctgcc

SEQ ID NO: 1782359 - DNA, 14 bp, Homo sapiens
gaggttatctgcct

SEQ ID NO: 1782360 - DNA, 20 bp, Homo sapiens
gaggttatctgcctggcctg

SEQ ID NO: 1782361 - DNA, 18 bp, Homo sapiens
gaggttattttccgccag

SEQ ID NO: 1782362 - DNA, 16 bp, Homo sapiens
gaggttcctctgcctg

SEQ ID NO: 1782363 - DNA, 18 bp, Homo sapiens
gaggttcctctgcctgcc

SEQ ID NO: 1782364 - DNA, 19 bp, Homo sapiens
gaggttcctctgcctgccc

SEQ ID NO: 1782365 - DNA, 15 bp, Homo sapiens
gaggttgaagccaag

SEQ ID NO: 1782366 - DNA, 20 bp, Homo sapiens
gaggttgattttcatgattc

SEQ ID NO: 1782367 - DNA, 13 bp, Homo sapiens
gaggttgcagtga

SEQ ID NO: 1782368 - DNA, 19 bp, Homo sapiens
gaggttgcagtgagccaag

SEQ ID NO: 1782369 - DNA, 13 bp, Homo sapiens
gaggttgtagtga

SEQ ID NO: 1782370 - DNA, 21 bp, Homo sapiens
gagtaaaacattttatttctt

SEQ ID NO: 1782371 - DNA, 19 bp, Homo sapiens
gagtaacaatacaaatgga

SEQ ID NO: 1782372 - DNA, 19 bp, Homo sapiens
gagtaacacataacattgt

SEQ ID NO: 1782373 - DNA, 17 bp, Homo sapiens
gagtaacatttgctgtt

SEQ ID NO: 1782374 - DNA, 17 bp, Homo sapiens
gagtaagacaagtggga

SEQ ID NO: 1782375 - DNA, 13 bp, Homo sapiens
gagtaagcagtgt

SEQ ID NO: 1782376 - DNA, 14 bp, Homo sapiens
gagtaatcaggcag

SEQ ID NO: 1782377 - DNA, 17 bp, Homo sapiens
gagtaatggtgtagaac

SEQ ID NO: 1782378 - DNA, 16 bp, Homo sapiens
gagtaatttattgttt

SEQ ID NO: 1782379 - DNA, 21 bp, Homo sapiens
gagtacaaaacaatctctcaa

SEQ ID NO: 1782380 - DNA, 19 bp, Homo sapiens
gagtacctgcaaaaatgag

SEQ ID NO: 1782381 - DNA, 17 bp, Homo sapiens
gagtacctgctgcccca

SEQ ID NO: 1782382 - DNA, 17 bp, Homo sapiens
gagtagccgagagcctg

SEQ ID NO: 1782383 - DNA, 23 bp, Homo sapiens
gagtaggagcactggggtggggg

SEQ ID NO: 1782384 - DNA, 15 bp, Homo sapiens
gagtaggctgtattt

SEQ ID NO: 1782385 - DNA, 19 bp, Homo sapiens
gagtaggctgtattttctt

SEQ ID NO: 1782386 - DNA, 21 bp, Homo sapiens
gagtagttgatgttgcatttt

SEQ ID NO: 1782387 - DNA, 16 bp, Homo sapiens
gagtatagtgcaaatt

SEQ ID NO: 1782388 - DNA, 22 bp, Homo sapiens
gagtatgttaagctctttatga

SEQ ID NO: 1782389 - DNA, 21 bp, Homo sapiens
gagtattctcataggagactg

SEQ ID NO: 1782390 - DNA, 20 bp, Homo sapiens
gagtatttaggcagattgaa

SEQ ID NO: 1782391 - DNA, 16 bp, Homo sapiens
gagtatttttgacaga

SEQ ID NO: 1782392 - DNA, 15 bp, Homo sapiens
gagtcaaatccagtg

SEQ ID NO: 1782393 - DNA, 14 bp, Homo sapiens
gagtcaactggagc

SEQ ID NO: 1782394 - DNA, 14 bp, Homo sapiens
gagtcaaggcctgc

SEQ ID NO: 1782395 - DNA, 13 bp, Homo sapiens
gagtcaatacata

SEQ ID NO: 1782396 - DNA, 18 bp, Homo sapiens
gagtcaattggaaagact

SEQ ID NO: 1782397 - DNA, 12 bp, Homo sapiens
gagtcacactca

SEQ ID NO: 1782398 - DNA, 17 bp, Homo sapiens
gagtcacatcagtgagg

SEQ ID NO: 1782399 - DNA, 22 bp, Homo sapiens
gagtcacatcagtgaggaggga

SEQ ID NO: 1782400 - DNA, 14 bp, Homo sapiens
gagtcaccaggaat

SEQ ID NO: 1782401 - DNA, 20 bp, Homo sapiens
gagtcacccagttggtgact

SEQ ID NO: 1782402 - DNA, 12 bp, Homo sapiens
gagtcacctcct

SEQ ID NO: 1782403 - DNA, 14 bp, Homo sapiens
gagtcacctgcaag

SEQ ID NO: 1782404 - DNA, 21 bp, Homo sapiens
gagtcacctgcaagccccagg

SEQ ID NO: 1782405 - DNA, 22 bp, Homo sapiens
gagtcacctgcaagccccaggg

SEQ ID NO: 1782406 - DNA, 23 bp, Homo sapiens
gagtcacctgcaagccccagggc

SEQ ID NO: 1782407 - DNA, 15 bp, Homo sapiens
gagtcactgcctctc

SEQ ID NO: 1782408 - DNA, 23 bp, Homo sapiens
gagtcactgcctctccctggccc

SEQ ID NO: 1782409 - DNA, 22 bp, Homo sapiens
gagtcagacattttaagatggt

SEQ ID NO: 1782410 - DNA, 22 bp, Homo sapiens
gagtcagcaccttggcccagga

SEQ ID NO: 1782411 - DNA, 16 bp, Homo sapiens
gagtcagccaggagct

SEQ ID NO: 1782412 - DNA, 21 bp, Homo sapiens
gagtcagccccgacttcctga

SEQ ID NO: 1782413 - DNA, 18 bp, Homo sapiens
gagtcagctctctgccct

SEQ ID NO: 1782414 - DNA, 22 bp, Homo sapiens
gagtcagggtgaactgcaaagc

SEQ ID NO: 1782415 - DNA, 21 bp, Homo sapiens
gagtcaggtgtcgaggccaca

SEQ ID NO: 1782416 - DNA, 23 bp, Homo sapiens
gagtcataacggttaagaaagca

SEQ ID NO: 1782417 - DNA, 14 bp, Homo sapiens
gagtgagaacagca

SEQ ID NO: 1782418 - DNA, 13 bp, Homo sapiens
gagtgagactcca

SEQ ID NO: 1782419 - DNA, 22 bp, Homo sapiens
gagtgaggaatagttgagcccc

SEQ ID NO: 1782420 - DNA, 18 bp, Homo sapiens
gagtgaggatgtctgggc

SEQ ID NO: 1782421 - DNA, 22 bp, Homo sapiens
gagtgagtcacctgctccagaa

SEQ ID NO: 1782422 - DNA, 10 bp, Homo sapiens
gagtgatctt

SEQ ID NO: 1782423 - DNA, 14 bp, Homo sapiens
gagtgcacctgcct

SEQ ID NO: 1782424 - DNA, 22 bp, Homo sapiens
gagtgcacctgcctccaccagc

SEQ ID NO: 1782425 - DNA, 17 bp, Homo sapiens
gagtgcagatctgtgct

SEQ ID NO: 1782426 - DNA, 16 bp, Homo sapiens
gagtgcagccgtttga

SEQ ID NO: 1782427 - DNA, 15 bp, Homo sapiens
gagtgccaggaccag

SEQ ID NO: 1782428 - DNA, 21 bp, Homo sapiens
gagtgcccccagcccagagcc

SEQ ID NO: 1782429 - DNA, 12 bp, Homo sapiens
gagtgcctggag

SEQ ID NO: 1782430 - DNA, 15 bp, Homo sapiens
gagtgcctggagtca

SEQ ID NO: 1782431 - DNA, 16 bp, Homo sapiens
gagtgcctggagtcag

SEQ ID NO: 1782432 - DNA, 18 bp, Homo sapiens
gagtgccttttgcagaag

SEQ ID NO: 1782433 - DNA, 14 bp, Homo sapiens
gagtggaatgcagg

SEQ ID NO: 1782434 - DNA, 16 bp, Homo sapiens
gagtggaatgcaggga

SEQ ID NO: 1782435 - DNA, 21 bp, Homo sapiens
gagtggaatgcagggaagagg

SEQ ID NO: 1782436 - DNA, 12 bp, Homo sapiens
gagtggagtctg

SEQ ID NO: 1782437 - DNA, 14 bp, Homo sapiens
gagtggagttgaaa

SEQ ID NO: 1782438 - DNA, 11 bp, Homo sapiens
gagtggcagcc

SEQ ID NO: 1782439 - DNA, 19 bp, Homo sapiens
gagtggcagccatgcctca

SEQ ID NO: 1782440 - DNA, 16 bp, Homo sapiens
gagtggcaggggacag

SEQ ID NO: 1782441 - DNA, 23 bp, Homo sapiens
gagtggcaggggacaggagtcca

SEQ ID NO: 1782442 - DNA, 17 bp, Homo sapiens
gagtggcaggtgggctg

SEQ ID NO: 1782443 - DNA, 16 bp, Homo sapiens
gagtggcctccctgct

SEQ ID NO: 1782444 - DNA, 10 bp, Homo sapiens
gagtggcctg

SEQ ID NO: 1782445 - DNA, 15 bp, Homo sapiens
gagtggcctggccag

SEQ ID NO: 1782446 - DNA, 20 bp, Homo sapiens
gagtggcctggccaggagct

SEQ ID NO: 1782447 - DNA, 15 bp, Homo sapiens
gagtggctcctcccg

SEQ ID NO: 1782448 - DNA, 16 bp, Homo sapiens
gagtggctgccggagg

SEQ ID NO: 1782449 - DNA, 19 bp, Homo sapiens
gagtggctgccggaggagc

SEQ ID NO: 1782450 - DNA, 19 bp, Homo sapiens
gagtgggccccgggctgga

SEQ ID NO: 1782451 - DNA, 13 bp, Homo sapiens
gagtggggcctgc

SEQ ID NO: 1782452 - DNA, 22 bp, Homo sapiens
gagtggggcctgccctctgccc

SEQ ID NO: 1782453 - DNA, 23 bp, Homo sapiens
gagtggggcctgccctctgcccc

SEQ ID NO: 1782454 - DNA, 21 bp, Homo sapiens
gagtggggttatctctgtgtt

SEQ ID NO: 1782455 - DNA, 18 bp, Homo sapiens
gagtgtacttaactattc

SEQ ID NO: 1782456 - DNA, 15 bp, Homo sapiens
gagtgtagactgtgg

SEQ ID NO: 1782457 - DNA, 19 bp, Homo sapiens
gagtgtagcctaaagggca

SEQ ID NO: 1782458 - DNA, 21 bp, Homo sapiens
gagtgtagcctaaagggcagg

SEQ ID NO: 1782459 - DNA, 22 bp, Homo sapiens
gagtgtagcctaaagggcaggg

SEQ ID NO: 1782460 - DNA, 18 bp, Homo sapiens
gagtgtagctgtaagggc

SEQ ID NO: 1782461 - DNA, 13 bp, Homo sapiens
gagtgtagctgtg

SEQ ID NO: 1782462 - DNA, 16 bp, Homo sapiens
gagtgtagctgtgaaa

SEQ ID NO: 1782463 - DNA, 11 bp, Homo sapiens
gagtgtagtga

SEQ ID NO: 1782464 - DNA, 22 bp, Homo sapiens
gagtgtattttttaaaattgat

SEQ ID NO: 1782465 - DNA, 16 bp, Homo sapiens
gagtgtcctgcccatg

SEQ ID NO: 1782466 - DNA, 18 bp, Homo sapiens
gagtgtcctgcccatgcc

SEQ ID NO: 1782467 - DNA, 17 bp, Homo sapiens
gagtgtcctggctgtga

SEQ ID NO: 1782468 - DNA, 13 bp, Homo sapiens
gagtgtctgcagt

SEQ ID NO: 1782469 - DNA, 19 bp, Homo sapiens
gagtgtcttaattaaaaga

SEQ ID NO: 1782470 - DNA, 18 bp, Homo sapiens
gagtgtgagccacctaag

SEQ ID NO: 1782471 - DNA, 23 bp, Homo sapiens
gagtgtgagccacctaagatctc

SEQ ID NO: 1782472 - DNA, 13 bp, Homo sapiens
gagtgtgcagaca

SEQ ID NO: 1782473 - DNA, 20 bp, Homo sapiens
gagtgtgcagacagccatgc

SEQ ID NO: 1782474 - DNA, 14 bp, Homo sapiens
gagtgtgctctccc

SEQ ID NO: 1782475 - DNA, 15 bp, Homo sapiens
gagtgtggactctgg

SEQ ID NO: 1782476 - DNA, 22 bp, Homo sapiens
gagtttattacaatgtatcttt

SEQ ID NO: 1782477 - DNA, 12 bp, Homo sapiens
gagtttctaagg

SEQ ID NO: 1782478 - DNA, 17 bp, Homo sapiens
gagtttgagaccaggct

SEQ ID NO: 1782479 - DNA, 17 bp, Homo sapiens
gagtttgagctgccttc

SEQ ID NO: 1782480 - DNA, 13 bp, Homo sapiens
gagtttgtaaata

SEQ ID NO: 1782481 - DNA, 17 bp, Homo sapiens
gagttttgtttcctctg

SEQ ID NO: 1782482 - DNA, 19 bp, Homo sapiens
gagtttttatggggctgaa

SEQ ID NO: 1782483 - DNA, 14 bp, Homo sapiens
gataaaaagatggc

SEQ ID NO: 1782484 - DNA, 20 bp, Homo sapiens
gataaaacagaatcttctgg

SEQ ID NO: 1782485 - DNA, 17 bp, Homo sapiens
gataaaacgatctaaag

SEQ ID NO: 1782486 - DNA, 13 bp, Homo sapiens
gataaaagatggc

SEQ ID NO: 1782487 - DNA, 17 bp, Homo sapiens
gataaaatatcctcagg

SEQ ID NO: 1782488 - DNA, 18 bp, Homo sapiens
gataaaatgaggttcaac

SEQ ID NO: 1782489 - DNA, 13 bp, Homo sapiens
gataaacacaggc

SEQ ID NO: 1782490 - DNA, 17 bp, Homo sapiens
gataaacacaggcaggt

SEQ ID NO: 1782491 - DNA, 16 bp, Homo sapiens
gataaaccaataaatc

SEQ ID NO: 1782492 - DNA, 11 bp, Homo sapiens
gataaactgac

SEQ ID NO: 1782493 - DNA, 14 bp, Homo sapiens
gataaactgagcct

SEQ ID NO: 1782494 - DNA, 17 bp, Homo sapiens
gataaactgatgtttga

SEQ ID NO: 1782495 - DNA, 18 bp, Homo sapiens
gataaagaaaaaaatact

SEQ ID NO: 1782496 - DNA, 16 bp, Homo sapiens
gataaagaaaagacat

SEQ ID NO: 1782497 - DNA, 18 bp, Homo sapiens
gataaagaccagaaattc

SEQ ID NO: 1782498 - DNA, 13 bp, Homo sapiens
gataaagatgatc

SEQ ID NO: 1782499 - DNA, 19 bp, Homo sapiens
gataaagatttctagtagg

SEQ ID NO: 1782500 - DNA, 16 bp, Homo sapiens
gataaagatttcttga

SEQ ID NO: 1782501 - DNA, 17 bp, Homo sapiens
gataaagccactgaaaa

SEQ ID NO: 1782502 - DNA, 17 bp, Homo sapiens
gataaagcctcaaggtt

SEQ ID NO: 1782503 - DNA, 16 bp, Homo sapiens
gataaagtttctcaga

SEQ ID NO: 1782504 - DNA, 20 bp, Homo sapiens
gataaatattcacacttgaa

SEQ ID NO: 1782505 - DNA, 18 bp, Homo sapiens
gataaatcagtggttatt

SEQ ID NO: 1782506 - DNA, 19 bp, Homo sapiens
gataaatcataaagtcagt

SEQ ID NO: 1782507 - DNA, 22 bp, Homo sapiens
gataaattaacctctcacagtt

SEQ ID NO: 1782508 - DNA, 12 bp, Homo sapiens
gataaattataa

SEQ ID NO: 1782509 - DNA, 14 bp, Homo sapiens
gataacaaaaaata

SEQ ID NO: 1782510 - DNA, 17 bp, Homo sapiens
gataacaaaaaataaat

SEQ ID NO: 1782511 - DNA, 18 bp, Homo sapiens
gataacaaaaaataaatt

SEQ ID NO: 1782512 - DNA, 15 bp, Homo sapiens
gataacaccagtggg

SEQ ID NO: 1782513 - DNA, 13 bp, Homo sapiens
gataacagaattg

SEQ ID NO: 1782514 - DNA, 23 bp, Homo sapiens
gataacagggattgattttaaaa

SEQ ID NO: 1782515 - DNA, 15 bp, Homo sapiens
gataacatacttctt

SEQ ID NO: 1782516 - DNA, 17 bp, Homo sapiens
gataacccttattccat

SEQ ID NO: 1782517 - DNA, 22 bp, Homo sapiens
gataacctgtacttcaagttaa

SEQ ID NO: 1782518 - DNA, 21 bp, Homo sapiens
gataactaaggtgaagaatct

SEQ ID NO: 1782519 - DNA, 11 bp, Homo sapiens
gataactctcc

SEQ ID NO: 1782520 - DNA, 18 bp, Homo sapiens
gataactgcaattttaat

SEQ ID NO: 1782521 - DNA, 15 bp, Homo sapiens
gataactgctttgca

SEQ ID NO: 1782522 - DNA, 17 bp, Homo sapiens
gataagaatgctggttt

SEQ ID NO: 1782523 - DNA, 23 bp, Homo sapiens
gataagccactctgtcccttcct

SEQ ID NO: 1782524 - DNA, 14 bp, Homo sapiens
gataagggaaaaga

SEQ ID NO: 1782525 - DNA, 14 bp, Homo sapiens
gataagtgttcttc

SEQ ID NO: 1782526 - DNA, 17 bp, Homo sapiens
gataagtgttcttcagt

SEQ ID NO: 1782527 - DNA, 12 bp, Homo sapiens
gataagttcata

SEQ ID NO: 1782528 - DNA, 14 bp, Homo sapiens
gataagttcataca

SEQ ID NO: 1782529 - DNA, 13 bp, Homo sapiens
gataatagattct

SEQ ID NO: 1782530 - DNA, 16 bp, Homo sapiens
gataatatctgtgagg

SEQ ID NO: 1782531 - DNA, 16 bp, Homo sapiens
gatatttcagaaatac

SEQ ID NO: 1782532 - DNA, 13 bp, Homo sapiens
gatatttccaaga

SEQ ID NO: 1782533 - DNA, 11 bp, Homo sapiens
gatatttccta

SEQ ID NO: 1782534 - DNA, 13 bp, Homo sapiens
gatatttgcacta

SEQ ID NO: 1782535 - DNA, 15 bp, Homo sapiens
gatattttatatgta

SEQ ID NO: 1782536 - DNA, 18 bp, Homo sapiens
gatatttttcataaacaa

SEQ ID NO: 1782537 - DNA, 15 bp, Homo sapiens
gatatttttccattt

SEQ ID NO: 1782538 - DNA, 21 bp, Homo sapiens
gatattttttcagaaatatgt

SEQ ID NO: 1782539 - DNA, 13 bp, Homo sapiens
gatcaaaaataaa

SEQ ID NO: 1782540 - DNA, 16 bp, Homo sapiens
gatcaaaaataaacta

SEQ ID NO: 1782541 - DNA, 21 bp, Homo sapiens
gatcaaaacctgtgccaggct

SEQ ID NO: 1782542 - DNA, 15 bp, Homo sapiens
gatcaaaaccttcct

SEQ ID NO: 1782543 - DNA, 19 bp, Homo sapiens
gatcaaaaccttccttccc

SEQ ID NO: 1782544 - DNA, 12 bp, Homo sapiens
gatcaaagatga

SEQ ID NO: 1782545 - DNA, 18 bp, Homo sapiens
gatcaaagatgaaaagta

SEQ ID NO: 1782546 - DNA, 16 bp, Homo sapiens
gatcaacatcttttct

SEQ ID NO: 1782547 - DNA, 13 bp, Homo sapiens
gatcaactgttca

SEQ ID NO: 1782548 - DNA, 13 bp, Homo sapiens
gatcaagttgttg

SEQ ID NO: 1782549 - DNA, 22 bp, Homo sapiens
gatcaagttgttgactgtgatt

SEQ ID NO: 1782550 - DNA, 18 bp, Homo sapiens
gatcaataaaatgtgatt

SEQ ID NO: 1782551 - DNA, 15 bp, Homo sapiens
gatcaattaaatgta

SEQ ID NO: 1782552 - DNA, 18 bp, Homo sapiens
gatcaattatagtttctg

SEQ ID NO: 1782553 - DNA, 19 bp, Homo sapiens
gatcaattatagtttctga

SEQ ID NO: 1782554 - DNA, 13 bp, Homo sapiens
gatcacaagatgg

SEQ ID NO: 1782555 - DNA, 12 bp, Homo sapiens
gatcacacagtg

SEQ ID NO: 1782556 - DNA, 20 bp, Homo sapiens
gatcacagggccccagaagg

SEQ ID NO: 1782557 - DNA, 23 bp, Homo sapiens
gatcacatcttaaattcatttct

SEQ ID NO: 1782558 - DNA, 19 bp, Homo sapiens
gatcaccatgtattttgta

SEQ ID NO: 1782559 - DNA, 15 bp, Homo sapiens
gatcaccattatatt

SEQ ID NO: 1782560 - DNA, 17 bp, Homo sapiens
gatcactctctgctggc

SEQ ID NO: 1782561 - DNA, 16 bp, Homo sapiens
gatcactgccacactc

SEQ ID NO: 1782562 - DNA, 18 bp, Homo sapiens
gatcactgccctttttga

SEQ ID NO: 1782563 - DNA, 23 bp, Homo sapiens
gatcactgccctttttgaaatca

SEQ ID NO: 1782564 - DNA, 12 bp, Homo sapiens
gatcactggagc

SEQ ID NO: 1782565 - DNA, 14 bp, Homo sapiens
gatcactggagccc

SEQ ID NO: 1782566 - DNA, 17 bp, Homo sapiens
gatcactggagcccagg

SEQ ID NO: 1782567 - DNA, 20 bp, Homo sapiens
gatcactgtgaaccaacccc

SEQ ID NO: 1782568 - DNA, 17 bp, Homo sapiens
gatcacttgttgtttta

SEQ ID NO: 1782569 - DNA, 19 bp, Homo sapiens
gatcagacatacagctgcc

SEQ ID NO: 1782570 - DNA, 20 bp, Homo sapiens
gatcagacatacagctgcct

SEQ ID NO: 1782571 - DNA, 21 bp, Homo sapiens
gatcagcagcgtgcacatctg

SEQ ID NO: 1782572 - DNA, 16 bp, Homo sapiens
gatcagccccaccctg

SEQ ID NO: 1782573 - DNA, 23 bp, Homo sapiens
gatcagccccaccctggcctaga

SEQ ID NO: 1782574 - DNA, 20 bp, Homo sapiens
gatcagctttcaaagcattt

SEQ ID NO: 1782575 - DNA, 15 bp, Homo sapiens
gatcaggcttcctgg

SEQ ID NO: 1782576 - DNA, 17 bp, Homo sapiens
gatcaggcttcctggtg

SEQ ID NO: 1782577 - DNA, 22 bp, Homo sapiens
gatcagtagtttgcatttcaga

SEQ ID NO: 1782578 - DNA, 20 bp, Homo sapiens
gatcagtataattttttaaa

SEQ ID NO: 1782579 - DNA, 15 bp, Homo sapiens
gatcatcaacaagat

SEQ ID NO: 1782580 - DNA, 23 bp, Homo sapiens
gatcatcgccagaggtgcttcac

SEQ ID NO: 1782581 - DNA, 18 bp, Homo sapiens
gatcatctctgcaggttt

SEQ ID NO: 1782582 - DNA, 19 bp, Homo sapiens
gatcatctgaatcccgggc

SEQ ID NO: 1782583 - DNA, 14 bp, Homo sapiens
gatcattcttttat

SEQ ID NO: 1782584 - DNA, 19 bp, Homo sapiens
gatccaaaagaagccccca

SEQ ID NO: 1782585 - DNA, 19 bp, Homo sapiens
gatccaactaatgccttac

SEQ ID NO: 1782586 - DNA, 22 bp, Homo sapiens
gatccaagctaagcactgccac

SEQ ID NO: 1782587 - DNA, 15 bp, Homo sapiens
gatccacacacagag

SEQ ID NO: 1782588 - DNA, 17 bp, Homo sapiens
gatccacacacagagga

SEQ ID NO: 1782589 - DNA, 20 bp, Homo sapiens
gatccaccggcctcggcctc

SEQ ID NO: 1782590 - DNA, 18 bp, Homo sapiens
gatccactcgcctcagcc

SEQ ID NO: 1782591 - DNA, 21 bp, Homo sapiens
gatccagaatggagtcttttc

SEQ ID NO: 1782592 - DNA, 14 bp, Homo sapiens
gatccagcactggt

SEQ ID NO: 1782593 - DNA, 13 bp, Homo sapiens
gatccagccactt

SEQ ID NO: 1782594 - DNA, 14 bp, Homo sapiens
gatccagccacttc

SEQ ID NO: 1782595 - DNA, 13 bp, Homo sapiens
gatccagcctggg

SEQ ID NO: 1782596 - DNA, 21 bp, Homo sapiens
gatccagcctggggtctggag

SEQ ID NO: 1782597 - DNA, 13 bp, Homo sapiens
gatccagggacag

SEQ ID NO: 1782598 - DNA, 18 bp, Homo sapiens
gatctttctcttccctga

SEQ ID NO: 1782599 - DNA, 19 bp, Homo sapiens
gatctttctcttccctgaa

SEQ ID NO: 1782600 - DNA, 14 bp, Homo sapiens
gatctttctgggag

SEQ ID NO: 1782601 - DNA, 19 bp, Homo sapiens
gatctttctttccaaaaca

SEQ ID NO: 1782602 - DNA, 16 bp, Homo sapiens
gatcttttaaaatcat

SEQ ID NO: 1782603 - DNA, 13 bp, Homo sapiens
gatcttttaaagt

SEQ ID NO: 1782604 - DNA, 20 bp, Homo sapiens
gatcttttaaagtgttactt

SEQ ID NO: 1782605 - DNA, 23 bp, Homo sapiens
gatgaaaagtatattgataacct

SEQ ID NO: 1782606 - DNA, 21 bp, Homo sapiens
gatgaaatctgctagaaagtt

SEQ ID NO: 1782607 - DNA, 20 bp, Homo sapiens
gatgaaccagccggggcctt

SEQ ID NO: 1782608 - DNA, 15 bp, Homo sapiens
gatgaagaagggggt

SEQ ID NO: 1782609 - DNA, 16 bp, Homo sapiens
gatgaagaagggggtg

SEQ ID NO: 1782610 - DNA, 17 bp, Homo sapiens
gatgaagaagggggtgg

SEQ ID NO: 1782611 - DNA, 15 bp, Homo sapiens
gatgaatagatgtga

SEQ ID NO: 1782612 - DNA, 19 bp, Homo sapiens
gatgaatgaggtcccaggc

SEQ ID NO: 1782613 - DNA, 16 bp, Homo sapiens
gatgaattaaatttaa

SEQ ID NO: 1782614 - DNA, 13 bp, Homo sapiens
gatgaattttctg

SEQ ID NO: 1782615 - DNA, 16 bp, Homo sapiens
gatgacaccctggcct

SEQ ID NO: 1782616 - DNA, 18 bp, Homo sapiens
gatgacaccctggcctga

SEQ ID NO: 1782617 - DNA, 13 bp, Homo sapiens
gatgacagggcag

SEQ ID NO: 1782618 - DNA, 22 bp, Homo sapiens
gatgacagggcagagcaggaag

SEQ ID NO: 1782619 - DNA, 18 bp, Homo sapiens
gatgaccagggatgctgg

SEQ ID NO: 1782620 - DNA, 17 bp, Homo sapiens
gatgaccatactcagac

SEQ ID NO: 1782621 - DNA, 15 bp, Homo sapiens
gatgacccactaaag

SEQ ID NO: 1782622 - DNA, 21 bp, Homo sapiens
gatgacccaggctgcctgagc

SEQ ID NO: 1782623 - DNA, 16 bp, Homo sapiens
gatgactagaggcagg

SEQ ID NO: 1782624 - DNA, 21 bp, Homo sapiens
gatgactatgcagaggcctgg

SEQ ID NO: 1782625 - DNA, 14 bp, Homo sapiens
gatgactgagtcct

SEQ ID NO: 1782626 - DNA, 13 bp, Homo sapiens
gatgagaaacagc

SEQ ID NO: 1782627 - DNA, 18 bp, Homo sapiens
gatgagaaacagctcagc

SEQ ID NO: 1782628 - DNA, 23 bp, Homo sapiens
gatgagacttccaaacctgacag

SEQ ID NO: 1782629 - DNA, 14 bp, Homo sapiens
gatgagaggccagc

SEQ ID NO: 1782630 - DNA, 15 bp, Homo sapiens
gatgagatccgggag

SEQ ID NO: 1782631 - DNA, 21 bp, Homo sapiens
gatgagatttgccagcacagg

SEQ ID NO: 1782632 - DNA, 16 bp, Homo sapiens
gatgagatttttaaaa

SEQ ID NO: 1782633 - DNA, 20 bp, Homo sapiens
gatgagcagtcacactgtta

SEQ ID NO: 1782634 - DNA, 15 bp, Homo sapiens
gatgagcgccacctc

SEQ ID NO: 1782635 - DNA, 13 bp, Homo sapiens
gatgaggacagag

SEQ ID NO: 1782636 - DNA, 18 bp, Homo sapiens
gatgaggcaaacagcaag

SEQ ID NO: 1782637 - DNA, 16 bp, Homo sapiens
gatgaggtattttttc

SEQ ID NO: 1782638 - DNA, 18 bp, Homo sapiens
gatgaggtcaccagggga

SEQ ID NO: 1782639 - DNA, 14 bp, Homo sapiens
gatgagttaactgt

SEQ ID NO: 1782640 - DNA, 19 bp, Homo sapiens
gatgagtttcactgtactg

SEQ ID NO: 1782641 - DNA, 24 bp, Homo sapiens
gatgagtttcactgtactgcatgt

SEQ ID NO: 1782642 - DNA, 19 bp, Homo sapiens
gatgagttttgggaagtta

SEQ ID NO: 1782643 - DNA, 20 bp, Homo sapiens
gatgataagttcctttcctt

SEQ ID NO: 1782644 - DNA, 18 bp, Homo sapiens
gatgatagaggattttat

SEQ ID NO: 1782645 - DNA, 20 bp, Homo sapiens
gatgatcaaaacctgtgcca

SEQ ID NO: 1782646 - DNA, 20 bp, Homo sapiens
gatgatcaattatagtttct

SEQ ID NO: 1782647 - DNA, 22 bp, Homo sapiens
gatgatcaattatagtttctga

SEQ ID NO: 1782648 - DNA, 16 bp, Homo sapiens
gatgatccagaacagt

SEQ ID NO: 1782649 - DNA, 15 bp, Homo sapiens
gatgatctactcaga

SEQ ID NO: 1782650 - DNA, 23 bp, Homo sapiens
gatgatgataatgatgatgacga

SEQ ID NO: 1782651 - DNA, 19 bp, Homo sapiens
gatgatggcagagccaggc

SEQ ID NO: 1782652 - DNA, 15 bp, Homo sapiens
gatgattcagaaatt

SEQ ID NO: 1782653 - DNA, 17 bp, Homo sapiens
gatgatttaagtataca

SEQ ID NO: 1782654 - DNA, 17 bp, Homo sapiens
gatgatttcatcttctg

SEQ ID NO: 1782655 - DNA, 20 bp, Homo sapiens
gatgatttcatcttctggaa

SEQ ID NO: 1782656 - DNA, 22 bp, Homo sapiens
gatgatttcatcttctggaata

SEQ ID NO: 1782657 - DNA, 15 bp, Homo sapiens
gatgattttttaagc

SEQ ID NO: 1782658 - DNA, 18 bp, Homo sapiens
gatgattttttgaaagtt

SEQ ID NO: 1782659 - DNA, 14 bp, Homo sapiens
gatgcaaggaccag

SEQ ID NO: 1782660 - DNA, 12 bp, Homo sapiens
gatgcaatataa

SEQ ID NO: 1782661 - DNA, 18 bp, Homo sapiens
gatgcaatgtgctactga

SEQ ID NO: 1782662 - DNA, 18 bp, Homo sapiens
gatgcaattgctcccatc

SEQ ID NO: 1782663 - DNA, 19 bp, Homo sapiens
gatgcacagatgccatggc

SEQ ID NO: 1782664 - DNA, 14 bp, Homo sapiens
gatgcacatttctg

SEQ ID NO: 1782665 - DNA, 16 bp, Homo sapiens
gatgcacatttctgga

SEQ ID NO: 1782666 - DNA, 18 bp, Homo sapiens
gatgcacatttctggatt

SEQ ID NO: 1782667 - DNA, 19 bp, Homo sapiens
gatgcacatttctggattg

SEQ ID NO: 1782668 - DNA, 20 bp, Homo sapiens
gatgcacatttctggattgt

SEQ ID NO: 1782669 - DNA, 21 bp, Homo sapiens
gatgcactgaaaacttagcca

SEQ ID NO: 1782670 - DNA, 18 bp, Homo sapiens
gatgcagagtaagtatta

SEQ ID NO: 1782671 - DNA, 17 bp, Homo sapiens
gatgcaggacaggaggc

SEQ ID NO: 1782672 - DNA, 15 bp, Homo sapiens
gatgggtcagttgta

SEQ ID NO: 1782673 - DNA, 22 bp, Homo sapiens
gatgggtcctggccttgtgtca

SEQ ID NO: 1782674 - DNA, 14 bp, Homo sapiens
gatgggttccagag

SEQ ID NO: 1782675 - DNA, 22 bp, Homo sapiens
gatggtatctgggtaagaagaa

SEQ ID NO: 1782676 - DNA, 19 bp, Homo sapiens
gatggtatgcacaattcca

SEQ ID NO: 1782677 - DNA, 18 bp, Homo sapiens
gatggtccatttgttcct

SEQ ID NO: 1782678 - DNA, 22 bp, Homo sapiens
gatggtccatttgttcctgctt

SEQ ID NO: 1782679 - DNA, 16 bp, Homo sapiens
gatggtccgtgcccag

SEQ ID NO: 1782680 - DNA, 15 bp, Homo sapiens
gatggtcctggggct

SEQ ID NO: 1782681 - DNA, 18 bp, Homo sapiens
gatggtcggatctcacag

SEQ ID NO: 1782682 - DNA, 24 bp, Homo sapiens
gatggtctccatatcagctctctg

SEQ ID NO: 1782683 - DNA, 19 bp, Homo sapiens
gatggtctcgatctcctga

SEQ ID NO: 1782684 - DNA, 16 bp, Homo sapiens
gatggtgacattgaaa

SEQ ID NO: 1782685 - DNA, 19 bp, Homo sapiens
gatggtgacattgaaacta

SEQ ID NO: 1782686 - DNA, 13 bp, Homo sapiens
gatggtgagctgg

SEQ ID NO: 1782687 - DNA, 14 bp, Homo sapiens
gatggtgagctggg

SEQ ID NO: 1782688 - DNA, 16 bp, Homo sapiens
gatggtgagctgggaa

SEQ ID NO: 1782689 - DNA, 18 bp, Homo sapiens
gatggtggactaagcaat

SEQ ID NO: 1782690 - DNA, 20 bp, Homo sapiens
gatggtggccgcccacccgc

SEQ ID NO: 1782691 - DNA, 13 bp, Homo sapiens
gatggttcccctg

SEQ ID NO: 1782692 - DNA, 14 bp, Homo sapiens
gatggttctagcat

SEQ ID NO: 1782693 - DNA, 14 bp, Homo sapiens
gatggttgtagcat

SEQ ID NO: 1782694 - DNA, 17 bp, Homo sapiens
gatggtttaataggtaa

SEQ ID NO: 1782695 - DNA, 16 bp, Homo sapiens
gatggttttaaacttt

SEQ ID NO: 1782696 - DNA, 13 bp, Homo sapiens
gatgtaaaatctt

SEQ ID NO: 1782697 - DNA, 14 bp, Homo sapiens
gatgtaaaatcttg

SEQ ID NO: 1782698 - DNA, 15 bp, Homo sapiens
gatgtaaaatcttgt

SEQ ID NO: 1782699 - DNA, 19 bp, Homo sapiens
gatgtaaacagtgcctgct

SEQ ID NO: 1782700 - DNA, 12 bp, Homo sapiens
gatgtaaatcct

SEQ ID NO: 1782701 - DNA, 15 bp, Homo sapiens
gatgtaaccaagctg

SEQ ID NO: 1782702 - DNA, 16 bp, Homo sapiens
gatgtaaggactgtaa

SEQ ID NO: 1782703 - DNA, 17 bp, Homo sapiens
gatgtacagtctgtcat

SEQ ID NO: 1782704 - DNA, 22 bp, Homo sapiens
gatgtacttctctgtgtgcaca

SEQ ID NO: 1782705 - DNA, 19 bp, Homo sapiens
gatgtagggtaaggtgcct

SEQ ID NO: 1782706 - DNA, 14 bp, Homo sapiens
gatgtataaatttt

SEQ ID NO: 1782707 - DNA, 17 bp, Homo sapiens
gatgtatggtatcttta

SEQ ID NO: 1782708 - DNA, 22 bp, Homo sapiens
gatgtatttttgatgtatatat

SEQ ID NO: 1782709 - DNA, 16 bp, Homo sapiens
gatgtcaatagcattg

SEQ ID NO: 1782710 - DNA, 22 bp, Homo sapiens
gatgtcagccgagccgggcctg

SEQ ID NO: 1782711 - DNA, 16 bp, Homo sapiens
gatgtcatcttgagct

SEQ ID NO: 1782712 - DNA, 16 bp, Homo sapiens
gatgtcccctgtccca

SEQ ID NO: 1782713 - DNA, 15 bp, Homo sapiens
gatgtcgacatgttt

SEQ ID NO: 1782714 - DNA, 14 bp, Homo sapiens
gatgtctaatagtt

SEQ ID NO: 1782715 - DNA, 22 bp, Homo sapiens
gatgtctgccaatttttgcctt

SEQ ID NO: 1782716 - DNA, 14 bp, Homo sapiens
gatgtcttctgcct

SEQ ID NO: 1782717 - DNA, 20 bp, Homo sapiens
gatgtcttctgcctgttata

SEQ ID NO: 1782718 - DNA, 22 bp, Homo sapiens
gatgtcttggaacattggaatg

SEQ ID NO: 1782719 - DNA, 14 bp, Homo sapiens
gatgtgaacacatc

SEQ ID NO: 1782720 - DNA, 16 bp, Homo sapiens
gatgtgaacacatcag

SEQ ID NO: 1782721 - DNA, 18 bp, Homo sapiens
gatgtgaattattgacac

SEQ ID NO: 1782722 - DNA, 22 bp, Homo sapiens
gatgtgaattattgacactgaa

SEQ ID NO: 1782723 - DNA, 23 bp, Homo sapiens
gatgtgactgcatcatatattta

SEQ ID NO: 1782724 - DNA, 16 bp, Homo sapiens
gatgtgcaaaatcact

SEQ ID NO: 1782725 - DNA, 12 bp, Homo sapiens
gatgtgcaataa

SEQ ID NO: 1782726 - DNA, 14 bp, Homo sapiens
gatgtgcaggaaga

SEQ ID NO: 1782727 - DNA, 17 bp, Homo sapiens
gatgtgcaggaagaaaa

SEQ ID NO: 1782728 - DNA, 22 bp, Homo sapiens
gatgtgcatttcacctgtgaca

SEQ ID NO: 1782729 - DNA, 19 bp, Homo sapiens
gatgtgctataatctgttt

SEQ ID NO: 1782730 - DNA, 12 bp, Homo sapiens
gatgtgctcagc

SEQ ID NO: 1782731 - DNA, 21 bp, Homo sapiens
gatgtgctttgcattcctaca

SEQ ID NO: 1782732 - DNA, 22 bp, Homo sapiens
gatgtggacttgtatgctgccc

SEQ ID NO: 1782733 - DNA, 17 bp, Homo sapiens
gatgtggcaaagtgctg

SEQ ID NO: 1782734 - DNA, 19 bp, Homo sapiens
gatgtggcaaagtgctgta

SEQ ID NO: 1782735 - DNA, 16 bp, Homo sapiens
gatgtgggccaccatg

SEQ ID NO: 1782736 - DNA, 19 bp, Homo sapiens
gatgtgggccaccattgca

SEQ ID NO: 1782737 - DNA, 13 bp, Homo sapiens
gatgtggggctga

SEQ ID NO: 1782738 - DNA, 18 bp, Homo sapiens
gatgtggggctgagctgg

SEQ ID NO: 1782739 - DNA, 19 bp, Homo sapiens
gatgtgggtaagaggagca

SEQ ID NO: 1782740 - DNA, 21 bp, Homo sapiens
gatgtgggtaagaggagcaga

SEQ ID NO: 1782741 - DNA, 17 bp, Homo sapiens
gatgtgtaaacaggtat

SEQ ID NO: 1782742 - DNA, 15 bp, Homo sapiens
gatgtgtcatctaat

SEQ ID NO: 1782743 - DNA, 13 bp, Homo sapiens
gatgtgtgcatgt

SEQ ID NO: 1782744 - DNA, 20 bp, Homo sapiens
gatgtgtggctcattctttt

SEQ ID NO: 1782745 - DNA, 13 bp, Homo sapiens
gatgtgtggggca

SEQ ID NO: 1782746 - DNA, 16 bp, Homo sapiens
gatgtgtggggcatgg

SEQ ID NO: 1782747 - DNA, 18 bp, Homo sapiens
gatgtgtgttctcagtga

SEQ ID NO: 1782748 - DNA, 14 bp, Homo sapiens
gatgtgttcttatt

SEQ ID NO: 1782749 - DNA, 16 bp, Homo sapiens
gatgttagaaagtgct

SEQ ID NO: 1782750 - DNA, 19 bp, Homo sapiens
gatgttagaaagtgctgat

SEQ ID NO: 1782751 - DNA, 17 bp, Homo sapiens
gatgttatgaacagctg

SEQ ID NO: 1782752 - DNA, 15 bp, Homo sapiens
gatgttattactgtt

SEQ ID NO: 1782753 - DNA, 22 bp, Homo sapiens
gatgttattactgttttgggcc

SEQ ID NO: 1782754 - DNA, 23 bp, Homo sapiens
gatgttattactgttttgggcct

SEQ ID NO: 1782755 - DNA, 20 bp, Homo sapiens
gatgttcagcactgtccctt

SEQ ID NO: 1782756 - DNA, 17 bp, Homo sapiens
gatgttccacctgccac

SEQ ID NO: 1782757 - DNA, 16 bp, Homo sapiens
gatgttccagtgagga

SEQ ID NO: 1782758 - DNA, 20 bp, Homo sapiens
gatgttccggcgtttatttc

SEQ ID NO: 1782759 - DNA, 14 bp, Homo sapiens
gatgttccttacca

SEQ ID NO: 1782760 - DNA, 16 bp, Homo sapiens
gatgttctaaggctct

SEQ ID NO: 1782761 - DNA, 18 bp, Homo sapiens
gatgttctaaggctctga

SEQ ID NO: 1782762 - DNA, 14 bp, Homo sapiens
gatgttctggccct

SEQ ID NO: 1782763 - DNA, 13 bp, Homo sapiens
gatgttgaactgg

SEQ ID NO: 1782764 - DNA, 15 bp, Homo sapiens
gatgttgccatgtgt

SEQ ID NO: 1782765 - DNA, 20 bp, Homo sapiens
gatgtttaacaaatctaatc

SEQ ID NO: 1782766 - DNA, 14 bp, Homo sapiens
gatgtttattcttc

SEQ ID NO: 1782767 - DNA, 21 bp, Homo sapiens
gatgtttattcttctagagtt

SEQ ID NO: 1782768 - DNA, 19 bp, Homo sapiens
gatgtttccagacttcctt

SEQ ID NO: 1782769 - DNA, 17 bp, Homo sapiens
gatgtttccagctgcca

SEQ ID NO: 1782770 - DNA, 19 bp, Homo sapiens
gatgtttccagctgccaag

SEQ ID NO: 1782771 - DNA, 14 bp, Homo sapiens
gatgtttcctggaa

SEQ ID NO: 1782772 - DNA, 13 bp, Homo sapiens
gatgtttctgtga

SEQ ID NO: 1782773 - DNA, 23 bp, Homo sapiens
gatgtttctgtgaaattctcaga

SEQ ID NO: 1782774 - DNA, 22 bp, Homo sapiens
gatgtttgctcttgtttttatt

SEQ ID NO: 1782775 - DNA, 14 bp, Homo sapiens
gatgtttgtgcagt

SEQ ID NO: 1782776 - DNA, 18 bp, Homo sapiens
gatgtttgtggcctcaga

SEQ ID NO: 1782777 - DNA, 18 bp, Homo sapiens
gatgttttgtataaaatc

SEQ ID NO: 1782778 - DNA, 16 bp, Homo sapiens
gatgttttttctgtaa

SEQ ID NO: 1782779 - DNA, 21 bp, Homo sapiens
gatgttttttctgtaatgtaa

SEQ ID NO: 1782780 - DNA, 22 bp, Homo sapiens
gattaaaaggtatactttagta

SEQ ID NO: 1782781 - DNA, 18 bp, Homo sapiens
gattaaagctaaggacct

SEQ ID NO: 1782782 - DNA, 16 bp, Homo sapiens
gattaaataagattct

SEQ ID NO: 1782783 - DNA, 18 bp, Homo sapiens
gattaaataagattctaa

SEQ ID NO: 1782784 - DNA, 17 bp, Homo sapiens
gattaaatatttgaaga

SEQ ID NO: 1782785 - DNA, 22 bp, Homo sapiens
gattaaatttaatatactgcat

SEQ ID NO: 1782786 - DNA, 14 bp, Homo sapiens
gattaacaatgtat

SEQ ID NO: 1782787 - DNA, 12 bp, Homo sapiens
gattaacatttg

SEQ ID NO: 1782788 - DNA, 17 bp, Homo sapiens
gattaacctctgcacta

SEQ ID NO: 1782789 - DNA, 20 bp, Homo sapiens
gatgcaggacaggaggcggc

SEQ ID NO: 1782790 - DNA, 14 bp, Homo sapiens
gatgcatgtctttt

SEQ ID NO: 1782791 - DNA, 16 bp, Homo sapiens
gatgcatgtcttttaa

SEQ ID NO: 1782792 - DNA, 15 bp, Homo sapiens
gatgcatttaataaa

SEQ ID NO: 1782793 - DNA, 18 bp, Homo sapiens
gatgcatttaataaagat

SEQ ID NO: 1782794 - DNA, 18 bp, Homo sapiens
gatgccaatttcctctcc

SEQ ID NO: 1782795 - DNA, 20 bp, Homo sapiens
gatgccaatttcctctccac

SEQ ID NO: 1782796 - DNA, 23 bp, Homo sapiens
gatgccaatttcctctccactgc

SEQ ID NO: 1782797 - DNA, 16 bp, Homo sapiens
gatgccaccctagcca

SEQ ID NO: 1782798 - DNA, 22 bp, Homo sapiens
gatgccactaccccttgatttt

SEQ ID NO: 1782799 - DNA, 15 bp, Homo sapiens
gatgccactcctccc

SEQ ID NO: 1782800 - DNA, 18 bp, Homo sapiens
gatgccactcctccctcc

SEQ ID NO: 1782801 - DNA, 23 bp, Homo sapiens
gatgccacttctaagaaaagcct

SEQ ID NO: 1782802 - DNA, 20 bp, Homo sapiens
gatgccagagggccagcagg

SEQ ID NO: 1782803 - DNA, 16 bp, Homo sapiens
gatgccagcttctctc

SEQ ID NO: 1782804 - DNA, 19 bp, Homo sapiens
gatgccagcttctctctcc

SEQ ID NO: 1782805 - DNA, 18 bp, Homo sapiens
gatgcccagaggactccc

SEQ ID NO: 1782806 - DNA, 18 bp, Homo sapiens
gatgcccagagggcccag

SEQ ID NO: 1782807 - DNA, 19 bp, Homo sapiens
gatgcccagagggcccagg

SEQ ID NO: 1782808 - DNA, 20 bp, Homo sapiens
gatgcccagagggcccaggc

SEQ ID NO: 1782809 - DNA, 22 bp, Homo sapiens
gatgcccagggccactctgcct

SEQ ID NO: 1782810 - DNA, 23 bp, Homo sapiens
gatgccccctaatccccttctcc

SEQ ID NO: 1782811 - DNA, 16 bp, Homo sapiens
gatgccccctccagga

SEQ ID NO: 1782812 - DNA, 18 bp, Homo sapiens
gatgccccctccaggaga

SEQ ID NO: 1782813 - DNA, 20 bp, Homo sapiens
gatgccccctccaggagaga

SEQ ID NO: 1782814 - DNA, 23 bp, Homo sapiens
gatgccccctccaggagagagcc

SEQ ID NO: 1782815 - DNA, 24 bp, Homo sapiens
gatgccccctccaggagagagcca

SEQ ID NO: 1782816 - DNA, 19 bp, Homo sapiens
gatgcccgttgtctaggag

SEQ ID NO: 1782817 - DNA, 17 bp, Homo sapiens
gatgccgttctgttcca

SEQ ID NO: 1782818 - DNA, 18 bp, Homo sapiens
gatgcctccccaagactg

SEQ ID NO: 1782819 - DNA, 21 bp, Homo sapiens
gatgcctgattcggacggcca

SEQ ID NO: 1782820 - DNA, 15 bp, Homo sapiens
gatgcctgcccgcac

SEQ ID NO: 1782821 - DNA, 22 bp, Homo sapiens
gatgccttttttgtagtttttt

SEQ ID NO: 1782822 - DNA, 14 bp, Homo sapiens
gatgcgaggctcgg

SEQ ID NO: 1782823 - DNA, 16 bp, Homo sapiens
gatgcgttcagcagac

SEQ ID NO: 1782824 - DNA, 20 bp, Homo sapiens
gatgctaggctgtctgcgaa

SEQ ID NO: 1782825 - DNA, 15 bp, Homo sapiens
gatgctatttatgca

SEQ ID NO: 1782826 - DNA, 21 bp, Homo sapiens
gatgctcaggcttgaaatgca

SEQ ID NO: 1782827 - DNA, 20 bp, Homo sapiens
gatgctccaagattctagat

SEQ ID NO: 1782828 - DNA, 12 bp, Homo sapiens
gatgctccaggg

SEQ ID NO: 1782829 - DNA, 15 bp, Homo sapiens
gatgctccagggcag

SEQ ID NO: 1782830 - DNA, 13 bp, Homo sapiens
gatgctccctccc

SEQ ID NO: 1782831 - DNA, 17 bp, Homo sapiens
gatgctctttcccagga

SEQ ID NO: 1782832 - DNA, 22 bp, Homo sapiens
gatgctgacctcacctggtcct

SEQ ID NO: 1782833 - DNA, 14 bp, Homo sapiens
gatgctgaggccac

SEQ ID NO: 1782834 - DNA, 16 bp, Homo sapiens
gatgctgaggccaccc

SEQ ID NO: 1782835 - DNA, 13 bp, Homo sapiens
gatgctgaggccc

SEQ ID NO: 1782836 - DNA, 15 bp, Homo sapiens
gatgctgaggcccct

SEQ ID NO: 1782837 - DNA, 12 bp, Homo sapiens
gatgctgcctga

SEQ ID NO: 1782838 - DNA, 14 bp, Homo sapiens
gatgctgcctgagt

SEQ ID NO: 1782839 - DNA, 15 bp, Homo sapiens
gatgctgctccgccc

SEQ ID NO: 1782840 - DNA, 20 bp, Homo sapiens
gatgctggatgtctgccaat

SEQ ID NO: 1782841 - DNA, 15 bp, Homo sapiens
gatgctggcccaggg

SEQ ID NO: 1782842 - DNA, 17 bp, Homo sapiens
gatgctggcccagggcc

SEQ ID NO: 1782843 - DNA, 19 bp, Homo sapiens
gatgctggcccagggccca

SEQ ID NO: 1782844 - DNA, 22 bp, Homo sapiens
gatgctggcccagggcccagag

SEQ ID NO: 1782845 - DNA, 13 bp, Homo sapiens
gatgctgggctgg

SEQ ID NO: 1782846 - DNA, 15 bp, Homo sapiens
gatgctgggctgggc

SEQ ID NO: 1782847 - DNA, 20 bp, Homo sapiens
gatgctgggctgggccctct

SEQ ID NO: 1782848 - DNA, 12 bp, Homo sapiens
gatgctgtaaat

SEQ ID NO: 1782849 - DNA, 13 bp, Homo sapiens
gatgctgtaaata

SEQ ID NO: 1782850 - DNA, 19 bp, Homo sapiens
gatgctgtaacttaaaata

SEQ ID NO: 1782851 - DNA, 15 bp, Homo sapiens
gatgcttctgggaga

SEQ ID NO: 1782852 - DNA, 23 bp, Homo sapiens
gatgcttgcggcaaaaggaaagc

SEQ ID NO: 1782853 - DNA, 23 bp, Homo sapiens
gatgctttgtttctttcatatga

SEQ ID NO: 1782854 - DNA, 16 bp, Homo sapiens
gatgcttttatagctg

SEQ ID NO: 1782855 - DNA, 16 bp, Homo sapiens
gatggaaaaataacaa

SEQ ID NO: 1782856 - DNA, 12 bp, Homo sapiens
gatggaaaataa

SEQ ID NO: 1782857 - DNA, 13 bp, Homo sapiens
gatggaaaataaa

SEQ ID NO: 1782858 - DNA, 16 bp, Homo sapiens
gatggaatggaaaagc

SEQ ID NO: 1782859 - DNA, 23 bp, Homo sapiens
gatggaatggaaaagcaacttca

SEQ ID NO: 1782860 - DNA, 16 bp, Homo sapiens
gatggacacgagccac

SEQ ID NO: 1782861 - DNA, 17 bp, Homo sapiens
gatggacacgagccaca

SEQ ID NO: 1782862 - DNA, 19 bp, Homo sapiens
gatggaccgggtgggcctg

SEQ ID NO: 1782863 - DNA, 16 bp, Homo sapiens
gatggactcctgacca

SEQ ID NO: 1782864 - DNA, 14 bp, Homo sapiens
gatggactctgaaa

SEQ ID NO: 1782865 - DNA, 20 bp, Homo sapiens
gatggagacaccctctgggg

SEQ ID NO: 1782866 - DNA, 13 bp, Homo sapiens
gatggagaggctg

SEQ ID NO: 1782867 - DNA, 16 bp, Homo sapiens
gatggagatgggaagg

SEQ ID NO: 1782868 - DNA, 12 bp, Homo sapiens
gatggagcccat

SEQ ID NO: 1782869 - DNA, 18 bp, Homo sapiens
gatggagccccaccttgt

SEQ ID NO: 1782870 - DNA, 16 bp, Homo sapiens
gatggagcgcacctgc

SEQ ID NO: 1782871 - DNA, 18 bp, Homo sapiens
gatggagggcttggccca

SEQ ID NO: 1782872 - DNA, 16 bp, Homo sapiens
gatggagggtggaaat

SEQ ID NO: 1782873 - DNA, 16 bp, Homo sapiens
gatggaggtatttgaa

SEQ ID NO: 1782874 - DNA, 17 bp, Homo sapiens
gatggagtttctaaggt

SEQ ID NO: 1782875 - DNA, 17 bp, Homo sapiens
gatggataaactgagcc

SEQ ID NO: 1782876 - DNA, 14 bp, Homo sapiens
gatggatcaccatt

SEQ ID NO: 1782877 - DNA, 16 bp, Homo sapiens
gatggatggcaccctg

SEQ ID NO: 1782878 - DNA, 18 bp, Homo sapiens
gatggatggcaccctgga

SEQ ID NO: 1782879 - DNA, 18 bp, Homo sapiens
gatggcaccaacgggacc

SEQ ID NO: 1782880 - DNA, 17 bp, Homo sapiens
gatggcaccctggaacc

SEQ ID NO: 1782881 - DNA, 23 bp, Homo sapiens
gatggcagagccaggctgttgga

SEQ ID NO: 1782882 - DNA, 15 bp, Homo sapiens
gatggccaagagcat

SEQ ID NO: 1782883 - DNA, 15 bp, Homo sapiens
gatggccccagcaca

SEQ ID NO: 1782884 - DNA, 18 bp, Homo sapiens
gatggcccctccagcaca

SEQ ID NO: 1782885 - DNA, 19 bp, Homo sapiens
gatggcccctccagcacac

SEQ ID NO: 1782886 - DNA, 16 bp, Homo sapiens
gatggcctggaaccca

SEQ ID NO: 1782887 - DNA, 13 bp, Homo sapiens
gatggcgcgggag

SEQ ID NO: 1782888 - DNA, 17 bp, Homo sapiens
gatggcgcgggaggcac

SEQ ID NO: 1782889 - DNA, 14 bp, Homo sapiens
gatggctttcaggg

SEQ ID NO: 1782890 - DNA, 17 bp, Homo sapiens
gatggctttcagggcag

SEQ ID NO: 1782891 - DNA, 16 bp, Homo sapiens
gatgggaaactgcttt

SEQ ID NO: 1782892 - DNA, 21 bp, Homo sapiens
gatgggaaagcggcgccacag

SEQ ID NO: 1782893 - DNA, 19 bp, Homo sapiens
gatgggacaagcagtccct

SEQ ID NO: 1782894 - DNA, 15 bp, Homo sapiens
gatgggacagcaaca

SEQ ID NO: 1782895 - DNA, 16 bp, Homo sapiens
gatgggcattgggctg

SEQ ID NO: 1782896 - DNA, 18 bp, Homo sapiens
gatgggcattgggctgac

SEQ ID NO: 1782897 - DNA, 21 bp, Homo sapiens
gatgggcattgggctgacacc

SEQ ID NO: 1782898 - DNA, 19 bp, Homo sapiens
gatggggacagactgaaga

SEQ ID NO: 1782899 - DNA, 12 bp, Homo sapiens
gatggggagaaa

SEQ ID NO: 1782900 - DNA, 14 bp, Homo sapiens
gatgggggaaaaaa

SEQ ID NO: 1782901 - DNA, 13 bp, Homo sapiens
gatgggggagagg

SEQ ID NO: 1782902 - DNA, 23 bp, Homo sapiens
gatggggtctcacagtgttgccc

SEQ ID NO: 1782903 - DNA, 20 bp, Homo sapiens
gatggggtctgtgactggat

SEQ ID NO: 1782904 - DNA, 15 bp, Homo sapiens
gatgggtattaaact

SEQ ID NO: 1782905 - DNA, 22 bp, Homo sapiens
gatgggtattaaacttgtcaga

SEQ ID NO: 1782906 - DNA, 17 bp, Homo sapiens
gattatcttcagcccag

SEQ ID NO: 1782907 - DNA, 21 bp, Homo sapiens
gattatcttcagcccaggctt

SEQ ID NO: 1782908 - DNA, 15 bp, Homo sapiens
gattatgggtcctgc

SEQ ID NO: 1782909 - DNA, 15 bp, Homo sapiens
gattattataaacta

SEQ ID NO: 1782910 - DNA, 16 bp, Homo sapiens
gattattataaactat

SEQ ID NO: 1782911 - DNA, 17 bp, Homo sapiens
gattattataaactata

SEQ ID NO: 1782912 - DNA, 14 bp, Homo sapiens
gattattatagcaa

SEQ ID NO: 1782913 - DNA, 16 bp, Homo sapiens
gattattatgtttatt

SEQ ID NO: 1782914 - DNA, 17 bp, Homo sapiens
gattattctgattccac

SEQ ID NO: 1782915 - DNA, 19 bp, Homo sapiens
gattattctgattccactt

SEQ ID NO: 1782916 - DNA, 12 bp, Homo sapiens
gattattggaaa

SEQ ID NO: 1782917 - DNA, 16 bp, Homo sapiens
gattatttatgacctg

SEQ ID NO: 1782918 - DNA, 22 bp, Homo sapiens
gattatttcactttagatgctg

SEQ ID NO: 1782919 - DNA, 23 bp, Homo sapiens
gattatttcactttagatgctga

SEQ ID NO: 1782920 - DNA, 15 bp, Homo sapiens
gattcaaaggttcta

SEQ ID NO: 1782921 - DNA, 22 bp, Homo sapiens
gattcaaagtgttgtgttcctg

SEQ ID NO: 1782922 - DNA, 13 bp, Homo sapiens
gattcaaattgct

SEQ ID NO: 1782923 - DNA, 17 bp, Homo sapiens
gattcaaattgctgctt

SEQ ID NO: 1782924 - DNA, 16 bp, Homo sapiens
gattcaagaacaagca

SEQ ID NO: 1782925 - DNA, 14 bp, Homo sapiens
gattcaaggctcag

SEQ ID NO: 1782926 - DNA, 20 bp, Homo sapiens
gattcaatctgtaaactgtg

SEQ ID NO: 1782927 - DNA, 21 bp, Homo sapiens
gattcacacctgactctgaaa

SEQ ID NO: 1782928 - DNA, 22 bp, Homo sapiens
gattcacccccctctgctgccg

SEQ ID NO: 1782929 - DNA, 14 bp, Homo sapiens
gattcacctcttcc

SEQ ID NO: 1782930 - DNA, 18 bp, Homo sapiens
gattcacctcttcctctg

SEQ ID NO: 1782931 - DNA, 15 bp, Homo sapiens
gattcacgcttttgt

SEQ ID NO: 1782932 - DNA, 18 bp, Homo sapiens
gattcactgccttcctct

SEQ ID NO: 1782933 - DNA, 13 bp, Homo sapiens
gattcaggaatgt

SEQ ID NO: 1782934 - DNA, 13 bp, Homo sapiens
gattcaggccagc

SEQ ID NO: 1782935 - DNA, 17 bp, Homo sapiens
gattcaggccagcccag

SEQ ID NO: 1782936 - DNA, 18 bp, Homo sapiens
gattcaggccagcccagc

SEQ ID NO: 1782937 - DNA, 13 bp, Homo sapiens
gattcaggctgct

SEQ ID NO: 1782938 - DNA, 18 bp, Homo sapiens
gattcagtcttctggatt

SEQ ID NO: 1782939 - DNA, 22 bp, Homo sapiens
gattcataaatacaaaaatgaa

SEQ ID NO: 1782940 - DNA, 18 bp, Homo sapiens
gattcatatttacttctt

SEQ ID NO: 1782941 - DNA, 22 bp, Homo sapiens
gattcatctaccctgctgacct

SEQ ID NO: 1782942 - DNA, 21 bp, Homo sapiens
gattcatgccaattagcaatt

SEQ ID NO: 1782943 - DNA, 16 bp, Homo sapiens
gattcattttcctgtt

SEQ ID NO: 1782944 - DNA, 13 bp, Homo sapiens
gattccaaaccag

SEQ ID NO: 1782945 - DNA, 16 bp, Homo sapiens
gattccaaaccaggac

SEQ ID NO: 1782946 - DNA, 20 bp, Homo sapiens
gattccactacacctggctg

SEQ ID NO: 1782947 - DNA, 21 bp, Homo sapiens
gattccactacacctggctga

SEQ ID NO: 1782948 - DNA, 18 bp, Homo sapiens
gattccagcccacattgg

SEQ ID NO: 1782949 - DNA, 14 bp, Homo sapiens
gattcccagagaca

SEQ ID NO: 1782950 - DNA, 19 bp, Homo sapiens
gattcccagagcaaaataa

SEQ ID NO: 1782951 - DNA, 13 bp, Homo sapiens
gattcccttctgg

SEQ ID NO: 1782952 - DNA, 22 bp, Homo sapiens
gattccggatcctaagcatcta

SEQ ID NO: 1782953 - DNA, 17 bp, Homo sapiens
gattcctctctaagtgg

SEQ ID NO: 1782954 - DNA, 13 bp, Homo sapiens
gattcctgggcct

SEQ ID NO: 1782955 - DNA, 10 bp, Homo sapiens
gattcctggt

SEQ ID NO: 1782956 - DNA, 12 bp, Homo sapiens
gattccttttga

SEQ ID NO: 1782957 - DNA, 21 bp, Homo sapiens
gattccttttgatggggagaa

SEQ ID NO: 1782958 - DNA, 23 bp, Homo sapiens
gattccttttgatggggagaaag

SEQ ID NO: 1782959 - DNA, 17 bp, Homo sapiens
gattcgaaggatgaaga

SEQ ID NO: 1782960 - DNA, 15 bp, Homo sapiens
gattcgctgtcccct

SEQ ID NO: 1782961 - DNA, 20 bp, Homo sapiens
gattcgctgtcccctcagcg

SEQ ID NO: 1782962 - DNA, 12 bp, Homo sapiens
gattctaaaaca

SEQ ID NO: 1782963 - DNA, 22 bp, Homo sapiens
gattctaaaatgtgatgttcta

SEQ ID NO: 1782964 - DNA, 13 bp, Homo sapiens
gattctaaagatt

SEQ ID NO: 1782965 - DNA, 16 bp, Homo sapiens
gattctaaagctcaat

SEQ ID NO: 1782966 - DNA, 15 bp, Homo sapiens
gattctaaaggtcca

SEQ ID NO: 1782967 - DNA, 14 bp, Homo sapiens
gattctatatttca

SEQ ID NO: 1782968 - DNA, 19 bp, Homo sapiens
gattctcccgcctcagcct

SEQ ID NO: 1782969 - DNA, 18 bp, Homo sapiens
gattctcctgcctcagcc

SEQ ID NO: 1782970 - DNA, 13 bp, Homo sapiens
gattctccttcag

SEQ ID NO: 1782971 - DNA, 23 bp, Homo sapiens
gattctctggctgtaaggctcta

SEQ ID NO: 1782972 - DNA, 12 bp, Homo sapiens
gattctctgtgg

SEQ ID NO: 1782973 - DNA, 18 bp, Homo sapiens
gattctctgtgtctaaga

SEQ ID NO: 1782974 - DNA, 23 bp, Homo sapiens
gattctgatttcagtttttcatt

SEQ ID NO: 1782975 - DNA, 12 bp, Homo sapiens
gattctggaata

SEQ ID NO: 1782976 - DNA, 20 bp, Homo sapiens
gattctggctttaagccttc

SEQ ID NO: 1782977 - DNA, 21 bp, Homo sapiens
gattctgggaggcaagaaaag

SEQ ID NO: 1782978 - DNA, 17 bp, Homo sapiens
gattctgggatgctcct

SEQ ID NO: 1782979 - DNA, 15 bp, Homo sapiens
gattctgtggaacaa

SEQ ID NO: 1782980 - DNA, 18 bp, Homo sapiens
gattctgtgtcagagccc

SEQ ID NO: 1782981 - DNA, 23 bp, Homo sapiens
gattctgtttattcttccagaat

SEQ ID NO: 1782982 - DNA, 23 bp, Homo sapiens
gattcttatgtagcaggaaataa

SEQ ID NO: 1782983 - DNA, 18 bp, Homo sapiens
gattcttgattcctggct

SEQ ID NO: 1782984 - DNA, 15 bp, Homo sapiens
gattcttgtaaatct

SEQ ID NO: 1782985 - DNA, 20 bp, Homo sapiens
gattctttcagttctttgga

SEQ ID NO: 1782986 - DNA, 13 bp, Homo sapiens
gattctttcccca

SEQ ID NO: 1782987 - DNA, 14 bp, Homo sapiens
gattgaaaactttt

SEQ ID NO: 1782988 - DNA, 19 bp, Homo sapiens
gattgaaaacttttctcag

SEQ ID NO: 1782989 - DNA, 21 bp, Homo sapiens
gattgaaaacttttctcagat

SEQ ID NO: 1782990 - DNA, 20 bp, Homo sapiens
gattgaaaatgtccaggaaa

SEQ ID NO: 1782991 - DNA, 23 bp, Homo sapiens
gattgaagtattttgctggaata

SEQ ID NO: 1782992 - DNA, 15 bp, Homo sapiens
gattgaattccatta

SEQ ID NO: 1782993 - DNA, 23 bp, Homo sapiens
gattgacacacagcactctctaa

SEQ ID NO: 1782994 - DNA, 23 bp, Homo sapiens
gattgactaactcaaatacacat

SEQ ID NO: 1782995 - DNA, 20 bp, Homo sapiens
gattgaggggccctggccag

SEQ ID NO: 1782996 - DNA, 16 bp, Homo sapiens
gatcctctcacctcag

SEQ ID NO: 1782997 - DNA, 17 bp, Homo sapiens
gatcctgcaccccagca

SEQ ID NO: 1782998 - DNA, 22 bp, Homo sapiens
gatcctgcaccccagcattcca

SEQ ID NO: 1782999 - DNA, 21 bp, Homo sapiens
gatcctgcaggaacgagcact

SEQ ID NO: 1783000 - DNA, 22 bp, Homo sapiens
gatcctgcaggaacgagcactg

SEQ ID NO: 1783001 - DNA, 23 bp, Homo sapiens
gatcctgcaggaacgagcactgg

SEQ ID NO: 1783002 - DNA, 16 bp, Homo sapiens
gatcctgctccagcag

SEQ ID NO: 1783003 - DNA, 18 bp, Homo sapiens
gatcctgctccagcagca

SEQ ID NO: 1783004 - DNA, 15 bp, Homo sapiens
gatcctgctgacctc

SEQ ID NO: 1783005 - DNA, 12 bp, Homo sapiens
gatcctggaggc

SEQ ID NO: 1783006 - DNA, 16 bp, Homo sapiens
gatcctggaggcccag

SEQ ID NO: 1783007 - DNA, 19 bp, Homo sapiens
gatcctggattcactcact

SEQ ID NO: 1783008 - DNA, 22 bp, Homo sapiens
gatcctgggtactgaaagcctt

SEQ ID NO: 1783009 - DNA, 20 bp, Homo sapiens
gatcctggttaccactcttt

SEQ ID NO: 1783010 - DNA, 20 bp, Homo sapiens
gatcctgtctttaaggaaaa

SEQ ID NO: 1783011 - DNA, 23 bp, Homo sapiens
gatcctgttacttgcttcagtgg

SEQ ID NO: 1783012 - DNA, 17 bp, Homo sapiens
gatccttctgagctcca

SEQ ID NO: 1783013 - DNA, 19 bp, Homo sapiens
gatccttctgagctccacc

SEQ ID NO: 1783014 - DNA, 14 bp, Homo sapiens
gatccttggtgctg

SEQ ID NO: 1783015 - DNA, 16 bp, Homo sapiens
gatccttggtgctgtg

SEQ ID NO: 1783016 - DNA, 17 bp, Homo sapiens
gatccttggtgctgtgt

SEQ ID NO: 1783017 - DNA, 22 bp, Homo sapiens
gatccttgtctttactgacaag

SEQ ID NO: 1783018 - DNA, 22 bp, Homo sapiens
gatccttttcctaattcacaca

SEQ ID NO: 1783019 - DNA, 19 bp, Homo sapiens
gatcgacaccatcctggct

SEQ ID NO: 1783020 - DNA, 15 bp, Homo sapiens
gatcgagccactgca

SEQ ID NO: 1783021 - DNA, 19 bp, Homo sapiens
gatcgagtgtagctgtgaa

SEQ ID NO: 1783022 - DNA, 13 bp, Homo sapiens
gatcgatgtgctc

SEQ ID NO: 1783023 - DNA, 13 bp, Homo sapiens
gatcgcagtttgc

SEQ ID NO: 1783024 - DNA, 17 bp, Homo sapiens
gatcgcttgagcccagg

SEQ ID NO: 1783025 - DNA, 17 bp, Homo sapiens
gatcggagcctcctctc

SEQ ID NO: 1783026 - DNA, 18 bp, Homo sapiens
gatcgtgctaaattttca

SEQ ID NO: 1783027 - DNA, 23 bp, Homo sapiens
gatctaaacagttatttctgttt

SEQ ID NO: 1783028 - DNA, 15 bp, Homo sapiens
gatctaacaaaataa

SEQ ID NO: 1783029 - DNA, 18 bp, Homo sapiens
gatctaacaaaataaggt

SEQ ID NO: 1783030 - DNA, 14 bp, Homo sapiens
gatctaataaactt

SEQ ID NO: 1783031 - DNA, 21 bp, Homo sapiens
gatctacacatgttgccttgc

SEQ ID NO: 1783032 - DNA, 20 bp, Homo sapiens
gatctacttctgtaattgtg

SEQ ID NO: 1783033 - DNA, 16 bp, Homo sapiens
gatctagtccttgtct

SEQ ID NO: 1783034 - DNA, 15 bp, Homo sapiens
gatctataggcagct

SEQ ID NO: 1783035 - DNA, 18 bp, Homo sapiens
gatctatcacctgtcatc

SEQ ID NO: 1783036 - DNA, 21 bp, Homo sapiens
gatctatccctgcggcctcca

SEQ ID NO: 1783037 - DNA, 17 bp, Homo sapiens
gatctatgtttgtgtga

SEQ ID NO: 1783038 - DNA, 19 bp, Homo sapiens
gatctatgtttgtgtgatt

SEQ ID NO: 1783039 - DNA, 12 bp, Homo sapiens
gatctattgctc

SEQ ID NO: 1783040 - DNA, 16 bp, Homo sapiens
gatctatttcatgttt

SEQ ID NO: 1783041 - DNA, 16 bp, Homo sapiens
gatctcacaggctgag

SEQ ID NO: 1783042 - DNA, 12 bp, Homo sapiens
gatctcagctca

SEQ ID NO: 1783043 - DNA, 17 bp, Homo sapiens
gatctcagctcactaca

SEQ ID NO: 1783044 - DNA, 17 bp, Homo sapiens
gatctcagctcactgca

SEQ ID NO: 1783045 - DNA, 21 bp, Homo sapiens
gatctcagctttgagaagcct

SEQ ID NO: 1783046 - DNA, 12 bp, Homo sapiens
gatctcaggagc

SEQ ID NO: 1783047 - DNA, 13 bp, Homo sapiens
gatctcaggagct

SEQ ID NO: 1783048 - DNA, 22 bp, Homo sapiens
gatctcaggagcttgcaagaag

SEQ ID NO: 1783049 - DNA, 17 bp, Homo sapiens
gatctcaggggctgttt

SEQ ID NO: 1783050 - DNA, 20 bp, Homo sapiens
gatctcattcagtattaaag

SEQ ID NO: 1783051 - DNA, 21 bp, Homo sapiens
gatctcattcagtattaaagg

SEQ ID NO: 1783052 - DNA, 11 bp, Homo sapiens
gatctccagcg

SEQ ID NO: 1783053 - DNA, 15 bp, Homo sapiens
gatctcctgctgcct

SEQ ID NO: 1783054 - DNA, 12 bp, Homo sapiens
gatctctcagga

SEQ ID NO: 1783055 - DNA, 23 bp, Homo sapiens
gatctctcaggagcacaggcagc

SEQ ID NO: 1783056 - DNA, 24 bp, Homo sapiens
gatctctcaggagcacaggcagct

SEQ ID NO: 1783057 - DNA, 16 bp, Homo sapiens
gatctctcctggccta

SEQ ID NO: 1783058 - DNA, 22 bp, Homo sapiens
gatctctcttgtcctcttctgc

SEQ ID NO: 1783059 - DNA, 23 bp, Homo sapiens
gatctctcttgtcctcttctgct

SEQ ID NO: 1783060 - DNA, 22 bp, Homo sapiens
gatctctgggatttatgctcat

SEQ ID NO: 1783061 - DNA, 14 bp, Homo sapiens
gatctgaaatccat

SEQ ID NO: 1783062 - DNA, 12 bp, Homo sapiens
gatctgagaaca

SEQ ID NO: 1783063 - DNA, 21 bp, Homo sapiens
gatctgagaacacgttgccag

SEQ ID NO: 1783064 - DNA, 23 bp, Homo sapiens
gatctgagaacacgttgccaggg

SEQ ID NO: 1783065 - DNA, 18 bp, Homo sapiens
gatctgatggtgagctgg

SEQ ID NO: 1783066 - DNA, 22 bp, Homo sapiens
gcaattgtctatttatctttta

SEQ ID NO: 1783067 - DNA, 13 bp, Homo sapiens
gcaattgttacaa

SEQ ID NO: 1783068 - DNA, 23 bp, Homo sapiens
gcaattgttacaagtgttcttag

SEQ ID NO: 1783069 - DNA, 23 bp, Homo sapiens
gcaatttcaaattactctttctc

SEQ ID NO: 1783070 - DNA, 17 bp, Homo sapiens
gcaatttctaattttta

SEQ ID NO: 1783071 - DNA, 15 bp, Homo sapiens
gcaattttagtgtat

SEQ ID NO: 1783072 - DNA, 19 bp, Homo sapiens
gcaattttagtgtattaat

SEQ ID NO: 1783073 - DNA, 13 bp, Homo sapiens
gcaattttctttg

SEQ ID NO: 1783074 - DNA, 15 bp, Homo sapiens
gcaattttctttgtt

SEQ ID NO: 1783075 - DNA, 21 bp, Homo sapiens
gcacaaaagcagatacttgag

SEQ ID NO: 1783076 - DNA, 14 bp, Homo sapiens
gcacatcacctctt

SEQ ID NO: 1783077 - DNA, 15 bp, Homo sapiens
gcacatcagaaagga

SEQ ID NO: 1783078 - DNA, 22 bp, Homo sapiens
gcacatccatcagcaccccagt

SEQ ID NO: 1783079 - DNA, 19 bp, Homo sapiens
gcacatccgcgtgtgcctg

SEQ ID NO: 1783080 - DNA, 13 bp, Homo sapiens
gcacatctgcatt

SEQ ID NO: 1783081 - DNA, 13 bp, Homo sapiens
gcacatgactcgg

SEQ ID NO: 1783082 - DNA, 22 bp, Homo sapiens
gcacatgcagatggggctcccg

SEQ ID NO: 1783083 - DNA, 20 bp, Homo sapiens
gcagagaaacttaagcaaag

SEQ ID NO: 1783084 - DNA, 22 bp, Homo sapiens
gcagagaatggctgggtcaggg

SEQ ID NO: 1783085 - DNA, 13 bp, Homo sapiens
gcagagacactaa

SEQ ID NO: 1783086 - DNA, 15 bp, Homo sapiens
gcagagagggaacta

SEQ ID NO: 1783087 - DNA, 16 bp, Homo sapiens
gcagagaggtggagaa

SEQ ID NO: 1783088 - DNA, 22 bp, Homo sapiens
gcagagcaattccaggctgagc

SEQ ID NO: 1783089 - DNA, 13 bp, Homo sapiens
gcagagcaggaag

SEQ ID NO: 1783090 - DNA, 12 bp, Homo sapiens
gcagagccatgg

SEQ ID NO: 1783091 - DNA, 15 bp, Homo sapiens
gcagagccatgggcc

SEQ ID NO: 1783092 - DNA, 16 bp, Homo sapiens
gcagagccatgggcct

SEQ ID NO: 1783093 - DNA, 15 bp, Homo sapiens
gcagagccctccagg

SEQ ID NO: 1783094 - DNA, 16 bp, Homo sapiens
gcagagccctccaggc

SEQ ID NO: 1783095 - DNA, 19 bp, Homo sapiens
gcagagccctccaggcctg

SEQ ID NO: 1783096 - DNA, 10 bp, Homo sapiens
gcagagccta

SEQ ID NO: 1783097 - DNA, 16 bp, Homo sapiens
gcagagccttctcaga

SEQ ID NO: 1783098 - DNA, 19 bp, Homo sapiens
gcagagccttctcagaagc

SEQ ID NO: 1783099 - DNA, 21 bp, Homo sapiens
gcagagcgggactctgtccaa

SEQ ID NO: 1783100 - DNA, 22 bp, Homo sapiens
gcagagcggggtcccctctgtg

SEQ ID NO: 1783101 - DNA, 15 bp, Homo sapiens
gcagagctgagggcc

SEQ ID NO: 1783102 - DNA, 18 bp, Homo sapiens
gcagagctgagggccctg

SEQ ID NO: 1783103 - DNA, 19 bp, Homo sapiens
gcagagctgagggccctgt

SEQ ID NO: 1783104 - DNA, 20 bp, Homo sapiens
gcagagctgagggccctgtg

SEQ ID NO: 1783105 - DNA, 15 bp, Homo sapiens
gcagagctggctctg

SEQ ID NO: 1783106 - DNA, 12 bp, Homo sapiens
gcagaggaatgt

SEQ ID NO: 1783107 - DNA, 21 bp, Homo sapiens
gcagaggacagtctggagaag

SEQ ID NO: 1783108 - DNA, 14 bp, Homo sapiens
gcagaggaccacag

SEQ ID NO: 1783109 - DNA, 16 bp, Homo sapiens
gcagaggaccacagtg

SEQ ID NO: 1783110 - DNA, 14 bp, Homo sapiens
gcagaggcctgggc

SEQ ID NO: 1783111 - DNA, 21 bp, Homo sapiens
gcagaggctggaggcagggcc

SEQ ID NO: 1783112 - DNA, 21 bp, Homo sapiens
gcagagggaatgttccctgca

SEQ ID NO: 1783113 - DNA, 18 bp, Homo sapiens
gcagagggcagaggctgg

SEQ ID NO: 1783114 - DNA, 16 bp, Homo sapiens
gcagagggcaggggtg

SEQ ID NO: 1783115 - DNA, 14 bp, Homo sapiens
gcagagggctggag

SEQ ID NO: 1783116 - DNA, 20 bp, Homo sapiens
gcagagggctggaggcccag

SEQ ID NO: 1783117 - DNA, 24 bp, Homo sapiens
gcagagggctggaggcccaggctg

SEQ ID NO: 1783118 - DNA, 14 bp, Homo sapiens
gcagaggggcagcc

SEQ ID NO: 1783119 - DNA, 16 bp, Homo sapiens
gcagaggggcagccgc

SEQ ID NO: 1783120 - DNA, 21 bp, Homo sapiens
gcagaggggctttctggagag

SEQ ID NO: 1783121 - DNA, 19 bp, Homo sapiens
gcagaggtaccctgggtgt

SEQ ID NO: 1783122 - DNA, 15 bp, Homo sapiens
gcagaggtctgtgct

SEQ ID NO: 1783123 - DNA, 18 bp, Homo sapiens
gcagaggtctgtgctgag

SEQ ID NO: 1783124 - DNA, 21 bp, Homo sapiens
gcagaggttgcagtgagctga

SEQ ID NO: 1783125 - DNA, 16 bp, Homo sapiens
gcagaggttttaatgt

SEQ ID NO: 1783126 - DNA, 21 bp, Homo sapiens
gcagaggttttaatgtctgtt

SEQ ID NO: 1783127 - DNA, 17 bp, Homo sapiens
gcagagtgagcaagggg

SEQ ID NO: 1783128 - DNA, 19 bp, Homo sapiens
gcagagtggaaactcagcc

SEQ ID NO: 1783129 - DNA, 17 bp, Homo sapiens
gcagagtggactgcatt

SEQ ID NO: 1783130 - DNA, 19 bp, Homo sapiens
gcagagtggactgcattta

SEQ ID NO: 1783131 - DNA, 21 bp, Homo sapiens
gcagagttacagttctgtggt

SEQ ID NO: 1783132 - DNA, 15 bp, Homo sapiens
gcagagttacttgat

SEQ ID NO: 1783133 - DNA, 17 bp, Homo sapiens
gcagagttctgtgaaga

SEQ ID NO: 1783134 - DNA, 18 bp, Homo sapiens
gcagagtttccaaaacca

SEQ ID NO: 1783135 - DNA, 20 bp, Homo sapiens
gcagagtttgtgtgttgtct

SEQ ID NO: 1783136 - DNA, 19 bp, Homo sapiens
gcagagttttcattaaatc

SEQ ID NO: 1783137 - DNA, 19 bp, Homo sapiens
gcagataagttggagcagg

SEQ ID NO: 1783138 - DNA, 18 bp, Homo sapiens
gcagatatctgcatgtgt

SEQ ID NO: 1783139 - DNA, 12 bp, Homo sapiens
gcagatctcatg

SEQ ID NO: 1783140 - DNA, 17 bp, Homo sapiens
gcagatctcatgtcctc

SEQ ID NO: 1783141 - DNA, 14 bp, Homo sapiens
gcagatctgtgccc

SEQ ID NO: 1783142 - DNA, 22 bp, Homo sapiens
gcagatcttccgtggtcagagt

SEQ ID NO: 1783143 - DNA, 23 bp, Homo sapiens
gcagatcttccgtggtcagagtg

SEQ ID NO: 1783144 - DNA, 22 bp, Homo sapiens
gcagatgagcagtcacactgtt

SEQ ID NO: 1783145 - DNA, 14 bp, Homo sapiens
gcagatgccaccct

SEQ ID NO: 1783146 - DNA, 17 bp, Homo sapiens
gcagatgccaccctagc

SEQ ID NO: 1783147 - DNA, 18 bp, Homo sapiens
gcagatgccaccctagcc

SEQ ID NO: 1783148 - DNA, 23 bp, Homo sapiens
gcagatgccattttgtacatgta

SEQ ID NO: 1783149 - DNA, 13 bp, Homo sapiens
gcagatgcctggg

SEQ ID NO: 1783150 - DNA, 18 bp, Homo sapiens
gcagatggaatgctgtgt

SEQ ID NO: 1783151 - DNA, 22 bp, Homo sapiens
gcagatggaatgctgtgttaaa

SEQ ID NO: 1783152 - DNA, 15 bp, Homo sapiens
gcagatgggcggacg

SEQ ID NO: 1783153 - DNA, 16 bp, Homo sapiens
gcagatgtttgcctca

SEQ ID NO: 1783154 - DNA, 19 bp, Homo sapiens
gcagattcatttttctttc

SEQ ID NO: 1783155 - DNA, 15 bp, Homo sapiens
gcagattcctgggcc

SEQ ID NO: 1783156 - DNA, 17 bp, Homo sapiens
gcagattgaaaaggaca

SEQ ID NO: 1783157 - DNA, 20 bp, Homo sapiens
gcagatttagtgaaagctag

SEQ ID NO: 1783158 - DNA, 19 bp, Homo sapiens
gcagatttctctttagcct

SEQ ID NO: 1783159 - DNA, 17 bp, Homo sapiens
gcagattttacaaaaga

SEQ ID NO: 1783160 - DNA, 21 bp, Homo sapiens
gcagatttttatgttttgaaa

SEQ ID NO: 1783161 - DNA, 16 bp, Homo sapiens
gcagcaaacactccac

SEQ ID NO: 1783162 - DNA, 14 bp, Homo sapiens
gcagcaaattttca

SEQ ID NO: 1783163 - DNA, 16 bp, Homo sapiens
gcagcaaggctgctgc

SEQ ID NO: 1783164 - DNA, 17 bp, Homo sapiens
gcagcacatgcgggctc

SEQ ID NO: 1783165 - DNA, 17 bp, Homo sapiens
gcagcaccaaccacagc

SEQ ID NO: 1783166 - DNA, 16 bp, Homo sapiens
gcagcaccacactggg

SEQ ID NO: 1783167 - DNA, 11 bp, Homo sapiens
gcagcaccctt

SEQ ID NO: 1783168 - DNA, 21 bp, Homo sapiens
gcagcacccttctcggagacc

SEQ ID NO: 1783169 - DNA, 19 bp, Homo sapiens
gcagcacctccaggcctgt

SEQ ID NO: 1783170 - DNA, 13 bp, Homo sapiens
gcagcactcccca

SEQ ID NO: 1783171 - DNA, 16 bp, Homo sapiens
gcagcactccccagag

SEQ ID NO: 1783172 - DNA, 21 bp, Homo sapiens
gcagcactccccagagctgtg

SEQ ID NO: 1783173 - DNA, 13 bp, Homo sapiens
gcagcagaagggg

SEQ ID NO: 1783174 - DNA, 15 bp, Homo sapiens
gcagcagaagggggt

SEQ ID NO: 1783175 - DNA, 21 bp, Homo sapiens
gcagcagagagagaggacaga

SEQ ID NO: 1783176 - DNA, 22 bp, Homo sapiens
gcagcagaggacagtctggaga

SEQ ID NO: 1783177 - DNA, 23 bp, Homo sapiens
gcagcagaggacagtctggagaa

SEQ ID NO: 1783178 - DNA, 21 bp, Homo sapiens
gcagcagagtgagcaaggggg

SEQ ID NO: 1783179 - DNA, 15 bp, Homo sapiens
gcagcagcaccaacc

SEQ ID NO: 1783180 - DNA, 11 bp, Homo sapiens
gcagcagccag

SEQ ID NO: 1783181 - DNA, 16 bp, Homo sapiens
gcagcagccagggacc

SEQ ID NO: 1783182 - DNA, 13 bp, Homo sapiens
gcagcagcccaag

SEQ ID NO: 1783183 - DNA, 12 bp, Homo sapiens
gcagcagcccag

SEQ ID NO: 1783184 - DNA, 19 bp, Homo sapiens
gcagcagcccagcttcctg

SEQ ID NO: 1783185 - DNA, 15 bp, Homo sapiens
gcagcagctgggacc

SEQ ID NO: 1783186 - DNA, 21 bp, Homo sapiens
gcagcagctgggacccctccc

SEQ ID NO: 1783187 - DNA, 16 bp, Homo sapiens
gcagcaggaaggaaca

SEQ ID NO: 1783188 - DNA, 21 bp, Homo sapiens
gcagcaggaaggaacaaagac

SEQ ID NO: 1783189 - DNA, 21 bp, Homo sapiens
gcagcaggaatatatgtgtgc

SEQ ID NO: 1783190 - DNA, 13 bp, Homo sapiens
gcagcaggctcag

SEQ ID NO: 1783191 - DNA, 15 bp, Homo sapiens
gcagcaggctcaggc

SEQ ID NO: 1783192 - DNA, 16 bp, Homo sapiens
gcagcaggctcaggca

SEQ ID NO: 1783193 - DNA, 17 bp, Homo sapiens
gcagcagggaagctctt

SEQ ID NO: 1783194 - DNA, 21 bp, Homo sapiens
gcagcaggtgattggaccagg

SEQ ID NO: 1783195 - DNA, 18 bp, Homo sapiens
gcaggctcctggctgtgc

SEQ ID NO: 1783196 - DNA, 21 bp, Homo sapiens
gcaggctcctggctgtgccca

SEQ ID NO: 1783197 - DNA, 23 bp, Homo sapiens
gcaggctcctggctgtgcccagc

SEQ ID NO: 1783198 - DNA, 11 bp, Homo sapiens
gcaggctctgg

SEQ ID NO: 1783199 - DNA, 18 bp, Homo sapiens
gcaggctctgggctcagg

SEQ ID NO: 1783200 - DNA, 19 bp, Homo sapiens
gcaggctctgggctcaggg

SEQ ID NO: 1783201 - DNA, 20 bp, Homo sapiens
gcaggctctgggctcagggc

SEQ ID NO: 1783202 - DNA, 23 bp, Homo sapiens
gcaggctctgggctcagggctgg

SEQ ID NO: 1783203 - DNA, 16 bp, Homo sapiens
gcaggctgagtccaga

SEQ ID NO: 1783204 - DNA, 20 bp, Homo sapiens
gcaggctgcacctctggcta

SEQ ID NO: 1783205 - DNA, 12 bp, Homo sapiens
gcaggctggcca

SEQ ID NO: 1783206 - DNA, 23 bp, Homo sapiens
gcaggctgggccatgtccaaaga

SEQ ID NO: 1783207 - DNA, 20 bp, Homo sapiens
gcaggctgtggggcagctga

SEQ ID NO: 1783208 - DNA, 13 bp, Homo sapiens
gcaggcttgggga

SEQ ID NO: 1783209 - DNA, 18 bp, Homo sapiens
gcatagattccctgagca

SEQ ID NO: 1783210 - DNA, 16 bp, Homo sapiens
gcatagcaagacacat

SEQ ID NO: 1783211 - DNA, 15 bp, Homo sapiens
gcatagccctcctga

SEQ ID NO: 1783212 - DNA, 18 bp, Homo sapiens
gcatagccctcctgagca

SEQ ID NO: 1783213 - DNA, 15 bp, Homo sapiens
gcatagcctgcctga

SEQ ID NO: 1783214 - DNA, 22 bp, Homo sapiens
gcatagcctgcctgatccctga

SEQ ID NO: 1783215 - DNA, 15 bp, Homo sapiens
gcatagctctggggt

SEQ ID NO: 1783216 - DNA, 17 bp, Homo sapiens
gcatataggtgatgttt

SEQ ID NO: 1783217 - DNA, 18 bp, Homo sapiens
gcatatcacccttccctg

SEQ ID NO: 1783218 - DNA, 19 bp, Homo sapiens
gcatatcacccttccctgc

SEQ ID NO: 1783219 - DNA, 15 bp, Homo sapiens
gcatatcctgagcca

SEQ ID NO: 1783220 - DNA, 20 bp, Homo sapiens
gcatatcctggtgtctagtt

SEQ ID NO: 1783221 - DNA, 14 bp, Homo sapiens
gcatatgacaaatg

SEQ ID NO: 1783222 - DNA, 15 bp, Homo sapiens
gcatatgacaaatgt

SEQ ID NO: 1783223 - DNA, 18 bp, Homo sapiens
gcatatgacaaatgtttc

SEQ ID NO: 1783224 - DNA, 12 bp, Homo sapiens
gcatatgtttct

SEQ ID NO: 1783225 - DNA, 21 bp, Homo sapiens
gcatattcaatgtattgagaa

SEQ ID NO: 1783226 - DNA, 23 bp, Homo sapiens
gcatatttatagcaatccatgtt

SEQ ID NO: 1783227 - DNA, 21 bp, Homo sapiens
gcatatttatccaaaatgtgt

SEQ ID NO: 1783228 - DNA, 18 bp, Homo sapiens
gcatattttgagaaactg

SEQ ID NO: 1783229 - DNA, 20 bp, Homo sapiens
gcatcaagggagacaccagt

SEQ ID NO: 1783230 - DNA, 20 bp, Homo sapiens
gcatcacacttatattttat

SEQ ID NO: 1783231 - DNA, 16 bp, Homo sapiens
gcatggacctaacatt

SEQ ID NO: 1783232 - DNA, 23 bp, Homo sapiens
gcatggagaagggttctgccctg

SEQ ID NO: 1783233 - DNA, 19 bp, Homo sapiens
gcatggagagcctcttagt

SEQ ID NO: 1783234 - DNA, 19 bp, Homo sapiens
gcatggaggactctcctct

SEQ ID NO: 1783235 - DNA, 15 bp, Homo sapiens
gcatggaggaggagg

SEQ ID NO: 1783236 - DNA, 20 bp, Homo sapiens
gcatggagtatagtgcaaat

SEQ ID NO: 1783237 - DNA, 20 bp, Homo sapiens
gcatggatatagttttactt

SEQ ID NO: 1783238 - DNA, 14 bp, Homo sapiens
gcatggcacctgtc

SEQ ID NO: 1783239 - DNA, 15 bp, Homo sapiens
gcatggcactgactg

SEQ ID NO: 1783240 - DNA, 13 bp, Homo sapiens
gcatggccctggg

SEQ ID NO: 1783241 - DNA, 14 bp, Homo sapiens
gcatggccctgggc

SEQ ID NO: 1783242 - DNA, 15 bp, Homo sapiens
gcatggctcctgtct

SEQ ID NO: 1783243 - DNA, 17 bp, Homo sapiens
gcatggctcctgtctgg

SEQ ID NO: 1783244 - DNA, 14 bp, Homo sapiens
gcatgggaggtgag

SEQ ID NO: 1783245 - DNA, 13 bp, Homo sapiens
gcatgggctcgcc

SEQ ID NO: 1783246 - DNA, 22 bp, Homo sapiens
gcatggggataaaggagaaggc

SEQ ID NO: 1783247 - DNA, 13 bp, Homo sapiens
gcatggggcccct

SEQ ID NO: 1783248 - DNA, 16 bp, Homo sapiens
gcatgggtccagggcc

SEQ ID NO: 1783249 - DNA, 15 bp, Homo sapiens
gcatggtgccccagg

SEQ ID NO: 1783250 - DNA, 17 bp, Homo sapiens
gcatggtgccccaggac

SEQ ID NO: 1783251 - DNA, 19 bp, Homo sapiens
gcatggtgccccaggacca

SEQ ID NO: 1783252 - DNA, 14 bp, Homo sapiens
gcatggtggccaga

SEQ ID NO: 1783253 - DNA, 16 bp, Homo sapiens
gcatggtggccagagg

SEQ ID NO: 1783254 - DNA, 16 bp, Homo sapiens
gcatggtggctcatgc

SEQ ID NO: 1783255 - DNA, 18 bp, Homo sapiens
gcatggttccttccctgg

SEQ ID NO: 1783256 - DNA, 14 bp, Homo sapiens
gcatggttgcagat

SEQ ID NO: 1783257 - DNA, 17 bp, Homo sapiens
gcatgtaaaagcggaaa

SEQ ID NO: 1783258 - DNA, 18 bp, Homo sapiens
gcatgtaccatttgcatg

SEQ ID NO: 1783259 - DNA, 13 bp, Homo sapiens
gcatgtagtaaca

SEQ ID NO: 1783260 - DNA, 21 bp, Homo sapiens
gcatgtagtaacactaatata

SEQ ID NO: 1783261 - DNA, 15 bp, Homo sapiens
gcatgtatgtcttgg

SEQ ID NO: 1783262 - DNA, 19 bp, Homo sapiens
gcatgtattagctcactga

SEQ ID NO: 1783263 - DNA, 20 bp, Homo sapiens
gcatgtcaaacatgagatgt

SEQ ID NO: 1783264 - DNA, 16 bp, Homo sapiens
gcatgtcccacccacc

SEQ ID NO: 1783265 - DNA, 17 bp, Homo sapiens
gcatgtcttttaaaatg

SEQ ID NO: 1783266 - DNA, 16 bp, Homo sapiens
gcatgtgaagcatgct

SEQ ID NO: 1783267 - DNA, 21 bp, Homo sapiens
gcatgtgaagcatgctttgct

SEQ ID NO: 1783268 - DNA, 11 bp, Homo sapiens
gcatgtgccaa

SEQ ID NO: 1783269 - DNA, 12 bp, Homo sapiens
gcatgtgccaag

SEQ ID NO: 1783270 - DNA, 13 bp, Homo sapiens
gcatgtgccaaga

SEQ ID NO: 1783271 - DNA, 21 bp, Homo sapiens
gcatgtgccaagattctactc

SEQ ID NO: 1783272 - DNA, 14 bp, Homo sapiens
gcatgtgctgtgtg

SEQ ID NO: 1783273 - DNA, 17 bp, Homo sapiens
gcatgtggcctgtggcc

SEQ ID NO: 1783274 - DNA, 12 bp, Homo sapiens
gcatgtgtattt

SEQ ID NO: 1783275 - DNA, 20 bp, Homo sapiens
gcatgtgtatttccagtgca

SEQ ID NO: 1783276 - DNA, 21 bp, Homo sapiens
gcatgtgtatttccagtgcaa

SEQ ID NO: 1783277 - DNA, 20 bp, Homo sapiens
gcatgtgtcctttcaagggg

SEQ ID NO: 1783278 - DNA, 18 bp, Homo sapiens
gcatgtgtgcctgtggca

SEQ ID NO: 1783279 - DNA, 18 bp, Homo sapiens
gcatgtgtgtgtctgtct

SEQ ID NO: 1783280 - DNA, 18 bp, Homo sapiens
gcatgttacctcctataa

SEQ ID NO: 1783281 - DNA, 21 bp, Homo sapiens
gcatgttactacagaggaaag

SEQ ID NO: 1783282 - DNA, 20 bp, Homo sapiens
gcatgttcacccttatagtc

SEQ ID NO: 1783283 - DNA, 15 bp, Homo sapiens
gcatgttttgcatgt

SEQ ID NO: 1783284 - DNA, 21 bp, Homo sapiens
gcattaagcacacacatctgg

SEQ ID NO: 1783285 - DNA, 15 bp, Homo sapiens
gcattataaaaagaa

SEQ ID NO: 1783286 - DNA, 19 bp, Homo sapiens
gcattatataccatttatc

SEQ ID NO: 1783287 - DNA, 22 bp, Homo sapiens
gcattatgtccactgtgtatag

SEQ ID NO: 1783288 - DNA, 17 bp, Homo sapiens
gcattattgacgaactg

SEQ ID NO: 1783289 - DNA, 21 bp, Homo sapiens
gcattattgacgaactggcta

SEQ ID NO: 1783290 - DNA, 21 bp, Homo sapiens
gcattcaaaatagttctattt

SEQ ID NO: 1783291 - DNA, 23 bp, Homo sapiens
gcattcacaaggtgactgggatg

SEQ ID NO: 1783292 - DNA, 12 bp, Homo sapiens
gcattcacccag

SEQ ID NO: 1783293 - DNA, 20 bp, Homo sapiens
gcattcacccagacagctcc

SEQ ID NO: 1783294 - DNA, 17 bp, Homo sapiens
gcattcagcacacacaa

SEQ ID NO: 1783295 - DNA, 12 bp, Homo sapiens
gcattccagaat

SEQ ID NO: 1783296 - DNA, 14 bp, Homo sapiens
gcattccagaatct

SEQ ID NO: 1783297 - DNA, 15 bp, Homo sapiens
gcattccagaatctt

SEQ ID NO: 1783298 - DNA, 22 bp, Homo sapiens
gcattccagagttaaaatgttt

SEQ ID NO: 1783299 - DNA, 15 bp, Homo sapiens
gcattccagcccctc

SEQ ID NO: 1783300 - DNA, 17 bp, Homo sapiens
gcattccagctctgccc

SEQ ID NO: 1783301 - DNA, 22 bp, Homo sapiens
gcattccctacagcctagggca

SEQ ID NO: 1783302 - DNA, 14 bp, Homo sapiens
gcattccctgagtc

SEQ ID NO: 1783303 - DNA, 21 bp, Homo sapiens
gcattccctgagtcaccagga

SEQ ID NO: 1783304 - DNA, 21 bp, Homo sapiens
gcattcctgatatgatttaaa

SEQ ID NO: 1783305 - DNA, 14 bp, Homo sapiens
gcattcctgtgccc

SEQ ID NO: 1783306 - DNA, 19 bp, Homo sapiens
gcattcgaagaaacccttg

SEQ ID NO: 1783307 - DNA, 23 bp, Homo sapiens
gcattcgctgtaccctttaagat

SEQ ID NO: 1783308 - DNA, 13 bp, Homo sapiens
gcattctcactcc

SEQ ID NO: 1783309 - DNA, 15 bp, Homo sapiens
gcattctcactccta

SEQ ID NO: 1783310 - DNA, 18 bp, Homo sapiens
gcattctcactcctacct

SEQ ID NO: 1783311 - DNA, 16 bp, Homo sapiens
gcattctctcccatcc

SEQ ID NO: 1783312 - DNA, 20 bp, Homo sapiens
gcattctgcctctctaggac

SEQ ID NO: 1783313 - DNA, 22 bp, Homo sapiens
gcattctggaggggagagcttt

SEQ ID NO: 1783314 - DNA, 22 bp, Homo sapiens
gcattcttaacaaactcttcag

SEQ ID NO: 1783315 - DNA, 19 bp, Homo sapiens
gcattcttgtcacaataaa

SEQ ID NO: 1783316 - DNA, 13 bp, Homo sapiens
gcattctttggta

SEQ ID NO: 1783317 - DNA, 18 bp, Homo sapiens
gccaaggccgaagctctg

SEQ ID NO: 1783318 - DNA, 19 bp, Homo sapiens
gccaaggccgaagctctgg

SEQ ID NO: 1783319 - DNA, 20 bp, Homo sapiens
gccaaggccgaagctctggc

SEQ ID NO: 1783320 - DNA, 18 bp, Homo sapiens
gccaagggaaaggggtgc

SEQ ID NO: 1783321 - DNA, 22 bp, Homo sapiens
gccaagggaaaggggtgctttt

SEQ ID NO: 1783322 - DNA, 15 bp, Homo sapiens
gccaagggccccagg

SEQ ID NO: 1783323 - DNA, 16 bp, Homo sapiens
gccaagggccccaggg

SEQ ID NO: 1783324 - DNA, 21 bp, Homo sapiens
gccaagggccgactaagagaa

SEQ ID NO: 1783325 - DNA, 22 bp, Homo sapiens
gccaaggtgccaccaccctgcc

SEQ ID NO: 1783326 - DNA, 16 bp, Homo sapiens
gccaaggtggagggaa

SEQ ID NO: 1783327 - DNA, 21 bp, Homo sapiens
gccaaggtgggctgagccctg

SEQ ID NO: 1783328 - DNA, 23 bp, Homo sapiens
gccaaggtgtttccatttctcaa

SEQ ID NO: 1783329 - DNA, 22 bp, Homo sapiens
gccaagtctaatgaagagaaaa

SEQ ID NO: 1783330 - DNA, 17 bp, Homo sapiens
gccaagtctcagaagag

SEQ ID NO: 1783331 - DNA, 15 bp, Homo sapiens
gccaagtgctctttg

SEQ ID NO: 1783332 - DNA, 19 bp, Homo sapiens
gccaagtggggtgctggga

SEQ ID NO: 1783333 - DNA, 15 bp, Homo sapiens
gccaagtggtccagc

SEQ ID NO: 1783334 - DNA, 20 bp, Homo sapiens
gccaagttgctgtcactgtt

SEQ ID NO: 1783335 - DNA, 19 bp, Homo sapiens
gccaatcccctccttgggc

SEQ ID NO: 1783336 - DNA, 21 bp, Homo sapiens
gccaatggagactgtctcaag

SEQ ID NO: 1783337 - DNA, 21 bp, Homo sapiens
gccaatggaggggggtgctgg

SEQ ID NO: 1783338 - DNA, 22 bp, Homo sapiens
gccaatggaggggggtgctggc

SEQ ID NO: 1783339 - DNA, 14 bp, Homo sapiens
gccaatggtgcttc

SEQ ID NO: 1783340 - DNA, 19 bp, Homo sapiens
gccaatggtgcttccccca

SEQ ID NO: 1783341 - DNA, 22 bp, Homo sapiens
gccaatgttgctgatggcccct

SEQ ID NO: 1783342 - DNA, 20 bp, Homo sapiens
gccaatttcaagttccaagt

SEQ ID NO: 1783343 - DNA, 16 bp, Homo sapiens
gccacaaaccaccagg

SEQ ID NO: 1783344 - DNA, 20 bp, Homo sapiens
gccacaaagctaggatggtt

SEQ ID NO: 1783345 - DNA, 20 bp, Homo sapiens
gccacaaatcaaagcaaggg

SEQ ID NO: 1783346 - DNA, 22 bp, Homo sapiens
gccacaaatcaaagcaagggct

SEQ ID NO: 1783347 - DNA, 16 bp, Homo sapiens
gccacaagctgcactg

SEQ ID NO: 1783348 - DNA, 20 bp, Homo sapiens
gccacaaggacgctggctac

SEQ ID NO: 1783349 - DNA, 13 bp, Homo sapiens
gccacaccactgc

SEQ ID NO: 1783350 - DNA, 12 bp, Homo sapiens
gcagtcattttg

SEQ ID NO: 1783351 - DNA, 14 bp, Homo sapiens
gcagtccagccagc

SEQ ID NO: 1783352 - DNA, 16 bp, Homo sapiens
gcagtccagccagctc

SEQ ID NO: 1783353 - DNA, 20 bp, Homo sapiens
gcagtcccattcatattaag

SEQ ID NO: 1783354 - DNA, 23 bp, Homo sapiens
gcagtcccattcatattaagaca

SEQ ID NO: 1783355 - DNA, 13 bp, Homo sapiens
gcagtccccagcc

SEQ ID NO: 1783356 - DNA, 14 bp, Homo sapiens
gcagtccccagccc

SEQ ID NO: 1783357 - DNA, 15 bp, Homo sapiens
gcagtccccagccct

SEQ ID NO: 1783358 - DNA, 17 bp, Homo sapiens
gcagtccccagcccttc

SEQ ID NO: 1783359 - DNA, 23 bp, Homo sapiens
gcagtccccagcccttctgcctt

SEQ ID NO: 1783360 - DNA, 15 bp, Homo sapiens
gcagtccctggagaa

SEQ ID NO: 1783361 - DNA, 20 bp, Homo sapiens
gcagtcctggaagccagctt

SEQ ID NO: 1783362 - DNA, 16 bp, Homo sapiens
gcagtcctggaggcag

SEQ ID NO: 1783363 - DNA, 17 bp, Homo sapiens
gcagtcctggaggcagg

SEQ ID NO: 1783364 - DNA, 16 bp, Homo sapiens
gcagtcctggtggggc

SEQ ID NO: 1783365 - DNA, 23 bp, Homo sapiens
gcagtcctggtggggctgagcct

SEQ ID NO: 1783366 - DNA, 15 bp, Homo sapiens
gcagtcctttgtaaa

SEQ ID NO: 1783367 - DNA, 15 bp, Homo sapiens
gcagtcgcaggatcc

SEQ ID NO: 1783368 - DNA, 16 bp, Homo sapiens
gccaccttcccacccc

SEQ ID NO: 1783369 - DNA, 13 bp, Homo sapiens
gccacgactgcca

SEQ ID NO: 1783370 - DNA, 14 bp, Homo sapiens
gccacgcactgggc

SEQ ID NO: 1783371 - DNA, 20 bp, Homo sapiens
gccacgcactgggccacgga

SEQ ID NO: 1783372 - DNA, 13 bp, Homo sapiens
gccacgcagccag

SEQ ID NO: 1783373 - DNA, 17 bp, Homo sapiens
gccacgcagccaggaca

SEQ ID NO: 1783374 - DNA, 22 bp, Homo sapiens
gccacgcagggccatccactgt

SEQ ID NO: 1783375 - DNA, 15 bp, Homo sapiens
gccacggaggaggga

SEQ ID NO: 1783376 - DNA, 20 bp, Homo sapiens
gccacggaggagggatgctg

SEQ ID NO: 1783377 - DNA, 14 bp, Homo sapiens
gccacggccaccct

SEQ ID NO: 1783378 - DNA, 17 bp, Homo sapiens
gccacggccccgggtcc

SEQ ID NO: 1783379 - DNA, 18 bp, Homo sapiens
gccacggggactcagccc

SEQ ID NO: 1783380 - DNA, 19 bp, Homo sapiens
gccacgggggcagtgtgag

SEQ ID NO: 1783381 - DNA, 15 bp, Homo sapiens
gccacgtcccagcat

SEQ ID NO: 1783382 - DNA, 18 bp, Homo sapiens
gccacgtcccagcatccc

SEQ ID NO: 1783383 - DNA, 17 bp, Homo sapiens
gccacgtgccaggcccg

SEQ ID NO: 1783384 - DNA, 16 bp, Homo sapiens
gccacgttccttactg

SEQ ID NO: 1783385 - DNA, 22 bp, Homo sapiens
gccactaaagcttcagactcaa

SEQ ID NO: 1783386 - DNA, 18 bp, Homo sapiens
gccactaattttagtatt

SEQ ID NO: 1783387 - DNA, 19 bp, Homo sapiens
gccactacactccagcctg

SEQ ID NO: 1783388 - DNA, 21 bp, Homo sapiens
gccactacactccagcctgag

SEQ ID NO: 1783389 - DNA, 19 bp, Homo sapiens
gccactcactaggccccca

SEQ ID NO: 1783390 - DNA, 20 bp, Homo sapiens
gccactcagccatttccccc

SEQ ID NO: 1783391 - DNA, 20 bp, Homo sapiens
gccactcaggaggctgaggc

SEQ ID NO: 1783392 - DNA, 20 bp, Homo sapiens
gccactcatattctgggctc

SEQ ID NO: 1783393 - DNA, 18 bp, Homo sapiens
gccactccagacccctgg

SEQ ID NO: 1783394 - DNA, 19 bp, Homo sapiens
gccactccagacccctggc

SEQ ID NO: 1783395 - DNA, 21 bp, Homo sapiens
gccactccagacccctggctt

SEQ ID NO: 1783396 - DNA, 13 bp, Homo sapiens
gccactccctgag

SEQ ID NO: 1783397 - DNA, 16 bp, Homo sapiens
gccactccctgagctt

SEQ ID NO: 1783398 - DNA, 19 bp, Homo sapiens
gccactccctgagctttgg

SEQ ID NO: 1783399 - DNA, 21 bp, Homo sapiens
gccactccgagaggtgggcca

SEQ ID NO: 1783400 - DNA, 16 bp, Homo sapiens
gccactcctccctccg

SEQ ID NO: 1783401 - DNA, 22 bp, Homo sapiens
gccactcctgtcccgccttcct

SEQ ID NO: 1783402 - DNA, 19 bp, Homo sapiens
gccactcgcagtcgcagga

SEQ ID NO: 1783403 - DNA, 12 bp, Homo sapiens
gccactctgcct

SEQ ID NO: 1783404 - DNA, 13 bp, Homo sapiens
gccactctgcctc

SEQ ID NO: 1783405 - DNA, 14 bp, Homo sapiens
gccactgaagctgg

SEQ ID NO: 1783406 - DNA, 21 bp, Homo sapiens
gccccagactgggcccaggca

SEQ ID NO: 1783407 - DNA, 12 bp, Homo sapiens
gccccagagaga

SEQ ID NO: 1783408 - DNA, 14 bp, Homo sapiens
gccccagagctgtt

SEQ ID NO: 1783409 - DNA, 22 bp, Homo sapiens
gccccagagctgtttatggcct

SEQ ID NO: 1783410 - DNA, 23 bp, Homo sapiens
gccccagagctgtttatggcctc

SEQ ID NO: 1783411 - DNA, 16 bp, Homo sapiens
gccccagaggccctgg

SEQ ID NO: 1783412 - DNA, 17 bp, Homo sapiens
gccccagaggccctgga

SEQ ID NO: 1783413 - DNA, 20 bp, Homo sapiens
gccccagaggccctggaggt

SEQ ID NO: 1783414 - DNA, 20 bp, Homo sapiens
gccccagatcaccagcccgg

SEQ ID NO: 1783415 - DNA, 16 bp, Homo sapiens
gccccagatctgcctg

SEQ ID NO: 1783416 - DNA, 18 bp, Homo sapiens
gccccagatctgcctggg

SEQ ID NO: 1783417 - DNA, 19 bp, Homo sapiens
gccccagatctgcctgggc

SEQ ID NO: 1783418 - DNA, 17 bp, Homo sapiens
gccccagatgatcccag

SEQ ID NO: 1783419 - DNA, 21 bp, Homo sapiens
gccccagatgatcccagtcac

SEQ ID NO: 1783420 - DNA, 20 bp, Homo sapiens
gccccagcacagcttgacct

SEQ ID NO: 1783421 - DNA, 19 bp, Homo sapiens
gccccagcactaaagcagt

SEQ ID NO: 1783422 - DNA, 12 bp, Homo sapiens
gccccagccaga

SEQ ID NO: 1783423 - DNA, 19 bp, Homo sapiens
gccccagccagagttcctg

SEQ ID NO: 1783424 - DNA, 21 bp, Homo sapiens
gccccagccccgttccttccg

SEQ ID NO: 1783425 - DNA, 17 bp, Homo sapiens
gccccagccctgctggg

SEQ ID NO: 1783426 - DNA, 20 bp, Homo sapiens
gccccagccctgctggggat

SEQ ID NO: 1783427 - DNA, 18 bp, Homo sapiens
gccccagcctccctgaag

SEQ ID NO: 1783428 - DNA, 20 bp, Homo sapiens
gccccagctctggatgaagg

SEQ ID NO: 1783429 - DNA, 11 bp, Homo sapiens
gccccagctga

SEQ ID NO: 1783430 - DNA, 17 bp, Homo sapiens
gccccagctgacatgga

SEQ ID NO: 1783431 - DNA, 14 bp, Homo sapiens
gccccagcttcctg

SEQ ID NO: 1783432 - DNA, 15 bp, Homo sapiens
gccccagcttcctgt

SEQ ID NO: 1783433 - DNA, 15 bp, Homo sapiens
gccccagcttggctc

SEQ ID NO: 1783434 - DNA, 18 bp, Homo sapiens
gccccaggaccagctcag

SEQ ID NO: 1783435 - DNA, 19 bp, Homo sapiens
gccccaggatcactctctg

SEQ ID NO: 1783436 - DNA, 20 bp, Homo sapiens
gccccaggccctactaccca

SEQ ID NO: 1783437 - DNA, 18 bp, Homo sapiens
gccccaggccggagccca

SEQ ID NO: 1783438 - DNA, 21 bp, Homo sapiens
gccccaggccggagcccagat

SEQ ID NO: 1783439 - DNA, 12 bp, Homo sapiens
gccccaggcctg

SEQ ID NO: 1783440 - DNA, 11 bp, Homo sapiens
gccccaggctc

SEQ ID NO: 1783441 - DNA, 19 bp, Homo sapiens
gccccaggctcgtggactg

SEQ ID NO: 1783442 - DNA, 18 bp, Homo sapiens
gccccaggctgagagcca

SEQ ID NO: 1783443 - DNA, 23 bp, Homo sapiens
gccccaggcttgtcactagcagc

SEQ ID NO: 1783444 - DNA, 15 bp, Homo sapiens
gccccagggcctggg

SEQ ID NO: 1783445 - DNA, 13 bp, Homo sapiens
gccccaggggcag

SEQ ID NO: 1783446 - DNA, 15 bp, Homo sapiens
gccccaggggcagca

SEQ ID NO: 1783447 - DNA, 17 bp, Homo sapiens
gccccaggggcagcaag

SEQ ID NO: 1783448 - DNA, 20 bp, Homo sapiens
gccccaggggcagcaaggcc

SEQ ID NO: 1783449 - DNA, 16 bp, Homo sapiens
gccccagggtcttccc

SEQ ID NO: 1783450 - DNA, 17 bp, Homo sapiens
gccccagggtcttccct

SEQ ID NO: 1783451 - DNA, 20 bp, Homo sapiens
gccccagggtcttccctacc

SEQ ID NO: 1783452 - DNA, 23 bp, Homo sapiens
gccccagggtcttccctacctca

SEQ ID NO: 1783453 - DNA, 20 bp, Homo sapiens
gccccagtcggccccatctc

SEQ ID NO: 1783454 - DNA, 23 bp, Homo sapiens
gccccagtgcctagatgcatggc

SEQ ID NO: 1783455 - DNA, 12 bp, Homo sapiens
gccccagtgctg

SEQ ID NO: 1783456 - DNA, 22 bp, Homo sapiens
gccccagttcctgtggctccct

SEQ ID NO: 1783457 - DNA, 15 bp, Homo sapiens
gccccatcagctcca

SEQ ID NO: 1783458 - DNA, 17 bp, Homo sapiens
gccccatcagctccagc

SEQ ID NO: 1783459 - DNA, 21 bp, Homo sapiens
gccccatcattgcacctgcag

SEQ ID NO: 1783460 - DNA, 20 bp, Homo sapiens
gccccatccagacctggctc

SEQ ID NO: 1783461 - DNA, 18 bp, Homo sapiens
gccccatcctcatccctg

SEQ ID NO: 1783462 - DNA, 20 bp, Homo sapiens
gccccatcctcatccctgac

SEQ ID NO: 1783463 - DNA, 16 bp, Homo sapiens
gccccatctggatgta

SEQ ID NO: 1783464 - DNA, 16 bp, Homo sapiens
gccccatgcctgtcca

SEQ ID NO: 1783465 - DNA, 20 bp, Homo sapiens
gccccatgcctgtccagcct

SEQ ID NO: 1783466 - DNA, 14 bp, Homo sapiens
gccccatgctctgc

SEQ ID NO: 1783467 - DNA, 17 bp, Homo sapiens
gccccatgctctgcccc

SEQ ID NO: 1783468 - DNA, 18 bp, Homo sapiens
gccccatgctctgcccca

SEQ ID NO: 1783469 - DNA, 17 bp, Homo sapiens
gccccatggtgggtagg

SEQ ID NO: 1783470 - DNA, 18 bp, Homo sapiens
gccccatgtctctcagaa

SEQ ID NO: 1783471 - DNA, 20 bp, Homo sapiens
gcccccaaagatagacaggt

SEQ ID NO: 1783472 - DNA, 20 bp, Homo sapiens
gcccccaaccccgcggtgct

SEQ ID NO: 1783473 - DNA, 20 bp, Homo sapiens
gcccccaataaaggcagctg

SEQ ID NO: 1783474 - DNA, 23 bp, Homo sapiens
gcccccacagaaagactgagctc

SEQ ID NO: 1783475 - DNA, 13 bp, Homo sapiens
gcccccacaggcc

SEQ ID NO: 1783476 - DNA, 17 bp, Homo sapiens
gcccccaccccggggac

SEQ ID NO: 1783477 - DNA, 13 bp, Homo sapiens
gcccccaccccta

SEQ ID NO: 1783478 - DNA, 16 bp, Homo sapiens
gcccccacccctacag

SEQ ID NO: 1783479 - DNA, 12 bp, Homo sapiens
gcccccactgac

SEQ ID NO: 1783480 - DNA, 16 bp, Homo sapiens
gcccccagcccagagc

SEQ ID NO: 1783481 - DNA, 22 bp, Homo sapiens
gcccccagcccagggctcctgc

SEQ ID NO: 1783482 - DNA, 21 bp, Homo sapiens
gcccccagccccggggtgagt

SEQ ID NO: 1783483 - DNA, 16 bp, Homo sapiens
gcccccagccctggga

SEQ ID NO: 1783484 - DNA, 23 bp, Homo sapiens
gcccccagctaagaacctggaac

SEQ ID NO: 1783485 - DNA, 12 bp, Homo sapiens
gcccccaggact

SEQ ID NO: 1783486 - DNA, 16 bp, Homo sapiens
gcccccaggactgggc

SEQ ID NO: 1783487 - DNA, 17 bp, Homo sapiens
gcccccaggactgggcc

SEQ ID NO: 1783488 - DNA, 18 bp, Homo sapiens
gcccccaggactgggcca

SEQ ID NO: 1783489 - DNA, 19 bp, Homo sapiens
gcccccagggcctccaggg

SEQ ID NO: 1783490 - DNA, 17 bp, Homo sapiens
gcccccagtccccaccc

SEQ ID NO: 1783491 - DNA, 18 bp, Homo sapiens
gcccccagtccccacccc

SEQ ID NO: 1783492 - DNA, 20 bp, Homo sapiens
gcccccagtccccacccctg

SEQ ID NO: 1783493 - DNA, 23 bp, Homo sapiens
gcccccagtgtgcacgagtggga

SEQ ID NO: 1783494 - DNA, 21 bp, Homo sapiens
gcccccatccctcggacccac

SEQ ID NO: 1783495 - DNA, 16 bp, Homo sapiens
gcccccatctccccag

SEQ ID NO: 1783496 - DNA, 21 bp, Homo sapiens
gcccccatctccccaggcctc

SEQ ID NO: 1783497 - DNA, 23 bp, Homo sapiens
gcccccatctccccaggcctcca

SEQ ID NO: 1783498 - DNA, 18 bp, Homo sapiens
gcccccatggggtccttg

SEQ ID NO: 1783499 - DNA, 17 bp, Homo sapiens
gcccccatttcacccat

SEQ ID NO: 1783500 - DNA, 21 bp, Homo sapiens
gccccccaaggttctggttcc

SEQ ID NO: 1783501 - DNA, 19 bp, Homo sapiens
gccccccagccccggtggc

SEQ ID NO: 1783502 - DNA, 16 bp, Homo sapiens
gccccccagcctctgg

SEQ ID NO: 1783503 - DNA, 17 bp, Homo sapiens
gcccccccaacactgtg

SEQ ID NO: 1783504 - DNA, 23 bp, Homo sapiens
gcccccccaacactgtgccctgg

SEQ ID NO: 1783505 - DNA, 23 bp, Homo sapiens
gcccccccttcccccttttttgt

SEQ ID NO: 1783506 - DNA, 22 bp, Homo sapiens
gccccccgcacagccacccgtg

SEQ ID NO: 1783507 - DNA, 14 bp, Homo sapiens
gccccccgcagcac

SEQ ID NO: 1783508 - DNA, 19 bp, Homo sapiens
gccccccgcagcaccctgc

SEQ ID NO: 1783509 - DNA, 20 bp, Homo sapiens
gccccccgcgcgcccaccct

SEQ ID NO: 1783510 - DNA, 19 bp, Homo sapiens
gccccccgcgctcgcccag

SEQ ID NO: 1783511 - DNA, 11 bp, Homo sapiens
gcccccctcct

SEQ ID NO: 1783512 - DNA, 16 bp, Homo sapiens
gcccccctcctccagt

SEQ ID NO: 1783513 - DNA, 15 bp, Homo sapiens
gcccccgccccacag

SEQ ID NO: 1783514 - DNA, 16 bp, Homo sapiens
gcccccgcctgccacc

SEQ ID NO: 1783515 - DNA, 22 bp, Homo sapiens
gcccccgcgggttctagacgcc

SEQ ID NO: 1783516 - DNA, 15 bp, Homo sapiens
gcccccggcggcgcc

SEQ ID NO: 1783517 - DNA, 20 bp, Homo sapiens
gcccccgggccgctggctgg

SEQ ID NO: 1783518 - DNA, 15 bp, Homo sapiens
gcccccgtcagggag

SEQ ID NO: 1783519 - DNA, 15 bp, Homo sapiens
gcccccgttccagct

SEQ ID NO: 1783520 - DNA, 19 bp, Homo sapiens
gccccctccagctcatgac

SEQ ID NO: 1783521 - DNA, 20 bp, Homo sapiens
gccccctcccccatgggctg

SEQ ID NO: 1783522 - DNA, 18 bp, Homo sapiens
gccccctcccttcctgcc

SEQ ID NO: 1783523 - DNA, 20 bp, Homo sapiens
gccccctccgccctgccact

SEQ ID NO: 1783524 - DNA, 13 bp, Homo sapiens
gccccctcctccc

SEQ ID NO: 1783525 - DNA, 16 bp, Homo sapiens
gccccctcctctagct

SEQ ID NO: 1783526 - DNA, 19 bp, Homo sapiens
gccccctcctctagctgtg

SEQ ID NO: 1783527 - DNA, 13 bp, Homo sapiens
gccccctcctgaa

SEQ ID NO: 1783528 - DNA, 15 bp, Homo sapiens
gccccctcctgaacc

SEQ ID NO: 1783529 - DNA, 21 bp, Homo sapiens
gccccctcctgaaccgcacag

SEQ ID NO: 1783530 - DNA, 18 bp, Homo sapiens
gccccctcgggggcctgt

SEQ ID NO: 1783531 - DNA, 12 bp, Homo sapiens
gccccctgcacc

SEQ ID NO: 1783532 - DNA, 20 bp, Homo sapiens
gccccctgcacccacccctg

SEQ ID NO: 1783533 - DNA, 13 bp, Homo sapiens
gccccctgcatct

SEQ ID NO: 1783534 - DNA, 13 bp, Homo sapiens
gccccctgccccc

SEQ ID NO: 1783535 - DNA, 14 bp, Homo sapiens
gccccctgcccccc

SEQ ID NO: 1783536 - DNA, 18 bp, Homo sapiens
gccccctgccccccagcc

SEQ ID NO: 1783537 - DNA, 15 bp, Homo sapiens
gccccctgctgccat

SEQ ID NO: 1783538 - DNA, 20 bp, Homo sapiens
gccccctgcttacttggtga

SEQ ID NO: 1783539 - DNA, 21 bp, Homo sapiens
gccccctggatgtcccctgtc

SEQ ID NO: 1783540 - DNA, 15 bp, Homo sapiens
gccccctggcctctg

SEQ ID NO: 1783541 - DNA, 19 bp, Homo sapiens
gcccccttgccctccgcct

SEQ ID NO: 1783542 - DNA, 16 bp, Homo sapiens
gccccctttcagatgt

SEQ ID NO: 1783543 - DNA, 23 bp, Homo sapiens
gccccgagacaccatcctgagcc

SEQ ID NO: 1783544 - DNA, 17 bp, Homo sapiens
gccccgatggactcctg

SEQ ID NO: 1783545 - DNA, 18 bp, Homo sapiens
gccccgatggactcctga

SEQ ID NO: 1783546 - DNA, 20 bp, Homo sapiens
gccccgatggactcctgacc

SEQ ID NO: 1783547 - DNA, 21 bp, Homo sapiens
gccccgatggactcctgacca

SEQ ID NO: 1783548 - DNA, 15 bp, Homo sapiens
gccccgccagggctg

SEQ ID NO: 1783549 - DNA, 19 bp, Homo sapiens
gccccgccagggctgggga

SEQ ID NO: 1783550 - DNA, 15 bp, Homo sapiens
gccccgcccccaccc

SEQ ID NO: 1783551 - DNA, 15 bp, Homo sapiens
gccccgcctgagtca

SEQ ID NO: 1783552 - DNA, 17 bp, Homo sapiens
gccccgcgcctccttcc

SEQ ID NO: 1783553 - DNA, 14 bp, Homo sapiens
gccccgctcccacc

SEQ ID NO: 1783554 - DNA, 15 bp, Homo sapiens
gccccgctcccacct

SEQ ID NO: 1783555 - DNA, 15 bp, Homo sapiens
gccccgcttccccac

SEQ ID NO: 1783556 - DNA, 18 bp, Homo sapiens
gccccgcttccccacaga

SEQ ID NO: 1783557 - DNA, 21 bp, Homo sapiens
gccccgcttccccacagaact

SEQ ID NO: 1783558 - DNA, 14 bp, Homo sapiens
gccccgcttgtcca

SEQ ID NO: 1783559 - DNA, 16 bp, Homo sapiens
gccccgcttgtccagc

SEQ ID NO: 1783560 - DNA, 19 bp, Homo sapiens
gccccgcttgtccagcgcc

SEQ ID NO: 1783561 - DNA, 20 bp, Homo sapiens
gccccgcttgtccagcgcct

SEQ ID NO: 1783562 - DNA, 18 bp, Homo sapiens
gccccggcaactctggct

SEQ ID NO: 1783563 - DNA, 17 bp, Homo sapiens
gccccggccccagccag

SEQ ID NO: 1783564 - DNA, 18 bp, Homo sapiens
gccccggccccagccaga

SEQ ID NO: 1783565 - DNA, 22 bp, Homo sapiens
gccccgggatattatagaaaat

SEQ ID NO: 1783566 - DNA, 16 bp, Homo sapiens
gccccgggctggagaa

SEQ ID NO: 1783567 - DNA, 15 bp, Homo sapiens
gccccgggcttccct

SEQ ID NO: 1783568 - DNA, 16 bp, Homo sapiens
gccccgggcttccctt

SEQ ID NO: 1783569 - DNA, 16 bp, Homo sapiens
gccccggggctggcaa

SEQ ID NO: 1783570 - DNA, 23 bp, Homo sapiens
gccccggggctggcaagcaggga

SEQ ID NO: 1783571 - DNA, 23 bp, Homo sapiens
gccccgggtccccagctccccag

SEQ ID NO: 1783572 - DNA, 19 bp, Homo sapiens
gccccggtggctgggcaga

SEQ ID NO: 1783573 - DNA, 18 bp, Homo sapiens
gccccgtgtctggatgca

SEQ ID NO: 1783574 - DNA, 13 bp, Homo sapiens
gccccgttccctg

SEQ ID NO: 1783575 - DNA, 15 bp, Homo sapiens
gccccgttccctgtc

SEQ ID NO: 1783576 - DNA, 18 bp, Homo sapiens
gccccgttgtgagctgga

SEQ ID NO: 1783577 - DNA, 21 bp, Homo sapiens
gccccgttgtgagctggatag

SEQ ID NO: 1783578 - DNA, 19 bp, Homo sapiens
gcccctacgggcgctgcag

SEQ ID NO: 1783579 - DNA, 20 bp, Homo sapiens
gcccctaggatgctgcagca

SEQ ID NO: 1783580 - DNA, 16 bp, Homo sapiens
gcccctagggtccctc

SEQ ID NO: 1783581 - DNA, 17 bp, Homo sapiens
gcccctaggtgcccagg

SEQ ID NO: 1783582 - DNA, 19 bp, Homo sapiens
gcccctaggtgcccagggc

SEQ ID NO: 1783583 - DNA, 21 bp, Homo sapiens
gcccctaggtgcccagggcca

SEQ ID NO: 1783584 - DNA, 14 bp, Homo sapiens
gcccctcaaaggga

SEQ ID NO: 1783585 - DNA, 21 bp, Homo sapiens
gcccctcaaagggagagaaaa

SEQ ID NO: 1783586 - DNA, 16 bp, Homo sapiens
gcccctcactcctgcg

SEQ ID NO: 1783587 - DNA, 16 bp, Homo sapiens
gcccctcagcccttgc

SEQ ID NO: 1783588 - DNA, 21 bp, Homo sapiens
gcccctcagcccttgccccca

SEQ ID NO: 1783589 - DNA, 19 bp, Homo sapiens
gcccctccaaacctccagc

SEQ ID NO: 1783590 - DNA, 17 bp, Homo sapiens
gcccctccagaccctgc

SEQ ID NO: 1783591 - DNA, 12 bp, Homo sapiens
gcccctccagca

SEQ ID NO: 1783592 - DNA, 15 bp, Homo sapiens
gcccctccagcacac

SEQ ID NO: 1783593 - DNA, 16 bp, Homo sapiens
gcccctccatccaccc

SEQ ID NO: 1783594 - DNA, 21 bp, Homo sapiens
gcccctcccaagcgttcctgg

SEQ ID NO: 1783595 - DNA, 15 bp, Homo sapiens
gcccctcccacacac

SEQ ID NO: 1783596 - DNA, 22 bp, Homo sapiens
gcccctcccacacccaaagctg

SEQ ID NO: 1783597 - DNA, 12 bp, Homo sapiens
gcccctccccca

SEQ ID NO: 1783598 - DNA, 16 bp, Homo sapiens
gcccctcccctccccg

SEQ ID NO: 1783599 - DNA, 19 bp, Homo sapiens
gcccctccctctgccccaa

SEQ ID NO: 1783600 - DNA, 14 bp, Homo sapiens
gcccctcccttcaa

SEQ ID NO: 1783601 - DNA, 15 bp, Homo sapiens
gcccctcccttcaac

SEQ ID NO: 1783602 - DNA, 18 bp, Homo sapiens
gcccctcctagacccagg

SEQ ID NO: 1783603 - DNA, 13 bp, Homo sapiens
gcccctcctccag

SEQ ID NO: 1783604 - DNA, 20 bp, Homo sapiens
gcccctcctccagcccctgt

SEQ ID NO: 1783605 - DNA, 17 bp, Homo sapiens
gcccctcctcccccggc

SEQ ID NO: 1783606 - DNA, 23 bp, Homo sapiens
gcccctcctctgccacctcccct

SEQ ID NO: 1783607 - DNA, 13 bp, Homo sapiens
gcccctccttctc

SEQ ID NO: 1783608 - DNA, 17 bp, Homo sapiens
gcccctcgaccctgtgc

SEQ ID NO: 1783609 - DNA, 19 bp, Homo sapiens
gcccctcgaccctgtgcag

SEQ ID NO: 1783610 - DNA, 16 bp, Homo sapiens
gcccctcgctgctgct

SEQ ID NO: 1783611 - DNA, 17 bp, Homo sapiens
gcccctcgctgctgcta

SEQ ID NO: 1783612 - DNA, 19 bp, Homo sapiens
gcccctcggctctggaggc

SEQ ID NO: 1783613 - DNA, 19 bp, Homo sapiens
gcccctctgcccagcttgg

SEQ ID NO: 1783614 - DNA, 13 bp, Homo sapiens
gcccctctgctgt

SEQ ID NO: 1783615 - DNA, 14 bp, Homo sapiens
gcccctctgctgtc

SEQ ID NO: 1783616 - DNA, 14 bp, Homo sapiens
gcccctctggtcgc

SEQ ID NO: 1783617 - DNA, 22 bp, Homo sapiens
gcccctgagcaatgtctgtgct

SEQ ID NO: 1783618 - DNA, 16 bp, Homo sapiens
gcccctgaggactgga

SEQ ID NO: 1783619 - DNA, 19 bp, Homo sapiens
gcccctgaggactggagac

SEQ ID NO: 1783620 - DNA, 15 bp, Homo sapiens
gcccctgcacaggca

SEQ ID NO: 1783621 - DNA, 19 bp, Homo sapiens
gcccctgcagtttggccct

SEQ ID NO: 1783622 - DNA, 21 bp, Homo sapiens
gcccctgcagtttggccctgg

SEQ ID NO: 1783623 - DNA, 13 bp, Homo sapiens
gcccctgccccta

SEQ ID NO: 1783624 - DNA, 14 bp, Homo sapiens
gcccctgcccctca

SEQ ID NO: 1783625 - DNA, 19 bp, Homo sapiens
gcccctgcccctcatgcca

SEQ ID NO: 1783626 - DNA, 18 bp, Homo sapiens
gcccctgctgtctctctg

SEQ ID NO: 1783627 - DNA, 20 bp, Homo sapiens
gcccctgctgtctctctggg

SEQ ID NO: 1783628 - DNA, 21 bp, Homo sapiens
gcccctgctgtctctctgggc

SEQ ID NO: 1783629 - DNA, 13 bp, Homo sapiens
gcccctggagcca

SEQ ID NO: 1783630 - DNA, 13 bp, Homo sapiens
gcccctggcccag

SEQ ID NO: 1783631 - DNA, 18 bp, Homo sapiens
gcccctggcccagcggcc

SEQ ID NO: 1783632 - DNA, 22 bp, Homo sapiens
gcccctggcccagcggcccctc

SEQ ID NO: 1783633 - DNA, 11 bp, Homo sapiens
gcccctggctt

SEQ ID NO: 1783634 - DNA, 13 bp, Homo sapiens
gcccctggctttg

SEQ ID NO: 1783635 - DNA, 20 bp, Homo sapiens
gcccctggctttgcctcttc

SEQ ID NO: 1783636 - DNA, 22 bp, Homo sapiens
gcccctggctttgcctcttctt

SEQ ID NO: 1783637 - DNA, 15 bp, Homo sapiens
gcccctgggctacca

SEQ ID NO: 1783638 - DNA, 21 bp, Homo sapiens
gcccctgggctaccatctgca

SEQ ID NO: 1783639 - DNA, 22 bp, Homo sapiens
gcccctgggctaccatctgcat

SEQ ID NO: 1783640 - DNA, 13 bp, Homo sapiens
gcccctgggctct

SEQ ID NO: 1783641 - DNA, 17 bp, Homo sapiens
gcccctgggctctcacc

SEQ ID NO: 1783642 - DNA, 12 bp, Homo sapiens
gcccctgggctt

SEQ ID NO: 1783643 - DNA, 18 bp, Homo sapiens
gcccctgggcttggcctg

SEQ ID NO: 1783644 - DNA, 19 bp, Homo sapiens
gcccctgggcttggcctgc

SEQ ID NO: 1783645 - DNA, 12 bp, Homo sapiens
gcccctggggaa

SEQ ID NO: 1783646 - DNA, 13 bp, Homo sapiens
gcccctggggctg

SEQ ID NO: 1783647 - DNA, 15 bp, Homo sapiens
gcccctggggctgta

SEQ ID NO: 1783648 - DNA, 19 bp, Homo sapiens
gcccctgggtccttctagc

SEQ ID NO: 1783649 - DNA, 21 bp, Homo sapiens
gcccctgggtgggtggtgggg

SEQ ID NO: 1783650 - DNA, 11 bp, Homo sapiens
gcccctgtggc

SEQ ID NO: 1783651 - DNA, 17 bp, Homo sapiens
gcccctgtggccaactg

SEQ ID NO: 1783652 - DNA, 17 bp, Homo sapiens
gcccctgtggccctggc

SEQ ID NO: 1783653 - DNA, 18 bp, Homo sapiens
gcccctgtgtgagttgag

SEQ ID NO: 1783654 - DNA, 24 bp, Homo sapiens
gcccctgtgtgagttgagtctcct

SEQ ID NO: 1783655 - DNA, 21 bp, Homo sapiens
gccccttaaacacaggctgtc

SEQ ID NO: 1783656 - DNA, 19 bp, Homo sapiens
gccccttaaccccaaggac

SEQ ID NO: 1783657 - DNA, 12 bp, Homo sapiens
gccccttccctg

SEQ ID NO: 1783658 - DNA, 13 bp, Homo sapiens
gccccttctggcc

SEQ ID NO: 1783659 - DNA, 14 bp, Homo sapiens
gccccttctggccg

SEQ ID NO: 1783660 - DNA, 18 bp, Homo sapiens
gccccttctggccggtgc

SEQ ID NO: 1783661 - DNA, 22 bp, Homo sapiens
gccccttctggccggtgctggg

SEQ ID NO: 1783662 - DNA, 23 bp, Homo sapiens
gccccttctggccggtgctgggt

SEQ ID NO: 1783663 - DNA, 19 bp, Homo sapiens
gccccttggattcctgcac

SEQ ID NO: 1783664 - DNA, 24 bp, Homo sapiens
gccccttttcgccccctgcctgcc

SEQ ID NO: 1783665 - DNA, 16 bp, Homo sapiens
gccccttttctttggg

SEQ ID NO: 1783666 - DNA, 12 bp, Homo sapiens
gcccgaagctct

SEQ ID NO: 1783667 - DNA, 14 bp, Homo sapiens
gcccgacagcctgg

SEQ ID NO: 1783668 - DNA, 23 bp, Homo sapiens
gcccgacagtgccatccccacct

SEQ ID NO: 1783669 - DNA, 23 bp, Homo sapiens
gcccgacttgctgttttgttctg

SEQ ID NO: 1783670 - DNA, 15 bp, Homo sapiens
gcccgaggcaccagt

SEQ ID NO: 1783671 - DNA, 15 bp, Homo sapiens
gcccgcaccccggcc

SEQ ID NO: 1783672 - DNA, 18 bp, Homo sapiens
gcccgcaccccggcctca

SEQ ID NO: 1783673 - DNA, 22 bp, Homo sapiens
gcccgcaccccggcctcagggc

SEQ ID NO: 1783674 - DNA, 13 bp, Homo sapiens
gcccgcagggcca

SEQ ID NO: 1783675 - DNA, 17 bp, Homo sapiens
gcccgcagtgctgggac

SEQ ID NO: 1783676 - DNA, 18 bp, Homo sapiens
gcccgcagtgctgggacc

SEQ ID NO: 1783677 - DNA, 17 bp, Homo sapiens
gcccgcatgcggcccag

SEQ ID NO: 1783678 - DNA, 14 bp, Homo sapiens
gcccgccagcctca

SEQ ID NO: 1783679 - DNA, 15 bp, Homo sapiens
gcccgccagcctcag

SEQ ID NO: 1783680 - DNA, 16 bp, Homo sapiens
gcccgccagcctcagt

SEQ ID NO: 1783681 - DNA, 17 bp, Homo sapiens
gcccgccagcctcagtg

SEQ ID NO: 1783682 - DNA, 18 bp, Homo sapiens
gcccgccagcctcagtgc

SEQ ID NO: 1783683 - DNA, 20 bp, Homo sapiens
gcccgccagcctcagtgcca

SEQ ID NO: 1783684 - DNA, 13 bp, Homo sapiens
gcccgcccactgt

SEQ ID NO: 1783685 - DNA, 17 bp, Homo sapiens
gcccgcccactgtcctg

SEQ ID NO: 1783686 - DNA, 12 bp, Homo sapiens
gcccgcctgccg

SEQ ID NO: 1783687 - DNA, 19 bp, Homo sapiens
gcccgctcccaacccccct

SEQ ID NO: 1783688 - DNA, 17 bp, Homo sapiens
gcccgctcctgccgcag

SEQ ID NO: 1783689 - DNA, 19 bp, Homo sapiens
gcccgctcctgccgcagac

SEQ ID NO: 1783690 - DNA, 15 bp, Homo sapiens
gcccgctgagtgggg

SEQ ID NO: 1783691 - DNA, 13 bp, Homo sapiens
gcccgctgggctg

SEQ ID NO: 1783692 - DNA, 19 bp, Homo sapiens
gcccggagattggacggcc

SEQ ID NO: 1783693 - DNA, 21 bp, Homo sapiens
gcccggagattggacggcctg

SEQ ID NO: 1783694 - DNA, 22 bp, Homo sapiens
gcccggagattggacggcctga

SEQ ID NO: 1783695 - DNA, 15 bp, Homo sapiens
gcccggattctggga

SEQ ID NO: 1783696 - DNA, 16 bp, Homo sapiens
gcccggcagccccttc

SEQ ID NO: 1783697 - DNA, 13 bp, Homo sapiens
gcccggccagcgg

SEQ ID NO: 1783698 - DNA, 22 bp, Homo sapiens
gcccggcctgctcccagcagcc

SEQ ID NO: 1783699 - DNA, 19 bp, Homo sapiens
gccctgattgtgccagtgc

SEQ ID NO: 1783700 - DNA, 12 bp, Homo sapiens
gccctgcacaga

SEQ ID NO: 1783701 - DNA, 21 bp, Homo sapiens
gccctgcaccatgctgctggg

SEQ ID NO: 1783702 - DNA, 11 bp, Homo sapiens
gccctgcagca

SEQ ID NO: 1783703 - DNA, 14 bp, Homo sapiens
gccctgcagccagc

SEQ ID NO: 1783704 - DNA, 17 bp, Homo sapiens
gccctgcatgctgccca

SEQ ID NO: 1783705 - DNA, 23 bp, Homo sapiens
gccctgcatgctgcccagccact

SEQ ID NO: 1783706 - DNA, 16 bp, Homo sapiens
gccctgcattggcctg

SEQ ID NO: 1783707 - DNA, 20 bp, Homo sapiens
gccctgcattggcctggcct

SEQ ID NO: 1783708 - DNA, 11 bp, Homo sapiens
gccctgccact

SEQ ID NO: 1783709 - DNA, 19 bp, Homo sapiens
gccctgccatcttcccagc

SEQ ID NO: 1783710 - DNA, 11 bp, Homo sapiens
gccctgcccca

SEQ ID NO: 1783711 - DNA, 14 bp, Homo sapiens
gccctgccccaccc

SEQ ID NO: 1783712 - DNA, 22 bp, Homo sapiens
gccctgccccctcgggggcctg

SEQ ID NO: 1783713 - DNA, 15 bp, Homo sapiens
gccctgccctagctc

SEQ ID NO: 1783714 - DNA, 18 bp, Homo sapiens
gccctgccctcccaagtc

SEQ ID NO: 1783715 - DNA, 22 bp, Homo sapiens
gccctgcctccaccgagccagc

SEQ ID NO: 1783716 - DNA, 13 bp, Homo sapiens
gccctgcctctgt

SEQ ID NO: 1783717 - DNA, 14 bp, Homo sapiens
gccctgcctctgtg

SEQ ID NO: 1783718 - DNA, 13 bp, Homo sapiens
gccctgcctgagg

SEQ ID NO: 1783719 - DNA, 18 bp, Homo sapiens
gccctgcctgaggaggag

SEQ ID NO: 1783720 - DNA, 19 bp, Homo sapiens
gccctgcctgaggaggagg

SEQ ID NO: 1783721 - DNA, 22 bp, Homo sapiens
gccctgcctgagggcccctctg

SEQ ID NO: 1783722 - DNA, 23 bp, Homo sapiens
gccctgcctgagggcccctctgc

SEQ ID NO: 1783723 - DNA, 17 bp, Homo sapiens
gccctgcctgcccactt

SEQ ID NO: 1783724 - DNA, 18 bp, Homo sapiens
gccctgcggagccggcac

SEQ ID NO: 1783725 - DNA, 20 bp, Homo sapiens
gccctgcggagccggcacct

SEQ ID NO: 1783726 - DNA, 18 bp, Homo sapiens
gccctgcgttggagccac

SEQ ID NO: 1783727 - DNA, 10 bp, Homo sapiens
gccctgctac

SEQ ID NO: 1783728 - DNA, 15 bp, Homo sapiens
gccctgctcctccct

SEQ ID NO: 1783729 - DNA, 16 bp, Homo sapiens
gccctgctcctccctg

SEQ ID NO: 1783730 - DNA, 23 bp, Homo sapiens
gccctgctcctccctggctgccc

SEQ ID NO: 1783731 - DNA, 19 bp, Homo sapiens
gccctgctgagtcatctgt

SEQ ID NO: 1783732 - DNA, 14 bp, Homo sapiens
gccctgctgtggga

SEQ ID NO: 1783733 - DNA, 12 bp, Homo sapiens
gccctgctgttt

SEQ ID NO: 1783734 - DNA, 19 bp, Homo sapiens
gccctgcttcctgcttgcc

SEQ ID NO: 1783735 - DNA, 11 bp, Homo sapiens
gccctgctttt

SEQ ID NO: 1783736 - DNA, 16 bp, Homo sapiens
gccctgctttttttct

SEQ ID NO: 1783737 - DNA, 20 bp, Homo sapiens
gccctggaagccggcggccc

SEQ ID NO: 1783738 - DNA, 15 bp, Homo sapiens
gccctggagagcccc

SEQ ID NO: 1783739 - DNA, 17 bp, Homo sapiens
gccctggagagccccat

SEQ ID NO: 1783740 - DNA, 23 bp, Homo sapiens
gccctggattggttggcaaacta

SEQ ID NO: 1783741 - DNA, 18 bp, Homo sapiens
gccctggatttcagaaag

SEQ ID NO: 1783742 - DNA, 15 bp, Homo sapiens
gccctggcagggggc

SEQ ID NO: 1783743 - DNA, 21 bp, Homo sapiens
gccctggcagggtcatcctgt

SEQ ID NO: 1783744 - DNA, 14 bp, Homo sapiens
gccctggccaggac

SEQ ID NO: 1783745 - DNA, 17 bp, Homo sapiens
gccctggccctgaggtg

SEQ ID NO: 1783746 - DNA, 14 bp, Homo sapiens
gccctggccctgcc

SEQ ID NO: 1783747 - DNA, 20 bp, Homo sapiens
gccctggccctgcccagccc

SEQ ID NO: 1783748 - DNA, 21 bp, Homo sapiens
gccctggccctgcccagccca

SEQ ID NO: 1783749 - DNA, 12 bp, Homo sapiens
gccctggcctcc

SEQ ID NO: 1783750 - DNA, 20 bp, Homo sapiens
gccctggcctcccctgccac

SEQ ID NO: 1783751 - DNA, 15 bp, Homo sapiens
gccctggctcccaca

SEQ ID NO: 1783752 - DNA, 10 bp, Homo sapiens
gccctggctg

SEQ ID NO: 1783753 - DNA, 12 bp, Homo sapiens
gccctggctgct

SEQ ID NO: 1783754 - DNA, 18 bp, Homo sapiens
gccctgggaaccactccc

SEQ ID NO: 1783755 - DNA, 21 bp, Homo sapiens
gccctgggaaccactcccacc

SEQ ID NO: 1783756 - DNA, 16 bp, Homo sapiens
gccctgggagggggct

SEQ ID NO: 1783757 - DNA, 20 bp, Homo sapiens
gccctgggcacccacctcca

SEQ ID NO: 1783758 - DNA, 22 bp, Homo sapiens
gccctgggcacccacctccacc

SEQ ID NO: 1783759 - DNA, 19 bp, Homo sapiens
gccctgggccccaccacct

SEQ ID NO: 1783760 - DNA, 14 bp, Homo sapiens
gccctgggcgagcc

SEQ ID NO: 1783761 - DNA, 14 bp, Homo sapiens
gccctgggctggaa

SEQ ID NO: 1783762 - DNA, 23 bp, Homo sapiens
gccctggggatcttcccacagga

SEQ ID NO: 1783763 - DNA, 18 bp, Homo sapiens
gccctgggtaccctgagc

SEQ ID NO: 1783764 - DNA, 21 bp, Homo sapiens
gccctgggtctaaggggttgg

SEQ ID NO: 1783765 - DNA, 14 bp, Homo sapiens
gccctggtccaggg

SEQ ID NO: 1783766 - DNA, 16 bp, Homo sapiens
gccctggtccagggaa

SEQ ID NO: 1783767 - DNA, 17 bp, Homo sapiens
gccctggtcctggcctc

SEQ ID NO: 1783768 - DNA, 18 bp, Homo sapiens
gccctggtcctggcctcc

SEQ ID NO: 1783769 - DNA, 19 bp, Homo sapiens
gccctggtcctggcctcct

SEQ ID NO: 1783770 - DNA, 21 bp, Homo sapiens
gccctggtgctgccacacttc

SEQ ID NO: 1783771 - DNA, 16 bp, Homo sapiens
gccctggtgtgtttcc

SEQ ID NO: 1783772 - DNA, 14 bp, Homo sapiens
gccctggttagctg

SEQ ID NO: 1783773 - DNA, 23 bp, Homo sapiens
gccctggttcctgctgtcctggt

SEQ ID NO: 1783774 - DNA, 16 bp, Homo sapiens
gccctgtcgagacact

SEQ ID NO: 1783775 - DNA, 17 bp, Homo sapiens
gccctgtcgagacactt

SEQ ID NO: 1783776 - DNA, 13 bp, Homo sapiens
gccctgtgcctgg

SEQ ID NO: 1783777 - DNA, 17 bp, Homo sapiens
gccctgtgcctgggccc

SEQ ID NO: 1783778 - DNA, 17 bp, Homo sapiens
gccctgtggagtccagc

SEQ ID NO: 1783779 - DNA, 18 bp, Homo sapiens
gccctgtggagtccagct

SEQ ID NO: 1783780 - DNA, 19 bp, Homo sapiens
gccctgtggagtccagctc

SEQ ID NO: 1783781 - DNA, 20 bp, Homo sapiens
gccctgtggagtccagctct

SEQ ID NO: 1783782 - DNA, 14 bp, Homo sapiens
gccctgtggccgcc

SEQ ID NO: 1783783 - DNA, 13 bp, Homo sapiens
gccctgtgtactt

SEQ ID NO: 1783784 - DNA, 14 bp, Homo sapiens
gccctgtgtgcagg

SEQ ID NO: 1783785 - DNA, 15 bp, Homo sapiens
gccctgtgtgcaggt

SEQ ID NO: 1783786 - DNA, 14 bp, Homo sapiens
gccctgttaaaaga

SEQ ID NO: 1783787 - DNA, 13 bp, Homo sapiens
gccctgttccctg

SEQ ID NO: 1783788 - DNA, 14 bp, Homo sapiens
gccctgttccctgg

SEQ ID NO: 1783789 - DNA, 21 bp, Homo sapiens
gccctgttccctggagtcagg

SEQ ID NO: 1783790 - DNA, 20 bp, Homo sapiens
gccctgttgaattttgttct

SEQ ID NO: 1783791 - DNA, 22 bp, Homo sapiens
gcccttaagccaaactcaggcc

SEQ ID NO: 1783792 - DNA, 23 bp, Homo sapiens
gcccttaagccaaactcaggccc

SEQ ID NO: 1783793 - DNA, 23 bp, Homo sapiens
gcccttacagccctaagtggctg

SEQ ID NO: 1783794 - DNA, 15 bp, Homo sapiens
gcccttatggagctc

SEQ ID NO: 1783795 - DNA, 14 bp, Homo sapiens
gcccttcagattgt

SEQ ID NO: 1783796 - DNA, 14 bp, Homo sapiens
gcccttcagcccac

SEQ ID NO: 1783797 - DNA, 18 bp, Homo sapiens
gcccttcagtctgctcca

SEQ ID NO: 1783798 - DNA, 18 bp, Homo sapiens
gcccttccatgtgccttt

SEQ ID NO: 1783799 - DNA, 19 bp, Homo sapiens
gcccttccatgtgcctttc

SEQ ID NO: 1783800 - DNA, 22 bp, Homo sapiens
gcccttcccctcccccactcct

SEQ ID NO: 1783801 - DNA, 16 bp, Homo sapiens
gcccttccctgtccct

SEQ ID NO: 1783802 - DNA, 17 bp, Homo sapiens
gcccttccctgtccctc

SEQ ID NO: 1783803 - DNA, 17 bp, Homo sapiens
gcccttcctcctgatgg

SEQ ID NO: 1783804 - DNA, 14 bp, Homo sapiens
gcccttcctctcca

SEQ ID NO: 1783805 - DNA, 22 bp, Homo sapiens
gcccttcctctccactgccttc

SEQ ID NO: 1783806 - DNA, 17 bp, Homo sapiens
gcccttctcaagacttt

SEQ ID NO: 1783807 - DNA, 21 bp, Homo sapiens
gcccttctgattcccctccac

SEQ ID NO: 1783808 - DNA, 12 bp, Homo sapiens
gcccttctgcct

SEQ ID NO: 1783809 - DNA, 22 bp, Homo sapiens
gcccttgaaccccctccctgtc

SEQ ID NO: 1783810 - DNA, 20 bp, Homo sapiens
gcccttgcaatcttctactt

SEQ ID NO: 1783811 - DNA, 20 bp, Homo sapiens
gcccttgcagttcagcacca

SEQ ID NO: 1783812 - DNA, 13 bp, Homo sapiens
gcccttgccccca

SEQ ID NO: 1783813 - DNA, 20 bp, Homo sapiens
gcccttgcccccatccctcg

SEQ ID NO: 1783814 - DNA, 19 bp, Homo sapiens
gcccttgcccttggagctg

SEQ ID NO: 1783815 - DNA, 14 bp, Homo sapiens
gcccttgcctcccc

SEQ ID NO: 1783816 - DNA, 20 bp, Homo sapiens
gccgggaacagacaacagaa

SEQ ID NO: 1783817 - DNA, 22 bp, Homo sapiens
gccgggcacattgagctgtgca

SEQ ID NO: 1783818 - DNA, 17 bp, Homo sapiens
gccgggcatggtggcag

SEQ ID NO: 1783819 - DNA, 19 bp, Homo sapiens
gccgggcccctgggcttgg

SEQ ID NO: 1783820 - DNA, 24 bp, Homo sapiens
gccgggcctcccaccgcagcgtcc

SEQ ID NO: 1783821 - DNA, 16 bp, Homo sapiens
gccgggcctgggcctc

SEQ ID NO: 1783822 - DNA, 16 bp, Homo sapiens
gccgggcgcggtggct

SEQ ID NO: 1783823 - DNA, 16 bp, Homo sapiens
gccgggcggtcacagc

SEQ ID NO: 1783824 - DNA, 12 bp, Homo sapiens
gccgggctgctg

SEQ ID NO: 1783825 - DNA, 13 bp, Homo sapiens
gccgggctgtaga

SEQ ID NO: 1783826 - DNA, 20 bp, Homo sapiens
gccggggccacccaaatgtg

SEQ ID NO: 1783827 - DNA, 20 bp, Homo sapiens
gccggggtccaggcccgtgg

SEQ ID NO: 1783828 - DNA, 19 bp, Homo sapiens
gccggggtgtaacttcctg

SEQ ID NO: 1783829 - DNA, 22 bp, Homo sapiens
gccggtaactgtcctgtcctgc

SEQ ID NO: 1783830 - DNA, 15 bp, Homo sapiens
gccggtcccccatgc

SEQ ID NO: 1783831 - DNA, 17 bp, Homo sapiens
gccggtcccccatgcca

SEQ ID NO: 1783832 - DNA, 15 bp, Homo sapiens
gccggtcgggcagcc

SEQ ID NO: 1783833 - DNA, 17 bp, Homo sapiens
gccggtcgggcagccag

SEQ ID NO: 1783834 - DNA, 22 bp, Homo sapiens
gccggtcgggcagccagcagag

SEQ ID NO: 1783835 - DNA, 17 bp, Homo sapiens
gccggtgagaataagag

SEQ ID NO: 1783836 - DNA, 15 bp, Homo sapiens
gccggtgcacaggcc

SEQ ID NO: 1783837 - DNA, 13 bp, Homo sapiens
gccggtgcctggc

SEQ ID NO: 1783838 - DNA, 13 bp, Homo sapiens
gccggtgctgggt

SEQ ID NO: 1783839 - DNA, 20 bp, Homo sapiens
gccggtgctgggttcccact

SEQ ID NO: 1783840 - DNA, 23 bp, Homo sapiens
gccggtgctgggttcccactccc

SEQ ID NO: 1783841 - DNA, 22 bp, Homo sapiens
gccggtgcttccaacaaggaca

SEQ ID NO: 1783842 - DNA, 13 bp, Homo sapiens
gccgtaattatgt

SEQ ID NO: 1783843 - DNA, 20 bp, Homo sapiens
gccgtaattctttctgtctc

SEQ ID NO: 1783844 - DNA, 21 bp, Homo sapiens
gccgtaattctttctgtctcc

SEQ ID NO: 1783845 - DNA, 14 bp, Homo sapiens
gccgtaccccaccc

SEQ ID NO: 1783846 - DNA, 16 bp, Homo sapiens
gccgtaggggctcctg

SEQ ID NO: 1783847 - DNA, 18 bp, Homo sapiens
gccgtaggggctcctgag

SEQ ID NO: 1783848 - DNA, 20 bp, Homo sapiens
gcctcagttttccttctgtt

SEQ ID NO: 1783849 - DNA, 17 bp, Homo sapiens
gcctcatagcatagcca

SEQ ID NO: 1783850 - DNA, 21 bp, Homo sapiens
gcctcatagcatagccagcat

SEQ ID NO: 1783851 - DNA, 13 bp, Homo sapiens
gcctcatcctgag

SEQ ID NO: 1783852 - DNA, 14 bp, Homo sapiens
gcctcatgccacac

SEQ ID NO: 1783853 - DNA, 18 bp, Homo sapiens
gcctcatgccacaccttc

SEQ ID NO: 1783854 - DNA, 20 bp, Homo sapiens
gcctcatggcttttgctttc

SEQ ID NO: 1783855 - DNA, 23 bp, Homo sapiens
gcctcatggcttttgctttccct

SEQ ID NO: 1783856 - DNA, 13 bp, Homo sapiens
gcctcatgttctg

SEQ ID NO: 1783857 - DNA, 15 bp, Homo sapiens
gcctcattcagcatg

SEQ ID NO: 1783858 - DNA, 21 bp, Homo sapiens
gcctcatttagagaggaaaag

SEQ ID NO: 1783859 - DNA, 22 bp, Homo sapiens
gcctcattttgggggtcatctt

SEQ ID NO: 1783860 - DNA, 16 bp, Homo sapiens
gcctccaacgcccctg

SEQ ID NO: 1783861 - DNA, 19 bp, Homo sapiens
gcctccaacgcccctgtgg

SEQ ID NO: 1783862 - DNA, 16 bp, Homo sapiens
gcctccaagcctgcct

SEQ ID NO: 1783863 - DNA, 20 bp, Homo sapiens
gcctccacaccagctgctgc

SEQ ID NO: 1783864 - DNA, 21 bp, Homo sapiens
gcctccacaccagctgctgct

SEQ ID NO: 1783865 - DNA, 23 bp, Homo sapiens
gcctccacagcgagggcagctgc

SEQ ID NO: 1783866 - DNA, 16 bp, Homo sapiens
gcctccaccaccactg

SEQ ID NO: 1783867 - DNA, 18 bp, Homo sapiens
gcctccaccaccactggc

SEQ ID NO: 1783868 - DNA, 20 bp, Homo sapiens
gcctccaccaccactggcca

SEQ ID NO: 1783869 - DNA, 23 bp, Homo sapiens
gcctccaccaccactggccacca

SEQ ID NO: 1783870 - DNA, 16 bp, Homo sapiens
gcctccaccagcaagg

SEQ ID NO: 1783871 - DNA, 18 bp, Homo sapiens
gcctccaccccccagaac

SEQ ID NO: 1783872 - DNA, 17 bp, Homo sapiens
gcctccaccgagccagc

SEQ ID NO: 1783873 - DNA, 20 bp, Homo sapiens
gcctccaccgagccagcttg

SEQ ID NO: 1783874 - DNA, 21 bp, Homo sapiens
gcctccaccgagccagcttgg

SEQ ID NO: 1783875 - DNA, 13 bp, Homo sapiens
gcctccactcccc

SEQ ID NO: 1783876 - DNA, 17 bp, Homo sapiens
gcctccacttccctcgt

SEQ ID NO: 1783877 - DNA, 19 bp, Homo sapiens
gcctccagaactcactggg

SEQ ID NO: 1783878 - DNA, 15 bp, Homo sapiens
gcctccagaagctgc

SEQ ID NO: 1783879 - DNA, 16 bp, Homo sapiens
gcctccagaagctgct

SEQ ID NO: 1783880 - DNA, 13 bp, Homo sapiens
gcctccagagcca

SEQ ID NO: 1783881 - DNA, 15 bp, Homo sapiens
gcctccagagccagc

SEQ ID NO: 1783882 - DNA, 19 bp, Homo sapiens
gcctccagagccagcctgg

SEQ ID NO: 1783883 - DNA, 12 bp, Homo sapiens
gcctccagctcc

SEQ ID NO: 1783884 - DNA, 13 bp, Homo sapiens
gcctccagctccc

SEQ ID NO: 1783885 - DNA, 20 bp, Homo sapiens
gcctccaggagcctaccccc

SEQ ID NO: 1783886 - DNA, 12 bp, Homo sapiens
gcctccagggca

SEQ ID NO: 1783887 - DNA, 13 bp, Homo sapiens
gcctccagggcat

SEQ ID NO: 1783888 - DNA, 16 bp, Homo sapiens
gcctccagggctggac

SEQ ID NO: 1783889 - DNA, 17 bp, Homo sapiens
gcctccagggctggact

SEQ ID NO: 1783890 - DNA, 22 bp, Homo sapiens
gcctccagggctggactgaggc

SEQ ID NO: 1783891 - DNA, 24 bp, Homo sapiens
gcctccagggctggactgaggcct

SEQ ID NO: 1783892 - DNA, 16 bp, Homo sapiens
gcctccaggtgtgcac

SEQ ID NO: 1783893 - DNA, 20 bp, Homo sapiens
gcctccatgccccagctctg

SEQ ID NO: 1783894 - DNA, 20 bp, Homo sapiens
gcctccatggcagcagccag

SEQ ID NO: 1783895 - DNA, 21 bp, Homo sapiens
gcctccatggcagcagccagg

SEQ ID NO: 1783896 - DNA, 17 bp, Homo sapiens
gcctccatttagttctt

SEQ ID NO: 1783897 - DNA, 19 bp, Homo sapiens
gcctcccaaagtgctggga

SEQ ID NO: 1783898 - DNA, 12 bp, Homo sapiens
gcctcccaccag

SEQ ID NO: 1783899 - DNA, 15 bp, Homo sapiens
gcctcccaccagagc

SEQ ID NO: 1783900 - DNA, 12 bp, Homo sapiens
gcctcccacccc

SEQ ID NO: 1783901 - DNA, 22 bp, Homo sapiens
gcctcccaccgcagcgtccccc

SEQ ID NO: 1783902 - DNA, 13 bp, Homo sapiens
gcctcccaggcaa

SEQ ID NO: 1783903 - DNA, 14 bp, Homo sapiens
gcctcccaggcaag

SEQ ID NO: 1783904 - DNA, 21 bp, Homo sapiens
gcctcccataattgctttgcc

SEQ ID NO: 1783905 - DNA, 22 bp, Homo sapiens
gcctcccattcactagaaaatg

SEQ ID NO: 1783906 - DNA, 18 bp, Homo sapiens
gcctccccatttcccatc

SEQ ID NO: 1783907 - DNA, 19 bp, Homo sapiens
gcctccccatttcccatct

SEQ ID NO: 1783908 - DNA, 23 bp, Homo sapiens
gcctccccatttcccatctgcac

SEQ ID NO: 1783909 - DNA, 14 bp, Homo sapiens
gcctccccccagac

SEQ ID NO: 1783910 - DNA, 20 bp, Homo sapiens
gcctccccccagaccccgcc

SEQ ID NO: 1783911 - DNA, 21 bp, Homo sapiens
gcctccccccagaccccgccc

SEQ ID NO: 1783912 - DNA, 14 bp, Homo sapiens
gcctcccccgcagg

SEQ ID NO: 1783913 - DNA, 20 bp, Homo sapiens
gcctcccccgccagccccaa

SEQ ID NO: 1783914 - DNA, 22 bp, Homo sapiens
gcctcccccgccagccccaagc

SEQ ID NO: 1783915 - DNA, 18 bp, Homo sapiens
gcctccccgaaacaggct

SEQ ID NO: 1783916 - DNA, 13 bp, Homo sapiens
gcctcccctgggc

SEQ ID NO: 1783917 - DNA, 21 bp, Homo sapiens
gcctcccctgtctctaaggag

SEQ ID NO: 1783918 - DNA, 17 bp, Homo sapiens
gcctcccgcctcccccg

SEQ ID NO: 1783919 - DNA, 21 bp, Homo sapiens
gcctccctctctcttctgctc

SEQ ID NO: 1783920 - DNA, 22 bp, Homo sapiens
gcctccctctctcttctgctcc

SEQ ID NO: 1783921 - DNA, 12 bp, Homo sapiens
gcctccctctga

SEQ ID NO: 1783922 - DNA, 13 bp, Homo sapiens
gcctccctgcaga

SEQ ID NO: 1783923 - DNA, 14 bp, Homo sapiens
gcctccctgcagac

SEQ ID NO: 1783924 - DNA, 17 bp, Homo sapiens
gcctccctgcagactcc

SEQ ID NO: 1783925 - DNA, 11 bp, Homo sapiens
gcctccctgct

SEQ ID NO: 1783926 - DNA, 21 bp, Homo sapiens
gcctccctggggaccaggagc

SEQ ID NO: 1783927 - DNA, 14 bp, Homo sapiens
gcctccctgtctcc

SEQ ID NO: 1783928 - DNA, 16 bp, Homo sapiens
gcctccctgtctccag

SEQ ID NO: 1783929 - DNA, 21 bp, Homo sapiens
gcctccctgttgaagctctgg

SEQ ID NO: 1783930 - DNA, 13 bp, Homo sapiens
gcctcccttctcc

SEQ ID NO: 1783931 - DNA, 14 bp, Homo sapiens
gcctccgacgctgc

SEQ ID NO: 1783932 - DNA, 18 bp, Homo sapiens
gcctccgacgctgcctct

SEQ ID NO: 1783933 - DNA, 15 bp, Homo sapiens
gcctccgagagggag

SEQ ID NO: 1783934 - DNA, 18 bp, Homo sapiens
gcctccgagagggagaga

SEQ ID NO: 1783935 - DNA, 22 bp, Homo sapiens
gccagatataactgtcttgttt

SEQ ID NO: 1783936 - DNA, 15 bp, Homo sapiens
gccagatccagcctg

SEQ ID NO: 1783937 - DNA, 20 bp, Homo sapiens
gccagatccagcctggggtc

SEQ ID NO: 1783938 - DNA, 15 bp, Homo sapiens
gccagatgcaggaca

SEQ ID NO: 1783939 - DNA, 17 bp, Homo sapiens
gccagatgcaggacagg

SEQ ID NO: 1783940 - DNA, 14 bp, Homo sapiens
gccagatgcctccc

SEQ ID NO: 1783941 - DNA, 16 bp, Homo sapiens
gccagatgcctcccca

SEQ ID NO: 1783942 - DNA, 21 bp, Homo sapiens
gccagattctcttgaataaag

SEQ ID NO: 1783943 - DNA, 15 bp, Homo sapiens
gccagattgccatcc

SEQ ID NO: 1783944 - DNA, 12 bp, Homo sapiens
gccagcaacgct

SEQ ID NO: 1783945 - DNA, 22 bp, Homo sapiens
gccagcaacgcttgtagaactc

SEQ ID NO: 1783946 - DNA, 19 bp, Homo sapiens
gccagcaagagttaggggc

SEQ ID NO: 1783947 - DNA, 21 bp, Homo sapiens
gccagcaatgatgtccagaag

SEQ ID NO: 1783948 - DNA, 13 bp, Homo sapiens
gccagcacagagc

SEQ ID NO: 1783949 - DNA, 22 bp, Homo sapiens
gccagcaccacctacacaggag

SEQ ID NO: 1783950 - DNA, 22 bp, Homo sapiens
gccagcacccacctggtactga

SEQ ID NO: 1783951 - DNA, 13 bp, Homo sapiens
gccagcagcagca

SEQ ID NO: 1783952 - DNA, 15 bp, Homo sapiens
gccagcagcagcagg

SEQ ID NO: 1783953 - DNA, 13 bp, Homo sapiens
gccagcagccagc

SEQ ID NO: 1783954 - DNA, 15 bp, Homo sapiens
gccagcagccagctc

SEQ ID NO: 1783955 - DNA, 17 bp, Homo sapiens
gccagcagccagctctc

SEQ ID NO: 1783956 - DNA, 22 bp, Homo sapiens
gccagcagccagctctcagcca

SEQ ID NO: 1783957 - DNA, 13 bp, Homo sapiens
gccagcagcctcg

SEQ ID NO: 1783958 - DNA, 19 bp, Homo sapiens
gccagcagcctcgcacagg

SEQ ID NO: 1783959 - DNA, 15 bp, Homo sapiens
gccagcagcgcgcag

SEQ ID NO: 1783960 - DNA, 16 bp, Homo sapiens
gccagcaggggggctg

SEQ ID NO: 1783961 - DNA, 19 bp, Homo sapiens
gccagcaggggggctgtgc

SEQ ID NO: 1783962 - DNA, 17 bp, Homo sapiens
gccagcatggttgcaga

SEQ ID NO: 1783963 - DNA, 11 bp, Homo sapiens
gccagccacag

SEQ ID NO: 1783964 - DNA, 22 bp, Homo sapiens
gccagccacagacccctgggag

SEQ ID NO: 1783965 - DNA, 23 bp, Homo sapiens
gccagccacagacccctgggagc

SEQ ID NO: 1783966 - DNA, 13 bp, Homo sapiens
gccagccagaagc

SEQ ID NO: 1783967 - DNA, 18 bp, Homo sapiens
gccagccagaagcctctg

SEQ ID NO: 1783968 - DNA, 16 bp, Homo sapiens
gccagccagcagccag

SEQ ID NO: 1783969 - DNA, 19 bp, Homo sapiens
gccagccagtcttgcctag

SEQ ID NO: 1783970 - DNA, 11 bp, Homo sapiens
gccagcccagc

SEQ ID NO: 1783971 - DNA, 12 bp, Homo sapiens
gccagcccagcc

SEQ ID NO: 1783972 - DNA, 14 bp, Homo sapiens
gccagcccagccca

SEQ ID NO: 1783973 - DNA, 18 bp, Homo sapiens
gccagccccaagctgggc

SEQ ID NO: 1783974 - DNA, 20 bp, Homo sapiens
gccagccccaagctgggccg

SEQ ID NO: 1783975 - DNA, 17 bp, Homo sapiens
gccagccccacccagga

SEQ ID NO: 1783976 - DNA, 20 bp, Homo sapiens
gccagcccctcttccccaat

SEQ ID NO: 1783977 - DNA, 12 bp, Homo sapiens
gcgtgatctcag

SEQ ID NO: 1783978 - DNA, 23 bp, Homo sapiens
gcgtgccagtcaagaagaaaaag

SEQ ID NO: 1783979 - DNA, 14 bp, Homo sapiens
gcgtgccctcgctg

SEQ ID NO: 1783980 - DNA, 22 bp, Homo sapiens
gcgtgcgcatcttgcctccagg

SEQ ID NO: 1783981 - DNA, 23 bp, Homo sapiens
gcgtgctagaggttgcagcatga

SEQ ID NO: 1783982 - DNA, 17 bp, Homo sapiens
gcgtggactctgcacat

SEQ ID NO: 1783983 - DNA, 17 bp, Homo sapiens
gcgtggagggaggcccc

SEQ ID NO: 1783984 - DNA, 22 bp, Homo sapiens
gcgtggagggaggccccagggg

SEQ ID NO: 1783985 - DNA, 18 bp, Homo sapiens
gcgtggcgcaggtgccat

SEQ ID NO: 1783986 - DNA, 23 bp, Homo sapiens
gcgtggctctaaaaggtaatgtg

SEQ ID NO: 1783987 - DNA, 12 bp, Homo sapiens
gcgtggctgact

SEQ ID NO: 1783988 - DNA, 15 bp, Homo sapiens
gcgtggtagtgcaag

SEQ ID NO: 1783989 - DNA, 13 bp, Homo sapiens
gcgtggtgccatc

SEQ ID NO: 1783990 - DNA, 14 bp, Homo sapiens
gcgtggtgccatcc

SEQ ID NO: 1783991 - DNA, 21 bp, Homo sapiens
gcgtggtgtgtccctggacac

SEQ ID NO: 1783992 - DNA, 18 bp, Homo sapiens
gcgtgtgctcctctcctt

SEQ ID NO: 1783993 - DNA, 18 bp, Homo sapiens
gcgtgtgtacacgggact

SEQ ID NO: 1783994 - DNA, 17 bp, Homo sapiens
gcgtgtgtgacactgat

SEQ ID NO: 1783995 - DNA, 20 bp, Homo sapiens
gcgtgtgtttgtatgtctgt

SEQ ID NO: 1783996 - DNA, 19 bp, Homo sapiens
gcgtgttagtgtgtgtgca

SEQ ID NO: 1783997 - DNA, 21 bp, Homo sapiens
gcgtgttagtgtgtgtgcatg

SEQ ID NO: 1783998 - DNA, 22 bp, Homo sapiens
gcgttattggtcggcagccttc

SEQ ID NO: 1783999 - DNA, 14 bp, Homo sapiens
gcgttcctggcctt

SEQ ID NO: 1784000 - DNA, 20 bp, Homo sapiens
gcgttctggactctgcccca

SEQ ID NO: 1784001 - DNA, 14 bp, Homo sapiens
gcgttggagccact

SEQ ID NO: 1784002 - DNA, 17 bp, Homo sapiens
gcgttggagccactcct

SEQ ID NO: 1784003 - DNA, 21 bp, Homo sapiens
gcgttggagccactcctgtcc

SEQ ID NO: 1784004 - DNA, 14 bp, Homo sapiens
gcgttgggagccta

SEQ ID NO: 1784005 - DNA, 15 bp, Homo sapiens
gcgttgttacaggaa

SEQ ID NO: 1784006 - DNA, 16 bp, Homo sapiens
gcgttgttacaggaag

SEQ ID NO: 1784007 - DNA, 22 bp, Homo sapiens
gcgtttattaatgcctctcccg

SEQ ID NO: 1784008 - DNA, 20 bp, Homo sapiens
gcgtttggaggcccctgggc

SEQ ID NO: 1784009 - DNA, 22 bp, Homo sapiens
gctaaaaatgagcttgattaaa

SEQ ID NO: 1784010 - DNA, 18 bp, Homo sapiens
gctaaaacaccttggctt

SEQ ID NO: 1784011 - DNA, 23 bp, Homo sapiens
gctaaactccttcctggcctgag

SEQ ID NO: 1784012 - DNA, 14 bp, Homo sapiens
gctaaagcactttg

SEQ ID NO: 1784013 - DNA, 22 bp, Homo sapiens
gctaaatgcaccaagaaagctt

SEQ ID NO: 1784014 - DNA, 22 bp, Homo sapiens
gctaaattactcaggaagaaca

SEQ ID NO: 1784015 - DNA, 21 bp, Homo sapiens
gctaaattttgttactgattc

SEQ ID NO: 1784016 - DNA, 19 bp, Homo sapiens
gctaacacgtgaaaccccg

SEQ ID NO: 1784017 - DNA, 22 bp, Homo sapiens
gctaaccactgtctgtccctga

SEQ ID NO: 1784018 - DNA, 15 bp, Homo sapiens
gctaaccatttatat

SEQ ID NO: 1784019 - DNA, 22 bp, Homo sapiens
gctaacccccttctactgagcc

SEQ ID NO: 1784020 - DNA, 14 bp, Homo sapiens
gctaactccgagag

SEQ ID NO: 1784021 - DNA, 22 bp, Homo sapiens
gctaactccgagagcagtgggc

SEQ ID NO: 1784022 - DNA, 15 bp, Homo sapiens
gctaactgggttaaa

SEQ ID NO: 1784023 - DNA, 12 bp, Homo sapiens
gctaactggtta

SEQ ID NO: 1784024 - DNA, 14 bp, Homo sapiens
gctaactggttaaa

SEQ ID NO: 1784025 - DNA, 20 bp, Homo sapiens
gctaagatagaaagctggac

SEQ ID NO: 1784026 - DNA, 18 bp, Homo sapiens
gctaagattatctgggga

SEQ ID NO: 1784027 - DNA, 14 bp, Homo sapiens
gctaagctggctct

SEQ ID NO: 1784028 - DNA, 19 bp, Homo sapiens
gctaagctggctctgtttg

SEQ ID NO: 1784029 - DNA, 21 bp, Homo sapiens
gctaaggaagtatcagcacta

SEQ ID NO: 1784030 - DNA, 17 bp, Homo sapiens
gctaaggctcctccttg

SEQ ID NO: 1784031 - DNA, 15 bp, Homo sapiens
gctaaggttctaagg

SEQ ID NO: 1784032 - DNA, 16 bp, Homo sapiens
gctaaggttctaaggc

SEQ ID NO: 1784033 - DNA, 21 bp, Homo sapiens
gctaaggtttccagtcagatg

SEQ ID NO: 1784034 - DNA, 18 bp, Homo sapiens
gctaagtgaaaaggtcat

SEQ ID NO: 1784035 - DNA, 20 bp, Homo sapiens
gctaataaaattcgctttct

SEQ ID NO: 1784036 - DNA, 23 bp, Homo sapiens
gctaataaaattcgctttctaaa

SEQ ID NO: 1784037 - DNA, 12 bp, Homo sapiens
gctaataaacca

SEQ ID NO: 1784038 - DNA, 11 bp, Homo sapiens
gctaataaatc

SEQ ID NO: 1784039 - DNA, 16 bp, Homo sapiens
gctaatacctcttact

SEQ ID NO: 1784040 - DNA, 22 bp, Homo sapiens
gctaatcagcattctcactcct

SEQ ID NO: 1784041 - DNA, 21 bp, Homo sapiens
gctaatcatgtgggtgagcca

SEQ ID NO: 1784042 - DNA, 13 bp, Homo sapiens
gctaatgtaatca

SEQ ID NO: 1784043 - DNA, 20 bp, Homo sapiens
gctaatgtaatcatttatct

SEQ ID NO: 1784044 - DNA, 11 bp, Homo sapiens
gctaatgtgca

SEQ ID NO: 1784045 - DNA, 22 bp, Homo sapiens
gctaattcaaggaatttcttaa

SEQ ID NO: 1784046 - DNA, 16 bp, Homo sapiens
gctaattctactcaca

SEQ ID NO: 1784047 - DNA, 22 bp, Homo sapiens
gctaatttagagataggaaact

SEQ ID NO: 1784048 - DNA, 20 bp, Homo sapiens
gctaatttgttttggatata

SEQ ID NO: 1784049 - DNA, 18 bp, Homo sapiens
gctaatttttggagaaat

SEQ ID NO: 1784050 - DNA, 17 bp, Homo sapiens
gctaatttttgtatttt

SEQ ID NO: 1784051 - DNA, 19 bp, Homo sapiens
gctacaaaaacacagcaag

SEQ ID NO: 1784052 - DNA, 20 bp, Homo sapiens
gctacaaatactcttaggaa

SEQ ID NO: 1784053 - DNA, 18 bp, Homo sapiens
gctacaaatttatgcatt

SEQ ID NO: 1784054 - DNA, 20 bp, Homo sapiens
gctacaaatttatgcatttc

SEQ ID NO: 1784055 - DNA, 20 bp, Homo sapiens
gctacaaccctaccctggca

SEQ ID NO: 1784056 - DNA, 21 bp, Homo sapiens
gctacaaccctaccctggcag

SEQ ID NO: 1784057 - DNA, 15 bp, Homo sapiens
gctacatcagccttc

SEQ ID NO: 1784058 - DNA, 14 bp, Homo sapiens
gctacatcccagcc

SEQ ID NO: 1784059 - DNA, 19 bp, Homo sapiens
gctacattcctcagctgcc

SEQ ID NO: 1784060 - DNA, 14 bp, Homo sapiens
gctaccaaaacagt

SEQ ID NO: 1784061 - DNA, 20 bp, Homo sapiens
gctaccaaagcaccttagct

SEQ ID NO: 1784062 - DNA, 21 bp, Homo sapiens
gctaccactggtacttccttt

SEQ ID NO: 1784063 - DNA, 23 bp, Homo sapiens
gctaccagcgccaaatgttcatc

SEQ ID NO: 1784064 - DNA, 13 bp, Homo sapiens
gctaccagtattt

SEQ ID NO: 1784065 - DNA, 18 bp, Homo sapiens
gctaccagtatttagaag

SEQ ID NO: 1784066 - DNA, 21 bp, Homo sapiens
gctacccaggaggctgaggtg

SEQ ID NO: 1784067 - DNA, 18 bp, Homo sapiens
gctacccatttacaaata

SEQ ID NO: 1784068 - DNA, 22 bp, Homo sapiens
gctaccctaaagggagaaggaa

SEQ ID NO: 1784069 - DNA, 15 bp, Homo sapiens
gctaccctcagcctc

SEQ ID NO: 1784070 - DNA, 22 bp, Homo sapiens
gctaccctttttctccagctgg

SEQ ID NO: 1784071 - DNA, 18 bp, Homo sapiens
gctaccgtggatctcctt

SEQ ID NO: 1784072 - DNA, 14 bp, Homo sapiens
gctaccgttgactt

SEQ ID NO: 1784073 - DNA, 13 bp, Homo sapiens
gctacctcaaggg

SEQ ID NO: 1784074 - DNA, 14 bp, Homo sapiens
gctacctcactggg

SEQ ID NO: 1784075 - DNA, 14 bp, Homo sapiens
gctacctctctgtc

SEQ ID NO: 1784076 - DNA, 19 bp, Homo sapiens
gctacctgctcagccctgc

SEQ ID NO: 1784077 - DNA, 23 bp, Homo sapiens
gctaccttctctacccatctccc

SEQ ID NO: 1784078 - DNA, 21 bp, Homo sapiens
gctactaagttcacattagaa

SEQ ID NO: 1784079 - DNA, 22 bp, Homo sapiens
gctactaagttcacattagaat

SEQ ID NO: 1784080 - DNA, 14 bp, Homo sapiens
gctactaatgatgt

SEQ ID NO: 1784081 - DNA, 15 bp, Homo sapiens
gctactataaagaga

SEQ ID NO: 1784082 - DNA, 20 bp, Homo sapiens
gctactcaagaggctgaggc

SEQ ID NO: 1784083 - DNA, 14 bp, Homo sapiens
gctactcagaagcc

SEQ ID NO: 1784084 - DNA, 16 bp, Homo sapiens
gctactcagaagcctg

SEQ ID NO: 1784085 - DNA, 19 bp, Homo sapiens
gctactcagaagcctgagg

SEQ ID NO: 1784086 - DNA, 18 bp, Homo sapiens
gctactcaggaggctgag

SEQ ID NO: 1784087 - DNA, 21 bp, Homo sapiens
gctactcaggaggctgagaca

SEQ ID NO: 1784088 - DNA, 21 bp, Homo sapiens
gctactctgtccaggccactg

SEQ ID NO: 1784089 - DNA, 16 bp, Homo sapiens
gctactgatgaaatct

SEQ ID NO: 1784090 - DNA, 18 bp, Homo sapiens
gctactgcactccagcct

SEQ ID NO: 1784091 - DNA, 20 bp, Homo sapiens
gctactgcactccagcctgg

SEQ ID NO: 1784092 - DNA, 21 bp, Homo sapiens
gctactgctgctgctgctgcc

SEQ ID NO: 1784093 - DNA, 15 bp, Homo sapiens
gctactggcagctcc

SEQ ID NO: 1784094 - DNA, 17 bp, Homo sapiens
gctactggcagctcctc

SEQ ID NO: 1784095 - DNA, 20 bp, Homo sapiens
gctactggcagctcctctcc

SEQ ID NO: 1784096 - DNA, 16 bp, Homo sapiens
gctactggggaggctg

SEQ ID NO: 1784097 - DNA, 17 bp, Homo sapiens
gctactggggaggctga

SEQ ID NO: 1784098 - DNA, 22 bp, Homo sapiens
gctactggggaggctgaggcag

SEQ ID NO: 1784099 - DNA, 23 bp, Homo sapiens
gctactggggaggctgaggcagg

SEQ ID NO: 1784100 - DNA, 23 bp, Homo sapiens
gctactgtctattaaaattctga

SEQ ID NO: 1784101 - DNA, 12 bp, Homo sapiens
gctactgtctca

SEQ ID NO: 1784102 - DNA, 21 bp, Homo sapiens
gctactgtctcactgaaacat

SEQ ID NO: 1784103 - DNA, 16 bp, Homo sapiens
gctacttcccttcctc

SEQ ID NO: 1784104 - DNA, 15 bp, Homo sapiens
gctacttctgggaaa

SEQ ID NO: 1784105 - DNA, 16 bp, Homo sapiens
gctacttctgggaaaa

SEQ ID NO: 1784106 - DNA, 17 bp, Homo sapiens
gctacttctgggaaaaa

SEQ ID NO: 1784107 - DNA, 20 bp, Homo sapiens
gctagaaaaaaaaaacactt

SEQ ID NO: 1784108 - DNA, 13 bp, Homo sapiens
gctagaaaaataa

SEQ ID NO: 1784109 - DNA, 19 bp, Homo sapiens
gctagaaaaattgttaagg

SEQ ID NO: 1784110 - DNA, 20 bp, Homo sapiens
gctagaatatcctatactgg

SEQ ID NO: 1784111 - DNA, 20 bp, Homo sapiens
gctagactcctcaggagaga

SEQ ID NO: 1784112 - DNA, 18 bp, Homo sapiens
gctagagacgctgatcca

SEQ ID NO: 1784113 - DNA, 19 bp, Homo sapiens
gctagagataaaacagaat

SEQ ID NO: 1784114 - DNA, 20 bp, Homo sapiens
gctagagatatggcagcgaa

SEQ ID NO: 1784115 - DNA, 19 bp, Homo sapiens
gctagaggccagccccacc

SEQ ID NO: 1784116 - DNA, 21 bp, Homo sapiens
gctagaggccagccccaccca

SEQ ID NO: 1784117 - DNA, 16 bp, Homo sapiens
gctagaggcctgagga

SEQ ID NO: 1784118 - DNA, 19 bp, Homo sapiens
gctagaggttgcagcatga

SEQ ID NO: 1784119 - DNA, 13 bp, Homo sapiens
gctagagtcctca

SEQ ID NO: 1784120 - DNA, 13 bp, Homo sapiens
gctagataaaagc

SEQ ID NO: 1784121 - DNA, 17 bp, Homo sapiens
gctagcacttggagcca

SEQ ID NO: 1784122 - DNA, 23 bp, Homo sapiens
gctagcagaaatctagaagactg

SEQ ID NO: 1784123 - DNA, 12 bp, Homo sapiens
gctagccagagg

SEQ ID NO: 1784124 - DNA, 13 bp, Homo sapiens
gctagccagaggg

SEQ ID NO: 1784125 - DNA, 16 bp, Homo sapiens
gctagcctttcttgta

SEQ ID NO: 1784126 - DNA, 20 bp, Homo sapiens
gctagcgctgccgcacccca

SEQ ID NO: 1784127 - DNA, 16 bp, Homo sapiens
gctagctatatattta

SEQ ID NO: 1784128 - DNA, 13 bp, Homo sapiens
gctagctgccact

SEQ ID NO: 1784129 - DNA, 17 bp, Homo sapiens
gctagctgtagaaatgt

SEQ ID NO: 1784130 - DNA, 12 bp, Homo sapiens
gctagcttctgc

SEQ ID NO: 1784131 - DNA, 15 bp, Homo sapiens
gctagcttctgcttt

SEQ ID NO: 1784132 - DNA, 22 bp, Homo sapiens
gctagcttctgcttttctgccc

SEQ ID NO: 1784133 - DNA, 20 bp, Homo sapiens
gctaggaagagcaggactcc

SEQ ID NO: 1784134 - DNA, 17 bp, Homo sapiens
gctaggaagaggagtgg

SEQ ID NO: 1784135 - DNA, 13 bp, Homo sapiens
gctaggaatgaaa

SEQ ID NO: 1784136 - DNA, 18 bp, Homo sapiens
gctaggaatgaaatcctg

SEQ ID NO: 1784137 - DNA, 11 bp, Homo sapiens
gctaggactga

SEQ ID NO: 1784138 - DNA, 15 bp, Homo sapiens
gctaggactgaggag

SEQ ID NO: 1784139 - DNA, 12 bp, Homo sapiens
gctaggagcccc

SEQ ID NO: 1784140 - DNA, 15 bp, Homo sapiens
gctaggccccagagg

SEQ ID NO: 1784141 - DNA, 21 bp, Homo sapiens
gctaggccccagaggccctgg

SEQ ID NO: 1784142 - DNA, 16 bp, Homo sapiens
gctaggctgtctgcga

SEQ ID NO: 1784143 - DNA, 17 bp, Homo sapiens
gctagggaaacttcccg

SEQ ID NO: 1784144 - DNA, 16 bp, Homo sapiens
gctagtagcaatgtgc

SEQ ID NO: 1784145 - DNA, 18 bp, Homo sapiens
gctagtagcaatgtgcct

SEQ ID NO: 1784146 - DNA, 16 bp, Homo sapiens
gctagtcactggcagc

SEQ ID NO: 1784147 - DNA, 20 bp, Homo sapiens
gctagtcactggcagcctgc

SEQ ID NO: 1784148 - DNA, 18 bp, Homo sapiens
gctagtcagagagagtgt

SEQ ID NO: 1784149 - DNA, 16 bp, Homo sapiens
gctagtggtagtatct

SEQ ID NO: 1784150 - DNA, 22 bp, Homo sapiens
gctagtgtacctcctctcagtg

SEQ ID NO: 1784151 - DNA, 19 bp, Homo sapiens
gctagtgtgagtggcagcc

SEQ ID NO: 1784152 - DNA, 15 bp, Homo sapiens
gctagttctcagctt

SEQ ID NO: 1784153 - DNA, 15 bp, Homo sapiens
gctagttctcttaac

SEQ ID NO: 1784154 - DNA, 12 bp, Homo sapiens
gctagttctgct

SEQ ID NO: 1784155 - DNA, 18 bp, Homo sapiens
gctagttctgctgccctc

SEQ ID NO: 1784156 - DNA, 19 bp, Homo sapiens
gctagttctgctgccctct

SEQ ID NO: 1784157 - DNA, 21 bp, Homo sapiens
gctagttttacagattgcctc

SEQ ID NO: 1784158 - DNA, 13 bp, Homo sapiens
gctataaatatat

SEQ ID NO: 1784159 - DNA, 16 bp, Homo sapiens
gctataaatgccagag

SEQ ID NO: 1784160 - DNA, 17 bp, Homo sapiens
gctataaatgccagagc

SEQ ID NO: 1784161 - DNA, 21 bp, Homo sapiens
gctataaatgccagagccaac

SEQ ID NO: 1784162 - DNA, 18 bp, Homo sapiens
gctataacaactctattt

SEQ ID NO: 1784163 - DNA, 11 bp, Homo sapiens
gctataatcat

SEQ ID NO: 1784164 - DNA, 14 bp, Homo sapiens
gctatacacacaca

SEQ ID NO: 1784165 - DNA, 17 bp, Homo sapiens
gctataggtcagagatg

SEQ ID NO: 1784166 - DNA, 18 bp, Homo sapiens
gctataggtgctacaaaa

SEQ ID NO: 1784167 - DNA, 21 bp, Homo sapiens
gctataggtgctacaaaaaca

SEQ ID NO: 1784168 - DNA, 18 bp, Homo sapiens
gctatatataaagacaac

SEQ ID NO: 1784169 - DNA, 22 bp, Homo sapiens
gctatatatttaggaaattcaa

SEQ ID NO: 1784170 - DNA, 18 bp, Homo sapiens
gctatccccatctccctg

SEQ ID NO: 1784171 - DNA, 19 bp, Homo sapiens
gctatccccatctccctgc

SEQ ID NO: 1784172 - DNA, 22 bp, Homo sapiens
gctatccccatctccctgcctg

SEQ ID NO: 1784173 - DNA, 22 bp, Homo sapiens
gctatcgccctcctttccctta

SEQ ID NO: 1784174 - DNA, 20 bp, Homo sapiens
gctatgaagggacagctgct

SEQ ID NO: 1784175 - DNA, 16 bp, Homo sapiens
gctatgactacatttt

SEQ ID NO: 1784176 - DNA, 19 bp, Homo sapiens
gctatgactacattttgag

SEQ ID NO: 1784177 - DNA, 18 bp, Homo sapiens
gctatgattatgccactg

SEQ ID NO: 1784178 - DNA, 20 bp, Homo sapiens
gctatgattatgccactgct

SEQ ID NO: 1784179 - DNA, 22 bp, Homo sapiens
gctatgcaaaatagacatcttt

SEQ ID NO: 1784180 - DNA, 14 bp, Homo sapiens
gctatggaacataa

SEQ ID NO: 1784181 - DNA, 18 bp, Homo sapiens
gctatggatggcttctaa

SEQ ID NO: 1784182 - DNA, 15 bp, Homo sapiens
gctatggcaaggggg

SEQ ID NO: 1784183 - DNA, 15 bp, Homo sapiens
gctatggcccagaaa

SEQ ID NO: 1784184 - DNA, 13 bp, Homo sapiens
gctatgggagccc

SEQ ID NO: 1784185 - DNA, 19 bp, Homo sapiens
gctatgggagccccagggt

SEQ ID NO: 1784186 - DNA, 21 bp, Homo sapiens
gctatgggaggcagccgaggc

SEQ ID NO: 1784187 - DNA, 19 bp, Homo sapiens
gctatggggatagatgtgt

SEQ ID NO: 1784188 - DNA, 21 bp, Homo sapiens
gctatggggatagatgtgtgg

SEQ ID NO: 1784189 - DNA, 20 bp, Homo sapiens
gctatggggtaggagaaaag

SEQ ID NO: 1784190 - DNA, 13 bp, Homo sapiens
gctatgtaagggt

SEQ ID NO: 1784191 - DNA, 15 bp, Homo sapiens
gctatgtataaaata

SEQ ID NO: 1784192 - DNA, 18 bp, Homo sapiens
gctatgtgtgagatatgt

SEQ ID NO: 1784193 - DNA, 16 bp, Homo sapiens
gctatgttactatttt

SEQ ID NO: 1784194 - DNA, 19 bp, Homo sapiens
gctatgttctgtcttccca

SEQ ID NO: 1784195 - DNA, 12 bp, Homo sapiens
gctattaaaaaa

SEQ ID NO: 1784196 - DNA, 21 bp, Homo sapiens
gctattattttcactgtagaa

SEQ ID NO: 1784197 - DNA, 14 bp, Homo sapiens
gctattcacctcag

SEQ ID NO: 1784198 - DNA, 18 bp, Homo sapiens
gctattcagtaataactc

SEQ ID NO: 1784199 - DNA, 16 bp, Homo sapiens
gctattgacaagtcat

SEQ ID NO: 1784200 - DNA, 19 bp, Homo sapiens
gctattgaccatgtggttc

SEQ ID NO: 1784201 - DNA, 14 bp, Homo sapiens
gctattgcactcca

SEQ ID NO: 1784202 - DNA, 15 bp, Homo sapiens
gctattgcactccag

SEQ ID NO: 1784203 - DNA, 12 bp, Homo sapiens
gctattgctgct

SEQ ID NO: 1784204 - DNA, 15 bp, Homo sapiens
gctattgttgtgggc

SEQ ID NO: 1784205 - DNA, 18 bp, Homo sapiens
gctattgttgtgggcttt

SEQ ID NO: 1784206 - DNA, 22 bp, Homo sapiens
gctattgttgtgggctttctcc

SEQ ID NO: 1784207 - DNA, 21 bp, Homo sapiens
gctatttaatatctggcactg

SEQ ID NO: 1784208 - DNA, 17 bp, Homo sapiens
gctatttatgggcccct

SEQ ID NO: 1784209 - DNA, 15 bp, Homo sapiens
gctatttgtaaatct

SEQ ID NO: 1784210 - DNA, 19 bp, Homo sapiens
gctatttgtaaatctgcca

SEQ ID NO: 1784211 - DNA, 16 bp, Homo sapiens
gctatttgtacaaata

SEQ ID NO: 1784212 - DNA, 21 bp, Homo sapiens
gctatttgtacaaataaacct

SEQ ID NO: 1784213 - DNA, 22 bp, Homo sapiens
gctatttgtacaaataaacctg

SEQ ID NO: 1784214 - DNA, 18 bp, Homo sapiens
gctatttgtatttctctt

SEQ ID NO: 1784215 - DNA, 13 bp, Homo sapiens
gctatttgttcag

SEQ ID NO: 1784216 - DNA, 15 bp, Homo sapiens
gctcaaaaaatgagc

SEQ ID NO: 1784217 - DNA, 23 bp, Homo sapiens
gctcaaaaacttgatcacatgct

SEQ ID NO: 1784218 - DNA, 13 bp, Homo sapiens
gctcaaaattgct

SEQ ID NO: 1784219 - DNA, 21 bp, Homo sapiens
gctcaaataggtcatcatgaa

SEQ ID NO: 1784220 - DNA, 17 bp, Homo sapiens
gctcaaatctattcaga

SEQ ID NO: 1784221 - DNA, 22 bp, Homo sapiens
gctcaaatctattcagacaagc

SEQ ID NO: 1784222 - DNA, 23 bp, Homo sapiens
gctcaaatctattcagacaagca

SEQ ID NO: 1784223 - DNA, 17 bp, Homo sapiens
gctcaaatgatcctccc

SEQ ID NO: 1784224 - DNA, 18 bp, Homo sapiens
gctcaaatgatcctccca

SEQ ID NO: 1784225 - DNA, 16 bp, Homo sapiens
gctcaaccactgtggc

SEQ ID NO: 1784226 - DNA, 17 bp, Homo sapiens
gctcaaccactgtggcg

SEQ ID NO: 1784227 - DNA, 23 bp, Homo sapiens
gctcaaggaaagggggtcccagt

SEQ ID NO: 1784228 - DNA, 16 bp, Homo sapiens
gctcaaggctgtgcag

SEQ ID NO: 1784229 - DNA, 15 bp, Homo sapiens
gctcaagggctggca

SEQ ID NO: 1784230 - DNA, 16 bp, Homo sapiens
gctcaatagcttgaag

SEQ ID NO: 1784231 - DNA, 19 bp, Homo sapiens
gctcacaccctaccttccc

SEQ ID NO: 1784232 - DNA, 21 bp, Homo sapiens
gctcacaccctaccttcccca

SEQ ID NO: 1784233 - DNA, 23 bp, Homo sapiens
gctcacaccctaccttccccaga

SEQ ID NO: 1784234 - DNA, 13 bp, Homo sapiens
gctcacactgaga

SEQ ID NO: 1784235 - DNA, 15 bp, Homo sapiens
gctcacagttcctcg

SEQ ID NO: 1784236 - DNA, 17 bp, Homo sapiens
gctcacagttcctcgcc

SEQ ID NO: 1784237 - DNA, 21 bp, Homo sapiens
gctcacagttcctcgccctgg

SEQ ID NO: 1784238 - DNA, 19 bp, Homo sapiens
gctcacatccagccttgga

SEQ ID NO: 1784239 - DNA, 16 bp, Homo sapiens
gctcaccaggcctggc

SEQ ID NO: 1784240 - DNA, 20 bp, Homo sapiens
gctcaccaggcctggcctct

SEQ ID NO: 1784241 - DNA, 17 bp, Homo sapiens
gctcaccctgcccgctc

SEQ ID NO: 1784242 - DNA, 22 bp, Homo sapiens
gctcaccctgcccgctcccaac

SEQ ID NO: 1784243 - DNA, 15 bp, Homo sapiens
gctcaccgcccatca

SEQ ID NO: 1784244 - DNA, 17 bp, Homo sapiens
gctcaccgcccatcagg

SEQ ID NO: 1784245 - DNA, 13 bp, Homo sapiens
gctcacctcagag

SEQ ID NO: 1784246 - DNA, 13 bp, Homo sapiens
gctcacctctgcc

SEQ ID NO: 1784247 - DNA, 14 bp, Homo sapiens
gctcacctgcagcc

SEQ ID NO: 1784248 - DNA, 21 bp, Homo sapiens
gctcacctgtgtgcccagcac

SEQ ID NO: 1784249 - DNA, 21 bp, Homo sapiens
gctcacgcctatgatcccagc

SEQ ID NO: 1784250 - DNA, 22 bp, Homo sapiens
gctcacgcctatgatcccagca

SEQ ID NO: 1784251 - DNA, 23 bp, Homo sapiens
gctcacgcctgtaatcccagcac

SEQ ID NO: 1784252 - DNA, 18 bp, Homo sapiens
gctcacgctcccccgcag

SEQ ID NO: 1784253 - DNA, 15 bp, Homo sapiens
gctcacgtcacactt

SEQ ID NO: 1784254 - DNA, 20 bp, Homo sapiens
gctcacgtcctgagaaagct

SEQ ID NO: 1784255 - DNA, 14 bp, Homo sapiens
gctcactatgaatc

SEQ ID NO: 1784256 - DNA, 17 bp, Homo sapiens
gctcactcacagagtca

SEQ ID NO: 1784257 - DNA, 23 bp, Homo sapiens
gctcactcatcaatggggccagt

SEQ ID NO: 1784258 - DNA, 22 bp, Homo sapiens
gctcactgaactccttccccac

SEQ ID NO: 1784259 - DNA, 19 bp, Homo sapiens
gctcactgcaacctccgcc

SEQ ID NO: 1784260 - DNA, 20 bp, Homo sapiens
gctcactgcaacctctgcct

SEQ ID NO: 1784261 - DNA, 23 bp, Homo sapiens
gctcactgcaacttccgcctcct

SEQ ID NO: 1784262 - DNA, 15 bp, Homo sapiens
gctcactgcagcctc

SEQ ID NO: 1784263 - DNA, 15 bp, Homo sapiens
gctcactgccaggcc

SEQ ID NO: 1784264 - DNA, 17 bp, Homo sapiens
gctcactgccaggccag

SEQ ID NO: 1784265 - DNA, 23 bp, Homo sapiens
gctcactgccaggccagcctccg

SEQ ID NO: 1784266 - DNA, 12 bp, Homo sapiens
gctcactggcag

SEQ ID NO: 1784267 - DNA, 13 bp, Homo sapiens
gctcactggcagg

SEQ ID NO: 1784268 - DNA, 15 bp, Homo sapiens
gctcactgtgctggg

SEQ ID NO: 1784269 - DNA, 23 bp, Homo sapiens
gctcacttctgggcttcatctgg

SEQ ID NO: 1784270 - DNA, 20 bp, Homo sapiens
gctcacttttcatccttccc

SEQ ID NO: 1784271 - DNA, 22 bp, Homo sapiens
gctcacttttcatccttcccca

SEQ ID NO: 1784272 - DNA, 16 bp, Homo sapiens
gctcagaacttgctgc

SEQ ID NO: 1784273 - DNA, 17 bp, Homo sapiens
gctcagaatagatctga

SEQ ID NO: 1784274 - DNA, 21 bp, Homo sapiens
gctcagaatagatctgatggt

SEQ ID NO: 1784275 - DNA, 19 bp, Homo sapiens
gctcagacattttcttttt

SEQ ID NO: 1784276 - DNA, 23 bp, Homo sapiens
gctcagacccccactctcattcc

SEQ ID NO: 1784277 - DNA, 21 bp, Homo sapiens
gctcagacggcggccaggcac

SEQ ID NO: 1784278 - DNA, 16 bp, Homo sapiens
gctcagaggcccagga

SEQ ID NO: 1784279 - DNA, 13 bp, Homo sapiens
gctcagcagccag

SEQ ID NO: 1784280 - DNA, 17 bp, Homo sapiens
gctcagcagccagtctc

SEQ ID NO: 1784281 - DNA, 11 bp, Homo sapiens
gctcagccagt

SEQ ID NO: 1784282 - DNA, 19 bp, Homo sapiens
gctcagcccgcttggccac

SEQ ID NO: 1784283 - DNA, 20 bp, Homo sapiens
gctcagcccgcttggccacc

SEQ ID NO: 1784284 - DNA, 19 bp, Homo sapiens
gctcagccctccctgcccc

SEQ ID NO: 1784285 - DNA, 21 bp, Homo sapiens
gctcagccctccctgcccctc

SEQ ID NO: 1784286 - DNA, 16 bp, Homo sapiens
gctcagccctgcacca

SEQ ID NO: 1784287 - DNA, 19 bp, Homo sapiens
gctcagcctcatcctgaga

SEQ ID NO: 1784288 - DNA, 15 bp, Homo sapiens
gctcagccttgctgc

SEQ ID NO: 1784289 - DNA, 16 bp, Homo sapiens
gctcagccttgctgct

SEQ ID NO: 1784290 - DNA, 21 bp, Homo sapiens
gctcagccttgctgctctgcg

SEQ ID NO: 1784291 - DNA, 14 bp, Homo sapiens
gctcagctctggtc

SEQ ID NO: 1784292 - DNA, 12 bp, Homo sapiens
gctcagctgccc

SEQ ID NO: 1784293 - DNA, 14 bp, Homo sapiens
gctcagctgcccat

SEQ ID NO: 1784294 - DNA, 19 bp, Homo sapiens
gctcagctgcccatcccag

SEQ ID NO: 1784295 - DNA, 13 bp, Homo sapiens
gctcagctgtggc

SEQ ID NO: 1784296 - DNA, 15 bp, Homo sapiens
gctcagctgtggctg

SEQ ID NO: 1784297 - DNA, 20 bp, Homo sapiens
gctcagctgtggctggagga

SEQ ID NO: 1784298 - DNA, 12 bp, Homo sapiens
gctcaggaccca

SEQ ID NO: 1784299 - DNA, 15 bp, Homo sapiens
gctcaggaggcgccc

SEQ ID NO: 1784300 - DNA, 13 bp, Homo sapiens
gctcaggaggctt

SEQ ID NO: 1784301 - DNA, 16 bp, Homo sapiens
gctcaggaggcttgga

SEQ ID NO: 1784302 - DNA, 17 bp, Homo sapiens
gctcaggaggcttggaa

SEQ ID NO: 1784303 - DNA, 21 bp, Homo sapiens
gctcaggagtttgagaccagg

SEQ ID NO: 1784304 - DNA, 13 bp, Homo sapiens
gctcaggcaagcc

SEQ ID NO: 1784305 - DNA, 14 bp, Homo sapiens
gctcaggcaagccc

SEQ ID NO: 1784306 - DNA, 17 bp, Homo sapiens
gctcaggcaagcccctc

SEQ ID NO: 1784307 - DNA, 14 bp, Homo sapiens
gctcaggcccagct

SEQ ID NO: 1784308 - DNA, 19 bp, Homo sapiens
gctcagggccatgctgagg

SEQ ID NO: 1784309 - DNA, 23 bp, Homo sapiens
gctgcaggaagaaacttttttat

SEQ ID NO: 1784310 - DNA, 16 bp, Homo sapiens
gctgcagggctcccat

SEQ ID NO: 1784311 - DNA, 17 bp, Homo sapiens
gctgcagggctttaaaa

SEQ ID NO: 1784312 - DNA, 14 bp, Homo sapiens
gctgcaggggcctc

SEQ ID NO: 1784313 - DNA, 22 bp, Homo sapiens
gctgcagtcaacagttcaaaga

SEQ ID NO: 1784314 - DNA, 21 bp, Homo sapiens
gctgcagtcacattgatgtaa

SEQ ID NO: 1784315 - DNA, 14 bp, Homo sapiens
gctgcagtcatcta

SEQ ID NO: 1784316 - DNA, 16 bp, Homo sapiens
gctgcagtcttctctc

SEQ ID NO: 1784317 - DNA, 21 bp, Homo sapiens
gctgcatactttgacaaggaa

SEQ ID NO: 1784318 - DNA, 18 bp, Homo sapiens
gctgcatttcacatgcct

SEQ ID NO: 1784319 - DNA, 21 bp, Homo sapiens
gctgcatttcacatgccttgc

SEQ ID NO: 1784320 - DNA, 22 bp, Homo sapiens
gctgccaaggccagagtggcct

SEQ ID NO: 1784321 - DNA, 21 bp, Homo sapiens
gctgccacacttcaggctctt

SEQ ID NO: 1784322 - DNA, 15 bp, Homo sapiens
gctgccacagagaag

SEQ ID NO: 1784323 - DNA, 22 bp, Homo sapiens
gctgccacagtaatactcattc

SEQ ID NO: 1784324 - DNA, 15 bp, Homo sapiens
gctgccaccacgtct

SEQ ID NO: 1784325 - DNA, 20 bp, Homo sapiens
gctgccaccacgtctgccag

SEQ ID NO: 1784326 - DNA, 11 bp, Homo sapiens
gctgccactgg

SEQ ID NO: 1784327 - DNA, 14 bp, Homo sapiens
gctgccagcacaga

SEQ ID NO: 1784328 - DNA, 14 bp, Homo sapiens
gctgccagcacagt

SEQ ID NO: 1784329 - DNA, 16 bp, Homo sapiens
gctgccagcacagtag

SEQ ID NO: 1784330 - DNA, 16 bp, Homo sapiens
gctgccagccttgagc

SEQ ID NO: 1784331 - DNA, 20 bp, Homo sapiens
gctgccagccttgagccctg

SEQ ID NO: 1784332 - DNA, 15 bp, Homo sapiens
gctgccagcgtctgt

SEQ ID NO: 1784333 - DNA, 20 bp, Homo sapiens
gctgccagcgtctgttgtgg

SEQ ID NO: 1784334 - DNA, 17 bp, Homo sapiens
gctgccataattctaag

SEQ ID NO: 1784335 - DNA, 19 bp, Homo sapiens
gctgccatgccactgccag

SEQ ID NO: 1784336 - DNA, 23 bp, Homo sapiens
gctgccatggcgtgtccctctcg

SEQ ID NO: 1784337 - DNA, 17 bp, Homo sapiens
gctgccatgtgaagagg

SEQ ID NO: 1784338 - DNA, 16 bp, Homo sapiens
gctgcccaatccatta

SEQ ID NO: 1784339 - DNA, 18 bp, Homo sapiens
gctgcccactgtttctct

SEQ ID NO: 1784340 - DNA, 18 bp, Homo sapiens
gctgcccagacacatggg

SEQ ID NO: 1784341 - DNA, 14 bp, Homo sapiens
gctgcccagagttg

SEQ ID NO: 1784342 - DNA, 22 bp, Homo sapiens
gctgcccaggcctctcggtgct

SEQ ID NO: 1784343 - DNA, 22 bp, Homo sapiens
gctgcccagtgcaaaccacttc

SEQ ID NO: 1784344 - DNA, 17 bp, Homo sapiens
gctgcccatcccagtcc

SEQ ID NO: 1784345 - DNA, 18 bp, Homo sapiens
gctgccccaacctgctga

SEQ ID NO: 1784346 - DNA, 20 bp, Homo sapiens
gctgccccaacctgctgaag

SEQ ID NO: 1784347 - DNA, 15 bp, Homo sapiens
gctgccccacctgcc

SEQ ID NO: 1784348 - DNA, 18 bp, Homo sapiens
gctgccccagcgtcttga

SEQ ID NO: 1784349 - DNA, 13 bp, Homo sapiens
gctgccccaggcc

SEQ ID NO: 1784350 - DNA, 13 bp, Homo sapiens
gctgccccgcttc

SEQ ID NO: 1784351 - DNA, 16 bp, Homo sapiens
gctgccccggcccctc

SEQ ID NO: 1784352 - DNA, 21 bp, Homo sapiens
gctgccccgggatgcgaggct

SEQ ID NO: 1784353 - DNA, 23 bp, Homo sapiens
gctgccccgggtccccagctccc

SEQ ID NO: 1784354 - DNA, 15 bp, Homo sapiens
gctgcccctctcacc

SEQ ID NO: 1784355 - DNA, 15 bp, Homo sapiens
gctgcccctgcagtt

SEQ ID NO: 1784356 - DNA, 17 bp, Homo sapiens
gctgccctagctgaccc

SEQ ID NO: 1784357 - DNA, 20 bp, Homo sapiens
gctgccctagctgaccccga

SEQ ID NO: 1784358 - DNA, 17 bp, Homo sapiens
gctgccctatgggcctg

SEQ ID NO: 1784359 - DNA, 13 bp, Homo sapiens
gctgccctcccac

SEQ ID NO: 1784360 - DNA, 22 bp, Homo sapiens
gctgccctcccacagcctcctt

SEQ ID NO: 1784361 - DNA, 23 bp, Homo sapiens
gctgccctcccctccggactggt

SEQ ID NO: 1784362 - DNA, 13 bp, Homo sapiens
gctgccctggccc

SEQ ID NO: 1784363 - DNA, 14 bp, Homo sapiens
gctgccctggtgct

SEQ ID NO: 1784364 - DNA, 19 bp, Homo sapiens
gctgccctggtgctgccac

SEQ ID NO: 1784365 - DNA, 22 bp, Homo sapiens
gctgccctggtgctgccacact

SEQ ID NO: 1784366 - DNA, 23 bp, Homo sapiens
gctgccctggtgctgccacactt

SEQ ID NO: 1784367 - DNA, 18 bp, Homo sapiens
gctgccctgtaccccagc

SEQ ID NO: 1784368 - DNA, 13 bp, Homo sapiens
gctgcccttgggc

SEQ ID NO: 1784369 - DNA, 18 bp, Homo sapiens
gctgcccttgggccaccc

SEQ ID NO: 1784370 - DNA, 18 bp, Homo sapiens
gctgcccttgttgcctgc

SEQ ID NO: 1784371 - DNA, 22 bp, Homo sapiens
gctgccgacttggagactcctg

SEQ ID NO: 1784372 - DNA, 21 bp, Homo sapiens
gctgccgagacagaccctctg

SEQ ID NO: 1784373 - DNA, 14 bp, Homo sapiens
gctgccgcacccca

SEQ ID NO: 1784374 - DNA, 21 bp, Homo sapiens
gctgccggaggagcatgcgca

SEQ ID NO: 1784375 - DNA, 21 bp, Homo sapiens
gctgccggctctgggcctgag

SEQ ID NO: 1784376 - DNA, 17 bp, Homo sapiens
gctgccgggccaggcgc

SEQ ID NO: 1784377 - DNA, 15 bp, Homo sapiens
gctgccgggcctgat

SEQ ID NO: 1784378 - DNA, 19 bp, Homo sapiens
gctgccgggcctgatttgg

SEQ ID NO: 1784379 - DNA, 18 bp, Homo sapiens
gctgcctaagtggctgct

SEQ ID NO: 1784380 - DNA, 10 bp, Homo sapiens
gctgcctcag

SEQ ID NO: 1784381 - DNA, 20 bp, Homo sapiens
gctgcctccatggcagcagc

SEQ ID NO: 1784382 - DNA, 16 bp, Homo sapiens
gctgcctcggactcca

SEQ ID NO: 1784383 - DNA, 20 bp, Homo sapiens
gctgcctcggactccatggc

SEQ ID NO: 1784384 - DNA, 13 bp, Homo sapiens
gctgcctctgctc

SEQ ID NO: 1784385 - DNA, 14 bp, Homo sapiens
gctgcctctgctcc

SEQ ID NO: 1784386 - DNA, 17 bp, Homo sapiens
gctgcctctgctccctc

SEQ ID NO: 1784387 - DNA, 13 bp, Homo sapiens
gctgcctgcagca

SEQ ID NO: 1784388 - DNA, 17 bp, Homo sapiens
gctgcctgcagcacatg

SEQ ID NO: 1784389 - DNA, 13 bp, Homo sapiens
gctgcctgccgcc

SEQ ID NO: 1784390 - DNA, 20 bp, Homo sapiens
gctgcctgccgcccaaagag

SEQ ID NO: 1784391 - DNA, 14 bp, Homo sapiens
gctgcctgcctgtc

SEQ ID NO: 1784392 - DNA, 18 bp, Homo sapiens
gctgcctgcttggcccgg

SEQ ID NO: 1784393 - DNA, 21 bp, Homo sapiens
gctgcctggaacaccagcagc

SEQ ID NO: 1784394 - DNA, 12 bp, Homo sapiens
gctgcctgggcc

SEQ ID NO: 1784395 - DNA, 16 bp, Homo sapiens
gctgcctgggctgttg

SEQ ID NO: 1784396 - DNA, 20 bp, Homo sapiens
gctgccttagaacctttctt

SEQ ID NO: 1784397 - DNA, 13 bp, Homo sapiens
gctgccttcccta

SEQ ID NO: 1784398 - DNA, 15 bp, Homo sapiens
gctgccttccctagc

SEQ ID NO: 1784399 - DNA, 16 bp, Homo sapiens
gctgccttcctcatcc

SEQ ID NO: 1784400 - DNA, 14 bp, Homo sapiens
gctgccttggctca

SEQ ID NO: 1784401 - DNA, 21 bp, Homo sapiens
gctgccttggctcagacatgt

SEQ ID NO: 1784402 - DNA, 15 bp, Homo sapiens
gctgcgatactggca

SEQ ID NO: 1784403 - DNA, 15 bp, Homo sapiens
gctgcgcttgctttt

SEQ ID NO: 1784404 - DNA, 16 bp, Homo sapiens
gctgcgggtctgaagg

SEQ ID NO: 1784405 - DNA, 13 bp, Homo sapiens
gctgcggtcactc

SEQ ID NO: 1784406 - DNA, 14 bp, Homo sapiens
gctgcgtcctcatt

SEQ ID NO: 1784407 - DNA, 17 bp, Homo sapiens
gctgctacctaaaaaaa

SEQ ID NO: 1784408 - DNA, 23 bp, Homo sapiens
gctgctactacccgagcccagct

SEQ ID NO: 1784409 - DNA, 14 bp, Homo sapiens
gctgctactgctgc

SEQ ID NO: 1784410 - DNA, 21 bp, Homo sapiens
gctgctatccccatctccctg

SEQ ID NO: 1784411 - DNA, 23 bp, Homo sapiens
gctgctatttcatctggtttctt

SEQ ID NO: 1784412 - DNA, 22 bp, Homo sapiens
gctgctattttataaacatttt

SEQ ID NO: 1784413 - DNA, 22 bp, Homo sapiens
gctgctcaagccgcaagctctc

SEQ ID NO: 1784414 - DNA, 23 bp, Homo sapiens
gctgctcaagccgcaagctctca

SEQ ID NO: 1784415 - DNA, 15 bp, Homo sapiens
gctgctcagcctcat

SEQ ID NO: 1784416 - DNA, 21 bp, Homo sapiens
gctgctcagcctcatcctgag

SEQ ID NO: 1784417 - DNA, 19 bp, Homo sapiens
gctgctcatctgatttttg

SEQ ID NO: 1784418 - DNA, 21 bp, Homo sapiens
gctgctcattacagttctttc

SEQ ID NO: 1784419 - DNA, 23 bp, Homo sapiens
gctgctcattacagttctttcct

SEQ ID NO: 1784420 - DNA, 16 bp, Homo sapiens
gctgctcccagcctct

SEQ ID NO: 1784421 - DNA, 16 bp, Homo sapiens
gctgctccccaggcca

SEQ ID NO: 1784422 - DNA, 13 bp, Homo sapiens
gctgctcctcatg

SEQ ID NO: 1784423 - DNA, 14 bp, Homo sapiens
gctgctcctccagg

SEQ ID NO: 1784424 - DNA, 18 bp, Homo sapiens
gctgctcctccagggcca

SEQ ID NO: 1784425 - DNA, 22 bp, Homo sapiens
gctgctctagctggcaggacac

SEQ ID NO: 1784426 - DNA, 13 bp, Homo sapiens
gctgctctgcccc

SEQ ID NO: 1784427 - DNA, 20 bp, Homo sapiens
gctgctctgccccttgggca

SEQ ID NO: 1784428 - DNA, 18 bp, Homo sapiens
gctgctcttagtgcccgc

SEQ ID NO: 1784429 - DNA, 22 bp, Homo sapiens
gctgctcttccagcgtctctcc

SEQ ID NO: 1784430 - DNA, 21 bp, Homo sapiens
gctgctcttgcatctgggcca

SEQ ID NO: 1784431 - DNA, 18 bp, Homo sapiens
gctgctgaaatttggaaa

SEQ ID NO: 1784432 - DNA, 18 bp, Homo sapiens
gctgctgaagttctgagc

SEQ ID NO: 1784433 - DNA, 16 bp, Homo sapiens
gctgctgagggtctgg

SEQ ID NO: 1784434 - DNA, 21 bp, Homo sapiens
gctgctgagggtctgggatct

SEQ ID NO: 1784435 - DNA, 15 bp, Homo sapiens
gctgctgcagccctg

SEQ ID NO: 1784436 - DNA, 15 bp, Homo sapiens
gctgctgcaggacat

SEQ ID NO: 1784437 - DNA, 13 bp, Homo sapiens
gctgctgcctctt

SEQ ID NO: 1784438 - DNA, 14 bp, Homo sapiens
gctgctgccttcac

SEQ ID NO: 1784439 - DNA, 14 bp, Homo sapiens
gctgctgctaccag

SEQ ID NO: 1784440 - DNA, 16 bp, Homo sapiens
gctgctgctaccagcg

SEQ ID NO: 1784441 - DNA, 13 bp, Homo sapiens
gctgctgctgccc

SEQ ID NO: 1784442 - DNA, 15 bp, Homo sapiens
gctgctgctgcgccc

SEQ ID NO: 1784443 - DNA, 13 bp, Homo sapiens
gctgctgctgctg

SEQ ID NO: 1784444 - DNA, 21 bp, Homo sapiens
gctgctggccaaatagcaaag

SEQ ID NO: 1784445 - DNA, 13 bp, Homo sapiens
gctgctggccagg

SEQ ID NO: 1784446 - DNA, 14 bp, Homo sapiens
gctgctggccaggg

SEQ ID NO: 1784447 - DNA, 20 bp, Homo sapiens
gctgctggggaagacagtgg

SEQ ID NO: 1784448 - DNA, 23 bp, Homo sapiens
gctgctggggcatgtgtgcctgt

SEQ ID NO: 1784449 - DNA, 15 bp, Homo sapiens
gctgctggtgcacag

SEQ ID NO: 1784450 - DNA, 23 bp, Homo sapiens
gctgctgtaactgctgagccact

SEQ ID NO: 1784451 - DNA, 12 bp, Homo sapiens
gctgctgtcctt

SEQ ID NO: 1784452 - DNA, 19 bp, Homo sapiens
gctgctgtgccccaccacg

SEQ ID NO: 1784453 - DNA, 18 bp, Homo sapiens
gctgctgtgctctgggga

SEQ ID NO: 1784454 - DNA, 22 bp, Homo sapiens
gctgctgtgtgctttttttgtg

SEQ ID NO: 1784455 - DNA, 9 bp, Homo sapiens
gctgctgtt

SEQ ID NO: 1784456 - DNA, 15 bp, Homo sapiens
gctgcttccaggctg

SEQ ID NO: 1784457 - DNA, 20 bp, Homo sapiens
gctgcttcccagaggagcag

SEQ ID NO: 1784458 - DNA, 14 bp, Homo sapiens
gctgcttcctcctg

SEQ ID NO: 1784459 - DNA, 15 bp, Homo sapiens
gctgcttcctcctgg

SEQ ID NO: 1784460 - DNA, 16 bp, Homo sapiens
gctgcttcctcctgga

SEQ ID NO: 1784461 - DNA, 15 bp, Homo sapiens
gctgcttgacctagc

SEQ ID NO: 1784462 - DNA, 22 bp, Homo sapiens
gctgcttgagttgcctgatgct

SEQ ID NO: 1784463 - DNA, 15 bp, Homo sapiens
gctgctttcccctgt

SEQ ID NO: 1784464 - DNA, 20 bp, Homo sapiens
gctgctttgcgctggtggac

SEQ ID NO: 1784465 - DNA, 18 bp, Homo sapiens
gctgctttttggcacagt

SEQ ID NO: 1784466 - DNA, 14 bp, Homo sapiens
gctgctttttttga

SEQ ID NO: 1784467 - DNA, 14 bp, Homo sapiens
gctggaaataaaac

SEQ ID NO: 1784468 - DNA, 17 bp, Homo sapiens
gctggaagactgtgcag

SEQ ID NO: 1784469 - DNA, 18 bp, Homo sapiens
gctggaagactgtgcaga

SEQ ID NO: 1784470 - DNA, 14 bp, Homo sapiens
gctggaagcctgcc

SEQ ID NO: 1784471 - DNA, 17 bp, Homo sapiens
gctggaagggaggaagg

SEQ ID NO: 1784472 - DNA, 20 bp, Homo sapiens
gctggaagggaggaaggcct

SEQ ID NO: 1784473 - DNA, 14 bp, Homo sapiens
gctggaaggggcca

SEQ ID NO: 1784474 - DNA, 19 bp, Homo sapiens
gctggaagtctccatgaag

SEQ ID NO: 1784475 - DNA, 15 bp, Homo sapiens
gctggacagcttacc

SEQ ID NO: 1784476 - DNA, 23 bp, Homo sapiens
gctggacctatgtcctaaggaca

SEQ ID NO: 1784477 - DNA, 16 bp, Homo sapiens
gctggacggcattcct

SEQ ID NO: 1784478 - DNA, 16 bp, Homo sapiens
gctggactattgtgcc

SEQ ID NO: 1784479 - DNA, 16 bp, Homo sapiens
gctggactccctcaag

SEQ ID NO: 1784480 - DNA, 13 bp, Homo sapiens
gctggactgacca

SEQ ID NO: 1784481 - DNA, 19 bp, Homo sapiens
gctggactgaccaaagact

SEQ ID NO: 1784482 - DNA, 22 bp, Homo sapiens
gctggactgaccaaagactgca

SEQ ID NO: 1784483 - DNA, 13 bp, Homo sapiens
gctggactgaggc

SEQ ID NO: 1784484 - DNA, 21 bp, Homo sapiens
gctggacttctacctgccctc

SEQ ID NO: 1784485 - DNA, 12 bp, Homo sapiens
gctggagaaaga

SEQ ID NO: 1784486 - DNA, 20 bp, Homo sapiens
gctggagaaagagctgcctg

SEQ ID NO: 1784487 - DNA, 21 bp, Homo sapiens
gctggagaaagagctgcctgg

SEQ ID NO: 1784488 - DNA, 22 bp, Homo sapiens
gctggagaaagagctgcctgga

SEQ ID NO: 1784489 - DNA, 12 bp, Homo sapiens
gctggagcagcg

SEQ ID NO: 1784490 - DNA, 12 bp, Homo sapiens
gctggagcccgc

SEQ ID NO: 1784491 - DNA, 21 bp, Homo sapiens
gctggagcccgcactgtccca

SEQ ID NO: 1784492 - DNA, 22 bp, Homo sapiens
gctggagcccgcactgtcccag

SEQ ID NO: 1784493 - DNA, 14 bp, Homo sapiens
gctggagctcttgg

SEQ ID NO: 1784494 - DNA, 15 bp, Homo sapiens
gctggagctcttgga

SEQ ID NO: 1784495 - DNA, 17 bp, Homo sapiens
gctggagctcttggaag

SEQ ID NO: 1784496 - DNA, 21 bp, Homo sapiens
gctggaggagctggcctgtgg

SEQ ID NO: 1784497 - DNA, 12 bp, Homo sapiens
gctggaggccca

SEQ ID NO: 1784498 - DNA, 16 bp, Homo sapiens
gctggaggcccaggct

SEQ ID NO: 1784499 - DNA, 17 bp, Homo sapiens
gctgtctccatgtttga

SEQ ID NO: 1784500 - DNA, 12 bp, Homo sapiens
gctgtctctctg

SEQ ID NO: 1784501 - DNA, 14 bp, Homo sapiens
gctgtctctctggg

SEQ ID NO: 1784502 - DNA, 19 bp, Homo sapiens
gctgtctctgaggggtggg

SEQ ID NO: 1784503 - DNA, 13 bp, Homo sapiens
gctgtctgcctgt

SEQ ID NO: 1784504 - DNA, 17 bp, Homo sapiens
gctgtctgcctgtattt

SEQ ID NO: 1784505 - DNA, 16 bp, Homo sapiens
gctgtctgtgggccgc

SEQ ID NO: 1784506 - DNA, 12 bp, Homo sapiens
gctgtcttcagt

SEQ ID NO: 1784507 - DNA, 17 bp, Homo sapiens
gctgtgaaaactctggt

SEQ ID NO: 1784508 - DNA, 20 bp, Homo sapiens
gctgtgaaccctggggcctg

SEQ ID NO: 1784509 - DNA, 15 bp, Homo sapiens
gctgtgacacctggt

SEQ ID NO: 1784510 - DNA, 15 bp, Homo sapiens
gctgtgacgcagccg

SEQ ID NO: 1784511 - DNA, 16 bp, Homo sapiens
gctgtgactctgggca

SEQ ID NO: 1784512 - DNA, 17 bp, Homo sapiens
gctgtgactctgggcag

SEQ ID NO: 1784513 - DNA, 14 bp, Homo sapiens
gctgtgagcagcct

SEQ ID NO: 1784514 - DNA, 15 bp, Homo sapiens
gctgtgagcagcctc

SEQ ID NO: 1784515 - DNA, 14 bp, Homo sapiens
gctgtgaggctgtc

SEQ ID NO: 1784516 - DNA, 15 bp, Homo sapiens
gctgtgaggctgtcc

SEQ ID NO: 1784517 - DNA, 22 bp, Homo sapiens
gctgtgagtctttggttctaag

SEQ ID NO: 1784518 - DNA, 22 bp, Homo sapiens
gctgtgagtgtaagtgtgagta

SEQ ID NO: 1784519 - DNA, 15 bp, Homo sapiens
gctgtgatgcatgag

SEQ ID NO: 1784520 - DNA, 20 bp, Homo sapiens
gctgtgatgcatgagctccc

SEQ ID NO: 1784521 - DNA, 21 bp, Homo sapiens
gctgtgatgcatgagctccct

SEQ ID NO: 1784522 - DNA, 12 bp, Homo sapiens
gctgtgattgct

SEQ ID NO: 1784523 - DNA, 18 bp, Homo sapiens
gctgtgatttgctgtgta

SEQ ID NO: 1784524 - DNA, 16 bp, Homo sapiens
gctgtgcagctctcta

SEQ ID NO: 1784525 - DNA, 23 bp, Homo sapiens
gctgtgcccagcaggcccagcat

SEQ ID NO: 1784526 - DNA, 16 bp, Homo sapiens
gctgtgcccctgatgc

SEQ ID NO: 1784527 - DNA, 13 bp, Homo sapiens
gctgtgcctgcta

SEQ ID NO: 1784528 - DNA, 15 bp, Homo sapiens
gctgtgcctgctcag

SEQ ID NO: 1784529 - DNA, 20 bp, Homo sapiens
gctgtgcctgctcagcagcc

SEQ ID NO: 1784530 - DNA, 13 bp, Homo sapiens
gctgtgctctggc

SEQ ID NO: 1784531 - DNA, 12 bp, Homo sapiens
gctgtggaccgt

SEQ ID NO: 1784532 - DNA, 14 bp, Homo sapiens
gctgtggactgtcc

SEQ ID NO: 1784533 - DNA, 12 bp, Homo sapiens
gctgtggaggcc

SEQ ID NO: 1784534 - DNA, 13 bp, Homo sapiens
gctgtggaggcct

SEQ ID NO: 1784535 - DNA, 13 bp, Homo sapiens
gctgtggcacaga

SEQ ID NO: 1784536 - DNA, 15 bp, Homo sapiens
gctgtggcacagact

SEQ ID NO: 1784537 - DNA, 20 bp, Homo sapiens
gctgtggcagccgtcccagg

SEQ ID NO: 1784538 - DNA, 21 bp, Homo sapiens
gctgtggcagccgtcccaggc

SEQ ID NO: 1784539 - DNA, 23 bp, Homo sapiens
gctgtggcagccgtcccaggcca

SEQ ID NO: 1784540 - DNA, 21 bp, Homo sapiens
gctgtggcatgggtgaagagg

SEQ ID NO: 1784541 - DNA, 18 bp, Homo sapiens
gctgtggcatttccaaac

SEQ ID NO: 1784542 - DNA, 21 bp, Homo sapiens
gctgtggccgcacgcctctcc

SEQ ID NO: 1784543 - DNA, 15 bp, Homo sapiens
gctgtggcctgggca

SEQ ID NO: 1784544 - DNA, 12 bp, Homo sapiens
gctgtggctcca

SEQ ID NO: 1784545 - DNA, 16 bp, Homo sapiens
gctgtggctggaggag

SEQ ID NO: 1784546 - DNA, 18 bp, Homo sapiens
gctgtgggcaagcctaag

SEQ ID NO: 1784547 - DNA, 17 bp, Homo sapiens
gctgtgggcaattgtta

SEQ ID NO: 1784548 - DNA, 12 bp, Homo sapiens
gctgtgggcctc

SEQ ID NO: 1784549 - DNA, 18 bp, Homo sapiens
gctgtggggaacacagct

SEQ ID NO: 1784550 - DNA, 19 bp, Homo sapiens
gctgtggggaacacagcta

SEQ ID NO: 1784551 - DNA, 21 bp, Homo sapiens
gctgtggggaacacagctaca

SEQ ID NO: 1784552 - DNA, 17 bp, Homo sapiens
gctgtggggctacagga

SEQ ID NO: 1784553 - DNA, 15 bp, Homo sapiens
gcttaaggtttgttt

SEQ ID NO: 1784554 - DNA, 19 bp, Homo sapiens
gcttaagtgagcagaacag

SEQ ID NO: 1784555 - DNA, 15 bp, Homo sapiens
gcttaatcattttca

SEQ ID NO: 1784556 - DNA, 15 bp, Homo sapiens
gcttaatctttgaaa

SEQ ID NO: 1784557 - DNA, 18 bp, Homo sapiens
gcttaatggagttcttgt

SEQ ID NO: 1784558 - DNA, 23 bp, Homo sapiens
gcttaattttctgtggatcattt

SEQ ID NO: 1784559 - DNA, 15 bp, Homo sapiens
gcttacactgaggac

SEQ ID NO: 1784560 - DNA, 17 bp, Homo sapiens
gcttacagtaactaatt

SEQ ID NO: 1784561 - DNA, 18 bp, Homo sapiens
gcttacatttttacaata

SEQ ID NO: 1784562 - DNA, 19 bp, Homo sapiens
gcttacatttttacaataa

SEQ ID NO: 1784563 - DNA, 14 bp, Homo sapiens
gcttacccaagctg

SEQ ID NO: 1784564 - DNA, 12 bp, Homo sapiens
gcttacctgaca

SEQ ID NO: 1784565 - DNA, 14 bp, Homo sapiens
gcttactcattaaa

SEQ ID NO: 1784566 - DNA, 21 bp, Homo sapiens
gcttactgatatattttacaa

SEQ ID NO: 1784567 - DNA, 15 bp, Homo sapiens
gcttagaaactggaa

SEQ ID NO: 1784568 - DNA, 21 bp, Homo sapiens
gcttagacttcgactcaggat

SEQ ID NO: 1784569 - DNA, 23 bp, Homo sapiens
gcttagacttcgactcaggatcc

SEQ ID NO: 1784570 - DNA, 18 bp, Homo sapiens
gcttagagttcttctttc

SEQ ID NO: 1784571 - DNA, 12 bp, Homo sapiens
gcttagccttgt

SEQ ID NO: 1784572 - DNA, 17 bp, Homo sapiens
gcttagccttgtgccct

SEQ ID NO: 1784573 - DNA, 18 bp, Homo sapiens
gcttagccttgtgccctg

SEQ ID NO: 1784574 - DNA, 22 bp, Homo sapiens
gcttaggatgtgtgcatgtgtg

SEQ ID NO: 1784575 - DNA, 19 bp, Homo sapiens
gcttagtaagtatttccat

SEQ ID NO: 1784576 - DNA, 17 bp, Homo sapiens
gcttagtatttctcagg

SEQ ID NO: 1784577 - DNA, 19 bp, Homo sapiens
gcttagtatttctcaggaa

SEQ ID NO: 1784578 - DNA, 18 bp, Homo sapiens
gcttataacctagttaaa

SEQ ID NO: 1784579 - DNA, 11 bp, Homo sapiens
gcttatatctg

SEQ ID NO: 1784580 - DNA, 15 bp, Homo sapiens
gcttatatctggcct

SEQ ID NO: 1784581 - DNA, 15 bp, Homo sapiens
gcttatatgtacttt

SEQ ID NO: 1784582 - DNA, 22 bp, Homo sapiens
gcttatctctgaagatctaaac

SEQ ID NO: 1784583 - DNA, 22 bp, Homo sapiens
gcttatgacatcacttgtacaa

SEQ ID NO: 1784584 - DNA, 16 bp, Homo sapiens
gcttatgtctctgcct

SEQ ID NO: 1784585 - DNA, 17 bp, Homo sapiens
gcttattgtgtgcgctg

SEQ ID NO: 1784586 - DNA, 16 bp, Homo sapiens
gcttattgtttctctg

SEQ ID NO: 1784587 - DNA, 19 bp, Homo sapiens
gcttatttctatgacaaat

SEQ ID NO: 1784588 - DNA, 14 bp, Homo sapiens
gcttattttattat

SEQ ID NO: 1784589 - DNA, 15 bp, Homo sapiens
gcttatttttctgtg

SEQ ID NO: 1784590 - DNA, 19 bp, Homo sapiens
gcttatttttctgtgaata

SEQ ID NO: 1784591 - DNA, 16 bp, Homo sapiens
gcttatttttttctac

SEQ ID NO: 1784592 - DNA, 18 bp, Homo sapiens
gcttcaaccctcagcctt

SEQ ID NO: 1784593 - DNA, 21 bp, Homo sapiens
gcttcaagtgttgctcttgga

SEQ ID NO: 1784594 - DNA, 16 bp, Homo sapiens
gcttcaataaatcttt

SEQ ID NO: 1784595 - DNA, 18 bp, Homo sapiens
gcttcaatataagaagca

SEQ ID NO: 1784596 - DNA, 23 bp, Homo sapiens
gcttcaccagtctgtctactgtg

SEQ ID NO: 1784597 - DNA, 22 bp, Homo sapiens
gcttcaccctgaatggttccat

SEQ ID NO: 1784598 - DNA, 13 bp, Homo sapiens
gcttcactgacca

SEQ ID NO: 1784599 - DNA, 17 bp, Homo sapiens
gcttcagagcctagcca

SEQ ID NO: 1784600 - DNA, 14 bp, Homo sapiens
gcttcagccaggag

SEQ ID NO: 1784601 - DNA, 19 bp, Homo sapiens
gcttcagccaggagctggg

SEQ ID NO: 1784602 - DNA, 16 bp, Homo sapiens
gcttcagcccccacca

SEQ ID NO: 1784603 - DNA, 23 bp, Homo sapiens
gcttcagtacttgtgaaacacag

SEQ ID NO: 1784604 - DNA, 18 bp, Homo sapiens
gcttcagttcagctttaa

SEQ ID NO: 1784605 - DNA, 22 bp, Homo sapiens
gcttcataaatgaagcagcttt

SEQ ID NO: 1784606 - DNA, 14 bp, Homo sapiens
gcttcatgccagct

SEQ ID NO: 1784607 - DNA, 13 bp, Homo sapiens
gcttcatgccttt

SEQ ID NO: 1784608 - DNA, 15 bp, Homo sapiens
gcttcatgcctttgt

SEQ ID NO: 1784609 - DNA, 17 bp, Homo sapiens
gcttcatgcctttgtaa

SEQ ID NO: 1784610 - DNA, 19 bp, Homo sapiens
gcttctaccatgaacagaa

SEQ ID NO: 1784611 - DNA, 16 bp, Homo sapiens
gcttctactttcatct

SEQ ID NO: 1784612 - DNA, 23 bp, Homo sapiens
gcttctagcttagtgctatgtgt

SEQ ID NO: 1784613 - DNA, 18 bp, Homo sapiens
gcttctataattttgcct

SEQ ID NO: 1784614 - DNA, 14 bp, Homo sapiens
gcttctatcccagg

SEQ ID NO: 1784615 - DNA, 19 bp, Homo sapiens
gcttctcaaagtactggga

SEQ ID NO: 1784616 - DNA, 12 bp, Homo sapiens
gcttctccacct

SEQ ID NO: 1784617 - DNA, 13 bp, Homo sapiens
gcttctccacctc

SEQ ID NO: 1784618 - DNA, 15 bp, Homo sapiens
gcttctccgccagcc

SEQ ID NO: 1784619 - DNA, 17 bp, Homo sapiens
gcttctccttctccttc

SEQ ID NO: 1784620 - DNA, 20 bp, Homo sapiens
gcttctcggggtccagtgca

SEQ ID NO: 1784621 - DNA, 12 bp, Homo sapiens
gcttctctcttt

SEQ ID NO: 1784622 - DNA, 16 bp, Homo sapiens
gcttctctcttttcct

SEQ ID NO: 1784623 - DNA, 17 bp, Homo sapiens
gcttctctgggctgaat

SEQ ID NO: 1784624 - DNA, 19 bp, Homo sapiens
gcttctctgtgaacgattt

SEQ ID NO: 1784625 - DNA, 17 bp, Homo sapiens
gcttctcttttgaaagt

SEQ ID NO: 1784626 - DNA, 13 bp, Homo sapiens
gcttctgaactca

SEQ ID NO: 1784627 - DNA, 18 bp, Homo sapiens
gcttctgagagcaaaggg

SEQ ID NO: 1784628 - DNA, 13 bp, Homo sapiens
gcttctgcaccct

SEQ ID NO: 1784629 - DNA, 18 bp, Homo sapiens
gcttctgcaccctccacc

SEQ ID NO: 1784630 - DNA, 13 bp, Homo sapiens
gcttctgctgccc

SEQ ID NO: 1784631 - DNA, 16 bp, Homo sapiens
gcttctgcttttctgc

SEQ ID NO: 1784632 - DNA, 20 bp, Homo sapiens
gcttctggaatttgttcaag

SEQ ID NO: 1784633 - DNA, 20 bp, Homo sapiens
gcttctggttttcgaagact

SEQ ID NO: 1784634 - DNA, 23 bp, Homo sapiens
gcttctgtcttatttgaaggcca

SEQ ID NO: 1784635 - DNA, 17 bp, Homo sapiens
gcttctgtgatgagctg

SEQ ID NO: 1784636 - DNA, 20 bp, Homo sapiens
gcttctgtgcactagcctgt

SEQ ID NO: 1784637 - DNA, 20 bp, Homo sapiens
gcttcttactattaagcagt

SEQ ID NO: 1784638 - DNA, 18 bp, Homo sapiens
gcttcttactgataattt

SEQ ID NO: 1784639 - DNA, 21 bp, Homo sapiens
gcttcttattaatcatacaaa

SEQ ID NO: 1784640 - DNA, 18 bp, Homo sapiens
gcttcttcacaggcactc

SEQ ID NO: 1784641 - DNA, 14 bp, Homo sapiens
gcttcttcccctct

SEQ ID NO: 1784642 - DNA, 13 bp, Homo sapiens
gcttcttgcctct

SEQ ID NO: 1784643 - DNA, 16 bp, Homo sapiens
gcttcttgcctctgtg

SEQ ID NO: 1784644 - DNA, 12 bp, Homo sapiens
gcttctttctag

SEQ ID NO: 1784645 - DNA, 21 bp, Homo sapiens
gcttctttctagaaagagaaa

SEQ ID NO: 1784646 - DNA, 19 bp, Homo sapiens
gcttgaaaagctagtgtac

SEQ ID NO: 1784647 - DNA, 23 bp, Homo sapiens
gcttgaacctgggaggcagaggt

SEQ ID NO: 1784648 - DNA, 20 bp, Homo sapiens
gcttgaactaggctgagcaa

SEQ ID NO: 1784649 - DNA, 11 bp, Homo sapiens
gcttgaagcca

SEQ ID NO: 1784650 - DNA, 16 bp, Homo sapiens
gcttgaagccaaagaa

SEQ ID NO: 1784651 - DNA, 15 bp, Homo sapiens
gcttgaaggccctgc

SEQ ID NO: 1784652 - DNA, 15 bp, Homo sapiens
gcttgacacctgtct

SEQ ID NO: 1784653 - DNA, 20 bp, Homo sapiens
gcttgacacctgtcttgaat

SEQ ID NO: 1784654 - DNA, 13 bp, Homo sapiens
gcttgacatacct

SEQ ID NO: 1784655 - DNA, 20 bp, Homo sapiens
gcttgaccaggcttggcctt

SEQ ID NO: 1784656 - DNA, 23 bp, Homo sapiens
gcttgactcaggatttaaaaact

SEQ ID NO: 1784657 - DNA, 17 bp, Homo sapiens
gcttgactcccaagttt

SEQ ID NO: 1784658 - DNA, 13 bp, Homo sapiens
gcttgactgcttt

SEQ ID NO: 1784659 - DNA, 21 bp, Homo sapiens
gcttgagagggcaaacccaaa

SEQ ID NO: 1784660 - DNA, 16 bp, Homo sapiens
gcttgagcccaggagt

SEQ ID NO: 1784661 - DNA, 17 bp, Homo sapiens
gcttgagccgggcccct

SEQ ID NO: 1784662 - DNA, 14 bp, Homo sapiens
gcttgagctagaga

SEQ ID NO: 1784663 - DNA, 23 bp, Homo sapiens
gcttgagctagagataaaacaga

SEQ ID NO: 1784664 - DNA, 12 bp, Homo sapiens
gcttgagctcag

SEQ ID NO: 1784665 - DNA, 21 bp, Homo sapiens
gcttgaggccaagatggctgc

SEQ ID NO: 1784666 - DNA, 22 bp, Homo sapiens
gcttgaggccaagatggctgct

SEQ ID NO: 1784667 - DNA, 14 bp, Homo sapiens
gcttgatttttgcc

SEQ ID NO: 1784668 - DNA, 23 bp, Homo sapiens
gcttgcacagccaacgagacaca

SEQ ID NO: 1784669 - DNA, 15 bp, Homo sapiens
gcttgccaaggcaga

SEQ ID NO: 1784670 - DNA, 12 bp, Homo sapiens
ggaatacagtgt

SEQ ID NO: 1784671 - DNA, 22 bp, Homo sapiens
ggaatacatattccatgggact

SEQ ID NO: 1784672 - DNA, 17 bp, Homo sapiens
ggaatagccagagagga

SEQ ID NO: 1784673 - DNA, 21 bp, Homo sapiens
ggaatagccagagaggagcac

SEQ ID NO: 1784674 - DNA, 20 bp, Homo sapiens
ggaatagtgcttgctggcca

SEQ ID NO: 1784675 - DNA, 20 bp, Homo sapiens
ggaatagttgagccccaagt

SEQ ID NO: 1784676 - DNA, 15 bp, Homo sapiens
ggaatataaaacagt

SEQ ID NO: 1784677 - DNA, 15 bp, Homo sapiens
ggaatataccttttt

SEQ ID NO: 1784678 - DNA, 14 bp, Homo sapiens
ggaatattgtgatt

SEQ ID NO: 1784679 - DNA, 22 bp, Homo sapiens
ggaatcaagatgtcagactggc

SEQ ID NO: 1784680 - DNA, 23 bp, Homo sapiens
ggaatcagacttcacactgcaag

SEQ ID NO: 1784681 - DNA, 16 bp, Homo sapiens
ggaatccgtgtgtgtg

SEQ ID NO: 1784682 - DNA, 18 bp, Homo sapiens
ggaatcctttgagaatgt

SEQ ID NO: 1784683 - DNA, 13 bp, Homo sapiens
ggaatctggatta

SEQ ID NO: 1784684 - DNA, 15 bp, Homo sapiens
ggaatctgtttctct

SEQ ID NO: 1784685 - DNA, 16 bp, Homo sapiens
ggaatcttcacctcag

SEQ ID NO: 1784686 - DNA, 21 bp, Homo sapiens
ggaatctttgtaccaaaattt

SEQ ID NO: 1784687 - DNA, 21 bp, Homo sapiens
ggaatgaggtgggaggtggaa

SEQ ID NO: 1784688 - DNA, 13 bp, Homo sapiens
ggaatgcagaggt

SEQ ID NO: 1784689 - DNA, 12 bp, Homo sapiens
ggaatgcaggga

SEQ ID NO: 1784690 - DNA, 18 bp, Homo sapiens
ggaatgcagggaagaggg

SEQ ID NO: 1784691 - DNA, 15 bp, Homo sapiens
ggaatgccgctgtct

SEQ ID NO: 1784692 - DNA, 15 bp, Homo sapiens
ggaatgcctgtgcca

SEQ ID NO: 1784693 - DNA, 22 bp, Homo sapiens
ggaatgcggccgcattccctga

SEQ ID NO: 1784694 - DNA, 23 bp, Homo sapiens
ggaatgctgcccgctctgcagac

SEQ ID NO: 1784695 - DNA, 17 bp, Homo sapiens
ggaatggaactactgta

SEQ ID NO: 1784696 - DNA, 20 bp, Homo sapiens
ggaatggatttttctttaac

SEQ ID NO: 1784697 - DNA, 16 bp, Homo sapiens
ggaatgggggcctctt

SEQ ID NO: 1784698 - DNA, 19 bp, Homo sapiens
ggaatgtcagggccaggtg

SEQ ID NO: 1784699 - DNA, 20 bp, Homo sapiens
ggaatgtggtagtacccagg

SEQ ID NO: 1784700 - DNA, 18 bp, Homo sapiens
ggaccagggccaccgcag

SEQ ID NO: 1784701 - DNA, 15 bp, Homo sapiens
ggaccagtcccacac

SEQ ID NO: 1784702 - DNA, 19 bp, Homo sapiens
ggaccattgacctcagctg

SEQ ID NO: 1784703 - DNA, 22 bp, Homo sapiens
ggaccattgacctcagctgcac

SEQ ID NO: 1784704 - DNA, 19 bp, Homo sapiens
ggacccaatgtaggagctg

SEQ ID NO: 1784705 - DNA, 18 bp, Homo sapiens
ggacccaccaaactgcac

SEQ ID NO: 1784706 - DNA, 11 bp, Homo sapiens
ggacccacccc

SEQ ID NO: 1784707 - DNA, 14 bp, Homo sapiens
ggacccaccccaac

SEQ ID NO: 1784708 - DNA, 15 bp, Homo sapiens
ggacccaccccaact

SEQ ID NO: 1784709 - DNA, 18 bp, Homo sapiens
ggacccactacccttctc

SEQ ID NO: 1784710 - DNA, 22 bp, Homo sapiens
ggacccagcctcagatccaggc

SEQ ID NO: 1784711 - DNA, 21 bp, Homo sapiens
ggacccagctactctgtccag

SEQ ID NO: 1784712 - DNA, 22 bp, Homo sapiens
ggacccagctactctgtccagg

SEQ ID NO: 1784713 - DNA, 11 bp, Homo sapiens
ggacccaggcc

SEQ ID NO: 1784714 - DNA, 19 bp, Homo sapiens
ggacccaggtgtgcctgtg

SEQ ID NO: 1784715 - DNA, 16 bp, Homo sapiens
ggacccagtgcagaat

SEQ ID NO: 1784716 - DNA, 12 bp, Homo sapiens
ggaccccagcat

SEQ ID NO: 1784717 - DNA, 14 bp, Homo sapiens
ggaccccagctggg

SEQ ID NO: 1784718 - DNA, 22 bp, Homo sapiens
ggaccccgagaaccctgagcag

SEQ ID NO: 1784719 - DNA, 21 bp, Homo sapiens
ggacccctaatgtcagcttgg

SEQ ID NO: 1784720 - DNA, 14 bp, Homo sapiens
ggacccgccagccc

SEQ ID NO: 1784721 - DNA, 21 bp, Homo sapiens
ggacccgccagccccgctccc

SEQ ID NO: 1784722 - DNA, 19 bp, Homo sapiens
ggacccggcggccctgctg

SEQ ID NO: 1784723 - DNA, 20 bp, Homo sapiens
ggacccgggaccacagctgc

SEQ ID NO: 1784724 - DNA, 23 bp, Homo sapiens
ggacccgggaccacagctgctgg

SEQ ID NO: 1784725 - DNA, 17 bp, Homo sapiens
ggacccggggtctcctg

SEQ ID NO: 1784726 - DNA, 22 bp, Homo sapiens
ggacccggggtctcctggacct

SEQ ID NO: 1784727 - DNA, 23 bp, Homo sapiens
ggaccctgtgacatggtgcctga

SEQ ID NO: 1784728 - DNA, 21 bp, Homo sapiens
ggacccttcccttgagccctc

SEQ ID NO: 1784729 - DNA, 15 bp, Homo sapiens
ggaccgccatggtgc

SEQ ID NO: 1784730 - DNA, 21 bp, Homo sapiens
ggaccgggtgggcctggcctg

SEQ ID NO: 1784731 - DNA, 14 bp, Homo sapiens
ggaccggtgctgca

SEQ ID NO: 1784732 - DNA, 16 bp, Homo sapiens
ggaccggtgctgcagg

SEQ ID NO: 1784733 - DNA, 17 bp, Homo sapiens
ggaccggtgctgcagga

SEQ ID NO: 1784734 - DNA, 17 bp, Homo sapiens
ggaccgtggacaggccc

SEQ ID NO: 1784735 - DNA, 18 bp, Homo sapiens
ggaccgtggacaggccca

SEQ ID NO: 1784736 - DNA, 17 bp, Homo sapiens
ggacctatgtcctaagg

SEQ ID NO: 1784737 - DNA, 15 bp, Homo sapiens
ggacctccctgtctc

SEQ ID NO: 1784738 - DNA, 16 bp, Homo sapiens
ggacctgagagcatct

SEQ ID NO: 1784739 - DNA, 21 bp, Homo sapiens
ggacctgagcctggtcctggc

SEQ ID NO: 1784740 - DNA, 23 bp, Homo sapiens
ggacctgatttattgaaattttt

SEQ ID NO: 1784741 - DNA, 18 bp, Homo sapiens
ggacctgcatccttcctg

SEQ ID NO: 1784742 - DNA, 17 bp, Homo sapiens
ggacctggtaccctcct

SEQ ID NO: 1784743 - DNA, 16 bp, Homo sapiens
ggacctgttttcttca

SEQ ID NO: 1784744 - DNA, 18 bp, Homo sapiens
ggaccttaggccttcctc

SEQ ID NO: 1784745 - DNA, 18 bp, Homo sapiens
ggaccttgacagagcagc

SEQ ID NO: 1784746 - DNA, 18 bp, Homo sapiens
ggaccttggagagctcag

SEQ ID NO: 1784747 - DNA, 23 bp, Homo sapiens
ggacctttaacttttttttctct

SEQ ID NO: 1784748 - DNA, 20 bp, Homo sapiens
ggacgaagcggagagagcca

SEQ ID NO: 1784749 - DNA, 22 bp, Homo sapiens
ggacgagacccccatccagcct

SEQ ID NO: 1784750 - DNA, 14 bp, Homo sapiens
ggacgcaggtgctg

SEQ ID NO: 1784751 - DNA, 22 bp, Homo sapiens
ggacgcatgaaggtcactcgtg

SEQ ID NO: 1784752 - DNA, 19 bp, Homo sapiens
ggacgctccgctgccgtgc

SEQ ID NO: 1784753 - DNA, 15 bp, Homo sapiens
ggacgctttgtctgt

SEQ ID NO: 1784754 - DNA, 15 bp, Homo sapiens
ggacggatgggccct

SEQ ID NO: 1784755 - DNA, 17 bp, Homo sapiens
ggacggccaagaatgta

SEQ ID NO: 1784756 - DNA, 21 bp, Homo sapiens
ggacggcctgatgctccctcc

SEQ ID NO: 1784757 - DNA, 12 bp, Homo sapiens
ggacggctgtgg

SEQ ID NO: 1784758 - DNA, 13 bp, Homo sapiens
ggacgggccacac

SEQ ID NO: 1784759 - DNA, 13 bp, Homo sapiens
ggacgggggctgc

SEQ ID NO: 1784760 - DNA, 18 bp, Homo sapiens
ggacgggggctgcttctc

SEQ ID NO: 1784761 - DNA, 17 bp, Homo sapiens
ggacgtcagacttggct

SEQ ID NO: 1784762 - DNA, 14 bp, Homo sapiens
ggacgtgaaatact

SEQ ID NO: 1784763 - DNA, 14 bp, Homo sapiens
ggacgttgttttgg

SEQ ID NO: 1784764 - DNA, 23 bp, Homo sapiens
ggacgtttctggaactgtctgaa

SEQ ID NO: 1784765 - DNA, 22 bp, Homo sapiens
ggactaaccccaacgcacagga

SEQ ID NO: 1784766 - DNA, 16 bp, Homo sapiens
ggactagagctttctt

SEQ ID NO: 1784767 - DNA, 20 bp, Homo sapiens
ggactatatttgggcctgct

SEQ ID NO: 1784768 - DNA, 23 bp, Homo sapiens
ggactatatttgggcctgctcca

SEQ ID NO: 1784769 - DNA, 14 bp, Homo sapiens
ggactatctttgct

SEQ ID NO: 1784770 - DNA, 14 bp, Homo sapiens
ggactattataatt

SEQ ID NO: 1784771 - DNA, 23 bp, Homo sapiens
ggactcaagaggaatctgtttct

SEQ ID NO: 1784772 - DNA, 14 bp, Homo sapiens
ggactcaagggaaa

SEQ ID NO: 1784773 - DNA, 14 bp, Homo sapiens
ggactcagccctga

SEQ ID NO: 1784774 - DNA, 15 bp, Homo sapiens
ggactcagccttcag

SEQ ID NO: 1784775 - DNA, 17 bp, Homo sapiens
ggactcagccttcagac

SEQ ID NO: 1784776 - DNA, 17 bp, Homo sapiens
ggactcaggatgcccag

SEQ ID NO: 1784777 - DNA, 19 bp, Homo sapiens
ggactcaggatgcccaggg

SEQ ID NO: 1784778 - DNA, 22 bp, Homo sapiens
ggactccatccacctcatcact

SEQ ID NO: 1784779 - DNA, 22 bp, Homo sapiens
ggactccatctctcatcctcca

SEQ ID NO: 1784780 - DNA, 18 bp, Homo sapiens
ggactcccaaccctggct

SEQ ID NO: 1784781 - DNA, 17 bp, Homo sapiens
ggactcccctccctgcc

SEQ ID NO: 1784782 - DNA, 21 bp, Homo sapiens
ggactctcccaggcctgcctg

SEQ ID NO: 1784783 - DNA, 16 bp, Homo sapiens
ggactctcctcctccc

SEQ ID NO: 1784784 - DNA, 13 bp, Homo sapiens
ggactctgaggct

SEQ ID NO: 1784785 - DNA, 21 bp, Homo sapiens
ggactctgaggctctttctgg

SEQ ID NO: 1784786 - DNA, 18 bp, Homo sapiens
ggactctggtgcctccag

SEQ ID NO: 1784787 - DNA, 16 bp, Homo sapiens
ggactgaagcctgcag

SEQ ID NO: 1784788 - DNA, 17 bp, Homo sapiens
ggactgaagcctgcagg

SEQ ID NO: 1784789 - DNA, 16 bp, Homo sapiens
ggactgaccaaagact

SEQ ID NO: 1784790 - DNA, 16 bp, Homo sapiens
ggagagactgagcagc

SEQ ID NO: 1784791 - DNA, 22 bp, Homo sapiens
ggagagagaggctgcctcagcc

SEQ ID NO: 1784792 - DNA, 12 bp, Homo sapiens
ggagagagccag

SEQ ID NO: 1784793 - DNA, 14 bp, Homo sapiens
ggagagagggactc

SEQ ID NO: 1784794 - DNA, 14 bp, Homo sapiens
ggagagaggggaat

SEQ ID NO: 1784795 - DNA, 13 bp, Homo sapiens
ggagagcagcagg

SEQ ID NO: 1784796 - DNA, 11 bp, Homo sapiens
ggagagccagc

SEQ ID NO: 1784797 - DNA, 12 bp, Homo sapiens
ggagagccagcc

SEQ ID NO: 1784798 - DNA, 15 bp, Homo sapiens
ggagagccccatggt

SEQ ID NO: 1784799 - DNA, 14 bp, Homo sapiens
ggagagcggctgga

SEQ ID NO: 1784800 - DNA, 17 bp, Homo sapiens
ggagagcggctggagaa

SEQ ID NO: 1784801 - DNA, 14 bp, Homo sapiens
ggagagctgagcca

SEQ ID NO: 1784802 - DNA, 11 bp, Homo sapiens
ggagaggagac

SEQ ID NO: 1784803 - DNA, 22 bp, Homo sapiens
ggagaggcagcatgcttgggct

SEQ ID NO: 1784804 - DNA, 14 bp, Homo sapiens
ggagagggaatgtg

SEQ ID NO: 1784805 - DNA, 12 bp, Homo sapiens
ggagaggggggc

SEQ ID NO: 1784806 - DNA, 17 bp, Homo sapiens
ggagaggggtgcaccca

SEQ ID NO: 1784807 - DNA, 21 bp, Homo sapiens
ggagaggggtgcacccactca

SEQ ID NO: 1784808 - DNA, 18 bp, Homo sapiens
ggagagggtctggagaag

SEQ ID NO: 1784809 - DNA, 20 bp, Homo sapiens
ggaggcgggggctgcccttg

SEQ ID NO: 1784810 - DNA, 20 bp, Homo sapiens
ggaggctacctcacctgggc

SEQ ID NO: 1784811 - DNA, 22 bp, Homo sapiens
ggaggctcctgcctgagcttcc

SEQ ID NO: 1784812 - DNA, 14 bp, Homo sapiens
ggaggctgaggcag

SEQ ID NO: 1784813 - DNA, 15 bp, Homo sapiens
ggaggctgaggcaga

SEQ ID NO: 1784814 - DNA, 16 bp, Homo sapiens
ggaggctgaggcagaa

SEQ ID NO: 1784815 - DNA, 19 bp, Homo sapiens
ggaggctgaggcaggagga

SEQ ID NO: 1784816 - DNA, 13 bp, Homo sapiens
ggaggctgaggcg

SEQ ID NO: 1784817 - DNA, 19 bp, Homo sapiens
ggaggctgaggtgggcaga

SEQ ID NO: 1784818 - DNA, 16 bp, Homo sapiens
ggagttctatgctctc

SEQ ID NO: 1784819 - DNA, 23 bp, Homo sapiens
ggagttgaggtgtcagagaaaat

SEQ ID NO: 1784820 - DNA, 21 bp, Homo sapiens
ggagttgatctggaacccaga

SEQ ID NO: 1784821 - DNA, 13 bp, Homo sapiens
ggagttgcctgac

SEQ ID NO: 1784822 - DNA, 19 bp, Homo sapiens
ggagtttaatacaggaaat

SEQ ID NO: 1784823 - DNA, 15 bp, Homo sapiens
ggatgggctcccacc

SEQ ID NO: 1784824 - DNA, 18 bp, Homo sapiens
ggatgggctcccaccctc

SEQ ID NO: 1784825 - DNA, 17 bp, Homo sapiens
ggatgggggaactcaga

SEQ ID NO: 1784826 - DNA, 21 bp, Homo sapiens
ggatgggggaactcagatcca

SEQ ID NO: 1784827 - DNA, 16 bp, Homo sapiens
ggatgggtggatggcc

SEQ ID NO: 1784828 - DNA, 22 bp, Homo sapiens
ggatggtcctggggctctgtgc

SEQ ID NO: 1784829 - DNA, 20 bp, Homo sapiens
ggatggtctcgatctcctga

SEQ ID NO: 1784830 - DNA, 13 bp, Homo sapiens
ggatggtgcccct

SEQ ID NO: 1784831 - DNA, 12 bp, Homo sapiens
ggatggtgtctc

SEQ ID NO: 1784832 - DNA, 17 bp, Homo sapiens
ggatggtttgagctcag

SEQ ID NO: 1784833 - DNA, 18 bp, Homo sapiens
ggatgtaaacagtgcctg

SEQ ID NO: 1784834 - DNA, 13 bp, Homo sapiens
ggatgtaaatcct

SEQ ID NO: 1784835 - DNA, 18 bp, Homo sapiens
ggatgtagagagaacagg

SEQ ID NO: 1784836 - DNA, 14 bp, Homo sapiens
ggatgtataaattt

SEQ ID NO: 1784837 - DNA, 16 bp, Homo sapiens
ggatgtatggggaatc

SEQ ID NO: 1784838 - DNA, 14 bp, Homo sapiens
ggatgtcagacaat

SEQ ID NO: 1784839 - DNA, 21 bp, Homo sapiens
ggatgtcatagccaaagccag

SEQ ID NO: 1784840 - DNA, 17 bp, Homo sapiens
ggatgtcccctgtccca

SEQ ID NO: 1784841 - DNA, 21 bp, Homo sapiens
ggatgtgggtaagaggagcag

SEQ ID NO: 1784842 - DNA, 13 bp, Homo sapiens
ggatgtgtgcatg

SEQ ID NO: 1784843 - DNA, 18 bp, Homo sapiens
ggatgttatgaacagctg

SEQ ID NO: 1784844 - DNA, 20 bp, Homo sapiens
ggatgttcagcactgtccct

SEQ ID NO: 1784845 - DNA, 18 bp, Homo sapiens
ggattaagaaaccttgct

SEQ ID NO: 1784846 - DNA, 20 bp, Homo sapiens
ggattaagaaaccttgctct

SEQ ID NO: 1784847 - DNA, 19 bp, Homo sapiens
ggattatgggtcacaggaa

SEQ ID NO: 1784848 - DNA, 21 bp, Homo sapiens
ggattatgttatacaaggcaa

SEQ ID NO: 1784849 - DNA, 17 bp, Homo sapiens
ggattattcatttaaaa

SEQ ID NO: 1784850 - DNA, 21 bp, Homo sapiens
ggattattcatttaaaatgat

SEQ ID NO: 1784851 - DNA, 12 bp, Homo sapiens
ggattattttct

SEQ ID NO: 1784852 - DNA, 15 bp, Homo sapiens
ggattcatttcctgc

SEQ ID NO: 1784853 - DNA, 15 bp, Homo sapiens
ggattccagtgcatg

SEQ ID NO: 1784854 - DNA, 15 bp, Homo sapiens
ggattcctgacccag

SEQ ID NO: 1784855 - DNA, 16 bp, Homo sapiens
ggattcctgacccagg

SEQ ID NO: 1784856 - DNA, 15 bp, Homo sapiens
ggattctaaatacat

SEQ ID NO: 1784857 - DNA, 16 bp, Homo sapiens
ggattctctaaccttt

SEQ ID NO: 1784858 - DNA, 21 bp, Homo sapiens
ggattctgaggccctgcccaa

SEQ ID NO: 1784859 - DNA, 15 bp, Homo sapiens
ggattctggatggcc

SEQ ID NO: 1784860 - DNA, 21 bp, Homo sapiens
ggattcttcccgctccccacc

SEQ ID NO: 1784861 - DNA, 15 bp, Homo sapiens
ggattctttccccag

SEQ ID NO: 1784862 - DNA, 17 bp, Homo sapiens
ggattgaggggccctgg

SEQ ID NO: 1784863 - DNA, 17 bp, Homo sapiens
ggattgattttaaaatg

SEQ ID NO: 1784864 - DNA, 17 bp, Homo sapiens
ggattgcacgtggcctc

SEQ ID NO: 1784865 - DNA, 16 bp, Homo sapiens
ggattgctatgaatga

SEQ ID NO: 1784866 - DNA, 22 bp, Homo sapiens
ggattggacaggagatcagcag

SEQ ID NO: 1784867 - DNA, 22 bp, Homo sapiens
ggattggccaaacatcagacct

SEQ ID NO: 1784868 - DNA, 20 bp, Homo sapiens
ggattgtatcaagtggcatg

SEQ ID NO: 1784869 - DNA, 13 bp, Homo sapiens
ggattgtggaaaa

SEQ ID NO: 1784870 - DNA, 18 bp, Homo sapiens
ggatttaaaaactggaac

SEQ ID NO: 1784871 - DNA, 16 bp, Homo sapiens
ggatttaaaagcctgc

SEQ ID NO: 1784872 - DNA, 17 bp, Homo sapiens
ggatttaaaagcctgct

SEQ ID NO: 1784873 - DNA, 17 bp, Homo sapiens
ggatttaagcaaaggct

SEQ ID NO: 1784874 - DNA, 22 bp, Homo sapiens
ggatttaagcaaaggctccctc

SEQ ID NO: 1784875 - DNA, 11 bp, Homo sapiens
ggatttcattt

SEQ ID NO: 1784876 - DNA, 22 bp, Homo sapiens
ggatttgccccttcccatctct

SEQ ID NO: 1784877 - DNA, 15 bp, Homo sapiens
ggatttgttgccatg

SEQ ID NO: 1784878 - DNA, 17 bp, Homo sapiens
ggattttaatttcagga

SEQ ID NO: 1784879 - DNA, 15 bp, Homo sapiens
ggattttaccaaagc

SEQ ID NO: 1784880 - DNA, 16 bp, Homo sapiens
ggattttaccaaagca

SEQ ID NO: 1784881 - DNA, 17 bp, Homo sapiens
ggattttaccaaagcat

SEQ ID NO: 1784882 - DNA, 15 bp, Homo sapiens
ggcaaaaaaattaaa

SEQ ID NO: 1784883 - DNA, 22 bp, Homo sapiens
ggcaaaaagaatcccaatgttt

SEQ ID NO: 1784884 - DNA, 12 bp, Homo sapiens
ggcaaaactcta

SEQ ID NO: 1784885 - DNA, 18 bp, Homo sapiens
ggcaaaactttggcactg

SEQ ID NO: 1784886 - DNA, 17 bp, Homo sapiens
ggcaaacatttgaagga

SEQ ID NO: 1784887 - DNA, 22 bp, Homo sapiens
ggcaaacattttctcttagaaa

SEQ ID NO: 1784888 - DNA, 22 bp, Homo sapiens
ggcaaagcacgaaatgttattt

SEQ ID NO: 1784889 - DNA, 17 bp, Homo sapiens
ggcaaaggaaggtggat

SEQ ID NO: 1784890 - DNA, 21 bp, Homo sapiens
ggcaaagggagcagaactgaa

SEQ ID NO: 1784891 - DNA, 19 bp, Homo sapiens
ggcaaagtacattgtaaaa

SEQ ID NO: 1784892 - DNA, 23 bp, Homo sapiens
ggcaaagttttacagagaggata

SEQ ID NO: 1784893 - DNA, 18 bp, Homo sapiens
ggcaaatgacatgcactg

SEQ ID NO: 1784894 - DNA, 21 bp, Homo sapiens
ggcaaatgacatgcactgacc

SEQ ID NO: 1784895 - DNA, 23 bp, Homo sapiens
ggcaaattattttaatattttgt

SEQ ID NO: 1784896 - DNA, 24 bp, Homo sapiens
ggcaacaacagcttcagtccatgg

SEQ ID NO: 1784897 - DNA, 17 bp, Homo sapiens
ggcaacactgctgtcca

SEQ ID NO: 1784898 - DNA, 18 bp, Homo sapiens
ggcaacactgctgtccac

SEQ ID NO: 1784899 - DNA, 15 bp, Homo sapiens
ggcaacagatctgga

SEQ ID NO: 1784900 - DNA, 13 bp, Homo sapiens
ggcaacagatgaa

SEQ ID NO: 1784901 - DNA, 14 bp, Homo sapiens
ggcaacatctttat

SEQ ID NO: 1784902 - DNA, 19 bp, Homo sapiens
ggcaaccactaagaattca

SEQ ID NO: 1784903 - DNA, 13 bp, Homo sapiens
ggcaaccagccag

SEQ ID NO: 1784904 - DNA, 17 bp, Homo sapiens
ggcaaccagccagcgtc

SEQ ID NO: 1784905 - DNA, 15 bp, Homo sapiens
ggcaacctcccatcc

SEQ ID NO: 1784906 - DNA, 16 bp, Homo sapiens
ggcaacgtagcctggg

SEQ ID NO: 1784907 - DNA, 19 bp, Homo sapiens
ggcaacgtgcgtgtctctg

SEQ ID NO: 1784908 - DNA, 21 bp, Homo sapiens
ggcaacgtgtgaactgcaaca

SEQ ID NO: 1784909 - DNA, 23 bp, Homo sapiens
ggcaactctggctccaggcagaa

SEQ ID NO: 1784910 - DNA, 14 bp, Homo sapiens
ggcaactgaggcag

SEQ ID NO: 1784911 - DNA, 15 bp, Homo sapiens
ggcaactgaggcaga

SEQ ID NO: 1784912 - DNA, 19 bp, Homo sapiens
ggcaactgaggcagacagc

SEQ ID NO: 1784913 - DNA, 14 bp, Homo sapiens
ggcaagaaaaggac

SEQ ID NO: 1784914 - DNA, 21 bp, Homo sapiens
ggcaagacagaaaagtgcctg

SEQ ID NO: 1784915 - DNA, 22 bp, Homo sapiens
ggcaagacctcttccctctggg

SEQ ID NO: 1784916 - DNA, 23 bp, Homo sapiens
ggcaagacctcttccctctgggc

SEQ ID NO: 1784917 - DNA, 16 bp, Homo sapiens
ggcaagagggggtgga

SEQ ID NO: 1784918 - DNA, 16 bp, Homo sapiens
ggcaagagtgttcttt

SEQ ID NO: 1784919 - DNA, 12 bp, Homo sapiens
ggcaagcaggga

SEQ ID NO: 1784920 - DNA, 15 bp, Homo sapiens
ggcaagcccctcagc

SEQ ID NO: 1784921 - DNA, 19 bp, Homo sapiens
ggcaagcgcttctgctgaa

SEQ ID NO: 1784922 - DNA, 14 bp, Homo sapiens
ggcaagcttgaggc

SEQ ID NO: 1784923 - DNA, 11 bp, Homo sapiens
ggcaaggaaag

SEQ ID NO: 1784924 - DNA, 23 bp, Homo sapiens
ggcaaggagtttattacaatgta

SEQ ID NO: 1784925 - DNA, 12 bp, Homo sapiens
ggcaaggcaggt

SEQ ID NO: 1784926 - DNA, 14 bp, Homo sapiens
ggcaaggcaggtgc

SEQ ID NO: 1784927 - DNA, 17 bp, Homo sapiens
ggcaaggggctggctgg

SEQ ID NO: 1784928 - DNA, 16 bp, Homo sapiens
ggcaagtcacttaact

SEQ ID NO: 1784929 - DNA, 13 bp, Homo sapiens
ggcaagtgtgggc

SEQ ID NO: 1784930 - DNA, 16 bp, Homo sapiens
ggcaagttttccctga

SEQ ID NO: 1784931 - DNA, 18 bp, Homo sapiens
ggcaatgtcaggaacaga

SEQ ID NO: 1784932 - DNA, 18 bp, Homo sapiens
ggcaattttagtgtatta

SEQ ID NO: 1784933 - DNA, 14 bp, Homo sapiens
ggcacacaccacca

SEQ ID NO: 1784934 - DNA, 13 bp, Homo sapiens
ggcacacacctgt

SEQ ID NO: 1784935 - DNA, 18 bp, Homo sapiens
ggcacacagagattctgg

SEQ ID NO: 1784936 - DNA, 17 bp, Homo sapiens
ggcacaccactgccctg

SEQ ID NO: 1784937 - DNA, 18 bp, Homo sapiens
ggcacaccactgccctgc

SEQ ID NO: 1784938 - DNA, 13 bp, Homo sapiens
ggcagattgaaaa

SEQ ID NO: 1784939 - DNA, 21 bp, Homo sapiens
ggcagattttacaaaagatgt

SEQ ID NO: 1784940 - DNA, 17 bp, Homo sapiens
ggcagattttcatgcaa

SEQ ID NO: 1784941 - DNA, 13 bp, Homo sapiens
ggcagcaaggctg

SEQ ID NO: 1784942 - DNA, 22 bp, Homo sapiens
ggcagcaaggctgctgccggaa

SEQ ID NO: 1784943 - DNA, 15 bp, Homo sapiens
ggcagcaagggacct

SEQ ID NO: 1784944 - DNA, 16 bp, Homo sapiens
ggcagcaagggacctg

SEQ ID NO: 1784945 - DNA, 17 bp, Homo sapiens
ggcagcaccacactggg

SEQ ID NO: 1784946 - DNA, 24 bp, Homo sapiens
ggcagcactccccagagctgtgcc

SEQ ID NO: 1784947 - DNA, 13 bp, Homo sapiens
ggcagcagccagg

SEQ ID NO: 1784948 - DNA, 12 bp, Homo sapiens
ggcagcagcccc

SEQ ID NO: 1784949 - DNA, 13 bp, Homo sapiens
ggcagcagccccc

SEQ ID NO: 1784950 - DNA, 12 bp, Homo sapiens
ggcagcaggagc

SEQ ID NO: 1784951 - DNA, 14 bp, Homo sapiens
ggcagcaggaggag

SEQ ID NO: 1784952 - DNA, 17 bp, Homo sapiens
ggcagcatggagagcct

SEQ ID NO: 1784953 - DNA, 19 bp, Homo sapiens
ggcagccaaacccatgagg

SEQ ID NO: 1784954 - DNA, 13 bp, Homo sapiens
ggcagccacggcc

SEQ ID NO: 1784955 - DNA, 21 bp, Homo sapiens
ggcagccacggccccgggtcc

SEQ ID NO: 1784956 - DNA, 15 bp, Homo sapiens
ggcagccaggctgcc

SEQ ID NO: 1784957 - DNA, 19 bp, Homo sapiens
ggcagccaggctgccaagg

SEQ ID NO: 1784958 - DNA, 13 bp, Homo sapiens
ggcagccatgcct

SEQ ID NO: 1784959 - DNA, 21 bp, Homo sapiens
ggcagccatgcctcatgccac

SEQ ID NO: 1784960 - DNA, 13 bp, Homo sapiens
ggcagccctcacc

SEQ ID NO: 1784961 - DNA, 18 bp, Homo sapiens
ggcagccctcacctctga

SEQ ID NO: 1784962 - DNA, 22 bp, Homo sapiens
ggcagccctcacctctgaggac

SEQ ID NO: 1784963 - DNA, 21 bp, Homo sapiens
ggcagcccttgcttgttggga

SEQ ID NO: 1784964 - DNA, 12 bp, Homo sapiens
ggcagccgaggc

SEQ ID NO: 1784965 - DNA, 19 bp, Homo sapiens
ggcagccgaggcctggcca

SEQ ID NO: 1784966 - DNA, 20 bp, Homo sapiens
ggcagccgaggcctggccaa

SEQ ID NO: 1784967 - DNA, 23 bp, Homo sapiens
ggcagccgctaggagagactgaa

SEQ ID NO: 1784968 - DNA, 17 bp, Homo sapiens
ggcagccgtcccaggcc

SEQ ID NO: 1784969 - DNA, 18 bp, Homo sapiens
ggcagccgtcccaggcca

SEQ ID NO: 1784970 - DNA, 18 bp, Homo sapiens
ggcagccgtgccttcagc

SEQ ID NO: 1784971 - DNA, 15 bp, Homo sapiens
ggcagcctccagagc

SEQ ID NO: 1784972 - DNA, 17 bp, Homo sapiens
ggcagcctccagagcca

SEQ ID NO: 1784973 - DNA, 22 bp, Homo sapiens
ggcagcctccagagccagcctg

SEQ ID NO: 1784974 - DNA, 23 bp, Homo sapiens
ggcagcctccagagccagcctgg

SEQ ID NO: 1784975 - DNA, 15 bp, Homo sapiens
ggcagcctcctttgt

SEQ ID NO: 1784976 - DNA, 12 bp, Homo sapiens
ggcagcctctgt

SEQ ID NO: 1784977 - DNA, 20 bp, Homo sapiens
ggcagcctctgtcaggcctt

SEQ ID NO: 1784978 - DNA, 22 bp, Homo sapiens
ggcagcctggatccctgccctt

SEQ ID NO: 1784979 - DNA, 14 bp, Homo sapiens
ggcagcctggctcc

SEQ ID NO: 1784980 - DNA, 14 bp, Homo sapiens
ggcagcctgtgcct

SEQ ID NO: 1784981 - DNA, 15 bp, Homo sapiens
ggcagcgaccccagg

SEQ ID NO: 1784982 - DNA, 15 bp, Homo sapiens
ggcagcgcatgtgtg

SEQ ID NO: 1784983 - DNA, 12 bp, Homo sapiens
ggcagcgggcca

SEQ ID NO: 1784984 - DNA, 12 bp, Homo sapiens
ggcagctaagat

SEQ ID NO: 1784985 - DNA, 20 bp, Homo sapiens
ggcagctaagatagaaagct

SEQ ID NO: 1784986 - DNA, 22 bp, Homo sapiens
ggcagctaagatagaaagctgg

SEQ ID NO: 1784987 - DNA, 18 bp, Homo sapiens
ggcagctagactggagtg

SEQ ID NO: 1784988 - DNA, 14 bp, Homo sapiens
ggcagctagtgcct

SEQ ID NO: 1784989 - DNA, 17 bp, Homo sapiens
ggcagctagtgccttta

SEQ ID NO: 1784990 - DNA, 18 bp, Homo sapiens
ggcagctcctctccttgg

SEQ ID NO: 1784991 - DNA, 22 bp, Homo sapiens
ggcagctcctctccttgggctc

SEQ ID NO: 1784992 - DNA, 17 bp, Homo sapiens
ggcagctgcccctggca

SEQ ID NO: 1784993 - DNA, 18 bp, Homo sapiens
ggcagctgcccctggcac

SEQ ID NO: 1784994 - DNA, 22 bp, Homo sapiens
ggcagctgcccctggcacctgt

SEQ ID NO: 1784995 - DNA, 13 bp, Homo sapiens
ggcagctgcctct

SEQ ID NO: 1784996 - DNA, 19 bp, Homo sapiens
ggcagctgcctctgctccc

SEQ ID NO: 1784997 - DNA, 20 bp, Homo sapiens
ggcagctgcctctgctccct

SEQ ID NO: 1784998 - DNA, 21 bp, Homo sapiens
ggcagctgcctctgctccctc

SEQ ID NO: 1784999 - DNA, 23 bp, Homo sapiens
ggcagctgctcttagtgcccgcc

SEQ ID NO: 1785000 - DNA, 18 bp, Homo sapiens
ggcagctgggccccacct

SEQ ID NO: 1785001 - DNA, 19 bp, Homo sapiens
ggcagctgggccccaccta

SEQ ID NO: 1785002 - DNA, 13 bp, Homo sapiens
ggcagctggggcc

SEQ ID NO: 1785003 - DNA, 17 bp, Homo sapiens
ggcagctggggccggag

SEQ ID NO: 1785004 - DNA, 22 bp, Homo sapiens
ggcagctggggggctgtcctga

SEQ ID NO: 1785005 - DNA, 18 bp, Homo sapiens
ggcagctgtttctcatga

SEQ ID NO: 1785006 - DNA, 16 bp, Homo sapiens
ggcaggaaggagagcc

SEQ ID NO: 1785007 - DNA, 16 bp, Homo sapiens
ggcaggacacatcccg

SEQ ID NO: 1785008 - DNA, 19 bp, Homo sapiens
ggcaggagaatcagcctgg

SEQ ID NO: 1785009 - DNA, 23 bp, Homo sapiens
ggcaggagagtgtgtgggcaggg

SEQ ID NO: 1785010 - DNA, 17 bp, Homo sapiens
ggcaggagcacgaggtc

SEQ ID NO: 1785011 - DNA, 15 bp, Homo sapiens
ggcaggagctcctgg

SEQ ID NO: 1785012 - DNA, 16 bp, Homo sapiens
ggcaggagctcctgga

SEQ ID NO: 1785013 - DNA, 24 bp, Homo sapiens
ggcaggaggattgcttgagcccag

SEQ ID NO: 1785014 - DNA, 17 bp, Homo sapiens
ggcaggaggccccaggc

SEQ ID NO: 1785015 - DNA, 19 bp, Homo sapiens
ggcaggaggccccaggctg

SEQ ID NO: 1785016 - DNA, 21 bp, Homo sapiens
ggcaggaggctttgggtggct

SEQ ID NO: 1785017 - DNA, 14 bp, Homo sapiens
ggcaggagggccct

SEQ ID NO: 1785018 - DNA, 21 bp, Homo sapiens
ggcaggagtgccaggaccagc

SEQ ID NO: 1785019 - DNA, 19 bp, Homo sapiens
ggcaggattctgcagctgc

SEQ ID NO: 1785020 - DNA, 21 bp, Homo sapiens
ggcaggattctgcagctgctt

SEQ ID NO: 1785021 - DNA, 18 bp, Homo sapiens
ggcaggcatggccctggg

SEQ ID NO: 1785022 - DNA, 20 bp, Homo sapiens
ggcaggcatggccctgggcg

SEQ ID NO: 1785023 - DNA, 20 bp, Homo sapiens
ggcaggcattcctgaaggga

SEQ ID NO: 1785024 - DNA, 12 bp, Homo sapiens
ggcaggcccact

SEQ ID NO: 1785025 - DNA, 15 bp, Homo sapiens
ggcaggcccactccc

SEQ ID NO: 1785026 - DNA, 18 bp, Homo sapiens
ggcaggcccactccccag

SEQ ID NO: 1785027 - DNA, 10 bp, Homo sapiens
ggcaggcctg

SEQ ID NO: 1785028 - DNA, 21 bp, Homo sapiens
ggcaggcctgagaatgagtgg

SEQ ID NO: 1785029 - DNA, 12 bp, Homo sapiens
ggcaggcctggg

SEQ ID NO: 1785030 - DNA, 14 bp, Homo sapiens
ggcaggcctgggac

SEQ ID NO: 1785031 - DNA, 13 bp, Homo sapiens
ggcaggctcactg

SEQ ID NO: 1785032 - DNA, 19 bp, Homo sapiens
ggcaggctcactgccaggc

SEQ ID NO: 1785033 - DNA, 10 bp, Homo sapiens
ggcaggctgg

SEQ ID NO: 1785034 - DNA, 11 bp, Homo sapiens
ggcaggctggc

SEQ ID NO: 1785035 - DNA, 12 bp, Homo sapiens
ggcaggctggcc

SEQ ID NO: 1785036 - DNA, 20 bp, Homo sapiens
ggcaggctggccagtccagg

SEQ ID NO: 1785037 - DNA, 12 bp, Homo sapiens
ggcaggcttggg

SEQ ID NO: 1785038 - DNA, 17 bp, Homo sapiens
ggcagggaaggacagga

SEQ ID NO: 1785039 - DNA, 17 bp, Homo sapiens
ggcagggagctgggccc

SEQ ID NO: 1785040 - DNA, 20 bp, Homo sapiens
ggcagggagtgtctgcagtc

SEQ ID NO: 1785041 - DNA, 13 bp, Homo sapiens
ggcagggcagagg

SEQ ID NO: 1785042 - DNA, 15 bp, Homo sapiens
ggcagggcatctcct

SEQ ID NO: 1785043 - DNA, 24 bp, Homo sapiens
ggcagggccactcaacagagagga

SEQ ID NO: 1785044 - DNA, 14 bp, Homo sapiens
ggggtctgtgctgt

SEQ ID NO: 1785045 - DNA, 18 bp, Homo sapiens
ggggtctgtgctgtgcct

SEQ ID NO: 1785046 - DNA, 22 bp, Homo sapiens
ggggtgagaccctcgcagacct

SEQ ID NO: 1785047 - DNA, 13 bp, Homo sapiens
ggggtgaggacca

SEQ ID NO: 1785048 - DNA, 17 bp, Homo sapiens
ggggtggaggcttcctg

SEQ ID NO: 1785049 - DNA, 17 bp, Homo sapiens
ggggtggggagacctgg

SEQ ID NO: 1785050 - DNA, 18 bp, Homo sapiens
ggggtgggggtggaggct

SEQ ID NO: 1785051 - DNA, 22 bp, Homo sapiens
ggggttaacttggtcagagcca

SEQ ID NO: 1785052 - DNA, 18 bp, Homo sapiens
ggggttaagtctcctgtc

SEQ ID NO: 1785053 - DNA, 13 bp, Homo sapiens
ggggttacaaact

SEQ ID NO: 1785054 - DNA, 15 bp, Homo sapiens
ggggttatctctgtg

SEQ ID NO: 1785055 - DNA, 15 bp, Homo sapiens
ggggttcaagcccag

SEQ ID NO: 1785056 - DNA, 22 bp, Homo sapiens
ggggttgggattgggggctggt

SEQ ID NO: 1785057 - DNA, 15 bp, Homo sapiens
ggggttgtgttgtca

SEQ ID NO: 1785058 - DNA, 20 bp, Homo sapiens
ggggtttgtgtttgattggc

SEQ ID NO: 1785059 - DNA, 21 bp, Homo sapiens
gggtaaaatacttttactctg

SEQ ID NO: 1785060 - DNA, 21 bp, Homo sapiens
gggtaagaggagcagagggca

SEQ ID NO: 1785061 - DNA, 13 bp, Homo sapiens
gggtaaggtgcct

SEQ ID NO: 1785062 - DNA, 14 bp, Homo sapiens
gggtaaggtgcctt

SEQ ID NO: 1785063 - DNA, 17 bp, Homo sapiens
gggtaatccgttcatag

SEQ ID NO: 1785064 - DNA, 17 bp, Homo sapiens
gggtaattgtacaataa

SEQ ID NO: 1785065 - DNA, 19 bp, Homo sapiens
gggtacatttctctgagca

SEQ ID NO: 1785066 - DNA, 22 bp, Homo sapiens
gggtagcaggtaccactgattt

SEQ ID NO: 1785067 - DNA, 12 bp, Homo sapiens
gggtaggcggga

SEQ ID NO: 1785068 - DNA, 23 bp, Homo sapiens
gggtataaaactttcctcgcctg

SEQ ID NO: 1785069 - DNA, 22 bp, Homo sapiens
gggtataggtctcatctcttca

SEQ ID NO: 1785070 - DNA, 23 bp, Homo sapiens
gggtatcccctgcctcctgccac

SEQ ID NO: 1785071 - DNA, 15 bp, Homo sapiens
gggtatgctcaggtc

SEQ ID NO: 1785072 - DNA, 16 bp, Homo sapiens
gggtcacatccatccc

SEQ ID NO: 1785073 - DNA, 20 bp, Homo sapiens
gggtcacggtggcagtaggg

SEQ ID NO: 1785074 - DNA, 21 bp, Homo sapiens
gggtcactgaaccactgcttc

SEQ ID NO: 1785075 - DNA, 13 bp, Homo sapiens
gggtcagcccagc

SEQ ID NO: 1785076 - DNA, 14 bp, Homo sapiens
gggtcaggagaggg

SEQ ID NO: 1785077 - DNA, 18 bp, Homo sapiens
gggtcaggtgtcaggccc

SEQ ID NO: 1785078 - DNA, 22 bp, Homo sapiens
gggtcatcatttgtcctgttct

SEQ ID NO: 1785079 - DNA, 21 bp, Homo sapiens
gggtcatccttggtctatgtg

SEQ ID NO: 1785080 - DNA, 12 bp, Homo sapiens
gggtccacagct

SEQ ID NO: 1785081 - DNA, 15 bp, Homo sapiens
gggtccacagctgga

SEQ ID NO: 1785082 - DNA, 14 bp, Homo sapiens
gggtccacctggag

SEQ ID NO: 1785083 - DNA, 15 bp, Homo sapiens
gggtccacctggaga

SEQ ID NO: 1785084 - DNA, 16 bp, Homo sapiens
gggtccacctggagag

SEQ ID NO: 1785085 - DNA, 16 bp, Homo sapiens
gggtccaggaaggcag

SEQ ID NO: 1785086 - DNA, 20 bp, Homo sapiens
gggtccaggaaggcagctgc

SEQ ID NO: 1785087 - DNA, 21 bp, Homo sapiens
gggtccaggaaggcagctgct

SEQ ID NO: 1785088 - DNA, 22 bp, Homo sapiens
gggtccaggaaggcagctgctc

SEQ ID NO: 1785089 - DNA, 13 bp, Homo sapiens
gggtccaggcccg

SEQ ID NO: 1785090 - DNA, 24 bp, Homo sapiens
gggtccagtctgtgatccttggtg

SEQ ID NO: 1785091 - DNA, 19 bp, Homo sapiens
gggtccagtggatgccaca

SEQ ID NO: 1785092 - DNA, 23 bp, Homo sapiens
gggtcccagtgggaggggcaggc

SEQ ID NO: 1785093 - DNA, 14 bp, Homo sapiens
gggtccccagctcc

SEQ ID NO: 1785094 - DNA, 15 bp, Homo sapiens
gggtccccagctccc

SEQ ID NO: 1785095 - DNA, 17 bp, Homo sapiens
gggtccccagctcccca

SEQ ID NO: 1785096 - DNA, 19 bp, Homo sapiens
gggtccccagctccccagg

SEQ ID NO: 1785097 - DNA, 17 bp, Homo sapiens
gggtcccccctgagtgg

SEQ ID NO: 1785098 - DNA, 19 bp, Homo sapiens
gggtcccccctgagtgggc

SEQ ID NO: 1785099 - DNA, 13 bp, Homo sapiens
gggtccctccacc

SEQ ID NO: 1785100 - DNA, 16 bp, Homo sapiens
gggtccctctaaccca

SEQ ID NO: 1785101 - DNA, 19 bp, Homo sapiens
gggtccctctaacccagtg

SEQ ID NO: 1785102 - DNA, 21 bp, Homo sapiens
gggtcccttgaaggaagaggg

SEQ ID NO: 1785103 - DNA, 20 bp, Homo sapiens
gggtccgagagggaagctgg

SEQ ID NO: 1785104 - DNA, 12 bp, Homo sapiens
gggtcctccaaa

SEQ ID NO: 1785105 - DNA, 17 bp, Homo sapiens
gggtcctcctgtgctat

SEQ ID NO: 1785106 - DNA, 12 bp, Homo sapiens
gggtcctctctg

SEQ ID NO: 1785107 - DNA, 14 bp, Homo sapiens
gggtcctctctgag

SEQ ID NO: 1785108 - DNA, 22 bp, Homo sapiens
gggtcctctctgagtcaaatcc

SEQ ID NO: 1785109 - DNA, 15 bp, Homo sapiens
gggtccttctccaca

SEQ ID NO: 1785110 - DNA, 21 bp, Homo sapiens
gggtccttgatgccagagggc

SEQ ID NO: 1785111 - DNA, 23 bp, Homo sapiens
gggtccttgatgccagagggcca

SEQ ID NO: 1785112 - DNA, 20 bp, Homo sapiens
gggtccttgggcctggccag

SEQ ID NO: 1785113 - DNA, 15 bp, Homo sapiens
gggtctccctctcct

SEQ ID NO: 1785114 - DNA, 17 bp, Homo sapiens
gggtctccctggctccc

SEQ ID NO: 1785115 - DNA, 18 bp, Homo sapiens
gggtctcctcccagcggc

SEQ ID NO: 1785116 - DNA, 14 bp, Homo sapiens
gggtctcgcagcct

SEQ ID NO: 1785117 - DNA, 16 bp, Homo sapiens
gggtctcgcagcctga

SEQ ID NO: 1785118 - DNA, 12 bp, Homo sapiens
gggtctctgaag

SEQ ID NO: 1785119 - DNA, 14 bp, Homo sapiens
gggtctctgaaggg

SEQ ID NO: 1785120 - DNA, 11 bp, Homo sapiens
gggtctctggg

SEQ ID NO: 1785121 - DNA, 22 bp, Homo sapiens
gggtctgaaggaatagccagag

SEQ ID NO: 1785122 - DNA, 15 bp, Homo sapiens
gggtctgacctggtg

SEQ ID NO: 1785123 - DNA, 18 bp, Homo sapiens
gggtctgagtctatgttc

SEQ ID NO: 1785124 - DNA, 20 bp, Homo sapiens
gggtctgagtctatgttcaa

SEQ ID NO: 1785125 - DNA, 20 bp, Homo sapiens
gggtctggagttgatctgga

SEQ ID NO: 1785126 - DNA, 22 bp, Homo sapiens
gggtctggagttgatctggaac

SEQ ID NO: 1785127 - DNA, 18 bp, Homo sapiens
gggtctgtgctgtgcctg

SEQ ID NO: 1785128 - DNA, 20 bp, Homo sapiens
gggtctgtgctgtgcctgct

SEQ ID NO: 1785129 - DNA, 22 bp, Homo sapiens
gggtctgtgctgtgcctgctag

SEQ ID NO: 1785130 - DNA, 23 bp, Homo sapiens
gggtcttccctacctcaggcagg

SEQ ID NO: 1785131 - DNA, 17 bp, Homo sapiens
gggtcttcctgcagtgc

SEQ ID NO: 1785132 - DNA, 21 bp, Homo sapiens
gggtcttgggctactggcagc

SEQ ID NO: 1785133 - DNA, 13 bp, Homo sapiens
gggtgaagagctt

SEQ ID NO: 1785134 - DNA, 14 bp, Homo sapiens
gggtgaagggagag

SEQ ID NO: 1785135 - DNA, 22 bp, Homo sapiens
gggtgaccgactaccccagtcc

SEQ ID NO: 1785136 - DNA, 13 bp, Homo sapiens
gggtgacgcccag

SEQ ID NO: 1785137 - DNA, 15 bp, Homo sapiens
gggtgacgcccagct

SEQ ID NO: 1785138 - DNA, 15 bp, Homo sapiens
gggtgaggaccactc

SEQ ID NO: 1785139 - DNA, 15 bp, Homo sapiens
gggtgaggagctggg

SEQ ID NO: 1785140 - DNA, 12 bp, Homo sapiens
gggtgagggagt

SEQ ID NO: 1785141 - DNA, 14 bp, Homo sapiens
gggtgccagggctg

SEQ ID NO: 1785142 - DNA, 20 bp, Homo sapiens
gggtgccccgcctgagtcag

SEQ ID NO: 1785143 - DNA, 18 bp, Homo sapiens
gggtgccgctctctctga

SEQ ID NO: 1785144 - DNA, 18 bp, Homo sapiens
gggtgcgctcacctgcag

SEQ ID NO: 1785145 - DNA, 20 bp, Homo sapiens
gggtgcgctcacctgcagcc

SEQ ID NO: 1785146 - DNA, 19 bp, Homo sapiens
gggtgcgtctccagtcatc

SEQ ID NO: 1785147 - DNA, 17 bp, Homo sapiens
gggtgcgtgtgtttgta

SEQ ID NO: 1785148 - DNA, 18 bp, Homo sapiens
gggtgctgggaggaggga

SEQ ID NO: 1785149 - DNA, 23 bp, Homo sapiens
gggtgctgtggacatgtgggtgg

SEQ ID NO: 1785150 - DNA, 22 bp, Homo sapiens
gggtgcttttatagaggctagc

SEQ ID NO: 1785151 - DNA, 22 bp, Homo sapiens
gggtggaatgccgctgtctctg

SEQ ID NO: 1785152 - DNA, 14 bp, Homo sapiens
gggtggagaaggga

SEQ ID NO: 1785153 - DNA, 18 bp, Homo sapiens
gggtggagaagggagggt

SEQ ID NO: 1785154 - DNA, 22 bp, Homo sapiens
gggtggaggaaggtgctgagct

SEQ ID NO: 1785155 - DNA, 16 bp, Homo sapiens
gggtggaggcttcctg

SEQ ID NO: 1785156 - DNA, 14 bp, Homo sapiens
gggtggaggggtgt

SEQ ID NO: 1785157 - DNA, 16 bp, Homo sapiens
gggtggcacctcctga

SEQ ID NO: 1785158 - DNA, 18 bp, Homo sapiens
gggtggcacctcctgaga

SEQ ID NO: 1785159 - DNA, 14 bp, Homo sapiens
gggtggcaggtcac

SEQ ID NO: 1785160 - DNA, 19 bp, Homo sapiens
gggtgtttgcagctgtgag

SEQ ID NO: 1785161 - DNA, 17 bp, Homo sapiens
gggttaaatcaaagata

SEQ ID NO: 1785162 - DNA, 14 bp, Homo sapiens
gggttaacaaatga

SEQ ID NO: 1785163 - DNA, 22 bp, Homo sapiens
gggttaacccttcatcttcctg

SEQ ID NO: 1785164 - DNA, 16 bp, Homo sapiens
gggttaagaagacttt

SEQ ID NO: 1785165 - DNA, 21 bp, Homo sapiens
gggttcacttgccatgcagga

SEQ ID NO: 1785166 - DNA, 20 bp, Homo sapiens
gggttcagaaatgctgcctg

SEQ ID NO: 1785167 - DNA, 21 bp, Homo sapiens
gggttcagaaatgctgcctgc

SEQ ID NO: 1785168 - DNA, 19 bp, Homo sapiens
gggttcagagactcagggc

SEQ ID NO: 1785169 - DNA, 17 bp, Homo sapiens
gggttcagcccctcctc

SEQ ID NO: 1785170 - DNA, 19 bp, Homo sapiens
gggttcagcccctcctctg

SEQ ID NO: 1785171 - DNA, 21 bp, Homo sapiens
gggttcagcccctcctctgcc

SEQ ID NO: 1785172 - DNA, 19 bp, Homo sapiens
gggttcataggtcactggc

SEQ ID NO: 1785173 - DNA, 14 bp, Homo sapiens
gggttcctcttccc

SEQ ID NO: 1785174 - DNA, 21 bp, Homo sapiens
gggttcctgtatggtggaagc

SEQ ID NO: 1785175 - DNA, 11 bp, Homo sapiens
gggttctagac

SEQ ID NO: 1785176 - DNA, 19 bp, Homo sapiens
gggttctagacgcccctcc

SEQ ID NO: 1785177 - DNA, 22 bp, Homo sapiens
gggttctaggcatctctgtact

SEQ ID NO: 1785178 - DNA, 15 bp, Homo sapiens
gggttctcacagtgg

SEQ ID NO: 1785179 - DNA, 20 bp, Homo sapiens
gggttctgccctgcctgagg

SEQ ID NO: 1785180 - DNA, 22 bp, Homo sapiens
gggttctgccctgcctgaggag

SEQ ID NO: 1785181 - DNA, 20 bp, Homo sapiens
gggttctgcctgccagctgc

SEQ ID NO: 1785182 - DNA, 21 bp, Homo sapiens
gggttctgcctgccagctgca

SEQ ID NO: 1785183 - DNA, 15 bp, Homo sapiens
gggttctttggaagc

SEQ ID NO: 1785184 - DNA, 16 bp, Homo sapiens
gggttgaaagacatca

SEQ ID NO: 1785185 - DNA, 17 bp, Homo sapiens
gggttgaaagacatcaa

SEQ ID NO: 1785186 - DNA, 20 bp, Homo sapiens
gggttgctgtataagttatt

SEQ ID NO: 1785187 - DNA, 17 bp, Homo sapiens
gggttggctgttccaga

SEQ ID NO: 1785188 - DNA, 13 bp, Homo sapiens
gggttggtcaagg

SEQ ID NO: 1785189 - DNA, 12 bp, Homo sapiens
gggttgtgcttt

SEQ ID NO: 1785190 - DNA, 20 bp, Homo sapiens
gggtttcatcgtgttaacca

SEQ ID NO: 1785191 - DNA, 16 bp, Homo sapiens
gggtttcgactggtcc

SEQ ID NO: 1785192 - DNA, 18 bp, Homo sapiens
gggtttcgactggtccag

SEQ ID NO: 1785193 - DNA, 19 bp, Homo sapiens
gggtttcgactggtccagc

SEQ ID NO: 1785194 - DNA, 21 bp, Homo sapiens
gggtttggaccccagctggga

SEQ ID NO: 1785195 - DNA, 23 bp, Homo sapiens
gggtttgtgtttgattggctttc

SEQ ID NO: 1785196 - DNA, 14 bp, Homo sapiens
gggttttatatttt

SEQ ID NO: 1785197 - DNA, 15 bp, Homo sapiens
gggttttcttttctt

SEQ ID NO: 1785198 - DNA, 19 bp, Homo sapiens
ggtaaataaaaagaaaggc

SEQ ID NO: 1785199 - DNA, 20 bp, Homo sapiens
ggtaaataaaccactgtgcg

SEQ ID NO: 1785200 - DNA, 11 bp, Homo sapiens
ggtaaatgtta

SEQ ID NO: 1785201 - DNA, 12 bp, Homo sapiens
ggtaaatgtttc

SEQ ID NO: 1785202 - DNA, 12 bp, Homo sapiens
ggtaaattcaga

SEQ ID NO: 1785203 - DNA, 13 bp, Homo sapiens
ggtaaatttctgt

SEQ ID NO: 1785204 - DNA, 18 bp, Homo sapiens
ggtaacagggagactgca

SEQ ID NO: 1785205 - DNA, 21 bp, Homo sapiens
ggtaacagttcatgtttgctt

SEQ ID NO: 1785206 - DNA, 23 bp, Homo sapiens
ggtaaccagccacagtacatatg

SEQ ID NO: 1785207 - DNA, 12 bp, Homo sapiens
ggtaactgccag

SEQ ID NO: 1785208 - DNA, 13 bp, Homo sapiens
ggtaactgccagc

SEQ ID NO: 1785209 - DNA, 14 bp, Homo sapiens
ggtaactgccagcc

SEQ ID NO: 1785210 - DNA, 20 bp, Homo sapiens
ggtaactgccagccttggag

SEQ ID NO: 1785211 - DNA, 12 bp, Homo sapiens
ggtaactgtcct

SEQ ID NO: 1785212 - DNA, 17 bp, Homo sapiens
ggtaactgtcctgtcct

SEQ ID NO: 1785213 - DNA, 17 bp, Homo sapiens
ggtaagaagaaagcaaa

SEQ ID NO: 1785214 - DNA, 15 bp, Homo sapiens
ggtaagaggagcaga

SEQ ID NO: 1785215 - DNA, 18 bp, Homo sapiens
ggtaagtgttctcatgaa

SEQ ID NO: 1785216 - DNA, 19 bp, Homo sapiens
ggtaataagtactgtgtac

SEQ ID NO: 1785217 - DNA, 13 bp, Homo sapiens
ggtaatctacacc

SEQ ID NO: 1785218 - DNA, 17 bp, Homo sapiens
ggtaattcacttcagtt

SEQ ID NO: 1785219 - DNA, 13 bp, Homo sapiens
ggtaattgtacaa

SEQ ID NO: 1785220 - DNA, 16 bp, Homo sapiens
ggtaattgtacaataa

SEQ ID NO: 1785221 - DNA, 22 bp, Homo sapiens
ggtaattgttgctaatcttctt

SEQ ID NO: 1785222 - DNA, 15 bp, Homo sapiens
ggtaatttttgtaca

SEQ ID NO: 1785223 - DNA, 11 bp, Homo sapiens
ggtaatttttt

SEQ ID NO: 1785224 - DNA, 21 bp, Homo sapiens
ggtaattttttttgttttttg

SEQ ID NO: 1785225 - DNA, 22 bp, Homo sapiens
ggtacaaacccaaaaaagaaca

SEQ ID NO: 1785226 - DNA, 18 bp, Homo sapiens
ggtacaactgtatttatt

SEQ ID NO: 1785227 - DNA, 14 bp, Homo sapiens
ggtacaatctggct

SEQ ID NO: 1785228 - DNA, 19 bp, Homo sapiens
ggtacagaaaacatgttta

SEQ ID NO: 1785229 - DNA, 22 bp, Homo sapiens
ggtacagcaacaggaatctcag

SEQ ID NO: 1785230 - DNA, 16 bp, Homo sapiens
ggtacagcgcggagga

SEQ ID NO: 1785231 - DNA, 17 bp, Homo sapiens
ggtacaggaaggcttgc

SEQ ID NO: 1785232 - DNA, 14 bp, Homo sapiens
ggtaccagctgcgc

SEQ ID NO: 1785233 - DNA, 20 bp, Homo sapiens
ggtacccagccatctgccca

SEQ ID NO: 1785234 - DNA, 13 bp, Homo sapiens
ggtaccctctgga

SEQ ID NO: 1785235 - DNA, 13 bp, Homo sapiens
ggtaccctgggtg

SEQ ID NO: 1785236 - DNA, 16 bp, Homo sapiens
ggtaccgatttctgct

SEQ ID NO: 1785237 - DNA, 19 bp, Homo sapiens
ggtacgaatctcatccctc

SEQ ID NO: 1785238 - DNA, 14 bp, Homo sapiens
ggtactgtagcagg

SEQ ID NO: 1785239 - DNA, 14 bp, Homo sapiens
ggtacttcctcctg

SEQ ID NO: 1785240 - DNA, 15 bp, Homo sapiens
ggtacttcttgaagg

SEQ ID NO: 1785241 - DNA, 18 bp, Homo sapiens
ggtactttattcttgctg

SEQ ID NO: 1785242 - DNA, 21 bp, Homo sapiens
ggtacttttatgatgtatatt

SEQ ID NO: 1785243 - DNA, 23 bp, Homo sapiens
ggtacttttatgatgtatattta

SEQ ID NO: 1785244 - DNA, 20 bp, Homo sapiens
ggtacttttgagtgtgtgtg

SEQ ID NO: 1785245 - DNA, 16 bp, Homo sapiens
ggtagaaaaaggggcc

SEQ ID NO: 1785246 - DNA, 11 bp, Homo sapiens
ggtagaaatgc

SEQ ID NO: 1785247 - DNA, 15 bp, Homo sapiens
ggtagacttggagct

SEQ ID NO: 1785248 - DNA, 17 bp, Homo sapiens
ggtagacttggagctgt

SEQ ID NO: 1785249 - DNA, 17 bp, Homo sapiens
ggtagagctgatccaga

SEQ ID NO: 1785250 - DNA, 14 bp, Homo sapiens
ggtagagttggaaa

SEQ ID NO: 1785251 - DNA, 18 bp, Homo sapiens
ggtagatcgcttgagccc

SEQ ID NO: 1785252 - DNA, 22 bp, Homo sapiens
ggtagattcgctgtcccctcag

SEQ ID NO: 1785253 - DNA, 16 bp, Homo sapiens
ggtagatttcctcctc

SEQ ID NO: 1785254 - DNA, 19 bp, Homo sapiens
ggtgaaggatccaggaata

SEQ ID NO: 1785255 - DNA, 16 bp, Homo sapiens
ggtgaagggagagcca

SEQ ID NO: 1785256 - DNA, 18 bp, Homo sapiens
ggtgaagggagagccagc

SEQ ID NO: 1785257 - DNA, 13 bp, Homo sapiens
ggtgaatattttc

SEQ ID NO: 1785258 - DNA, 18 bp, Homo sapiens
ggtgacacattacaaagc

SEQ ID NO: 1785259 - DNA, 19 bp, Homo sapiens
ggtgacacattacaaagcc

SEQ ID NO: 1785260 - DNA, 16 bp, Homo sapiens
ggtgacaccagccttt

SEQ ID NO: 1785261 - DNA, 17 bp, Homo sapiens
ggtgacagcagtcggtt

SEQ ID NO: 1785262 - DNA, 15 bp, Homo sapiens
ggtgacgcccagctc

SEQ ID NO: 1785263 - DNA, 17 bp, Homo sapiens
ggtgacgcccagctccg

SEQ ID NO: 1785264 - DNA, 11 bp, Homo sapiens
ggtgactggaa

SEQ ID NO: 1785265 - DNA, 12 bp, Homo sapiens
ggtgactgtgct

SEQ ID NO: 1785266 - DNA, 12 bp, Homo sapiens
ggtgagaaaaaa

SEQ ID NO: 1785267 - DNA, 13 bp, Homo sapiens
ggtgagaaaactc

SEQ ID NO: 1785268 - DNA, 20 bp, Homo sapiens
ggtgagaaagggattgctga

SEQ ID NO: 1785269 - DNA, 19 bp, Homo sapiens
ggtgagcagaagtggagct

SEQ ID NO: 1785270 - DNA, 18 bp, Homo sapiens
ggtgagctgcacctgatt

SEQ ID NO: 1785271 - DNA, 16 bp, Homo sapiens
ggtgagggttggcgct

SEQ ID NO: 1785272 - DNA, 23 bp, Homo sapiens
ggtgagtcttggcggcagcagcc

SEQ ID NO: 1785273 - DNA, 23 bp, Homo sapiens
ggtgagtcttggttctaaaggta

SEQ ID NO: 1785274 - DNA, 20 bp, Homo sapiens
ggtgagtttgagctgccttc

SEQ ID NO: 1785275 - DNA, 12 bp, Homo sapiens
ggtgatcagtgc

SEQ ID NO: 1785276 - DNA, 20 bp, Homo sapiens
ggtgatccgcctacctcagc

SEQ ID NO: 1785277 - DNA, 18 bp, Homo sapiens
ggtgattggaccaggcca

SEQ ID NO: 1785278 - DNA, 15 bp, Homo sapiens
ggtgcaaattcagaa

SEQ ID NO: 1785279 - DNA, 14 bp, Homo sapiens
ggtgcacaggcctc

SEQ ID NO: 1785280 - DNA, 18 bp, Homo sapiens
ggtgcacaggcctctgcc

SEQ ID NO: 1785281 - DNA, 19 bp, Homo sapiens
ggtgcacaggcctctgcct

SEQ ID NO: 1785282 - DNA, 21 bp, Homo sapiens
ggtgcacaggcctctgcctgc

SEQ ID NO: 1785283 - DNA, 16 bp, Homo sapiens
ggtgcacagtgatttt

SEQ ID NO: 1785284 - DNA, 16 bp, Homo sapiens
ggtgcacccacctgtt

SEQ ID NO: 1785285 - DNA, 17 bp, Homo sapiens
ggtgcacccacctgttt

SEQ ID NO: 1785286 - DNA, 16 bp, Homo sapiens
ggtgcacgcaggcaca

SEQ ID NO: 1785287 - DNA, 19 bp, Homo sapiens
ggtgcacgcaggcacagca

SEQ ID NO: 1785288 - DNA, 19 bp, Homo sapiens
ggtgcagaggtaccctggg

SEQ ID NO: 1785289 - DNA, 16 bp, Homo sapiens
ggtgcagatgggctgt

SEQ ID NO: 1785290 - DNA, 17 bp, Homo sapiens
ggtgcaggcagccttga

SEQ ID NO: 1785291 - DNA, 23 bp, Homo sapiens
ggtgccaaacaaaaaggttctca

SEQ ID NO: 1785292 - DNA, 19 bp, Homo sapiens
ggtgccaaatagccccaga

SEQ ID NO: 1785293 - DNA, 22 bp, Homo sapiens
ggtgccaaatagccccagactg

SEQ ID NO: 1785294 - DNA, 18 bp, Homo sapiens
ggtgccaagggccccagg

SEQ ID NO: 1785295 - DNA, 19 bp, Homo sapiens
ggtgccaagggccccaggg

SEQ ID NO: 1785296 - DNA, 21 bp, Homo sapiens
ggtgccaagggccccaggggc

SEQ ID NO: 1785297 - DNA, 23 bp, Homo sapiens
ggtgccaagggccccaggggcag

SEQ ID NO: 1785298 - DNA, 23 bp, Homo sapiens
ggtgccaatttcaagttccaagt

SEQ ID NO: 1785299 - DNA, 19 bp, Homo sapiens
ggtgccaccaccctgcccc

SEQ ID NO: 1785300 - DNA, 13 bp, Homo sapiens
ggtgccactccct

SEQ ID NO: 1785301 - DNA, 19 bp, Homo sapiens
ggtgccactccctgagctt

SEQ ID NO: 1785302 - DNA, 14 bp, Homo sapiens
ggtgccatgcctgc

SEQ ID NO: 1785303 - DNA, 15 bp, Homo sapiens
ggtgccatgcctgct

SEQ ID NO: 1785304 - DNA, 20 bp, Homo sapiens
ggtgccatgcctgctccctg

SEQ ID NO: 1785305 - DNA, 21 bp, Homo sapiens
ggtgccatgcctgctccctgt

SEQ ID NO: 1785306 - DNA, 22 bp, Homo sapiens
ggtgccatgtcagcgctctggt

SEQ ID NO: 1785307 - DNA, 15 bp, Homo sapiens
ggtgccattcccagc

SEQ ID NO: 1785308 - DNA, 23 bp, Homo sapiens
ggtgcccaaacaccagtcacctc

SEQ ID NO: 1785309 - DNA, 14 bp, Homo sapiens
ggtgcccaagccag

SEQ ID NO: 1785310 - DNA, 23 bp, Homo sapiens
ggtgcccaagccagaggctgggt

SEQ ID NO: 1785311 - DNA, 18 bp, Homo sapiens
ggtgccccacctgcctgg

SEQ ID NO: 1785312 - DNA, 20 bp, Homo sapiens
ggtgccccaggaccagctca

SEQ ID NO: 1785313 - DNA, 20 bp, Homo sapiens
ggtgccccaggatgccacgc

SEQ ID NO: 1785314 - DNA, 22 bp, Homo sapiens
ggtgccccccttgccagacatg

SEQ ID NO: 1785315 - DNA, 19 bp, Homo sapiens
ggtgccccctcctctccca

SEQ ID NO: 1785316 - DNA, 20 bp, Homo sapiens
ggtgccccctcctctcccat

SEQ ID NO: 1785317 - DNA, 20 bp, Homo sapiens
ggtgcccgtaatcccagcta

SEQ ID NO: 1785318 - DNA, 14 bp, Homo sapiens
ggtgccctctcagg

SEQ ID NO: 1785319 - DNA, 17 bp, Homo sapiens
ggtgccctctcaggtgg

SEQ ID NO: 1785320 - DNA, 21 bp, Homo sapiens
ggtgcccttggtagcagcctg

SEQ ID NO: 1785321 - DNA, 17 bp, Homo sapiens
ggtgccgctctctctga

SEQ ID NO: 1785322 - DNA, 15 bp, Homo sapiens
ggtgccgctgtctct

SEQ ID NO: 1785323 - DNA, 17 bp, Homo sapiens
ggtgccgctgtctctga

SEQ ID NO: 1785324 - DNA, 19 bp, Homo sapiens
ggtgccgctttctctgagg

SEQ ID NO: 1785325 - DNA, 23 bp, Homo sapiens
ggtgccggcatctcccctagctc

SEQ ID NO: 1785326 - DNA, 17 bp, Homo sapiens
ggtgccgtgagcaggct

SEQ ID NO: 1785327 - DNA, 23 bp, Homo sapiens
ggtgcctcatagcatagccagca

SEQ ID NO: 1785328 - DNA, 16 bp, Homo sapiens
ggtgcctccaggtgtg

SEQ ID NO: 1785329 - DNA, 22 bp, Homo sapiens
ggtgcctgccaccttcaagttc

SEQ ID NO: 1785330 - DNA, 23 bp, Homo sapiens
ggtgccttcttattctcactcca

SEQ ID NO: 1785331 - DNA, 14 bp, Homo sapiens
ggtgcgggcctggc

SEQ ID NO: 1785332 - DNA, 22 bp, Homo sapiens
ggtgcgggcctggccctcactc

SEQ ID NO: 1785333 - DNA, 12 bp, Homo sapiens
ggtgcgtggctg

SEQ ID NO: 1785334 - DNA, 13 bp, Homo sapiens
ggtgcgtggctgt

SEQ ID NO: 1785335 - DNA, 15 bp, Homo sapiens
ggtgcgtggctgtgg

SEQ ID NO: 1785336 - DNA, 19 bp, Homo sapiens
ggtgcgtttataattggct

SEQ ID NO: 1785337 - DNA, 22 bp, Homo sapiens
ggtgcgtttataattggcttaa

SEQ ID NO: 1785338 - DNA, 16 bp, Homo sapiens
ggtgcgtttttacagt

SEQ ID NO: 1785339 - DNA, 18 bp, Homo sapiens
ggtgctaaaaatgaaaat

SEQ ID NO: 1785340 - DNA, 21 bp, Homo sapiens
ggtgctaaagccaaccagcct

SEQ ID NO: 1785341 - DNA, 23 bp, Homo sapiens
ggtgctaaagccaaccagccttt

SEQ ID NO: 1785342 - DNA, 19 bp, Homo sapiens
ggtgctacaaaaacacagc

SEQ ID NO: 1785343 - DNA, 23 bp, Homo sapiens
ggtgctagtgggccctctctctg

SEQ ID NO: 1785344 - DNA, 15 bp, Homo sapiens
ggtgctccctctgtc

SEQ ID NO: 1785345 - DNA, 16 bp, Homo sapiens
ggtgctctctttctgt

SEQ ID NO: 1785346 - DNA, 12 bp, Homo sapiens
ggtgctctggcg

SEQ ID NO: 1785347 - DNA, 15 bp, Homo sapiens
ggtgctgacggccag

SEQ ID NO: 1785348 - DNA, 17 bp, Homo sapiens
ggtgctgacggccaggg

SEQ ID NO: 1785349 - DNA, 19 bp, Homo sapiens
ggtgctgactgaggcctgc

SEQ ID NO: 1785350 - DNA, 20 bp, Homo sapiens
ggtgctgactgaggcctgct

SEQ ID NO: 1785351 - DNA, 19 bp, Homo sapiens
ggtgctgactggcttcagc

SEQ ID NO: 1785352 - DNA, 14 bp, Homo sapiens
ggtgctgcaggagt

SEQ ID NO: 1785353 - DNA, 15 bp, Homo sapiens
ggtgctgcaggagtg

SEQ ID NO: 1785354 - DNA, 15 bp, Homo sapiens
ggtgctgcccaggcc

SEQ ID NO: 1785355 - DNA, 20 bp, Homo sapiens
ggtgctgggaggagggagag

SEQ ID NO: 1785356 - DNA, 12 bp, Homo sapiens
ggtgctgtgtgc

SEQ ID NO: 1785357 - DNA, 13 bp, Homo sapiens
ggtgctgtttaaa

SEQ ID NO: 1785358 - DNA, 18 bp, Homo sapiens
ggtgcttccaacaaggac

SEQ ID NO: 1785359 - DNA, 21 bp, Homo sapiens
ggtgcttgttccctctccctg

SEQ ID NO: 1785360 - DNA, 21 bp, Homo sapiens
ggtgcttttatagaggctagc

SEQ ID NO: 1785361 - DNA, 13 bp, Homo sapiens
ggtggaagccctc

SEQ ID NO: 1785362 - DNA, 18 bp, Homo sapiens
ggtggaagtgcccagccc

SEQ ID NO: 1785363 - DNA, 15 bp, Homo sapiens
ggtggaatgccgctg

SEQ ID NO: 1785364 - DNA, 14 bp, Homo sapiens
ggtggacccaggga

SEQ ID NO: 1785365 - DNA, 16 bp, Homo sapiens
ggtggagaaagcactg

SEQ ID NO: 1785366 - DNA, 21 bp, Homo sapiens
ggtggagaaagcactgacctg

SEQ ID NO: 1785367 - DNA, 19 bp, Homo sapiens
ggtggagaagggagggtgg

SEQ ID NO: 1785368 - DNA, 16 bp, Homo sapiens
ggtggagaagtgtcgt

SEQ ID NO: 1785369 - DNA, 13 bp, Homo sapiens
ggtggagcagcca

SEQ ID NO: 1785370 - DNA, 12 bp, Homo sapiens
ggtgttatttgg

SEQ ID NO: 1785371 - DNA, 22 bp, Homo sapiens
ggtgttcctggaagcaggtgct

SEQ ID NO: 1785372 - DNA, 17 bp, Homo sapiens
ggtgttgtatgccttta

SEQ ID NO: 1785373 - DNA, 20 bp, Homo sapiens
ggtgtttgcagctgtgagaa

SEQ ID NO: 1785374 - DNA, 12 bp, Homo sapiens
ggtttggacccc

SEQ ID NO: 1785375 - DNA, 21 bp, Homo sapiens
ggtttggattactattgcaaa

SEQ ID NO: 1785376 - DNA, 12 bp, Homo sapiens
ggtttggggaga

SEQ ID NO: 1785377 - DNA, 13 bp, Homo sapiens
ggtttggggagaa

SEQ ID NO: 1785378 - DNA, 17 bp, Homo sapiens
ggtttgggggcgccctc

SEQ ID NO: 1785379 - DNA, 20 bp, Homo sapiens
ggtttgggggcgccctctct

SEQ ID NO: 1785380 - DNA, 15 bp, Homo sapiens
ggtttggtttgcttt

SEQ ID NO: 1785381 - DNA, 14 bp, Homo sapiens
ggtttgtgttcttc

SEQ ID NO: 1785382 - DNA, 19 bp, Homo sapiens
ggttttaagctaaaatgtt

SEQ ID NO: 1785383 - DNA, 22 bp, Homo sapiens
ggttttaagctaaaatgttact

SEQ ID NO: 1785384 - DNA, 21 bp, Homo sapiens
ggttttgtctcctttccactg

SEQ ID NO: 1785385 - DNA, 22 bp, Homo sapiens
ggttttgttcccctcctccact

SEQ ID NO: 1785386 - DNA, 20 bp, Homo sapiens
ggtttttaaatatatatttt

SEQ ID NO: 1785387 - DNA, 14 bp, Homo sapiens
ggtttttaagggcc

SEQ ID NO: 1785388 - DNA, 15 bp, Homo sapiens
ggtttttcatctttt

SEQ ID NO: 1785389 - DNA, 16 bp, Homo sapiens
ggtttttcatctttta

SEQ ID NO: 1785390 - DNA, 12 bp, Homo sapiens
ggtttttgctct

SEQ ID NO: 1785391 - DNA, 15 bp, Homo sapiens
ggtttttggctcttt

SEQ ID NO: 1785392 - DNA, 14 bp, Homo sapiens
ggttttttaatata

SEQ ID NO: 1785393 - DNA, 9 bp, Homo sapiens
ggttttttt

SEQ ID NO: 1785394 - DNA, 13 bp, Homo sapiens
ggtttttttcctt

SEQ ID NO: 1785395 - DNA, 12 bp, Homo sapiens
gtaaaaaaagca

SEQ ID NO: 1785396 - DNA, 14 bp, Homo sapiens
gtaaaaaaagcaaa

SEQ ID NO: 1785397 - DNA, 14 bp, Homo sapiens
gtaaaaaatggaaa

SEQ ID NO: 1785398 - DNA, 17 bp, Homo sapiens
gtaaaaaattaaagccc

SEQ ID NO: 1785399 - DNA, 15 bp, Homo sapiens
gtaaaaagcctcctt

SEQ ID NO: 1785400 - DNA, 14 bp, Homo sapiens
gtaaaaatgctgct

SEQ ID NO: 1785401 - DNA, 20 bp, Homo sapiens
gtaaaacaatgccatgaaca

SEQ ID NO: 1785402 - DNA, 17 bp, Homo sapiens
gtaaaacagggccacat

SEQ ID NO: 1785403 - DNA, 18 bp, Homo sapiens
gtaaaaccacagcagttg

SEQ ID NO: 1785404 - DNA, 23 bp, Homo sapiens
gtaaaaccacagcagttgaaaag

SEQ ID NO: 1785405 - DNA, 14 bp, Homo sapiens
gtaaaagaaatcat

SEQ ID NO: 1785406 - DNA, 23 bp, Homo sapiens
gtaaaagatgcagagtaagtatt

SEQ ID NO: 1785407 - DNA, 17 bp, Homo sapiens
gtaaaaggtattaaatt

SEQ ID NO: 1785408 - DNA, 14 bp, Homo sapiens
gtaaaataaaatta

SEQ ID NO: 1785409 - DNA, 12 bp, Homo sapiens
gtaaaatatgta

SEQ ID NO: 1785410 - DNA, 14 bp, Homo sapiens
gtaaaatatgtaaa

SEQ ID NO: 1785411 - DNA, 15 bp, Homo sapiens
gtaaaatatgtaaaa

SEQ ID NO: 1785412 - DNA, 22 bp, Homo sapiens
gtaaaatcccatctgctagaag

SEQ ID NO: 1785413 - DNA, 19 bp, Homo sapiens
gtaaaatcttgtcatgtgt

SEQ ID NO: 1785414 - DNA, 21 bp, Homo sapiens
gtaaaatcttgtcatgtgtat

SEQ ID NO: 1785415 - DNA, 17 bp, Homo sapiens
gtaaaatgaattgaaaa

SEQ ID NO: 1785416 - DNA, 19 bp, Homo sapiens
gtaaaatgtgaagtgaatg

SEQ ID NO: 1785417 - DNA, 11 bp, Homo sapiens
gtaaacaaatt

SEQ ID NO: 1785418 - DNA, 19 bp, Homo sapiens
gtaaacagcctctttttga

SEQ ID NO: 1785419 - DNA, 21 bp, Homo sapiens
gtaaacaggtatttttttaaa

SEQ ID NO: 1785420 - DNA, 23 bp, Homo sapiens
gtaaacaggtatttttttaaatc

SEQ ID NO: 1785421 - DNA, 15 bp, Homo sapiens
gtaaacagtgcctgc

SEQ ID NO: 1785422 - DNA, 14 bp, Homo sapiens
gtaaaccactgaaa

SEQ ID NO: 1785423 - DNA, 22 bp, Homo sapiens
gtaaacgggaacatgccccctg

SEQ ID NO: 1785424 - DNA, 15 bp, Homo sapiens
gtaaactatttatct

SEQ ID NO: 1785425 - DNA, 23 bp, Homo sapiens
gtaaactcaaaatatttgtacat

SEQ ID NO: 1785426 - DNA, 15 bp, Homo sapiens
gtaaactgatgtact

SEQ ID NO: 1785427 - DNA, 21 bp, Homo sapiens
gtaaactgtatcaaatctgta

SEQ ID NO: 1785428 - DNA, 14 bp, Homo sapiens
gtaaagaaaaatat

SEQ ID NO: 1785429 - DNA, 21 bp, Homo sapiens
gtaaagaaaaatatttaatgt

SEQ ID NO: 1785430 - DNA, 14 bp, Homo sapiens
gtaaagaattttca

SEQ ID NO: 1785431 - DNA, 15 bp, Homo sapiens
gtaaaggagggagat

SEQ ID NO: 1785432 - DNA, 23 bp, Homo sapiens
gtaaaggtacgattatacttgag

SEQ ID NO: 1785433 - DNA, 15 bp, Homo sapiens
gtaaagtatgtatta

SEQ ID NO: 1785434 - DNA, 17 bp, Homo sapiens
gtaaagtgataatttct

SEQ ID NO: 1785435 - DNA, 23 bp, Homo sapiens
gtaaagtgataatttctggaatt

SEQ ID NO: 1785436 - DNA, 15 bp, Homo sapiens
gtaaataaaaagaaa

SEQ ID NO: 1785437 - DNA, 16 bp, Homo sapiens
gtaaataaaatgtgta

SEQ ID NO: 1785438 - DNA, 18 bp, Homo sapiens
gtaaataaaatgtgtaca

SEQ ID NO: 1785439 - DNA, 19 bp, Homo sapiens
gtaaataaactatttatat

SEQ ID NO: 1785440 - DNA, 12 bp, Homo sapiens
gtaaataaagtc

SEQ ID NO: 1785441 - DNA, 11 bp, Homo sapiens
gtaaataagag

SEQ ID NO: 1785442 - DNA, 15 bp, Homo sapiens
gtaaataatttattt

SEQ ID NO: 1785443 - DNA, 17 bp, Homo sapiens
gtaaatacaacacatct

SEQ ID NO: 1785444 - DNA, 14 bp, Homo sapiens
gtaaatacaggtag

SEQ ID NO: 1785445 - DNA, 16 bp, Homo sapiens
gtaaatacccatatgt

SEQ ID NO: 1785446 - DNA, 17 bp, Homo sapiens
gtaaatactggactcag

SEQ ID NO: 1785447 - DNA, 22 bp, Homo sapiens
gtaaatactggactcaggaact

SEQ ID NO: 1785448 - DNA, 13 bp, Homo sapiens
gtaaatactgtga

SEQ ID NO: 1785449 - DNA, 14 bp, Homo sapiens
gtaaataggaattg

SEQ ID NO: 1785450 - DNA, 11 bp, Homo sapiens
gtaaatatata

SEQ ID NO: 1785451 - DNA, 17 bp, Homo sapiens
gtaaatatatatgtcaa

SEQ ID NO: 1785452 - DNA, 18 bp, Homo sapiens
gtaaatatatatgtcaat

SEQ ID NO: 1785453 - DNA, 21 bp, Homo sapiens
gtaaatatatatgtcaatatt

SEQ ID NO: 1785454 - DNA, 11 bp, Homo sapiens
gtaaatatatc

SEQ ID NO: 1785455 - DNA, 16 bp, Homo sapiens
gtaaatatgaatctgc

SEQ ID NO: 1785456 - DNA, 23 bp, Homo sapiens
gtaaatatgaatctgctcacttt

SEQ ID NO: 1785457 - DNA, 19 bp, Homo sapiens
gtaaatatgtttgtgcctt

SEQ ID NO: 1785458 - DNA, 21 bp, Homo sapiens
gtaaatattctacacatgtaa

SEQ ID NO: 1785459 - DNA, 12 bp, Homo sapiens
gtaaatatttat

SEQ ID NO: 1785460 - DNA, 11 bp, Homo sapiens
gtaaatcactt

SEQ ID NO: 1785461 - DNA, 18 bp, Homo sapiens
gtaaatcagaaagtaaca

SEQ ID NO: 1785462 - DNA, 17 bp, Homo sapiens
gtaaatcctgccattta

SEQ ID NO: 1785463 - DNA, 15 bp, Homo sapiens
gtaaatctagagttt

SEQ ID NO: 1785464 - DNA, 12 bp, Homo sapiens
gtaaatctgcca

SEQ ID NO: 1785465 - DNA, 14 bp, Homo sapiens
gtaaatctgccaca

SEQ ID NO: 1785466 - DNA, 19 bp, Homo sapiens
gtaaatctttttgcttcta

SEQ ID NO: 1785467 - DNA, 12 bp, Homo sapiens
gtaaatgcatat

SEQ ID NO: 1785468 - DNA, 17 bp, Homo sapiens
gtaaattatgatgtcca

SEQ ID NO: 1785469 - DNA, 15 bp, Homo sapiens
gtaaattcagacaac

SEQ ID NO: 1785470 - DNA, 20 bp, Homo sapiens
gtaaattcagacaacattat

SEQ ID NO: 1785471 - DNA, 16 bp, Homo sapiens
gtaaattgcagaattc

SEQ ID NO: 1785472 - DNA, 17 bp, Homo sapiens
gtaaatttatgtgatgg

SEQ ID NO: 1785473 - DNA, 20 bp, Homo sapiens
gtaacaaataaagtgcagtt

SEQ ID NO: 1785474 - DNA, 16 bp, Homo sapiens
gtaacaagaaaacata

SEQ ID NO: 1785475 - DNA, 14 bp, Homo sapiens
gtaacacagtcatt

SEQ ID NO: 1785476 - DNA, 23 bp, Homo sapiens
gtaacacagtgccttcaataaat

SEQ ID NO: 1785477 - DNA, 16 bp, Homo sapiens
gtaacactaatatatt

SEQ ID NO: 1785478 - DNA, 20 bp, Homo sapiens
gtaacactaatatatttaaa

SEQ ID NO: 1785479 - DNA, 18 bp, Homo sapiens
gtaacactgcaagaagtc

SEQ ID NO: 1785480 - DNA, 14 bp, Homo sapiens
gtaacactttgctt

SEQ ID NO: 1785481 - DNA, 11 bp, Homo sapiens
gtaacagacac

SEQ ID NO: 1785482 - DNA, 17 bp, Homo sapiens
gtaacagacacacgatg

SEQ ID NO: 1785483 - DNA, 20 bp, Homo sapiens
gtaacaggaaaattttaaaa

SEQ ID NO: 1785484 - DNA, 17 bp, Homo sapiens
gtaacagtcaaatatca

SEQ ID NO: 1785485 - DNA, 15 bp, Homo sapiens
gtaacatcagggacc

SEQ ID NO: 1785486 - DNA, 18 bp, Homo sapiens
gtaacatcataattacat

SEQ ID NO: 1785487 - DNA, 14 bp, Homo sapiens
gtaacattggtgaa

SEQ ID NO: 1785488 - DNA, 15 bp, Homo sapiens
gtaacccctcctggc

SEQ ID NO: 1785489 - DNA, 16 bp, Homo sapiens
gtaacgcgtcttcctg

SEQ ID NO: 1785490 - DNA, 13 bp, Homo sapiens
gtacggatttgtc

SEQ ID NO: 1785491 - DNA, 20 bp, Homo sapiens
gtacgtggcacctcttccga

SEQ ID NO: 1785492 - DNA, 14 bp, Homo sapiens
gtacgtttgtatgt

SEQ ID NO: 1785493 - DNA, 15 bp, Homo sapiens
gtacgttttgcacat

SEQ ID NO: 1785494 - DNA, 15 bp, Homo sapiens
gtactaaggaatctt

SEQ ID NO: 1785495 - DNA, 12 bp, Homo sapiens
gtactaatctga

SEQ ID NO: 1785496 - DNA, 15 bp, Homo sapiens
gtactagtgttctgt

SEQ ID NO: 1785497 - DNA, 16 bp, Homo sapiens
gtactagttacacatc

SEQ ID NO: 1785498 - DNA, 14 bp, Homo sapiens
gtactatttaactg

SEQ ID NO: 1785499 - DNA, 17 bp, Homo sapiens
gtactcacatataacat

SEQ ID NO: 1785500 - DNA, 14 bp, Homo sapiens
gtagccccttttct

SEQ ID NO: 1785501 - DNA, 20 bp, Homo sapiens
gtagcctatttttttagatt

SEQ ID NO: 1785502 - DNA, 22 bp, Homo sapiens
gtagcctggatattattcttgt

SEQ ID NO: 1785503 - DNA, 19 bp, Homo sapiens
gtagcctgggctcactgtg

SEQ ID NO: 1785504 - DNA, 13 bp, Homo sapiens
gtagctccctcct

SEQ ID NO: 1785505 - DNA, 13 bp, Homo sapiens
gtagctctgcctc

SEQ ID NO: 1785506 - DNA, 14 bp, Homo sapiens
gtagctctgcctcc

SEQ ID NO: 1785507 - DNA, 12 bp, Homo sapiens
gtagctgctagt

SEQ ID NO: 1785508 - DNA, 22 bp, Homo sapiens
gtagctgggaaagcataaagct

SEQ ID NO: 1785509 - DNA, 17 bp, Homo sapiens
gtagctgggatgacagg

SEQ ID NO: 1785510 - DNA, 14 bp, Homo sapiens
gtagctgtaagggc

SEQ ID NO: 1785511 - DNA, 17 bp, Homo sapiens
gtagctgtaagggcagt

SEQ ID NO: 1785512 - DNA, 20 bp, Homo sapiens
gtagctgtcagatgtcacat

SEQ ID NO: 1785513 - DNA, 12 bp, Homo sapiens
gtagctgtgaaa

SEQ ID NO: 1785514 - DNA, 17 bp, Homo sapiens
gtagcttacctgacaca

SEQ ID NO: 1785515 - DNA, 18 bp, Homo sapiens
gtagcttacctgacacaa

SEQ ID NO: 1785516 - DNA, 22 bp, Homo sapiens
gtagcttacctgacacaagagg

SEQ ID NO: 1785517 - DNA, 20 bp, Homo sapiens
gtagctttaaaaccacagct

SEQ ID NO: 1785518 - DNA, 21 bp, Homo sapiens
gtagctttaaaaccacagctg

SEQ ID NO: 1785519 - DNA, 16 bp, Homo sapiens
gtaggaaagaggaagc

SEQ ID NO: 1785520 - DNA, 15 bp, Homo sapiens
gtaggaatcctttga

SEQ ID NO: 1785521 - DNA, 16 bp, Homo sapiens
gtaggacgcatgaagg

SEQ ID NO: 1785522 - DNA, 16 bp, Homo sapiens
gtaggagggtgggaag

SEQ ID NO: 1785523 - DNA, 14 bp, Homo sapiens
gtaggaggtttgga

SEQ ID NO: 1785524 - DNA, 19 bp, Homo sapiens
gtaggcagaccctggaccc

SEQ ID NO: 1785525 - DNA, 20 bp, Homo sapiens
gtaggcatgagggatcacag

SEQ ID NO: 1785526 - DNA, 22 bp, Homo sapiens
gtaggcatgagggatcacaggg

SEQ ID NO: 1785527 - DNA, 19 bp, Homo sapiens
gtaggcccttgtcctgcca

SEQ ID NO: 1785528 - DNA, 21 bp, Homo sapiens
gtaggcccttgtcctgccagc

SEQ ID NO: 1785529 - DNA, 22 bp, Homo sapiens
gtaggcccttgtcctgccagct

SEQ ID NO: 1785530 - DNA, 23 bp, Homo sapiens
gtaggcccttgtcctgccagctg

SEQ ID NO: 1785531 - DNA, 15 bp, Homo sapiens
gtaggctgtattttc

SEQ ID NO: 1785532 - DNA, 18 bp, Homo sapiens
gtagggagtacctgctgc

SEQ ID NO: 1785533 - DNA, 16 bp, Homo sapiens
gtaggggagggcaggc

SEQ ID NO: 1785534 - DNA, 12 bp, Homo sapiens
gtaggggcaggg

SEQ ID NO: 1785535 - DNA, 14 bp, Homo sapiens
gtaggggctcctga

SEQ ID NO: 1785536 - DNA, 15 bp, Homo sapiens
gtaggggctcctgag

SEQ ID NO: 1785537 - DNA, 22 bp, Homo sapiens
gtagggtaaatcagtaagaggt

SEQ ID NO: 1785538 - DNA, 13 bp, Homo sapiens
gtagggtggcact

SEQ ID NO: 1785539 - DNA, 13 bp, Homo sapiens
gtagggtgttctg

SEQ ID NO: 1785540 - DNA, 19 bp, Homo sapiens
gtaggtaaagaggaaaagg

SEQ ID NO: 1785541 - DNA, 23 bp, Homo sapiens
gtaggtgatgtttccagctgcca

SEQ ID NO: 1785542 - DNA, 19 bp, Homo sapiens
gtaggttatttaaaataaa

SEQ ID NO: 1785543 - DNA, 17 bp, Homo sapiens
gtaggttcagccaaggt

SEQ ID NO: 1785544 - DNA, 19 bp, Homo sapiens
gtaggttgggacaccaggg

SEQ ID NO: 1785545 - DNA, 15 bp, Homo sapiens
gtaggttgtctaaaa

SEQ ID NO: 1785546 - DNA, 16 bp, Homo sapiens
gtaggttgtctaaaaa

SEQ ID NO: 1785547 - DNA, 14 bp, Homo sapiens
gtagtaaaagtggt

SEQ ID NO: 1785548 - DNA, 14 bp, Homo sapiens
gtagtaatttattg

SEQ ID NO: 1785549 - DNA, 19 bp, Homo sapiens
gtagtaatttattgtctgt

SEQ ID NO: 1785550 - DNA, 24 bp, Homo sapiens
gtagtaatttattgtctgtctaca

SEQ ID NO: 1785551 - DNA, 16 bp, Homo sapiens
gtagtataaagaaaag

SEQ ID NO: 1785552 - DNA, 14 bp, Homo sapiens
gtagtattaaaagt

SEQ ID NO: 1785553 - DNA, 22 bp, Homo sapiens
gtagtattaaaagttgcatttg

SEQ ID NO: 1785554 - DNA, 19 bp, Homo sapiens
gtagtattttttgtataat

SEQ ID NO: 1785555 - DNA, 21 bp, Homo sapiens
gtagtcattcttacaattgca

SEQ ID NO: 1785556 - DNA, 12 bp, Homo sapiens
gtagtccatcac

SEQ ID NO: 1785557 - DNA, 20 bp, Homo sapiens
gtagtcccagctactcggga

SEQ ID NO: 1785558 - DNA, 12 bp, Homo sapiens
gtagtccccaac

SEQ ID NO: 1785559 - DNA, 12 bp, Homo sapiens
gtagtcctgtga

SEQ ID NO: 1785560 - DNA, 19 bp, Homo sapiens
gtagtcttgtcttagctct

SEQ ID NO: 1785561 - DNA, 22 bp, Homo sapiens
gtagtgagccaagatcgcacca

SEQ ID NO: 1785562 - DNA, 19 bp, Homo sapiens
gtagtgcatttttaaactt

SEQ ID NO: 1785563 - DNA, 20 bp, Homo sapiens
gtagtgcatttttaaacttg

SEQ ID NO: 1785564 - DNA, 13 bp, Homo sapiens
gtagtggaagagc

SEQ ID NO: 1785565 - DNA, 18 bp, Homo sapiens
gtagtggaagagcagcct

SEQ ID NO: 1785566 - DNA, 19 bp, Homo sapiens
gtagtggaagagcagcctg

SEQ ID NO: 1785567 - DNA, 12 bp, Homo sapiens
gtagttgaatgg

SEQ ID NO: 1785568 - DNA, 17 bp, Homo sapiens
gtagttgccttaaaata

SEQ ID NO: 1785569 - DNA, 21 bp, Homo sapiens
gtagttggcaggagctcctgg

SEQ ID NO: 1785570 - DNA, 18 bp, Homo sapiens
gtagtttagttctgttga

SEQ ID NO: 1785571 - DNA, 19 bp, Homo sapiens
gtagtttatggcagaaggg

SEQ ID NO: 1785572 - DNA, 16 bp, Homo sapiens
gtagttttcaaaacac

SEQ ID NO: 1785573 - DNA, 22 bp, Homo sapiens
gtagtttttacagctgtgttat

SEQ ID NO: 1785574 - DNA, 20 bp, Homo sapiens
gtagtttttatatgttgtaa

SEQ ID NO: 1785575 - DNA, 12 bp, Homo sapiens
gtataaaaacaa

SEQ ID NO: 1785576 - DNA, 18 bp, Homo sapiens
gtataaaactttcctcgc

SEQ ID NO: 1785577 - DNA, 14 bp, Homo sapiens
gtataaaaggttgc

SEQ ID NO: 1785578 - DNA, 12 bp, Homo sapiens
gtataaaataca

SEQ ID NO: 1785579 - DNA, 21 bp, Homo sapiens
gtataaaatctgaattttgca

SEQ ID NO: 1785580 - DNA, 14 bp, Homo sapiens
gtataaatatcagt

SEQ ID NO: 1785581 - DNA, 17 bp, Homo sapiens
gtataaatatcagtatt

SEQ ID NO: 1785582 - DNA, 18 bp, Homo sapiens
gtataacaagccaaacat

SEQ ID NO: 1785583 - DNA, 22 bp, Homo sapiens
gtataagttatttttgtacatg

SEQ ID NO: 1785584 - DNA, 16 bp, Homo sapiens
gtataagttgaaggaa

SEQ ID NO: 1785585 - DNA, 12 bp, Homo sapiens
gtataatataaa

SEQ ID NO: 1785586 - DNA, 13 bp, Homo sapiens
gtataatataaaa

SEQ ID NO: 1785587 - DNA, 16 bp, Homo sapiens
gtataatatatatcta

SEQ ID NO: 1785588 - DNA, 21 bp, Homo sapiens
gtataatggttgactgggttt

SEQ ID NO: 1785589 - DNA, 23 bp, Homo sapiens
gtataatggttgactgggtttct

SEQ ID NO: 1785590 - DNA, 15 bp, Homo sapiens
gtataatgtttatta

SEQ ID NO: 1785591 - DNA, 18 bp, Homo sapiens
gtataattaattgtcatt

SEQ ID NO: 1785592 - DNA, 18 bp, Homo sapiens
gtataattggatttccta

SEQ ID NO: 1785593 - DNA, 23 bp, Homo sapiens
gtataattgtgtgatatttcaga

SEQ ID NO: 1785594 - DNA, 22 bp, Homo sapiens
gtataattttttaaagttactt

SEQ ID NO: 1785595 - DNA, 17 bp, Homo sapiens
gtatacaactgcctggg

SEQ ID NO: 1785596 - DNA, 16 bp, Homo sapiens
gtatacatgtgtacat

SEQ ID NO: 1785597 - DNA, 20 bp, Homo sapiens
gtatacgtataaatatcagt

SEQ ID NO: 1785598 - DNA, 18 bp, Homo sapiens
gtatagaagtctggaaaa

SEQ ID NO: 1785599 - DNA, 15 bp, Homo sapiens
gtatagaccaaagca

SEQ ID NO: 1785600 - DNA, 23 bp, Homo sapiens
gtatagcctatggcagaaaaaat

SEQ ID NO: 1785601 - DNA, 15 bp, Homo sapiens
gtatagcttacctga

SEQ ID NO: 1785602 - DNA, 21 bp, Homo sapiens
gtatagtgtctattatcacat

SEQ ID NO: 1785603 - DNA, 16 bp, Homo sapiens
gtatagtgttcacaaa

SEQ ID NO: 1785604 - DNA, 12 bp, Homo sapiens
gtatagttgctt

SEQ ID NO: 1785605 - DNA, 20 bp, Homo sapiens
gtatataatggtttcaaaga

SEQ ID NO: 1785606 - DNA, 23 bp, Homo sapiens
gtatatacacccaagatgggcat

SEQ ID NO: 1785607 - DNA, 22 bp, Homo sapiens
gtatatagtatatttatactct

SEQ ID NO: 1785608 - DNA, 14 bp, Homo sapiens
gtatatatagaatc

SEQ ID NO: 1785609 - DNA, 17 bp, Homo sapiens
gtatatctggacaagcc

SEQ ID NO: 1785610 - DNA, 18 bp, Homo sapiens
gtatatggtggtaataag

SEQ ID NO: 1785611 - DNA, 12 bp, Homo sapiens
gtatatgtatat

SEQ ID NO: 1785612 - DNA, 22 bp, Homo sapiens
gtatatgtattcccttgtattt

SEQ ID NO: 1785613 - DNA, 17 bp, Homo sapiens
gtcaccaccctgctcat

SEQ ID NO: 1785614 - DNA, 11 bp, Homo sapiens
gtcaccacctt

SEQ ID NO: 1785615 - DNA, 19 bp, Homo sapiens
gtcaccaccttcccagctc

SEQ ID NO: 1785616 - DNA, 20 bp, Homo sapiens
gtcaccaccttcccagctct

SEQ ID NO: 1785617 - DNA, 22 bp, Homo sapiens
gtcaccaccttcccagctctcc

SEQ ID NO: 1785618 - DNA, 16 bp, Homo sapiens
gtcaccagagcttctc

SEQ ID NO: 1785619 - DNA, 21 bp, Homo sapiens
gtcaccagctgctgtgcccca

SEQ ID NO: 1785620 - DNA, 13 bp, Homo sapiens
gtcaccaggtact

SEQ ID NO: 1785621 - DNA, 20 bp, Homo sapiens
gtcacccaggctggactgca

SEQ ID NO: 1785622 - DNA, 18 bp, Homo sapiens
gtcacccgactttggaat

SEQ ID NO: 1785623 - DNA, 21 bp, Homo sapiens
gtcacccgactttggaatttg

SEQ ID NO: 1785624 - DNA, 15 bp, Homo sapiens
gtcaccgacagcggc

SEQ ID NO: 1785625 - DNA, 17 bp, Homo sapiens
gtcaccgacagcggcct

SEQ ID NO: 1785626 - DNA, 21 bp, Homo sapiens
gtcaccgacagcggccttgaa

SEQ ID NO: 1785627 - DNA, 12 bp, Homo sapiens
gtcacctgcaag

SEQ ID NO: 1785628 - DNA, 13 bp, Homo sapiens
gtcacctgcaagc

SEQ ID NO: 1785629 - DNA, 13 bp, Homo sapiens
gtcacctgctcca

SEQ ID NO: 1785630 - DNA, 15 bp, Homo sapiens
gtcacctgctccaga

SEQ ID NO: 1785631 - DNA, 16 bp, Homo sapiens
gtcacctgctccagaa

SEQ ID NO: 1785632 - DNA, 14 bp, Homo sapiens
gtcaccttcgagta

SEQ ID NO: 1785633 - DNA, 18 bp, Homo sapiens
gtcacgctcatgtcctgt

SEQ ID NO: 1785634 - DNA, 16 bp, Homo sapiens
gtcactacgcctggct

SEQ ID NO: 1785635 - DNA, 23 bp, Homo sapiens
gtcactagcagctgcagtcaaca

SEQ ID NO: 1785636 - DNA, 16 bp, Homo sapiens
gtcactcacactggcc

SEQ ID NO: 1785637 - DNA, 17 bp, Homo sapiens
gtcactcacactggcca

SEQ ID NO: 1785638 - DNA, 14 bp, Homo sapiens
gtcactcattgctg

SEQ ID NO: 1785639 - DNA, 18 bp, Homo sapiens
gtcactcattgctgagcc

SEQ ID NO: 1785640 - DNA, 22 bp, Homo sapiens
gtcactcattgctgagcctctg

SEQ ID NO: 1785641 - DNA, 15 bp, Homo sapiens
gtcactccaccatcc

SEQ ID NO: 1785642 - DNA, 13 bp, Homo sapiens
gtcactccagtgc

SEQ ID NO: 1785643 - DNA, 21 bp, Homo sapiens
gtcactccagtgctcagctgt

SEQ ID NO: 1785644 - DNA, 23 bp, Homo sapiens
gtcactccagtgctcagctgtgg

SEQ ID NO: 1785645 - DNA, 13 bp, Homo sapiens
gtcactcctgggg

SEQ ID NO: 1785646 - DNA, 21 bp, Homo sapiens
gtcactcctggggcctcttgg

SEQ ID NO: 1785647 - DNA, 13 bp, Homo sapiens
gtcactgaacaaa

SEQ ID NO: 1785648 - DNA, 15 bp, Homo sapiens
gtcactgaacaaaac

SEQ ID NO: 1785649 - DNA, 16 bp, Homo sapiens
gtcactgaaccactgc

SEQ ID NO: 1785650 - DNA, 17 bp, Homo sapiens
gtcactgaaccactgct

SEQ ID NO: 1785651 - DNA, 18 bp, Homo sapiens
gtcactgaaccactgctt

SEQ ID NO: 1785652 - DNA, 22 bp, Homo sapiens
gtcactgaaccactgcttctct

SEQ ID NO: 1785653 - DNA, 20 bp, Homo sapiens
gtcactgcacagtgcatctc

SEQ ID NO: 1785654 - DNA, 22 bp, Homo sapiens
gtcactgccgacatccctcccc

SEQ ID NO: 1785655 - DNA, 22 bp, Homo sapiens
gtcactgcctctccctggccct

SEQ ID NO: 1785656 - DNA, 23 bp, Homo sapiens
gtcactgcctctccctggccctc

SEQ ID NO: 1785657 - DNA, 15 bp, Homo sapiens
gtcactggaaagggg

SEQ ID NO: 1785658 - DNA, 23 bp, Homo sapiens
gtcactggaaaggggagagcctg

SEQ ID NO: 1785659 - DNA, 20 bp, Homo sapiens
gtcactggaggttgaagcca

SEQ ID NO: 1785660 - DNA, 21 bp, Homo sapiens
gtcactggctctccaagtgcc

SEQ ID NO: 1785661 - DNA, 21 bp, Homo sapiens
gtcactggtagaccaaaataa

SEQ ID NO: 1785662 - DNA, 18 bp, Homo sapiens
gtcactgttcgtcactca

SEQ ID NO: 1785663 - DNA, 13 bp, Homo sapiens
gtcacttaaattt

SEQ ID NO: 1785664 - DNA, 20 bp, Homo sapiens
gtcacttaaatttgttcttt

SEQ ID NO: 1785665 - DNA, 18 bp, Homo sapiens
gtcacttcgcgtgccctc

SEQ ID NO: 1785666 - DNA, 17 bp, Homo sapiens
gtcacttcttcacctct

SEQ ID NO: 1785667 - DNA, 14 bp, Homo sapiens
gtcactttttctga

SEQ ID NO: 1785668 - DNA, 13 bp, Homo sapiens
gtcagaaattcta

SEQ ID NO: 1785669 - DNA, 22 bp, Homo sapiens
gtcagaagcaggttcttgatgt

SEQ ID NO: 1785670 - DNA, 16 bp, Homo sapiens
gtcagaataggaaaac

SEQ ID NO: 1785671 - DNA, 20 bp, Homo sapiens
gtcagaatgtgaaaaaggaa

SEQ ID NO: 1785672 - DNA, 18 bp, Homo sapiens
gtcagactggctggctgc

SEQ ID NO: 1785673 - DNA, 12 bp, Homo sapiens
gtcagagagacc

SEQ ID NO: 1785674 - DNA, 16 bp, Homo sapiens
gtcagagagacctcat

SEQ ID NO: 1785675 - DNA, 12 bp, Homo sapiens
gtcagagccact

SEQ ID NO: 1785676 - DNA, 13 bp, Homo sapiens
gtcagagccactc

SEQ ID NO: 1785677 - DNA, 19 bp, Homo sapiens
gtcagaggctaagatgaga

SEQ ID NO: 1785678 - DNA, 20 bp, Homo sapiens
gtcagagggactgtcagctg

SEQ ID NO: 1785679 - DNA, 12 bp, Homo sapiens
gtcagatgaggc

SEQ ID NO: 1785680 - DNA, 13 bp, Homo sapiens
gtcagatgaggca

SEQ ID NO: 1785681 - DNA, 18 bp, Homo sapiens
gtcagatttttatttatg

SEQ ID NO: 1785682 - DNA, 13 bp, Homo sapiens
gtcagcaagagga

SEQ ID NO: 1785683 - DNA, 12 bp, Homo sapiens
gtcagcaccttg

SEQ ID NO: 1785684 - DNA, 20 bp, Homo sapiens
gtcagcaccttggcccagga

SEQ ID NO: 1785685 - DNA, 19 bp, Homo sapiens
gtcagcatctgaccatctg

SEQ ID NO: 1785686 - DNA, 15 bp, Homo sapiens
gtcagcatctggctg

SEQ ID NO: 1785687 - DNA, 16 bp, Homo sapiens
gtcagcccagcacctg

SEQ ID NO: 1785688 - DNA, 21 bp, Homo sapiens
gtcagcccagcacctgctccc

SEQ ID NO: 1785689 - DNA, 16 bp, Homo sapiens
gtcagccgagccgggc

SEQ ID NO: 1785690 - DNA, 15 bp, Homo sapiens
gtcagccgggccctg

SEQ ID NO: 1785691 - DNA, 16 bp, Homo sapiens
gtcagccgggccctga

SEQ ID NO: 1785692 - DNA, 14 bp, Homo sapiens
gtcagcctggaagg

SEQ ID NO: 1785693 - DNA, 12 bp, Homo sapiens
gtcagctccagc

SEQ ID NO: 1785694 - DNA, 17 bp, Homo sapiens
gtcagctgctccctggc

SEQ ID NO: 1785695 - DNA, 15 bp, Homo sapiens
gtcagcttgaatgtc

SEQ ID NO: 1785696 - DNA, 13 bp, Homo sapiens
gtcagctttcaga

SEQ ID NO: 1785697 - DNA, 19 bp, Homo sapiens
gtcagcttttgttgtttat

SEQ ID NO: 1785698 - DNA, 16 bp, Homo sapiens
gtcaggaacagaagga

SEQ ID NO: 1785699 - DNA, 18 bp, Homo sapiens
gtcaggacaccagcctgg

SEQ ID NO: 1785700 - DNA, 17 bp, Homo sapiens
gtcaggagagtgcagat

SEQ ID NO: 1785701 - DNA, 23 bp, Homo sapiens
gtcaggagttcaagaccagcctg

SEQ ID NO: 1785702 - DNA, 21 bp, Homo sapiens
gtcaggagttgtttctgaccc

SEQ ID NO: 1785703 - DNA, 18 bp, Homo sapiens
gtcaggcccgtcggagct

SEQ ID NO: 1785704 - DNA, 21 bp, Homo sapiens
gtcaggcccgtcggagctgcc

SEQ ID NO: 1785705 - DNA, 23 bp, Homo sapiens
gtcaggcccgtcggagctgcctg

SEQ ID NO: 1785706 - DNA, 15 bp, Homo sapiens
gtcaggccctctgcc

SEQ ID NO: 1785707 - DNA, 18 bp, Homo sapiens
gtcaggccctctgcctgc

SEQ ID NO: 1785708 - DNA, 19 bp, Homo sapiens
gtcaggccctctgcctgca

SEQ ID NO: 1785709 - DNA, 20 bp, Homo sapiens
gtcaggccctctgcctgcac

SEQ ID NO: 1785710 - DNA, 23 bp, Homo sapiens
gtcaggccctctgcctgcactcc

SEQ ID NO: 1785711 - DNA, 21 bp, Homo sapiens
gtcaggcccttattttcaaga

SEQ ID NO: 1785712 - DNA, 17 bp, Homo sapiens
gtcaggctccattagga

SEQ ID NO: 1785713 - DNA, 12 bp, Homo sapiens
gtcaggcttctc

SEQ ID NO: 1785714 - DNA, 17 bp, Homo sapiens
gtcaggcttctcttgct

SEQ ID NO: 1785715 - DNA, 13 bp, Homo sapiens
gtcagggacagca

SEQ ID NO: 1785716 - DNA, 17 bp, Homo sapiens
gtcagggacagcagcct

SEQ ID NO: 1785717 - DNA, 12 bp, Homo sapiens
gtcagggcccaa

SEQ ID NO: 1785718 - DNA, 14 bp, Homo sapiens
gtcaggggggagaa

SEQ ID NO: 1785719 - DNA, 22 bp, Homo sapiens
gtcaggggtcaggtgtcaggcc

SEQ ID NO: 1785720 - DNA, 18 bp, Homo sapiens
gtcaggtgtcgaggccac

SEQ ID NO: 1785721 - DNA, 19 bp, Homo sapiens
gtcaggttatactcctcct

SEQ ID NO: 1785722 - DNA, 20 bp, Homo sapiens
gtcagtaggtccaagggcca

SEQ ID NO: 1785723 - DNA, 19 bp, Homo sapiens
gtcagtcatgatggcacca

SEQ ID NO: 1785724 - DNA, 22 bp, Homo sapiens
gtcagtcatgatggcaccactg

SEQ ID NO: 1785725 - DNA, 15 bp, Homo sapiens
gtcagtctttgctca

SEQ ID NO: 1785726 - DNA, 21 bp, Homo sapiens
gtcagtgctataaatgccaga

SEQ ID NO: 1785727 - DNA, 22 bp, Homo sapiens
gtcagtgctataaatgccagag

SEQ ID NO: 1785728 - DNA, 19 bp, Homo sapiens
gtcagttcccggagcacag

SEQ ID NO: 1785729 - DNA, 13 bp, Homo sapiens
gtcagttgtatca

SEQ ID NO: 1785730 - DNA, 19 bp, Homo sapiens
gtcagttgtgttttttaag

SEQ ID NO: 1785731 - DNA, 21 bp, Homo sapiens
gtcataaagattataatatgt

SEQ ID NO: 1785732 - DNA, 16 bp, Homo sapiens
gtcataaatactgtca

SEQ ID NO: 1785733 - DNA, 17 bp, Homo sapiens
gtcataaattactgttt

SEQ ID NO: 1785734 - DNA, 12 bp, Homo sapiens
gtcatagaaata

SEQ ID NO: 1785735 - DNA, 17 bp, Homo sapiens
gtcatagagctgcaggg

SEQ ID NO: 1785736 - DNA, 20 bp, Homo sapiens
gtcatagcaagcttttgctc

SEQ ID NO: 1785737 - DNA, 21 bp, Homo sapiens
gtcataggttttaaatctgct

SEQ ID NO: 1785738 - DNA, 22 bp, Homo sapiens
gtcatagtcttgaaatgaaagg

SEQ ID NO: 1785739 - DNA, 15 bp, Homo sapiens
gtcatagtttcctga

SEQ ID NO: 1785740 - DNA, 22 bp, Homo sapiens
gtcatatactgccatgtactag

SEQ ID NO: 1785741 - DNA, 20 bp, Homo sapiens
gtcatcaaacatttgccaag

SEQ ID NO: 1785742 - DNA, 16 bp, Homo sapiens
gtcatcaccacccttc

SEQ ID NO: 1785743 - DNA, 19 bp, Homo sapiens
gtcatcatgaactggcttg

SEQ ID NO: 1785744 - DNA, 21 bp, Homo sapiens
gtcatccacacaacaccagga

SEQ ID NO: 1785745 - DNA, 21 bp, Homo sapiens
gtcatccacctgtcttggcct

SEQ ID NO: 1785746 - DNA, 19 bp, Homo sapiens
gtcatcctcaaagaaagtg

SEQ ID NO: 1785747 - DNA, 21 bp, Homo sapiens
gtcatctagcattaggtatat

SEQ ID NO: 1785748 - DNA, 20 bp, Homo sapiens
gtcatctcagggtccagacc

SEQ ID NO: 1785749 - DNA, 17 bp, Homo sapiens
gtcatctccatcagctg

SEQ ID NO: 1785750 - DNA, 17 bp, Homo sapiens
gtcatctgattggacag

SEQ ID NO: 1785751 - DNA, 13 bp, Homo sapiens
gtcatctggcgga

SEQ ID NO: 1785752 - DNA, 14 bp, Homo sapiens
ggtccctggtcctt

SEQ ID NO: 1785753 - DNA, 15 bp, Homo sapiens
ggtcccttgaaggaa

SEQ ID NO: 1785754 - DNA, 21 bp, Homo sapiens
ggtcccttgagacctcagcca

SEQ ID NO: 1785755 - DNA, 14 bp, Homo sapiens
ggtccgagagggaa

SEQ ID NO: 1785756 - DNA, 21 bp, Homo sapiens
ggtccgcaccagctgctctgc

SEQ ID NO: 1785757 - DNA, 22 bp, Homo sapiens
ggtccgcaccagctgctctgcc

SEQ ID NO: 1785758 - DNA, 16 bp, Homo sapiens
ggtccgcatccctgct

SEQ ID NO: 1785759 - DNA, 17 bp, Homo sapiens
ggtccgcatccctgctt

SEQ ID NO: 1785760 - DNA, 22 bp, Homo sapiens
ggtccgtcttcacactgcgcag

SEQ ID NO: 1785761 - DNA, 22 bp, Homo sapiens
ggtcctcacaagcctcttctga

SEQ ID NO: 1785762 - DNA, 23 bp, Homo sapiens
ggtcctcacccctcgccaccttt

SEQ ID NO: 1785763 - DNA, 19 bp, Homo sapiens
ggtcctcacttctgtctcc

SEQ ID NO: 1785764 - DNA, 16 bp, Homo sapiens
ggtcctccgcctactg

SEQ ID NO: 1785765 - DNA, 23 bp, Homo sapiens
ggtcctccgtagggtctttcttg

SEQ ID NO: 1785766 - DNA, 19 bp, Homo sapiens
ggtcctcctatctccctgg

SEQ ID NO: 1785767 - DNA, 17 bp, Homo sapiens
gtccagcgtcactccag

SEQ ID NO: 1785768 - DNA, 19 bp, Homo sapiens
gtccagcgtcactccagtg

SEQ ID NO: 1785769 - DNA, 23 bp, Homo sapiens
gtccagctcccgctgtggccgca

SEQ ID NO: 1785770 - DNA, 11 bp, Homo sapiens
gtccagctctg

SEQ ID NO: 1785771 - DNA, 12 bp, Homo sapiens
gtccagctctga

SEQ ID NO: 1785772 - DNA, 20 bp, Homo sapiens
gtccagctctgacatccctt

SEQ ID NO: 1785773 - DNA, 16 bp, Homo sapiens
gtccagctctggaggg

SEQ ID NO: 1785774 - DNA, 20 bp, Homo sapiens
gtccagctgggcctcctgcc

SEQ ID NO: 1785775 - DNA, 19 bp, Homo sapiens
gtccagcttccaaagccta

SEQ ID NO: 1785776 - DNA, 17 bp, Homo sapiens
gtccagcttgctcttca

SEQ ID NO: 1785777 - DNA, 17 bp, Homo sapiens
gtccaggaaggcagctg

SEQ ID NO: 1785778 - DNA, 20 bp, Homo sapiens
gtccaggaaggcagctgctc

SEQ ID NO: 1785779 - DNA, 21 bp, Homo sapiens
gtccaggaaggcagctgctct

SEQ ID NO: 1785780 - DNA, 18 bp, Homo sapiens
gtccaggactgggtctga

SEQ ID NO: 1785781 - DNA, 21 bp, Homo sapiens
gtccaggactgggtctgacct

SEQ ID NO: 1785782 - DNA, 23 bp, Homo sapiens
gtccaggagaagtgctccctgga

SEQ ID NO: 1785783 - DNA, 13 bp, Homo sapiens
gtccaggagcctg

SEQ ID NO: 1785784 - DNA, 12 bp, Homo sapiens
gtccaggagcta

SEQ ID NO: 1785785 - DNA, 12 bp, Homo sapiens
gtccaggcagct

SEQ ID NO: 1785786 - DNA, 20 bp, Homo sapiens
gtccaggcagctccctcctg

SEQ ID NO: 1785787 - DNA, 11 bp, Homo sapiens
gtccaggccac

SEQ ID NO: 1785788 - DNA, 13 bp, Homo sapiens
gtccaggccactg

SEQ ID NO: 1785789 - DNA, 21 bp, Homo sapiens
gtccaggccactgtggccaga

SEQ ID NO: 1785790 - DNA, 22 bp, Homo sapiens
gtccaggccccaccggccaggc

SEQ ID NO: 1785791 - DNA, 20 bp, Homo sapiens
gtccaggctgccgtggggcc

SEQ ID NO: 1785792 - DNA, 15 bp, Homo sapiens
gtccagggccctgag

SEQ ID NO: 1785793 - DNA, 20 bp, Homo sapiens
gtccaggtctcactgctttg

SEQ ID NO: 1785794 - DNA, 18 bp, Homo sapiens
gtccaggtgaggcccaag

SEQ ID NO: 1785795 - DNA, 14 bp, Homo sapiens
gtccagtcgggagg

SEQ ID NO: 1785796 - DNA, 18 bp, Homo sapiens
gtccagtcgggaggagca

SEQ ID NO: 1785797 - DNA, 15 bp, Homo sapiens
gtccagtgtttcttt

SEQ ID NO: 1785798 - DNA, 19 bp, Homo sapiens
gtcttctcaggctctgccc

SEQ ID NO: 1785799 - DNA, 19 bp, Homo sapiens
gtcttctctctggctcagg

SEQ ID NO: 1785800 - DNA, 14 bp, Homo sapiens
gtcttctgcctgtt

SEQ ID NO: 1785801 - DNA, 18 bp, Homo sapiens
gtcttctgggcacagtgg

SEQ ID NO: 1785802 - DNA, 14 bp, Homo sapiens
gtcttgaaatgaaa

SEQ ID NO: 1785803 - DNA, 20 bp, Homo sapiens
gtcttgaacgagcagcccag

SEQ ID NO: 1785804 - DNA, 21 bp, Homo sapiens
gtcttgaacgagcagcccagg

SEQ ID NO: 1785805 - DNA, 17 bp, Homo sapiens
gtcttgaatgtcttttg

SEQ ID NO: 1785806 - DNA, 22 bp, Homo sapiens
gtcttgaattagtatttcagtg

SEQ ID NO: 1785807 - DNA, 22 bp, Homo sapiens
gtcttgactcatggcagctgtt

SEQ ID NO: 1785808 - DNA, 14 bp, Homo sapiens
gtcttgccagccag

SEQ ID NO: 1785809 - DNA, 15 bp, Homo sapiens
gtcttgccagccaga

SEQ ID NO: 1785810 - DNA, 21 bp, Homo sapiens
gtcttgcccagcagctcaaga

SEQ ID NO: 1785811 - DNA, 14 bp, Homo sapiens
gtcttgcctaggcc

SEQ ID NO: 1785812 - DNA, 21 bp, Homo sapiens
gtcttggaagctgtttggaaa

SEQ ID NO: 1785813 - DNA, 13 bp, Homo sapiens
gtcttggcctccc

SEQ ID NO: 1785814 - DNA, 21 bp, Homo sapiens
gtcttggcctcccaaagtgct

SEQ ID NO: 1785815 - DNA, 15 bp, Homo sapiens
gtcttggcggcagca

SEQ ID NO: 1785816 - DNA, 16 bp, Homo sapiens
gtcttggcggcagcag

SEQ ID NO: 1785817 - DNA, 19 bp, Homo sapiens
gtcttgggcagagctggct

SEQ ID NO: 1785818 - DNA, 17 bp, Homo sapiens
gtcttgggctactggca

SEQ ID NO: 1785819 - DNA, 18 bp, Homo sapiens
gtcttgggctactggcag

SEQ ID NO: 1785820 - DNA, 20 bp, Homo sapiens
gtcttggggccactttcaga

SEQ ID NO: 1785821 - DNA, 15 bp, Homo sapiens
gtcttgggttcctgt

SEQ ID NO: 1785822 - DNA, 14 bp, Homo sapiens
gtcttggtgctatc

SEQ ID NO: 1785823 - DNA, 14 bp, Homo sapiens
gtcttggttctaaa

SEQ ID NO: 1785824 - DNA, 22 bp, Homo sapiens
gtcttgttttttttttccactt

SEQ ID NO: 1785825 - DNA, 21 bp, Homo sapiens
gtctttataacccatattttc

SEQ ID NO: 1785826 - DNA, 22 bp, Homo sapiens
gtctttcagtacttttttaaat

SEQ ID NO: 1785827 - DNA, 13 bp, Homo sapiens
gtctttcatggct

SEQ ID NO: 1785828 - DNA, 23 bp, Homo sapiens
gtctttcatggctgctgttgctt

SEQ ID NO: 1785829 - DNA, 19 bp, Homo sapiens
gtctttcccatggggaggg

SEQ ID NO: 1785830 - DNA, 16 bp, Homo sapiens
gtctttctcaaagaaa

SEQ ID NO: 1785831 - DNA, 19 bp, Homo sapiens
gtctttctctaaatatgat

SEQ ID NO: 1785832 - DNA, 13 bp, Homo sapiens
gtctttctggaga

SEQ ID NO: 1785833 - DNA, 12 bp, Homo sapiens
gtctttcttctt

SEQ ID NO: 1785834 - DNA, 23 bp, Homo sapiens
gtctttcttgggatagtgttctg

SEQ ID NO: 1785835 - DNA, 15 bp, Homo sapiens
gtctttgcacatgtg

SEQ ID NO: 1785836 - DNA, 15 bp, Homo sapiens
gtctttgccttctct

SEQ ID NO: 1785837 - DNA, 24 bp, Homo sapiens
gtctttgctgcagtcttctctctg

SEQ ID NO: 1785838 - DNA, 18 bp, Homo sapiens
gtctttgtaatgtcacca

SEQ ID NO: 1785839 - DNA, 20 bp, Homo sapiens
gtctttgtaatgtcaccacc

SEQ ID NO: 1785840 - DNA, 22 bp, Homo sapiens
gtctttgtcaccacgtggggct

SEQ ID NO: 1785841 - DNA, 17 bp, Homo sapiens
gtctttgttgtctccct

SEQ ID NO: 1785842 - DNA, 12 bp, Homo sapiens
gtcttttcaatc

SEQ ID NO: 1785843 - DNA, 16 bp, Homo sapiens
gtctttttctggactg

SEQ ID NO: 1785844 - DNA, 18 bp, Homo sapiens
gtcttttttaaggctctg

SEQ ID NO: 1785845 - DNA, 23 bp, Homo sapiens
gtcttttttctcttcccttccca

SEQ ID NO: 1785846 - DNA, 17 bp, Homo sapiens
gtctttttttgtattat

SEQ ID NO: 1785847 - DNA, 15 bp, Homo sapiens
gtcttttttttcctg

SEQ ID NO: 1785848 - DNA, 19 bp, Homo sapiens
gtgaaaaccaaccctgtgg

SEQ ID NO: 1785849 - DNA, 21 bp, Homo sapiens
gtgaaaaccaaccctgtgggc

SEQ ID NO: 1785850 - DNA, 22 bp, Homo sapiens
gtgaaaatagtgtaagaactgt

SEQ ID NO: 1785851 - DNA, 20 bp, Homo sapiens
gtgaaaatttttacattcat

SEQ ID NO: 1785852 - DNA, 19 bp, Homo sapiens
gtgaaacaatgttgtccaa

SEQ ID NO: 1785853 - DNA, 18 bp, Homo sapiens
gtgaaacagttgctgtga

SEQ ID NO: 1785854 - DNA, 16 bp, Homo sapiens
gtgaaaccccgtctct

SEQ ID NO: 1785855 - DNA, 22 bp, Homo sapiens
gtgaaacctttagggcagcttg

SEQ ID NO: 1785856 - DNA, 19 bp, Homo sapiens
gtgaaacgtcccacacttt

SEQ ID NO: 1785857 - DNA, 20 bp, Homo sapiens
gtgaaagaaagctgagaaga

SEQ ID NO: 1785858 - DNA, 15 bp, Homo sapiens
gtgacttcactgtat

SEQ ID NO: 1785859 - DNA, 11 bp, Homo sapiens
gtgacttctga

SEQ ID NO: 1785860 - DNA, 13 bp, Homo sapiens
gtgacttttgctt

SEQ ID NO: 1785861 - DNA, 19 bp, Homo sapiens
gtgagaaagggattgctga

SEQ ID NO: 1785862 - DNA, 20 bp, Homo sapiens
gtgagaactctctccctggt

SEQ ID NO: 1785863 - DNA, 20 bp, Homo sapiens
gtgagaagtgaatgctggga

SEQ ID NO: 1785864 - DNA, 15 bp, Homo sapiens
gtgagacccagtgca

SEQ ID NO: 1785865 - DNA, 22 bp, Homo sapiens
gtgagactcgagaactttcatt

SEQ ID NO: 1785866 - DNA, 18 bp, Homo sapiens
gtgagagaaagagagaag

SEQ ID NO: 1785867 - DNA, 14 bp, Homo sapiens
gtgagagattctgt

SEQ ID NO: 1785868 - DNA, 18 bp, Homo sapiens
gtgagagcgaggctgagc

SEQ ID NO: 1785869 - DNA, 14 bp, Homo sapiens
gtgagcacacccgt

SEQ ID NO: 1785870 - DNA, 12 bp, Homo sapiens
gtgagcagaaca

SEQ ID NO: 1785871 - DNA, 13 bp, Homo sapiens
gtgagcagaacag

SEQ ID NO: 1785872 - DNA, 14 bp, Homo sapiens
gtgagcagaacagg

SEQ ID NO: 1785873 - DNA, 19 bp, Homo sapiens
gtgagcagaagtggagctg

SEQ ID NO: 1785874 - DNA, 19 bp, Homo sapiens
gtgagcaggctttgggaac

SEQ ID NO: 1785875 - DNA, 15 bp, Homo sapiens
gtgagcatcagaggg

SEQ ID NO: 1785876 - DNA, 17 bp, Homo sapiens
gtgagcatcctggcagg

SEQ ID NO: 1785877 - DNA, 20 bp, Homo sapiens
gtgagcatccttcccagcag

SEQ ID NO: 1785878 - DNA, 12 bp, Homo sapiens
gtgagccaagga

SEQ ID NO: 1785879 - DNA, 20 bp, Homo sapiens
gtgagccacagaccacctgc

SEQ ID NO: 1785880 - DNA, 18 bp, Homo sapiens
gtgagccaccgctgccag

SEQ ID NO: 1785881 - DNA, 24 bp, Homo sapiens
gtgagccatgatcgagccactgca

SEQ ID NO: 1785882 - DNA, 21 bp, Homo sapiens
gtgagccgcatcttctccatc

SEQ ID NO: 1785883 - DNA, 23 bp, Homo sapiens
gtgagcgccccgcccccacccct

SEQ ID NO: 1785884 - DNA, 15 bp, Homo sapiens
gtgagctctggtgga

SEQ ID NO: 1785885 - DNA, 14 bp, Homo sapiens
gtgagctgagatca

SEQ ID NO: 1785886 - DNA, 20 bp, Homo sapiens
gtgaggacctgtaaggcagg

SEQ ID NO: 1785887 - DNA, 22 bp, Homo sapiens
gtgaggagaatgaaatgtatgt

SEQ ID NO: 1785888 - DNA, 13 bp, Homo sapiens
gtgaggaggaaaa

SEQ ID NO: 1785889 - DNA, 14 bp, Homo sapiens
gtgaggaggaaaag

SEQ ID NO: 1785890 - DNA, 15 bp, Homo sapiens
gtgaggatgtctggg

SEQ ID NO: 1785891 - DNA, 21 bp, Homo sapiens
gtgaggattatgggtcctgca

SEQ ID NO: 1785892 - DNA, 17 bp, Homo sapiens
gtgaggcaggggcggag

SEQ ID NO: 1785893 - DNA, 14 bp, Homo sapiens
gtgaggcccaagga

SEQ ID NO: 1785894 - DNA, 17 bp, Homo sapiens
gtgaggcccaaggagct

SEQ ID NO: 1785895 - DNA, 15 bp, Homo sapiens
gtgaggcggcagctg

SEQ ID NO: 1785896 - DNA, 18 bp, Homo sapiens
gtgaggcttccaggctct

SEQ ID NO: 1785897 - DNA, 11 bp, Homo sapiens
gtgagggagtt

SEQ ID NO: 1785898 - DNA, 16 bp, Homo sapiens
gtgaggggcaggtcta

SEQ ID NO: 1785899 - DNA, 16 bp, Homo sapiens
gtgagggtcccatgtg

SEQ ID NO: 1785900 - DNA, 21 bp, Homo sapiens
gtgaggtgcagagtgcccaga

SEQ ID NO: 1785901 - DNA, 14 bp, Homo sapiens
gtgagtaagagctg

SEQ ID NO: 1785902 - DNA, 14 bp, Homo sapiens
gtgagtcacctgct

SEQ ID NO: 1785903 - DNA, 13 bp, Homo sapiens
gtgagtcagcacc

SEQ ID NO: 1785904 - DNA, 17 bp, Homo sapiens
gtgagtcttggcggcag

SEQ ID NO: 1785905 - DNA, 19 bp, Homo sapiens
gtgagtcttggcggcagca

SEQ ID NO: 1785906 - DNA, 20 bp, Homo sapiens
gtgcagaccccttggccagc

SEQ ID NO: 1785907 - DNA, 16 bp, Homo sapiens
gtgcagagccttctca

SEQ ID NO: 1785908 - DNA, 15 bp, Homo sapiens
gtgcagaggtaccct

SEQ ID NO: 1785909 - DNA, 15 bp, Homo sapiens
gtgcagcagcccagc

SEQ ID NO: 1785910 - DNA, 11 bp, Homo sapiens
gtgcagccctc

SEQ ID NO: 1785911 - DNA, 18 bp, Homo sapiens
gtgcagcgcccctctgca

SEQ ID NO: 1785912 - DNA, 16 bp, Homo sapiens
gtgcaggacagctctt

SEQ ID NO: 1785913 - DNA, 16 bp, Homo sapiens
gtgcaggcagccttga

SEQ ID NO: 1785914 - DNA, 15 bp, Homo sapiens
gtgcagtacaggcaa

SEQ ID NO: 1785915 - DNA, 17 bp, Homo sapiens
gtgcagtgatacatgta

SEQ ID NO: 1785916 - DNA, 24 bp, Homo sapiens
gtgcagtggcgcgatctcagctca

SEQ ID NO: 1785917 - DNA, 20 bp, Homo sapiens
gtgcagttctagtttgcatt

SEQ ID NO: 1785918 - DNA, 16 bp, Homo sapiens
gtgcatagcgtcctgc

SEQ ID NO: 1785919 - DNA, 19 bp, Homo sapiens
gtgcatagcgtcctgccct

SEQ ID NO: 1785920 - DNA, 20 bp, Homo sapiens
gtgcatagcgtcctgccctg

SEQ ID NO: 1785921 - DNA, 20 bp, Homo sapiens
gtgcatagttgtagacaaag

SEQ ID NO: 1785922 - DNA, 16 bp, Homo sapiens
gtgcatccttgtaata

SEQ ID NO: 1785923 - DNA, 20 bp, Homo sapiens
gtgcatccttgtaatacctg

SEQ ID NO: 1785924 - DNA, 16 bp, Homo sapiens
gtgcatctagaaagct

SEQ ID NO: 1785925 - DNA, 13 bp, Homo sapiens
gtgcatctcagcc

SEQ ID NO: 1785926 - DNA, 22 bp, Homo sapiens
gtgcatgcctgtagtctcagct

SEQ ID NO: 1785927 - DNA, 13 bp, Homo sapiens
gtgcatgctctct

SEQ ID NO: 1785928 - DNA, 15 bp, Homo sapiens
gtgcatgctctctgc

SEQ ID NO: 1785929 - DNA, 16 bp, Homo sapiens
gtgcatgctctctgca

SEQ ID NO: 1785930 - DNA, 12 bp, Homo sapiens
gtgcatgggctc

SEQ ID NO: 1785931 - DNA, 16 bp, Homo sapiens
gtgcattatgtacaca

SEQ ID NO: 1785932 - DNA, 23 bp, Homo sapiens
gtgcattcatgcaagagtttctt

SEQ ID NO: 1785933 - DNA, 15 bp, Homo sapiens
gtgcattctttggta

SEQ ID NO: 1785934 - DNA, 16 bp, Homo sapiens
gtgcattgctgtgtga

SEQ ID NO: 1785935 - DNA, 20 bp, Homo sapiens
gtgcattggaagaccccacc

SEQ ID NO: 1785936 - DNA, 20 bp, Homo sapiens
gtgcattttgtttctgtata

SEQ ID NO: 1785937 - DNA, 18 bp, Homo sapiens
gtgcatttttgtgaaatg

SEQ ID NO: 1785938 - DNA, 22 bp, Homo sapiens
gtgcatttttgtgaaatgaaaa

SEQ ID NO: 1785939 - DNA, 18 bp, Homo sapiens
gtgccaaatagccccaga

SEQ ID NO: 1785940 - DNA, 19 bp, Homo sapiens
gtgccaaatagccccagac

SEQ ID NO: 1785941 - DNA, 16 bp, Homo sapiens
gtgccaagattctact

SEQ ID NO: 1785942 - DNA, 17 bp, Homo sapiens
gtgccaagggccccagg

SEQ ID NO: 1785943 - DNA, 16 bp, Homo sapiens
gtgccaccatgcctca

SEQ ID NO: 1785944 - DNA, 20 bp, Homo sapiens
gtgccacccgtaggcagcct

SEQ ID NO: 1785945 - DNA, 13 bp, Homo sapiens
gtgccactccctg

SEQ ID NO: 1785946 - DNA, 17 bp, Homo sapiens
gtgccactccctgagct

SEQ ID NO: 1785947 - DNA, 14 bp, Homo sapiens
gtgccactgacttg

SEQ ID NO: 1785948 - DNA, 22 bp, Homo sapiens
gtgccactgacttgctgtgtga

SEQ ID NO: 1785949 - DNA, 12 bp, Homo sapiens
gtgccactgccc

SEQ ID NO: 1785950 - DNA, 13 bp, Homo sapiens
gtgccactgcggg

SEQ ID NO: 1785951 - DNA, 23 bp, Homo sapiens
gtgccactttacccacctagaac

SEQ ID NO: 1785952 - DNA, 18 bp, Homo sapiens
gtgccagaggtgggcagg

SEQ ID NO: 1785953 - DNA, 18 bp, Homo sapiens
gtgccagatataactgtc

SEQ ID NO: 1785954 - DNA, 21 bp, Homo sapiens
gtgccagcagcctcgcacagg

SEQ ID NO: 1785955 - DNA, 14 bp, Homo sapiens
gtgccaggaccagc

SEQ ID NO: 1785956 - DNA, 21 bp, Homo sapiens
gtgccaggatggaatgatggg

SEQ ID NO: 1785957 - DNA, 14 bp, Homo sapiens
gtgccatgcctgct

SEQ ID NO: 1785958 - DNA, 13 bp, Homo sapiens
gtgccatgctggg

SEQ ID NO: 1785959 - DNA, 15 bp, Homo sapiens
gtgccatgctgggcc

SEQ ID NO: 1785960 - DNA, 17 bp, Homo sapiens
gtgccatggatctgatc

SEQ ID NO: 1785961 - DNA, 20 bp, Homo sapiens
gtgccatggatttccactgc

SEQ ID NO: 1785962 - DNA, 12 bp, Homo sapiens
gtgccatgtctg

SEQ ID NO: 1785963 - DNA, 16 bp, Homo sapiens
gtgccattcccagcgt

SEQ ID NO: 1785964 - DNA, 19 bp, Homo sapiens
gtgcccaaacaccagtcac

SEQ ID NO: 1785965 - DNA, 20 bp, Homo sapiens
gtgcccaagaatagatgctg

SEQ ID NO: 1785966 - DNA, 12 bp, Homo sapiens
gtgcccaagcca

SEQ ID NO: 1785967 - DNA, 23 bp, Homo sapiens
gtgcccaccaacatcccattgcc

SEQ ID NO: 1785968 - DNA, 16 bp, Homo sapiens
gtgcccagcacctgga

SEQ ID NO: 1785969 - DNA, 13 bp, Homo sapiens
gtgcccagcaggc

SEQ ID NO: 1785970 - DNA, 18 bp, Homo sapiens
gtgcccagcaggcccagc

SEQ ID NO: 1785971 - DNA, 16 bp, Homo sapiens
gtgcccagcccctgcc

SEQ ID NO: 1785972 - DNA, 14 bp, Homo sapiens
gtgcccaggccctt

SEQ ID NO: 1785973 - DNA, 16 bp, Homo sapiens
gtgcccagggccagtg

SEQ ID NO: 1785974 - DNA, 21 bp, Homo sapiens
gtgcccagggccagtgggacc

SEQ ID NO: 1785975 - DNA, 22 bp, Homo sapiens
gtgcccagggttttgccccaag

SEQ ID NO: 1785976 - DNA, 13 bp, Homo sapiens
gtgccccacctgc

SEQ ID NO: 1785977 - DNA, 17 bp, Homo sapiens
gtgccccacctgcctgg

SEQ ID NO: 1785978 - DNA, 21 bp, Homo sapiens
gtgccccacctgcctggtgca

SEQ ID NO: 1785979 - DNA, 15 bp, Homo sapiens
gtgccccactccagc

SEQ ID NO: 1785980 - DNA, 16 bp, Homo sapiens
gtgccccactccagcc

SEQ ID NO: 1785981 - DNA, 12 bp, Homo sapiens
gtctgattctat

SEQ ID NO: 1785982 - DNA, 15 bp, Homo sapiens
gtctgattggctgct

SEQ ID NO: 1785983 - DNA, 15 bp, Homo sapiens
gtctgcaagggccca

SEQ ID NO: 1785984 - DNA, 17 bp, Homo sapiens
gtctgcaagggcccaga

SEQ ID NO: 1785985 - DNA, 19 bp, Homo sapiens
gtctgcaagggcccagagt

SEQ ID NO: 1785986 - DNA, 20 bp, Homo sapiens
gtctgcaagggcccagagtg

SEQ ID NO: 1785987 - DNA, 17 bp, Homo sapiens
gtctgcagtgcccggct

SEQ ID NO: 1785988 - DNA, 21 bp, Homo sapiens
gtctgccaatttttgccttca

SEQ ID NO: 1785989 - DNA, 15 bp, Homo sapiens
gtctgccagccagca

SEQ ID NO: 1785990 - DNA, 13 bp, Homo sapiens
gtctgccaggccc

SEQ ID NO: 1785991 - DNA, 21 bp, Homo sapiens
gtctgccaggcccatctcagg

SEQ ID NO: 1785992 - DNA, 15 bp, Homo sapiens
gtctgccccacatgt

SEQ ID NO: 1785993 - DNA, 12 bp, Homo sapiens
gtctgccccagc

SEQ ID NO: 1785994 - DNA, 20 bp, Homo sapiens
gtctgcccctcggggtgtca

SEQ ID NO: 1785995 - DNA, 19 bp, Homo sapiens
gtctgcctaggagctggct

SEQ ID NO: 1785996 - DNA, 13 bp, Homo sapiens
gtctgcctggagg

SEQ ID NO: 1785997 - DNA, 11 bp, Homo sapiens
gtctgcctgta

SEQ ID NO: 1785998 - DNA, 17 bp, Homo sapiens
gtctgctaaataaacat

SEQ ID NO: 1785999 - DNA, 18 bp, Homo sapiens
gtctgctaggcgctgggg

SEQ ID NO: 1786000 - DNA, 14 bp, Homo sapiens
gtctgctctggtgg

SEQ ID NO: 1786001 - DNA, 16 bp, Homo sapiens
gtctgctctggtggct

SEQ ID NO: 1786002 - DNA, 22 bp, Homo sapiens
gtctgctgagttggcctggcca

SEQ ID NO: 1786003 - DNA, 13 bp, Homo sapiens
gtctgctgccagc

SEQ ID NO: 1786004 - DNA, 14 bp, Homo sapiens
gtctgctgccagca

SEQ ID NO: 1786005 - DNA, 21 bp, Homo sapiens
gtctgctgctgcctccctggg

SEQ ID NO: 1786006 - DNA, 18 bp, Homo sapiens
gtctgctggtatttctaa

SEQ ID NO: 1786007 - DNA, 19 bp, Homo sapiens
gtctggagaagcagtgagc

SEQ ID NO: 1786008 - DNA, 16 bp, Homo sapiens
gtctggagaaggtatt

SEQ ID NO: 1786009 - DNA, 22 bp, Homo sapiens
gtctggatctgggaccctttcc

SEQ ID NO: 1786010 - DNA, 17 bp, Homo sapiens
gtctggctccctgcccc

SEQ ID NO: 1786011 - DNA, 23 bp, Homo sapiens
gtctggctccctgccccttaacc

SEQ ID NO: 1786012 - DNA, 15 bp, Homo sapiens
gtctggctttgctct

SEQ ID NO: 1786013 - DNA, 21 bp, Homo sapiens
gtctggctttggtgaactgtt

SEQ ID NO: 1786014 - DNA, 19 bp, Homo sapiens
gtctgggatatggctgccc

SEQ ID NO: 1786015 - DNA, 12 bp, Homo sapiens
gtctgggatctg

SEQ ID NO: 1786016 - DNA, 21 bp, Homo sapiens
gtctgggatctgttttctgga

SEQ ID NO: 1786017 - DNA, 19 bp, Homo sapiens
gtctgggatgtagaacttc

SEQ ID NO: 1786018 - DNA, 15 bp, Homo sapiens
gtctggggtgaggga

SEQ ID NO: 1786019 - DNA, 15 bp, Homo sapiens
gtctggggtgtgggg

SEQ ID NO: 1786020 - DNA, 13 bp, Homo sapiens
gtctggtgcagaa

SEQ ID NO: 1786021 - DNA, 13 bp, Homo sapiens
gtctggtggcccc

SEQ ID NO: 1786022 - DNA, 14 bp, Homo sapiens
gtctggtttctaga

SEQ ID NO: 1786023 - DNA, 14 bp, Homo sapiens
gtctgtacacgtgt

SEQ ID NO: 1786024 - DNA, 18 bp, Homo sapiens
gtctgtatactcctgtca

SEQ ID NO: 1786025 - DNA, 20 bp, Homo sapiens
gtctgtatactcctgtcacc

SEQ ID NO: 1786026 - DNA, 23 bp, Homo sapiens
gtctgtatagtctagactttaaa

SEQ ID NO: 1786027 - DNA, 19 bp, Homo sapiens
gtctgtatttatgtgtgag

SEQ ID NO: 1786028 - DNA, 22 bp, Homo sapiens
gtctgtcatgaacatgttcctg

SEQ ID NO: 1786029 - DNA, 19 bp, Homo sapiens
gtctgtcctgatttctaca

SEQ ID NO: 1786030 - DNA, 16 bp, Homo sapiens
gtctgtcgtgatgggg

SEQ ID NO: 1786031 - DNA, 24 bp, Homo sapiens
gtctgtctccctcccctctcagaa

SEQ ID NO: 1786032 - DNA, 18 bp, Homo sapiens
gtctgtctcgatgcctga

SEQ ID NO: 1786033 - DNA, 22 bp, Homo sapiens
gtctgtctctccatctgtttgg

SEQ ID NO: 1786034 - DNA, 15 bp, Homo sapiens
gtctgtgactggatc

SEQ ID NO: 1786035 - DNA, 22 bp, Homo sapiens
gtgcctcgaggcaccggcgctg

SEQ ID NO: 1786036 - DNA, 13 bp, Homo sapiens
gtgcctctgggac

SEQ ID NO: 1786037 - DNA, 18 bp, Homo sapiens
gtgcctctgtgcacagtg

SEQ ID NO: 1786038 - DNA, 14 bp, Homo sapiens
gtgcctgagaggca

SEQ ID NO: 1786039 - DNA, 12 bp, Homo sapiens
gtgcctgagagt

SEQ ID NO: 1786040 - DNA, 16 bp, Homo sapiens
gtgcctgagctgggga

SEQ ID NO: 1786041 - DNA, 17 bp, Homo sapiens
gtgcctgcaccaggaga

SEQ ID NO: 1786042 - DNA, 16 bp, Homo sapiens
gtgcctgcactgagag

SEQ ID NO: 1786043 - DNA, 16 bp, Homo sapiens
gtgcctgctagagcaa

SEQ ID NO: 1786044 - DNA, 22 bp, Homo sapiens
gtgcctgctagagcaacccctg

SEQ ID NO: 1786045 - DNA, 23 bp, Homo sapiens
gtgcctgctagagcaacccctgt

SEQ ID NO: 1786046 - DNA, 16 bp, Homo sapiens
gtgcctgctcagcagc

SEQ ID NO: 1786047 - DNA, 17 bp, Homo sapiens
gtgcctgctcagcagcc

SEQ ID NO: 1786048 - DNA, 15 bp, Homo sapiens
gtgcctgggaatgta

SEQ ID NO: 1786049 - DNA, 17 bp, Homo sapiens
gtgcctgggaatgtatt

SEQ ID NO: 1786050 - DNA, 16 bp, Homo sapiens
gtgcctgggccctggg

SEQ ID NO: 1786051 - DNA, 19 bp, Homo sapiens
gtgcctgggccctgggctg

SEQ ID NO: 1786052 - DNA, 22 bp, Homo sapiens
gtgcctgggtggggctgctcct

SEQ ID NO: 1786053 - DNA, 11 bp, Homo sapiens
gtgcctggtca

SEQ ID NO: 1786054 - DNA, 15 bp, Homo sapiens
gtgcctgtcccaccc

SEQ ID NO: 1786055 - DNA, 20 bp, Homo sapiens
gtgcctgtcccacccccacc

SEQ ID NO: 1786056 - DNA, 12 bp, Homo sapiens
gtgcctgtggca

SEQ ID NO: 1786057 - DNA, 12 bp, Homo sapiens
gtgcctgtgtcc

SEQ ID NO: 1786058 - DNA, 14 bp, Homo sapiens
gtgccttacctcct

SEQ ID NO: 1786059 - DNA, 17 bp, Homo sapiens
gtgccttacctcctgcc

SEQ ID NO: 1786060 - DNA, 18 bp, Homo sapiens
gtgccttacctcctgccc

SEQ ID NO: 1786061 - DNA, 15 bp, Homo sapiens
gtgccttccataatt

SEQ ID NO: 1786062 - DNA, 12 bp, Homo sapiens
gtgccttccctt

SEQ ID NO: 1786063 - DNA, 16 bp, Homo sapiens
gtgccttcccttctct

SEQ ID NO: 1786064 - DNA, 18 bp, Homo sapiens
gtgccttctctcagctcc

SEQ ID NO: 1786065 - DNA, 21 bp, Homo sapiens
gtgccttctctcagctcccag

SEQ ID NO: 1786066 - DNA, 21 bp, Homo sapiens
gtgccttggggaatttcctct

SEQ ID NO: 1786067 - DNA, 18 bp, Homo sapiens
gtgcctttctacaactga

SEQ ID NO: 1786068 - DNA, 14 bp, Homo sapiens
gtgcctttctttgc

SEQ ID NO: 1786069 - DNA, 19 bp, Homo sapiens
gtgccttttgcacccctcc

SEQ ID NO: 1786070 - DNA, 16 bp, Homo sapiens
gtgcctttttcctaga

SEQ ID NO: 1786071 - DNA, 17 bp, Homo sapiens
gtgcctttttcctagaa

SEQ ID NO: 1786072 - DNA, 23 bp, Homo sapiens
gtgcgacagagagaggggagaga

SEQ ID NO: 1786073 - DNA, 18 bp, Homo sapiens
gtgcgcatcttgcctcca

SEQ ID NO: 1786074 - DNA, 20 bp, Homo sapiens
gtgcgcatcttgcctccagg

SEQ ID NO: 1786075 - DNA, 24 bp, Homo sapiens
gtgcgcatcttgcctccaggtgca

SEQ ID NO: 1786076 - DNA, 13 bp, Homo sapiens
gtgcgcccagggc

SEQ ID NO: 1786077 - DNA, 16 bp, Homo sapiens
gtgcgcccagggctgg

SEQ ID NO: 1786078 - DNA, 12 bp, Homo sapiens
gtgcgcccgtgg

SEQ ID NO: 1786079 - DNA, 19 bp, Homo sapiens
gtgcgctcttggtccctgg

SEQ ID NO: 1786080 - DNA, 17 bp, Homo sapiens
gtgcgctgcctggccag

SEQ ID NO: 1786081 - DNA, 17 bp, Homo sapiens
gtgcgggcacaataaat

SEQ ID NO: 1786082 - DNA, 12 bp, Homo sapiens
gtgcgggcctgg

SEQ ID NO: 1786083 - DNA, 16 bp, Homo sapiens
gtgcgggcctggccct

SEQ ID NO: 1786084 - DNA, 14 bp, Homo sapiens
gtgcggttcctcat

SEQ ID NO: 1786085 - DNA, 13 bp, Homo sapiens
gtgcgtcccagct

SEQ ID NO: 1786086 - DNA, 16 bp, Homo sapiens
gtgcgtctccagtcat

SEQ ID NO: 1786087 - DNA, 16 bp, Homo sapiens
gtgcgtgcgtgtgtgt

SEQ ID NO: 1786088 - DNA, 15 bp, Homo sapiens
gtgcgtggctgtggc

SEQ ID NO: 1786089 - DNA, 23 bp, Homo sapiens
gtgcgtggtatacatgtgtacat

SEQ ID NO: 1786090 - DNA, 17 bp, Homo sapiens
gtgctaaagccaaccag

SEQ ID NO: 1786091 - DNA, 22 bp, Homo sapiens
gtgctaaatggtcgcccaggag

SEQ ID NO: 1786092 - DNA, 16 bp, Homo sapiens
gtgctaaattttcagt

SEQ ID NO: 1786093 - DNA, 15 bp, Homo sapiens
gtgctacaaaaacac

SEQ ID NO: 1786094 - DNA, 20 bp, Homo sapiens
gtgctacaaaaacacagcaa

SEQ ID NO: 1786095 - DNA, 16 bp, Homo sapiens
gtgctacaacatgtga

SEQ ID NO: 1786096 - DNA, 16 bp, Homo sapiens
gtgctacctgggtcct

SEQ ID NO: 1786097 - DNA, 16 bp, Homo sapiens
gtgctactgattgttt

SEQ ID NO: 1786098 - DNA, 19 bp, Homo sapiens
gtgctaggaagaggagtgg

SEQ ID NO: 1786099 - DNA, 19 bp, Homo sapiens
gtgctataaatgccagagc

SEQ ID NO: 1786100 - DNA, 21 bp, Homo sapiens
gtgctataaatgccagagcca

SEQ ID NO: 1786101 - DNA, 22 bp, Homo sapiens
gtgctataatctgtttttacgt

SEQ ID NO: 1786102 - DNA, 13 bp, Homo sapiens
gtgctatgcaaaa

SEQ ID NO: 1786103 - DNA, 17 bp, Homo sapiens
gtgctatgcggaggaaa

SEQ ID NO: 1786104 - DNA, 13 bp, Homo sapiens
gtgctattctgtg

SEQ ID NO: 1786105 - DNA, 23 bp, Homo sapiens
gtgctattgtagagccagaggtc

SEQ ID NO: 1786106 - DNA, 14 bp, Homo sapiens
gtgctatttgtaca

SEQ ID NO: 1786107 - DNA, 17 bp, Homo sapiens
gtgctatttgtacaaat

SEQ ID NO: 1786108 - DNA, 18 bp, Homo sapiens
gtgctatttgtacaaata

SEQ ID NO: 1786109 - DNA, 22 bp, Homo sapiens
gtgctatttgtacaaataaacc

SEQ ID NO: 1786110 - DNA, 17 bp, Homo sapiens
gtgctcacgctcccccg

SEQ ID NO: 1786111 - DNA, 20 bp, Homo sapiens
gtgctcacgctcccccgcag

SEQ ID NO: 1786112 - DNA, 16 bp, Homo sapiens
gtgctcagaagggcta

SEQ ID NO: 1786113 - DNA, 19 bp, Homo sapiens
gtgctcagccaaatttcct

SEQ ID NO: 1786114 - DNA, 19 bp, Homo sapiens
gtggatgctccagggcagc

SEQ ID NO: 1786115 - DNA, 18 bp, Homo sapiens
gtggatggccgtggatgc

SEQ ID NO: 1786116 - DNA, 15 bp, Homo sapiens
gtggatgttatgaac

SEQ ID NO: 1786117 - DNA, 17 bp, Homo sapiens
gtggattatttcatttt

SEQ ID NO: 1786118 - DNA, 13 bp, Homo sapiens
gtggattctatat

SEQ ID NO: 1786119 - DNA, 13 bp, Homo sapiens
gtggattgagggt

SEQ ID NO: 1786120 - DNA, 16 bp, Homo sapiens
gtggattggctttgtg

SEQ ID NO: 1786121 - DNA, 14 bp, Homo sapiens
gtggcaaagtgctg

SEQ ID NO: 1786122 - DNA, 15 bp, Homo sapiens
gtggcaaagtgctgt

SEQ ID NO: 1786123 - DNA, 18 bp, Homo sapiens
gtggcaaagtgctgtacc

SEQ ID NO: 1786124 - DNA, 20 bp, Homo sapiens
gtggcaaagtgctgtaccct

SEQ ID NO: 1786125 - DNA, 15 bp, Homo sapiens
gtggcaagaccaaaa

SEQ ID NO: 1786126 - DNA, 17 bp, Homo sapiens
gtggcaagagtgtggag

SEQ ID NO: 1786127 - DNA, 13 bp, Homo sapiens
gtggcaattagtg

SEQ ID NO: 1786128 - DNA, 22 bp, Homo sapiens
gtggcacagacttctggaaggc

SEQ ID NO: 1786129 - DNA, 17 bp, Homo sapiens
gtggcacagccctgagt

SEQ ID NO: 1786130 - DNA, 23 bp, Homo sapiens
gtggcacagccctgagtgtccca

SEQ ID NO: 1786131 - DNA, 12 bp, Homo sapiens
gtggcacaggcc

SEQ ID NO: 1786132 - DNA, 16 bp, Homo sapiens
gtggcacaggccccct

SEQ ID NO: 1786133 - DNA, 15 bp, Homo sapiens
gtggcacctcctgag

SEQ ID NO: 1786134 - DNA, 19 bp, Homo sapiens
gtggcactcaactctgagc

SEQ ID NO: 1786135 - DNA, 21 bp, Homo sapiens
gtggcactcaactctgagccc

SEQ ID NO: 1786136 - DNA, 12 bp, Homo sapiens
gtggcactggga

SEQ ID NO: 1786137 - DNA, 24 bp, Homo sapiens
gtggcagaaaagaggagaccctgg

SEQ ID NO: 1786138 - DNA, 13 bp, Homo sapiens
gtggcagccatgc

SEQ ID NO: 1786139 - DNA, 15 bp, Homo sapiens
gtggcagccatgcct

SEQ ID NO: 1786140 - DNA, 22 bp, Homo sapiens
gtggcagccatgcctcatgcca

SEQ ID NO: 1786141 - DNA, 15 bp, Homo sapiens
gtggcagctggggag

SEQ ID NO: 1786142 - DNA, 19 bp, Homo sapiens
gtggcagctgttagggctg

SEQ ID NO: 1786143 - DNA, 16 bp, Homo sapiens
gtggcaggggacagga

SEQ ID NO: 1786144 - DNA, 22 bp, Homo sapiens
gtggcagggggccccgccaggg

SEQ ID NO: 1786145 - DNA, 18 bp, Homo sapiens
gtggcagtggaggtgggg

SEQ ID NO: 1786146 - DNA, 15 bp, Homo sapiens
gtggcagtggccagg

SEQ ID NO: 1786147 - DNA, 18 bp, Homo sapiens
gtggcagtggccaggcag

SEQ ID NO: 1786148 - DNA, 19 bp, Homo sapiens
gtggcagtggccaggcagg

SEQ ID NO: 1786149 - DNA, 22 bp, Homo sapiens
gtggcatcgtagaagagatgtg

SEQ ID NO: 1786150 - DNA, 21 bp, Homo sapiens
gtggcatctttgccttgggct

SEQ ID NO: 1786151 - DNA, 14 bp, Homo sapiens
gtggcatggaaggg

SEQ ID NO: 1786152 - DNA, 18 bp, Homo sapiens
gtggcatgtggcctgtgg

SEQ ID NO: 1786153 - DNA, 22 bp, Homo sapiens
gtggcatgttcatcgtataaca

SEQ ID NO: 1786154 - DNA, 17 bp, Homo sapiens
gtggccaacgtggacct

SEQ ID NO: 1786155 - DNA, 21 bp, Homo sapiens
gtggccaacgtggacctgcct

SEQ ID NO: 1786156 - DNA, 15 bp, Homo sapiens
gtggccaagaagcag

SEQ ID NO: 1786157 - DNA, 21 bp, Homo sapiens
gtggccacagcccccttgccc

SEQ ID NO: 1786158 - DNA, 23 bp, Homo sapiens
gtggccacgggggcagtgtgagg

SEQ ID NO: 1786159 - DNA, 21 bp, Homo sapiens
gtggccactccagacccctgg

SEQ ID NO: 1786160 - DNA, 15 bp, Homo sapiens
gtggccagagctgga

SEQ ID NO: 1786161 - DNA, 18 bp, Homo sapiens
gtggccagagctggaagg

SEQ ID NO: 1786162 - DNA, 19 bp, Homo sapiens
gtggccagagctggaaggc

SEQ ID NO: 1786163 - DNA, 13 bp, Homo sapiens
gtggccagaggtg

SEQ ID NO: 1786164 - DNA, 14 bp, Homo sapiens
gtggccagcccggc

SEQ ID NO: 1786165 - DNA, 14 bp, Homo sapiens
gtggccagcctgga

SEQ ID NO: 1786166 - DNA, 19 bp, Homo sapiens
gtggccatgttatgctggt

SEQ ID NO: 1786167 - DNA, 19 bp, Homo sapiens
gtggccccaccctgggccc

SEQ ID NO: 1786168 - DNA, 16 bp, Homo sapiens
gtggccccgtttctgg

SEQ ID NO: 1786169 - DNA, 17 bp, Homo sapiens
gtggccccgtttctggt

SEQ ID NO: 1786170 - DNA, 20 bp, Homo sapiens
gtggcccctgctgtctctct

SEQ ID NO: 1786171 - DNA, 23 bp, Homo sapiens
gtggcccctgctgtctctctggg

SEQ ID NO: 1786172 - DNA, 17 bp, Homo sapiens
gtggcccgacagcctgg

SEQ ID NO: 1786173 - DNA, 19 bp, Homo sapiens
gtggcccgacagcctggca

SEQ ID NO: 1786174 - DNA, 17 bp, Homo sapiens
gtggccctgccctctcc

SEQ ID NO: 1786175 - DNA, 21 bp, Homo sapiens
gtggccctgccctctccttcc

SEQ ID NO: 1786176 - DNA, 13 bp, Homo sapiens
gtggccctggcct

SEQ ID NO: 1786177 - DNA, 17 bp, Homo sapiens
gtggccctggcctgctg

SEQ ID NO: 1786178 - DNA, 19 bp, Homo sapiens
gtggccctggcctgctggg

SEQ ID NO: 1786179 - DNA, 17 bp, Homo sapiens
gtggccgcctggcaggt

SEQ ID NO: 1786180 - DNA, 14 bp, Homo sapiens
gtggccgggcacag

SEQ ID NO: 1786181 - DNA, 13 bp, Homo sapiens
gtggccgtctcct

SEQ ID NO: 1786182 - DNA, 9 bp, Homo sapiens
gtggcctca

SEQ ID NO: 1786183 - DNA, 13 bp, Homo sapiens
gtggcctcagaat

SEQ ID NO: 1786184 - DNA, 22 bp, Homo sapiens
gtggcctcagctcaatgcagtt

SEQ ID NO: 1786185 - DNA, 14 bp, Homo sapiens
gtggcctccctgct

SEQ ID NO: 1786186 - DNA, 16 bp, Homo sapiens
gtggcctctgcctggg

SEQ ID NO: 1786187 - DNA, 17 bp, Homo sapiens
gtggcctcttgagcagt

SEQ ID NO: 1786188 - DNA, 20 bp, Homo sapiens
gtggcctcttgagcagtggc

SEQ ID NO: 1786189 - DNA, 18 bp, Homo sapiens
gtggcctggccaggagct

SEQ ID NO: 1786190 - DNA, 20 bp, Homo sapiens
gtggcctggccaggagctct

SEQ ID NO: 1786191 - DNA, 21 bp, Homo sapiens
gtggcctggccaggagctctt

SEQ ID NO: 1786192 - DNA, 12 bp, Homo sapiens
gtggcctgggca

SEQ ID NO: 1786193 - DNA, 14 bp, Homo sapiens
gtggcctgggcaag

SEQ ID NO: 1786194 - DNA, 19 bp, Homo sapiens
gtggcctgtgtccagcagc

SEQ ID NO: 1786195 - DNA, 17 bp, Homo sapiens
gtggcctgtgtcccatg

SEQ ID NO: 1786196 - DNA, 17 bp, Homo sapiens
gtggcctgttccctaga

SEQ ID NO: 1786197 - DNA, 12 bp, Homo sapiens
gtggccttcccc

SEQ ID NO: 1786198 - DNA, 20 bp, Homo sapiens
gtggccttccccagcctctt

SEQ ID NO: 1786199 - DNA, 17 bp, Homo sapiens
gtggcgactctgcagag

SEQ ID NO: 1786200 - DNA, 19 bp, Homo sapiens
gtggcgcgatctcagctca

SEQ ID NO: 1786201 - DNA, 14 bp, Homo sapiens
gtggcgctttctcc

SEQ ID NO: 1786202 - DNA, 21 bp, Homo sapiens
gtggcgctttctcctgtgccc

SEQ ID NO: 1786203 - DNA, 22 bp, Homo sapiens
gtggcgctttctcctgtgccca

SEQ ID NO: 1786204 - DNA, 14 bp, Homo sapiens
gtggcggccttccg

SEQ ID NO: 1786205 - DNA, 14 bp, Homo sapiens
gtggcggtgcctgg

SEQ ID NO: 1786206 - DNA, 19 bp, Homo sapiens
gtggcgtgatctcagctca

SEQ ID NO: 1786207 - DNA, 18 bp, Homo sapiens
gtggcgtgggagccagcc

SEQ ID NO: 1786208 - DNA, 20 bp, Homo sapiens
gtggctaccattgtcactcg

SEQ ID NO: 1786209 - DNA, 20 bp, Homo sapiens
gtggctcagtgccttcctct

SEQ ID NO: 1786210 - DNA, 21 bp, Homo sapiens
gtggctccccctctgcttctc

SEQ ID NO: 1786211 - DNA, 18 bp, Homo sapiens
gtggctcctatctgtgtt

SEQ ID NO: 1786212 - DNA, 20 bp, Homo sapiens
gtggctcctatctgtgtttt

SEQ ID NO: 1786213 - DNA, 15 bp, Homo sapiens
gtggctcctgggccg

SEQ ID NO: 1786214 - DNA, 13 bp, Homo sapiens
gtggctccttccc

SEQ ID NO: 1786215 - DNA, 23 bp, Homo sapiens
gtggctctgggaatgggagaggg

SEQ ID NO: 1786216 - DNA, 20 bp, Homo sapiens
gtggctgaaaatgcaaagct

SEQ ID NO: 1786217 - DNA, 15 bp, Homo sapiens
gtggctgacccagtc

SEQ ID NO: 1786218 - DNA, 13 bp, Homo sapiens
gtggctgccccgg

SEQ ID NO: 1786219 - DNA, 15 bp, Homo sapiens
gtggctgccccggcc

SEQ ID NO: 1786220 - DNA, 19 bp, Homo sapiens
gtggctgctagcacttgga

SEQ ID NO: 1786221 - DNA, 19 bp, Homo sapiens
gtggctgctcccagcctct

SEQ ID NO: 1786222 - DNA, 17 bp, Homo sapiens
gtggctggaagatcctg

SEQ ID NO: 1786223 - DNA, 17 bp, Homo sapiens
gtggctggatctgtgag

SEQ ID NO: 1786224 - DNA, 12 bp, Homo sapiens
gtggctgggacc

SEQ ID NO: 1786225 - DNA, 13 bp, Homo sapiens
gtggctgggacct

SEQ ID NO: 1786226 - DNA, 14 bp, Homo sapiens
gtggctgggacctt

SEQ ID NO: 1786227 - DNA, 11 bp, Homo sapiens
gtggctgggca

SEQ ID NO: 1786228 - DNA, 12 bp, Homo sapiens
gtggctgggtgc

SEQ ID NO: 1786229 - DNA, 15 bp, Homo sapiens
gtggctggtccaggg

SEQ ID NO: 1786230 - DNA, 13 bp, Homo sapiens
gtggcttcccagc

SEQ ID NO: 1786231 - DNA, 19 bp, Homo sapiens
gtggcttcccgctcagccc

SEQ ID NO: 1786232 - DNA, 17 bp, Homo sapiens
gtggcttccctgtccca

SEQ ID NO: 1786233 - DNA, 14 bp, Homo sapiens
gtggcttggagtgg

SEQ ID NO: 1786234 - DNA, 21 bp, Homo sapiens
gtggcttggggattgtacacg

SEQ ID NO: 1786235 - DNA, 15 bp, Homo sapiens
gtggctttaattgta

SEQ ID NO: 1786236 - DNA, 19 bp, Homo sapiens
gtggctttggcagtgtttt

SEQ ID NO: 1786237 - DNA, 17 bp, Homo sapiens
gtgggaactcactttcc

SEQ ID NO: 1786238 - DNA, 21 bp, Homo sapiens
gtgggaagaccaaaggaagga

SEQ ID NO: 1786239 - DNA, 12 bp, Homo sapiens
gtgggaagagaa

SEQ ID NO: 1786240 - DNA, 21 bp, Homo sapiens
gtgggaagcccatcctgacca

SEQ ID NO: 1786241 - DNA, 17 bp, Homo sapiens
gtgggaagcgtctgtcc

SEQ ID NO: 1786242 - DNA, 13 bp, Homo sapiens
gtgggaagggaga

SEQ ID NO: 1786243 - DNA, 18 bp, Homo sapiens
gtgggacacaacacagat

SEQ ID NO: 1786244 - DNA, 14 bp, Homo sapiens
gtgggacagtggtg

SEQ ID NO: 1786245 - DNA, 11 bp, Homo sapiens
gtgggaccagt

SEQ ID NO: 1786246 - DNA, 14 bp, Homo sapiens
gtgggagacagcag

SEQ ID NO: 1786247 - DNA, 15 bp, Homo sapiens
gtgggagacagcagc

SEQ ID NO: 1786248 - DNA, 17 bp, Homo sapiens
gtgggagacagcagcct

SEQ ID NO: 1786249 - DNA, 13 bp, Homo sapiens
gtgggagagccca

SEQ ID NO: 1786250 - DNA, 14 bp, Homo sapiens
gtgggagcacctgc

SEQ ID NO: 1786251 - DNA, 19 bp, Homo sapiens
gtgggagcagcggtttggg

SEQ ID NO: 1786252 - DNA, 23 bp, Homo sapiens
gtgggagctcctccgcagaaggt

SEQ ID NO: 1786253 - DNA, 13 bp, Homo sapiens
gtgggagctgagc

SEQ ID NO: 1786254 - DNA, 17 bp, Homo sapiens
gtgggagctgagctgga

SEQ ID NO: 1786255 - DNA, 21 bp, Homo sapiens
gtgggagcttcccacacctgc

SEQ ID NO: 1786256 - DNA, 15 bp, Homo sapiens
gtgggaggcgtgccc

SEQ ID NO: 1786257 - DNA, 14 bp, Homo sapiens
gtgggaggggcagg

SEQ ID NO: 1786258 - DNA, 17 bp, Homo sapiens
gtgggaggtggaagaag

SEQ ID NO: 1786259 - DNA, 19 bp, Homo sapiens
gtgggagtgtgtctgctga

SEQ ID NO: 1786260 - DNA, 14 bp, Homo sapiens
gtgggagtgtgtgc

SEQ ID NO: 1786261 - DNA, 17 bp, Homo sapiens
gtgggagtgtgtgcctg

SEQ ID NO: 1786262 - DNA, 16 bp, Homo sapiens
gtgggatcctccctca

SEQ ID NO: 1786263 - DNA, 16 bp, Homo sapiens
gtgggatggaggagaa

SEQ ID NO: 1786264 - DNA, 17 bp, Homo sapiens
gtgggatggaggagaag

SEQ ID NO: 1786265 - DNA, 23 bp, Homo sapiens
gtgggatgttcagcactgtccct

SEQ ID NO: 1786266 - DNA, 15 bp, Homo sapiens
gtgggcactggtggg

SEQ ID NO: 1786267 - DNA, 16 bp, Homo sapiens
gtgggcagctgggccc

SEQ ID NO: 1786268 - DNA, 18 bp, Homo sapiens
gtgggcaggtggtggcac

SEQ ID NO: 1786269 - DNA, 17 bp, Homo sapiens
gtgggccaacaaagaac

SEQ ID NO: 1786270 - DNA, 18 bp, Homo sapiens
gtgggccaggacaggccc

SEQ ID NO: 1786271 - DNA, 15 bp, Homo sapiens
gtgggccagtctgtg

SEQ ID NO: 1786272 - DNA, 16 bp, Homo sapiens
gtgggccagtctgtgg

SEQ ID NO: 1786273 - DNA, 17 bp, Homo sapiens
gtgggccagtctgtgga

SEQ ID NO: 1786274 - DNA, 18 bp, Homo sapiens
gtgggccagtctgtggat

SEQ ID NO: 1786275 - DNA, 14 bp, Homo sapiens
gtgggcccaggacc

SEQ ID NO: 1786276 - DNA, 23 bp, Homo sapiens
gtgggcccataatagttagccct

SEQ ID NO: 1786277 - DNA, 23 bp, Homo sapiens
gtgggcccggagtaatcaggcag

SEQ ID NO: 1786278 - DNA, 14 bp, Homo sapiens
gtgggcctcggccc

SEQ ID NO: 1786279 - DNA, 13 bp, Homo sapiens
gtgggcctggcct

SEQ ID NO: 1786280 - DNA, 16 bp, Homo sapiens
gtgggcctggcctgag

SEQ ID NO: 1786281 - DNA, 16 bp, Homo sapiens
gtgggcctgtgtgtgt

SEQ ID NO: 1786282 - DNA, 16 bp, Homo sapiens
gtgggcgcaaaggtgc

SEQ ID NO: 1786283 - DNA, 22 bp, Homo sapiens
gtgggcgcaaaggtgcctcata

SEQ ID NO: 1786284 - DNA, 21 bp, Homo sapiens
gtgggcgcccaccctgggctc

SEQ ID NO: 1786285 - DNA, 18 bp, Homo sapiens
gtgggctctgtgcagtca

SEQ ID NO: 1786286 - DNA, 16 bp, Homo sapiens
gtgggctgagccctgg

SEQ ID NO: 1786287 - DNA, 17 bp, Homo sapiens
gtgggctggacttctac

SEQ ID NO: 1786288 - DNA, 20 bp, Homo sapiens
gtgggctgggccctctgtcc

SEQ ID NO: 1786289 - DNA, 19 bp, Homo sapiens
gtgggctggggctgctccc

SEQ ID NO: 1786290 - DNA, 21 bp, Homo sapiens
gtgggctggggctgctcccct

SEQ ID NO: 1786291 - DNA, 20 bp, Homo sapiens
gtgggcttatgtctctgcct

SEQ ID NO: 1786292 - DNA, 21 bp, Homo sapiens
gtgggcttatgtctctgcctt

SEQ ID NO: 1786293 - DNA, 22 bp, Homo sapiens
gtggggaacatggctggcctgg

SEQ ID NO: 1786294 - DNA, 13 bp, Homo sapiens
gtggggacacagc

SEQ ID NO: 1786295 - DNA, 18 bp, Homo sapiens
gtggggacacagcagtga

SEQ ID NO: 1786296 - DNA, 22 bp, Homo sapiens
gtggggagcacttgcgtcctgc

SEQ ID NO: 1786297 - DNA, 13 bp, Homo sapiens
gtggggagctaga

SEQ ID NO: 1786298 - DNA, 18 bp, Homo sapiens
gtggggagggacaaggga

SEQ ID NO: 1786299 - DNA, 15 bp, Homo sapiens
gtggggcagggagct

SEQ ID NO: 1786300 - DNA, 11 bp, Homo sapiens
gtggggccagg

SEQ ID NO: 1786301 - DNA, 14 bp, Homo sapiens
gtggggccaggtca

SEQ ID NO: 1786302 - DNA, 17 bp, Homo sapiens
gtggggcccactgctcg

SEQ ID NO: 1786303 - DNA, 15 bp, Homo sapiens
gtggggccctgcccc

SEQ ID NO: 1786304 - DNA, 16 bp, Homo sapiens
gtggggccctgcccct

SEQ ID NO: 1786305 - DNA, 17 bp, Homo sapiens
gtggggctcgccatgcc

SEQ ID NO: 1786306 - DNA, 15 bp, Homo sapiens
gtggggctgagctgg

SEQ ID NO: 1786307 - DNA, 14 bp, Homo sapiens
gtggggctgccgga

SEQ ID NO: 1786308 - DNA, 14 bp, Homo sapiens
gtggggctgctcct

SEQ ID NO: 1786309 - DNA, 17 bp, Homo sapiens
gtggggctgctcctcca

SEQ ID NO: 1786310 - DNA, 18 bp, Homo sapiens
gtggggctgctcctccag

SEQ ID NO: 1786311 - DNA, 13 bp, Homo sapiens
gtggggctggcat

SEQ ID NO: 1786312 - DNA, 18 bp, Homo sapiens
gtggggctgtcctgctgc

SEQ ID NO: 1786313 - DNA, 15 bp, Homo sapiens
gtgggggctgtcctg

SEQ ID NO: 1786314 - DNA, 20 bp, Homo sapiens
gtgggggctgtcctgctcac

SEQ ID NO: 1786315 - DNA, 16 bp, Homo sapiens
gtgggggggagaagaa

SEQ ID NO: 1786316 - DNA, 14 bp, Homo sapiens
gtgggggtctgtgt

SEQ ID NO: 1786317 - DNA, 22 bp, Homo sapiens
gtggggtacatttctctgagca

SEQ ID NO: 1786318 - DNA, 17 bp, Homo sapiens
gtggggtctccctctcc

SEQ ID NO: 1786319 - DNA, 19 bp, Homo sapiens
gtggggtctccctctcctg

SEQ ID NO: 1786320 - DNA, 22 bp, Homo sapiens
gtgctgcggtcactcaggcctc

SEQ ID NO: 1786321 - DNA, 19 bp, Homo sapiens
gtgctgctaattctttgca

SEQ ID NO: 1786322 - DNA, 23 bp, Homo sapiens
gtgctgctctctccgaggggtgg

SEQ ID NO: 1786323 - DNA, 13 bp, Homo sapiens
gtgctgctgaaga

SEQ ID NO: 1786324 - DNA, 19 bp, Homo sapiens
gtgctggaaagggagggag

SEQ ID NO: 1786325 - DNA, 13 bp, Homo sapiens
gtgctggaagtct

SEQ ID NO: 1786326 - DNA, 12 bp, Homo sapiens
gtgctggaggat

SEQ ID NO: 1786327 - DNA, 15 bp, Homo sapiens
gtgctggcaaccact

SEQ ID NO: 1786328 - DNA, 15 bp, Homo sapiens
gtgctggcccaccca

SEQ ID NO: 1786329 - DNA, 20 bp, Homo sapiens
gtgctggcccacccagtcca

SEQ ID NO: 1786330 - DNA, 14 bp, Homo sapiens
gtgctggcccccag

SEQ ID NO: 1786331 - DNA, 16 bp, Homo sapiens
gtgctgggaccagagc

SEQ ID NO: 1786332 - DNA, 18 bp, Homo sapiens
gtgctgggaccagagcca

SEQ ID NO: 1786333 - DNA, 19 bp, Homo sapiens
gtgctgggactgagccagt

SEQ ID NO: 1786334 - DNA, 22 bp, Homo sapiens
gtgctgggactgagccagtccc

SEQ ID NO: 1786335 - DNA, 23 bp, Homo sapiens
gtgctgggagctccactctgctt

SEQ ID NO: 1786336 - DNA, 17 bp, Homo sapiens
gtgctgggaggagggag

SEQ ID NO: 1786337 - DNA, 15 bp, Homo sapiens
gtgctgggctggact

SEQ ID NO: 1786338 - DNA, 16 bp, Homo sapiens
gtgctgggctggactg

SEQ ID NO: 1786339 - DNA, 19 bp, Homo sapiens
gtgctgggctggactggcc

SEQ ID NO: 1786340 - DNA, 20 bp, Homo sapiens
gtgctggtcccctcctcagt

SEQ ID NO: 1786341 - DNA, 20 bp, Homo sapiens
gtgctggtcccggggccagc

SEQ ID NO: 1786342 - DNA, 21 bp, Homo sapiens
gtgctggtgaacactgtgacc

SEQ ID NO: 1786343 - DNA, 23 bp, Homo sapiens
gtgctggtgtcctgaccaccctc

SEQ ID NO: 1786344 - DNA, 18 bp, Homo sapiens
gtgctgtacccttccacc

SEQ ID NO: 1786345 - DNA, 13 bp, Homo sapiens
gtgctgtgaggga

SEQ ID NO: 1786346 - DNA, 14 bp, Homo sapiens
gtgctgtgagggag

SEQ ID NO: 1786347 - DNA, 12 bp, Homo sapiens
gtgctgtgcctg

SEQ ID NO: 1786348 - DNA, 15 bp, Homo sapiens
gtgctgtgcctgcta

SEQ ID NO: 1786349 - DNA, 18 bp, Homo sapiens
gtgctgtgcctgctagag

SEQ ID NO: 1786350 - DNA, 20 bp, Homo sapiens
gtgctgtgcctgctagagca

SEQ ID NO: 1786351 - DNA, 17 bp, Homo sapiens
gtgctgtgggcctcagg

SEQ ID NO: 1786352 - DNA, 11 bp, Homo sapiens
gtgctgtgtgt

SEQ ID NO: 1786353 - DNA, 22 bp, Homo sapiens
gtgcttacagtaactaattttg

SEQ ID NO: 1786354 - DNA, 21 bp, Homo sapiens
gtgcttatcccatagccagga

SEQ ID NO: 1786355 - DNA, 21 bp, Homo sapiens
gtgcttattctcaaagcagga

SEQ ID NO: 1786356 - DNA, 22 bp, Homo sapiens
gtgcttcacagtagagccagct

SEQ ID NO: 1786357 - DNA, 18 bp, Homo sapiens
gtgcttcagagtttgtgt

SEQ ID NO: 1786358 - DNA, 18 bp, Homo sapiens
gtgcttcagcctgaggct

SEQ ID NO: 1786359 - DNA, 18 bp, Homo sapiens
gtgcttctcaccacggga

SEQ ID NO: 1786360 - DNA, 14 bp, Homo sapiens
gtgcttgaaggccc

SEQ ID NO: 1786361 - DNA, 21 bp, Homo sapiens
gtgcttgaaggccctgctgag

SEQ ID NO: 1786362 - DNA, 14 bp, Homo sapiens
gtgcttgagccagg

SEQ ID NO: 1786363 - DNA, 11 bp, Homo sapiens
gtgcttggatt

SEQ ID NO: 1786364 - DNA, 12 bp, Homo sapiens
gtgctttctagc

SEQ ID NO: 1786365 - DNA, 15 bp, Homo sapiens
gtgcttttaaatgca

SEQ ID NO: 1786366 - DNA, 14 bp, Homo sapiens
gtgcttttctccaa

SEQ ID NO: 1786367 - DNA, 14 bp, Homo sapiens
gtgcttttgatgtg

SEQ ID NO: 1786368 - DNA, 14 bp, Homo sapiens
gtggaaactcagcc

SEQ ID NO: 1786369 - DNA, 15 bp, Homo sapiens
gtggaaactcagccg

SEQ ID NO: 1786370 - DNA, 14 bp, Homo sapiens
gtggaaagcctctg

SEQ ID NO: 1786371 - DNA, 23 bp, Homo sapiens
gtggaaagcctctgctgccatgg

SEQ ID NO: 1786372 - DNA, 20 bp, Homo sapiens
gtggaaataatttgaatgta

SEQ ID NO: 1786373 - DNA, 20 bp, Homo sapiens
gtggaagaagggagaagaaa

SEQ ID NO: 1786374 - DNA, 16 bp, Homo sapiens
gtggaagcaaggctgg

SEQ ID NO: 1786375 - DNA, 18 bp, Homo sapiens
gtggaagccctccttcca

SEQ ID NO: 1786376 - DNA, 23 bp, Homo sapiens
gtggaaggcacccgccctttcct

SEQ ID NO: 1786377 - DNA, 17 bp, Homo sapiens
gtggaaggcagagaaat

SEQ ID NO: 1786378 - DNA, 14 bp, Homo sapiens
gtggaagtgtgggt

SEQ ID NO: 1786379 - DNA, 22 bp, Homo sapiens
gtggacaccaggagtccctggt

SEQ ID NO: 1786380 - DNA, 12 bp, Homo sapiens
gtggacaggccc

SEQ ID NO: 1786381 - DNA, 15 bp, Homo sapiens
gtggacaggcccagc

SEQ ID NO: 1786382 - DNA, 22 bp, Homo sapiens
gtggacatcgtaggcagccacg

SEQ ID NO: 1786383 - DNA, 23 bp, Homo sapiens
gtggacatgtgggtggagaaggg

SEQ ID NO: 1786384 - DNA, 18 bp, Homo sapiens
gtggaccaggacaggacc

SEQ ID NO: 1786385 - DNA, 15 bp, Homo sapiens
gtggaccgtggacag

SEQ ID NO: 1786386 - DNA, 20 bp, Homo sapiens
gtggacgcaattgtgggatg

SEQ ID NO: 1786387 - DNA, 17 bp, Homo sapiens
gtggactctgcacatgt

SEQ ID NO: 1786388 - DNA, 22 bp, Homo sapiens
gtggactctgctagactcctca

SEQ ID NO: 1786389 - DNA, 15 bp, Homo sapiens
gtggactggctgtgc

SEQ ID NO: 1786390 - DNA, 17 bp, Homo sapiens
gtggactggctgtgccc

SEQ ID NO: 1786391 - DNA, 16 bp, Homo sapiens
gtggactgtcctgagg

SEQ ID NO: 1786392 - DNA, 22 bp, Homo sapiens
gtggactgtcctgaggagccct

SEQ ID NO: 1786393 - DNA, 14 bp, Homo sapiens
gtggactgtggcac

SEQ ID NO: 1786394 - DNA, 17 bp, Homo sapiens
gtggacttgttttaatt

SEQ ID NO: 1786395 - DNA, 21 bp, Homo sapiens
gtggagaaactgtagtctcag

SEQ ID NO: 1786396 - DNA, 20 bp, Homo sapiens
gtggagaagatcgcatggca

SEQ ID NO: 1786397 - DNA, 17 bp, Homo sapiens
gtggagaagccacaggc

SEQ ID NO: 1786398 - DNA, 20 bp, Homo sapiens
gtggagaagccacaggcctg

SEQ ID NO: 1786399 - DNA, 11 bp, Homo sapiens
gtggagacagt

SEQ ID NO: 1786400 - DNA, 18 bp, Homo sapiens
gtggagactgcttcccat

SEQ ID NO: 1786401 - DNA, 22 bp, Homo sapiens
gtggagagatgtttggaaacca

SEQ ID NO: 1786402 - DNA, 17 bp, Homo sapiens
gtggagagctggtgccc

SEQ ID NO: 1786403 - DNA, 22 bp, Homo sapiens
gtggggtctccctctcctgcct

SEQ ID NO: 1786404 - DNA, 20 bp, Homo sapiens
gtggggtgaacagctggtgc

SEQ ID NO: 1786405 - DNA, 15 bp, Homo sapiens
gtggggtgctgccct

SEQ ID NO: 1786406 - DNA, 23 bp, Homo sapiens
gtggggtggagtcgcagaccaga

SEQ ID NO: 1786407 - DNA, 12 bp, Homo sapiens
gtggggtggggt

SEQ ID NO: 1786408 - DNA, 22 bp, Homo sapiens
gtggggttgggggacagccttc

SEQ ID NO: 1786409 - DNA, 16 bp, Homo sapiens
gtgggtaagaggagca

SEQ ID NO: 1786410 - DNA, 17 bp, Homo sapiens
gtgggtaattgtacaat

SEQ ID NO: 1786411 - DNA, 21 bp, Homo sapiens
gtgggtaattgtacaataaat

SEQ ID NO: 1786412 - DNA, 17 bp, Homo sapiens
gtgggtcaaaccaagaa

SEQ ID NO: 1786413 - DNA, 18 bp, Homo sapiens
gtgggtcagaacatgtta

SEQ ID NO: 1786414 - DNA, 12 bp, Homo sapiens
gtgggtccagga

SEQ ID NO: 1786415 - DNA, 20 bp, Homo sapiens
gtgggtccaggaaggcagct

SEQ ID NO: 1786416 - DNA, 23 bp, Homo sapiens
gtgggtccaggaaggcagctgct

SEQ ID NO: 1786417 - DNA, 11 bp, Homo sapiens
gtgggtctctg

SEQ ID NO: 1786418 - DNA, 19 bp, Homo sapiens
gtgggtctctgggcacagt

SEQ ID NO: 1786419 - DNA, 13 bp, Homo sapiens
gtgggtctgggag

SEQ ID NO: 1786420 - DNA, 16 bp, Homo sapiens
gtgggtgaccaggtcc

SEQ ID NO: 1786421 - DNA, 21 bp, Homo sapiens
gtgggtgattcctcccaggag

SEQ ID NO: 1786422 - DNA, 16 bp, Homo sapiens
gtgtttttcatgtttt

SEQ ID NO: 1786423 - DNA, 15 bp, Homo sapiens
gtgtttttgaaatat

SEQ ID NO: 1786424 - DNA, 18 bp, Homo sapiens
gttaaaaaacaaatgttc

SEQ ID NO: 1786425 - DNA, 14 bp, Homo sapiens
gttaaaaacctgcc

SEQ ID NO: 1786426 - DNA, 20 bp, Homo sapiens
gttaaaaaggccaaagataa

SEQ ID NO: 1786427 - DNA, 20 bp, Homo sapiens
gttaaaaatggctcaagtag

SEQ ID NO: 1786428 - DNA, 19 bp, Homo sapiens
gttagttatagatgtctag

SEQ ID NO: 1786429 - DNA, 19 bp, Homo sapiens
gttagttgtgaaagaaagc

SEQ ID NO: 1786430 - DNA, 22 bp, Homo sapiens
gttagtttagtgtgtgtgcaga

SEQ ID NO: 1786431 - DNA, 15 bp, Homo sapiens
gttataaatacatat

SEQ ID NO: 1786432 - DNA, 13 bp, Homo sapiens
gttataagaagaa

SEQ ID NO: 1786433 - DNA, 13 bp, Homo sapiens
gttataagactct

SEQ ID NO: 1786434 - DNA, 12 bp, Homo sapiens
gttataattttt

SEQ ID NO: 1786435 - DNA, 23 bp, Homo sapiens
gttatagaatacttttttctagt

SEQ ID NO: 1786436 - DNA, 16 bp, Homo sapiens
gttatatataataaat

SEQ ID NO: 1786437 - DNA, 16 bp, Homo sapiens
gttatatatctctttt

SEQ ID NO: 1786438 - DNA, 15 bp, Homo sapiens
gttatatcatcaata

SEQ ID NO: 1786439 - DNA, 21 bp, Homo sapiens
gttatattggaattataaata

SEQ ID NO: 1786440 - DNA, 20 bp, Homo sapiens
gttatatttttgtgttttct

SEQ ID NO: 1786441 - DNA, 23 bp, Homo sapiens
gttatcaaacttcagctgtactt

SEQ ID NO: 1786442 - DNA, 14 bp, Homo sapiens
gttatcatgaattt

SEQ ID NO: 1786443 - DNA, 19 bp, Homo sapiens
gttatcatgaattttaaag

SEQ ID NO: 1786444 - DNA, 21 bp, Homo sapiens
gttatcccttccttttagcct

SEQ ID NO: 1786445 - DNA, 13 bp, Homo sapiens
gttatctctgtgt

SEQ ID NO: 1786446 - DNA, 16 bp, Homo sapiens
gttatctgcctggcct

SEQ ID NO: 1786447 - DNA, 17 bp, Homo sapiens
gttatctgcctggcctg

SEQ ID NO: 1786448 - DNA, 20 bp, Homo sapiens
gttatctgcctggcctggct

SEQ ID NO: 1786449 - DNA, 18 bp, Homo sapiens
gttatcttctcaagttct

SEQ ID NO: 1786450 - DNA, 20 bp, Homo sapiens
gttatcttttgaattcttga

SEQ ID NO: 1786451 - DNA, 11 bp, Homo sapiens
gttatgaaaat

SEQ ID NO: 1786452 - DNA, 12 bp, Homo sapiens
gttatgaacagc

SEQ ID NO: 1786453 - DNA, 16 bp, Homo sapiens
gttatgaacagctgtg

SEQ ID NO: 1786454 - DNA, 17 bp, Homo sapiens
gttatgaacagctgtgt

SEQ ID NO: 1786455 - DNA, 14 bp, Homo sapiens
gttatgaacatcca

SEQ ID NO: 1786456 - DNA, 20 bp, Homo sapiens
gttatgaacatccaagtctt

SEQ ID NO: 1786457 - DNA, 19 bp, Homo sapiens
gttatgcactgtggtttca

SEQ ID NO: 1786458 - DNA, 22 bp, Homo sapiens
gttatgcactgtggtttcagat

SEQ ID NO: 1786459 - DNA, 13 bp, Homo sapiens
gttatgctgtgac

SEQ ID NO: 1786460 - DNA, 17 bp, Homo sapiens
gttatgggatgtaaaca

SEQ ID NO: 1786461 - DNA, 22 bp, Homo sapiens
gttatgtgaatgatctctctga

SEQ ID NO: 1786462 - DNA, 21 bp, Homo sapiens
gttattaactttaatgttttt

SEQ ID NO: 1786463 - DNA, 22 bp, Homo sapiens
gttattatctgggcttatatct

SEQ ID NO: 1786464 - DNA, 13 bp, Homo sapiens
gttattctttgca

SEQ ID NO: 1786465 - DNA, 16 bp, Homo sapiens
gttattctttgcactt

SEQ ID NO: 1786466 - DNA, 18 bp, Homo sapiens
gttattgataagttcata

SEQ ID NO: 1786467 - DNA, 12 bp, Homo sapiens
gttattggactc

SEQ ID NO: 1786468 - DNA, 18 bp, Homo sapiens
gttattggactccaggcc

SEQ ID NO: 1786469 - DNA, 12 bp, Homo sapiens
gttattgtggaa

SEQ ID NO: 1786470 - DNA, 14 bp, Homo sapiens
gttattgttttgtt

SEQ ID NO: 1786471 - DNA, 15 bp, Homo sapiens
gttatttaaagaaga

SEQ ID NO: 1786472 - DNA, 19 bp, Homo sapiens
gttatttactcctcctgct

SEQ ID NO: 1786473 - DNA, 20 bp, Homo sapiens
gttatttactcctcctgctc

SEQ ID NO: 1786474 - DNA, 17 bp, Homo sapiens
gttatttatcaattttt

SEQ ID NO: 1786475 - DNA, 21 bp, Homo sapiens
gttatttatcaatttttccca

SEQ ID NO: 1786476 - DNA, 18 bp, Homo sapiens
gttatttccccagccaca

SEQ ID NO: 1786477 - DNA, 18 bp, Homo sapiens
gttatttccctttagctg

SEQ ID NO: 1786478 - DNA, 23 bp, Homo sapiens
gttatttccctttagctgtgtta

SEQ ID NO: 1786479 - DNA, 22 bp, Homo sapiens
gttatttcttccctgctttgca

SEQ ID NO: 1786480 - DNA, 17 bp, Homo sapiens
gttatttggtattaaac

SEQ ID NO: 1786481 - DNA, 14 bp, Homo sapiens
gttattttaaatat

SEQ ID NO: 1786482 - DNA, 19 bp, Homo sapiens
gttattttaaatataaata

SEQ ID NO: 1786483 - DNA, 14 bp, Homo sapiens
gttatttttacagc

SEQ ID NO: 1786484 - DNA, 17 bp, Homo sapiens
gttatttttctcttgta

SEQ ID NO: 1786485 - DNA, 21 bp, Homo sapiens
gttattttttaattattattt

SEQ ID NO: 1786486 - DNA, 17 bp, Homo sapiens
gttcaaagatgcatttt

SEQ ID NO: 1786487 - DNA, 13 bp, Homo sapiens
gttcaaagtgtat

SEQ ID NO: 1786488 - DNA, 21 bp, Homo sapiens
gttcaaagtgtatatttattc

SEQ ID NO: 1786489 - DNA, 16 bp, Homo sapiens
gttcaaatattgtaaa

SEQ ID NO: 1786490 - DNA, 19 bp, Homo sapiens
gttcaagcacactggaata

SEQ ID NO: 1786491 - DNA, 13 bp, Homo sapiens
gttcaagcctgtg

SEQ ID NO: 1786492 - DNA, 16 bp, Homo sapiens
gttcaagcctgtggga

SEQ ID NO: 1786493 - DNA, 12 bp, Homo sapiens
gttcaagttttg

SEQ ID NO: 1786494 - DNA, 12 bp, Homo sapiens
gttcaatatcag

SEQ ID NO: 1786495 - DNA, 14 bp, Homo sapiens
gttcaatgttccat

SEQ ID NO: 1786496 - DNA, 20 bp, Homo sapiens
gttcacaaactacctctgga

SEQ ID NO: 1786497 - DNA, 12 bp, Homo sapiens
gttcacaaactg

SEQ ID NO: 1786498 - DNA, 13 bp, Homo sapiens
gttcacagaaaaa

SEQ ID NO: 1786499 - DNA, 13 bp, Homo sapiens
gttcaccatgttg

SEQ ID NO: 1786500 - DNA, 21 bp, Homo sapiens
gttcacctccaagcatttcat

SEQ ID NO: 1786501 - DNA, 16 bp, Homo sapiens
gttcacctgtgactcc

SEQ ID NO: 1786502 - DNA, 18 bp, Homo sapiens
gttcacctgtgactcctg

SEQ ID NO: 1786503 - DNA, 19 bp, Homo sapiens
gttcaccttcaaaatgttc

SEQ ID NO: 1786504 - DNA, 22 bp, Homo sapiens
gttcaccttcaaaatgttctat

SEQ ID NO: 1786505 - DNA, 14 bp, Homo sapiens
gttcaccttggaag

SEQ ID NO: 1786506 - DNA, 15 bp, Homo sapiens
gttcaccttggaagg

SEQ ID NO: 1786507 - DNA, 22 bp, Homo sapiens
gttcacgtacaaaactctgtat

SEQ ID NO: 1786508 - DNA, 23 bp, Homo sapiens
gttcacgtacaaaactctgtata

SEQ ID NO: 1786509 - DNA, 15 bp, Homo sapiens
gttcactaaagcagt

SEQ ID NO: 1786510 - DNA, 13 bp, Homo sapiens
gttcagaacaact

SEQ ID NO: 1786511 - DNA, 19 bp, Homo sapiens
gttcagaatggcagtcctg

SEQ ID NO: 1786512 - DNA, 20 bp, Homo sapiens
gttcagaattaaacttttaa

SEQ ID NO: 1786513 - DNA, 18 bp, Homo sapiens
gttcagaattaagcagaa

SEQ ID NO: 1786514 - DNA, 17 bp, Homo sapiens
gttcagacccctgcctg

SEQ ID NO: 1786515 - DNA, 14 bp, Homo sapiens
gttcagatgtgcat

SEQ ID NO: 1786516 - DNA, 15 bp, Homo sapiens
gttcagcactgtccc

SEQ ID NO: 1786517 - DNA, 18 bp, Homo sapiens
gttcagcactgtcccttg

SEQ ID NO: 1786518 - DNA, 14 bp, Homo sapiens
gttcagcagactgg

SEQ ID NO: 1786519 - DNA, 14 bp, Homo sapiens
gttcagcagtacag

SEQ ID NO: 1786520 - DNA, 17 bp, Homo sapiens
gttcagccactgaggga

SEQ ID NO: 1786521 - DNA, 15 bp, Homo sapiens
gttcagcccctcctc

SEQ ID NO: 1786522 - DNA, 16 bp, Homo sapiens
gttcagcccctcctct

SEQ ID NO: 1786523 - DNA, 18 bp, Homo sapiens
gttcagcccctcctctgc

SEQ ID NO: 1786524 - DNA, 21 bp, Homo sapiens
gttcagcccctcctctgccac

SEQ ID NO: 1786525 - DNA, 22 bp, Homo sapiens
gttcagcccctcctctgccacc

SEQ ID NO: 1786526 - DNA, 23 bp, Homo sapiens
gttcagcccctcctctgccacct

SEQ ID NO: 1786527 - DNA, 11 bp, Homo sapiens
gttcagcctgt

SEQ ID NO: 1786528 - DNA, 18 bp, Homo sapiens
gttcagctctttccaaat

SEQ ID NO: 1786529 - DNA, 20 bp, Homo sapiens
gttcagcttcctgctgctgg

SEQ ID NO: 1786530 - DNA, 21 bp, Homo sapiens
gttcagcttcctgctgctggg

SEQ ID NO: 1786531 - DNA, 15 bp, Homo sapiens
gttcaggagtcccaa

SEQ ID NO: 1786532 - DNA, 17 bp, Homo sapiens
gttcagggaccgtccag

SEQ ID NO: 1786533 - DNA, 23 bp, Homo sapiens
gttcagtctgaatgctgccacaa

SEQ ID NO: 1786534 - DNA, 13 bp, Homo sapiens
gttcagtgccttc

SEQ ID NO: 1786535 - DNA, 15 bp, Homo sapiens
gttcagtgccttcct

SEQ ID NO: 1786536 - DNA, 16 bp, Homo sapiens
gttcagtgtcccgggc

SEQ ID NO: 1786537 - DNA, 18 bp, Homo sapiens
gttcataataaaagtgaa

SEQ ID NO: 1786538 - DNA, 13 bp, Homo sapiens
gttcatacatatt

SEQ ID NO: 1786539 - DNA, 14 bp, Homo sapiens
gttcatacattgta

SEQ ID NO: 1786540 - DNA, 20 bp, Homo sapiens
gttcatagggtctcttcagg

SEQ ID NO: 1786541 - DNA, 19 bp, Homo sapiens
gttcatatgtaccatgtac

SEQ ID NO: 1786542 - DNA, 22 bp, Homo sapiens
gttcatatgtaccatgtacatg

SEQ ID NO: 1786543 - DNA, 18 bp, Homo sapiens
gttcgatgcctgcatgct

SEQ ID NO: 1786544 - DNA, 23 bp, Homo sapiens
gttcgtacgcccaggacagctgg

SEQ ID NO: 1786545 - DNA, 14 bp, Homo sapiens
gttcgtgctgtgct

SEQ ID NO: 1786546 - DNA, 22 bp, Homo sapiens
gttcgtttccatcatgtctgta

SEQ ID NO: 1786547 - DNA, 23 bp, Homo sapiens
gttctaaagatggaaaaaccacc

SEQ ID NO: 1786548 - DNA, 21 bp, Homo sapiens
gttctttcctctttctgctct

SEQ ID NO: 1786549 - DNA, 12 bp, Homo sapiens
gttctttctggg

SEQ ID NO: 1786550 - DNA, 17 bp, Homo sapiens
gttctttgggccagaca

SEQ ID NO: 1786551 - DNA, 22 bp, Homo sapiens
gttctttgggccagacatgcca

SEQ ID NO: 1786552 - DNA, 13 bp, Homo sapiens
gttcttttaaagg

SEQ ID NO: 1786553 - DNA, 15 bp, Homo sapiens
gttcttttctattta

SEQ ID NO: 1786554 - DNA, 16 bp, Homo sapiens
gttcttttctatttat

SEQ ID NO: 1786555 - DNA, 22 bp, Homo sapiens
gttcttttctatttataagtga

SEQ ID NO: 1786556 - DNA, 19 bp, Homo sapiens
gttcttttctcctttacca

SEQ ID NO: 1786557 - DNA, 20 bp, Homo sapiens
gttcttttctcctttaccag

SEQ ID NO: 1786558 - DNA, 14 bp, Homo sapiens
gtgtatattttaat

SEQ ID NO: 1786559 - DNA, 20 bp, Homo sapiens
gtgtatcctggggctccctt

SEQ ID NO: 1786560 - DNA, 20 bp, Homo sapiens
gtgtatgtgagtattctcat

SEQ ID NO: 1786561 - DNA, 12 bp, Homo sapiens
gtgtatgtgtga

SEQ ID NO: 1786562 - DNA, 18 bp, Homo sapiens
gtgtatgtttgcacactt

SEQ ID NO: 1786563 - DNA, 14 bp, Homo sapiens
gtgtattcagaggc

SEQ ID NO: 1786564 - DNA, 22 bp, Homo sapiens
gtgtattctgtggattctatat

SEQ ID NO: 1786565 - DNA, 17 bp, Homo sapiens
gtgtattgatgcaatat

SEQ ID NO: 1786566 - DNA, 19 bp, Homo sapiens
gtgtatttattttacagct

SEQ ID NO: 1786567 - DNA, 14 bp, Homo sapiens
gtgtatttgctttt

SEQ ID NO: 1786568 - DNA, 16 bp, Homo sapiens
gtgtatttgtattaat

SEQ ID NO: 1786569 - DNA, 17 bp, Homo sapiens
gtgtcaaaactggttta

SEQ ID NO: 1786570 - DNA, 16 bp, Homo sapiens
gtgtcaagctgctctg

SEQ ID NO: 1786571 - DNA, 17 bp, Homo sapiens
gtgtcaagctgctctga

SEQ ID NO: 1786572 - DNA, 12 bp, Homo sapiens
gtgtcacagaga

SEQ ID NO: 1786573 - DNA, 15 bp, Homo sapiens
taacattatttatat

SEQ ID NO: 1786574 - DNA, 22 bp, Homo sapiens
taacattccaagactctagagt

SEQ ID NO: 1786575 - DNA, 20 bp, Homo sapiens
taacattcctcatgaatgta

SEQ ID NO: 1786576 - DNA, 16 bp, Homo sapiens
taacattgaccaagaa

SEQ ID NO: 1786577 - DNA, 22 bp, Homo sapiens
taacattgaccaagaactgcat

SEQ ID NO: 1786578 - DNA, 23 bp, Homo sapiens
taacattgaccaagaactgcatg

SEQ ID NO: 1786579 - DNA, 17 bp, Homo sapiens
taacatttctgttctca

SEQ ID NO: 1786580 - DNA, 22 bp, Homo sapiens
taacatttgctgttttaaacat

SEQ ID NO: 1786581 - DNA, 20 bp, Homo sapiens
taaccaagctgagtttccta

SEQ ID NO: 1786582 - DNA, 11 bp, Homo sapiens
taaccaagttc

SEQ ID NO: 1786583 - DNA, 15 bp, Homo sapiens
taaccacggaaaaga

SEQ ID NO: 1786584 - DNA, 19 bp, Homo sapiens
taaccacttaaaaaatgtc

SEQ ID NO: 1786585 - DNA, 21 bp, Homo sapiens
taaccagcattccctacagcc

SEQ ID NO: 1786586 - DNA, 13 bp, Homo sapiens
taaccagccacag

SEQ ID NO: 1786587 - DNA, 20 bp, Homo sapiens
taaccatatgattgaaaaga

SEQ ID NO: 1786588 - DNA, 14 bp, Homo sapiens
taaccatccccaac

SEQ ID NO: 1786589 - DNA, 15 bp, Homo sapiens
taaccatccccaact

SEQ ID NO: 1786590 - DNA, 22 bp, Homo sapiens
taaccatgtgaaaaggcaaaaa

SEQ ID NO: 1786591 - DNA, 18 bp, Homo sapiens
taaccatttatataaaac

SEQ ID NO: 1786592 - DNA, 14 bp, Homo sapiens
taaccatttgcact

SEQ ID NO: 1786593 - DNA, 18 bp, Homo sapiens
taacccacctctcctgcc

SEQ ID NO: 1786594 - DNA, 16 bp, Homo sapiens
taacccataattgaag

SEQ ID NO: 1786595 - DNA, 22 bp, Homo sapiens
taaccccctctgctctgtcctc

SEQ ID NO: 1786596 - DNA, 17 bp, Homo sapiens
taacccctcctggctgt

SEQ ID NO: 1786597 - DNA, 13 bp, Homo sapiens
taacccctttcct

SEQ ID NO: 1786598 - DNA, 15 bp, Homo sapiens
taaccctactttgct

SEQ ID NO: 1786599 - DNA, 17 bp, Homo sapiens
taaccctaggaatttag

SEQ ID NO: 1786600 - DNA, 20 bp, Homo sapiens
taaccctcctgggcccaagt

SEQ ID NO: 1786601 - DNA, 16 bp, Homo sapiens
taaccctgtgctgtca

SEQ ID NO: 1786602 - DNA, 19 bp, Homo sapiens
taaccgcacatgcacacac

SEQ ID NO: 1786603 - DNA, 20 bp, Homo sapiens
taacctatgatattttctgt

SEQ ID NO: 1786604 - DNA, 22 bp, Homo sapiens
taacctcccttaagcagcaaca

SEQ ID NO: 1786605 - DNA, 14 bp, Homo sapiens
taacctctgcacta

SEQ ID NO: 1786606 - DNA, 17 bp, Homo sapiens
taacctgttacactggg

SEQ ID NO: 1786607 - DNA, 20 bp, Homo sapiens
taaccttaaccttaaaattg

SEQ ID NO: 1786608 - DNA, 19 bp, Homo sapiens
taaccttactaattatact

SEQ ID NO: 1786609 - DNA, 17 bp, Homo sapiens
taaccttgaatgctgcc

SEQ ID NO: 1786610 - DNA, 18 bp, Homo sapiens
taaccttgaatgctgcca

SEQ ID NO: 1786611 - DNA, 12 bp, Homo sapiens
taacctttctgg

SEQ ID NO: 1786612 - DNA, 22 bp, Homo sapiens
taacgaagtgcacttacactta

SEQ ID NO: 1786613 - DNA, 13 bp, Homo sapiens
taacgaataaagg

SEQ ID NO: 1786614 - DNA, 16 bp, Homo sapiens
taacgcgtcttcctga

SEQ ID NO: 1786615 - DNA, 14 bp, Homo sapiens
taacggaccaaagc

SEQ ID NO: 1786616 - DNA, 15 bp, Homo sapiens
taacggctccaggat

SEQ ID NO: 1786617 - DNA, 22 bp, Homo sapiens
taacggtctgttctgtttcaag

SEQ ID NO: 1786618 - DNA, 17 bp, Homo sapiens
taacggttaagaaagca

SEQ ID NO: 1786619 - DNA, 20 bp, Homo sapiens
taacggttaagaaagcactt

SEQ ID NO: 1786620 - DNA, 15 bp, Homo sapiens
taacgtaaatacaca

SEQ ID NO: 1786621 - DNA, 18 bp, Homo sapiens
taacgtccactagcttac

SEQ ID NO: 1786622 - DNA, 20 bp, Homo sapiens
taacgtccactagcttactg

SEQ ID NO: 1786623 - DNA, 20 bp, Homo sapiens
taactaaggtgaagaatctt

SEQ ID NO: 1786624 - DNA, 23 bp, Homo sapiens
taactaatttgaatgtggttact

SEQ ID NO: 1786625 - DNA, 16 bp, Homo sapiens
taactacaaagctttg

SEQ ID NO: 1786626 - DNA, 20 bp, Homo sapiens
taactacaaagctttgctac

SEQ ID NO: 1786627 - DNA, 22 bp, Homo sapiens
taactactaagaataaataaag

SEQ ID NO: 1786628 - DNA, 13 bp, Homo sapiens
taactactttata

SEQ ID NO: 1786629 - DNA, 14 bp, Homo sapiens
taactactttataa

SEQ ID NO: 1786630 - DNA, 16 bp, Homo sapiens
taactgttcccttatc

SEQ ID NO: 1786631 - DNA, 13 bp, Homo sapiens
taacttactgtat

SEQ ID NO: 1786632 - DNA, 17 bp, Homo sapiens
taacttactgtatatgt

SEQ ID NO: 1786633 - DNA, 21 bp, Homo sapiens
taacttattccaagtgcattt

SEQ ID NO: 1786634 - DNA, 17 bp, Homo sapiens
taacttccaatttacat

SEQ ID NO: 1786635 - DNA, 11 bp, Homo sapiens
taacttcctgc

SEQ ID NO: 1786636 - DNA, 14 bp, Homo sapiens
taacttcctgctgc

SEQ ID NO: 1786637 - DNA, 23 bp, Homo sapiens
taacttctatattttaatagaaa

SEQ ID NO: 1786638 - DNA, 13 bp, Homo sapiens
taacttcttgctt

SEQ ID NO: 1786639 - DNA, 20 bp, Homo sapiens
taacttcttgcttctttcta

SEQ ID NO: 1786640 - DNA, 22 bp, Homo sapiens
taacttgaatttggtctgtata

SEQ ID NO: 1786641 - DNA, 22 bp, Homo sapiens
taacttgagagtagatggtttg

SEQ ID NO: 1786642 - DNA, 19 bp, Homo sapiens
taacttgcttagtatggtt

SEQ ID NO: 1786643 - DNA, 13 bp, Homo sapiens
taacttgtatatt

SEQ ID NO: 1786644 - DNA, 21 bp, Homo sapiens
taacttgtatattccaccatt

SEQ ID NO: 1786645 - DNA, 13 bp, Homo sapiens
taacttgtttgag

SEQ ID NO: 1786646 - DNA, 21 bp, Homo sapiens
taactttaaatcttttcttca

SEQ ID NO: 1786647 - DNA, 21 bp, Homo sapiens
taactttatcacattatttgc

SEQ ID NO: 1786648 - DNA, 14 bp, Homo sapiens
taactttatgtgta

SEQ ID NO: 1786649 - DNA, 23 bp, Homo sapiens
taactttcagaagagatgggctt

SEQ ID NO: 1786650 - DNA, 23 bp, Homo sapiens
taactttcgaccgactttcccca

SEQ ID NO: 1786651 - DNA, 13 bp, Homo sapiens
taactttctctta

SEQ ID NO: 1786652 - DNA, 16 bp, Homo sapiens
taacttttaaatgttt

SEQ ID NO: 1786653 - DNA, 15 bp, Homo sapiens
taacttttcaccaat

SEQ ID NO: 1786654 - DNA, 22 bp, Homo sapiens
taacttttgtgaattaggctgt

SEQ ID NO: 1786655 - DNA, 18 bp, Homo sapiens
taacttttttgtgtatgt

SEQ ID NO: 1786656 - DNA, 19 bp, Homo sapiens
taacttttttgtgtatgta

SEQ ID NO: 1786657 - DNA, 22 bp, Homo sapiens
taacttttttgtgtatgtactt

SEQ ID NO: 1786658 - DNA, 23 bp, Homo sapiens
taacttttttgtgtatgtactta

SEQ ID NO: 1786659 - DNA, 21 bp, Homo sapiens
taactttttttcttctacttt

SEQ ID NO: 1786660 - DNA, 11 bp, Homo sapiens
taagaaaaaag

SEQ ID NO: 1786661 - DNA, 19 bp, Homo sapiens
taagaaaaacttttttggt

SEQ ID NO: 1786662 - DNA, 12 bp, Homo sapiens
taagaaaacatt

SEQ ID NO: 1786663 - DNA, 13 bp, Homo sapiens
taagaaaacattt

SEQ ID NO: 1786664 - DNA, 19 bp, Homo sapiens
taagaaaatacaataaact

SEQ ID NO: 1786665 - DNA, 12 bp, Homo sapiens
taagaaaatgta

SEQ ID NO: 1786666 - DNA, 18 bp, Homo sapiens
taagaaaggaagcattgt

SEQ ID NO: 1786667 - DNA, 20 bp, Homo sapiens
taagaaaggaagcattgtaa

SEQ ID NO: 1786668 - DNA, 21 bp, Homo sapiens
taagaaaggaagcattgtaaa

SEQ ID NO: 1786669 - DNA, 15 bp, Homo sapiens
taagaaagtgaagca

SEQ ID NO: 1786670 - DNA, 15 bp, Homo sapiens
taagaaatactcatg

SEQ ID NO: 1786671 - DNA, 19 bp, Homo sapiens
taagaaatactcatgtgca

SEQ ID NO: 1786672 - DNA, 24 bp, Homo sapiens
taagaaatctagtatttcatgctg

SEQ ID NO: 1786673 - DNA, 22 bp, Homo sapiens
taagaacaaagagaaaaaatac

SEQ ID NO: 1786674 - DNA, 18 bp, Homo sapiens
taagaaccattgatttaa

SEQ ID NO: 1786675 - DNA, 14 bp, Homo sapiens
taagaactgtacat

SEQ ID NO: 1786676 - DNA, 15 bp, Homo sapiens
taagaagacatgaac

SEQ ID NO: 1786677 - DNA, 12 bp, Homo sapiens
taagaagagact

SEQ ID NO: 1786678 - DNA, 19 bp, Homo sapiens
taagaagagactgggaaga

SEQ ID NO: 1786679 - DNA, 13 bp, Homo sapiens
taagaagcaataa

SEQ ID NO: 1786680 - DNA, 20 bp, Homo sapiens
taagaagcaatctttgaaat

SEQ ID NO: 1786681 - DNA, 21 bp, Homo sapiens
taagaagcaatctttgaaata

SEQ ID NO: 1786682 - DNA, 16 bp, Homo sapiens
taagaagctctggccc

SEQ ID NO: 1786683 - DNA, 13 bp, Homo sapiens
taagaatgagttt

SEQ ID NO: 1786684 - DNA, 12 bp, Homo sapiens
taagatgctggg

SEQ ID NO: 1786685 - DNA, 22 bp, Homo sapiens
taagatggctgtggcatttcca

SEQ ID NO: 1786686 - DNA, 14 bp, Homo sapiens
taagatgtgaaaat

SEQ ID NO: 1786687 - DNA, 16 bp, Homo sapiens
taagatgtgaaaatta

SEQ ID NO: 1786688 - DNA, 20 bp, Homo sapiens
taagatgtgatattctaaga

SEQ ID NO: 1786689 - DNA, 22 bp, Homo sapiens
taagatgtgatattctaagact

SEQ ID NO: 1786690 - DNA, 16 bp, Homo sapiens
taagatgttgtcttgc

SEQ ID NO: 1786691 - DNA, 17 bp, Homo sapiens
taagattaagagcaaat

SEQ ID NO: 1786692 - DNA, 15 bp, Homo sapiens
taagattataattgt

SEQ ID NO: 1786693 - DNA, 15 bp, Homo sapiens
taagattatagattc

SEQ ID NO: 1786694 - DNA, 22 bp, Homo sapiens
taagattatagattctaaagat

SEQ ID NO: 1786695 - DNA, 14 bp, Homo sapiens
taagattccagaga

SEQ ID NO: 1786696 - DNA, 17 bp, Homo sapiens
taagattctaaaggtcc

SEQ ID NO: 1786697 - DNA, 15 bp, Homo sapiens
taagattctaatgat

SEQ ID NO: 1786698 - DNA, 12 bp, Homo sapiens
taagattctaga

SEQ ID NO: 1786699 - DNA, 14 bp, Homo sapiens
taagattctagatc

SEQ ID NO: 1786700 - DNA, 13 bp, Homo sapiens
taagattctttgt

SEQ ID NO: 1786701 - DNA, 21 bp, Homo sapiens
taagattgatatctataaaat

SEQ ID NO: 1786702 - DNA, 23 bp, Homo sapiens
taagattgatatctataaaatag

SEQ ID NO: 1786703 - DNA, 23 bp, Homo sapiens
taagattggtgttcgtttccatc

SEQ ID NO: 1786704 - DNA, 15 bp, Homo sapiens
taagatttggtttgg

SEQ ID NO: 1786705 - DNA, 23 bp, Homo sapiens
taagatttgtgtttttctttttc

SEQ ID NO: 1786706 - DNA, 22 bp, Homo sapiens
taagcaaacgtctattttgtat

SEQ ID NO: 1786707 - DNA, 13 bp, Homo sapiens
taagcaaaggctc

SEQ ID NO: 1786708 - DNA, 17 bp, Homo sapiens
taagcaaaggctccctc

SEQ ID NO: 1786709 - DNA, 16 bp, Homo sapiens
taagcaagaatgcagt

SEQ ID NO: 1786710 - DNA, 13 bp, Homo sapiens
taagcaagatgtt

SEQ ID NO: 1786711 - DNA, 21 bp, Homo sapiens
taagcaagatgttttgtataa

SEQ ID NO: 1786712 - DNA, 23 bp, Homo sapiens
taagcaaggtgtccctgccttca

SEQ ID NO: 1786713 - DNA, 21 bp, Homo sapiens
taagcacacacatctggccct

SEQ ID NO: 1786714 - DNA, 15 bp, Homo sapiens
taagcagaacaaatg

SEQ ID NO: 1786715 - DNA, 19 bp, Homo sapiens
taagcagcatggaaaaatg

SEQ ID NO: 1786716 - DNA, 17 bp, Homo sapiens
taagcagcttattgttt

SEQ ID NO: 1786717 - DNA, 18 bp, Homo sapiens
taagcagtgtctgtgttt

SEQ ID NO: 1786718 - DNA, 19 bp, Homo sapiens
taagcagttttgtaaatgt

SEQ ID NO: 1786719 - DNA, 21 bp, Homo sapiens
taagcagttttgtaaatgtac

SEQ ID NO: 1786720 - DNA, 15 bp, Homo sapiens
taagcataaaagatc

SEQ ID NO: 1786721 - DNA, 16 bp, Homo sapiens
taagcataaaagatca

SEQ ID NO: 1786722 - DNA, 14 bp, Homo sapiens
taagcatctaagtt

SEQ ID NO: 1786723 - DNA, 18 bp, Homo sapiens
taagcatctggctctaat

SEQ ID NO: 1786724 - DNA, 17 bp, Homo sapiens
taagcatgtgtcccagg

SEQ ID NO: 1786725 - DNA, 17 bp, Homo sapiens
taagcattttgaaacaa

SEQ ID NO: 1786726 - DNA, 21 bp, Homo sapiens
taagcattttgaaacaaagta

SEQ ID NO: 1786727 - DNA, 20 bp, Homo sapiens
taagccaaactcaggcccag

SEQ ID NO: 1786728 - DNA, 23 bp, Homo sapiens
taagccaaagaaacaagctgtgc

SEQ ID NO: 1786729 - DNA, 15 bp, Homo sapiens
taagccagagcctgg

SEQ ID NO: 1786730 - DNA, 14 bp, Homo sapiens
taagcccccagggc

SEQ ID NO: 1786731 - DNA, 17 bp, Homo sapiens
taagcccccagggcctc

SEQ ID NO: 1786732 - DNA, 16 bp, Homo sapiens
taagccctaaggtcct

SEQ ID NO: 1786733 - DNA, 18 bp, Homo sapiens
taagccctgccccgggat

SEQ ID NO: 1786734 - DNA, 14 bp, Homo sapiens
taagtaagactttt

SEQ ID NO: 1786735 - DNA, 19 bp, Homo sapiens
taagtaagcaacagcataa

SEQ ID NO: 1786736 - DNA, 23 bp, Homo sapiens
taagtaattatcgggaacagtgt

SEQ ID NO: 1786737 - DNA, 16 bp, Homo sapiens
taagtaattcaagaaa

SEQ ID NO: 1786738 - DNA, 13 bp, Homo sapiens
taagtactatgta

SEQ ID NO: 1786739 - DNA, 17 bp, Homo sapiens
taagtactatgtatcaa

SEQ ID NO: 1786740 - DNA, 19 bp, Homo sapiens
taagtagaacaaaaaaccc

SEQ ID NO: 1786741 - DNA, 17 bp, Homo sapiens
taagtagttggtttgta

SEQ ID NO: 1786742 - DNA, 23 bp, Homo sapiens
taagtatatagtatatttatact

SEQ ID NO: 1786743 - DNA, 21 bp, Homo sapiens
taagtatgggatgatagttga

SEQ ID NO: 1786744 - DNA, 19 bp, Homo sapiens
taagtatgttttttatgtt

SEQ ID NO: 1786745 - DNA, 19 bp, Homo sapiens
taagtattcttatttaatg

SEQ ID NO: 1786746 - DNA, 20 bp, Homo sapiens
taagtattcttatttaatga

SEQ ID NO: 1786747 - DNA, 12 bp, Homo sapiens
taagtatttagg

SEQ ID NO: 1786748 - DNA, 14 bp, Homo sapiens
taagtatttataat

SEQ ID NO: 1786749 - DNA, 13 bp, Homo sapiens
taagtatttatat

SEQ ID NO: 1786750 - DNA, 18 bp, Homo sapiens
taagtatttatatattta

SEQ ID NO: 1786751 - DNA, 15 bp, Homo sapiens
taagtcaacagtaaa

SEQ ID NO: 1786752 - DNA, 16 bp, Homo sapiens
taagtcaacagtaaac

SEQ ID NO: 1786753 - DNA, 18 bp, Homo sapiens
taagtcaggagtgtagtt

SEQ ID NO: 1786754 - DNA, 17 bp, Homo sapiens
taagtcagtttcacata

SEQ ID NO: 1786755 - DNA, 14 bp, Homo sapiens
taagtctcctgtct

SEQ ID NO: 1786756 - DNA, 11 bp, Homo sapiens
taagtctctgt

SEQ ID NO: 1786757 - DNA, 12 bp, Homo sapiens
taagtctctgtg

SEQ ID NO: 1786758 - DNA, 16 bp, Homo sapiens
taagtcttccttaaat

SEQ ID NO: 1786759 - DNA, 17 bp, Homo sapiens
taagtcttgcctatatt

SEQ ID NO: 1786760 - DNA, 20 bp, Homo sapiens
taagtcttgcctatattttc

SEQ ID NO: 1786761 - DNA, 20 bp, Homo sapiens
taagtgacaaagccagagga

SEQ ID NO: 1786762 - DNA, 13 bp, Homo sapiens
taagtgacacaga

SEQ ID NO: 1786763 - DNA, 20 bp, Homo sapiens
taagtgacaccaataaatgt

SEQ ID NO: 1786764 - DNA, 23 bp, Homo sapiens
taagtgacaccaataaatgtttg

SEQ ID NO: 1786765 - DNA, 15 bp, Homo sapiens
taagtgagagagaca

SEQ ID NO: 1786766 - DNA, 19 bp, Homo sapiens
taagtgatattcatttaaa

SEQ ID NO: 1786767 - DNA, 18 bp, Homo sapiens
taagtgatttaaaaaaat

SEQ ID NO: 1786768 - DNA, 18 bp, Homo sapiens
taagtgatttttttgtcc

SEQ ID NO: 1786769 - DNA, 14 bp, Homo sapiens
taagtgcacttttt

SEQ ID NO: 1786770 - DNA, 16 bp, Homo sapiens
taagtgcactttttta

SEQ ID NO: 1786771 - DNA, 23 bp, Homo sapiens
taagtgcacttttttatgaagaa

SEQ ID NO: 1786772 - DNA, 15 bp, Homo sapiens
taagtgcccaaagtg

SEQ ID NO: 1786773 - DNA, 16 bp, Homo sapiens
taagtgcccaaagtgg

SEQ ID NO: 1786774 - DNA, 18 bp, Homo sapiens
taagtgcccacatttgat

SEQ ID NO: 1786775 - DNA, 21 bp, Homo sapiens
taagtggaggaaatgttggaa

SEQ ID NO: 1786776 - DNA, 13 bp, Homo sapiens
taagtggctgctg

SEQ ID NO: 1786777 - DNA, 20 bp, Homo sapiens
taagtggggttgcaaccact

SEQ ID NO: 1786778 - DNA, 15 bp, Homo sapiens
taagtgtaaaaaatg

SEQ ID NO: 1786779 - DNA, 15 bp, Homo sapiens
taagtgtagctcaaa

SEQ ID NO: 1786780 - DNA, 14 bp, Homo sapiens
taatagaataaagg

SEQ ID NO: 1786781 - DNA, 12 bp, Homo sapiens
taatagaggagc

SEQ ID NO: 1786782 - DNA, 17 bp, Homo sapiens
taatagaggagctgctt

SEQ ID NO: 1786783 - DNA, 21 bp, Homo sapiens
taatagcaacttttgtgtaat

SEQ ID NO: 1786784 - DNA, 14 bp, Homo sapiens
taatagcttctgtg

SEQ ID NO: 1786785 - DNA, 16 bp, Homo sapiens
taatagcttctgtgtg

SEQ ID NO: 1786786 - DNA, 23 bp, Homo sapiens
taatagcttctgtgtgtgagcta

SEQ ID NO: 1786787 - DNA, 18 bp, Homo sapiens
taataggaaaaacggaag

SEQ ID NO: 1786788 - DNA, 18 bp, Homo sapiens
taatagggaaaattctaa

SEQ ID NO: 1786789 - DNA, 16 bp, Homo sapiens
taatagggaatatatc

SEQ ID NO: 1786790 - DNA, 20 bp, Homo sapiens
taataggtatatagaacaca

SEQ ID NO: 1786791 - DNA, 14 bp, Homo sapiens
taatagtagatttg

SEQ ID NO: 1786792 - DNA, 21 bp, Homo sapiens
taatagtgcttaaaaatcatt

SEQ ID NO: 1786793 - DNA, 23 bp, Homo sapiens
taatagtgcttttttttttttga

SEQ ID NO: 1786794 - DNA, 14 bp, Homo sapiens
taatagttcagtag

SEQ ID NO: 1786795 - DNA, 23 bp, Homo sapiens
taatagttcagtagaattaccat

SEQ ID NO: 1786796 - DNA, 13 bp, Homo sapiens
taatagtttgtct

SEQ ID NO: 1786797 - DNA, 17 bp, Homo sapiens
taatagtttgtctattt

SEQ ID NO: 1786798 - DNA, 18 bp, Homo sapiens
taatagtttgtctatttt

SEQ ID NO: 1786799 - DNA, 19 bp, Homo sapiens
taatataaatttaagcaaa

SEQ ID NO: 1786800 - DNA, 16 bp, Homo sapiens
taatataatgtatttt

SEQ ID NO: 1786801 - DNA, 17 bp, Homo sapiens
taatatacctggtttac

SEQ ID NO: 1786802 - DNA, 14 bp, Homo sapiens
taatatactgcata

SEQ ID NO: 1786803 - DNA, 15 bp, Homo sapiens
taatatactgcatat

SEQ ID NO: 1786804 - DNA, 16 bp, Homo sapiens
taatatagctgagact

SEQ ID NO: 1786805 - DNA, 18 bp, Homo sapiens
taatatatatgaataaag

SEQ ID NO: 1786806 - DNA, 16 bp, Homo sapiens
taatatatgatatttt

SEQ ID NO: 1786807 - DNA, 13 bp, Homo sapiens
taatatatgttta

SEQ ID NO: 1786808 - DNA, 19 bp, Homo sapiens
taatatatttaaagggaaa

SEQ ID NO: 1786809 - DNA, 18 bp, Homo sapiens
taatatatttcagacatt

SEQ ID NO: 1786810 - DNA, 14 bp, Homo sapiens
taatatatttccat

SEQ ID NO: 1786811 - DNA, 14 bp, Homo sapiens
taatatatttcttc

SEQ ID NO: 1786812 - DNA, 22 bp, Homo sapiens
taatatcaaaagaaaattgata

SEQ ID NO: 1786813 - DNA, 14 bp, Homo sapiens
taatatctggcact

SEQ ID NO: 1786814 - DNA, 15 bp, Homo sapiens
taatatctgtgaggt

SEQ ID NO: 1786815 - DNA, 22 bp, Homo sapiens
taatatcttgctggattaatgt

SEQ ID NO: 1786816 - DNA, 12 bp, Homo sapiens
taatatgagctt

SEQ ID NO: 1786817 - DNA, 14 bp, Homo sapiens
taatatgagcttca

SEQ ID NO: 1786818 - DNA, 22 bp, Homo sapiens
taatatgagcttcaatataaga

SEQ ID NO: 1786819 - DNA, 23 bp, Homo sapiens
taatatgagcttcaatataagaa

SEQ ID NO: 1786820 - DNA, 10 bp, Homo sapiens
taatatgcat

SEQ ID NO: 1786821 - DNA, 20 bp, Homo sapiens
taatatgcttataacctagt

SEQ ID NO: 1786822 - DNA, 21 bp, Homo sapiens
taatatgttaacctcagtgtc

SEQ ID NO: 1786823 - DNA, 10 bp, Homo sapiens
taatgttttt

SEQ ID NO: 1786824 - DNA, 22 bp, Homo sapiens
taatgttttttgccacagcttt

SEQ ID NO: 1786825 - DNA, 22 bp, Homo sapiens
taattaaaaaaatttttttccc

SEQ ID NO: 1786826 - DNA, 19 bp, Homo sapiens
taattaaaagcaaatcatt

SEQ ID NO: 1786827 - DNA, 16 bp, Homo sapiens
taattaaattttaatg

SEQ ID NO: 1786828 - DNA, 17 bp, Homo sapiens
taattaatatattaaaa

SEQ ID NO: 1786829 - DNA, 14 bp, Homo sapiens
taattaattgtaat

SEQ ID NO: 1786830 - DNA, 15 bp, Homo sapiens
taattaattgtcatt

SEQ ID NO: 1786831 - DNA, 15 bp, Homo sapiens
taattaatttggagc

SEQ ID NO: 1786832 - DNA, 20 bp, Homo sapiens
taattaatttggagcacaaa

SEQ ID NO: 1786833 - DNA, 21 bp, Homo sapiens
taattaccaacctgttaccta

SEQ ID NO: 1786834 - DNA, 13 bp, Homo sapiens
taattactaattt

SEQ ID NO: 1786835 - DNA, 16 bp, Homo sapiens
taattactgccttgaa

SEQ ID NO: 1786836 - DNA, 21 bp, Homo sapiens
taattactgctataaataggt

SEQ ID NO: 1786837 - DNA, 21 bp, Homo sapiens
taattactggaattcttctgc

SEQ ID NO: 1786838 - DNA, 22 bp, Homo sapiens
taattactgtgtgtgagccaga

SEQ ID NO: 1786839 - DNA, 17 bp, Homo sapiens
taattaggggttgctaa

SEQ ID NO: 1786840 - DNA, 22 bp, Homo sapiens
taattagtgccacttaatgtat

SEQ ID NO: 1786841 - DNA, 20 bp, Homo sapiens
taattagtttatattactct

SEQ ID NO: 1786842 - DNA, 17 bp, Homo sapiens
taattatatattttgtt

SEQ ID NO: 1786843 - DNA, 16 bp, Homo sapiens
taattatgtaaataca

SEQ ID NO: 1786844 - DNA, 18 bp, Homo sapiens
taattatgtaaatacaat

SEQ ID NO: 1786845 - DNA, 12 bp, Homo sapiens
taattattattt

SEQ ID NO: 1786846 - DNA, 13 bp, Homo sapiens
taattattattta

SEQ ID NO: 1786847 - DNA, 14 bp, Homo sapiens
taattattatttat

SEQ ID NO: 1786848 - DNA, 17 bp, Homo sapiens
taattattatttccagt

SEQ ID NO: 1786849 - DNA, 17 bp, Homo sapiens
taattattatttgtgtt

SEQ ID NO: 1786850 - DNA, 13 bp, Homo sapiens
taattattttaaa

SEQ ID NO: 1786851 - DNA, 21 bp, Homo sapiens
taattattttggtacttttat

SEQ ID NO: 1786852 - DNA, 18 bp, Homo sapiens
taattcaaggaatttctt

SEQ ID NO: 1786853 - DNA, 14 bp, Homo sapiens
taattcacagtgct

SEQ ID NO: 1786854 - DNA, 21 bp, Homo sapiens
taattcacagtgctcttttct

SEQ ID NO: 1786855 - DNA, 18 bp, Homo sapiens
taattcagcactgatttc

SEQ ID NO: 1786856 - DNA, 18 bp, Homo sapiens
taattcatttgtattgct

SEQ ID NO: 1786857 - DNA, 20 bp, Homo sapiens
tacctgtctgctgccagcac

SEQ ID NO: 1786858 - DNA, 13 bp, Homo sapiens
tacctgtgaaata

SEQ ID NO: 1786859 - DNA, 14 bp, Homo sapiens
tacctgttatttat

SEQ ID NO: 1786860 - DNA, 21 bp, Homo sapiens
tacctgttcagtgtcccgggc

SEQ ID NO: 1786861 - DNA, 13 bp, Homo sapiens
tacctgtttaaat

SEQ ID NO: 1786862 - DNA, 14 bp, Homo sapiens
tacctgtttaaatt

SEQ ID NO: 1786863 - DNA, 16 bp, Homo sapiens
taccttatagttactg

SEQ ID NO: 1786864 - DNA, 23 bp, Homo sapiens
taccttatcttacaatattgatt

SEQ ID NO: 1786865 - DNA, 17 bp, Homo sapiens
taccttatttatttttg

SEQ ID NO: 1786866 - DNA, 14 bp, Homo sapiens
taccttcatgtgat

SEQ ID NO: 1786867 - DNA, 15 bp, Homo sapiens
taccttccccagact

SEQ ID NO: 1786868 - DNA, 16 bp, Homo sapiens
taccttccttccctgg

SEQ ID NO: 1786869 - DNA, 12 bp, Homo sapiens
taccttctaaaa

SEQ ID NO: 1786870 - DNA, 16 bp, Homo sapiens
taccttctaaaagcca

SEQ ID NO: 1786871 - DNA, 24 bp, Homo sapiens
taccttctaaaagccattattatg

SEQ ID NO: 1786872 - DNA, 15 bp, Homo sapiens
taccttgaaaggaag

SEQ ID NO: 1786873 - DNA, 15 bp, Homo sapiens
taccttgaccatcgt

SEQ ID NO: 1786874 - DNA, 20 bp, Homo sapiens
taccttgaccatcgtccttc

SEQ ID NO: 1786875 - DNA, 14 bp, Homo sapiens
tacctttcaaagct

SEQ ID NO: 1786876 - DNA, 17 bp, Homo sapiens
taccttttctgttgtac

SEQ ID NO: 1786877 - DNA, 21 bp, Homo sapiens
taccttttgaggagccccagc

SEQ ID NO: 1786878 - DNA, 14 bp, Homo sapiens
taccttttgtagtt

SEQ ID NO: 1786879 - DNA, 16 bp, Homo sapiens
taccttttttgttcca

SEQ ID NO: 1786880 - DNA, 15 bp, Homo sapiens
tacctttttttttct

SEQ ID NO: 1786881 - DNA, 15 bp, Homo sapiens
tacgaaacacaaacc

SEQ ID NO: 1786882 - DNA, 13 bp, Homo sapiens
tacgaaatcagtt

SEQ ID NO: 1786883 - DNA, 22 bp, Homo sapiens
tacgaacctacagttttaactg

SEQ ID NO: 1786884 - DNA, 22 bp, Homo sapiens
tacgaagagtatttttgacaga

SEQ ID NO: 1786885 - DNA, 23 bp, Homo sapiens
tacgaagagtatttttgacagaa

SEQ ID NO: 1786886 - DNA, 14 bp, Homo sapiens
tacgaatctcatcc

SEQ ID NO: 1786887 - DNA, 20 bp, Homo sapiens
tacgagcacctccagcctga

SEQ ID NO: 1786888 - DNA, 21 bp, Homo sapiens
tacgagcacctccagcctgaa

SEQ ID NO: 1786889 - DNA, 23 bp, Homo sapiens
tacgatacgctactataaagaga

SEQ ID NO: 1786890 - DNA, 20 bp, Homo sapiens
tacgatcaagttgttgactg

SEQ ID NO: 1786891 - DNA, 20 bp, Homo sapiens
tacgattatacttgagattt

SEQ ID NO: 1786892 - DNA, 13 bp, Homo sapiens
tacgattccactg

SEQ ID NO: 1786893 - DNA, 16 bp, Homo sapiens
tacgcacataccttca

SEQ ID NO: 1786894 - DNA, 13 bp, Homo sapiens
tacggaagagcag

SEQ ID NO: 1786895 - DNA, 15 bp, Homo sapiens
tacgggggcacttgg

SEQ ID NO: 1786896 - DNA, 14 bp, Homo sapiens
tacgtagctctctt

SEQ ID NO: 1786897 - DNA, 18 bp, Homo sapiens
tacgtcccgctgctgtgc

SEQ ID NO: 1786898 - DNA, 23 bp, Homo sapiens
tacgtccgtgtgtcccagatgct

SEQ ID NO: 1786899 - DNA, 14 bp, Homo sapiens
tacgtgcacagggt

SEQ ID NO: 1786900 - DNA, 20 bp, Homo sapiens
tacgtgcacagggtccccga

SEQ ID NO: 1786901 - DNA, 21 bp, Homo sapiens
tacgtgccagatataactgtc

SEQ ID NO: 1786902 - DNA, 23 bp, Homo sapiens
tacgtgccagatataactgtctt

SEQ ID NO: 1786903 - DNA, 15 bp, Homo sapiens
tacgtggcttcagag

SEQ ID NO: 1786904 - DNA, 14 bp, Homo sapiens
tacgtgtgcatgtg

SEQ ID NO: 1786905 - DNA, 14 bp, Homo sapiens
tacgtttgtatgtg

SEQ ID NO: 1786906 - DNA, 17 bp, Homo sapiens
tacgtttgtgcagaatc

SEQ ID NO: 1786907 - DNA, 19 bp, Homo sapiens
tacgtttgtgcagaatctc

SEQ ID NO: 1786908 - DNA, 21 bp, Homo sapiens
tacgtttgtgcagaatctcta

SEQ ID NO: 1786909 - DNA, 18 bp, Homo sapiens
tacgttttgcacattttg

SEQ ID NO: 1786910 - DNA, 20 bp, Homo sapiens
tacgttttggttctatgcta

SEQ ID NO: 1786911 - DNA, 11 bp, Homo sapiens
tactaaaatta

SEQ ID NO: 1786912 - DNA, 16 bp, Homo sapiens
tactaaagaaagatta

SEQ ID NO: 1786913 - DNA, 22 bp, Homo sapiens
tactaaagatatcagagctctt

SEQ ID NO: 1786914 - DNA, 12 bp, Homo sapiens
tactaacctccc

SEQ ID NO: 1786915 - DNA, 15 bp, Homo sapiens
tactaagaagaaaat

SEQ ID NO: 1786916 - DNA, 14 bp, Homo sapiens
tactaagaatgtcc

SEQ ID NO: 1786917 - DNA, 16 bp, Homo sapiens
tactaatatatatttt

SEQ ID NO: 1786918 - DNA, 20 bp, Homo sapiens
tactaatatatattttaagg

SEQ ID NO: 1786919 - DNA, 15 bp, Homo sapiens
tactaatgatgtttt

SEQ ID NO: 1786920 - DNA, 13 bp, Homo sapiens
tactacaaaattt

SEQ ID NO: 1786921 - DNA, 18 bp, Homo sapiens
tactacaaaatttgaaat

SEQ ID NO: 1786922 - DNA, 17 bp, Homo sapiens
tactacaatatgtacat

SEQ ID NO: 1786923 - DNA, 21 bp, Homo sapiens
tactacagaaattaagatgtt

SEQ ID NO: 1786924 - DNA, 15 bp, Homo sapiens
tactacagaaattct

SEQ ID NO: 1786925 - DNA, 19 bp, Homo sapiens
tactacagctatatttgat

SEQ ID NO: 1786926 - DNA, 15 bp, Homo sapiens
tactacccagctctg

SEQ ID NO: 1786927 - DNA, 16 bp, Homo sapiens
tactacccagctctgt

SEQ ID NO: 1786928 - DNA, 14 bp, Homo sapiens
tactacctagaagt

SEQ ID NO: 1786929 - DNA, 17 bp, Homo sapiens
tactactagatgtcttt

SEQ ID NO: 1786930 - DNA, 18 bp, Homo sapiens
tactactagatgtcttta

SEQ ID NO: 1786931 - DNA, 16 bp, Homo sapiens
tactactcctgtaatt

SEQ ID NO: 1786932 - DNA, 16 bp, Homo sapiens
tactactgagggaaat

SEQ ID NO: 1786933 - DNA, 20 bp, Homo sapiens
tactacttttgcatgaaaat

SEQ ID NO: 1786934 - DNA, 19 bp, Homo sapiens
tactagcatacttaaaata

SEQ ID NO: 1786935 - DNA, 23 bp, Homo sapiens
tactaggatacagaaatgcaaaa

SEQ ID NO: 1786936 - DNA, 20 bp, Homo sapiens
tactagggagccatttgaga

SEQ ID NO: 1786937 - DNA, 14 bp, Homo sapiens
tactagtgttctgt

SEQ ID NO: 1786938 - DNA, 14 bp, Homo sapiens
tactagttacacat

SEQ ID NO: 1786939 - DNA, 14 bp, Homo sapiens
tactataaagagaa

SEQ ID NO: 1786940 - DNA, 21 bp, Homo sapiens
tactatatttacaaataaaat

SEQ ID NO: 1786941 - DNA, 21 bp, Homo sapiens
tactatcatactactgaaaca

SEQ ID NO: 1786942 - DNA, 16 bp, Homo sapiens
tactatcctgtaaata

SEQ ID NO: 1786943 - DNA, 15 bp, Homo sapiens
tactatctgttgaaa

SEQ ID NO: 1786944 - DNA, 22 bp, Homo sapiens
tactatcttatctcagatattt

SEQ ID NO: 1786945 - DNA, 20 bp, Homo sapiens
tactatgtgccagttcctgt

SEQ ID NO: 1786946 - DNA, 21 bp, Homo sapiens
tactatgtgccagttcctgta

SEQ ID NO: 1786947 - DNA, 18 bp, Homo sapiens
tactatgttaataacttg

SEQ ID NO: 1786948 - DNA, 22 bp, Homo sapiens
tactattaggaaaataaacaga

SEQ ID NO: 1786949 - DNA, 22 bp, Homo sapiens
tactattcagtggcgagaaata

SEQ ID NO: 1786950 - DNA, 19 bp, Homo sapiens
tactatttaaagcctcctc

SEQ ID NO: 1786951 - DNA, 13 bp, Homo sapiens
tactatttaactg

SEQ ID NO: 1786952 - DNA, 12 bp, Homo sapiens
tactatttaaga

SEQ ID NO: 1786953 - DNA, 19 bp, Homo sapiens
tactatttaagatgtgaaa

SEQ ID NO: 1786954 - DNA, 19 bp, Homo sapiens
tactattttctacaattaa

SEQ ID NO: 1786955 - DNA, 17 bp, Homo sapiens
tactattttgacagtta

SEQ ID NO: 1786956 - DNA, 17 bp, Homo sapiens
tactcaaatgagtaaca

SEQ ID NO: 1786957 - DNA, 18 bp, Homo sapiens
tactcaaatgagtaacat

SEQ ID NO: 1786958 - DNA, 22 bp, Homo sapiens
tactcaacccattgttgtcaag

SEQ ID NO: 1786959 - DNA, 19 bp, Homo sapiens
tactcaatggtatcattac

SEQ ID NO: 1786960 - DNA, 14 bp, Homo sapiens
tactcaatgtttct

SEQ ID NO: 1786961 - DNA, 17 bp, Homo sapiens
tactcacacttcagctg

SEQ ID NO: 1786962 - DNA, 15 bp, Homo sapiens
tactcaccaaaatat

SEQ ID NO: 1786963 - DNA, 17 bp, Homo sapiens
tactcaccaaaatatag

SEQ ID NO: 1786964 - DNA, 19 bp, Homo sapiens
tactcagaagcctgaggct

SEQ ID NO: 1786965 - DNA, 13 bp, Homo sapiens
tactcagagcaga

SEQ ID NO: 1786966 - DNA, 15 bp, Homo sapiens
tactcagagcagatg

SEQ ID NO: 1786967 - DNA, 19 bp, Homo sapiens
tactcagcagccctcctca

SEQ ID NO: 1786968 - DNA, 12 bp, Homo sapiens
tactcagccctg

SEQ ID NO: 1786969 - DNA, 16 bp, Homo sapiens
tactcagccctgggcc

SEQ ID NO: 1786970 - DNA, 22 bp, Homo sapiens
tactcaggaggctgagacagga

SEQ ID NO: 1786971 - DNA, 17 bp, Homo sapiens
tactcagtggggctggc

SEQ ID NO: 1786972 - DNA, 14 bp, Homo sapiens
tactcatttttcat

SEQ ID NO: 1786973 - DNA, 16 bp, Homo sapiens
tactcatttttcatta

SEQ ID NO: 1786974 - DNA, 17 bp, Homo sapiens
taccatctgatgtttca

SEQ ID NO: 1786975 - DNA, 13 bp, Homo sapiens
taccatctgcatg

SEQ ID NO: 1786976 - DNA, 14 bp, Homo sapiens
taccatctgctgcc

SEQ ID NO: 1786977 - DNA, 12 bp, Homo sapiens
taccatgctgct

SEQ ID NO: 1786978 - DNA, 23 bp, Homo sapiens
taccatgctgctttttggcacag

SEQ ID NO: 1786979 - DNA, 16 bp, Homo sapiens
taccatggtttgatat

SEQ ID NO: 1786980 - DNA, 16 bp, Homo sapiens
taccattgctgttcta

SEQ ID NO: 1786981 - DNA, 19 bp, Homo sapiens
taccatttagtaagaatac

SEQ ID NO: 1786982 - DNA, 13 bp, Homo sapiens
taccatttgtaat

SEQ ID NO: 1786983 - DNA, 18 bp, Homo sapiens
taccattttaaagttagt

SEQ ID NO: 1786984 - DNA, 20 bp, Homo sapiens
tacccaaaaccctgaagcca

SEQ ID NO: 1786985 - DNA, 12 bp, Homo sapiens
tactccacagcg

SEQ ID NO: 1786986 - DNA, 12 bp, Homo sapiens
tactccactgcc

SEQ ID NO: 1786987 - DNA, 15 bp, Homo sapiens
tactccataaacaga

SEQ ID NO: 1786988 - DNA, 16 bp, Homo sapiens
taggcattaacacaaa

SEQ ID NO: 1786989 - DNA, 15 bp, Homo sapiens
taggcatttcctgct

SEQ ID NO: 1786990 - DNA, 22 bp, Homo sapiens
taggccaccattataatttata

SEQ ID NO: 1786991 - DNA, 19 bp, Homo sapiens
taggccaccccctatcctc

SEQ ID NO: 1786992 - DNA, 15 bp, Homo sapiens
taggccactcctcca

SEQ ID NO: 1786993 - DNA, 14 bp, Homo sapiens
taggccatgaaaaa

SEQ ID NO: 1786994 - DNA, 19 bp, Homo sapiens
taggccccagaggccctgg

SEQ ID NO: 1786995 - DNA, 21 bp, Homo sapiens
taggcccccaaattgccttca

SEQ ID NO: 1786996 - DNA, 20 bp, Homo sapiens
taggcccctcctagacccag

SEQ ID NO: 1786997 - DNA, 22 bp, Homo sapiens
taggccctggttcctgctgtcc

SEQ ID NO: 1786998 - DNA, 22 bp, Homo sapiens
taggcctataaaattaaatgcc

SEQ ID NO: 1786999 - DNA, 12 bp, Homo sapiens
taggcctatcaa

SEQ ID NO: 1787000 - DNA, 20 bp, Homo sapiens
taggccttaacacactggcc

SEQ ID NO: 1787001 - DNA, 23 bp, Homo sapiens
taggccttcctctctccagatgt

SEQ ID NO: 1787002 - DNA, 17 bp, Homo sapiens
taggcggtcatgtgtgc

SEQ ID NO: 1787003 - DNA, 20 bp, Homo sapiens
taggcggtcatgtgtgcatg

SEQ ID NO: 1787004 - DNA, 16 bp, Homo sapiens
taggctattaaaaaag

SEQ ID NO: 1787005 - DNA, 11 bp, Homo sapiens
taggctctgca

SEQ ID NO: 1787006 - DNA, 15 bp, Homo sapiens
taggctcttaagcag

SEQ ID NO: 1787007 - DNA, 20 bp, Homo sapiens
taggctcttatgtgtgcctt

SEQ ID NO: 1787008 - DNA, 19 bp, Homo sapiens
taggctgtaactactttat

SEQ ID NO: 1787009 - DNA, 18 bp, Homo sapiens
taggcttttaagaaacac

SEQ ID NO: 1787010 - DNA, 16 bp, Homo sapiens
tagggaaataataggg

SEQ ID NO: 1787011 - DNA, 14 bp, Homo sapiens
tagggaatctggat

SEQ ID NO: 1787012 - DNA, 13 bp, Homo sapiens
tagggacaggtgg

SEQ ID NO: 1787013 - DNA, 18 bp, Homo sapiens
tagggacctcagaggttt

SEQ ID NO: 1787014 - DNA, 18 bp, Homo sapiens
tagggagaatatttacta

SEQ ID NO: 1787015 - DNA, 16 bp, Homo sapiens
tagggagacagggtag

SEQ ID NO: 1787016 - DNA, 15 bp, Homo sapiens
tagggagagagaagc

SEQ ID NO: 1787017 - DNA, 13 bp, Homo sapiens
tagggataattta

SEQ ID NO: 1787018 - DNA, 14 bp, Homo sapiens
tagggatgcctcct

SEQ ID NO: 1787019 - DNA, 15 bp, Homo sapiens
tagggatgcctcctt

SEQ ID NO: 1787020 - DNA, 22 bp, Homo sapiens
tagggatgcggatcctgctggg

SEQ ID NO: 1787021 - DNA, 18 bp, Homo sapiens
tagggatgttctggccct

SEQ ID NO: 1787022 - DNA, 13 bp, Homo sapiens
tagggcactgggc

SEQ ID NO: 1787023 - DNA, 20 bp, Homo sapiens
tagggcagattttcatgcaa

SEQ ID NO: 1787024 - DNA, 11 bp, Homo sapiens
tagggcagctt

SEQ ID NO: 1787025 - DNA, 21 bp, Homo sapiens
tagggcctggtccctgggagg

SEQ ID NO: 1787026 - DNA, 16 bp, Homo sapiens
tagggcttttattttt

SEQ ID NO: 1787027 - DNA, 20 bp, Homo sapiens
tagggcttttattttttctt

SEQ ID NO: 1787028 - DNA, 18 bp, Homo sapiens
taggggaaggagaagtaa

SEQ ID NO: 1787029 - DNA, 17 bp, Homo sapiens
taggggcagggaggcaa

SEQ ID NO: 1787030 - DNA, 12 bp, Homo sapiens
taggggccacct

SEQ ID NO: 1787031 - DNA, 14 bp, Homo sapiens
taggggccacctcc

SEQ ID NO: 1787032 - DNA, 19 bp, Homo sapiens
taggggccacctcctcccc

SEQ ID NO: 1787033 - DNA, 19 bp, Homo sapiens
tagggggatataatacata

SEQ ID NO: 1787034 - DNA, 15 bp, Homo sapiens
tagggggctttctgg

SEQ ID NO: 1787035 - DNA, 17 bp, Homo sapiens
taggggtcaggctccat

SEQ ID NO: 1787036 - DNA, 23 bp, Homo sapiens
taggggtgcgctcacctgcagcc

SEQ ID NO: 1787037 - DNA, 13 bp, Homo sapiens
taggggttgctaa

SEQ ID NO: 1787038 - DNA, 12 bp, Homo sapiens
tagggtaaatca

SEQ ID NO: 1787039 - DNA, 22 bp, Homo sapiens
tagggtaaatcagtaagaggtg

SEQ ID NO: 1787040 - DNA, 23 bp, Homo sapiens
tagggtaagaagattcaagagga

SEQ ID NO: 1787041 - DNA, 15 bp, Homo sapiens
tagggtaaggtgcct

SEQ ID NO: 1787042 - DNA, 15 bp, Homo sapiens
tagggtgtgtgttca

SEQ ID NO: 1787043 - DNA, 13 bp, Homo sapiens
tagggtgttttaa

SEQ ID NO: 1787044 - DNA, 14 bp, Homo sapiens
tagggttaaatggt

SEQ ID NO: 1787045 - DNA, 15 bp, Homo sapiens
tagggttataataat

SEQ ID NO: 1787046 - DNA, 17 bp, Homo sapiens
tagggttataataatgt

SEQ ID NO: 1787047 - DNA, 19 bp, Homo sapiens
tagggttttgcaataactt

SEQ ID NO: 1787048 - DNA, 17 bp, Homo sapiens
taggtaatctataacta

SEQ ID NO: 1787049 - DNA, 13 bp, Homo sapiens
taggtaatgatta

SEQ ID NO: 1787050 - DNA, 22 bp, Homo sapiens
taggtcaataacactgtatttt

SEQ ID NO: 1787051 - DNA, 18 bp, Homo sapiens
taggtcccggccagctct

SEQ ID NO: 1787052 - DNA, 17 bp, Homo sapiens
taggtctcatctcttca

SEQ ID NO: 1787053 - DNA, 12 bp, Homo sapiens
taggtctccagt

SEQ ID NO: 1787054 - DNA, 15 bp, Homo sapiens
taggtctcctcaggg

SEQ ID NO: 1787055 - DNA, 16 bp, Homo sapiens
taggtctcctcagggt

SEQ ID NO: 1787056 - DNA, 15 bp, Homo sapiens
taggtgagaaaaaaa

SEQ ID NO: 1787057 - DNA, 19 bp, Homo sapiens
taggtgatgtttccagctg

SEQ ID NO: 1787058 - DNA, 21 bp, Homo sapiens
taggtgatgtttccagctgcc

SEQ ID NO: 1787059 - DNA, 17 bp, Homo sapiens
taggttaaaaaaaggca

SEQ ID NO: 1787060 - DNA, 22 bp, Homo sapiens
taggttaattccaattatatga

SEQ ID NO: 1787061 - DNA, 17 bp, Homo sapiens
taggttattttgctttg

SEQ ID NO: 1787062 - DNA, 15 bp, Homo sapiens
taggttcagccaagg

SEQ ID NO: 1787063 - DNA, 15 bp, Homo sapiens
taggttcccctgtca

SEQ ID NO: 1787064 - DNA, 12 bp, Homo sapiens
taggttctaaaa

SEQ ID NO: 1787065 - DNA, 18 bp, Homo sapiens
taggttctttgctgcatt

SEQ ID NO: 1787066 - DNA, 16 bp, Homo sapiens
taggttgtctaaaaat

SEQ ID NO: 1787067 - DNA, 14 bp, Homo sapiens
taggtttactgtga

SEQ ID NO: 1787068 - DNA, 17 bp, Homo sapiens
taggtttactgtgaaga

SEQ ID NO: 1787069 - DNA, 11 bp, Homo sapiens
taggtttcaaa

SEQ ID NO: 1787070 - DNA, 14 bp, Homo sapiens
taggtttcaaagat

SEQ ID NO: 1787071 - DNA, 21 bp, Homo sapiens
taggtttgtcccagtcagaaa

SEQ ID NO: 1787072 - DNA, 23 bp, Homo sapiens
taggtttgtcccagtcagaaata

SEQ ID NO: 1787073 - DNA, 20 bp, Homo sapiens
tagtaaaagtggtctctgct

SEQ ID NO: 1787074 - DNA, 16 bp, Homo sapiens
tagtaaaatgcttaca

SEQ ID NO: 1787075 - DNA, 23 bp, Homo sapiens
tagtaaacattaagtaaatgctg

SEQ ID NO: 1787076 - DNA, 15 bp, Homo sapiens
tagtaaaggaggaat

SEQ ID NO: 1787077 - DNA, 14 bp, Homo sapiens
tagtaactctttct

SEQ ID NO: 1787078 - DNA, 17 bp, Homo sapiens
tagtaagatgcactgaa

SEQ ID NO: 1787079 - DNA, 11 bp, Homo sapiens
tagtaagcata

SEQ ID NO: 1787080 - DNA, 22 bp, Homo sapiens
tagtaagtcttgcctatatttt

SEQ ID NO: 1787081 - DNA, 21 bp, Homo sapiens
tagtaatataatacacaaaat

SEQ ID NO: 1787082 - DNA, 17 bp, Homo sapiens
tagtaatatatttaaag

SEQ ID NO: 1787083 - DNA, 18 bp, Homo sapiens
tagtaatatatttaaagg

SEQ ID NO: 1787084 - DNA, 20 bp, Homo sapiens
tagtaatttctttttttcct

SEQ ID NO: 1787085 - DNA, 22 bp, Homo sapiens
tagtacaagtggtaatttttgt

SEQ ID NO: 1787086 - DNA, 14 bp, Homo sapiens
tagtacaataatct

SEQ ID NO: 1787087 - DNA, 22 bp, Homo sapiens
tagtaccctatagagagggggc

SEQ ID NO: 1787088 - DNA, 18 bp, Homo sapiens
tagtacctgaaaagtaac

SEQ ID NO: 1787089 - DNA, 20 bp, Homo sapiens
tagtactcctgcaaaatttt

SEQ ID NO: 1787090 - DNA, 17 bp, Homo sapiens
tagtactccttaagaac

SEQ ID NO: 1787091 - DNA, 13 bp, Homo sapiens
tagtactgctctt

SEQ ID NO: 1787092 - DNA, 18 bp, Homo sapiens
tagtactttgtgctcata

SEQ ID NO: 1787093 - DNA, 16 bp, Homo sapiens
tagtagaactggatcc

SEQ ID NO: 1787094 - DNA, 20 bp, Homo sapiens
tagtagaactggatcccaac

SEQ ID NO: 1787095 - DNA, 16 bp, Homo sapiens
tagtagacatttgtgt

SEQ ID NO: 1787096 - DNA, 16 bp, Homo sapiens
tagtagcttataagag

SEQ ID NO: 1787097 - DNA, 13 bp, Homo sapiens
tagtagtgttcta

SEQ ID NO: 1787098 - DNA, 16 bp, Homo sapiens
tagtataaagaaaagt

SEQ ID NO: 1787099 - DNA, 16 bp, Homo sapiens
tagtatacgtataaat

SEQ ID NO: 1787100 - DNA, 21 bp, Homo sapiens
tagtatagaagtctggaaaaa

SEQ ID NO: 1787101 - DNA, 19 bp, Homo sapiens
tagtatatctggacaagcc

SEQ ID NO: 1787102 - DNA, 17 bp, Homo sapiens
tagtatatttatactct

SEQ ID NO: 1787103 - DNA, 23 bp, Homo sapiens
tagtatctcgtaatagcttctgt

SEQ ID NO: 1787104 - DNA, 11 bp, Homo sapiens
tagtatctgta

SEQ ID NO: 1787105 - DNA, 15 bp, Homo sapiens
tagtatgaaattata

SEQ ID NO: 1787106 - DNA, 19 bp, Homo sapiens
tagtatggttcaagattgt

SEQ ID NO: 1787107 - DNA, 11 bp, Homo sapiens
tagtatgtctg

SEQ ID NO: 1787108 - DNA, 23 bp, Homo sapiens
tagtattatcaaagggataaaga

SEQ ID NO: 1787109 - DNA, 22 bp, Homo sapiens
tagtattatcttgttcaggaaa

SEQ ID NO: 1787110 - DNA, 21 bp, Homo sapiens
tagtattcctaacctgtcaga

SEQ ID NO: 1787111 - DNA, 20 bp, Homo sapiens
tagtatttatgggtggattt

SEQ ID NO: 1787112 - DNA, 13 bp, Homo sapiens
tagtatttctcag

SEQ ID NO: 1787113 - DNA, 18 bp, Homo sapiens
tagtattttttgtataat

SEQ ID NO: 1787114 - DNA, 19 bp, Homo sapiens
tagtattttttgtataatt

SEQ ID NO: 1787115 - DNA, 19 bp, Homo sapiens
tagtcaatttctacttctg

SEQ ID NO: 1787116 - DNA, 19 bp, Homo sapiens
tagtcaccgacagcggcct

SEQ ID NO: 1787117 - DNA, 18 bp, Homo sapiens
tagtcactggcagcctgc

SEQ ID NO: 1787118 - DNA, 15 bp, Homo sapiens
tagtcagaagcaggt

SEQ ID NO: 1787119 - DNA, 15 bp, Homo sapiens
tagtcagctgccttt

SEQ ID NO: 1787120 - DNA, 23 bp, Homo sapiens
tagtcagtgtcgtttatattgta

SEQ ID NO: 1787121 - DNA, 16 bp, Homo sapiens
tagtcataactagatt

SEQ ID NO: 1787122 - DNA, 16 bp, Homo sapiens
tagtccagccttccag

SEQ ID NO: 1787123 - DNA, 18 bp, Homo sapiens
tagtccccaaggcctctc

SEQ ID NO: 1787124 - DNA, 21 bp, Homo sapiens
tagtccccaaggcctctctct

SEQ ID NO: 1787125 - DNA, 14 bp, Homo sapiens
tagtcccccaaagg

SEQ ID NO: 1787126 - DNA, 14 bp, Homo sapiens
tagtcctattctat

SEQ ID NO: 1787127 - DNA, 13 bp, Homo sapiens
tagtctaagacta

SEQ ID NO: 1787128 - DNA, 19 bp, Homo sapiens
tagtctcagtttgtgtgtc

SEQ ID NO: 1787129 - DNA, 21 bp, Homo sapiens
tagtctcctttgcactgaggg

SEQ ID NO: 1787130 - DNA, 22 bp, Homo sapiens
tagtctcctttgcactgagggc

SEQ ID NO: 1787131 - DNA, 17 bp, Homo sapiens
tagtctctctgcaagac

SEQ ID NO: 1787132 - DNA, 13 bp, Homo sapiens
tagtctctgattt

SEQ ID NO: 1787133 - DNA, 18 bp, Homo sapiens
tagtctctttaaaaggaa

SEQ ID NO: 1787134 - DNA, 15 bp, Homo sapiens
tagtctgaaactggc

SEQ ID NO: 1787135 - DNA, 21 bp, Homo sapiens
tagtcttgaaatgaaagggaa

SEQ ID NO: 1787136 - DNA, 14 bp, Homo sapiens
tagtctttagaact

SEQ ID NO: 1787137 - DNA, 18 bp, Homo sapiens
tagtctttgccagtcatt

SEQ ID NO: 1787138 - DNA, 16 bp, Homo sapiens
tagtcttttgcttttg

SEQ ID NO: 1787139 - DNA, 16 bp, Homo sapiens
tagtgaaatggctggg

SEQ ID NO: 1787140 - DNA, 18 bp, Homo sapiens
tagtgaaccaaaaataga

SEQ ID NO: 1787141 - DNA, 20 bp, Homo sapiens
tagtgaaccaaaaatagaaa

SEQ ID NO: 1787142 - DNA, 21 bp, Homo sapiens
tagtgaaccaaaaatagaaat

SEQ ID NO: 1787143 - DNA, 23 bp, Homo sapiens
tagtgaaccaaaaatagaaatta

SEQ ID NO: 1787144 - DNA, 12 bp, Homo sapiens
tagtgaatgact

SEQ ID NO: 1787145 - DNA, 11 bp, Homo sapiens
tagtgactttt

SEQ ID NO: 1787146 - DNA, 19 bp, Homo sapiens
tagtgacttttcaagtatt

SEQ ID NO: 1787147 - DNA, 20 bp, Homo sapiens
tagtgaggaagacaagcatt

SEQ ID NO: 1787148 - DNA, 13 bp, Homo sapiens
tagtgatggttcc

SEQ ID NO: 1787149 - DNA, 18 bp, Homo sapiens
tagtgcaacatctctgaa

SEQ ID NO: 1787150 - DNA, 17 bp, Homo sapiens
tagtgcatttttaaact

SEQ ID NO: 1787151 - DNA, 19 bp, Homo sapiens
tagtgcatttttaaacttg

SEQ ID NO: 1787152 - DNA, 21 bp, Homo sapiens
tagtgccagaattttaggaac

SEQ ID NO: 1787153 - DNA, 14 bp, Homo sapiens
tagtgccccagact

SEQ ID NO: 1787154 - DNA, 14 bp, Homo sapiens
tagtgcctaaaatt

SEQ ID NO: 1787155 - DNA, 21 bp, Homo sapiens
tagtgcgatgtttcaggaggc

SEQ ID NO: 1787156 - DNA, 17 bp, Homo sapiens
tagtgcggacaagtttt

SEQ ID NO: 1787157 - DNA, 13 bp, Homo sapiens
tagtgctgctgaa

SEQ ID NO: 1787158 - DNA, 22 bp, Homo sapiens
tagtgctgctgtgtgctttttt

SEQ ID NO: 1787159 - DNA, 21 bp, Homo sapiens
tagtgctggtcagagagacct

SEQ ID NO: 1787160 - DNA, 22 bp, Homo sapiens
tagtgcttcagagtttgtgtgt

SEQ ID NO: 1787161 - DNA, 14 bp, Homo sapiens
tagtggaagagcag

SEQ ID NO: 1787162 - DNA, 16 bp, Homo sapiens
tagtggaagagcagcc

SEQ ID NO: 1787163 - DNA, 21 bp, Homo sapiens
tagtggaagagcagcctgatg

SEQ ID NO: 1787164 - DNA, 14 bp, Homo sapiens
tagtggacttgttt

SEQ ID NO: 1787165 - DNA, 19 bp, Homo sapiens
tagtggacttgttttaatt

SEQ ID NO: 1787166 - DNA, 18 bp, Homo sapiens
tagtggccatcatttctg

SEQ ID NO: 1787167 - DNA, 19 bp, Homo sapiens
tagtggccatcatttctgg

SEQ ID NO: 1787168 - DNA, 14 bp, Homo sapiens
tagtggggcctggg

SEQ ID NO: 1787169 - DNA, 23 bp, Homo sapiens
tagtggggtctccctctcctgcc

SEQ ID NO: 1787170 - DNA, 12 bp, Homo sapiens
tagtggtagtat

SEQ ID NO: 1787171 - DNA, 13 bp, Homo sapiens
tagtggtatgtct

SEQ ID NO: 1787172 - DNA, 15 bp, Homo sapiens
tagtggtatgtctct

SEQ ID NO: 1787173 - DNA, 21 bp, Homo sapiens
tagtgtacatttctataaata

SEQ ID NO: 1787174 - DNA, 15 bp, Homo sapiens
tagtgtatgattact

SEQ ID NO: 1787175 - DNA, 14 bp, Homo sapiens
tagtgtattaatca

SEQ ID NO: 1787176 - DNA, 17 bp, Homo sapiens
tagtgtcacttacctag

SEQ ID NO: 1787177 - DNA, 18 bp, Homo sapiens
tagtgtcataaagattat

SEQ ID NO: 1787178 - DNA, 21 bp, Homo sapiens
tagtgtcataaagattataat

SEQ ID NO: 1787179 - DNA, 12 bp, Homo sapiens
tagtgtctgacc

SEQ ID NO: 1787180 - DNA, 11 bp, Homo sapiens
tagtgtgaaat

SEQ ID NO: 1787181 - DNA, 20 bp, Homo sapiens
tagtgtgacagtttccaaat

SEQ ID NO: 1787182 - DNA, 22 bp, Homo sapiens
tagtgtgagtggcagccatgcc

SEQ ID NO: 1787183 - DNA, 15 bp, Homo sapiens
tagtgtgtcctgtga

SEQ ID NO: 1787184 - DNA, 14 bp, Homo sapiens
tagtgtgtgtgcat

SEQ ID NO: 1787185 - DNA, 12 bp, Homo sapiens
tagtgttctgtt

SEQ ID NO: 1787186 - DNA, 19 bp, Homo sapiens
tagttaaaagactgcagct

SEQ ID NO: 1787187 - DNA, 17 bp, Homo sapiens
tagttaaataactgtgt

SEQ ID NO: 1787188 - DNA, 12 bp, Homo sapiens
tagttaccttat

SEQ ID NO: 1787189 - DNA, 18 bp, Homo sapiens
tagttaccttatagttac

SEQ ID NO: 1787190 - DNA, 19 bp, Homo sapiens
tagttaccttatagttact

SEQ ID NO: 1787191 - DNA, 23 bp, Homo sapiens
tagttaccttatagttactgtgt

SEQ ID NO: 1787192 - DNA, 12 bp, Homo sapiens
tagttactgtaa

SEQ ID NO: 1787193 - DNA, 12 bp, Homo sapiens
tagttagacaat

SEQ ID NO: 1787194 - DNA, 16 bp, Homo sapiens
tagttagcatgcgcgc

SEQ ID NO: 1787195 - DNA, 20 bp, Homo sapiens
tagttagccatctaatgctt

SEQ ID NO: 1787196 - DNA, 15 bp, Homo sapiens
tagttagccctcagt

SEQ ID NO: 1787197 - DNA, 14 bp, Homo sapiens
tagttagtttggaa

SEQ ID NO: 1787198 - DNA, 19 bp, Homo sapiens
tagttatacttatttgtat

SEQ ID NO: 1787199 - DNA, 17 bp, Homo sapiens
tagttattattgctgtt

SEQ ID NO: 1787200 - DNA, 17 bp, Homo sapiens
tagttattctgccttcc

SEQ ID NO: 1787201 - DNA, 19 bp, Homo sapiens
tagttcagtagaattacca

SEQ ID NO: 1787202 - DNA, 21 bp, Homo sapiens
tagttcagtagaattaccatt

SEQ ID NO: 1787203 - DNA, 14 bp, Homo sapiens
tagttcatccaatc

SEQ ID NO: 1787204 - DNA, 20 bp, Homo sapiens
tagttcatccaatcctcact

SEQ ID NO: 1787205 - DNA, 16 bp, Homo sapiens
tagttccagtttctcc

SEQ ID NO: 1787206 - DNA, 18 bp, Homo sapiens
tagttccagtttctcctt

SEQ ID NO: 1787207 - DNA, 20 bp, Homo sapiens
tagttccagtttctccttga

SEQ ID NO: 1787208 - DNA, 23 bp, Homo sapiens
tagttccctgaaaacccagagag

SEQ ID NO: 1787209 - DNA, 13 bp, Homo sapiens
tagttctaagact

SEQ ID NO: 1787210 - DNA, 20 bp, Homo sapiens
tagttctataagtgaggaag

SEQ ID NO: 1787211 - DNA, 22 bp, Homo sapiens
tagttctatccttttgcctgca

SEQ ID NO: 1787212 - DNA, 15 bp, Homo sapiens
tagttctcagcttgc

SEQ ID NO: 1787213 - DNA, 13 bp, Homo sapiens
tagttctgctgcc

SEQ ID NO: 1787214 - DNA, 16 bp, Homo sapiens
tagttctttcctcccc

SEQ ID NO: 1787215 - DNA, 20 bp, Homo sapiens
tagttctttcctccccctgc

SEQ ID NO: 1787216 - DNA, 15 bp, Homo sapiens
tagttgaaaaatcta

SEQ ID NO: 1787217 - DNA, 17 bp, Homo sapiens
tagttgaacaagatttc

SEQ ID NO: 1787218 - DNA, 12 bp, Homo sapiens
tagttgaatttt

SEQ ID NO: 1787219 - DNA, 20 bp, Homo sapiens
tagttgcatagcagtatatg

SEQ ID NO: 1787220 - DNA, 19 bp, Homo sapiens
tagttgccaacagttgtat

SEQ ID NO: 1787221 - DNA, 17 bp, Homo sapiens
tagttgcgttacaccct

SEQ ID NO: 1787222 - DNA, 17 bp, Homo sapiens
tactttcatcttaaact

SEQ ID NO: 1787223 - DNA, 16 bp, Homo sapiens
tactttccagcagtca

SEQ ID NO: 1787224 - DNA, 14 bp, Homo sapiens
tactttccatgttt

SEQ ID NO: 1787225 - DNA, 16 bp, Homo sapiens
tactttccatgttttt

SEQ ID NO: 1787226 - DNA, 20 bp, Homo sapiens
tactttcgtaatagctcaga

SEQ ID NO: 1787227 - DNA, 12 bp, Homo sapiens
tactttctgtta

SEQ ID NO: 1787228 - DNA, 23 bp, Homo sapiens
tactttcttcaccaagtgcaata

SEQ ID NO: 1787229 - DNA, 19 bp, Homo sapiens
tactttgaaaccagaaaat

SEQ ID NO: 1787230 - DNA, 17 bp, Homo sapiens
tactttgacaaggaaaa

SEQ ID NO: 1787231 - DNA, 20 bp, Homo sapiens
tactttgacagtgtttttag

SEQ ID NO: 1787232 - DNA, 14 bp, Homo sapiens
tactttgacttttt

SEQ ID NO: 1787233 - DNA, 23 bp, Homo sapiens
tactttgatattttcaacgcagc

SEQ ID NO: 1787234 - DNA, 16 bp, Homo sapiens
tactttgccatttttc

SEQ ID NO: 1787235 - DNA, 16 bp, Homo sapiens
tactttgcccctttca

SEQ ID NO: 1787236 - DNA, 13 bp, Homo sapiens
tactttgctatgt

SEQ ID NO: 1787237 - DNA, 19 bp, Homo sapiens
tactttggttaatgttgat

SEQ ID NO: 1787238 - DNA, 18 bp, Homo sapiens
tactttggtttctgtctg

SEQ ID NO: 1787239 - DNA, 19 bp, Homo sapiens
tactttggtttctgtctgt

SEQ ID NO: 1787240 - DNA, 16 bp, Homo sapiens
tactttgtctgaaaaa

SEQ ID NO: 1787241 - DNA, 13 bp, Homo sapiens
tactttgttctgt

SEQ ID NO: 1787242 - DNA, 21 bp, Homo sapiens
tacttttaaaaaatactctgc

SEQ ID NO: 1787243 - DNA, 14 bp, Homo sapiens
tacttttaaaaaca

SEQ ID NO: 1787244 - DNA, 16 bp, Homo sapiens
tacttttcattctctt

SEQ ID NO: 1787245 - DNA, 17 bp, Homo sapiens
tacttttgagtgtgtgt

SEQ ID NO: 1787246 - DNA, 19 bp, Homo sapiens
tacttttgcaaactgtcct

SEQ ID NO: 1787247 - DNA, 15 bp, Homo sapiens
tactttttatgtgct

SEQ ID NO: 1787248 - DNA, 23 bp, Homo sapiens
tacttttttaaatattttctatt

SEQ ID NO: 1787249 - DNA, 15 bp, Homo sapiens
tacttttttcttaag

SEQ ID NO: 1787250 - DNA, 12 bp, Homo sapiens
tagaaaaaacaa

SEQ ID NO: 1787251 - DNA, 19 bp, Homo sapiens
tagaaaaagtaaaagatca

SEQ ID NO: 1787252 - DNA, 15 bp, Homo sapiens
tagaaaaataaaaat

SEQ ID NO: 1787253 - DNA, 17 bp, Homo sapiens
tagaaaaataaaatgtt

SEQ ID NO: 1787254 - DNA, 18 bp, Homo sapiens
tagaaaaatctcattccc

SEQ ID NO: 1787255 - DNA, 16 bp, Homo sapiens
tagaaaaatgtataaa

SEQ ID NO: 1787256 - DNA, 16 bp, Homo sapiens
tagaaaacctctcgct

SEQ ID NO: 1787257 - DNA, 14 bp, Homo sapiens
tagaaaagtgaatt

SEQ ID NO: 1787258 - DNA, 17 bp, Homo sapiens
tagaaaagtgaattgaa

SEQ ID NO: 1787259 - DNA, 23 bp, Homo sapiens
tagaaaataggggttaagactga

SEQ ID NO: 1787260 - DNA, 21 bp, Homo sapiens
tagaaaatgacttatttctgc

SEQ ID NO: 1787261 - DNA, 15 bp, Homo sapiens
tagaaaatgagaaaa

SEQ ID NO: 1787262 - DNA, 12 bp, Homo sapiens
tagaaaatggtc

SEQ ID NO: 1787263 - DNA, 12 bp, Homo sapiens
tagaaaatgtgt

SEQ ID NO: 1787264 - DNA, 15 bp, Homo sapiens
tagaaaattcataac

SEQ ID NO: 1787265 - DNA, 15 bp, Homo sapiens
tagaaaattttgtaa

SEQ ID NO: 1787266 - DNA, 20 bp, Homo sapiens
tagaaaattttgtaaaacaa

SEQ ID NO: 1787267 - DNA, 22 bp, Homo sapiens
tagaaaattttgtaaaacaatg

SEQ ID NO: 1787268 - DNA, 10 bp, Homo sapiens
tagaaacaga

SEQ ID NO: 1787269 - DNA, 22 bp, Homo sapiens
tagaaagatcgtttaaaaacaa

SEQ ID NO: 1787270 - DNA, 13 bp, Homo sapiens
tagaaagctggac

SEQ ID NO: 1787271 - DNA, 16 bp, Homo sapiens
tagaaagctggactga

SEQ ID NO: 1787272 - DNA, 23 bp, Homo sapiens
tagaaagctgtttatttattcac

SEQ ID NO: 1787273 - DNA, 13 bp, Homo sapiens
tagaaaggcagcc

SEQ ID NO: 1787274 - DNA, 17 bp, Homo sapiens
tagaaagtgccagaaag

SEQ ID NO: 1787275 - DNA, 21 bp, Homo sapiens
tagaaagttagggggttctta

SEQ ID NO: 1787276 - DNA, 20 bp, Homo sapiens
tagaaataaatgttacctaa

SEQ ID NO: 1787277 - DNA, 16 bp, Homo sapiens
tagaaataaattccta

SEQ ID NO: 1787278 - DNA, 16 bp, Homo sapiens
tagaaataatatgcat

SEQ ID NO: 1787279 - DNA, 16 bp, Homo sapiens
tagaaatatctttctc

SEQ ID NO: 1787280 - DNA, 15 bp, Homo sapiens
tagaaatattcacat

SEQ ID NO: 1787281 - DNA, 13 bp, Homo sapiens
tagaaatgcatat

SEQ ID NO: 1787282 - DNA, 17 bp, Homo sapiens
tagaaatggtttcctct

SEQ ID NO: 1787283 - DNA, 19 bp, Homo sapiens
tagaaatggtttcctctgg

SEQ ID NO: 1787284 - DNA, 17 bp, Homo sapiens
tagaaatgtttgctgaa

SEQ ID NO: 1787285 - DNA, 19 bp, Homo sapiens
tagaaattacacccaaaga

SEQ ID NO: 1787286 - DNA, 23 bp, Homo sapiens
tagaaattagaaaaaaattacta

SEQ ID NO: 1787287 - DNA, 17 bp, Homo sapiens
tagaaattttacaatag

SEQ ID NO: 1787288 - DNA, 13 bp, Homo sapiens
tagaaattttcaa

SEQ ID NO: 1787289 - DNA, 18 bp, Homo sapiens
tagaaattttgtaagaag

SEQ ID NO: 1787290 - DNA, 22 bp, Homo sapiens
tagaaatttttcagatgcttct

SEQ ID NO: 1787291 - DNA, 17 bp, Homo sapiens
tagaacaacatatacaa

SEQ ID NO: 1787292 - DNA, 18 bp, Homo sapiens
tagaacaatgggaggctg

SEQ ID NO: 1787293 - DNA, 16 bp, Homo sapiens
tagaacactaactcac

SEQ ID NO: 1787294 - DNA, 19 bp, Homo sapiens
tagaacactaattcataat

SEQ ID NO: 1787295 - DNA, 19 bp, Homo sapiens
tagaacaggacctctgctt

SEQ ID NO: 1787296 - DNA, 22 bp, Homo sapiens
tagaacagggaaaataggcagg

SEQ ID NO: 1787297 - DNA, 14 bp, Homo sapiens
tagaacatgcacat

SEQ ID NO: 1787298 - DNA, 22 bp, Homo sapiens
tagaaccaagcttcagagccta

SEQ ID NO: 1787299 - DNA, 21 bp, Homo sapiens
tagaaccagccgtattttaca

SEQ ID NO: 1787300 - DNA, 16 bp, Homo sapiens
tagaacccttgcacag

SEQ ID NO: 1787301 - DNA, 22 bp, Homo sapiens
tagaacgtccagggtttacatt

SEQ ID NO: 1787302 - DNA, 16 bp, Homo sapiens
tagaacgtgcatcctt

SEQ ID NO: 1787303 - DNA, 17 bp, Homo sapiens
tagaactcagcagttga

SEQ ID NO: 1787304 - DNA, 22 bp, Homo sapiens
tagaactcagttttaactagaa

SEQ ID NO: 1787305 - DNA, 13 bp, Homo sapiens
tagaactgtactg

SEQ ID NO: 1787306 - DNA, 22 bp, Homo sapiens
tagaactgtcccacaaaatatt

SEQ ID NO: 1787307 - DNA, 23 bp, Homo sapiens
tagaactgtcccacaaaatattt

SEQ ID NO: 1787308 - DNA, 12 bp, Homo sapiens
tagaactgttca

SEQ ID NO: 1787309 - DNA, 16 bp, Homo sapiens
tagaacttgaccccct

SEQ ID NO: 1787310 - DNA, 17 bp, Homo sapiens
tagaagaaaagcccatt

SEQ ID NO: 1787311 - DNA, 18 bp, Homo sapiens
tagaagaacatccaagga

SEQ ID NO: 1787312 - DNA, 19 bp, Homo sapiens
tagaagaaccaaatacctc

SEQ ID NO: 1787313 - DNA, 21 bp, Homo sapiens
tagaagaaccaaatacctcaa

SEQ ID NO: 1787314 - DNA, 19 bp, Homo sapiens
tagaagaagaggaagaaat

SEQ ID NO: 1787315 - DNA, 14 bp, Homo sapiens
tagaagagagaggt

SEQ ID NO: 1787316 - DNA, 22 bp, Homo sapiens
tagaagatgtgtaaacaggtat

SEQ ID NO: 1787317 - DNA, 21 bp, Homo sapiens
tagaagattgttggtgaattt

SEQ ID NO: 1787318 - DNA, 12 bp, Homo sapiens
tagaagccaagg

SEQ ID NO: 1787319 - DNA, 15 bp, Homo sapiens
tagaagccaagggaa

SEQ ID NO: 1787320 - DNA, 16 bp, Homo sapiens
tagaagccaagggaaa

SEQ ID NO: 1787321 - DNA, 19 bp, Homo sapiens
tagaagccaagtaaagtgc

SEQ ID NO: 1787322 - DNA, 17 bp, Homo sapiens
tagaagtaagaagagga

SEQ ID NO: 1787323 - DNA, 21 bp, Homo sapiens
tagaagtaagaagaggagcct

SEQ ID NO: 1787324 - DNA, 24 bp, Homo sapiens
tagaagtaagaagaggagcctcag

SEQ ID NO: 1787325 - DNA, 17 bp, Homo sapiens
tagaagtctccctgcac

SEQ ID NO: 1787326 - DNA, 18 bp, Homo sapiens
tagaagtcttagatgtat

SEQ ID NO: 1787327 - DNA, 17 bp, Homo sapiens
tagaagtgagagaaaaa

SEQ ID NO: 1787328 - DNA, 19 bp, Homo sapiens
tagaagtgagtttgtaaat

SEQ ID NO: 1787329 - DNA, 19 bp, Homo sapiens
tagaagtggaccaggacag

SEQ ID NO: 1787330 - DNA, 16 bp, Homo sapiens
tagaagtgggccagga

SEQ ID NO: 1787331 - DNA, 20 bp, Homo sapiens
taggatacagaaatgcaaaa

SEQ ID NO: 1787332 - DNA, 21 bp, Homo sapiens
taggatagctaactgtaaatc

SEQ ID NO: 1787333 - DNA, 19 bp, Homo sapiens
taggatcagccctcatttt

SEQ ID NO: 1787334 - DNA, 23 bp, Homo sapiens
taggatctgcaaacaatgaagaa

SEQ ID NO: 1787335 - DNA, 17 bp, Homo sapiens
taggatgggggagaggg

SEQ ID NO: 1787336 - DNA, 12 bp, Homo sapiens
taggattcaagt

SEQ ID NO: 1787337 - DNA, 12 bp, Homo sapiens
taggattctaaa

SEQ ID NO: 1787338 - DNA, 12 bp, Homo sapiens
taggatttaaca

SEQ ID NO: 1787339 - DNA, 22 bp, Homo sapiens
taggattttggatgttgagagg

SEQ ID NO: 1787340 - DNA, 14 bp, Homo sapiens
taggatttttagaa

SEQ ID NO: 1787341 - DNA, 16 bp, Homo sapiens
taggcaagtttgttca

SEQ ID NO: 1787342 - DNA, 17 bp, Homo sapiens
taggcaagttttccctg

SEQ ID NO: 1787343 - DNA, 21 bp, Homo sapiens
taggcactgtagttctaagac

SEQ ID NO: 1787344 - DNA, 17 bp, Homo sapiens
taggcagactgggtttc

SEQ ID NO: 1787345 - DNA, 21 bp, Homo sapiens
taggcagagccataatggact

SEQ ID NO: 1787346 - DNA, 13 bp, Homo sapiens
taggcagaggctg

SEQ ID NO: 1787347 - DNA, 20 bp, Homo sapiens
taggcagattgaaaaggaca

SEQ ID NO: 1787348 - DNA, 23 bp, Homo sapiens
taggcagccacggccccgggtcc

SEQ ID NO: 1787349 - DNA, 12 bp, Homo sapiens
taggcagcttct

SEQ ID NO: 1787350 - DNA, 17 bp, Homo sapiens
taggcagcttctaagag

SEQ ID NO: 1787351 - DNA, 16 bp, Homo sapiens
taggcagggggccctg

SEQ ID NO: 1787352 - DNA, 19 bp, Homo sapiens
taggcagggggccctgccc

SEQ ID NO: 1787353 - DNA, 19 bp, Homo sapiens
taggcatcccaggggacca

SEQ ID NO: 1787354 - DNA, 17 bp, Homo sapiens
tagttggggcaccatac

SEQ ID NO: 1787355 - DNA, 20 bp, Homo sapiens
tagttggtttgtatgagatg

SEQ ID NO: 1787356 - DNA, 18 bp, Homo sapiens
tagtttaatagtttgaag

SEQ ID NO: 1787357 - DNA, 13 bp, Homo sapiens
tagtttacagaaa

SEQ ID NO: 1787358 - DNA, 17 bp, Homo sapiens
tagtttacctctttaaa

SEQ ID NO: 1787359 - DNA, 16 bp, Homo sapiens
tagtttactgagaatg

SEQ ID NO: 1787360 - DNA, 14 bp, Homo sapiens
tagtttaggagaaa

SEQ ID NO: 1787361 - DNA, 15 bp, Homo sapiens
tagtttagttctgtt

SEQ ID NO: 1787362 - DNA, 20 bp, Homo sapiens
tagtttatgatgcaaatctg

SEQ ID NO: 1787363 - DNA, 15 bp, Homo sapiens
tagtttattggaagt

SEQ ID NO: 1787364 - DNA, 13 bp, Homo sapiens
tagtttccttttt

SEQ ID NO: 1787365 - DNA, 19 bp, Homo sapiens
tagtttctgaactctgaca

SEQ ID NO: 1787366 - DNA, 12 bp, Homo sapiens
tagtttcttgtg

SEQ ID NO: 1787367 - DNA, 14 bp, Homo sapiens
tagtttctttggga

SEQ ID NO: 1787368 - DNA, 15 bp, Homo sapiens
tagtttgaattcagt

SEQ ID NO: 1787369 - DNA, 17 bp, Homo sapiens
tagtttgaattcagtaa

SEQ ID NO: 1787370 - DNA, 20 bp, Homo sapiens
tagtttgacctcacagtgac

SEQ ID NO: 1787371 - DNA, 21 bp, Homo sapiens
tagtttgacctcacagtgacc

SEQ ID NO: 1787372 - DNA, 12 bp, Homo sapiens
tagtttgcagtt

SEQ ID NO: 1787373 - DNA, 16 bp, Homo sapiens
tagtttgcatacttcc

SEQ ID NO: 1787374 - DNA, 13 bp, Homo sapiens
tagtttgcatttc

SEQ ID NO: 1787375 - DNA, 21 bp, Homo sapiens
tagtttggctataagtgctca

SEQ ID NO: 1787376 - DNA, 12 bp, Homo sapiens
tagtttgtctat

SEQ ID NO: 1787377 - DNA, 15 bp, Homo sapiens
tagtttgtctatttt

SEQ ID NO: 1787378 - DNA, 18 bp, Homo sapiens
tagtttgtctattttaaa

SEQ ID NO: 1787379 - DNA, 23 bp, Homo sapiens
tagtttgtgatgtaaggcactgt

SEQ ID NO: 1787380 - DNA, 20 bp, Homo sapiens
tagttttacttttaaactgt

SEQ ID NO: 1787381 - DNA, 22 bp, Homo sapiens
tagttttacttttaaactgtgt

SEQ ID NO: 1787382 - DNA, 17 bp, Homo sapiens
tagttttagttgcagaa

SEQ ID NO: 1787383 - DNA, 14 bp, Homo sapiens
tagttttagttttc

SEQ ID NO: 1787384 - DNA, 17 bp, Homo sapiens
tagttttatttgtatta

SEQ ID NO: 1787385 - DNA, 17 bp, Homo sapiens
tagttttccctgcactg

SEQ ID NO: 1787386 - DNA, 15 bp, Homo sapiens
tagttttgattttgg

SEQ ID NO: 1787387 - DNA, 15 bp, Homo sapiens
tagttttgtcaaact

SEQ ID NO: 1787388 - DNA, 14 bp, Homo sapiens
tagtttttgaaaat

SEQ ID NO: 1787389 - DNA, 17 bp, Homo sapiens
tagtttttgaaaattat

SEQ ID NO: 1787390 - DNA, 18 bp, Homo sapiens
tagttttttttgtaaact

SEQ ID NO: 1787391 - DNA, 18 bp, Homo sapiens
tagtttttttttttttcc

SEQ ID NO: 1787392 - DNA, 19 bp, Homo sapiens
tagtttttttttttttcct

SEQ ID NO: 1787393 - DNA, 14 bp, Homo sapiens
tataaaaaatcttt

SEQ ID NO: 1787394 - DNA, 12 bp, Homo sapiens
tataaaaacaaa

SEQ ID NO: 1787395 - DNA, 22 bp, Homo sapiens
tataaaaagaaaaaaatggaaa

SEQ ID NO: 1787396 - DNA, 16 bp, Homo sapiens
tataaaactgtacttc

SEQ ID NO: 1787397 - DNA, 17 bp, Homo sapiens
tataaaagcaaaagaga

SEQ ID NO: 1787398 - DNA, 18 bp, Homo sapiens
tataaaaggttgccaaat

SEQ ID NO: 1787399 - DNA, 12 bp, Homo sapiens
tataaaatacag

SEQ ID NO: 1787400 - DNA, 12 bp, Homo sapiens
tataaaatacat

SEQ ID NO: 1787401 - DNA, 15 bp, Homo sapiens
tataaaatacatagt

SEQ ID NO: 1787402 - DNA, 18 bp, Homo sapiens
tataaaatataaacaaag

SEQ ID NO: 1787403 - DNA, 15 bp, Homo sapiens
tataaaatctgaatt

SEQ ID NO: 1787404 - DNA, 23 bp, Homo sapiens
tataaaatctgaattttgcaatg

SEQ ID NO: 1787405 - DNA, 13 bp, Homo sapiens
tataaaatgaaag

SEQ ID NO: 1787406 - DNA, 17 bp, Homo sapiens
tataaaatgaaagattt

SEQ ID NO: 1787407 - DNA, 14 bp, Homo sapiens
tataaaatgggaag

SEQ ID NO: 1787408 - DNA, 17 bp, Homo sapiens
tataaaatgggaagact

SEQ ID NO: 1787409 - DNA, 18 bp, Homo sapiens
tataaaattaaatgcctt

SEQ ID NO: 1787410 - DNA, 23 bp, Homo sapiens
tataaaattaaatgccttgtata

SEQ ID NO: 1787411 - DNA, 16 bp, Homo sapiens
tataaacagaaatgga

SEQ ID NO: 1787412 - DNA, 17 bp, Homo sapiens
tataaacagaaatggaa

SEQ ID NO: 1787413 - DNA, 14 bp, Homo sapiens
tataaacatcacac

SEQ ID NO: 1787414 - DNA, 22 bp, Homo sapiens
tataaacatgcttgcattatat

SEQ ID NO: 1787415 - DNA, 19 bp, Homo sapiens
tataaaccacttgagccta

SEQ ID NO: 1787416 - DNA, 20 bp, Homo sapiens
tataaactaccaaattagtg

SEQ ID NO: 1787417 - DNA, 21 bp, Homo sapiens
tataaactaccaaattagtga

SEQ ID NO: 1787418 - DNA, 12 bp, Homo sapiens
tataaactcatt

SEQ ID NO: 1787419 - DNA, 17 bp, Homo sapiens
tataaacttaagggcaa

SEQ ID NO: 1787420 - DNA, 15 bp, Homo sapiens
tataaactttagagt

SEQ ID NO: 1787421 - DNA, 21 bp, Homo sapiens
tataaactttagagtagcatg

SEQ ID NO: 1787422 - DNA, 22 bp, Homo sapiens
tataaactttagagtagcatga

SEQ ID NO: 1787423 - DNA, 19 bp, Homo sapiens
tataaagaagaacttgcat

SEQ ID NO: 1787424 - DNA, 23 bp, Homo sapiens
tataaagaaggttggtgaatttc

SEQ ID NO: 1787425 - DNA, 18 bp, Homo sapiens
tataaagacaagtatgaa

SEQ ID NO: 1787426 - DNA, 15 bp, Homo sapiens
tataaagataaaata

SEQ ID NO: 1787427 - DNA, 15 bp, Homo sapiens
tataaagattgtact

SEQ ID NO: 1787428 - DNA, 16 bp, Homo sapiens
tataaagattgtactt

SEQ ID NO: 1787429 - DNA, 24 bp, Homo sapiens
tataaagattgtacttagccagtt

SEQ ID NO: 1787430 - DNA, 12 bp, Homo sapiens
tataaagcagta

SEQ ID NO: 1787431 - DNA, 12 bp, Homo sapiens
tataaagctgtt

SEQ ID NO: 1787432 - DNA, 17 bp, Homo sapiens
tataaagctgttattct

SEQ ID NO: 1787433 - DNA, 23 bp, Homo sapiens
tataaagtacccatctagtactt

SEQ ID NO: 1787434 - DNA, 20 bp, Homo sapiens
tataaagtctaagcaagatg

SEQ ID NO: 1787435 - DNA, 19 bp, Homo sapiens
tataaataataaagaactc

SEQ ID NO: 1787436 - DNA, 18 bp, Homo sapiens
tataaataatcacacaca

SEQ ID NO: 1787437 - DNA, 14 bp, Homo sapiens
tataaatacatata

SEQ ID NO: 1787438 - DNA, 21 bp, Homo sapiens
tataaatagtgtacacagact

SEQ ID NO: 1787439 - DNA, 15 bp, Homo sapiens
tataaatatcagtat

SEQ ID NO: 1787440 - DNA, 16 bp, Homo sapiens
tataaatatcagtatt

SEQ ID NO: 1787441 - DNA, 19 bp, Homo sapiens
tataaatatcagtattctg

SEQ ID NO: 1787442 - DNA, 20 bp, Homo sapiens
tataaatcaatgtcacttaa

SEQ ID NO: 1787443 - DNA, 15 bp, Homo sapiens
tataaatgcaatatt

SEQ ID NO: 1787444 - DNA, 17 bp, Homo sapiens
tataacaagccaaacat

SEQ ID NO: 1787445 - DNA, 21 bp, Homo sapiens
tataacaagccaaacattctt

SEQ ID NO: 1787446 - DNA, 20 bp, Homo sapiens
tataacaatataactgagtt

SEQ ID NO: 1787447 - DNA, 14 bp, Homo sapiens
tataacacattttt

SEQ ID NO: 1787448 - DNA, 13 bp, Homo sapiens
tataacatgtaaa

SEQ ID NO: 1787449 - DNA, 17 bp, Homo sapiens
tataaccagctgaagtt

SEQ ID NO: 1787450 - DNA, 14 bp, Homo sapiens
tataacctggcaaa

SEQ ID NO: 1787451 - DNA, 16 bp, Homo sapiens
tataacctggcaaaat

SEQ ID NO: 1787452 - DNA, 20 bp, Homo sapiens
tataacggtttaattctgtc

SEQ ID NO: 1787453 - DNA, 14 bp, Homo sapiens
tataactaacatgt

SEQ ID NO: 1787454 - DNA, 22 bp, Homo sapiens
tataactcaaggataccttctt

SEQ ID NO: 1787455 - DNA, 13 bp, Homo sapiens
tataactgtattt

SEQ ID NO: 1787456 - DNA, 19 bp, Homo sapiens
tataactgtcttgtttcag

SEQ ID NO: 1787457 - DNA, 19 bp, Homo sapiens
tataacttaaaaaaatgac

SEQ ID NO: 1787458 - DNA, 22 bp, Homo sapiens
tataacttaaaaaaatgacaga

SEQ ID NO: 1787459 - DNA, 20 bp, Homo sapiens
tataacttaaaaatgtaaat

SEQ ID NO: 1787460 - DNA, 23 bp, Homo sapiens
tataactttaaatcttttcttca

SEQ ID NO: 1787461 - DNA, 12 bp, Homo sapiens
tataagaaaaac

SEQ ID NO: 1787462 - DNA, 15 bp, Homo sapiens
tataagaaaaacttt

SEQ ID NO: 1787463 - DNA, 14 bp, Homo sapiens
tataagaagcaatc

SEQ ID NO: 1787464 - DNA, 21 bp, Homo sapiens
tataagaagcaatctttgaaa

SEQ ID NO: 1787465 - DNA, 23 bp, Homo sapiens
tataagaagcaatctttgaaata

SEQ ID NO: 1787466 - DNA, 17 bp, Homo sapiens
tataagaagccttaatt

SEQ ID NO: 1787467 - DNA, 12 bp, Homo sapiens
tataagactctc

SEQ ID NO: 1787468 - DNA, 14 bp, Homo sapiens
tataagatcctaga

SEQ ID NO: 1787469 - DNA, 21 bp, Homo sapiens
tataagatcctagatcctaag

SEQ ID NO: 1787470 - DNA, 16 bp, Homo sapiens
tataaggaaagcaata

SEQ ID NO: 1787471 - DNA, 23 bp, Homo sapiens
tataaggagagttcaagcctgtg

SEQ ID NO: 1787472 - DNA, 17 bp, Homo sapiens
tataagggagagctgag

SEQ ID NO: 1787473 - DNA, 18 bp, Homo sapiens
tataagggagtaggctgt

SEQ ID NO: 1787474 - DNA, 22 bp, Homo sapiens
tataagggagtaggctgtattt

SEQ ID NO: 1787475 - DNA, 15 bp, Homo sapiens
tataaggtgcctcag

SEQ ID NO: 1787476 - DNA, 20 bp, Homo sapiens
tataagtagtaaatcagaaa

SEQ ID NO: 1787477 - DNA, 22 bp, Homo sapiens
tataagtagttggtttgtatga

SEQ ID NO: 1787478 - DNA, 18 bp, Homo sapiens
tataagtgaagtgatact

SEQ ID NO: 1787479 - DNA, 19 bp, Homo sapiens
tataagttatttttgtaca

SEQ ID NO: 1787480 - DNA, 22 bp, Homo sapiens
tataataaatactcagtgatga

SEQ ID NO: 1787481 - DNA, 12 bp, Homo sapiens
tataataaatat

SEQ ID NO: 1787482 - DNA, 15 bp, Homo sapiens
tataatacacaaaat

SEQ ID NO: 1787483 - DNA, 23 bp, Homo sapiens
tataatacacaaaatcaaataat

SEQ ID NO: 1787484 - DNA, 22 bp, Homo sapiens
tataataggaacaatctttgct

SEQ ID NO: 1787485 - DNA, 18 bp, Homo sapiens
tataataggtatatagaa

SEQ ID NO: 1787486 - DNA, 22 bp, Homo sapiens
tataatataaaaaattttaaaa

SEQ ID NO: 1787487 - DNA, 17 bp, Homo sapiens
tataatatactatattt

SEQ ID NO: 1787488 - DNA, 14 bp, Homo sapiens
tataatatatatct

SEQ ID NO: 1787489 - DNA, 21 bp, Homo sapiens
tataatatgtgccttaagttt

SEQ ID NO: 1787490 - DNA, 21 bp, Homo sapiens
tataatattcagccagcttaa

SEQ ID NO: 1787491 - DNA, 23 bp, Homo sapiens
tataatattcagccagcttaaac

SEQ ID NO: 1787492 - DNA, 17 bp, Homo sapiens
tataatctcaaaggaga

SEQ ID NO: 1787493 - DNA, 18 bp, Homo sapiens
tataatctcaaaggagaa

SEQ ID NO: 1787494 - DNA, 11 bp, Homo sapiens
tataatgaatg

SEQ ID NO: 1787495 - DNA, 20 bp, Homo sapiens
tataatgaatgaaacatttt

SEQ ID NO: 1787496 - DNA, 14 bp, Homo sapiens
tataatgaggatga

SEQ ID NO: 1787497 - DNA, 23 bp, Homo sapiens
tataatggtttcaaagattcaaa

SEQ ID NO: 1787498 - DNA, 20 bp, Homo sapiens
tataatgtattcatatttgt

SEQ ID NO: 1787499 - DNA, 13 bp, Homo sapiens
tataatgtatttt

SEQ ID NO: 1787500 - DNA, 17 bp, Homo sapiens
tataatgtcattaaaca

SEQ ID NO: 1787501 - DNA, 20 bp, Homo sapiens
tataatgttgataatatata

SEQ ID NO: 1787502 - DNA, 18 bp, Homo sapiens
tataatgttgttatttaa

SEQ ID NO: 1787503 - DNA, 19 bp, Homo sapiens
tataattatcggaagcagt

SEQ ID NO: 1787504 - DNA, 15 bp, Homo sapiens
tataattctcattaa

SEQ ID NO: 1787505 - DNA, 12 bp, Homo sapiens
tataattctgta

SEQ ID NO: 1787506 - DNA, 15 bp, Homo sapiens
tataattctgtaaat

SEQ ID NO: 1787507 - DNA, 19 bp, Homo sapiens
tataattggatttcctaat

SEQ ID NO: 1787508 - DNA, 22 bp, Homo sapiens
tataattgtgtgatatttcaga

SEQ ID NO: 1787509 - DNA, 14 bp, Homo sapiens
tataattgttgcat

SEQ ID NO: 1787510 - DNA, 16 bp, Homo sapiens
tataatttaatgcatg

SEQ ID NO: 1787511 - DNA, 20 bp, Homo sapiens
tataatttacctaagattac

SEQ ID NO: 1787512 - DNA, 14 bp, Homo sapiens
tataatttcaagga

SEQ ID NO: 1787513 - DNA, 20 bp, Homo sapiens
tataatttttttatgttttg

SEQ ID NO: 1787514 - DNA, 13 bp, Homo sapiens
tatacaacaccaa

SEQ ID NO: 1787515 - DNA, 22 bp, Homo sapiens
tatacaaccctggcattatgtc

SEQ ID NO: 1787516 - DNA, 13 bp, Homo sapiens
tatacaaggcaag

SEQ ID NO: 1787517 - DNA, 22 bp, Homo sapiens
tatacacttacactttatgcac

SEQ ID NO: 1787518 - DNA, 19 bp, Homo sapiens
tatacacttggatttcatt

SEQ ID NO: 1787519 - DNA, 16 bp, Homo sapiens
tatacaggtcatatta

SEQ ID NO: 1787520 - DNA, 19 bp, Homo sapiens
tatacagtaactttatgtg

SEQ ID NO: 1787521 - DNA, 18 bp, Homo sapiens
tatacagtgcagagcctt

SEQ ID NO: 1787522 - DNA, 15 bp, Homo sapiens
tatacagtgtacatg

SEQ ID NO: 1787523 - DNA, 22 bp, Homo sapiens
tatacatagcatgacatttctt

SEQ ID NO: 1787524 - DNA, 14 bp, Homo sapiens
tatacatatgagaa

SEQ ID NO: 1787525 - DNA, 18 bp, Homo sapiens
tatacatctgtgtatttg

SEQ ID NO: 1787526 - DNA, 11 bp, Homo sapiens
tatacatgcca

SEQ ID NO: 1787527 - DNA, 22 bp, Homo sapiens
tatacatggaatcgaagtgttt

SEQ ID NO: 1787528 - DNA, 18 bp, Homo sapiens
tatacatgtgatacattt

SEQ ID NO: 1787529 - DNA, 20 bp, Homo sapiens
tatacatgtgatacattttt

SEQ ID NO: 1787530 - DNA, 20 bp, Homo sapiens
tatacatgtgtacatatatg

SEQ ID NO: 1787531 - DNA, 22 bp, Homo sapiens
tatacattgtgtgaaaaaagaa

SEQ ID NO: 1787532 - DNA, 14 bp, Homo sapiens
tatacatttgataa

SEQ ID NO: 1787533 - DNA, 13 bp, Homo sapiens
tatacattttgtt

SEQ ID NO: 1787534 - DNA, 21 bp, Homo sapiens
tatacattttgttatagaata

SEQ ID NO: 1787535 - DNA, 16 bp, Homo sapiens
tataccaaattaaaaa

SEQ ID NO: 1787536 - DNA, 17 bp, Homo sapiens
tataccagcaatatatc

SEQ ID NO: 1787537 - DNA, 19 bp, Homo sapiens
tataccaggatttattttg

SEQ ID NO: 1787538 - DNA, 14 bp, Homo sapiens
tatacctggtttac

SEQ ID NO: 1787539 - DNA, 17 bp, Homo sapiens
tatacctggtttacttc

SEQ ID NO: 1787540 - DNA, 17 bp, Homo sapiens
tatacctgtttaaattg

SEQ ID NO: 1787541 - DNA, 12 bp, Homo sapiens
tataccttattt

SEQ ID NO: 1787542 - DNA, 21 bp, Homo sapiens
tatactactttgttaggattt

SEQ ID NO: 1787543 - DNA, 23 bp, Homo sapiens
tatactcctgtcacctagaacgt

SEQ ID NO: 1787544 - DNA, 14 bp, Homo sapiens
tatactctcccaga

SEQ ID NO: 1787545 - DNA, 12 bp, Homo sapiens
tatactgaagga

SEQ ID NO: 1787546 - DNA, 22 bp, Homo sapiens
tatactgaaggaaaaacacaag

SEQ ID NO: 1787547 - DNA, 19 bp, Homo sapiens
tatactgcacagtggcaca

SEQ ID NO: 1787548 - DNA, 22 bp, Homo sapiens
tatactgcatatcctggtgtct

SEQ ID NO: 1787549 - DNA, 22 bp, Homo sapiens
tatatttgaaatagtatacatt

SEQ ID NO: 1787550 - DNA, 12 bp, Homo sapiens
tatatttgacat

SEQ ID NO: 1787551 - DNA, 16 bp, Homo sapiens
tatatttgattatgta

SEQ ID NO: 1787552 - DNA, 14 bp, Homo sapiens
tatatttgcttttt

SEQ ID NO: 1787553 - DNA, 13 bp, Homo sapiens
tatatttgtacaa

SEQ ID NO: 1787554 - DNA, 14 bp, Homo sapiens
tatatttgtacaaa

SEQ ID NO: 1787555 - DNA, 17 bp, Homo sapiens
tatatttgtcttccgat

SEQ ID NO: 1787556 - DNA, 23 bp, Homo sapiens
tatattttacacgtatctcttgg

SEQ ID NO: 1787557 - DNA, 15 bp, Homo sapiens
tatattttatattac

SEQ ID NO: 1787558 - DNA, 13 bp, Homo sapiens
tatattttatgaa

SEQ ID NO: 1787559 - DNA, 21 bp, Homo sapiens
tatattttatgaacattgtac

SEQ ID NO: 1787560 - DNA, 22 bp, Homo sapiens
tatattttatgaacattgtact

SEQ ID NO: 1787561 - DNA, 11 bp, Homo sapiens
tatattttgac

SEQ ID NO: 1787562 - DNA, 13 bp, Homo sapiens
tatattttgggaa

SEQ ID NO: 1787563 - DNA, 18 bp, Homo sapiens
tatattttgtactttgtg

SEQ ID NO: 1787564 - DNA, 16 bp, Homo sapiens
tatattttgtgtgaaa

SEQ ID NO: 1787565 - DNA, 19 bp, Homo sapiens
tatattttgttgttcctct

SEQ ID NO: 1787566 - DNA, 20 bp, Homo sapiens
tatattttgttgttcctcta

SEQ ID NO: 1787567 - DNA, 15 bp, Homo sapiens
tatatttttaagata

SEQ ID NO: 1787568 - DNA, 20 bp, Homo sapiens
tatatttttaagataataat

SEQ ID NO: 1787569 - DNA, 18 bp, Homo sapiens
tatatttttggttgtcaa

SEQ ID NO: 1787570 - DNA, 20 bp, Homo sapiens
tatatttttgtacatattgt

SEQ ID NO: 1787571 - DNA, 20 bp, Homo sapiens
tatatttttgtgttttcttg

SEQ ID NO: 1787572 - DNA, 24 bp, Homo sapiens
tatatttttgtgttttcttgtaaa

SEQ ID NO: 1787573 - DNA, 19 bp, Homo sapiens
tatattttttaatttgatg

SEQ ID NO: 1787574 - DNA, 22 bp, Homo sapiens
tatattttttaatttgatgaaa

SEQ ID NO: 1787575 - DNA, 15 bp, Homo sapiens
tatattttttgtctg

SEQ ID NO: 1787576 - DNA, 20 bp, Homo sapiens
tatcaaaaagctaatgtgca

SEQ ID NO: 1787577 - DNA, 14 bp, Homo sapiens
tatcaaaatcacta

SEQ ID NO: 1787578 - DNA, 21 bp, Homo sapiens
tatcaaaatcactatctttct

SEQ ID NO: 1787579 - DNA, 13 bp, Homo sapiens
tatcaaaattcta

SEQ ID NO: 1787580 - DNA, 17 bp, Homo sapiens
tatcaaaccctagcctt

SEQ ID NO: 1787581 - DNA, 18 bp, Homo sapiens
tatcaaaccctagccttg

SEQ ID NO: 1787582 - DNA, 23 bp, Homo sapiens
tatcaaaccctagccttgcttgt

SEQ ID NO: 1787583 - DNA, 18 bp, Homo sapiens
tatcaaagggtgaaaatt

SEQ ID NO: 1787584 - DNA, 13 bp, Homo sapiens
tatcaaatctgta

SEQ ID NO: 1787585 - DNA, 17 bp, Homo sapiens
tatcaaattatcttcac

SEQ ID NO: 1787586 - DNA, 19 bp, Homo sapiens
tatcaacctaagcaacaga

SEQ ID NO: 1787587 - DNA, 14 bp, Homo sapiens
tatcaactctgaag

SEQ ID NO: 1787588 - DNA, 13 bp, Homo sapiens
tatcaactttaat

SEQ ID NO: 1787589 - DNA, 14 bp, Homo sapiens
tatcaagcaacatt

SEQ ID NO: 1787590 - DNA, 16 bp, Homo sapiens
tatcaagcaacattct

SEQ ID NO: 1787591 - DNA, 18 bp, Homo sapiens
tatcaagcaacattcttg

SEQ ID NO: 1787592 - DNA, 23 bp, Homo sapiens
tatcaagccagtacgtgctaaca

SEQ ID NO: 1787593 - DNA, 22 bp, Homo sapiens
tatcaaggaagaaatggttcag

SEQ ID NO: 1787594 - DNA, 16 bp, Homo sapiens
tatcaatttttcccag

SEQ ID NO: 1787595 - DNA, 13 bp, Homo sapiens
tatcacacttctg

SEQ ID NO: 1787596 - DNA, 13 bp, Homo sapiens
tatcacactttgt

SEQ ID NO: 1787597 - DNA, 16 bp, Homo sapiens
tatcacaggccagatg

SEQ ID NO: 1787598 - DNA, 22 bp, Homo sapiens
tatcacattaatctcaaagaga

SEQ ID NO: 1787599 - DNA, 15 bp, Homo sapiens
tatcaccacagtaag

SEQ ID NO: 1787600 - DNA, 17 bp, Homo sapiens
tatcacccttccctgct

SEQ ID NO: 1787601 - DNA, 18 bp, Homo sapiens
tatcacctagcagcctca

SEQ ID NO: 1787602 - DNA, 15 bp, Homo sapiens
tatcacctcattctg

SEQ ID NO: 1787603 - DNA, 16 bp, Homo sapiens
tatcacctcattctga

SEQ ID NO: 1787604 - DNA, 17 bp, Homo sapiens
tatcacctctcttcagc

SEQ ID NO: 1787605 - DNA, 12 bp, Homo sapiens
tatcacctgtca

SEQ ID NO: 1787606 - DNA, 13 bp, Homo sapiens
tatcacctgtcat

SEQ ID NO: 1787607 - DNA, 15 bp, Homo sapiens
tatcacctgtcatca

SEQ ID NO: 1787608 - DNA, 16 bp, Homo sapiens
tatcagacaagcacta

SEQ ID NO: 1787609 - DNA, 13 bp, Homo sapiens
tatcagaggtcta

SEQ ID NO: 1787610 - DNA, 14 bp, Homo sapiens
tatcagcaaagaaa

SEQ ID NO: 1787611 - DNA, 15 bp, Homo sapiens
tatcagcatgaagaa

SEQ ID NO: 1787612 - DNA, 19 bp, Homo sapiens
tatcagcctgagtctcctg

SEQ ID NO: 1787613 - DNA, 16 bp, Homo sapiens
tatcagccttgctttg

SEQ ID NO: 1787614 - DNA, 19 bp, Homo sapiens
tatcagctttgataattgt

SEQ ID NO: 1787615 - DNA, 21 bp, Homo sapiens
tatcagctttgataattgtgt

SEQ ID NO: 1787616 - DNA, 14 bp, Homo sapiens
tatcaggggtgcat

SEQ ID NO: 1787617 - DNA, 20 bp, Homo sapiens
tatcagtattctgacatgta

SEQ ID NO: 1787618 - DNA, 17 bp, Homo sapiens
tatccatttatcttttg

SEQ ID NO: 1787619 - DNA, 20 bp, Homo sapiens
tatccattttttttactgtt

SEQ ID NO: 1787620 - DNA, 22 bp, Homo sapiens
tatcccaaagttgttgtaacct

SEQ ID NO: 1787621 - DNA, 13 bp, Homo sapiens
tatccccaagctg

SEQ ID NO: 1787622 - DNA, 13 bp, Homo sapiens
tatccccaggcca

SEQ ID NO: 1787623 - DNA, 17 bp, Homo sapiens
tatccccatctccctgc

SEQ ID NO: 1787624 - DNA, 20 bp, Homo sapiens
tatccccatctccctgcctg

SEQ ID NO: 1787625 - DNA, 15 bp, Homo sapiens
tatccccccatcttg

SEQ ID NO: 1787626 - DNA, 12 bp, Homo sapiens
tatcccctgcct

SEQ ID NO: 1787627 - DNA, 13 bp, Homo sapiens
tatcccctgcctc

SEQ ID NO: 1787628 - DNA, 20 bp, Homo sapiens
tatcccctgcctcctgccac

SEQ ID NO: 1787629 - DNA, 16 bp, Homo sapiens
tatccctctcttcccc

SEQ ID NO: 1787630 - DNA, 22 bp, Homo sapiens
tatccctctcttccccttccct

SEQ ID NO: 1787631 - DNA, 15 bp, Homo sapiens
tatccctcttgtaag

SEQ ID NO: 1787632 - DNA, 19 bp, Homo sapiens
tatccctgcggcctccaca

SEQ ID NO: 1787633 - DNA, 14 bp, Homo sapiens
tatcccttcctttt

SEQ ID NO: 1787634 - DNA, 14 bp, Homo sapiens
tatccgctgccagc

SEQ ID NO: 1787635 - DNA, 14 bp, Homo sapiens
tatcctaaacttta

SEQ ID NO: 1787636 - DNA, 18 bp, Homo sapiens
tatcctaggggtgcgctc

SEQ ID NO: 1787637 - DNA, 21 bp, Homo sapiens
tatcctagtcttcacaacttt

SEQ ID NO: 1787638 - DNA, 15 bp, Homo sapiens
tatcctccaccgtct

SEQ ID NO: 1787639 - DNA, 18 bp, Homo sapiens
tatcctcctgttctgaaa

SEQ ID NO: 1787640 - DNA, 17 bp, Homo sapiens
tatcctgaaatttcaga

SEQ ID NO: 1787641 - DNA, 14 bp, Homo sapiens
tatcctgataaaca

SEQ ID NO: 1787642 - DNA, 10 bp, Homo sapiens
tatcctgccc

SEQ ID NO: 1787643 - DNA, 15 bp, Homo sapiens
tatcctgcccagtgt

SEQ ID NO: 1787644 - DNA, 16 bp, Homo sapiens
tatcctgcccagtgtt

SEQ ID NO: 1787645 - DNA, 18 bp, Homo sapiens
tatcctgctagctgtaga

SEQ ID NO: 1787646 - DNA, 20 bp, Homo sapiens
tatcctgctagctgtagaaa

SEQ ID NO: 1787647 - DNA, 22 bp, Homo sapiens
tatcctgcttctgatatgcagt

SEQ ID NO: 1787648 - DNA, 10 bp, Homo sapiens
tatcctgggg

SEQ ID NO: 1787649 - DNA, 22 bp, Homo sapiens
tatcctggggctcccttcatct

SEQ ID NO: 1787650 - DNA, 16 bp, Homo sapiens
tatcctgtgactgtct

SEQ ID NO: 1787651 - DNA, 13 bp, Homo sapiens
tatccttccttca

SEQ ID NO: 1787652 - DNA, 23 bp, Homo sapiens
tatcgacttgtttttgcacatgt

SEQ ID NO: 1787653 - DNA, 20 bp, Homo sapiens
tatcgcaccactgtgtattt

SEQ ID NO: 1787654 - DNA, 20 bp, Homo sapiens
tatcgccctcctttccctta

SEQ ID NO: 1787655 - DNA, 19 bp, Homo sapiens
tatcggattactgaattgt

SEQ ID NO: 1787656 - DNA, 16 bp, Homo sapiens
tatcgggaacagtgtt

SEQ ID NO: 1787657 - DNA, 15 bp, Homo sapiens
tatcgggagcagtgt

SEQ ID NO: 1787658 - DNA, 22 bp, Homo sapiens
tatctaaagtcatcatgaactg

SEQ ID NO: 1787659 - DNA, 15 bp, Homo sapiens
tatctaatacctctg

SEQ ID NO: 1787660 - DNA, 13 bp, Homo sapiens
tatctaatttata

SEQ ID NO: 1787661 - DNA, 16 bp, Homo sapiens
tatctacaatatatat

SEQ ID NO: 1787662 - DNA, 20 bp, Homo sapiens
tatctacaatatatattata

SEQ ID NO: 1787663 - DNA, 16 bp, Homo sapiens
tatctacatctttttt

SEQ ID NO: 1787664 - DNA, 17 bp, Homo sapiens
tatctaccattgaagga

SEQ ID NO: 1787665 - DNA, 15 bp, Homo sapiens
tatctagaaagaaaa

SEQ ID NO: 1787666 - DNA, 16 bp, Homo sapiens
tatctagcaagaagat

SEQ ID NO: 1787667 - DNA, 21 bp, Homo sapiens
tatctagcaagaagattctaa

SEQ ID NO: 1787668 - DNA, 22 bp, Homo sapiens
tatctagcaagaagattctaaa

SEQ ID NO: 1787669 - DNA, 23 bp, Homo sapiens
tatctagtaatatatttaaaggg

SEQ ID NO: 1787670 - DNA, 16 bp, Homo sapiens
tatctagtatgaaatt

SEQ ID NO: 1787671 - DNA, 19 bp, Homo sapiens
tatctagtgtgtcctgtga

SEQ ID NO: 1787672 - DNA, 22 bp, Homo sapiens
tatctataaaatagatataaat

SEQ ID NO: 1787673 - DNA, 13 bp, Homo sapiens
tatctataattta

SEQ ID NO: 1787674 - DNA, 14 bp, Homo sapiens
tatctataatttac

SEQ ID NO: 1787675 - DNA, 16 bp, Homo sapiens
tatctataatttacct

SEQ ID NO: 1787676 - DNA, 13 bp, Homo sapiens
tatctatatatgt

SEQ ID NO: 1787677 - DNA, 17 bp, Homo sapiens
tatctatatatgtgtat

SEQ ID NO: 1787678 - DNA, 22 bp, Homo sapiens
tatctatatatgtgtatgtacg

SEQ ID NO: 1787679 - DNA, 22 bp, Homo sapiens
tatctatatcatatttctgtgg

SEQ ID NO: 1787680 - DNA, 14 bp, Homo sapiens
tatctatatttttg

SEQ ID NO: 1787681 - DNA, 23 bp, Homo sapiens
tatctatcttccaaatgcaattt

SEQ ID NO: 1787682 - DNA, 17 bp, Homo sapiens
tatctatgtggaaaaca

SEQ ID NO: 1787683 - DNA, 12 bp, Homo sapiens
tatctattaata

SEQ ID NO: 1787684 - DNA, 17 bp, Homo sapiens
tatctatttgtacaatt

SEQ ID NO: 1787685 - DNA, 16 bp, Homo sapiens
tatctcaatgaaccat

SEQ ID NO: 1787686 - DNA, 18 bp, Homo sapiens
tatctcagatatttgcac

SEQ ID NO: 1787687 - DNA, 20 bp, Homo sapiens
tatctccctggctcactggc

SEQ ID NO: 1787688 - DNA, 11 bp, Homo sapiens
tatctcctgac

SEQ ID NO: 1787689 - DNA, 14 bp, Homo sapiens
tatctcctgacaga

SEQ ID NO: 1787690 - DNA, 21 bp, Homo sapiens
tatctcctgacagaaggtgcc

SEQ ID NO: 1787691 - DNA, 16 bp, Homo sapiens
tatctccttcccctac

SEQ ID NO: 1787692 - DNA, 16 bp, Homo sapiens
tatctcgtaatagctt

SEQ ID NO: 1787693 - DNA, 23 bp, Homo sapiens
tatctcgtaatagcttctgtgtg

SEQ ID NO: 1787694 - DNA, 16 bp, Homo sapiens
tatctctgtgtgcaca

SEQ ID NO: 1787695 - DNA, 17 bp, Homo sapiens
tatctctgtgtgcacaa

SEQ ID NO: 1787696 - DNA, 12 bp, Homo sapiens
tatctcttcagt

SEQ ID NO: 1787697 - DNA, 16 bp, Homo sapiens
tatctcttttatattt

SEQ ID NO: 1787698 - DNA, 22 bp, Homo sapiens
tatctcttttgaatccatgctt

SEQ ID NO: 1787699 - DNA, 23 bp, Homo sapiens
tatctcttttgaatccatgcttg

SEQ ID NO: 1787700 - DNA, 14 bp, Homo sapiens
tatctgaaaatgta

SEQ ID NO: 1787701 - DNA, 19 bp, Homo sapiens
tatctgaagagtatccttc

SEQ ID NO: 1787702 - DNA, 12 bp, Homo sapiens
tatctgcatgtg

SEQ ID NO: 1787703 - DNA, 13 bp, Homo sapiens
tatctgcctcccc

SEQ ID NO: 1787704 - DNA, 13 bp, Homo sapiens
tatctgcctggcc

SEQ ID NO: 1787705 - DNA, 16 bp, Homo sapiens
tatctgcctggcctgg

SEQ ID NO: 1787706 - DNA, 19 bp, Homo sapiens
tatctgcctggcctggctc

SEQ ID NO: 1787707 - DNA, 18 bp, Homo sapiens
tatctggacaagccaact

SEQ ID NO: 1787708 - DNA, 14 bp, Homo sapiens
tatctggagcctga

SEQ ID NO: 1787709 - DNA, 12 bp, Homo sapiens
tatctggcactg

SEQ ID NO: 1787710 - DNA, 16 bp, Homo sapiens
tatctggcgttctttg

SEQ ID NO: 1787711 - DNA, 18 bp, Homo sapiens
tatctgggctgtgggcaa

SEQ ID NO: 1787712 - DNA, 19 bp, Homo sapiens
tatctgtgaaatgctggca

SEQ ID NO: 1787713 - DNA, 21 bp, Homo sapiens
tatctgtggagttcctgctcc

SEQ ID NO: 1787714 - DNA, 22 bp, Homo sapiens
tatctgtggagttcctgctccg

SEQ ID NO: 1787715 - DNA, 17 bp, Homo sapiens
tatctgtgtttttgaaa

SEQ ID NO: 1787716 - DNA, 20 bp, Homo sapiens
tatctgtgtttttgaaatat

SEQ ID NO: 1787717 - DNA, 16 bp, Homo sapiens
tatctgttttctacct

SEQ ID NO: 1787718 - DNA, 15 bp, Homo sapiens
tatcttaaagaaaca

SEQ ID NO: 1787719 - DNA, 17 bp, Homo sapiens
tatcttaagcatgtcaa

SEQ ID NO: 1787720 - DNA, 15 bp, Homo sapiens
tatcttaatccatta

SEQ ID NO: 1787721 - DNA, 16 bp, Homo sapiens
tatcttcaaactttca

SEQ ID NO: 1787722 - DNA, 17 bp, Homo sapiens
tatcttcaaactttcac

SEQ ID NO: 1787723 - DNA, 22 bp, Homo sapiens
tatcttcaccctcatcctttac

SEQ ID NO: 1787724 - DNA, 18 bp, Homo sapiens
tatcttcagctctttttg

SEQ ID NO: 1787725 - DNA, 13 bp, Homo sapiens
tatcttccaaatg

SEQ ID NO: 1787726 - DNA, 12 bp, Homo sapiens
tatcttctggat

SEQ ID NO: 1787727 - DNA, 14 bp, Homo sapiens
tatcttctggatta

SEQ ID NO: 1787728 - DNA, 21 bp, Homo sapiens
tatcttctggattagaatgcc

SEQ ID NO: 1787729 - DNA, 17 bp, Homo sapiens
tatcttgaaggaaaaat

SEQ ID NO: 1787730 - DNA, 17 bp, Homo sapiens
tatcttggacaaatcac

SEQ ID NO: 1787731 - DNA, 20 bp, Homo sapiens
tatcttggactgacatttag

SEQ ID NO: 1787732 - DNA, 21 bp, Homo sapiens
tatcttgggtgtattctctgt

SEQ ID NO: 1787733 - DNA, 23 bp, Homo sapiens
tatcttgggtgtattctctgtaa

SEQ ID NO: 1787734 - DNA, 15 bp, Homo sapiens
tatcttgtctctggg

SEQ ID NO: 1787735 - DNA, 18 bp, Homo sapiens
tatgatggagcaactgaa

SEQ ID NO: 1787736 - DNA, 19 bp, Homo sapiens
tatgatggagcaactgaaa

SEQ ID NO: 1787737 - DNA, 20 bp, Homo sapiens
tatgatggcaggagaatcag

SEQ ID NO: 1787738 - DNA, 16 bp, Homo sapiens
tatgatggttttaaac

SEQ ID NO: 1787739 - DNA, 13 bp, Homo sapiens
tatgatgtatatt

SEQ ID NO: 1787740 - DNA, 17 bp, Homo sapiens
tatgatgttagaagaag

SEQ ID NO: 1787741 - DNA, 15 bp, Homo sapiens
tatgattactggcct

SEQ ID NO: 1787742 - DNA, 12 bp, Homo sapiens
tatgattattaa

SEQ ID NO: 1787743 - DNA, 20 bp, Homo sapiens
tatgattctcttgagataag

SEQ ID NO: 1787744 - DNA, 15 bp, Homo sapiens
tatgattgctccaga

SEQ ID NO: 1787745 - DNA, 14 bp, Homo sapiens
tatgatttctgaat

SEQ ID NO: 1787746 - DNA, 19 bp, Homo sapiens
tatgatttgttttgaattt

SEQ ID NO: 1787747 - DNA, 20 bp, Homo sapiens
tatgatttgttttgaatttt

SEQ ID NO: 1787748 - DNA, 19 bp, Homo sapiens
tatgatttttttttcatac

SEQ ID NO: 1787749 - DNA, 17 bp, Homo sapiens
tatgatttttttttcca

SEQ ID NO: 1787750 - DNA, 21 bp, Homo sapiens
tatgcaaaatagacatcttta

SEQ ID NO: 1787751 - DNA, 14 bp, Homo sapiens
tatgcaaagcactg

SEQ ID NO: 1787752 - DNA, 15 bp, Homo sapiens
tatgcaaagcactga

SEQ ID NO: 1787753 - DNA, 16 bp, Homo sapiens
tatgcaatttcctttt

SEQ ID NO: 1787754 - DNA, 14 bp, Homo sapiens
tatgcacagtaaaa

SEQ ID NO: 1787755 - DNA, 13 bp, Homo sapiens
tatgcacatatgg

SEQ ID NO: 1787756 - DNA, 19 bp, Homo sapiens
tatgcacatatggactctg

SEQ ID NO: 1787757 - DNA, 14 bp, Homo sapiens
tatgcaccttgtgt

SEQ ID NO: 1787758 - DNA, 22 bp, Homo sapiens
tatgcactgtggtttcagatgt

SEQ ID NO: 1787759 - DNA, 12 bp, Homo sapiens
tatgcactttta

SEQ ID NO: 1787760 - DNA, 19 bp, Homo sapiens
tatgcacttttagaaatgc

SEQ ID NO: 1787761 - DNA, 18 bp, Homo sapiens
tatgcagaaatagacaaa

SEQ ID NO: 1787762 - DNA, 17 bp, Homo sapiens
tatgcagaagcatattt

SEQ ID NO: 1787763 - DNA, 18 bp, Homo sapiens
tatgcagtactaaaatta

SEQ ID NO: 1787764 - DNA, 18 bp, Homo sapiens
tatgcagttgataagagg

SEQ ID NO: 1787765 - DNA, 17 bp, Homo sapiens
tatgcagtttttcagag

SEQ ID NO: 1787766 - DNA, 15 bp, Homo sapiens
tatgcataaagtcag

SEQ ID NO: 1787767 - DNA, 16 bp, Homo sapiens
tatgcatattcaatgt

SEQ ID NO: 1787768 - DNA, 13 bp, Homo sapiens
tatgcatttcatt

SEQ ID NO: 1787769 - DNA, 17 bp, Homo sapiens
tatgcatttcattcaaa

SEQ ID NO: 1787770 - DNA, 18 bp, Homo sapiens
tatgccacacctggcctt

SEQ ID NO: 1787771 - DNA, 17 bp, Homo sapiens
tatgccagctcagtccc

SEQ ID NO: 1787772 - DNA, 22 bp, Homo sapiens
tatgccatagcaagattgctta

SEQ ID NO: 1787773 - DNA, 19 bp, Homo sapiens
tatgccccaccaaggctga

SEQ ID NO: 1787774 - DNA, 21 bp, Homo sapiens
tatgccggatgtgcttttctc

SEQ ID NO: 1787775 - DNA, 22 bp, Homo sapiens
tatgccgtataggatgtcagac

SEQ ID NO: 1787776 - DNA, 22 bp, Homo sapiens
tatgcctctgacagtccacagg

SEQ ID NO: 1787777 - DNA, 12 bp, Homo sapiens
tatgcctggcta

SEQ ID NO: 1787778 - DNA, 12 bp, Homo sapiens
tatgcctgtatt

SEQ ID NO: 1787779 - DNA, 22 bp, Homo sapiens
tatgccttaagcagaacaaatg

SEQ ID NO: 1787780 - DNA, 18 bp, Homo sapiens
tatgcgaacagttattgt

SEQ ID NO: 1787781 - DNA, 13 bp, Homo sapiens
tatgcggttaatt

SEQ ID NO: 1787782 - DNA, 20 bp, Homo sapiens
tatgctaaacctcctgcctc

SEQ ID NO: 1787783 - DNA, 13 bp, Homo sapiens
tatgctatttctg

SEQ ID NO: 1787784 - DNA, 14 bp, Homo sapiens
tatgctatttctgt

SEQ ID NO: 1787785 - DNA, 11 bp, Homo sapiens
tatgctcaggt

SEQ ID NO: 1787786 - DNA, 19 bp, Homo sapiens
tatgctctcgcacctttcc

SEQ ID NO: 1787787 - DNA, 17 bp, Homo sapiens
tatgctcttgaaatatt

SEQ ID NO: 1787788 - DNA, 22 bp, Homo sapiens
tatgctgagtatgttaagctct

SEQ ID NO: 1787789 - DNA, 15 bp, Homo sapiens
tatgctgatctttta

SEQ ID NO: 1787790 - DNA, 20 bp, Homo sapiens
tatgctgatcttttaaaatc

SEQ ID NO: 1787791 - DNA, 16 bp, Homo sapiens
tattcagccagcttaa

SEQ ID NO: 1787792 - DNA, 12 bp, Homo sapiens
tattcaggactt

SEQ ID NO: 1787793 - DNA, 15 bp, Homo sapiens
tattcagggtaaata

SEQ ID NO: 1787794 - DNA, 16 bp, Homo sapiens
tattcaggtggccaga

SEQ ID NO: 1787795 - DNA, 14 bp, Homo sapiens
tattcataatgaat

SEQ ID NO: 1787796 - DNA, 23 bp, Homo sapiens
tattcatatacaaacatgtatgt

SEQ ID NO: 1787797 - DNA, 15 bp, Homo sapiens
tattcatatttgtac

SEQ ID NO: 1787798 - DNA, 16 bp, Homo sapiens
tattcatatttgtact

SEQ ID NO: 1787799 - DNA, 18 bp, Homo sapiens
tattcatgccatctgttt

SEQ ID NO: 1787800 - DNA, 16 bp, Homo sapiens
tattcatgtgaagtgt

SEQ ID NO: 1787801 - DNA, 19 bp, Homo sapiens
tattcattctgcattgcta

SEQ ID NO: 1787802 - DNA, 16 bp, Homo sapiens
tattcattggcagctc

SEQ ID NO: 1787803 - DNA, 22 bp, Homo sapiens
tattcattggcagctcaaagac

SEQ ID NO: 1787804 - DNA, 13 bp, Homo sapiens
tattcatttaaaa

SEQ ID NO: 1787805 - DNA, 15 bp, Homo sapiens
tattcatttaaaatg

SEQ ID NO: 1787806 - DNA, 17 bp, Homo sapiens
tattcatttaaaatgat

SEQ ID NO: 1787807 - DNA, 16 bp, Homo sapiens
tattcatttttgttat

SEQ ID NO: 1787808 - DNA, 22 bp, Homo sapiens
tattccaacccagccacgactg

SEQ ID NO: 1787809 - DNA, 14 bp, Homo sapiens
tattccaagtgcat

SEQ ID NO: 1787810 - DNA, 19 bp, Homo sapiens
tattccaccattcacattt

SEQ ID NO: 1787811 - DNA, 15 bp, Homo sapiens
tattccatatttatt

SEQ ID NO: 1787812 - DNA, 18 bp, Homo sapiens
tattccatccatatactt

SEQ ID NO: 1787813 - DNA, 17 bp, Homo sapiens
tattccatgaatgtatc

SEQ ID NO: 1787814 - DNA, 22 bp, Homo sapiens
tattcccaagcccatgagtcct

SEQ ID NO: 1787815 - DNA, 13 bp, Homo sapiens
tattcccaagccg

SEQ ID NO: 1787816 - DNA, 16 bp, Homo sapiens
tattcccaagtatgcc

SEQ ID NO: 1787817 - DNA, 17 bp, Homo sapiens
tattccccattcttcct

SEQ ID NO: 1787818 - DNA, 14 bp, Homo sapiens
tattcccttgtatt

SEQ ID NO: 1787819 - DNA, 15 bp, Homo sapiens
tattcccttgtattt

SEQ ID NO: 1787820 - DNA, 17 bp, Homo sapiens
tattccgagcattccag

SEQ ID NO: 1787821 - DNA, 21 bp, Homo sapiens
tattcctaatggctatttttg

SEQ ID NO: 1787822 - DNA, 20 bp, Homo sapiens
tattcctatatagtttattg

SEQ ID NO: 1787823 - DNA, 19 bp, Homo sapiens
tattcctgccctgctgttt

SEQ ID NO: 1787824 - DNA, 22 bp, Homo sapiens
tattcctttatacacagtggat

SEQ ID NO: 1787825 - DNA, 15 bp, Homo sapiens
tattccttttctgta

SEQ ID NO: 1787826 - DNA, 15 bp, Homo sapiens
tattctaaaaccatt

SEQ ID NO: 1787827 - DNA, 15 bp, Homo sapiens
tattctaaattttat

SEQ ID NO: 1787828 - DNA, 20 bp, Homo sapiens
tattctaaattttatatctt

SEQ ID NO: 1787829 - DNA, 11 bp, Homo sapiens
tattctaagac

SEQ ID NO: 1787830 - DNA, 12 bp, Homo sapiens
tattctaagact

SEQ ID NO: 1787831 - DNA, 13 bp, Homo sapiens
tattctaagactt

SEQ ID NO: 1787832 - DNA, 21 bp, Homo sapiens
tattctaagacttactctaag

SEQ ID NO: 1787833 - DNA, 23 bp, Homo sapiens
tattctaagacttactctaagat

SEQ ID NO: 1787834 - DNA, 16 bp, Homo sapiens
tattctagcctgcatt

SEQ ID NO: 1787835 - DNA, 21 bp, Homo sapiens
tattctagcctgcattgagct

SEQ ID NO: 1787836 - DNA, 21 bp, Homo sapiens
tattctagtcaactgctgttt

SEQ ID NO: 1787837 - DNA, 22 bp, Homo sapiens
tattctatccatctcctggtgt

SEQ ID NO: 1787838 - DNA, 16 bp, Homo sapiens
tattctatgagaacaa

SEQ ID NO: 1787839 - DNA, 12 bp, Homo sapiens
tattctattgca

SEQ ID NO: 1787840 - DNA, 17 bp, Homo sapiens
tattctcaaacacagtt

SEQ ID NO: 1787841 - DNA, 13 bp, Homo sapiens
tattctcactcca

SEQ ID NO: 1787842 - DNA, 22 bp, Homo sapiens
tattctcactccaccacccaaa

SEQ ID NO: 1787843 - DNA, 15 bp, Homo sapiens
tattctcatgcctca

SEQ ID NO: 1787844 - DNA, 17 bp, Homo sapiens
tattctcatgcctcagc

SEQ ID NO: 1787845 - DNA, 18 bp, Homo sapiens
tattctctccaaaaatgc

SEQ ID NO: 1787846 - DNA, 21 bp, Homo sapiens
tattctcttaatttttcttaa

SEQ ID NO: 1787847 - DNA, 14 bp, Homo sapiens
tattctgacatgta

SEQ ID NO: 1787848 - DNA, 21 bp, Homo sapiens
tattctgaccgttaaaaaatt

SEQ ID NO: 1787849 - DNA, 17 bp, Homo sapiens
tattctgagaaaacaag

SEQ ID NO: 1787850 - DNA, 11 bp, Homo sapiens
tattctgagcc

SEQ ID NO: 1787851 - DNA, 13 bp, Homo sapiens
tattctgagcctt

SEQ ID NO: 1787852 - DNA, 19 bp, Homo sapiens
tattctgtagattctgtgg

SEQ ID NO: 1787853 - DNA, 19 bp, Homo sapiens
tattctgtggattctatat

SEQ ID NO: 1787854 - DNA, 14 bp, Homo sapiens
tattctgtgttgaa

SEQ ID NO: 1787855 - DNA, 15 bp, Homo sapiens
tattcttatttcatt

SEQ ID NO: 1787856 - DNA, 13 bp, Homo sapiens
tattcttctagag

SEQ ID NO: 1787857 - DNA, 17 bp, Homo sapiens
tattcttctagagttca

SEQ ID NO: 1787858 - DNA, 16 bp, Homo sapiens
tattcttgctgggcat

SEQ ID NO: 1787859 - DNA, 19 bp, Homo sapiens
tattggtgcgtttttacag

SEQ ID NO: 1787860 - DNA, 13 bp, Homo sapiens
tattggttcttcc

SEQ ID NO: 1787861 - DNA, 14 bp, Homo sapiens
tattgtaaatactg

SEQ ID NO: 1787862 - DNA, 18 bp, Homo sapiens
tattgtaaatactggact

SEQ ID NO: 1787863 - DNA, 14 bp, Homo sapiens
tattgtacaaatgt

SEQ ID NO: 1787864 - DNA, 18 bp, Homo sapiens
tattgtacagactgtttt

SEQ ID NO: 1787865 - DNA, 15 bp, Homo sapiens
tattgtacataaaag

SEQ ID NO: 1787866 - DNA, 16 bp, Homo sapiens
tattgtacataaaaga

SEQ ID NO: 1787867 - DNA, 15 bp, Homo sapiens
tattgtagcatttct

SEQ ID NO: 1787868 - DNA, 17 bp, Homo sapiens
tattgtagcatttcttg

SEQ ID NO: 1787869 - DNA, 15 bp, Homo sapiens
tattgtataaaaagt

SEQ ID NO: 1787870 - DNA, 12 bp, Homo sapiens
tattgtatgtaa

SEQ ID NO: 1787871 - DNA, 18 bp, Homo sapiens
tattgtattactagaaga

SEQ ID NO: 1787872 - DNA, 18 bp, Homo sapiens
tattgtccttcagagctc

SEQ ID NO: 1787873 - DNA, 20 bp, Homo sapiens
tattgtctgtctacatttct

SEQ ID NO: 1787874 - DNA, 15 bp, Homo sapiens
tattgtgaagtacat

SEQ ID NO: 1787875 - DNA, 19 bp, Homo sapiens
tattgtgaagtacatatta

SEQ ID NO: 1787876 - DNA, 15 bp, Homo sapiens
tattgtgactcttct

SEQ ID NO: 1787877 - DNA, 16 bp, Homo sapiens
tattgtgattctgttt

SEQ ID NO: 1787878 - DNA, 22 bp, Homo sapiens
tattgtgcacaagtctttccag

SEQ ID NO: 1787879 - DNA, 19 bp, Homo sapiens
tattgtgtaatttaagtga

SEQ ID NO: 1787880 - DNA, 20 bp, Homo sapiens
tattgtgtgcgctgcctggc

SEQ ID NO: 1787881 - DNA, 19 bp, Homo sapiens
tattgtgtgttatttaaat

SEQ ID NO: 1787882 - DNA, 14 bp, Homo sapiens
tattgttaaatcct

SEQ ID NO: 1787883 - DNA, 21 bp, Homo sapiens
tattgttaactcttgtctatt

SEQ ID NO: 1787884 - DNA, 22 bp, Homo sapiens
tattgttacgtagcctaaggct

SEQ ID NO: 1787885 - DNA, 13 bp, Homo sapiens
tattgttggtaat

SEQ ID NO: 1787886 - DNA, 16 bp, Homo sapiens
tattgtttaaaatcat

SEQ ID NO: 1787887 - DNA, 20 bp, Homo sapiens
tattgtttaaaatcatttct

SEQ ID NO: 1787888 - DNA, 17 bp, Homo sapiens
tattgtttaaaatgtaa

SEQ ID NO: 1787889 - DNA, 12 bp, Homo sapiens
tattgttttcag

SEQ ID NO: 1787890 - DNA, 22 bp, Homo sapiens
tattgttttcagtgtacatgga

SEQ ID NO: 1787891 - DNA, 20 bp, Homo sapiens
tattgttttctgtaaataac

SEQ ID NO: 1787892 - DNA, 23 bp, Homo sapiens
tatttaaaaataagtcaacagta

SEQ ID NO: 1787893 - DNA, 15 bp, Homo sapiens
tatttaaaaatattt

SEQ ID NO: 1787894 - DNA, 20 bp, Homo sapiens
tatttaaaaatatttcagat

SEQ ID NO: 1787895 - DNA, 21 bp, Homo sapiens
tatttaaaaatatttcagata

SEQ ID NO: 1787896 - DNA, 16 bp, Homo sapiens
tatttaaaaattgttt

SEQ ID NO: 1787897 - DNA, 21 bp, Homo sapiens
tatttaaaaattgtttcttga

SEQ ID NO: 1787898 - DNA, 22 bp, Homo sapiens
tatttaaaaattgtttcttgac

SEQ ID NO: 1787899 - DNA, 21 bp, Homo sapiens
tatttaaacctttttcttgat

SEQ ID NO: 1787900 - DNA, 13 bp, Homo sapiens
tatttaaagacaa

SEQ ID NO: 1787901 - DNA, 17 bp, Homo sapiens
tatttaaagacaaagac

SEQ ID NO: 1787902 - DNA, 18 bp, Homo sapiens
tatttaaagacaaagaca

SEQ ID NO: 1787903 - DNA, 12 bp, Homo sapiens
tatttaaaggga

SEQ ID NO: 1787904 - DNA, 18 bp, Homo sapiens
tatttaaagggaaattga

SEQ ID NO: 1787905 - DNA, 21 bp, Homo sapiens
tatttaaatgtttaacatcat

SEQ ID NO: 1787906 - DNA, 23 bp, Homo sapiens
tatttaaatgtttaacatcattg

SEQ ID NO: 1787907 - DNA, 14 bp, Homo sapiens
tatttaacagaaat

SEQ ID NO: 1787908 - DNA, 11 bp, Homo sapiens
tatttaactga

SEQ ID NO: 1787909 - DNA, 13 bp, Homo sapiens
tatttaactgact

SEQ ID NO: 1787910 - DNA, 21 bp, Homo sapiens
tatttaactgccttgtgtaca

SEQ ID NO: 1787911 - DNA, 14 bp, Homo sapiens
tatttaagaaaaca

SEQ ID NO: 1787912 - DNA, 13 bp, Homo sapiens
tatttaagaaaat

SEQ ID NO: 1787913 - DNA, 14 bp, Homo sapiens
tatttaagaaaata

SEQ ID NO: 1787914 - DNA, 17 bp, Homo sapiens
tatttaagataattata

SEQ ID NO: 1787915 - DNA, 20 bp, Homo sapiens
tatttaagataattataata

SEQ ID NO: 1787916 - DNA, 21 bp, Homo sapiens
tatttaagatatatacatgga

SEQ ID NO: 1787917 - DNA, 13 bp, Homo sapiens
tatttaagatgtg

SEQ ID NO: 1787918 - DNA, 12 bp, Homo sapiens
tatttaaggatg

SEQ ID NO: 1787919 - DNA, 16 bp, Homo sapiens
tatttaaggatggatg

SEQ ID NO: 1787920 - DNA, 18 bp, Homo sapiens
tatttaaggatggatggc

SEQ ID NO: 1787921 - DNA, 12 bp, Homo sapiens
tatttaagtagt

SEQ ID NO: 1787922 - DNA, 23 bp, Homo sapiens
tatttaagtagtgggcatttcat

SEQ ID NO: 1787923 - DNA, 14 bp, Homo sapiens
tatttaagttatca

SEQ ID NO: 1787924 - DNA, 13 bp, Homo sapiens
tatttaatatcaa

SEQ ID NO: 1787925 - DNA, 19 bp, Homo sapiens
tatttaatgataagtaaat

SEQ ID NO: 1787926 - DNA, 20 bp, Homo sapiens
tatttaattttttactttca

SEQ ID NO: 1787927 - DNA, 18 bp, Homo sapiens
tatttacactattatttc

SEQ ID NO: 1787928 - DNA, 21 bp, Homo sapiens
tatttacatgaattgcatttt

SEQ ID NO: 1787929 - DNA, 21 bp, Homo sapiens
tatttactaactaaataccat

SEQ ID NO: 1787930 - DNA, 15 bp, Homo sapiens
tcaagctagccagag

SEQ ID NO: 1787931 - DNA, 15 bp, Homo sapiens
tcaagctatttaata

SEQ ID NO: 1787932 - DNA, 21 bp, Homo sapiens
tcaagctggaagaagtgagca

SEQ ID NO: 1787933 - DNA, 21 bp, Homo sapiens
tcaagctgtcccctctgtcat

SEQ ID NO: 1787934 - DNA, 21 bp, Homo sapiens
tcaagctgttatttcttccct

SEQ ID NO: 1787935 - DNA, 23 bp, Homo sapiens
tcaagctgttatttcttccctgc

SEQ ID NO: 1787936 - DNA, 19 bp, Homo sapiens
tcaaggaaagggggtccca

SEQ ID NO: 1787937 - DNA, 19 bp, Homo sapiens
tcaaggaatttcttaactt

SEQ ID NO: 1787938 - DNA, 18 bp, Homo sapiens
tcaaggacaaagtctcca

SEQ ID NO: 1787939 - DNA, 21 bp, Homo sapiens
tcaaggacaaagtctccagcc

SEQ ID NO: 1787940 - DNA, 23 bp, Homo sapiens
tcaaggacaaagtctccagccca

SEQ ID NO: 1787941 - DNA, 17 bp, Homo sapiens
tcaaggcactctagatt

SEQ ID NO: 1787942 - DNA, 20 bp, Homo sapiens
tcaaggcactctagattcca

SEQ ID NO: 1787943 - DNA, 17 bp, Homo sapiens
tcaaggcatcatgcaga

SEQ ID NO: 1787944 - DNA, 18 bp, Homo sapiens
tcaaggccacctctgcct

SEQ ID NO: 1787945 - DNA, 20 bp, Homo sapiens
tcaaggccacctctgcctct

SEQ ID NO: 1787946 - DNA, 10 bp, Homo sapiens
tcaaggcctt

SEQ ID NO: 1787947 - DNA, 14 bp, Homo sapiens
tcaaggcgggaggg

SEQ ID NO: 1787948 - DNA, 17 bp, Homo sapiens
tcaaggctcagaaggaa

SEQ ID NO: 1787949 - DNA, 14 bp, Homo sapiens
tcaaggcttccact

SEQ ID NO: 1787950 - DNA, 21 bp, Homo sapiens
tcaagggaaaggcaagcttga

SEQ ID NO: 1787951 - DNA, 19 bp, Homo sapiens
tcaagggaatgtaactgct

SEQ ID NO: 1787952 - DNA, 18 bp, Homo sapiens
tcaagggcttactatttc

SEQ ID NO: 1787953 - DNA, 13 bp, Homo sapiens
tcaagggtaatct

SEQ ID NO: 1787954 - DNA, 18 bp, Homo sapiens
tcaagggtggcaggtcac

SEQ ID NO: 1787955 - DNA, 13 bp, Homo sapiens
tcaagggttcttt

SEQ ID NO: 1787956 - DNA, 21 bp, Homo sapiens
tcaaggtcacttaaagggtct

SEQ ID NO: 1787957 - DNA, 22 bp, Homo sapiens
tcaaggtgagaattaagtttta

SEQ ID NO: 1787958 - DNA, 14 bp, Homo sapiens
tcaaggttctaacc

SEQ ID NO: 1787959 - DNA, 16 bp, Homo sapiens
tcaaggttttaaaaca

SEQ ID NO: 1787960 - DNA, 21 bp, Homo sapiens
tcaaggttttaggttctaaag

SEQ ID NO: 1787961 - DNA, 23 bp, Homo sapiens
tcaaggttttaggttctaaagtt

SEQ ID NO: 1787962 - DNA, 22 bp, Homo sapiens
tcaagtaagaagacatgaacca

SEQ ID NO: 1787963 - DNA, 23 bp, Homo sapiens
tcaagtaagaagacatgaaccaa

SEQ ID NO: 1787964 - DNA, 24 bp, Homo sapiens
tcaagtacataaagtacataacaa

SEQ ID NO: 1787965 - DNA, 19 bp, Homo sapiens
tcaagtagactactgttca

SEQ ID NO: 1787966 - DNA, 13 bp, Homo sapiens
tcaagtagctggg

SEQ ID NO: 1787967 - DNA, 14 bp, Homo sapiens
tcaagtattataaa

SEQ ID NO: 1787968 - DNA, 16 bp, Homo sapiens
tcaagtattataaaca

SEQ ID NO: 1787969 - DNA, 18 bp, Homo sapiens
tcaagtcccttgttttgt

SEQ ID NO: 1787970 - DNA, 19 bp, Homo sapiens
tcaagtgattctcctgcct

SEQ ID NO: 1787971 - DNA, 21 bp, Homo sapiens
tcaagtgcatgctctctgcag

SEQ ID NO: 1787972 - DNA, 13 bp, Homo sapiens
tcaagtgccaaac

SEQ ID NO: 1787973 - DNA, 18 bp, Homo sapiens
tcaagtgccaaacagagt

SEQ ID NO: 1787974 - DNA, 19 bp, Homo sapiens
tcaagtgcctcttgttgca

SEQ ID NO: 1787975 - DNA, 15 bp, Homo sapiens
tcaagtgtcctgaaa

SEQ ID NO: 1787976 - DNA, 13 bp, Homo sapiens
tcaagttcccaac

SEQ ID NO: 1787977 - DNA, 13 bp, Homo sapiens
tcaagttctaaga

SEQ ID NO: 1787978 - DNA, 16 bp, Homo sapiens
tcaagttctaagattc

SEQ ID NO: 1787979 - DNA, 16 bp, Homo sapiens
tcaagttgtaaataat

SEQ ID NO: 1787980 - DNA, 13 bp, Homo sapiens
tcaagttgtgctt

SEQ ID NO: 1787981 - DNA, 17 bp, Homo sapiens
tcaagttttaaagttca

SEQ ID NO: 1787982 - DNA, 19 bp, Homo sapiens
tcaagttttgggtatgttt

SEQ ID NO: 1787983 - DNA, 16 bp, Homo sapiens
tcaataaaaaaaagaa

SEQ ID NO: 1787984 - DNA, 22 bp, Homo sapiens
tcaataaaatgtgatttttctg

SEQ ID NO: 1787985 - DNA, 23 bp, Homo sapiens
tcaataaaatgtgatttttctga

SEQ ID NO: 1787986 - DNA, 18 bp, Homo sapiens
tcaataaagcactgagca

SEQ ID NO: 1787987 - DNA, 12 bp, Homo sapiens
tcaataaatctt

SEQ ID NO: 1787988 - DNA, 15 bp, Homo sapiens
tcaataaatggtata

SEQ ID NO: 1787989 - DNA, 22 bp, Homo sapiens
tcaataaattattagagatttt

SEQ ID NO: 1787990 - DNA, 15 bp, Homo sapiens
tcaatacaaatgtta

SEQ ID NO: 1787991 - DNA, 20 bp, Homo sapiens
tcaatacagacaaggttctg

SEQ ID NO: 1787992 - DNA, 15 bp, Homo sapiens
tcaatactcttgaaa

SEQ ID NO: 1787993 - DNA, 21 bp, Homo sapiens
tcaatacttttgtgtattctg

SEQ ID NO: 1787994 - DNA, 22 bp, Homo sapiens
tcaatacttttgtgtattctgt

SEQ ID NO: 1787995 - DNA, 13 bp, Homo sapiens
tcaatagtaatat

SEQ ID NO: 1787996 - DNA, 12 bp, Homo sapiens
tcaatagttgaa

SEQ ID NO: 1787997 - DNA, 15 bp, Homo sapiens
tcaatagttgaatta

SEQ ID NO: 1787998 - DNA, 16 bp, Homo sapiens
tcaatatattgaactt

SEQ ID NO: 1787999 - DNA, 17 bp, Homo sapiens
tcaatatattgaacttt

SEQ ID NO: 1788000 - DNA, 21 bp, Homo sapiens
tcaatatcgtacctgtccctc

SEQ ID NO: 1788001 - DNA, 19 bp, Homo sapiens
tcaatatctaatatatatg

SEQ ID NO: 1788002 - DNA, 15 bp, Homo sapiens
tcaatattaaataca

SEQ ID NO: 1788003 - DNA, 16 bp, Homo sapiens
tcaatattaaatacag

SEQ ID NO: 1788004 - DNA, 21 bp, Homo sapiens
tcaatattcctgaatgaaata

SEQ ID NO: 1788005 - DNA, 13 bp, Homo sapiens
tcaatattgacat

SEQ ID NO: 1788006 - DNA, 16 bp, Homo sapiens
tcaatattgacatttg

SEQ ID NO: 1788007 - DNA, 17 bp, Homo sapiens
tcaatattgacatttgt

SEQ ID NO: 1788008 - DNA, 11 bp, Homo sapiens
tcaatatttat

SEQ ID NO: 1788009 - DNA, 13 bp, Homo sapiens
tcaatatttatta

SEQ ID NO: 1788010 - DNA, 16 bp, Homo sapiens
tcaatcaactttactg

SEQ ID NO: 1788011 - DNA, 18 bp, Homo sapiens
tcaatcaactttactgta

SEQ ID NO: 1788012 - DNA, 16 bp, Homo sapiens
tcaatcagtataattc

SEQ ID NO: 1788013 - DNA, 21 bp, Homo sapiens
tcaatcagtataattctgtac

SEQ ID NO: 1788014 - DNA, 22 bp, Homo sapiens
tcaatcagtataattctgtact

SEQ ID NO: 1788015 - DNA, 20 bp, Homo sapiens
tcaatcccctcattcaggaa

SEQ ID NO: 1788016 - DNA, 21 bp, Homo sapiens
tcaatcctaatttctcctccc

SEQ ID NO: 1788017 - DNA, 14 bp, Homo sapiens
tcaatcctctaagc

SEQ ID NO: 1788018 - DNA, 14 bp, Homo sapiens
tcaatcctggtaac

SEQ ID NO: 1788019 - DNA, 18 bp, Homo sapiens
tcaatctcccgctgctgc

SEQ ID NO: 1788020 - DNA, 11 bp, Homo sapiens
tcaatctctgt

SEQ ID NO: 1788021 - DNA, 17 bp, Homo sapiens
tcaatggtatcattaca

SEQ ID NO: 1788022 - DNA, 15 bp, Homo sapiens
tcaatgtattgagaa

SEQ ID NO: 1788023 - DNA, 14 bp, Homo sapiens
tcaatgtcttccca

SEQ ID NO: 1788024 - DNA, 12 bp, Homo sapiens
tcaatgttccat

SEQ ID NO: 1788025 - DNA, 13 bp, Homo sapiens
tcaatgtttctgg

SEQ ID NO: 1788026 - DNA, 20 bp, Homo sapiens
tcaatgtttctggacattct

SEQ ID NO: 1788027 - DNA, 24 bp, Homo sapiens
tcaatgtttctggacattctcttt

SEQ ID NO: 1788028 - DNA, 18 bp, Homo sapiens
tcaatgtttcttctaggt

SEQ ID NO: 1788029 - DNA, 14 bp, Homo sapiens
tcaatgttttgagt

SEQ ID NO: 1788030 - DNA, 18 bp, Homo sapiens
tcaatgtttttaaaaatc

SEQ ID NO: 1788031 - DNA, 13 bp, Homo sapiens
tcaattaaatgta

SEQ ID NO: 1788032 - DNA, 14 bp, Homo sapiens
tcaattaaatgtag

SEQ ID NO: 1788033 - DNA, 11 bp, Homo sapiens
tcaattaataa

SEQ ID NO: 1788034 - DNA, 22 bp, Homo sapiens
tcaattatactacttctaaggt

SEQ ID NO: 1788035 - DNA, 18 bp, Homo sapiens
tcaattatagtttctgag

SEQ ID NO: 1788036 - DNA, 19 bp, Homo sapiens
tcaattatagtttctgagg

SEQ ID NO: 1788037 - DNA, 14 bp, Homo sapiens
tcaattccacctgc

SEQ ID NO: 1788038 - DNA, 21 bp, Homo sapiens
tcaattccatttaaaaaacaa

SEQ ID NO: 1788039 - DNA, 14 bp, Homo sapiens
tcaattcctctggg

SEQ ID NO: 1788040 - DNA, 18 bp, Homo sapiens
tcaattggtggaattcct

SEQ ID NO: 1788041 - DNA, 15 bp, Homo sapiens
tcaatttcattatca

SEQ ID NO: 1788042 - DNA, 21 bp, Homo sapiens
tcaattttcattaaacttgaa

SEQ ID NO: 1788043 - DNA, 13 bp, Homo sapiens
tcaattttgactt

SEQ ID NO: 1788044 - DNA, 18 bp, Homo sapiens
tcaattttgacttaatgt

SEQ ID NO: 1788045 - DNA, 18 bp, Homo sapiens
tcaatttttaccacttct

SEQ ID NO: 1788046 - DNA, 20 bp, Homo sapiens
tcaatttttcttatttcatt

SEQ ID NO: 1788047 - DNA, 13 bp, Homo sapiens
tcacaaaaaggca

SEQ ID NO: 1788048 - DNA, 18 bp, Homo sapiens
tcacaaaaaggcaaatat

SEQ ID NO: 1788049 - DNA, 14 bp, Homo sapiens
tcacaaaattttat

SEQ ID NO: 1788050 - DNA, 18 bp, Homo sapiens
tcacaaactgtgaaaata

SEQ ID NO: 1788051 - DNA, 17 bp, Homo sapiens
tcacaaagtggaacgaa

SEQ ID NO: 1788052 - DNA, 20 bp, Homo sapiens
tcacaaatcctaaaagaagc

SEQ ID NO: 1788053 - DNA, 19 bp, Homo sapiens
tcacaaatgtcattgtcta

SEQ ID NO: 1788054 - DNA, 13 bp, Homo sapiens
tcacaaccaagaa

SEQ ID NO: 1788055 - DNA, 15 bp, Homo sapiens
tcacaaccagatttg

SEQ ID NO: 1788056 - DNA, 14 bp, Homo sapiens
tcacaaccttctgt

SEQ ID NO: 1788057 - DNA, 17 bp, Homo sapiens
tcacaagagcccagcag

SEQ ID NO: 1788058 - DNA, 17 bp, Homo sapiens
tcacaagcacaaagctc

SEQ ID NO: 1788059 - DNA, 18 bp, Homo sapiens
tcacaagcacaaagctca

SEQ ID NO: 1788060 - DNA, 13 bp, Homo sapiens
tcacaaggcccag

SEQ ID NO: 1788061 - DNA, 18 bp, Homo sapiens
tcacaagggacgctttgg

SEQ ID NO: 1788062 - DNA, 20 bp, Homo sapiens
tcacaagttgtgtttgatat

SEQ ID NO: 1788063 - DNA, 14 bp, Homo sapiens
tcacaatagaaact

SEQ ID NO: 1788064 - DNA, 15 bp, Homo sapiens
tcacaatgtgaaact

SEQ ID NO: 1788065 - DNA, 17 bp, Homo sapiens
tcacaattccatttcca

SEQ ID NO: 1788066 - DNA, 10 bp, Homo sapiens
tcacacacac

SEQ ID NO: 1788067 - DNA, 14 bp, Homo sapiens
tcacacacatggaa

SEQ ID NO: 1788068 - DNA, 14 bp, Homo sapiens
tcacacacccctca

SEQ ID NO: 1788069 - DNA, 12 bp, Homo sapiens
tcacacagtgtt

SEQ ID NO: 1788070 - DNA, 18 bp, Homo sapiens
tcacacatctgggtgccc

SEQ ID NO: 1788071 - DNA, 20 bp, Homo sapiens
tcacacatctgggtgccctg

SEQ ID NO: 1788072 - DNA, 15 bp, Homo sapiens
tcacacatgaataaa

SEQ ID NO: 1788073 - DNA, 15 bp, Homo sapiens
tcacaccactgtact

SEQ ID NO: 1788074 - DNA, 11 bp, Homo sapiens
tcacacccacc

SEQ ID NO: 1788075 - DNA, 20 bp, Homo sapiens
tcacacccaccgtccgccct

SEQ ID NO: 1788076 - DNA, 24 bp, Homo sapiens
tcacacccaccgtccgccctgctc

SEQ ID NO: 1788077 - DNA, 13 bp, Homo sapiens
tcacaccccagtg

SEQ ID NO: 1788078 - DNA, 14 bp, Homo sapiens
tcacacccctgtcc

SEQ ID NO: 1788079 - DNA, 22 bp, Homo sapiens
tcacaccctaccttccccagac

SEQ ID NO: 1788080 - DNA, 12 bp, Homo sapiens
tcacacctgact

SEQ ID NO: 1788081 - DNA, 13 bp, Homo sapiens
tcacacctgactc

SEQ ID NO: 1788082 - DNA, 19 bp, Homo sapiens
tcacacgactgtcatctaa

SEQ ID NO: 1788083 - DNA, 19 bp, Homo sapiens
tcacacgtttaatcccagc

SEQ ID NO: 1788084 - DNA, 21 bp, Homo sapiens
tcacacgtttaatcccagcac

SEQ ID NO: 1788085 - DNA, 22 bp, Homo sapiens
tcacacgtttaatcccagcact

SEQ ID NO: 1788086 - DNA, 21 bp, Homo sapiens
tcacactcagttgtgactaac

SEQ ID NO: 1788087 - DNA, 18 bp, Homo sapiens
tcacactccagtggcaga

SEQ ID NO: 1788088 - DNA, 23 bp, Homo sapiens
tcacactcttcagtgactcctgc

SEQ ID NO: 1788089 - DNA, 11 bp, Homo sapiens
tcacactgaga

SEQ ID NO: 1788090 - DNA, 20 bp, Homo sapiens
tcacactgcaagagccttgg

SEQ ID NO: 1788091 - DNA, 14 bp, Homo sapiens
tcacactgcgcagg

SEQ ID NO: 1788092 - DNA, 22 bp, Homo sapiens
tcacactgcgcaggtctcttct

SEQ ID NO: 1788093 - DNA, 21 bp, Homo sapiens
tcacactgggtggtggcctgg

SEQ ID NO: 1788094 - DNA, 16 bp, Homo sapiens
tcacactggtaaatgt

SEQ ID NO: 1788095 - DNA, 19 bp, Homo sapiens
tcacactggtttgccaggc

SEQ ID NO: 1788096 - DNA, 21 bp, Homo sapiens
tcacactggtttgccaggcca

SEQ ID NO: 1788097 - DNA, 21 bp, Homo sapiens
tcacactgttactccacagcg

SEQ ID NO: 1788098 - DNA, 23 bp, Homo sapiens
tcacactgttactccacagcgga

SEQ ID NO: 1788099 - DNA, 18 bp, Homo sapiens
tcacacttatattttatg

SEQ ID NO: 1788100 - DNA, 18 bp, Homo sapiens
tcacacttccaccagcct

SEQ ID NO: 1788101 - DNA, 19 bp, Homo sapiens
tcacacttccaccagcctg

SEQ ID NO: 1788102 - DNA, 22 bp, Homo sapiens
tcacacttctgtgagaccccca

SEQ ID NO: 1788103 - DNA, 19 bp, Homo sapiens
tcacagaaaaagcatgatg

SEQ ID NO: 1788104 - DNA, 12 bp, Homo sapiens
tcacagaagaat

SEQ ID NO: 1788105 - DNA, 23 bp, Homo sapiens
tcacagaagtgttaacttttcta

SEQ ID NO: 1788106 - DNA, 14 bp, Homo sapiens
tcacagacctggag

SEQ ID NO: 1788107 - DNA, 18 bp, Homo sapiens
tcacagacctggagcccc

SEQ ID NO: 1788108 - DNA, 18 bp, Homo sapiens
tcacagagaagctcctgc

SEQ ID NO: 1788109 - DNA, 20 bp, Homo sapiens
tcacagagaagctcctgcta

SEQ ID NO: 1788110 - DNA, 12 bp, Homo sapiens
tcacagagagct

SEQ ID NO: 1788111 - DNA, 15 bp, Homo sapiens
tcacagagcagagtc

SEQ ID NO: 1788112 - DNA, 13 bp, Homo sapiens
tcacagagtgaga

SEQ ID NO: 1788113 - DNA, 20 bp, Homo sapiens
tcacagatgggtattaaact

SEQ ID NO: 1788114 - DNA, 22 bp, Homo sapiens
tcacagatgggtattaaacttg

SEQ ID NO: 1788115 - DNA, 23 bp, Homo sapiens
tcacagcaagtcactggccagtg

SEQ ID NO: 1788116 - DNA, 21 bp, Homo sapiens
tcacagcacagtacacacaaa

SEQ ID NO: 1788117 - DNA, 17 bp, Homo sapiens
tctcactggatgcaaag

SEQ ID NO: 1788118 - DNA, 22 bp, Homo sapiens
tctcactgtattagagcgccag

SEQ ID NO: 1788119 - DNA, 22 bp, Homo sapiens
tctcactgtcgcccaggctgga

SEQ ID NO: 1788120 - DNA, 23 bp, Homo sapiens
tctcactgtgttactgctttgca

SEQ ID NO: 1788121 - DNA, 21 bp, Homo sapiens
tctcagaaagtgcctgacaca

SEQ ID NO: 1788122 - DNA, 15 bp, Homo sapiens
tctcagaacagctga

SEQ ID NO: 1788123 - DNA, 11 bp, Homo sapiens
tctcagaacat

SEQ ID NO: 1788124 - DNA, 14 bp, Homo sapiens
tctcagaactcctg

SEQ ID NO: 1788125 - DNA, 23 bp, Homo sapiens
tctcagaactcctgtgtgtggaa

SEQ ID NO: 1788126 - DNA, 21 bp, Homo sapiens
tctcagaactgttggctgctc

SEQ ID NO: 1788127 - DNA, 14 bp, Homo sapiens
tctcagaagcacag

SEQ ID NO: 1788128 - DNA, 15 bp, Homo sapiens
tctcagaagcacaga

SEQ ID NO: 1788129 - DNA, 22 bp, Homo sapiens
tctcagaataactacctcctca

SEQ ID NO: 1788130 - DNA, 17 bp, Homo sapiens
tctcagaatccaaagat

SEQ ID NO: 1788131 - DNA, 21 bp, Homo sapiens
tctcagaatctcaaataacta

SEQ ID NO: 1788132 - DNA, 22 bp, Homo sapiens
tctcagaattcggtgtgctgcc

SEQ ID NO: 1788133 - DNA, 21 bp, Homo sapiens
tctcagagacaggtggcctag

SEQ ID NO: 1788134 - DNA, 16 bp, Homo sapiens
tctcagagaccagcac

SEQ ID NO: 1788135 - DNA, 20 bp, Homo sapiens
tctcagaggaaaaatgggag

SEQ ID NO: 1788136 - DNA, 15 bp, Homo sapiens
tctcagaggcctgct

SEQ ID NO: 1788137 - DNA, 16 bp, Homo sapiens
tctcagatccttgttt

SEQ ID NO: 1788138 - DNA, 22 bp, Homo sapiens
tctcagatccttgtttcaaaca

SEQ ID NO: 1788139 - DNA, 18 bp, Homo sapiens
tctcagatctggtttcta

SEQ ID NO: 1788140 - DNA, 23 bp, Homo sapiens
tctcagatctggtttctaagagt

SEQ ID NO: 1788141 - DNA, 17 bp, Homo sapiens
tctcagatcttgacagt

SEQ ID NO: 1788142 - DNA, 15 bp, Homo sapiens
tctcagcatagcctg

SEQ ID NO: 1788143 - DNA, 23 bp, Homo sapiens
tctcagccagcccgtgtgtataa

SEQ ID NO: 1788144 - DNA, 14 bp, Homo sapiens
tctcagcctcccaa

SEQ ID NO: 1788145 - DNA, 15 bp, Homo sapiens
tctcagcctcccaca

SEQ ID NO: 1788146 - DNA, 15 bp, Homo sapiens
tctcagctaagctca

SEQ ID NO: 1788147 - DNA, 19 bp, Homo sapiens
tctcagctttgagaagcct

SEQ ID NO: 1788148 - DNA, 12 bp, Homo sapiens
tctcaggaaatc

SEQ ID NO: 1788149 - DNA, 23 bp, Homo sapiens
tctcaggaaatcaaatatgcaaa

SEQ ID NO: 1788150 - DNA, 15 bp, Homo sapiens
tctcaggagcacagg

SEQ ID NO: 1788151 - DNA, 18 bp, Homo sapiens
tctcaggagcacaggcag

SEQ ID NO: 1788152 - DNA, 20 bp, Homo sapiens
tctcaggagcacaggcagct

SEQ ID NO: 1788153 - DNA, 11 bp, Homo sapiens
tctcaggcagc

SEQ ID NO: 1788154 - DNA, 22 bp, Homo sapiens
tctcaggcagcaccacactggg

SEQ ID NO: 1788155 - DNA, 21 bp, Homo sapiens
tctcaggccccgggcttccct

SEQ ID NO: 1788156 - DNA, 15 bp, Homo sapiens
tctcaggctctgccc

SEQ ID NO: 1788157 - DNA, 17 bp, Homo sapiens
tctcaggctctgccctg

SEQ ID NO: 1788158 - DNA, 20 bp, Homo sapiens
tctcaggctctgccctgccc

SEQ ID NO: 1788159 - DNA, 17 bp, Homo sapiens
tctcagggaagcccagc

SEQ ID NO: 1788160 - DNA, 19 bp, Homo sapiens
tctcagggaagcccagctc

SEQ ID NO: 1788161 - DNA, 11 bp, Homo sapiens
tctcagggcag

SEQ ID NO: 1788162 - DNA, 17 bp, Homo sapiens
tctcaggtaccttttct

SEQ ID NO: 1788163 - DNA, 14 bp, Homo sapiens
tctcaggtgccact

SEQ ID NO: 1788164 - DNA, 18 bp, Homo sapiens
tctcaggtgccactccct

SEQ ID NO: 1788165 - DNA, 21 bp, Homo sapiens
tctcaggtgccactccctgag

SEQ ID NO: 1788166 - DNA, 15 bp, Homo sapiens
tctcagtctgtcacc

SEQ ID NO: 1788167 - DNA, 14 bp, Homo sapiens
tctcagtgccttct

SEQ ID NO: 1788168 - DNA, 15 bp, Homo sapiens
tctcagtgccttctc

SEQ ID NO: 1788169 - DNA, 18 bp, Homo sapiens
tctcagtgccttctctca

SEQ ID NO: 1788170 - DNA, 14 bp, Homo sapiens
tctcagtgttggta

SEQ ID NO: 1788171 - DNA, 23 bp, Homo sapiens
tctcagtgttttggactccatct

SEQ ID NO: 1788172 - DNA, 18 bp, Homo sapiens
tctcagttgtttgcttct

SEQ ID NO: 1788173 - DNA, 17 bp, Homo sapiens
tctcagtttgtgtgtct

SEQ ID NO: 1788174 - DNA, 16 bp, Homo sapiens
tctcataattttgcaa

SEQ ID NO: 1788175 - DNA, 15 bp, Homo sapiens
tctcatacctctgac

SEQ ID NO: 1788176 - DNA, 19 bp, Homo sapiens
tctcataggaaaagtacat

SEQ ID NO: 1788177 - DNA, 23 bp, Homo sapiens
tctcataggaaaagtacatttaa

SEQ ID NO: 1788178 - DNA, 24 bp, Homo sapiens
tctcataggaaaagtacatttaat

SEQ ID NO: 1788179 - DNA, 16 bp, Homo sapiens
tctcataggagactgc

SEQ ID NO: 1788180 - DNA, 22 bp, Homo sapiens
tctcatattcgctagtgtttaa

SEQ ID NO: 1788181 - DNA, 15 bp, Homo sapiens
tctcatcaactgaat

SEQ ID NO: 1788182 - DNA, 18 bp, Homo sapiens
tctcatcaacttaaaagt

SEQ ID NO: 1788183 - DNA, 19 bp, Homo sapiens
tctcatcaggcaaattgta

SEQ ID NO: 1788184 - DNA, 22 bp, Homo sapiens
tctcatccccaggggtcccagc

SEQ ID NO: 1788185 - DNA, 13 bp, Homo sapiens
tctcatccctcaa

SEQ ID NO: 1788186 - DNA, 21 bp, Homo sapiens
tctcatcggaggcccatgccc

SEQ ID NO: 1788187 - DNA, 20 bp, Homo sapiens
tctcatctcttagctcccct

SEQ ID NO: 1788188 - DNA, 13 bp, Homo sapiens
tctcatctttctt

SEQ ID NO: 1788189 - DNA, 22 bp, Homo sapiens
tctcatctttcttgatcaacat

SEQ ID NO: 1788190 - DNA, 15 bp, Homo sapiens
tctcatgatttacag

SEQ ID NO: 1788191 - DNA, 16 bp, Homo sapiens
tctcatgcctcagcct

SEQ ID NO: 1788192 - DNA, 19 bp, Homo sapiens
tctcatggaaactggccag

SEQ ID NO: 1788193 - DNA, 23 bp, Homo sapiens
tctcatggaaactggccaggggt

SEQ ID NO: 1788194 - DNA, 19 bp, Homo sapiens
tctcatggaccagtggctg

SEQ ID NO: 1788195 - DNA, 17 bp, Homo sapiens
tctcatgggtggcactc

SEQ ID NO: 1788196 - DNA, 17 bp, Homo sapiens
tctcattcagtattaaa

SEQ ID NO: 1788197 - DNA, 21 bp, Homo sapiens
tctcattcccagagtcagagg

SEQ ID NO: 1788198 - DNA, 18 bp, Homo sapiens
tctcattccgttgtctgt

SEQ ID NO: 1788199 - DNA, 21 bp, Homo sapiens
tctcattccgttgtctgtgga

SEQ ID NO: 1788200 - DNA, 18 bp, Homo sapiens
tctcattcgcctttgtct

SEQ ID NO: 1788201 - DNA, 13 bp, Homo sapiens
tctcattctgtgc

SEQ ID NO: 1788202 - DNA, 14 bp, Homo sapiens
tctcattctttgaa

SEQ ID NO: 1788203 - DNA, 18 bp, Homo sapiens
tctcattctttgaacatg

SEQ ID NO: 1788204 - DNA, 21 bp, Homo sapiens
tctcattgtttgtttgtaagt

SEQ ID NO: 1788205 - DNA, 22 bp, Homo sapiens
tctcatttcacccctccctttc

SEQ ID NO: 1788206 - DNA, 19 bp, Homo sapiens
tctcattttgtccatgtcc

SEQ ID NO: 1788207 - DNA, 23 bp, Homo sapiens
tctccaaactgaagcagcctctc

SEQ ID NO: 1788208 - DNA, 15 bp, Homo sapiens
tctccaaaggggctg

SEQ ID NO: 1788209 - DNA, 22 bp, Homo sapiens
tctccaaaggggctgctggggc

SEQ ID NO: 1788210 - DNA, 24 bp, Homo sapiens
tctccaaatattattcaagtgcct

SEQ ID NO: 1788211 - DNA, 17 bp, Homo sapiens
tctccaacatcacagcc

SEQ ID NO: 1788212 - DNA, 20 bp, Homo sapiens
tctccaacatcacagcccag

SEQ ID NO: 1788213 - DNA, 17 bp, Homo sapiens
tctccaaccccccagca

SEQ ID NO: 1788214 - DNA, 23 bp, Homo sapiens
tctccaaccccccagcactgagg

SEQ ID NO: 1788215 - DNA, 15 bp, Homo sapiens
tctccaacctggaca

SEQ ID NO: 1788216 - DNA, 20 bp, Homo sapiens
tctccaagggagggtgcagc

SEQ ID NO: 1788217 - DNA, 22 bp, Homo sapiens
tctccaagggagggtgcagccc

SEQ ID NO: 1788218 - DNA, 21 bp, Homo sapiens
tctccaagggcttctgcaccc

SEQ ID NO: 1788219 - DNA, 22 bp, Homo sapiens
tctccaagggcttctgcaccct

SEQ ID NO: 1788220 - DNA, 23 bp, Homo sapiens
tctccaagggcttctgcaccctc

SEQ ID NO: 1788221 - DNA, 18 bp, Homo sapiens
tctccaatatcagtgctc

SEQ ID NO: 1788222 - DNA, 21 bp, Homo sapiens
tctccacagtgttgtgcccct

SEQ ID NO: 1788223 - DNA, 18 bp, Homo sapiens
tctccaccccccacgtct

SEQ ID NO: 1788224 - DNA, 23 bp, Homo sapiens
tctccaccctccggccagcgagt

SEQ ID NO: 1788225 - DNA, 22 bp, Homo sapiens
tctccacctacacccctgtgct

SEQ ID NO: 1788226 - DNA, 15 bp, Homo sapiens
tctccacctcagcct

SEQ ID NO: 1788227 - DNA, 16 bp, Homo sapiens
tctccacctcagcctt

SEQ ID NO: 1788228 - DNA, 17 bp, Homo sapiens
tctccacctcagccttg

SEQ ID NO: 1788229 - DNA, 22 bp, Homo sapiens
tctccacctcccccaaaccctg

SEQ ID NO: 1788230 - DNA, 14 bp, Homo sapiens
tctccactcaatgt

SEQ ID NO: 1788231 - DNA, 17 bp, Homo sapiens
tctccactcagttgcaa

SEQ ID NO: 1788232 - DNA, 15 bp, Homo sapiens
tctcccgcctcagcc

SEQ ID NO: 1788233 - DNA, 16 bp, Homo sapiens
tctcccgctgctgctg

SEQ ID NO: 1788234 - DNA, 17 bp, Homo sapiens
tctcccggctgcctgcc

SEQ ID NO: 1788235 - DNA, 14 bp, Homo sapiens
tctccctaccttgc

SEQ ID NO: 1788236 - DNA, 19 bp, Homo sapiens
tctccctaccttgcctcct

SEQ ID NO: 1788237 - DNA, 20 bp, Homo sapiens
tctccctaccttgcctcctt

SEQ ID NO: 1788238 - DNA, 16 bp, Homo sapiens
tctccctagcccaccc

SEQ ID NO: 1788239 - DNA, 17 bp, Homo sapiens
tctccctccctctctca

SEQ ID NO: 1788240 - DNA, 17 bp, Homo sapiens
tctccctctcctgccta

SEQ ID NO: 1788241 - DNA, 12 bp, Homo sapiens
tctccctctctc

SEQ ID NO: 1788242 - DNA, 16 bp, Homo sapiens
tctccctctggccctg

SEQ ID NO: 1788243 - DNA, 15 bp, Homo sapiens
tctccctgcacagcc

SEQ ID NO: 1788244 - DNA, 12 bp, Homo sapiens
tctccctgcctg

SEQ ID NO: 1788245 - DNA, 15 bp, Homo sapiens
tctccctgcctggcc

SEQ ID NO: 1788246 - DNA, 16 bp, Homo sapiens
tctccctgcctggccc

SEQ ID NO: 1788247 - DNA, 17 bp, Homo sapiens
tctccctgcctggcccc

SEQ ID NO: 1788248 - DNA, 14 bp, Homo sapiens
tctccctggctccc

SEQ ID NO: 1788249 - DNA, 20 bp, Homo sapiens
tctccctggctccctcctcc

SEQ ID NO: 1788250 - DNA, 16 bp, Homo sapiens
tctccctggtgcctct

SEQ ID NO: 1788251 - DNA, 18 bp, Homo sapiens
tctccctggtgcctctgt

SEQ ID NO: 1788252 - DNA, 19 bp, Homo sapiens
tctccctggtgcctctgtg

SEQ ID NO: 1788253 - DNA, 13 bp, Homo sapiens
tctcccttctctc

SEQ ID NO: 1788254 - DNA, 14 bp, Homo sapiens
tctcccttctctct

SEQ ID NO: 1788255 - DNA, 13 bp, Homo sapiens
tctcccttggccc

SEQ ID NO: 1788256 - DNA, 18 bp, Homo sapiens
tctcccttggcccagaga

SEQ ID NO: 1788257 - DNA, 20 bp, Homo sapiens
tctcccttgtcctgcttggg

SEQ ID NO: 1788258 - DNA, 17 bp, Homo sapiens
tctccgacttcccctgg

SEQ ID NO: 1788259 - DNA, 17 bp, Homo sapiens
tctccgagctctggtgc

SEQ ID NO: 1788260 - DNA, 14 bp, Homo sapiens
tctccgccagcctc

SEQ ID NO: 1788261 - DNA, 21 bp, Homo sapiens
tctccgccagcctcctctgga

SEQ ID NO: 1788262 - DNA, 13 bp, Homo sapiens
tctccggggtctg

SEQ ID NO: 1788263 - DNA, 18 bp, Homo sapiens
tctccggggtctgtgctg

SEQ ID NO: 1788264 - DNA, 23 bp, Homo sapiens
tctccggggtctgtgctgtgcct

SEQ ID NO: 1788265 - DNA, 17 bp, Homo sapiens
tctccgttagctcctgt

SEQ ID NO: 1788266 - DNA, 21 bp, Homo sapiens
tctccgttagctcctgtggcc

SEQ ID NO: 1788267 - DNA, 22 bp, Homo sapiens
tctccgttagctcctgtggccc

SEQ ID NO: 1788268 - DNA, 20 bp, Homo sapiens
tctccgttccatctgggctt

SEQ ID NO: 1788269 - DNA, 13 bp, Homo sapiens
tctcctaaagctt

SEQ ID NO: 1788270 - DNA, 14 bp, Homo sapiens
tctcctaacaaaag

SEQ ID NO: 1788271 - DNA, 16 bp, Homo sapiens
tctcctaacaaaagaa

SEQ ID NO: 1788272 - DNA, 20 bp, Homo sapiens
tctcctacatatcccttcca

SEQ ID NO: 1788273 - DNA, 15 bp, Homo sapiens
tctcctatatatttc

SEQ ID NO: 1788274 - DNA, 15 bp, Homo sapiens
tctcctccccacccg

SEQ ID NO: 1788275 - DNA, 14 bp, Homo sapiens
tctcctccccttcc

SEQ ID NO: 1788276 - DNA, 19 bp, Homo sapiens
tctcctcccgccccgcccc

SEQ ID NO: 1788277 - DNA, 14 bp, Homo sapiens
tctcctcccttcct

SEQ ID NO: 1788278 - DNA, 12 bp, Homo sapiens
tctcctcctccc

SEQ ID NO: 1788279 - DNA, 14 bp, Homo sapiens
tctcctcctcgaag

SEQ ID NO: 1788280 - DNA, 17 bp, Homo sapiens
tctcctgacccagtccc

SEQ ID NO: 1788281 - DNA, 16 bp, Homo sapiens
tctcctgacccctgcc

SEQ ID NO: 1788282 - DNA, 17 bp, Homo sapiens
tctcctgacccctgcct

SEQ ID NO: 1788283 - DNA, 13 bp, Homo sapiens
tctcctgactggt

SEQ ID NO: 1788284 - DNA, 17 bp, Homo sapiens
tctcctgatttctctga

SEQ ID NO: 1788285 - DNA, 15 bp, Homo sapiens
tctcctgccctctgc

SEQ ID NO: 1788286 - DNA, 21 bp, Homo sapiens
tctcctgccctctgctctgcc

SEQ ID NO: 1788287 - DNA, 17 bp, Homo sapiens
tctcctgcctactcacg

SEQ ID NO: 1788288 - DNA, 12 bp, Homo sapiens
tctcctgcctca

SEQ ID NO: 1788289 - DNA, 13 bp, Homo sapiens
tctcctgcctcac

SEQ ID NO: 1788290 - DNA, 15 bp, Homo sapiens
tctcctgcctcagcc

SEQ ID NO: 1788291 - DNA, 13 bp, Homo sapiens
tctcctgctgcct

SEQ ID NO: 1788292 - DNA, 21 bp, Homo sapiens
tctcctggaaatattaagaaa

SEQ ID NO: 1788293 - DNA, 11 bp, Homo sapiens
tctcctggctt

SEQ ID NO: 1788294 - DNA, 15 bp, Homo sapiens
tctcctggtgttctg

SEQ ID NO: 1788295 - DNA, 15 bp, Homo sapiens
tctcctgtccctcca

SEQ ID NO: 1788296 - DNA, 20 bp, Homo sapiens
tctcctgtctcagcctcctg

SEQ ID NO: 1788297 - DNA, 21 bp, Homo sapiens
tctcctgtctcagcctcctga

SEQ ID NO: 1788298 - DNA, 23 bp, Homo sapiens
tctcctgtgcatgggtgaaggga

SEQ ID NO: 1788299 - DNA, 12 bp, Homo sapiens
tctccttaagct

SEQ ID NO: 1788300 - DNA, 22 bp, Homo sapiens
tctccttaagctgcagagattt

SEQ ID NO: 1788301 - DNA, 17 bp, Homo sapiens
tctccttactctgagcc

SEQ ID NO: 1788302 - DNA, 13 bp, Homo sapiens
tctccttcagcac

SEQ ID NO: 1788303 - DNA, 11 bp, Homo sapiens
tctccttcccc

SEQ ID NO: 1788304 - DNA, 16 bp, Homo sapiens
tctccttcccccagcc

SEQ ID NO: 1788305 - DNA, 19 bp, Homo sapiens
tctccttcccccagcccaa

SEQ ID NO: 1788306 - DNA, 13 bp, Homo sapiens
tctccttcccttc

SEQ ID NO: 1788307 - DNA, 17 bp, Homo sapiens
tctccttcccttctctt

SEQ ID NO: 1788308 - DNA, 19 bp, Homo sapiens
tctccttcctcttggctga

SEQ ID NO: 1788309 - DNA, 13 bp, Homo sapiens
tctccttcctgtg

SEQ ID NO: 1788310 - DNA, 17 bp, Homo sapiens
tctccttctccttccca

SEQ ID NO: 1788311 - DNA, 13 bp, Homo sapiens
tctccttgaaatg

SEQ ID NO: 1788312 - DNA, 16 bp, Homo sapiens
tctccttgagtgtatg

SEQ ID NO: 1788313 - DNA, 17 bp, Homo sapiens
tctccttggctgtctgt

SEQ ID NO: 1788314 - DNA, 13 bp, Homo sapiens
tctccttgggccc

SEQ ID NO: 1788315 - DNA, 14 bp, Homo sapiens
tctccttgggccct

SEQ ID NO: 1788316 - DNA, 14 bp, Homo sapiens
tctccttgggctcc

SEQ ID NO: 1788317 - DNA, 16 bp, Homo sapiens
tctccttgggctcctg

SEQ ID NO: 1788318 - DNA, 22 bp, Homo sapiens
tctccttgggctcctggctgcc

SEQ ID NO: 1788319 - DNA, 15 bp, Homo sapiens
tctcctttaattgta

SEQ ID NO: 1788320 - DNA, 22 bp, Homo sapiens
tctcctttccttcccaggccct

SEQ ID NO: 1788321 - DNA, 17 bp, Homo sapiens
tctcctttgataaaata

SEQ ID NO: 1788322 - DNA, 23 bp, Homo sapiens
tctcctttgataaaataaatgag

SEQ ID NO: 1788323 - DNA, 16 bp, Homo sapiens
tctcctttgcactgag

SEQ ID NO: 1788324 - DNA, 17 bp, Homo sapiens
tctcctttgcactgagg

SEQ ID NO: 1788325 - DNA, 21 bp, Homo sapiens
tctcctttgcactgagggcca

SEQ ID NO: 1788326 - DNA, 13 bp, Homo sapiens
tctcctttgctct

SEQ ID NO: 1788327 - DNA, 16 bp, Homo sapiens
tctcctttgctcttgc

SEQ ID NO: 1788328 - DNA, 22 bp, Homo sapiens
tctcctttgctgaggcctccag

SEQ ID NO: 1788329 - DNA, 22 bp, Homo sapiens
tctccttttacttcacttcaaa

SEQ ID NO: 1788330 - DNA, 17 bp, Homo sapiens
tctccttttcctatcct

SEQ ID NO: 1788331 - DNA, 15 bp, Homo sapiens
tctcgaatgtaattg

SEQ ID NO: 1788332 - DNA, 15 bp, Homo sapiens
tctcgagccccctgg

SEQ ID NO: 1788333 - DNA, 22 bp, Homo sapiens
tctcgatgccataatcagaaca

SEQ ID NO: 1788334 - DNA, 16 bp, Homo sapiens
tctcgcagcctgaagc

SEQ ID NO: 1788335 - DNA, 18 bp, Homo sapiens
tctcgcagcctgaagcct

SEQ ID NO: 1788336 - DNA, 16 bp, Homo sapiens
tctcgcataggacctt

SEQ ID NO: 1788337 - DNA, 15 bp, Homo sapiens
tctcgccatgatcag

SEQ ID NO: 1788338 - DNA, 16 bp, Homo sapiens
tctcgcgccctccccc

SEQ ID NO: 1788339 - DNA, 17 bp, Homo sapiens
tctcgcgccctccccca

SEQ ID NO: 1788340 - DNA, 15 bp, Homo sapiens
tctcgctctctctcg

SEQ ID NO: 1788341 - DNA, 17 bp, Homo sapiens
tctcgctctgttgccca

SEQ ID NO: 1788342 - DNA, 18 bp, Homo sapiens
tctcgctgcgtcctcatt

SEQ ID NO: 1788343 - DNA, 17 bp, Homo sapiens
tctcgcttcctcagcct

SEQ ID NO: 1788344 - DNA, 17 bp, Homo sapiens
tctcggaaggctggctg

SEQ ID NO: 1788345 - DNA, 15 bp, Homo sapiens
tctcggagctggccc

SEQ ID NO: 1788346 - DNA, 16 bp, Homo sapiens
tctcggagctggccca

SEQ ID NO: 1788347 - DNA, 15 bp, Homo sapiens
tctcggatgaccaaa

SEQ ID NO: 1788348 - DNA, 21 bp, Homo sapiens
tctcggctccccatgtgtcct

SEQ ID NO: 1788349 - DNA, 20 bp, Homo sapiens
tctcggcttggatcctgggc

SEQ ID NO: 1788350 - DNA, 14 bp, Homo sapiens
tctcgggagaggat

SEQ ID NO: 1788351 - DNA, 16 bp, Homo sapiens
tctcggggtccagtgc

SEQ ID NO: 1788352 - DNA, 19 bp, Homo sapiens
tctcgggtgggggagccag

SEQ ID NO: 1788353 - DNA, 12 bp, Homo sapiens
tctcgtaatagc

SEQ ID NO: 1788354 - DNA, 16 bp, Homo sapiens
tctcgtaatagcttct

SEQ ID NO: 1788355 - DNA, 18 bp, Homo sapiens
tctcgtgcatttcaactt

SEQ ID NO: 1788356 - DNA, 14 bp, Homo sapiens
tctctaaactggca

SEQ ID NO: 1788357 - DNA, 20 bp, Homo sapiens
tctctaaactggcatctgct

SEQ ID NO: 1788358 - DNA, 21 bp, Homo sapiens
tctctaaactggcatctgctc

SEQ ID NO: 1788359 - DNA, 16 bp, Homo sapiens
tctctaaccattcaaa

SEQ ID NO: 1788360 - DNA, 18 bp, Homo sapiens
tctctaaccattcaaatg

SEQ ID NO: 1788361 - DNA, 22 bp, Homo sapiens
tctctaactcagaaacatcagt

SEQ ID NO: 1788362 - DNA, 17 bp, Homo sapiens
tctctaactcctgccat

SEQ ID NO: 1788363 - DNA, 23 bp, Homo sapiens
tctctaagtgggcattgccatgt

SEQ ID NO: 1788364 - DNA, 16 bp, Homo sapiens
tctctaatgtctgcag

SEQ ID NO: 1788365 - DNA, 18 bp, Homo sapiens
tctctaccagtctatttc

SEQ ID NO: 1788366 - DNA, 12 bp, Homo sapiens
tctctacctcca

SEQ ID NO: 1788367 - DNA, 13 bp, Homo sapiens
tctctacctccac

SEQ ID NO: 1788368 - DNA, 20 bp, Homo sapiens
tctctactaccacaaggaaa

SEQ ID NO: 1788369 - DNA, 22 bp, Homo sapiens
tctctagaattttaagtgcttt

SEQ ID NO: 1788370 - DNA, 13 bp, Homo sapiens
tctctagcacaat

SEQ ID NO: 1788371 - DNA, 16 bp, Homo sapiens
tctctataccaataaa

SEQ ID NO: 1788372 - DNA, 17 bp, Homo sapiens
tctctataccaataaag

SEQ ID NO: 1788373 - DNA, 14 bp, Homo sapiens
tctctatcagaaat

SEQ ID NO: 1788374 - DNA, 13 bp, Homo sapiens
tctctattctctg

SEQ ID NO: 1788375 - DNA, 13 bp, Homo sapiens
tctctattttcat

SEQ ID NO: 1788376 - DNA, 13 bp, Homo sapiens
tctctcaagtgat

SEQ ID NO: 1788377 - DNA, 12 bp, Homo sapiens
tctctcagctcc

SEQ ID NO: 1788378 - DNA, 15 bp, Homo sapiens
tctctcagctcccag

SEQ ID NO: 1788379 - DNA, 18 bp, Homo sapiens
tctctcagctcccaggcc

SEQ ID NO: 1788380 - DNA, 15 bp, Homo sapiens
tctctcaggagcaca

SEQ ID NO: 1788381 - DNA, 17 bp, Homo sapiens
tctctcaggagcacagg

SEQ ID NO: 1788382 - DNA, 22 bp, Homo sapiens
tctctcaggagcacaggcagct

SEQ ID NO: 1788383 - DNA, 21 bp, Homo sapiens
tctctcatcggaggcccatgc

SEQ ID NO: 1788384 - DNA, 22 bp, Homo sapiens
tctctcatctcttagctcccct

SEQ ID NO: 1788385 - DNA, 22 bp, Homo sapiens
tctctccaccccccacgtctgt

SEQ ID NO: 1788386 - DNA, 14 bp, Homo sapiens
tctctccactgctc

SEQ ID NO: 1788387 - DNA, 16 bp, Homo sapiens
tctctccagatgtttc

SEQ ID NO: 1788388 - DNA, 15 bp, Homo sapiens
tctctccagctgact

SEQ ID NO: 1788389 - DNA, 12 bp, Homo sapiens
tctctccagggt

SEQ ID NO: 1788390 - DNA, 18 bp, Homo sapiens
tctctccaggtcagcctg

SEQ ID NO: 1788391 - DNA, 19 bp, Homo sapiens
tctctcccaccccctcccc

SEQ ID NO: 1788392 - DNA, 20 bp, Homo sapiens
tctctcccatttcaggaatt

SEQ ID NO: 1788393 - DNA, 16 bp, Homo sapiens
tctctcccctctgcaa

SEQ ID NO: 1788394 - DNA, 19 bp, Homo sapiens
tctctccctccctctctca

SEQ ID NO: 1788395 - DNA, 21 bp, Homo sapiens
tctctccctccctctctcatg

SEQ ID NO: 1788396 - DNA, 16 bp, Homo sapiens
tctctccctggtctct

SEQ ID NO: 1788397 - DNA, 12 bp, Homo sapiens
tctctcctggcc

SEQ ID NO: 1788398 - DNA, 14 bp, Homo sapiens
tctctcctgtccaa

SEQ ID NO: 1788399 - DNA, 22 bp, Homo sapiens
tctctcctttctttttcttctt

SEQ ID NO: 1788400 - DNA, 14 bp, Homo sapiens
tctctctacctcca

SEQ ID NO: 1788401 - DNA, 13 bp, Homo sapiens
tctctctccaggg

SEQ ID NO: 1788402 - DNA, 12 bp, Homo sapiens
tctctctcctgt

SEQ ID NO: 1788403 - DNA, 13 bp, Homo sapiens
tctctctcctgtc

SEQ ID NO: 1788404 - DNA, 14 bp, Homo sapiens
tctctctctacaaa

SEQ ID NO: 1788405 - DNA, 14 bp, Homo sapiens
tctctctgaggaca

SEQ ID NO: 1788406 - DNA, 16 bp, Homo sapiens
tctctctgcccaaccc

SEQ ID NO: 1788407 - DNA, 13 bp, Homo sapiens
tctctctgcctgt

SEQ ID NO: 1788408 - DNA, 13 bp, Homo sapiens
tctctctggagcc

SEQ ID NO: 1788409 - DNA, 17 bp, Homo sapiens
tctctctggagcccctc

SEQ ID NO: 1788410 - DNA, 14 bp, Homo sapiens
tctctctggctcag

SEQ ID NO: 1788411 - DNA, 19 bp, Homo sapiens
tctctcttctgctccaccc

SEQ ID NO: 1788412 - DNA, 18 bp, Homo sapiens
tctctcttgtcctcttct

SEQ ID NO: 1788413 - DNA, 19 bp, Homo sapiens
tctctcttgtcctcttctg

SEQ ID NO: 1788414 - DNA, 15 bp, Homo sapiens
tctctctttcctcca

SEQ ID NO: 1788415 - DNA, 18 bp, Homo sapiens
tctctcttttcctcctcc

SEQ ID NO: 1788416 - DNA, 11 bp, Homo sapiens
tctctcttttg

SEQ ID NO: 1788417 - DNA, 16 bp, Homo sapiens
tctctgaacagaaaac

SEQ ID NO: 1788418 - DNA, 23 bp, Homo sapiens
tctctgaagagtgggtttcacaa

SEQ ID NO: 1788419 - DNA, 21 bp, Homo sapiens
tctctgacactgtgtaagaag

SEQ ID NO: 1788420 - DNA, 23 bp, Homo sapiens
tctctgacgcttgtgacagtgcc

SEQ ID NO: 1788421 - DNA, 14 bp, Homo sapiens
tctctgacttctgc

SEQ ID NO: 1788422 - DNA, 17 bp, Homo sapiens
tctctgacttctgcctg

SEQ ID NO: 1788423 - DNA, 12 bp, Homo sapiens
tctctgagactg

SEQ ID NO: 1788424 - DNA, 19 bp, Homo sapiens
tctctgagtcaaatccagt

SEQ ID NO: 1788425 - DNA, 14 bp, Homo sapiens
tctctgatcttgtg

SEQ ID NO: 1788426 - DNA, 23 bp, Homo sapiens
tctctgcaatttgtttaaagaat

SEQ ID NO: 1788427 - DNA, 11 bp, Homo sapiens
tctctgcagcc

SEQ ID NO: 1788428 - DNA, 17 bp, Homo sapiens
tctctgcagccagccca

SEQ ID NO: 1788429 - DNA, 19 bp, Homo sapiens
tctctgcagccagcccagc

SEQ ID NO: 1788430 - DNA, 16 bp, Homo sapiens
tctctgcagctgccgg

SEQ ID NO: 1788431 - DNA, 21 bp, Homo sapiens
tctctgccaacatgaggacag

SEQ ID NO: 1788432 - DNA, 18 bp, Homo sapiens
tctctgccatatcagtga

SEQ ID NO: 1788433 - DNA, 12 bp, Homo sapiens
tctctgcccaac

SEQ ID NO: 1788434 - DNA, 15 bp, Homo sapiens
tctctgcccagccgg

SEQ ID NO: 1788435 - DNA, 17 bp, Homo sapiens
tctctgccccagcctgt

SEQ ID NO: 1788436 - DNA, 18 bp, Homo sapiens
tctctgccccagcctgtc

SEQ ID NO: 1788437 - DNA, 22 bp, Homo sapiens
tctctgcccttgatcagcccca

SEQ ID NO: 1788438 - DNA, 16 bp, Homo sapiens
tctctgccgctacctc

SEQ ID NO: 1788439 - DNA, 12 bp, Homo sapiens
tctctgcctggg

SEQ ID NO: 1788440 - DNA, 21 bp, Homo sapiens
tctctgcgtgcagggacaaag

SEQ ID NO: 1788441 - DNA, 11 bp, Homo sapiens
tctctgctcca

SEQ ID NO: 1788442 - DNA, 13 bp, Homo sapiens
tctctgctccacc

SEQ ID NO: 1788443 - DNA, 11 bp, Homo sapiens
tctctgctcct

SEQ ID NO: 1788444 - DNA, 13 bp, Homo sapiens
tctctgctccttc

SEQ ID NO: 1788445 - DNA, 14 bp, Homo sapiens
tctctgctccttca

SEQ ID NO: 1788446 - DNA, 22 bp, Homo sapiens
tctctgctccttcactgttccc

SEQ ID NO: 1788447 - DNA, 13 bp, Homo sapiens
tctctgctctagc

SEQ ID NO: 1788448 - DNA, 17 bp, Homo sapiens
tctctgctctagccagg

SEQ ID NO: 1788449 - DNA, 14 bp, Homo sapiens
tctctgctggccca

SEQ ID NO: 1788450 - DNA, 15 bp, Homo sapiens
tctctgctggcccag

SEQ ID NO: 1788451 - DNA, 19 bp, Homo sapiens
tctctgctggcccagccaa

SEQ ID NO: 1788452 - DNA, 17 bp, Homo sapiens
tctctgctggggaaggg

SEQ ID NO: 1788453 - DNA, 11 bp, Homo sapiens
tctctgctgta

SEQ ID NO: 1788454 - DNA, 17 bp, Homo sapiens
tctctgcttacccttca

SEQ ID NO: 1788455 - DNA, 19 bp, Homo sapiens
tctctgcttacccttcacc

SEQ ID NO: 1788456 - DNA, 23 bp, Homo sapiens
tctctggaaatttagagttctag

SEQ ID NO: 1788457 - DNA, 22 bp, Homo sapiens
tctctggcccagaaagcctctc

SEQ ID NO: 1788458 - DNA, 11 bp, Homo sapiens
tctctggcctc

SEQ ID NO: 1788459 - DNA, 15 bp, Homo sapiens
tctctggcctcccac

SEQ ID NO: 1788460 - DNA, 18 bp, Homo sapiens
tctctggcctcccacccg

SEQ ID NO: 1788461 - DNA, 19 bp, Homo sapiens
tctctggcctcccacccga

SEQ ID NO: 1788462 - DNA, 16 bp, Homo sapiens
tctctggcttctctct

SEQ ID NO: 1788463 - DNA, 17 bp, Homo sapiens
tctctgggacctcctta

SEQ ID NO: 1788464 - DNA, 16 bp, Homo sapiens
tctctgggagaaaatc

SEQ ID NO: 1788465 - DNA, 22 bp, Homo sapiens
tctctgggagaaaatcatcaag

SEQ ID NO: 1788466 - DNA, 17 bp, Homo sapiens
tctctgggagcccagaa

SEQ ID NO: 1788467 - DNA, 20 bp, Homo sapiens
tctctgggagcccagaaccc

SEQ ID NO: 1788468 - DNA, 13 bp, Homo sapiens
tctctggtctcct

SEQ ID NO: 1788469 - DNA, 13 bp, Homo sapiens
tctctgtaagtgt

SEQ ID NO: 1788470 - DNA, 19 bp, Homo sapiens
tctctgtagtggccccctc

SEQ ID NO: 1788471 - DNA, 14 bp, Homo sapiens
tctctgtcccttgc

SEQ ID NO: 1788472 - DNA, 16 bp, Homo sapiens
tctctgtcctacttct

SEQ ID NO: 1788473 - DNA, 19 bp, Homo sapiens
tctctgtgagactcgagaa

SEQ ID NO: 1788474 - DNA, 20 bp, Homo sapiens
tctctgtggttttttttgaa

SEQ ID NO: 1788475 - DNA, 16 bp, Homo sapiens
tctctgtgtctaagat

SEQ ID NO: 1788476 - DNA, 22 bp, Homo sapiens
tctctgtgtctaagattctaga

SEQ ID NO: 1788477 - DNA, 12 bp, Homo sapiens
tctctgttaaca

SEQ ID NO: 1788478 - DNA, 15 bp, Homo sapiens
tctctgttaacatct

SEQ ID NO: 1788479 - DNA, 14 bp, Homo sapiens
tctctgttcttttc

SEQ ID NO: 1788480 - DNA, 14 bp, Homo sapiens
tctcttacctgtta

SEQ ID NO: 1788481 - DNA, 15 bp, Homo sapiens
tctcttagaaatact

SEQ ID NO: 1788482 - DNA, 22 bp, Homo sapiens
tctcttagctactgtatgcaaa

SEQ ID NO: 1788483 - DNA, 16 bp, Homo sapiens
tctcttagctcccctc

SEQ ID NO: 1788484 - DNA, 18 bp, Homo sapiens
tctcttagctcccctcca

SEQ ID NO: 1788485 - DNA, 15 bp, Homo sapiens
tctcttatagaatat

SEQ ID NO: 1788486 - DNA, 20 bp, Homo sapiens
tctcttatagaatatttatt

SEQ ID NO: 1788487 - DNA, 22 bp, Homo sapiens
tctcttatcctctctctcttct

SEQ ID NO: 1788488 - DNA, 14 bp, Homo sapiens
tctcttattctaat

SEQ ID NO: 1788489 - DNA, 17 bp, Homo sapiens
tctcttcactcccaata

SEQ ID NO: 1788490 - DNA, 13 bp, Homo sapiens
tctcttcagcccc

SEQ ID NO: 1788491 - DNA, 14 bp, Homo sapiens
tctcttcaggttct

SEQ ID NO: 1788492 - DNA, 23 bp, Homo sapiens
tctcttcaggttcttagtgtcac

SEQ ID NO: 1788493 - DNA, 13 bp, Homo sapiens
tctcttcagtctc

SEQ ID NO: 1788494 - DNA, 17 bp, Homo sapiens
tctcttcagtctctata

SEQ ID NO: 1788495 - DNA, 16 bp, Homo sapiens
tctcttcatgcttgac

SEQ ID NO: 1788496 - DNA, 17 bp, Homo sapiens
tctcttcccttcccaga

SEQ ID NO: 1788497 - DNA, 21 bp, Homo sapiens
tctcttcccttcccagaccag

SEQ ID NO: 1788498 - DNA, 11 bp, Homo sapiens
tctcttcctac

SEQ ID NO: 1788499 - DNA, 22 bp, Homo sapiens
tctcttcctcttcccccaagat

SEQ ID NO: 1788500 - DNA, 13 bp, Homo sapiens
tctcttcgctgtg

SEQ ID NO: 1788501 - DNA, 11 bp, Homo sapiens
tctcttctcca

SEQ ID NO: 1788502 - DNA, 14 bp, Homo sapiens
tctcttctccactg

SEQ ID NO: 1788503 - DNA, 14 bp, Homo sapiens
tctcttctctccag

SEQ ID NO: 1788504 - DNA, 21 bp, Homo sapiens
tctcttctgagctatttcatc

SEQ ID NO: 1788505 - DNA, 22 bp, Homo sapiens
tctcttctgagctatttcatct

SEQ ID NO: 1788506 - DNA, 13 bp, Homo sapiens
tctcttctgctcc

SEQ ID NO: 1788507 - DNA, 17 bp, Homo sapiens
tctcttctgctccaccc

SEQ ID NO: 1788508 - DNA, 19 bp, Homo sapiens
tctcttctgctccaccctt

SEQ ID NO: 1788509 - DNA, 23 bp, Homo sapiens
tctcttgaaaagttcagggaccg

SEQ ID NO: 1788510 - DNA, 19 bp, Homo sapiens
tctcttgaaacctgttaaa

SEQ ID NO: 1788511 - DNA, 22 bp, Homo sapiens
tctcttgagcatcaatcttgtt

SEQ ID NO: 1788512 - DNA, 14 bp, Homo sapiens
tctcttgagctggc

SEQ ID NO: 1788513 - DNA, 15 bp, Homo sapiens
tctcttgagctggcc

SEQ ID NO: 1788514 - DNA, 14 bp, Homo sapiens
tctcttgagtttgt

SEQ ID NO: 1788515 - DNA, 14 bp, Homo sapiens
tctcttgcacccgc

SEQ ID NO: 1788516 - DNA, 21 bp, Homo sapiens
tctcttgcattgtgacaagaa

SEQ ID NO: 1788517 - DNA, 13 bp, Homo sapiens
tctcttggctgca

SEQ ID NO: 1788518 - DNA, 20 bp, Homo sapiens
tctcttggtatgcatctttt

SEQ ID NO: 1788519 - DNA, 17 bp, Homo sapiens
tctcttggtttccttcc

SEQ ID NO: 1788520 - DNA, 13 bp, Homo sapiens
tctcttgtagaag

SEQ ID NO: 1788521 - DNA, 16 bp, Homo sapiens
tctctttaaccctccc

SEQ ID NO: 1788522 - DNA, 20 bp, Homo sapiens
tctctttaatcttcagtttt

SEQ ID NO: 1788523 - DNA, 11 bp, Homo sapiens
tctctttcctt

SEQ ID NO: 1788524 - DNA, 17 bp, Homo sapiens
tctctttgataacaaaa

SEQ ID NO: 1788525 - DNA, 19 bp, Homo sapiens
tctctttgataacaaaaaa

SEQ ID NO: 1788526 - DNA, 18 bp, Homo sapiens
tctctttggaaatagcat

SEQ ID NO: 1788527 - DNA, 19 bp, Homo sapiens
tctctttggaaatagcatg

SEQ ID NO: 1788528 - DNA, 20 bp, Homo sapiens
tctcttttcccctttcctgt

SEQ ID NO: 1788529 - DNA, 12 bp, Homo sapiens
tctcttttcctc

SEQ ID NO: 1788530 - DNA, 14 bp, Homo sapiens
tctcttttcctcct

SEQ ID NO: 1788531 - DNA, 19 bp, Homo sapiens
tctcttttctttctgtctt

SEQ ID NO: 1788532 - DNA, 18 bp, Homo sapiens
tctcttttgaaagtagag

SEQ ID NO: 1788533 - DNA, 20 bp, Homo sapiens
tctcttttgaatccatgctt

SEQ ID NO: 1788534 - DNA, 16 bp, Homo sapiens
tctcttttttaaaaac

SEQ ID NO: 1788535 - DNA, 23 bp, Homo sapiens
tctgaaaagtgtgtatatatttt

SEQ ID NO: 1788536 - DNA, 14 bp, Homo sapiens
tctgaaaatgtatg

SEQ ID NO: 1788537 - DNA, 22 bp, Homo sapiens
tctgaaaccttagtttcaagag

SEQ ID NO: 1788538 - DNA, 22 bp, Homo sapiens
tctgaaagagtctttcttcttc

SEQ ID NO: 1788539 - DNA, 16 bp, Homo sapiens
tctgaaaggagacatt

SEQ ID NO: 1788540 - DNA, 23 bp, Homo sapiens
tctgaaaggagacattgctctat

SEQ ID NO: 1788541 - DNA, 17 bp, Homo sapiens
tctgaaataggaaacaa

SEQ ID NO: 1788542 - DNA, 15 bp, Homo sapiens
tctgaaatctgaaga

SEQ ID NO: 1788543 - DNA, 22 bp, Homo sapiens
tctgaacacagtttagtgcttt

SEQ ID NO: 1788544 - DNA, 21 bp, Homo sapiens
tctgaacccttgtgcttggtg

SEQ ID NO: 1788545 - DNA, 16 bp, Homo sapiens
tctgaactcaaactga

SEQ ID NO: 1788546 - DNA, 17 bp, Homo sapiens
tctgaactcaaactgag

SEQ ID NO: 1788547 - DNA, 20 bp, Homo sapiens
tctgaactccatacagcctc

SEQ ID NO: 1788548 - DNA, 18 bp, Homo sapiens
tctgaacttgcattgtga

SEQ ID NO: 1788549 - DNA, 13 bp, Homo sapiens
tctgaagatcaga

SEQ ID NO: 1788550 - DNA, 18 bp, Homo sapiens
tctgaagatctaaacttt

SEQ ID NO: 1788551 - DNA, 16 bp, Homo sapiens
tctgaagcttgactcc

SEQ ID NO: 1788552 - DNA, 20 bp, Homo sapiens
tctgaaggaatagccagaga

SEQ ID NO: 1788553 - DNA, 21 bp, Homo sapiens
tctgaaggaatagccagagag

SEQ ID NO: 1788554 - DNA, 20 bp, Homo sapiens
tctgaaggacacttcctgcc

SEQ ID NO: 1788555 - DNA, 17 bp, Homo sapiens
tctgaaggcaaatataa

SEQ ID NO: 1788556 - DNA, 13 bp, Homo sapiens
tctgaagtactta

SEQ ID NO: 1788557 - DNA, 21 bp, Homo sapiens
tctgaagtatggtattacaaa

SEQ ID NO: 1788558 - DNA, 22 bp, Homo sapiens
tctgaagtatggtattacaaaa

SEQ ID NO: 1788559 - DNA, 16 bp, Homo sapiens
tctgaatattctagaa

SEQ ID NO: 1788560 - DNA, 12 bp, Homo sapiens
tctgaatatttt

SEQ ID NO: 1788561 - DNA, 19 bp, Homo sapiens
tctgaatctcaagatgggg

SEQ ID NO: 1788562 - DNA, 18 bp, Homo sapiens
tctgaattgctatgtgaa

SEQ ID NO: 1788563 - DNA, 14 bp, Homo sapiens
tctgaattggaagg

SEQ ID NO: 1788564 - DNA, 19 bp, Homo sapiens
tctgaatttatctttgata

SEQ ID NO: 1788565 - DNA, 21 bp, Homo sapiens
tctgaatttatctttgataac

SEQ ID NO: 1788566 - DNA, 14 bp, Homo sapiens
tctgaattttcaga

SEQ ID NO: 1788567 - DNA, 16 bp, Homo sapiens
tctgaattttgcaatg

SEQ ID NO: 1788568 - DNA, 18 bp, Homo sapiens
tctgaattttgcaatgta

SEQ ID NO: 1788569 - DNA, 19 bp, Homo sapiens
tctgaattttgcaatgtat

SEQ ID NO: 1788570 - DNA, 19 bp, Homo sapiens
tctgacaaaggtggtaaat

SEQ ID NO: 1788571 - DNA, 14 bp, Homo sapiens
tctgacacaaaaaa

SEQ ID NO: 1788572 - DNA, 19 bp, Homo sapiens
tctgacagtccttggggtt

SEQ ID NO: 1788573 - DNA, 14 bp, Homo sapiens
tctgacatcccttc

SEQ ID NO: 1788574 - DNA, 16 bp, Homo sapiens
tctgacatcccttcct

SEQ ID NO: 1788575 - DNA, 17 bp, Homo sapiens
tctgacatcccttcctg

SEQ ID NO: 1788576 - DNA, 16 bp, Homo sapiens
tctgacatgtaagaaa

SEQ ID NO: 1788577 - DNA, 13 bp, Homo sapiens
tctgaccatctgt

SEQ ID NO: 1788578 - DNA, 22 bp, Homo sapiens
tctgacccaagtggggcctcct

SEQ ID NO: 1788579 - DNA, 17 bp, Homo sapiens
tctgacccactttgtaa

SEQ ID NO: 1788580 - DNA, 19 bp, Homo sapiens
tctgacccagtgcccccac

SEQ ID NO: 1788581 - DNA, 23 bp, Homo sapiens
tctgacccagtgcccccactgac

SEQ ID NO: 1788582 - DNA, 20 bp, Homo sapiens
tctgaccgattcctttatat

SEQ ID NO: 1788583 - DNA, 23 bp, Homo sapiens
tctgacctaaaagttgaaaagcc

SEQ ID NO: 1788584 - DNA, 14 bp, Homo sapiens
tctgacctgcaggc

SEQ ID NO: 1788585 - DNA, 15 bp, Homo sapiens
tctgacctgcaggcc

SEQ ID NO: 1788586 - DNA, 17 bp, Homo sapiens
tctgacctgcaggccaa

SEQ ID NO: 1788587 - DNA, 21 bp, Homo sapiens
tctgacctgcaggccaagagc

SEQ ID NO: 1788588 - DNA, 13 bp, Homo sapiens
tctgacgcttgtg

SEQ ID NO: 1788589 - DNA, 13 bp, Homo sapiens
tctgactagttta

SEQ ID NO: 1788590 - DNA, 12 bp, Homo sapiens
tctgactccaga

SEQ ID NO: 1788591 - DNA, 15 bp, Homo sapiens
tctgactccagagtc

SEQ ID NO: 1788592 - DNA, 19 bp, Homo sapiens
tctgactccagagtctgag

SEQ ID NO: 1788593 - DNA, 18 bp, Homo sapiens
tctgactcggtttctcca

SEQ ID NO: 1788594 - DNA, 19 bp, Homo sapiens
tctgactcggtttctccaa

SEQ ID NO: 1788595 - DNA, 20 bp, Homo sapiens
tctgactgccaaataaatca

SEQ ID NO: 1788596 - DNA, 17 bp, Homo sapiens
tctgactgccaagccag

SEQ ID NO: 1788597 - DNA, 23 bp, Homo sapiens
tctgactgccaagccagattctc

SEQ ID NO: 1788598 - DNA, 11 bp, Homo sapiens
tctgactgttt

SEQ ID NO: 1788599 - DNA, 22 bp, Homo sapiens
tctgactgtttatttaaggatg

SEQ ID NO: 1788600 - DNA, 14 bp, Homo sapiens
tctgacttcctctg

SEQ ID NO: 1788601 - DNA, 15 bp, Homo sapiens
tctgacttctgcctg

SEQ ID NO: 1788602 - DNA, 12 bp, Homo sapiens
tctgacttttgt

SEQ ID NO: 1788603 - DNA, 20 bp, Homo sapiens
tctgagaaacctgttgaaga

SEQ ID NO: 1788604 - DNA, 11 bp, Homo sapiens
tctgagaagac

SEQ ID NO: 1788605 - DNA, 20 bp, Homo sapiens
tctgagaaggtccttaatga

SEQ ID NO: 1788606 - DNA, 19 bp, Homo sapiens
tctgagacaaagcaatgga

SEQ ID NO: 1788607 - DNA, 18 bp, Homo sapiens
tctgagacccttttctca

SEQ ID NO: 1788608 - DNA, 22 bp, Homo sapiens
tctgagacccttttctcaggac

SEQ ID NO: 1788609 - DNA, 14 bp, Homo sapiens
tctgagagatttgg

SEQ ID NO: 1788610 - DNA, 16 bp, Homo sapiens
tctgagaggctctccg

SEQ ID NO: 1788611 - DNA, 19 bp, Homo sapiens
tctgagaggctctccgtgc

SEQ ID NO: 1788612 - DNA, 19 bp, Homo sapiens
tctgagagtctagattctc

SEQ ID NO: 1788613 - DNA, 20 bp, Homo sapiens
tctgagagttggctcaggca

SEQ ID NO: 1788614 - DNA, 21 bp, Homo sapiens
tctgagagttggctcaggcag

SEQ ID NO: 1788615 - DNA, 22 bp, Homo sapiens
tctgagcaaactatttgcgact

SEQ ID NO: 1788616 - DNA, 22 bp, Homo sapiens
tctgagcaaggagtttaaatga

SEQ ID NO: 1788617 - DNA, 22 bp, Homo sapiens
tctgagcactgtttatacactg

SEQ ID NO: 1788618 - DNA, 16 bp, Homo sapiens
tctgagcataatgctc

SEQ ID NO: 1788619 - DNA, 23 bp, Homo sapiens
tctgagcattcgctgtacccttt

SEQ ID NO: 1788620 - DNA, 15 bp, Homo sapiens
tctgagcccaggccg

SEQ ID NO: 1788621 - DNA, 23 bp, Homo sapiens
tctgagcccccggctagtaccct

SEQ ID NO: 1788622 - DNA, 13 bp, Homo sapiens
tctgagcccgggc

SEQ ID NO: 1788623 - DNA, 17 bp, Homo sapiens
tctgagcccgggctgcc

SEQ ID NO: 1788624 - DNA, 11 bp, Homo sapiens
tctgagccctg

SEQ ID NO: 1788625 - DNA, 15 bp, Homo sapiens
tctgagccctggtgt

SEQ ID NO: 1788626 - DNA, 15 bp, Homo sapiens
tctgagcctgatatt

SEQ ID NO: 1788627 - DNA, 17 bp, Homo sapiens
tctgagccttgagagaa

SEQ ID NO: 1788628 - DNA, 18 bp, Homo sapiens
tctgagccttgagagaaa

SEQ ID NO: 1788629 - DNA, 22 bp, Homo sapiens
tctgagcggcgcagagccctcc

SEQ ID NO: 1788630 - DNA, 17 bp, Homo sapiens
tctgagctccacctctg

SEQ ID NO: 1788631 - DNA, 22 bp, Homo sapiens
tctgagcttttcatggaagtgg

SEQ ID NO: 1788632 - DNA, 19 bp, Homo sapiens
tctgaggacagaggccggg

SEQ ID NO: 1788633 - DNA, 14 bp, Homo sapiens
tctgaggccctgcc

SEQ ID NO: 1788634 - DNA, 23 bp, Homo sapiens
tctgaggcctcctctctcagttt

SEQ ID NO: 1788635 - DNA, 21 bp, Homo sapiens
tctgaggctctttctgggcca

SEQ ID NO: 1788636 - DNA, 18 bp, Homo sapiens
tctgagggaggaggccac

SEQ ID NO: 1788637 - DNA, 23 bp, Homo sapiens
tctgagggaggaggccacctctc

SEQ ID NO: 1788638 - DNA, 21 bp, Homo sapiens
tctgaggtgcctgtcccaccc

SEQ ID NO: 1788639 - DNA, 20 bp, Homo sapiens
tctgagtaactggttgctgt

SEQ ID NO: 1788640 - DNA, 21 bp, Homo sapiens
tctgagtcaaatccagtggtg

SEQ ID NO: 1788641 - DNA, 22 bp, Homo sapiens
tctgagtcaaatccagtggtgg

SEQ ID NO: 1788642 - DNA, 23 bp, Homo sapiens
tctgagtcccaggagctgcccag

SEQ ID NO: 1788643 - DNA, 18 bp, Homo sapiens
tctgagtcctgtctctgc

SEQ ID NO: 1788644 - DNA, 22 bp, Homo sapiens
tctgagtcctgtctctgcctgc

SEQ ID NO: 1788645 - DNA, 12 bp, Homo sapiens
tctgagtctatg

SEQ ID NO: 1788646 - DNA, 22 bp, Homo sapiens
tctgagtctatgttcaaagact

SEQ ID NO: 1788647 - DNA, 17 bp, Homo sapiens
tctgagtctgagtcctg

SEQ ID NO: 1788648 - DNA, 24 bp, Homo sapiens
tctgagtgtttttactacagttgt

SEQ ID NO: 1788649 - DNA, 20 bp, Homo sapiens
tctgagttttgtgtttgttg

SEQ ID NO: 1788650 - DNA, 15 bp, Homo sapiens
tctgatatgggactg

SEQ ID NO: 1788651 - DNA, 14 bp, Homo sapiens
tctgatcaagagtc

SEQ ID NO: 1788652 - DNA, 15 bp, Homo sapiens
tctgatcaatttgaa

SEQ ID NO: 1788653 - DNA, 22 bp, Homo sapiens
tctgatcacattcttcaaagac

SEQ ID NO: 1788654 - DNA, 18 bp, Homo sapiens
tctgatctaacaaaataa

SEQ ID NO: 1788655 - DNA, 13 bp, Homo sapiens
tctgatctataca

SEQ ID NO: 1788656 - DNA, 15 bp, Homo sapiens
tctgatcttgtgctc

SEQ ID NO: 1788657 - DNA, 19 bp, Homo sapiens
tctgatcttgtgctcagca

SEQ ID NO: 1788658 - DNA, 13 bp, Homo sapiens
tctgatgaatctc

SEQ ID NO: 1788659 - DNA, 13 bp, Homo sapiens
tctgatggcctta

SEQ ID NO: 1788660 - DNA, 21 bp, Homo sapiens
tctgatggccttaatttcctt

SEQ ID NO: 1788661 - DNA, 22 bp, Homo sapiens
tctgatggccttaatttccttt

SEQ ID NO: 1788662 - DNA, 22 bp, Homo sapiens
tctgatgtccatttgtcccaat

SEQ ID NO: 1788663 - DNA, 15 bp, Homo sapiens
tctgatgtttctgtg

SEQ ID NO: 1788664 - DNA, 16 bp, Homo sapiens
tctgatgtttctgtga

SEQ ID NO: 1788665 - DNA, 18 bp, Homo sapiens
tctgatgtttctgtgaaa

SEQ ID NO: 1788666 - DNA, 21 bp, Homo sapiens
tctgattagagtgcaaaagtg

SEQ ID NO: 1788667 - DNA, 15 bp, Homo sapiens
tctgattggacattt

SEQ ID NO: 1788668 - DNA, 19 bp, Homo sapiens
tctgattggacattttctt

SEQ ID NO: 1788669 - DNA, 20 bp, Homo sapiens
tctgattggacattttcttc

SEQ ID NO: 1788670 - DNA, 14 bp, Homo sapiens
tctgattggctgct

SEQ ID NO: 1788671 - DNA, 16 bp, Homo sapiens
tctgatttcagttttt

SEQ ID NO: 1788672 - DNA, 21 bp, Homo sapiens
tctgatttcagtttttcattt

SEQ ID NO: 1788673 - DNA, 19 bp, Homo sapiens
tctgatttgctgctcttca

SEQ ID NO: 1788674 - DNA, 12 bp, Homo sapiens
tctgattttaat

SEQ ID NO: 1788675 - DNA, 13 bp, Homo sapiens
tctgattttctca

SEQ ID NO: 1788676 - DNA, 15 bp, Homo sapiens
tctgattttgcttct

SEQ ID NO: 1788677 - DNA, 19 bp, Homo sapiens
tctgcaaacaatgaagaat

SEQ ID NO: 1788678 - DNA, 16 bp, Homo sapiens
tctgcaaatagtttca

SEQ ID NO: 1788679 - DNA, 14 bp, Homo sapiens
tctgcaacactttg

SEQ ID NO: 1788680 - DNA, 17 bp, Homo sapiens
tctgcaactagccaagg

SEQ ID NO: 1788681 - DNA, 18 bp, Homo sapiens
tctgcaagggcccagagt

SEQ ID NO: 1788682 - DNA, 18 bp, Homo sapiens
tctgcaattcccctctgc

SEQ ID NO: 1788683 - DNA, 13 bp, Homo sapiens
tctgcacagatgg

SEQ ID NO: 1788684 - DNA, 19 bp, Homo sapiens
tctgcacagtcagaaggac

SEQ ID NO: 1788685 - DNA, 20 bp, Homo sapiens
tctgcacataaactctttta

SEQ ID NO: 1788686 - DNA, 23 bp, Homo sapiens
tctgcacatgaatcccacccaca

SEQ ID NO: 1788687 - DNA, 17 bp, Homo sapiens
tctgcacatgtcttgta

SEQ ID NO: 1788688 - DNA, 20 bp, Homo sapiens
tctgcaccccttctctcctc

SEQ ID NO: 1788689 - DNA, 14 bp, Homo sapiens
tctgcacccgcctc

SEQ ID NO: 1788690 - DNA, 18 bp, Homo sapiens
tctgcacccgcctcgacc

SEQ ID NO: 1788691 - DNA, 16 bp, Homo sapiens
tctgcaccctccaccc

SEQ ID NO: 1788692 - DNA, 23 bp, Homo sapiens
tctgcaccctggggcctggacct

SEQ ID NO: 1788693 - DNA, 12 bp, Homo sapiens
tctgcactactc

SEQ ID NO: 1788694 - DNA, 20 bp, Homo sapiens
tctgcactccatggccaccc

SEQ ID NO: 1788695 - DNA, 15 bp, Homo sapiens
tctgcagaaacagaa

SEQ ID NO: 1788696 - DNA, 21 bp, Homo sapiens
tctgcagaagccaagggaaga

SEQ ID NO: 1788697 - DNA, 23 bp, Homo sapiens
tctgcagaagccaagggaagaca

SEQ ID NO: 1788698 - DNA, 22 bp, Homo sapiens
tctgcagaatccctttgcacct

SEQ ID NO: 1788699 - DNA, 19 bp, Homo sapiens
tctgcagacacgccttccc

SEQ ID NO: 1788700 - DNA, 22 bp, Homo sapiens
tctgcagacgtctgccttggca

SEQ ID NO: 1788701 - DNA, 19 bp, Homo sapiens
tctgcagatcttccgtggt

SEQ ID NO: 1788702 - DNA, 21 bp, Homo sapiens
tctgcagcacctcacctgaga

SEQ ID NO: 1788703 - DNA, 16 bp, Homo sapiens
tctgcagcatgacctg

SEQ ID NO: 1788704 - DNA, 15 bp, Homo sapiens
tctgcagccagccca

SEQ ID NO: 1788705 - DNA, 19 bp, Homo sapiens
tctgcagccagcccagccc

SEQ ID NO: 1788706 - DNA, 23 bp, Homo sapiens
tctgcagcccggcgccaccatcc

SEQ ID NO: 1788707 - DNA, 23 bp, Homo sapiens
tctgcagctcaagggctggcact

SEQ ID NO: 1788708 - DNA, 14 bp, Homo sapiens
tctgcagctgacct

SEQ ID NO: 1788709 - DNA, 19 bp, Homo sapiens
tctgcaggccactgtgagc

SEQ ID NO: 1788710 - DNA, 17 bp, Homo sapiens
tctgcagtcatctcccc

SEQ ID NO: 1788711 - DNA, 13 bp, Homo sapiens
tctgcagtcctgg

SEQ ID NO: 1788712 - DNA, 14 bp, Homo sapiens
tctgcagtgccttg

SEQ ID NO: 1788713 - DNA, 18 bp, Homo sapiens
tctgcataagtaattaaa

SEQ ID NO: 1788714 - DNA, 19 bp, Homo sapiens
tctgcatcagctgctgaaa

SEQ ID NO: 1788715 - DNA, 17 bp, Homo sapiens
tctgcatctactcccaa

SEQ ID NO: 1788716 - DNA, 13 bp, Homo sapiens
tctgcattcctga

SEQ ID NO: 1788717 - DNA, 18 bp, Homo sapiens
tctgcattgctagataaa

SEQ ID NO: 1788718 - DNA, 22 bp, Homo sapiens
tctgcattgttattgtggaaga

SEQ ID NO: 1788719 - DNA, 13 bp, Homo sapiens
tctgccaaacaca

SEQ ID NO: 1788720 - DNA, 19 bp, Homo sapiens
tctgccaacatgaggacag

SEQ ID NO: 1788721 - DNA, 21 bp, Homo sapiens
tctgccaacatgaggacagaa

SEQ ID NO: 1788722 - DNA, 22 bp, Homo sapiens
tctgccaacatgaggacagaag

SEQ ID NO: 1788723 - DNA, 14 bp, Homo sapiens
tctgccacctcccc

SEQ ID NO: 1788724 - DNA, 15 bp, Homo sapiens
tctgccactgaggag

SEQ ID NO: 1788725 - DNA, 14 bp, Homo sapiens
tctgccactggaag

SEQ ID NO: 1788726 - DNA, 15 bp, Homo sapiens
tctgccagccagcag

SEQ ID NO: 1788727 - DNA, 17 bp, Homo sapiens
tctgccagccagcagcc

SEQ ID NO: 1788728 - DNA, 16 bp, Homo sapiens
tctgccaggcccatct

SEQ ID NO: 1788729 - DNA, 13 bp, Homo sapiens
tctgccaggcctg

SEQ ID NO: 1788730 - DNA, 22 bp, Homo sapiens
tctgccaggcctgtatgaggct

SEQ ID NO: 1788731 - DNA, 21 bp, Homo sapiens
tctgccagtgacagacaggct

SEQ ID NO: 1788732 - DNA, 15 bp, Homo sapiens
tctgccattgggacc

SEQ ID NO: 1788733 - DNA, 17 bp, Homo sapiens
tctgccattgggaccct

SEQ ID NO: 1788734 - DNA, 18 bp, Homo sapiens
tctgcccacattggaccc

SEQ ID NO: 1788735 - DNA, 20 bp, Homo sapiens
tctgcccacctcggcctccc

SEQ ID NO: 1788736 - DNA, 19 bp, Homo sapiens
tctgcccacgatcccctcc

SEQ ID NO: 1788737 - DNA, 21 bp, Homo sapiens
tctgcccacgatcccctcccc

SEQ ID NO: 1788738 - DNA, 23 bp, Homo sapiens
tctgcccacgatcccctccccca

SEQ ID NO: 1788739 - DNA, 12 bp, Homo sapiens
tctgcccagctt

SEQ ID NO: 1788740 - DNA, 16 bp, Homo sapiens
tctgcccagcttgggc

SEQ ID NO: 1788741 - DNA, 12 bp, Homo sapiens
tctgccccaagc

SEQ ID NO: 1788742 - DNA, 14 bp, Homo sapiens
tctgccccaagcag

SEQ ID NO: 1788743 - DNA, 15 bp, Homo sapiens
tctgccccaagcccc

SEQ ID NO: 1788744 - DNA, 20 bp, Homo sapiens
tctgccccagctctggcttc

SEQ ID NO: 1788745 - DNA, 19 bp, Homo sapiens
tctggggggatatttccta

SEQ ID NO: 1788746 - DNA, 15 bp, Homo sapiens
tctgggggtcctctc

SEQ ID NO: 1788747 - DNA, 17 bp, Homo sapiens
tctgggggtcctctctg

SEQ ID NO: 1788748 - DNA, 16 bp, Homo sapiens
tctgggtatctttcca

SEQ ID NO: 1788749 - DNA, 22 bp, Homo sapiens
tctgggtctgattttctcactg

SEQ ID NO: 1788750 - DNA, 18 bp, Homo sapiens
tctgggtggaagtgccca

SEQ ID NO: 1788751 - DNA, 19 bp, Homo sapiens
tctgggtggtaactgccag

SEQ ID NO: 1788752 - DNA, 21 bp, Homo sapiens
tctgggtggtaactgccagcc

SEQ ID NO: 1788753 - DNA, 14 bp, Homo sapiens
tctgggtttctaag

SEQ ID NO: 1788754 - DNA, 14 bp, Homo sapiens
tctggtaggaagat

SEQ ID NO: 1788755 - DNA, 14 bp, Homo sapiens
tctggtcccttgca

SEQ ID NO: 1788756 - DNA, 13 bp, Homo sapiens
tctggtccttttt

SEQ ID NO: 1788757 - DNA, 15 bp, Homo sapiens
tctggtcgctcctgc

SEQ ID NO: 1788758 - DNA, 19 bp, Homo sapiens
tctggtctactctagaaga

SEQ ID NO: 1788759 - DNA, 17 bp, Homo sapiens
tctggtgacaccagcct

SEQ ID NO: 1788760 - DNA, 20 bp, Homo sapiens
tctggtgagtcaccacttca

SEQ ID NO: 1788761 - DNA, 15 bp, Homo sapiens
tctggtgcagaatat

SEQ ID NO: 1788762 - DNA, 12 bp, Homo sapiens
tctggtgctgag

SEQ ID NO: 1788763 - DNA, 13 bp, Homo sapiens
tctggtggctcct

SEQ ID NO: 1788764 - DNA, 21 bp, Homo sapiens
tctggtggggctgtcctgctg

SEQ ID NO: 1788765 - DNA, 16 bp, Homo sapiens
tctggtgtaggaagtt

SEQ ID NO: 1788766 - DNA, 19 bp, Homo sapiens
tctggtgtatattttaatg

SEQ ID NO: 1788767 - DNA, 16 bp, Homo sapiens
tctggtgtgtggtgag

SEQ ID NO: 1788768 - DNA, 14 bp, Homo sapiens
tctggttccagggt

SEQ ID NO: 1788769 - DNA, 12 bp, Homo sapiens
tctggttccatt

SEQ ID NO: 1788770 - DNA, 11 bp, Homo sapiens
tctggttctaa

SEQ ID NO: 1788771 - DNA, 15 bp, Homo sapiens
tctggttgaactctg

SEQ ID NO: 1788772 - DNA, 12 bp, Homo sapiens
tctggttgcttc

SEQ ID NO: 1788773 - DNA, 23 bp, Homo sapiens
tctggttgtttttgttctttgtg

SEQ ID NO: 1788774 - DNA, 19 bp, Homo sapiens
tctgtaaaaaatggagctc

SEQ ID NO: 1788775 - DNA, 15 bp, Homo sapiens
tctgtaaactgtgta

SEQ ID NO: 1788776 - DNA, 12 bp, Homo sapiens
tctgtaaatatg

SEQ ID NO: 1788777 - DNA, 16 bp, Homo sapiens
tctgtaaatatgtttt

SEQ ID NO: 1788778 - DNA, 14 bp, Homo sapiens
tctgtaaattttta

SEQ ID NO: 1788779 - DNA, 15 bp, Homo sapiens
tctgtaagagaaaat

SEQ ID NO: 1788780 - DNA, 13 bp, Homo sapiens
tctgtaatgtaaa

SEQ ID NO: 1788781 - DNA, 20 bp, Homo sapiens
tctgtaattcaggtttttcc

SEQ ID NO: 1788782 - DNA, 14 bp, Homo sapiens
tctgtaattcattg

SEQ ID NO: 1788783 - DNA, 19 bp, Homo sapiens
tctgtacagaatgctattt

SEQ ID NO: 1788784 - DNA, 17 bp, Homo sapiens
tctgtacagatcaagaa

SEQ ID NO: 1788785 - DNA, 15 bp, Homo sapiens
tctgtacatactgtt

SEQ ID NO: 1788786 - DNA, 17 bp, Homo sapiens
tctgtaccgcccggcag

SEQ ID NO: 1788787 - DNA, 22 bp, Homo sapiens
tctgtaccgcccggcagcccct

SEQ ID NO: 1788788 - DNA, 22 bp, Homo sapiens
tctgtactaaacagtaagatat

SEQ ID NO: 1788789 - DNA, 19 bp, Homo sapiens
tcttgccagccagaagcct

SEQ ID NO: 1788790 - DNA, 13 bp, Homo sapiens
tcttgcccatcct

SEQ ID NO: 1788791 - DNA, 18 bp, Homo sapiens
tcttgcccatcctgactg

SEQ ID NO: 1788792 - DNA, 22 bp, Homo sapiens
tcttgcccgcacccctccctgc

SEQ ID NO: 1788793 - DNA, 20 bp, Homo sapiens
tcttgcctatattttcctga

SEQ ID NO: 1788794 - DNA, 16 bp, Homo sapiens
tcttgcctctgtcccc

SEQ ID NO: 1788795 - DNA, 22 bp, Homo sapiens
tcttgcctctgtccccttctct

SEQ ID NO: 1788796 - DNA, 19 bp, Homo sapiens
tcttgcctctgtgctgtgt

SEQ ID NO: 1788797 - DNA, 21 bp, Homo sapiens
tcttgcctgcctaacaaaata

SEQ ID NO: 1788798 - DNA, 16 bp, Homo sapiens
tcttgcctgtttccca

SEQ ID NO: 1788799 - DNA, 16 bp, Homo sapiens
tcttgcgatccttaat

SEQ ID NO: 1788800 - DNA, 14 bp, Homo sapiens
tcttgcgggcctgg

SEQ ID NO: 1788801 - DNA, 17 bp, Homo sapiens
tcttgcgggcctggaca

SEQ ID NO: 1788802 - DNA, 14 bp, Homo sapiens
tcttgctaccagta

SEQ ID NO: 1788803 - DNA, 19 bp, Homo sapiens
tcttgctatatgatttagc

SEQ ID NO: 1788804 - DNA, 18 bp, Homo sapiens
tcttgctatttgagcatg

SEQ ID NO: 1788805 - DNA, 18 bp, Homo sapiens
tcttgctcaaaaatctgt

SEQ ID NO: 1788806 - DNA, 14 bp, Homo sapiens
tcttgctcagagct

SEQ ID NO: 1788807 - DNA, 16 bp, Homo sapiens
tcttgctcagagctag

SEQ ID NO: 1788808 - DNA, 11 bp, Homo sapiens
tcttgctctct

SEQ ID NO: 1788809 - DNA, 23 bp, Homo sapiens
tcttgcttccctaatctatggtc

SEQ ID NO: 1788810 - DNA, 11 bp, Homo sapiens
tcttgcttctt

SEQ ID NO: 1788811 - DNA, 14 bp, Homo sapiens
tcttgcttgaactt

SEQ ID NO: 1788812 - DNA, 20 bp, Homo sapiens
tcttgcttggggaacttgtg

SEQ ID NO: 1788813 - DNA, 13 bp, Homo sapiens
tcttgctttcaca

SEQ ID NO: 1788814 - DNA, 16 bp, Homo sapiens
tcttggaactgtccca

SEQ ID NO: 1788815 - DNA, 16 bp, Homo sapiens
tcttggacactgtaca

SEQ ID NO: 1788816 - DNA, 14 bp, Homo sapiens
tcttggaccttggc

SEQ ID NO: 1788817 - DNA, 17 bp, Homo sapiens
tcttggagaagtctcag

SEQ ID NO: 1788818 - DNA, 14 bp, Homo sapiens
tcttggcaaatttt

SEQ ID NO: 1788819 - DNA, 14 bp, Homo sapiens
tcttggccagccaa

SEQ ID NO: 1788820 - DNA, 13 bp, Homo sapiens
tcttggcccctgt

SEQ ID NO: 1788821 - DNA, 16 bp, Homo sapiens
tcttggcccctgtgtg

SEQ ID NO: 1788822 - DNA, 12 bp, Homo sapiens
tcttggcctccc

SEQ ID NO: 1788823 - DNA, 22 bp, Homo sapiens
tcttggcctcccaaagtgctgg

SEQ ID NO: 1788824 - DNA, 18 bp, Homo sapiens
tcttggcggcagcagcca

SEQ ID NO: 1788825 - DNA, 23 bp, Homo sapiens
tcttggctattgaagatgctgcc

SEQ ID NO: 1788826 - DNA, 13 bp, Homo sapiens
tcttggctgaccc

SEQ ID NO: 1788827 - DNA, 21 bp, Homo sapiens
tcttggcttaatcattttcat

SEQ ID NO: 1788828 - DNA, 18 bp, Homo sapiens
tcttgggaagtgtgttta

SEQ ID NO: 1788829 - DNA, 17 bp, Homo sapiens
tcttgggatacagatct

SEQ ID NO: 1788830 - DNA, 19 bp, Homo sapiens
tcttgggcagagctggctc

SEQ ID NO: 1788831 - DNA, 21 bp, Homo sapiens
tcttgggcagagctggctctg

SEQ ID NO: 1788832 - DNA, 23 bp, Homo sapiens
tcttgggcagagctggctctgag

SEQ ID NO: 1788833 - DNA, 21 bp, Homo sapiens
tcttggggccactttcagagc

SEQ ID NO: 1788834 - DNA, 16 bp, Homo sapiens
tcttggggctgatgaa

SEQ ID NO: 1788835 - DNA, 20 bp, Homo sapiens
tcttggggctgatgaagaag

SEQ ID NO: 1788836 - DNA, 19 bp, Homo sapiens
tcttgggggccggggggaa

SEQ ID NO: 1788837 - DNA, 20 bp, Homo sapiens
tcttgggggggtggccgctg

SEQ ID NO: 1788838 - DNA, 22 bp, Homo sapiens
tcttggtagttctgtgcctccc

SEQ ID NO: 1788839 - DNA, 14 bp, Homo sapiens
tcttggttctaaag

SEQ ID NO: 1788840 - DNA, 15 bp, Homo sapiens
tcttggttctaaagg

SEQ ID NO: 1788841 - DNA, 23 bp, Homo sapiens
tcttggttgaaaataaaaagatc

SEQ ID NO: 1788842 - DNA, 14 bp, Homo sapiens
tcttggtttgggga

SEQ ID NO: 1788843 - DNA, 17 bp, Homo sapiens
tcttggtttggggagaa

SEQ ID NO: 1788844 - DNA, 20 bp, Homo sapiens
tcttggtttggggagaaata

SEQ ID NO: 1788845 - DNA, 17 bp, Homo sapiens
tcttgtaaatgtttctt

SEQ ID NO: 1788846 - DNA, 23 bp, Homo sapiens
tcttgtaatttaaacaggcccag

SEQ ID NO: 1788847 - DNA, 20 bp, Homo sapiens
tcttgtaccatagaaaaatg

SEQ ID NO: 1788848 - DNA, 22 bp, Homo sapiens
tcttgtaccatagaaaaatgta

SEQ ID NO: 1788849 - DNA, 17 bp, Homo sapiens
tcttgtacttctgtgtt

SEQ ID NO: 1788850 - DNA, 20 bp, Homo sapiens
tcttgtacttctgtgttcat

SEQ ID NO: 1788851 - DNA, 23 bp, Homo sapiens
tcttgtatttgggccaaggtgtt

SEQ ID NO: 1788852 - DNA, 13 bp, Homo sapiens
tcttgtcatgtgt

SEQ ID NO: 1788853 - DNA, 12 bp, Homo sapiens
tcttgtcatttt

SEQ ID NO: 1788854 - DNA, 19 bp, Homo sapiens
tcttgtcatttttaatatt

SEQ ID NO: 1788855 - DNA, 20 bp, Homo sapiens
tcttgtccctttccctacct

SEQ ID NO: 1788856 - DNA, 14 bp, Homo sapiens
tcttgtcctggccc

SEQ ID NO: 1788857 - DNA, 15 bp, Homo sapiens
tcttgtcttcctatt

SEQ ID NO: 1788858 - DNA, 15 bp, Homo sapiens
tcttgtgaaggcagg

SEQ ID NO: 1788859 - DNA, 21 bp, Homo sapiens
tcttgtgatattgcccaggct

SEQ ID NO: 1788860 - DNA, 23 bp, Homo sapiens
tcttgtgctagaatactttttaa

SEQ ID NO: 1788861 - DNA, 18 bp, Homo sapiens
tcttgtgctcacgctccc

SEQ ID NO: 1788862 - DNA, 16 bp, Homo sapiens
tcttgtggggccagga

SEQ ID NO: 1788863 - DNA, 20 bp, Homo sapiens
tcttgtggttaaaaacctgc

SEQ ID NO: 1788864 - DNA, 18 bp, Homo sapiens
tcttgttaatgtcattgc

SEQ ID NO: 1788865 - DNA, 15 bp, Homo sapiens
tcttgttcaggaaaa

SEQ ID NO: 1788866 - DNA, 17 bp, Homo sapiens
tcttgttggtagcatgt

SEQ ID NO: 1788867 - DNA, 12 bp, Homo sapiens
tcttgtttgtca

SEQ ID NO: 1788868 - DNA, 15 bp, Homo sapiens
tcttgtttgtcagca

SEQ ID NO: 1788869 - DNA, 13 bp, Homo sapiens
tcttgttttgaaa

SEQ ID NO: 1788870 - DNA, 13 bp, Homo sapiens
tcttgttttgtct

SEQ ID NO: 1788871 - DNA, 15 bp, Homo sapiens
tcttgtttttattaa

SEQ ID NO: 1788872 - DNA, 21 bp, Homo sapiens
tcttgtttttccactactgct

SEQ ID NO: 1788873 - DNA, 15 bp, Homo sapiens
tctttaaaaacattt

SEQ ID NO: 1788874 - DNA, 16 bp, Homo sapiens
tctttaaaagagagag

SEQ ID NO: 1788875 - DNA, 17 bp, Homo sapiens
tctttaaaagagagaga

SEQ ID NO: 1788876 - DNA, 16 bp, Homo sapiens
tctttaaaaggaaaga

SEQ ID NO: 1788877 - DNA, 14 bp, Homo sapiens
tctatcacctgtca

SEQ ID NO: 1788878 - DNA, 17 bp, Homo sapiens
tctatcacctgtcatca

SEQ ID NO: 1788879 - DNA, 14 bp, Homo sapiens
tctatcagaaatac

SEQ ID NO: 1788880 - DNA, 15 bp, Homo sapiens
tctatcagaaataca

SEQ ID NO: 1788881 - DNA, 19 bp, Homo sapiens
tctatcagaaatacaaaaa

SEQ ID NO: 1788882 - DNA, 20 bp, Homo sapiens
tctatcaggaaaacaaatca

SEQ ID NO: 1788883 - DNA, 23 bp, Homo sapiens
tctatcaggggtgcattctggcc

SEQ ID NO: 1788884 - DNA, 21 bp, Homo sapiens
tctatcattccaattctaaat

SEQ ID NO: 1788885 - DNA, 18 bp, Homo sapiens
tctatccaaatctgaaga

SEQ ID NO: 1788886 - DNA, 14 bp, Homo sapiens
tctatccatctcct

SEQ ID NO: 1788887 - DNA, 20 bp, Homo sapiens
tctatccatctcctggtgtt

SEQ ID NO: 1788888 - DNA, 14 bp, Homo sapiens
tctatccccaagct

SEQ ID NO: 1788889 - DNA, 16 bp, Homo sapiens
tctatccccaagctgg

SEQ ID NO: 1788890 - DNA, 15 bp, Homo sapiens
tctatccccatccag

SEQ ID NO: 1788891 - DNA, 20 bp, Homo sapiens
tctatcgagtttgcaatgtc

SEQ ID NO: 1788892 - DNA, 14 bp, Homo sapiens
tctatcttccaaat

SEQ ID NO: 1788893 - DNA, 23 bp, Homo sapiens
tctatcttccaaatgcaatttga

SEQ ID NO: 1788894 - DNA, 18 bp, Homo sapiens
tctatgaagtatataatg

SEQ ID NO: 1788895 - DNA, 14 bp, Homo sapiens
tctatgaagttgct

SEQ ID NO: 1788896 - DNA, 15 bp, Homo sapiens
tctatgaagttgctg

SEQ ID NO: 1788897 - DNA, 16 bp, Homo sapiens
tctatgaagttgctgt

SEQ ID NO: 1788898 - DNA, 14 bp, Homo sapiens
tctatgacaaattc

SEQ ID NO: 1788899 - DNA, 12 bp, Homo sapiens
tctatgagaaaa

SEQ ID NO: 1788900 - DNA, 17 bp, Homo sapiens
tctatgagaaaagaggc

SEQ ID NO: 1788901 - DNA, 15 bp, Homo sapiens
tctatgagtctagat

SEQ ID NO: 1788902 - DNA, 18 bp, Homo sapiens
tctatgagtctagatgtt

SEQ ID NO: 1788903 - DNA, 15 bp, Homo sapiens
tctatgccaaagatc

SEQ ID NO: 1788904 - DNA, 17 bp, Homo sapiens
tctatgccaaagatcac

SEQ ID NO: 1788905 - DNA, 16 bp, Homo sapiens
tctatggcagtccagc

SEQ ID NO: 1788906 - DNA, 17 bp, Homo sapiens
tctatgtagaactgttc

SEQ ID NO: 1788907 - DNA, 14 bp, Homo sapiens
tctatgtatattct

SEQ ID NO: 1788908 - DNA, 13 bp, Homo sapiens
tctatgtatgtta

SEQ ID NO: 1788909 - DNA, 23 bp, Homo sapiens
tctatgtatgttaatttatttag

SEQ ID NO: 1788910 - DNA, 15 bp, Homo sapiens
tctatgtcattttta

SEQ ID NO: 1788911 - DNA, 18 bp, Homo sapiens
tctatgtcatttttaatg

SEQ ID NO: 1788912 - DNA, 15 bp, Homo sapiens
tctatgtctgccttc

SEQ ID NO: 1788913 - DNA, 16 bp, Homo sapiens
tctatgtctgccttcg

SEQ ID NO: 1788914 - DNA, 15 bp, Homo sapiens
tctatgttcaaagac

SEQ ID NO: 1788915 - DNA, 22 bp, Homo sapiens
tctatgtttacaaatggacata

SEQ ID NO: 1788916 - DNA, 18 bp, Homo sapiens
tctatgtttgtgtgattt

SEQ ID NO: 1788917 - DNA, 22 bp, Homo sapiens
tctatgtttgtgtgatttccta

SEQ ID NO: 1788918 - DNA, 16 bp, Homo sapiens
tctattaagatttcca

SEQ ID NO: 1788919 - DNA, 12 bp, Homo sapiens
tctattaatata

SEQ ID NO: 1788920 - DNA, 13 bp, Homo sapiens
tctattaatatat

SEQ ID NO: 1788921 - DNA, 16 bp, Homo sapiens
tctattaatatatgta

SEQ ID NO: 1788922 - DNA, 22 bp, Homo sapiens
tctattaatatcaactctgaag

SEQ ID NO: 1788923 - DNA, 19 bp, Homo sapiens
tctattaatcacctctctg

SEQ ID NO: 1788924 - DNA, 14 bp, Homo sapiens
tctattaattactg

SEQ ID NO: 1788925 - DNA, 23 bp, Homo sapiens
tctattatttggagcctgccaag

SEQ ID NO: 1788926 - DNA, 16 bp, Homo sapiens
tctattatttttataa

SEQ ID NO: 1788927 - DNA, 12 bp, Homo sapiens
tctattcagctt

SEQ ID NO: 1788928 - DNA, 14 bp, Homo sapiens
tctattccaataaa

SEQ ID NO: 1788929 - DNA, 23 bp, Homo sapiens
tctattcctgtaaataagagttg

SEQ ID NO: 1788930 - DNA, 17 bp, Homo sapiens
tctattctctgcaattt

SEQ ID NO: 1788931 - DNA, 19 bp, Homo sapiens
tctattctgagaaaacaag

SEQ ID NO: 1788932 - DNA, 18 bp, Homo sapiens
tctattctgtcagtgtta

SEQ ID NO: 1788933 - DNA, 14 bp, Homo sapiens
tctattgaaaacag

SEQ ID NO: 1788934 - DNA, 19 bp, Homo sapiens
tctattgaaaacagtgtct

SEQ ID NO: 1788935 - DNA, 20 bp, Homo sapiens
tctattgtagcatttcttga

SEQ ID NO: 1788936 - DNA, 23 bp, Homo sapiens
tctattgtcatggggatcaattt

SEQ ID NO: 1788937 - DNA, 16 bp, Homo sapiens
tctattgtttattctt

SEQ ID NO: 1788938 - DNA, 14 bp, Homo sapiens
tctatttataatac

SEQ ID NO: 1788939 - DNA, 14 bp, Homo sapiens
tctatttctatctg

SEQ ID NO: 1788940 - DNA, 16 bp, Homo sapiens
tctatttctatctgca

SEQ ID NO: 1788941 - DNA, 13 bp, Homo sapiens
tctatttgtacaa

SEQ ID NO: 1788942 - DNA, 16 bp, Homo sapiens
tctatttgtacaattt

SEQ ID NO: 1788943 - DNA, 22 bp, Homo sapiens
tctatttgtacaattttaaagt

SEQ ID NO: 1788944 - DNA, 12 bp, Homo sapiens
tctattttaaga

SEQ ID NO: 1788945 - DNA, 15 bp, Homo sapiens
tctattttaattact

SEQ ID NO: 1788946 - DNA, 13 bp, Homo sapiens
tctattttattat

SEQ ID NO: 1788947 - DNA, 14 bp, Homo sapiens
tctattttattatg

SEQ ID NO: 1788948 - DNA, 14 bp, Homo sapiens
tctattttcataat

SEQ ID NO: 1788949 - DNA, 14 bp, Homo sapiens
tctattttgatttt

SEQ ID NO: 1788950 - DNA, 17 bp, Homo sapiens
tctattttgtaaactca

SEQ ID NO: 1788951 - DNA, 16 bp, Homo sapiens
tctattttgtttttta

SEQ ID NO: 1788952 - DNA, 13 bp, Homo sapiens
tctcaaaaaataa

SEQ ID NO: 1788953 - DNA, 16 bp, Homo sapiens
tctcaaaacagagggc

SEQ ID NO: 1788954 - DNA, 18 bp, Homo sapiens
tctcaaaacagagggctg

SEQ ID NO: 1788955 - DNA, 17 bp, Homo sapiens
tctcaaaactgcactgt

SEQ ID NO: 1788956 - DNA, 17 bp, Homo sapiens
tctcaaaataaagcaat

SEQ ID NO: 1788957 - DNA, 23 bp, Homo sapiens
tctcaaacctgtttaaatatttc

SEQ ID NO: 1788958 - DNA, 16 bp, Homo sapiens
tctcaaactcctgacc

SEQ ID NO: 1788959 - DNA, 12 bp, Homo sapiens
tctttaaataga

SEQ ID NO: 1788960 - DNA, 18 bp, Homo sapiens
tctttaacatagtcctgt

SEQ ID NO: 1788961 - DNA, 20 bp, Homo sapiens
tctttaactgccgtaattta

SEQ ID NO: 1788962 - DNA, 22 bp, Homo sapiens
tctttaactgccgtaatttaac

SEQ ID NO: 1788963 - DNA, 13 bp, Homo sapiens
tctttaataacaa

SEQ ID NO: 1788964 - DNA, 14 bp, Homo sapiens
tctttaatcttcag

SEQ ID NO: 1788965 - DNA, 15 bp, Homo sapiens
tctttaatcttcagt

SEQ ID NO: 1788966 - DNA, 20 bp, Homo sapiens
tctttaccaaaaaccatgtt

SEQ ID NO: 1788967 - DNA, 13 bp, Homo sapiens
tctttacctgaga

SEQ ID NO: 1788968 - DNA, 16 bp, Homo sapiens
tctttacctgagacca

SEQ ID NO: 1788969 - DNA, 16 bp, Homo sapiens
tctttaccttctaaaa

SEQ ID NO: 1788970 - DNA, 18 bp, Homo sapiens
tctttaccttctaaaagc

SEQ ID NO: 1788971 - DNA, 21 bp, Homo sapiens
tctttactcggcgtgctcctt

SEQ ID NO: 1788972 - DNA, 14 bp, Homo sapiens
tctttactctctcc

SEQ ID NO: 1788973 - DNA, 21 bp, Homo sapiens
tctttactgcactcagattta

SEQ ID NO: 1788974 - DNA, 16 bp, Homo sapiens
tctttaggagatttat

SEQ ID NO: 1788975 - DNA, 13 bp, Homo sapiens
tctttagtactca

SEQ ID NO: 1788976 - DNA, 23 bp, Homo sapiens
tctttagtttttggttgggaatg

SEQ ID NO: 1788977 - DNA, 20 bp, Homo sapiens
tctttatagaaggaatttgt

SEQ ID NO: 1788978 - DNA, 15 bp, Homo sapiens
tctttatgactgttt

SEQ ID NO: 1788979 - DNA, 17 bp, Homo sapiens
tctttatgctgtatttt

SEQ ID NO: 1788980 - DNA, 20 bp, Homo sapiens
tctttatgctgtattttaac

SEQ ID NO: 1788981 - DNA, 16 bp, Homo sapiens
tctttatgtagcacta

SEQ ID NO: 1788982 - DNA, 12 bp, Homo sapiens
tctttattaaaa

SEQ ID NO: 1788983 - DNA, 14 bp, Homo sapiens
tctttattctgtgt

SEQ ID NO: 1788984 - DNA, 19 bp, Homo sapiens
tgacaaccgagaaggttta

SEQ ID NO: 1788985 - DNA, 16 bp, Homo sapiens
tgacaacctagaatgt

SEQ ID NO: 1788986 - DNA, 21 bp, Homo sapiens
tgacaactgcacatgaaagtt

SEQ ID NO: 1788987 - DNA, 22 bp, Homo sapiens
tgacaacttcccagtgaattct

SEQ ID NO: 1788988 - DNA, 21 bp, Homo sapiens
tgacaagagttggggacagaa

SEQ ID NO: 1788989 - DNA, 11 bp, Homo sapiens
tgacaataaag

SEQ ID NO: 1788990 - DNA, 14 bp, Homo sapiens
tgacaataatttca

SEQ ID NO: 1788991 - DNA, 13 bp, Homo sapiens
tgacaatcacctt

SEQ ID NO: 1788992 - DNA, 18 bp, Homo sapiens
tgacaatctaccaactgt

SEQ ID NO: 1788993 - DNA, 14 bp, Homo sapiens
tgacaatgaaggga

SEQ ID NO: 1788994 - DNA, 15 bp, Homo sapiens
tgacaatggcagcta

SEQ ID NO: 1788995 - DNA, 20 bp, Homo sapiens
tgacaatttctggcagatgt

SEQ ID NO: 1788996 - DNA, 13 bp, Homo sapiens
tgacaattttgtc

SEQ ID NO: 1788997 - DNA, 15 bp, Homo sapiens
tgacaattttgtctt

SEQ ID NO: 1788998 - DNA, 18 bp, Homo sapiens
tgacaattttgtcttaag

SEQ ID NO: 1788999 - DNA, 22 bp, Homo sapiens
tgacaattttgtcttaagtgtt

SEQ ID NO: 1789000 - DNA, 16 bp, Homo sapiens
tgacacaaaggtggaa

SEQ ID NO: 1789001 - DNA, 16 bp, Homo sapiens
tgacacaactgtgtga

SEQ ID NO: 1789002 - DNA, 15 bp, Homo sapiens
tgacacaagcacttt

SEQ ID NO: 1789003 - DNA, 12 bp, Homo sapiens
tgacacacagca

SEQ ID NO: 1789004 - DNA, 14 bp, Homo sapiens
tgacacacagcact

SEQ ID NO: 1789005 - DNA, 15 bp, Homo sapiens
tgacacacagcactc

SEQ ID NO: 1789006 - DNA, 22 bp, Homo sapiens
tgacacaccaggcgctaattca

SEQ ID NO: 1789007 - DNA, 20 bp, Homo sapiens
tgacacacgtatttatattt

SEQ ID NO: 1789008 - DNA, 20 bp, Homo sapiens
tgacacactaaccaagctga

SEQ ID NO: 1789009 - DNA, 12 bp, Homo sapiens
tgacacagacat

SEQ ID NO: 1789010 - DNA, 17 bp, Homo sapiens
tgacacagacattttgt

SEQ ID NO: 1789011 - DNA, 22 bp, Homo sapiens
tgacacataaatctgtctgatt

SEQ ID NO: 1789012 - DNA, 17 bp, Homo sapiens
tgacacatatgaacaca

SEQ ID NO: 1789013 - DNA, 19 bp, Homo sapiens
tgacacatcgttttggggg

SEQ ID NO: 1789014 - DNA, 16 bp, Homo sapiens
tgacacatggcccctc

SEQ ID NO: 1789015 - DNA, 22 bp, Homo sapiens
tgacacatggcccctccccctg

SEQ ID NO: 1789016 - DNA, 16 bp, Homo sapiens
tgacaccaataaatgt

SEQ ID NO: 1789017 - DNA, 18 bp, Homo sapiens
tgacaccaataaatgttt

SEQ ID NO: 1789018 - DNA, 23 bp, Homo sapiens
tgacaccaataaatgtttgttat

SEQ ID NO: 1789019 - DNA, 15 bp, Homo sapiens
tgacaccagcctttc

SEQ ID NO: 1789020 - DNA, 22 bp, Homo sapiens
tgacaccagcctttctcccagg

SEQ ID NO: 1789021 - DNA, 14 bp, Homo sapiens
tgacaccattctcc

SEQ ID NO: 1789022 - DNA, 16 bp, Homo sapiens
tgacaccattctcctg

SEQ ID NO: 1789023 - DNA, 17 bp, Homo sapiens
tgacaccattctcctgc

SEQ ID NO: 1789024 - DNA, 18 bp, Homo sapiens
tgacaccattctcctgcc

SEQ ID NO: 1789025 - DNA, 14 bp, Homo sapiens
tgacacccaggctg

SEQ ID NO: 1789026 - DNA, 14 bp, Homo sapiens
tgacaccccctccc

SEQ ID NO: 1789027 - DNA, 14 bp, Homo sapiens
tgacaccctggcct

SEQ ID NO: 1789028 - DNA, 16 bp, Homo sapiens
tgacaccgtccctcag

SEQ ID NO: 1789029 - DNA, 21 bp, Homo sapiens
tgacaccgtccctcagtgata

SEQ ID NO: 1789030 - DNA, 19 bp, Homo sapiens
tgacacctaccatgctgct

SEQ ID NO: 1789031 - DNA, 16 bp, Homo sapiens
tgacacctccatttct

SEQ ID NO: 1789032 - DNA, 22 bp, Homo sapiens
tgacacctgtcttgaataagag

SEQ ID NO: 1789033 - DNA, 16 bp, Homo sapiens
tgacacgcgctctcca

SEQ ID NO: 1789034 - DNA, 19 bp, Homo sapiens
tgacacgcgctctccacca

SEQ ID NO: 1789035 - DNA, 19 bp, Homo sapiens
tgacactagcccaatgaaa

SEQ ID NO: 1789036 - DNA, 23 bp, Homo sapiens
tgacactagcccaatgaaatgaa

SEQ ID NO: 1789037 - DNA, 19 bp, Homo sapiens
tgacactatatctgtatat

SEQ ID NO: 1789038 - DNA, 12 bp, Homo sapiens
tgacactgaaag

SEQ ID NO: 1789039 - DNA, 19 bp, Homo sapiens
tgacactgaaagttttgta

SEQ ID NO: 1789040 - DNA, 11 bp, Homo sapiens
tgacactgacc

SEQ ID NO: 1789041 - DNA, 23 bp, Homo sapiens
tgacactgaccttggagagacac

SEQ ID NO: 1789042 - DNA, 20 bp, Homo sapiens
tgacactgatgagtttcact

SEQ ID NO: 1789043 - DNA, 17 bp, Homo sapiens
tgacactggaccaggtc

SEQ ID NO: 1789044 - DNA, 19 bp, Homo sapiens
tgacactggaccaggtcct

SEQ ID NO: 1789045 - DNA, 15 bp, Homo sapiens
tgacacttccaaaga

SEQ ID NO: 1789046 - DNA, 19 bp, Homo sapiens
tgacacttccaaagactcc

SEQ ID NO: 1789047 - DNA, 16 bp, Homo sapiens
tgacacttcccagtgg

SEQ ID NO: 1789048 - DNA, 22 bp, Homo sapiens
tgacacttgattgtctcctaat

SEQ ID NO: 1789049 - DNA, 22 bp, Homo sapiens
tgacagaatatgtttcaaactt

SEQ ID NO: 1789050 - DNA, 18 bp, Homo sapiens
tgacagaccacatcttta

SEQ ID NO: 1789051 - DNA, 22 bp, Homo sapiens
tgacagaccacatctttatctg

SEQ ID NO: 1789052 - DNA, 18 bp, Homo sapiens
tgacagagcaagactctg

SEQ ID NO: 1789053 - DNA, 17 bp, Homo sapiens
tgacagagcgagactcc

SEQ ID NO: 1789054 - DNA, 23 bp, Homo sapiens
tgacagagcgagactccatctct

SEQ ID NO: 1789055 - DNA, 15 bp, Homo sapiens
tgacagagttcacta

SEQ ID NO: 1789056 - DNA, 16 bp, Homo sapiens
tgacagataaatcctt

SEQ ID NO: 1789057 - DNA, 19 bp, Homo sapiens
tgacagatgtcagccgagc

SEQ ID NO: 1789058 - DNA, 14 bp, Homo sapiens
tgacagcaaaatgt

SEQ ID NO: 1789059 - DNA, 20 bp, Homo sapiens
tgacagcagtcggttggagc

SEQ ID NO: 1789060 - DNA, 12 bp, Homo sapiens
tgacagcctccc

SEQ ID NO: 1789061 - DNA, 22 bp, Homo sapiens
tgacagcctcccacccccatct

SEQ ID NO: 1789062 - DNA, 12 bp, Homo sapiens
tgacagctgtcc

SEQ ID NO: 1789063 - DNA, 16 bp, Homo sapiens
tgacagctgtccctgt

SEQ ID NO: 1789064 - DNA, 18 bp, Homo sapiens
tgacagctgtccctgtca

SEQ ID NO: 1789065 - DNA, 20 bp, Homo sapiens
tgacagcttggaaagggaag

SEQ ID NO: 1789066 - DNA, 14 bp, Homo sapiens
tgacagctttctgg

SEQ ID NO: 1789067 - DNA, 20 bp, Homo sapiens
tgacagctttctgggatgtc

SEQ ID NO: 1789068 - DNA, 21 bp, Homo sapiens
tgacaggcatgaatcactgtg

SEQ ID NO: 1789069 - DNA, 12 bp, Homo sapiens
tgacagggcaga

SEQ ID NO: 1789070 - DNA, 23 bp, Homo sapiens
tgacagggcagagcaggaaggac

SEQ ID NO: 1789071 - DNA, 14 bp, Homo sapiens
tgacagtcagctgt

SEQ ID NO: 1789072 - DNA, 21 bp, Homo sapiens
tgacagtcagctgtggggaac

SEQ ID NO: 1789073 - DNA, 14 bp, Homo sapiens
tgacagtccacagg

SEQ ID NO: 1789074 - DNA, 14 bp, Homo sapiens
tgacagtgcctggg

SEQ ID NO: 1789075 - DNA, 17 bp, Homo sapiens
tgacagtgcctgggaat

SEQ ID NO: 1789076 - DNA, 14 bp, Homo sapiens
tgacagtgccttct

SEQ ID NO: 1789077 - DNA, 21 bp, Homo sapiens
tgacagtgctctaggctgccc

SEQ ID NO: 1789078 - DNA, 19 bp, Homo sapiens
tgacagtgttgaaaatgtt

SEQ ID NO: 1789079 - DNA, 14 bp, Homo sapiens
tgacagtgttttta

SEQ ID NO: 1789080 - DNA, 17 bp, Homo sapiens
tgacagttctgaagaat

SEQ ID NO: 1789081 - DNA, 17 bp, Homo sapiens
tgacagtttccaaattg

SEQ ID NO: 1789082 - DNA, 17 bp, Homo sapiens
tgacagtttttctgttt

SEQ ID NO: 1789083 - DNA, 18 bp, Homo sapiens
tgacataaaaacaacttt

SEQ ID NO: 1789084 - DNA, 15 bp, Homo sapiens
tgacataaaaagaag

SEQ ID NO: 1789085 - DNA, 17 bp, Homo sapiens
tgacataaaatttacat

SEQ ID NO: 1789086 - DNA, 18 bp, Homo sapiens
tgacataaaatttacatt

SEQ ID NO: 1789087 - DNA, 21 bp, Homo sapiens
tgacataacactataaaggtt

SEQ ID NO: 1789088 - DNA, 16 bp, Homo sapiens
tgacataatatattct

SEQ ID NO: 1789089 - DNA, 14 bp, Homo sapiens
tgacatagcctcat

SEQ ID NO: 1789090 - DNA, 17 bp, Homo sapiens
tgacatcacttgtacaa

SEQ ID NO: 1789091 - DNA, 21 bp, Homo sapiens
tgacatcacttgtacaaaata

SEQ ID NO: 1789092 - DNA, 23 bp, Homo sapiens
tgacatcacttgtacaaaataaa

SEQ ID NO: 1789093 - DNA, 14 bp, Homo sapiens
tgacatcagcctgc

SEQ ID NO: 1789094 - DNA, 15 bp, Homo sapiens
tgacatccaaatcta

SEQ ID NO: 1789095 - DNA, 14 bp, Homo sapiens
tgacatcccttcct

SEQ ID NO: 1789096 - DNA, 16 bp, Homo sapiens
tgacatcccttcctgg

SEQ ID NO: 1789097 - DNA, 21 bp, Homo sapiens
tgacatcccttcctggaaaca

SEQ ID NO: 1789098 - DNA, 23 bp, Homo sapiens
tgacatcctagaggtagagaaac

SEQ ID NO: 1789099 - DNA, 16 bp, Homo sapiens
tctttgttactgtcca

SEQ ID NO: 1789100 - DNA, 15 bp, Homo sapiens
tctttgttataccat

SEQ ID NO: 1789101 - DNA, 22 bp, Homo sapiens
tctttgttctgttttgtgagaa

SEQ ID NO: 1789102 - DNA, 18 bp, Homo sapiens
tctttgttggaaaagaat

SEQ ID NO: 1789103 - DNA, 14 bp, Homo sapiens
tctttgtttaacaa

SEQ ID NO: 1789104 - DNA, 23 bp, Homo sapiens
tctttgtttccagcttgcattga

SEQ ID NO: 1789105 - DNA, 19 bp, Homo sapiens
tcttttaaaaattcaaatg

SEQ ID NO: 1789106 - DNA, 14 bp, Homo sapiens
tcttttaaattgca

SEQ ID NO: 1789107 - DNA, 17 bp, Homo sapiens
tcttttaattgaaatta

SEQ ID NO: 1789108 - DNA, 21 bp, Homo sapiens
tcttttaattgaaattaactt

SEQ ID NO: 1789109 - DNA, 14 bp, Homo sapiens
tcttttacattctg

SEQ ID NO: 1789110 - DNA, 13 bp, Homo sapiens
tcttttagacaac

SEQ ID NO: 1789111 - DNA, 14 bp, Homo sapiens
tcttttagacaact

SEQ ID NO: 1789112 - DNA, 20 bp, Homo sapiens
tcttttagacaactagattt

SEQ ID NO: 1789113 - DNA, 22 bp, Homo sapiens
tcttttagacaactagatttgt

SEQ ID NO: 1789114 - DNA, 18 bp, Homo sapiens
tcttttagatcctaagtc

SEQ ID NO: 1789115 - DNA, 16 bp, Homo sapiens
tcttttagttttagtt

SEQ ID NO: 1789116 - DNA, 18 bp, Homo sapiens
tcttttatatctgtaaat

SEQ ID NO: 1789117 - DNA, 19 bp, Homo sapiens
tcttttatatctgtaaatt

SEQ ID NO: 1789118 - DNA, 22 bp, Homo sapiens
tcttttatttagggccttttct

SEQ ID NO: 1789119 - DNA, 19 bp, Homo sapiens
tcttttcagcttgtttcta

SEQ ID NO: 1789120 - DNA, 13 bp, Homo sapiens
tgaaatggctggg

SEQ ID NO: 1789121 - DNA, 20 bp, Homo sapiens
tgaaatgtagaattgaaaat

SEQ ID NO: 1789122 - DNA, 21 bp, Homo sapiens
tgaaatgtgaatttttattgt

SEQ ID NO: 1789123 - DNA, 13 bp, Homo sapiens
tgaaatgtgtttc

SEQ ID NO: 1789124 - DNA, 20 bp, Homo sapiens
tgaaattaacacaaaggaag

SEQ ID NO: 1789125 - DNA, 18 bp, Homo sapiens
tgaaattaaccatagatg

SEQ ID NO: 1789126 - DNA, 14 bp, Homo sapiens
tgaaattaactttt

SEQ ID NO: 1789127 - DNA, 22 bp, Homo sapiens
tgaaattacgggtacctgaaga

SEQ ID NO: 1789128 - DNA, 23 bp, Homo sapiens
tgaaattactacaaaatttgaaa

SEQ ID NO: 1789129 - DNA, 17 bp, Homo sapiens
tgaaattatgtatgttt

SEQ ID NO: 1789130 - DNA, 18 bp, Homo sapiens
tgaaattatgtatgttta

SEQ ID NO: 1789131 - DNA, 14 bp, Homo sapiens
tgaaattctcagag

SEQ ID NO: 1789132 - DNA, 15 bp, Homo sapiens
tgaaattctcagagt

SEQ ID NO: 1789133 - DNA, 11 bp, Homo sapiens
tgaactgttac

SEQ ID NO: 1789134 - DNA, 19 bp, Homo sapiens
tgaacttacaggtgattaa

SEQ ID NO: 1789135 - DNA, 22 bp, Homo sapiens
tgaacttccatttgtattcaaa

SEQ ID NO: 1789136 - DNA, 23 bp, Homo sapiens
tgaacttccatttgtattcaaat

SEQ ID NO: 1789137 - DNA, 14 bp, Homo sapiens
tgaacttgctcttt

SEQ ID NO: 1789138 - DNA, 16 bp, Homo sapiens
tgaacttgctcttttt

SEQ ID NO: 1789139 - DNA, 11 bp, Homo sapiens
tgaacttgtca

SEQ ID NO: 1789140 - DNA, 15 bp, Homo sapiens
tgaacttttgtactg

SEQ ID NO: 1789141 - DNA, 13 bp, Homo sapiens
tgaagaaaaaagc

SEQ ID NO: 1789142 - DNA, 19 bp, Homo sapiens
tgaagggacagctgctggg

SEQ ID NO: 1789143 - DNA, 16 bp, Homo sapiens
tgaagggagagccagc

SEQ ID NO: 1789144 - DNA, 16 bp, Homo sapiens
tgaagggccagagcca

SEQ ID NO: 1789145 - DNA, 22 bp, Homo sapiens
tgaaggggcacaccactgccct

SEQ ID NO: 1789146 - DNA, 21 bp, Homo sapiens
tgaaggggtgcacccacctgt

SEQ ID NO: 1789147 - DNA, 14 bp, Homo sapiens
tgaagggtcctgcc

SEQ ID NO: 1789148 - DNA, 21 bp, Homo sapiens
tgaaggtaaaattgaaaggca

SEQ ID NO: 1789149 - DNA, 15 bp, Homo sapiens
tgaaggtcaataaat

SEQ ID NO: 1789150 - DNA, 17 bp, Homo sapiens
tgaaggtcccctggcag

SEQ ID NO: 1789151 - DNA, 19 bp, Homo sapiens
tgaaggtctcctaaaactg

SEQ ID NO: 1789152 - DNA, 15 bp, Homo sapiens
tgaaggtgacagcag

SEQ ID NO: 1789153 - DNA, 15 bp, Homo sapiens
tgaaggtgctgacgg

SEQ ID NO: 1789154 - DNA, 15 bp, Homo sapiens
tgaaggtttttgtaa

SEQ ID NO: 1789155 - DNA, 16 bp, Homo sapiens
tgaaggtttttgtaaa

SEQ ID NO: 1789156 - DNA, 19 bp, Homo sapiens
tgaaggtttttgtaaagat

SEQ ID NO: 1789157 - DNA, 16 bp, Homo sapiens
tgaagtaaattaaaca

SEQ ID NO: 1789158 - DNA, 16 bp, Homo sapiens
tgaagtaaattatgta

SEQ ID NO: 1789159 - DNA, 18 bp, Homo sapiens
tgaagtaaattatgtaac

SEQ ID NO: 1789160 - DNA, 19 bp, Homo sapiens
tgaagtaacccctcctggc

SEQ ID NO: 1789161 - DNA, 21 bp, Homo sapiens
tgaagtaacccctcctggctg

SEQ ID NO: 1789162 - DNA, 14 bp, Homo sapiens
tgaagtaatgaatt

SEQ ID NO: 1789163 - DNA, 20 bp, Homo sapiens
tgaagtacttaaacttccac

SEQ ID NO: 1789164 - DNA, 20 bp, Homo sapiens
tgaagtagcctcttgtgtaa

SEQ ID NO: 1789165 - DNA, 16 bp, Homo sapiens
tgaagtatataatggt

SEQ ID NO: 1789166 - DNA, 15 bp, Homo sapiens
tgaagtattcacaaa

SEQ ID NO: 1789167 - DNA, 20 bp, Homo sapiens
tgaagtattttgctggaata

SEQ ID NO: 1789168 - DNA, 14 bp, Homo sapiens
tgaagtcaaaatat

SEQ ID NO: 1789169 - DNA, 18 bp, Homo sapiens
tgaagtcaaaatatgtaa

SEQ ID NO: 1789170 - DNA, 18 bp, Homo sapiens
tgaagtcacatcacagga

SEQ ID NO: 1789171 - DNA, 22 bp, Homo sapiens
tgaagtcacattccacatctgt

SEQ ID NO: 1789172 - DNA, 19 bp, Homo sapiens
tgaagtcacccggccccca

SEQ ID NO: 1789173 - DNA, 14 bp, Homo sapiens
tgaagtcactgcac

SEQ ID NO: 1789174 - DNA, 15 bp, Homo sapiens
tgaagtcactgcaca

SEQ ID NO: 1789175 - DNA, 18 bp, Homo sapiens
tgaagtcagccacactgg

SEQ ID NO: 1789176 - DNA, 13 bp, Homo sapiens
tgaagtccaggac

SEQ ID NO: 1789177 - DNA, 16 bp, Homo sapiens
tgaagtccaggactgg

SEQ ID NO: 1789178 - DNA, 20 bp, Homo sapiens
tgaagtcgggtcaaaaataa

SEQ ID NO: 1789179 - DNA, 19 bp, Homo sapiens
tgaagtctttaataaataa

SEQ ID NO: 1789180 - DNA, 20 bp, Homo sapiens
tgaagtgaaaaagttttaca

SEQ ID NO: 1789181 - DNA, 17 bp, Homo sapiens
tgaagtgagcacagcct

SEQ ID NO: 1789182 - DNA, 16 bp, Homo sapiens
tgaagtggctggtaga

SEQ ID NO: 1789183 - DNA, 22 bp, Homo sapiens
tgaagtggtacaatctggctca

SEQ ID NO: 1789184 - DNA, 18 bp, Homo sapiens
tgaagtgtataatataaa

SEQ ID NO: 1789185 - DNA, 14 bp, Homo sapiens
tgaagttaacagag

SEQ ID NO: 1789186 - DNA, 15 bp, Homo sapiens
tgaagttaacagtct

SEQ ID NO: 1789187 - DNA, 16 bp, Homo sapiens
tgaagttatgctgtca

SEQ ID NO: 1789188 - DNA, 17 bp, Homo sapiens
tgaagttcatcttgcag

SEQ ID NO: 1789189 - DNA, 19 bp, Homo sapiens
tgaagttcatggtgatcag

SEQ ID NO: 1789190 - DNA, 14 bp, Homo sapiens
tgaagttctgagcc

SEQ ID NO: 1789191 - DNA, 13 bp, Homo sapiens
tgaagttgaacat

SEQ ID NO: 1789192 - DNA, 17 bp, Homo sapiens
tgaagttgctgtttatt

SEQ ID NO: 1789193 - DNA, 20 bp, Homo sapiens
tgaagttgggtgtttccaga

SEQ ID NO: 1789194 - DNA, 14 bp, Homo sapiens
tgaagttgtgcaac

SEQ ID NO: 1789195 - DNA, 21 bp, Homo sapiens
tgaagttgtgcaacggccagg

SEQ ID NO: 1789196 - DNA, 16 bp, Homo sapiens
tgaagttgtttatcaa

SEQ ID NO: 1789197 - DNA, 16 bp, Homo sapiens
tgaagtttacattgta

SEQ ID NO: 1789198 - DNA, 16 bp, Homo sapiens
tgaagtttccgccccc

SEQ ID NO: 1789199 - DNA, 16 bp, Homo sapiens
tgaagttttactgtct

SEQ ID NO: 1789200 - DNA, 17 bp, Homo sapiens
tgaagttttactgtcta

SEQ ID NO: 1789201 - DNA, 19 bp, Homo sapiens
tgaagttttggagagggaa

SEQ ID NO: 1789202 - DNA, 20 bp, Homo sapiens
tgaagttttggagagggaag

SEQ ID NO: 1789203 - DNA, 11 bp, Homo sapiens
tgaataaaaca

SEQ ID NO: 1789204 - DNA, 16 bp, Homo sapiens
tgaataaaacactcat

SEQ ID NO: 1789205 - DNA, 19 bp, Homo sapiens
tgaataaaacactcatccc

SEQ ID NO: 1789206 - DNA, 14 bp, Homo sapiens
tgaataaagacacc

SEQ ID NO: 1789207 - DNA, 16 bp, Homo sapiens
tgaataaagacaccta

SEQ ID NO: 1789208 - DNA, 14 bp, Homo sapiens
tgaataaagcaatt

SEQ ID NO: 1789209 - DNA, 22 bp, Homo sapiens
tgaataaagcctttgtatcttt

SEQ ID NO: 1789210 - DNA, 17 bp, Homo sapiens
tgaataaagttgaagct

SEQ ID NO: 1789211 - DNA, 21 bp, Homo sapiens
tgaataaatacccattgaact

SEQ ID NO: 1789212 - DNA, 19 bp, Homo sapiens
tgaataaattctataggaa

SEQ ID NO: 1789213 - DNA, 15 bp, Homo sapiens
tgaataaccacttaa

SEQ ID NO: 1789214 - DNA, 21 bp, Homo sapiens
tgaataagtaaagaattactt

SEQ ID NO: 1789215 - DNA, 16 bp, Homo sapiens
tgaataatatcaaata

SEQ ID NO: 1789216 - DNA, 16 bp, Homo sapiens
tgaataatgctaccag

SEQ ID NO: 1789217 - DNA, 14 bp, Homo sapiens
tgaataatggaaaa

SEQ ID NO: 1789218 - DNA, 16 bp, Homo sapiens
tgaataatggaaaatg

SEQ ID NO: 1789219 - DNA, 18 bp, Homo sapiens
tgaataattacagtgcct

SEQ ID NO: 1789220 - DNA, 19 bp, Homo sapiens
tgaataatttcacttaata

SEQ ID NO: 1789221 - DNA, 14 bp, Homo sapiens
tgaataatttccca

SEQ ID NO: 1789222 - DNA, 15 bp, Homo sapiens
tgaatacaaacaatg

SEQ ID NO: 1789223 - DNA, 16 bp, Homo sapiens
tgaatacaaacaatgg

SEQ ID NO: 1789224 - DNA, 20 bp, Homo sapiens
tgaatacaaacaatggaaac

SEQ ID NO: 1789225 - DNA, 22 bp, Homo sapiens
tgaatacaaacaatggaaactg

SEQ ID NO: 1789226 - DNA, 20 bp, Homo sapiens
tgaatacattaacggtgcta

SEQ ID NO: 1789227 - DNA, 16 bp, Homo sapiens
tgaatacatttgtatt

SEQ ID NO: 1789228 - DNA, 22 bp, Homo sapiens
tgaataccattaaaactgcttt

SEQ ID NO: 1789229 - DNA, 20 bp, Homo sapiens
tgaatacctaagatttctgt

SEQ ID NO: 1789230 - DNA, 21 bp, Homo sapiens
tgaatacctaagatttctgtc

SEQ ID NO: 1789231 - DNA, 14 bp, Homo sapiens
tgaatacctgctca

SEQ ID NO: 1789232 - DNA, 14 bp, Homo sapiens
tgaatactcttgaa

SEQ ID NO: 1789233 - DNA, 18 bp, Homo sapiens
tgaataggtagtatcata

SEQ ID NO: 1789234 - DNA, 15 bp, Homo sapiens
tgaatatatagaatt

SEQ ID NO: 1789235 - DNA, 17 bp, Homo sapiens
tgaatatatatgatgaa

SEQ ID NO: 1789236 - DNA, 23 bp, Homo sapiens
tgaatatatatgatgaaattctt

SEQ ID NO: 1789237 - DNA, 18 bp, Homo sapiens
tgaatatctattaatata

SEQ ID NO: 1789238 - DNA, 18 bp, Homo sapiens
tgaatatgttagaatcaa

SEQ ID NO: 1789239 - DNA, 16 bp, Homo sapiens
tgaatattactctcaa

SEQ ID NO: 1789240 - DNA, 15 bp, Homo sapiens
tgaatattgatgtta

SEQ ID NO: 1789241 - DNA, 17 bp, Homo sapiens
tgaatatttataacagc

SEQ ID NO: 1789242 - DNA, 20 bp, Homo sapiens
tgaatatttatatttcacta

SEQ ID NO: 1789243 - DNA, 21 bp, Homo sapiens
tgaatatttgttatgtagata

SEQ ID NO: 1789244 - DNA, 13 bp, Homo sapiens
tgaatattttcaa

SEQ ID NO: 1789245 - DNA, 19 bp, Homo sapiens
tgaatattttcattaaaag

SEQ ID NO: 1789246 - DNA, 13 bp, Homo sapiens
tgaatcaatcctg

SEQ ID NO: 1789247 - DNA, 22 bp, Homo sapiens
tgaatcactgtgctcagccacc

SEQ ID NO: 1789248 - DNA, 22 bp, Homo sapiens
tgaatcagaccctaccccacca

SEQ ID NO: 1789249 - DNA, 18 bp, Homo sapiens
tgaatcagatgtgtgttc

SEQ ID NO: 1789250 - DNA, 15 bp, Homo sapiens
tgaatcatgagcctg

SEQ ID NO: 1789251 - DNA, 22 bp, Homo sapiens
tgaatccaaatctgtcctctgt

SEQ ID NO: 1789252 - DNA, 13 bp, Homo sapiens
tgacttctgcctg

SEQ ID NO: 1789253 - DNA, 23 bp, Homo sapiens
tgacttcttggtttggggagaaa

SEQ ID NO: 1789254 - DNA, 20 bp, Homo sapiens
tgacttgctgtccaggcagc

SEQ ID NO: 1789255 - DNA, 21 bp, Homo sapiens
tgacttgctgtccaggcagct

SEQ ID NO: 1789256 - DNA, 22 bp, Homo sapiens
tgacttgctgtgtgaccctggg

SEQ ID NO: 1789257 - DNA, 15 bp, Homo sapiens
tgacttggcacttaa

SEQ ID NO: 1789258 - DNA, 14 bp, Homo sapiens
tgacttggccccag

SEQ ID NO: 1789259 - DNA, 20 bp, Homo sapiens
tgacttgtacaaacagtatt

SEQ ID NO: 1789260 - DNA, 15 bp, Homo sapiens
tgacttgtttgtctt

SEQ ID NO: 1789261 - DNA, 19 bp, Homo sapiens
tgacttgtttgtcttccat

SEQ ID NO: 1789262 - DNA, 18 bp, Homo sapiens
tgactttacgcccatctc

SEQ ID NO: 1789263 - DNA, 14 bp, Homo sapiens
tgactttacttgtg

SEQ ID NO: 1789264 - DNA, 20 bp, Homo sapiens
tgactttacttgtggtgtga

SEQ ID NO: 1789265 - DNA, 15 bp, Homo sapiens
tgactttctgattgg

SEQ ID NO: 1789266 - DNA, 14 bp, Homo sapiens
tgactttgcccagg

SEQ ID NO: 1789267 - DNA, 17 bp, Homo sapiens
tgactttgcttgctttg

SEQ ID NO: 1789268 - DNA, 19 bp, Homo sapiens
tgactttggtttttccaac

SEQ ID NO: 1789269 - DNA, 16 bp, Homo sapiens
tgacttttataaagca

SEQ ID NO: 1789270 - DNA, 16 bp, Homo sapiens
tgacttttcaagtatt

SEQ ID NO: 1789271 - DNA, 13 bp, Homo sapiens
tgacttttccaaa

SEQ ID NO: 1789272 - DNA, 21 bp, Homo sapiens
tgacttttccaaataaacatt

SEQ ID NO: 1789273 - DNA, 23 bp, Homo sapiens
tgacttttccaaataaacatttt

SEQ ID NO: 1789274 - DNA, 18 bp, Homo sapiens
tgactttttagccagtga

SEQ ID NO: 1789275 - DNA, 13 bp, Homo sapiens
tgactttttataa

SEQ ID NO: 1789276 - DNA, 14 bp, Homo sapiens
tgactttttttgta

SEQ ID NO: 1789277 - DNA, 19 bp, Homo sapiens
tgagaaaaaaaaaaaagac

SEQ ID NO: 1789278 - DNA, 13 bp, Homo sapiens
tgagaaaacaagc

SEQ ID NO: 1789279 - DNA, 14 bp, Homo sapiens
tgagaaaacaagca

SEQ ID NO: 1789280 - DNA, 23 bp, Homo sapiens
tgagaaaacaagcaagttctgag

SEQ ID NO: 1789281 - DNA, 13 bp, Homo sapiens
tgagaaaactcaa

SEQ ID NO: 1789282 - DNA, 19 bp, Homo sapiens
tgagaaacagctcagccag

SEQ ID NO: 1789283 - DNA, 15 bp, Homo sapiens
tgagaaacccaccag

SEQ ID NO: 1789284 - DNA, 19 bp, Homo sapiens
tgagaaagaataggggctg

SEQ ID NO: 1789285 - DNA, 19 bp, Homo sapiens
tgagaaagatgttccagtg

SEQ ID NO: 1789286 - DNA, 23 bp, Homo sapiens
tgagaaagatgttccagtgagga

SEQ ID NO: 1789287 - DNA, 23 bp, Homo sapiens
tgagaaaggacagagccagcggc

SEQ ID NO: 1789288 - DNA, 14 bp, Homo sapiens
tgagaaatcctgga

SEQ ID NO: 1789289 - DNA, 20 bp, Homo sapiens
tgagaaatgaataatttccc

SEQ ID NO: 1789290 - DNA, 13 bp, Homo sapiens
tgagaaatgatga

SEQ ID NO: 1789291 - DNA, 11 bp, Homo sapiens
tgagaaatgca

SEQ ID NO: 1789292 - DNA, 18 bp, Homo sapiens
tgagaacaagtcacagct

SEQ ID NO: 1789293 - DNA, 22 bp, Homo sapiens
tgagaacaagtcacagctgcag

SEQ ID NO: 1789294 - DNA, 17 bp, Homo sapiens
tgagaacagataaagat

SEQ ID NO: 1789295 - DNA, 13 bp, Homo sapiens
tgagaacccagag

SEQ ID NO: 1789296 - DNA, 14 bp, Homo sapiens
tgagaacccagaga

SEQ ID NO: 1789297 - DNA, 19 bp, Homo sapiens
tgagaactctctccctggt

SEQ ID NO: 1789298 - DNA, 15 bp, Homo sapiens
tgagaacttgacaag

SEQ ID NO: 1789299 - DNA, 16 bp, Homo sapiens
tgagaagagggcctgt

SEQ ID NO: 1789300 - DNA, 18 bp, Homo sapiens
tgagaagatcggaacagc

SEQ ID NO: 1789301 - DNA, 22 bp, Homo sapiens
tgagaagccatgtactcaagta

SEQ ID NO: 1789302 - DNA, 13 bp, Homo sapiens
tgagaagccttca

SEQ ID NO: 1789303 - DNA, 14 bp, Homo sapiens
tgagaagccttcag

SEQ ID NO: 1789304 - DNA, 14 bp, Homo sapiens
tgagaagcggtcat

SEQ ID NO: 1789305 - DNA, 17 bp, Homo sapiens
tgagaaggccagccctc

SEQ ID NO: 1789306 - DNA, 18 bp, Homo sapiens
tgagaaggccctgtgccc

SEQ ID NO: 1789307 - DNA, 16 bp, Homo sapiens
tgagaaggtccttaat

SEQ ID NO: 1789308 - DNA, 13 bp, Homo sapiens
tgagaagtacttg

SEQ ID NO: 1789309 - DNA, 12 bp, Homo sapiens
tgagaagtatac

SEQ ID NO: 1789310 - DNA, 15 bp, Homo sapiens
tgagaagttctcaga

SEQ ID NO: 1789311 - DNA, 23 bp, Homo sapiens
tgagaataagttcatacaatcgt

SEQ ID NO: 1789312 - DNA, 16 bp, Homo sapiens
tgagaatagaaacgta

SEQ ID NO: 1789313 - DNA, 21 bp, Homo sapiens
tgagaatataccttatttatt

SEQ ID NO: 1789314 - DNA, 16 bp, Homo sapiens
tgagaatcaaaactct

SEQ ID NO: 1789315 - DNA, 19 bp, Homo sapiens
tgagaatccagtttctttc

SEQ ID NO: 1789316 - DNA, 20 bp, Homo sapiens
tgagaatcctctcctttctt

SEQ ID NO: 1789317 - DNA, 23 bp, Homo sapiens
tgagaatctatatttaacaagat

SEQ ID NO: 1789318 - DNA, 16 bp, Homo sapiens
tgagaatgagtgggaa

SEQ ID NO: 1789319 - DNA, 17 bp, Homo sapiens
tgagacaagccctggca

SEQ ID NO: 1789320 - DNA, 22 bp, Homo sapiens
tgagacacggagcccagccctc

SEQ ID NO: 1789321 - DNA, 15 bp, Homo sapiens
tgagacagtcttgct

SEQ ID NO: 1789322 - DNA, 15 bp, Homo sapiens
tgagacagtgaattt

SEQ ID NO: 1789323 - DNA, 16 bp, Homo sapiens
tgagacagtgaatttg

SEQ ID NO: 1789324 - DNA, 10 bp, Homo sapiens
tgagacatcc

SEQ ID NO: 1789325 - DNA, 14 bp, Homo sapiens
tgagaccactgtta

SEQ ID NO: 1789326 - DNA, 13 bp, Homo sapiens
tgagaccagcctg

SEQ ID NO: 1789327 - DNA, 15 bp, Homo sapiens
tgagaccaggctggg

SEQ ID NO: 1789328 - DNA, 12 bp, Homo sapiens
tgagaccagttg

SEQ ID NO: 1789329 - DNA, 19 bp, Homo sapiens
tgagacccagtgcactccg

SEQ ID NO: 1789330 - DNA, 21 bp, Homo sapiens
tgagacccccaagcttccacc

SEQ ID NO: 1789331 - DNA, 19 bp, Homo sapiens
tgagaccctcgcagaccta

SEQ ID NO: 1789332 - DNA, 13 bp, Homo sapiens
tgagaccctgtct

SEQ ID NO: 1789333 - DNA, 15 bp, Homo sapiens
tgagaccctgtctca

SEQ ID NO: 1789334 - DNA, 18 bp, Homo sapiens
tgagacccttttctcagg

SEQ ID NO: 1789335 - DNA, 12 bp, Homo sapiens
tgagacctcagc

SEQ ID NO: 1789336 - DNA, 16 bp, Homo sapiens
tgagacctcagccatg

SEQ ID NO: 1789337 - DNA, 18 bp, Homo sapiens
tgagacctggaaccagag

SEQ ID NO: 1789338 - DNA, 19 bp, Homo sapiens
tgagacctgggatttgaga

SEQ ID NO: 1789339 - DNA, 23 bp, Homo sapiens
tgagacgtttttggaagagtagt

SEQ ID NO: 1789340 - DNA, 16 bp, Homo sapiens
tgagactcagtgcaga

SEQ ID NO: 1789341 - DNA, 17 bp, Homo sapiens
tgagactcagtgcagat

SEQ ID NO: 1789342 - DNA, 12 bp, Homo sapiens
tgagactcgaga

SEQ ID NO: 1789343 - DNA, 22 bp, Homo sapiens
tgagactctagggtccagtgga

SEQ ID NO: 1789344 - DNA, 22 bp, Homo sapiens
tgagactgcgggatggtcctgg

SEQ ID NO: 1789345 - DNA, 13 bp, Homo sapiens
tgagactggcact

SEQ ID NO: 1789346 - DNA, 21 bp, Homo sapiens
tgagactgggtaatttataaa

SEQ ID NO: 1789347 - DNA, 15 bp, Homo sapiens
tgagactttcccctc

SEQ ID NO: 1789348 - DNA, 14 bp, Homo sapiens
tgagactttctgct

SEQ ID NO: 1789349 - DNA, 19 bp, Homo sapiens
tgagagaaaaagtgcccct

SEQ ID NO: 1789350 - DNA, 20 bp, Homo sapiens
tgagagaaaaagtgcccctt

SEQ ID NO: 1789351 - DNA, 17 bp, Homo sapiens
tgagagaaagagagaag

SEQ ID NO: 1789352 - DNA, 14 bp, Homo sapiens
tgagaggctctccg

SEQ ID NO: 1789353 - DNA, 14 bp, Homo sapiens
tgagaggctgaggt

SEQ ID NO: 1789354 - DNA, 18 bp, Homo sapiens
tgagagggcaaggaagtg

SEQ ID NO: 1789355 - DNA, 17 bp, Homo sapiens
tgagagggcatgcgcac

SEQ ID NO: 1789356 - DNA, 22 bp, Homo sapiens
tgagagggctcgaggggtgggc

SEQ ID NO: 1789357 - DNA, 14 bp, Homo sapiens
tgagagtctagatt

SEQ ID NO: 1789358 - DNA, 17 bp, Homo sapiens
tgagagttccttctcac

SEQ ID NO: 1789359 - DNA, 18 bp, Homo sapiens
tgagagttccttctcact

SEQ ID NO: 1789360 - DNA, 18 bp, Homo sapiens
tgagagttggctcaggca

SEQ ID NO: 1789361 - DNA, 21 bp, Homo sapiens
tgagagttggctcaggcagac

SEQ ID NO: 1789362 - DNA, 18 bp, Homo sapiens
tgagagttttgtcttgaa

SEQ ID NO: 1789363 - DNA, 21 bp, Homo sapiens
tgagagttttgtcttgaatgt

SEQ ID NO: 1789364 - DNA, 21 bp, Homo sapiens
tgagataaagtcaaatgccaa

SEQ ID NO: 1789365 - DNA, 22 bp, Homo sapiens
tgagataaagtcaaatgccaaa

SEQ ID NO: 1789366 - DNA, 15 bp, Homo sapiens
tgagataagaaaagc

SEQ ID NO: 1789367 - DNA, 16 bp, Homo sapiens
tgagataatatctgtg

SEQ ID NO: 1789368 - DNA, 18 bp, Homo sapiens
tgagatagaatacatgta

SEQ ID NO: 1789369 - DNA, 19 bp, Homo sapiens
tgagatagtagcatacatt

SEQ ID NO: 1789370 - DNA, 23 bp, Homo sapiens
tgagatagtagcatacatttata

SEQ ID NO: 1789371 - DNA, 20 bp, Homo sapiens
tgagatatttattgtttatt

SEQ ID NO: 1789372 - DNA, 22 bp, Homo sapiens
tgagatcactgactctgactca

SEQ ID NO: 1789373 - DNA, 16 bp, Homo sapiens
tgagatcagcattcaa

SEQ ID NO: 1789374 - DNA, 21 bp, Homo sapiens
tgagatcgtgctactgcactc

SEQ ID NO: 1789375 - DNA, 12 bp, Homo sapiens
tgagatctaaaa

SEQ ID NO: 1789376 - DNA, 23 bp, Homo sapiens
tgagatctaagcctttccataag

SEQ ID NO: 1789377 - DNA, 15 bp, Homo sapiens
tgagatgagccccac

SEQ ID NO: 1789378 - DNA, 16 bp, Homo sapiens
tgagatgatttggtca

SEQ ID NO: 1789379 - DNA, 17 bp, Homo sapiens
tgagatgctggttttct

SEQ ID NO: 1789380 - DNA, 16 bp, Homo sapiens
tgagatggagaggctg

SEQ ID NO: 1789381 - DNA, 17 bp, Homo sapiens
tgagatggagaggctga

SEQ ID NO: 1789382 - DNA, 18 bp, Homo sapiens
tgagatggagaggctgag

SEQ ID NO: 1789383 - DNA, 17 bp, Homo sapiens
tgagatgggtgtacaaa

SEQ ID NO: 1789384 - DNA, 16 bp, Homo sapiens
tgagatgtagaaagtt

SEQ ID NO: 1789385 - DNA, 12 bp, Homo sapiens
tgagatgtatga

SEQ ID NO: 1789386 - DNA, 24 bp, Homo sapiens
tgagatgtgaacacatcagcttgc

SEQ ID NO: 1789387 - DNA, 14 bp, Homo sapiens
tgagatgtgctttg

SEQ ID NO: 1789388 - DNA, 20 bp, Homo sapiens
tgagatgtgctttgctgcac

SEQ ID NO: 1789389 - DNA, 17 bp, Homo sapiens
tgagatgttgtgtggca

SEQ ID NO: 1789390 - DNA, 17 bp, Homo sapiens
tgagattctttaaggag

SEQ ID NO: 1789391 - DNA, 18 bp, Homo sapiens
tgagattctttaaggaga

SEQ ID NO: 1789392 - DNA, 21 bp, Homo sapiens
tgagattctttaaggagatag

SEQ ID NO: 1789393 - DNA, 22 bp, Homo sapiens
tgagattctttaaggagataga

SEQ ID NO: 1789394 - DNA, 19 bp, Homo sapiens
tgagattggttttcctgtg

SEQ ID NO: 1789395 - DNA, 13 bp, Homo sapiens
tgagattgtgttt

SEQ ID NO: 1789396 - DNA, 14 bp, Homo sapiens
tgagatttcatctg

SEQ ID NO: 1789397 - DNA, 17 bp, Homo sapiens
tgagatttcttaaataa

SEQ ID NO: 1789398 - DNA, 19 bp, Homo sapiens
tgagcaactgcgacaaaac

SEQ ID NO: 1789399 - DNA, 19 bp, Homo sapiens
tgagcaagaccctgtctct

SEQ ID NO: 1789400 - DNA, 17 bp, Homo sapiens
tgagcaagatcttgtct

SEQ ID NO: 1789401 - DNA, 19 bp, Homo sapiens
tgagcaagatcttgtctcc

SEQ ID NO: 1789402 - DNA, 20 bp, Homo sapiens
tgagcaagatcttgtctcca

SEQ ID NO: 1789403 - DNA, 22 bp, Homo sapiens
tgagcaagatcttgtctccact

SEQ ID NO: 1789404 - DNA, 17 bp, Homo sapiens
tgagcaagatgatgtaa

SEQ ID NO: 1789405 - DNA, 23 bp, Homo sapiens
tgagcaaggagcacaagccacaa

SEQ ID NO: 1789406 - DNA, 16 bp, Homo sapiens
tgagcaagggggccca

SEQ ID NO: 1789407 - DNA, 16 bp, Homo sapiens
tgagcaatgtctgtgc

SEQ ID NO: 1789408 - DNA, 18 bp, Homo sapiens
tgagcaatgtctgtgcta

SEQ ID NO: 1789409 - DNA, 13 bp, Homo sapiens
tgagcacacttta

SEQ ID NO: 1789410 - DNA, 23 bp, Homo sapiens
tgagcacatgcgtatatgtgcgt

SEQ ID NO: 1789411 - DNA, 17 bp, Homo sapiens
tgagcaccgtcatggct

SEQ ID NO: 1789412 - DNA, 19 bp, Homo sapiens
tgagcaccgtcatggctta

SEQ ID NO: 1789413 - DNA, 15 bp, Homo sapiens
tgagcactgtttata

SEQ ID NO: 1789414 - DNA, 18 bp, Homo sapiens
tgagcagaatactggtct

SEQ ID NO: 1789415 - DNA, 16 bp, Homo sapiens
tgagcagaatgttgta

SEQ ID NO: 1789416 - DNA, 18 bp, Homo sapiens
tgagcagaatgttgtact

SEQ ID NO: 1789417 - DNA, 17 bp, Homo sapiens
tgagcagagatgtactg

SEQ ID NO: 1789418 - DNA, 16 bp, Homo sapiens
tgagcagccgccagct

SEQ ID NO: 1789419 - DNA, 22 bp, Homo sapiens
tgagcagcctctgccaggcctg

SEQ ID NO: 1789420 - DNA, 21 bp, Homo sapiens
tgagcaggcagggctgggcca

SEQ ID NO: 1789421 - DNA, 20 bp, Homo sapiens
tgagcagggtcaagcctctt

SEQ ID NO: 1789422 - DNA, 21 bp, Homo sapiens
tgagcagggtcaagcctctta

SEQ ID NO: 1789423 - DNA, 17 bp, Homo sapiens
tgagcagggtccacagc

SEQ ID NO: 1789424 - DNA, 18 bp, Homo sapiens
tgagcagggtccacagct

SEQ ID NO: 1789425 - DNA, 19 bp, Homo sapiens
tgagcagggtccacagctg

SEQ ID NO: 1789426 - DNA, 18 bp, Homo sapiens
tgagcagtcacactgtta

SEQ ID NO: 1789427 - DNA, 13 bp, Homo sapiens
tgagcagtggctg

SEQ ID NO: 1789428 - DNA, 22 bp, Homo sapiens
tgagcagtggctggtccagggc

SEQ ID NO: 1789429 - DNA, 18 bp, Homo sapiens
tgagcatcaatcttgtta

SEQ ID NO: 1789430 - DNA, 20 bp, Homo sapiens
tgagcatcaatcttgttact

SEQ ID NO: 1789431 - DNA, 15 bp, Homo sapiens
tgagcatcctggcag

SEQ ID NO: 1789432 - DNA, 16 bp, Homo sapiens
tgagcatcctggcagg

SEQ ID NO: 1789433 - DNA, 20 bp, Homo sapiens
tgagcatttgaaaggtgtgc

SEQ ID NO: 1789434 - DNA, 23 bp, Homo sapiens
tgagcatttttttaaaagaagct

SEQ ID NO: 1789435 - DNA, 18 bp, Homo sapiens
tgagccaagatcgcacca

SEQ ID NO: 1789436 - DNA, 17 bp, Homo sapiens
tgagccaccgctgccag

SEQ ID NO: 1789437 - DNA, 23 bp, Homo sapiens
tgagccaccgctgccagcacaga

SEQ ID NO: 1789438 - DNA, 22 bp, Homo sapiens
tgagccactcgcagtcgcagga

SEQ ID NO: 1789439 - DNA, 14 bp, Homo sapiens
tgagccagacaaat

SEQ ID NO: 1789440 - DNA, 13 bp, Homo sapiens
tgagccagaggga

SEQ ID NO: 1789441 - DNA, 15 bp, Homo sapiens
tgagccagggaacag

SEQ ID NO: 1789442 - DNA, 19 bp, Homo sapiens
tgagccagggaacagcccc

SEQ ID NO: 1789443 - DNA, 20 bp, Homo sapiens
tgagccagggaacagcccca

SEQ ID NO: 1789444 - DNA, 21 bp, Homo sapiens
tgagccagggaacagccccag

SEQ ID NO: 1789445 - DNA, 22 bp, Homo sapiens
tgagccagggaacagccccagg

SEQ ID NO: 1789446 - DNA, 16 bp, Homo sapiens
tgagccagtcccaggg

SEQ ID NO: 1789447 - DNA, 19 bp, Homo sapiens
tgagccagtcccaggggca

SEQ ID NO: 1789448 - DNA, 22 bp, Homo sapiens
tgagccatcactagaagaaaag

SEQ ID NO: 1789449 - DNA, 23 bp, Homo sapiens
tgagccatgaggagcgtggactc

SEQ ID NO: 1789450 - DNA, 20 bp, Homo sapiens
tgagcccactgcccaccccc

SEQ ID NO: 1789451 - DNA, 23 bp, Homo sapiens
tgagcccactgcccaccccctca

SEQ ID NO: 1789452 - DNA, 14 bp, Homo sapiens
tgagcccaggagct

SEQ ID NO: 1789453 - DNA, 13 bp, Homo sapiens
tgagcccaggagt

SEQ ID NO: 1789454 - DNA, 13 bp, Homo sapiens
tgagcccaggccg

SEQ ID NO: 1789455 - DNA, 15 bp, Homo sapiens
tgagcccccggctag

SEQ ID NO: 1789456 - DNA, 15 bp, Homo sapiens
tgagccccctgcacc

SEQ ID NO: 1789457 - DNA, 19 bp, Homo sapiens
tgagcccctaccccacacc

SEQ ID NO: 1789458 - DNA, 22 bp, Homo sapiens
tgagcccctaccccacaccagg

SEQ ID NO: 1789459 - DNA, 23 bp, Homo sapiens
tgagccccttcatccgcctgtgg

SEQ ID NO: 1789460 - DNA, 15 bp, Homo sapiens
tgagcccgggctgcc

SEQ ID NO: 1789461 - DNA, 18 bp, Homo sapiens
tgagcccgggctgcctgg

SEQ ID NO: 1789462 - DNA, 19 bp, Homo sapiens
tgagcccgggctgcctggg

SEQ ID NO: 1789463 - DNA, 21 bp, Homo sapiens
tgagcccgggctgcctgggct

SEQ ID NO: 1789464 - DNA, 22 bp, Homo sapiens
tgagcccgggctgcctgggctg

SEQ ID NO: 1789465 - DNA, 13 bp, Homo sapiens
tgagccctggctg

SEQ ID NO: 1789466 - DNA, 20 bp, Homo sapiens
tgagccgagattgcgccact

SEQ ID NO: 1789467 - DNA, 17 bp, Homo sapiens
tgagccgcatcttctcc

SEQ ID NO: 1789468 - DNA, 19 bp, Homo sapiens
tgagccgggcccctgggct

SEQ ID NO: 1789469 - DNA, 20 bp, Homo sapiens
tgagccgggcccctgggctt

SEQ ID NO: 1789470 - DNA, 16 bp, Homo sapiens
tgagcctcaaccttct

SEQ ID NO: 1789471 - DNA, 17 bp, Homo sapiens
tgagcctcccccaaagc

SEQ ID NO: 1789472 - DNA, 15 bp, Homo sapiens
tgagccttgagagaa

SEQ ID NO: 1789473 - DNA, 16 bp, Homo sapiens
tgagccttttccctct

SEQ ID NO: 1789474 - DNA, 13 bp, Homo sapiens
tgagcgccacctc

SEQ ID NO: 1789475 - DNA, 14 bp, Homo sapiens
tgagcgccacctct

SEQ ID NO: 1789476 - DNA, 19 bp, Homo sapiens
tgagcgccccgcccccacc

SEQ ID NO: 1789477 - DNA, 21 bp, Homo sapiens
tgagcgccccgcccccacccc

SEQ ID NO: 1789478 - DNA, 23 bp, Homo sapiens
tgagcgcctccatccaaggccag

SEQ ID NO: 1789479 - DNA, 14 bp, Homo sapiens
tgagcgctgtggac

SEQ ID NO: 1789480 - DNA, 17 bp, Homo sapiens
tgagcggcgcagagccc

SEQ ID NO: 1789481 - DNA, 16 bp, Homo sapiens
tgagcgtttgcacggt

SEQ ID NO: 1789482 - DNA, 18 bp, Homo sapiens
tgagctaccgtggatctc

SEQ ID NO: 1789483 - DNA, 21 bp, Homo sapiens
tgagctaccgtggatctcctt

SEQ ID NO: 1789484 - DNA, 23 bp, Homo sapiens
tgagctaccgtggatctccttcc

SEQ ID NO: 1789485 - DNA, 21 bp, Homo sapiens
tgagctatgattatgccactg

SEQ ID NO: 1789486 - DNA, 23 bp, Homo sapiens
tgagctatgattatgccactgct

SEQ ID NO: 1789487 - DNA, 15 bp, Homo sapiens
tgagctattcacctc

SEQ ID NO: 1789488 - DNA, 22 bp, Homo sapiens
tgagctcaggagtttgagacca

SEQ ID NO: 1789489 - DNA, 12 bp, Homo sapiens
tgagctcaggca

SEQ ID NO: 1789490 - DNA, 15 bp, Homo sapiens
tgagctccacctctg

SEQ ID NO: 1789491 - DNA, 16 bp, Homo sapiens
tgagctccacctctgg

SEQ ID NO: 1789492 - DNA, 19 bp, Homo sapiens
tgagctccacctctggtgg

SEQ ID NO: 1789493 - DNA, 14 bp, Homo sapiens
tgagctcccacctc

SEQ ID NO: 1789494 - DNA, 15 bp, Homo sapiens
tgagctcccacctcc

SEQ ID NO: 1789495 - DNA, 17 bp, Homo sapiens
tgagctcccctggagcc

SEQ ID NO: 1789496 - DNA, 19 bp, Homo sapiens
tgagctcccctggagccag

SEQ ID NO: 1789497 - DNA, 21 bp, Homo sapiens
tgagctcggggggctctgcct

SEQ ID NO: 1789498 - DNA, 14 bp, Homo sapiens
tgagctcggtggac

SEQ ID NO: 1789499 - DNA, 16 bp, Homo sapiens
tgagctctccaggcca

SEQ ID NO: 1789500 - DNA, 17 bp, Homo sapiens
tgagctctccaggccag

SEQ ID NO: 1789501 - DNA, 12 bp, Homo sapiens
tgagctctgaaa

SEQ ID NO: 1789502 - DNA, 15 bp, Homo sapiens
tgagctcttccctta

SEQ ID NO: 1789503 - DNA, 21 bp, Homo sapiens
tgagctcttcctatccctctc

SEQ ID NO: 1789504 - DNA, 12 bp, Homo sapiens
tgagctgcaggt

SEQ ID NO: 1789505 - DNA, 16 bp, Homo sapiens
tgagctgcctctgaga

SEQ ID NO: 1789506 - DNA, 12 bp, Homo sapiens
tgagctgctcat

SEQ ID NO: 1789507 - DNA, 17 bp, Homo sapiens
tgagctgctttttttga

SEQ ID NO: 1789508 - DNA, 18 bp, Homo sapiens
tgagctgctttttttgaa

SEQ ID NO: 1789509 - DNA, 19 bp, Homo sapiens
tgagctgctttttttgaaa

SEQ ID NO: 1789510 - DNA, 19 bp, Homo sapiens
tgagctggatagacttggg

SEQ ID NO: 1789511 - DNA, 21 bp, Homo sapiens
tgagctgggaagctgtactca

SEQ ID NO: 1789512 - DNA, 15 bp, Homo sapiens
tgagctggggccaca

SEQ ID NO: 1789513 - DNA, 21 bp, Homo sapiens
tgagctggggtgggagctcct

SEQ ID NO: 1789514 - DNA, 17 bp, Homo sapiens
tgagctgtcgctgcctc

SEQ ID NO: 1789515 - DNA, 18 bp, Homo sapiens
tgagctgtcgctgcctcc

SEQ ID NO: 1789516 - DNA, 23 bp, Homo sapiens
tgagctgtcgctgcctccatggc

SEQ ID NO: 1789517 - DNA, 23 bp, Homo sapiens
tgagctgtgttttgtctgagcct

SEQ ID NO: 1789518 - DNA, 12 bp, Homo sapiens
tgagctgttgga

SEQ ID NO: 1789519 - DNA, 11 bp, Homo sapiens
tgagctgtttt

SEQ ID NO: 1789520 - DNA, 18 bp, Homo sapiens
tgagcttacattgaaaac

SEQ ID NO: 1789521 - DNA, 20 bp, Homo sapiens
tgagcttagccttgtgccct

SEQ ID NO: 1789522 - DNA, 15 bp, Homo sapiens
tgagcttcaatataa

SEQ ID NO: 1789523 - DNA, 16 bp, Homo sapiens
tgagcttcaatataag

SEQ ID NO: 1789524 - DNA, 17 bp, Homo sapiens
tgagcttgagctcccct

SEQ ID NO: 1789525 - DNA, 20 bp, Homo sapiens
tgagcttggcagctgaacta

SEQ ID NO: 1789526 - DNA, 19 bp, Homo sapiens
tgagctttccatgttgctg

SEQ ID NO: 1789527 - DNA, 21 bp, Homo sapiens
tgagctttggggacagttggc

SEQ ID NO: 1789528 - DNA, 12 bp, Homo sapiens
tgaggaaaatat

SEQ ID NO: 1789529 - DNA, 19 bp, Homo sapiens
tgaggaactcacatactga

SEQ ID NO: 1789530 - DNA, 23 bp, Homo sapiens
tgaggaagaacggggctcttctc

SEQ ID NO: 1789531 - DNA, 24 bp, Homo sapiens
tgaggaagaacggggctcttctca

SEQ ID NO: 1789532 - DNA, 18 bp, Homo sapiens
tgaggaagacaagcattt

SEQ ID NO: 1789533 - DNA, 17 bp, Homo sapiens
tgaggaagagggactgt

SEQ ID NO: 1789534 - DNA, 19 bp, Homo sapiens
tgaggaatacagaagcagt

SEQ ID NO: 1789535 - DNA, 19 bp, Homo sapiens
tgaggaatcaacagggcag

SEQ ID NO: 1789536 - DNA, 18 bp, Homo sapiens
tgaggaatggacatttct

SEQ ID NO: 1789537 - DNA, 22 bp, Homo sapiens
tgaggaatttcacctgtaaacc

SEQ ID NO: 1789538 - DNA, 14 bp, Homo sapiens
tgaggaattttctt

SEQ ID NO: 1789539 - DNA, 18 bp, Homo sapiens
tgaggaattttctttgtg

SEQ ID NO: 1789540 - DNA, 22 bp, Homo sapiens
tgaggacagaaggactggtgcg

SEQ ID NO: 1789541 - DNA, 12 bp, Homo sapiens
tgaggacagagc

SEQ ID NO: 1789542 - DNA, 14 bp, Homo sapiens
tgaggacagagggc

SEQ ID NO: 1789543 - DNA, 22 bp, Homo sapiens
tgaggaccccttaatcttgctt

SEQ ID NO: 1789544 - DNA, 16 bp, Homo sapiens
tgaggaccgctgataa

SEQ ID NO: 1789545 - DNA, 20 bp, Homo sapiens
tgaggaccgctgataagcat

SEQ ID NO: 1789546 - DNA, 22 bp, Homo sapiens
tgaggaccgctgataagcattg

SEQ ID NO: 1789547 - DNA, 21 bp, Homo sapiens
tgaggacctctcagcatagcc

SEQ ID NO: 1789548 - DNA, 19 bp, Homo sapiens
tgaggacgagacccccatc

SEQ ID NO: 1789549 - DNA, 20 bp, Homo sapiens
tgaggacgagacccccatcc

SEQ ID NO: 1789550 - DNA, 17 bp, Homo sapiens
tgaggactcatatattt

SEQ ID NO: 1789551 - DNA, 20 bp, Homo sapiens
tgaggactcatatatttaag

SEQ ID NO: 1789552 - DNA, 15 bp, Homo sapiens
tgaggacttcaagcc

SEQ ID NO: 1789553 - DNA, 11 bp, Homo sapiens
tgaggagaagg

SEQ ID NO: 1789554 - DNA, 22 bp, Homo sapiens
tgaggagaagggggtctctgtt

SEQ ID NO: 1789555 - DNA, 14 bp, Homo sapiens
tgaggagaatgaaa

SEQ ID NO: 1789556 - DNA, 21 bp, Homo sapiens
tgaggagatgaccagggatgc

SEQ ID NO: 1789557 - DNA, 16 bp, Homo sapiens
tgaggagccccagcta

SEQ ID NO: 1789558 - DNA, 18 bp, Homo sapiens
tgaggagccctgaggacc

SEQ ID NO: 1789559 - DNA, 17 bp, Homo sapiens
tgagtaagagctggtgt

SEQ ID NO: 1789560 - DNA, 21 bp, Homo sapiens
tgagtaagagctggtgtctga

SEQ ID NO: 1789561 - DNA, 22 bp, Homo sapiens
tgagtaagccagttggcttcta

SEQ ID NO: 1789562 - DNA, 22 bp, Homo sapiens
tgagtaatcaatacagacaagg

SEQ ID NO: 1789563 - DNA, 18 bp, Homo sapiens
tgagtaatggtgtagaac

SEQ ID NO: 1789564 - DNA, 19 bp, Homo sapiens
tgagtaatggtgtagaaca

SEQ ID NO: 1789565 - DNA, 21 bp, Homo sapiens
tgagtacagatactgtgagct

SEQ ID NO: 1789566 - DNA, 15 bp, Homo sapiens
tgagtacagcagaaa

SEQ ID NO: 1789567 - DNA, 14 bp, Homo sapiens
tgagtacctgcaaa

SEQ ID NO: 1789568 - DNA, 21 bp, Homo sapiens
tgagtagatccatttccattg

SEQ ID NO: 1789569 - DNA, 13 bp, Homo sapiens
tgagtagctggat

SEQ ID NO: 1789570 - DNA, 15 bp, Homo sapiens
tgagtagctgggact

SEQ ID NO: 1789571 - DNA, 13 bp, Homo sapiens
tgagtaggctggg

SEQ ID NO: 1789572 - DNA, 18 bp, Homo sapiens
tgagtatgcttgggccct

SEQ ID NO: 1789573 - DNA, 19 bp, Homo sapiens
tgagtatgcttgggccctg

SEQ ID NO: 1789574 - DNA, 21 bp, Homo sapiens
tgagtatgcttgggccctgca

SEQ ID NO: 1789575 - DNA, 20 bp, Homo sapiens
tgagtattccatgagctgct

SEQ ID NO: 1789576 - DNA, 13 bp, Homo sapiens
tgagtattctcat

SEQ ID NO: 1789577 - DNA, 22 bp, Homo sapiens
tgagtattctcataggagactg

SEQ ID NO: 1789578 - DNA, 15 bp, Homo sapiens
tgagtattgtttaaa

SEQ ID NO: 1789579 - DNA, 19 bp, Homo sapiens
tgagtatttggtccaaaaa

SEQ ID NO: 1789580 - DNA, 16 bp, Homo sapiens
tgagtattttttataa

SEQ ID NO: 1789581 - DNA, 13 bp, Homo sapiens
tgagtcaaaacaa

SEQ ID NO: 1789582 - DNA, 14 bp, Homo sapiens
tgagtcaaaacaaa

SEQ ID NO: 1789583 - DNA, 21 bp, Homo sapiens
tgagtcaaatccagtggtggg

SEQ ID NO: 1789584 - DNA, 13 bp, Homo sapiens
tgagtcaccagga

SEQ ID NO: 1789585 - DNA, 16 bp, Homo sapiens
tgagtcacctgctcca

SEQ ID NO: 1789586 - DNA, 15 bp, Homo sapiens
tgagtcagcaccttg

SEQ ID NO: 1789587 - DNA, 14 bp, Homo sapiens
tgagtcccctactc

SEQ ID NO: 1789588 - DNA, 15 bp, Homo sapiens
tgagtcccctactcc

SEQ ID NO: 1789589 - DNA, 16 bp, Homo sapiens
tgagtcccctccagga

SEQ ID NO: 1789590 - DNA, 22 bp, Homo sapiens
tgagtccctgtgatggccaggc

SEQ ID NO: 1789591 - DNA, 15 bp, Homo sapiens
tgagtcctaggactt

SEQ ID NO: 1789592 - DNA, 17 bp, Homo sapiens
tgagtcctggtttcctg

SEQ ID NO: 1789593 - DNA, 15 bp, Homo sapiens
tgagtctagatgttt

SEQ ID NO: 1789594 - DNA, 16 bp, Homo sapiens
tgagtctatcctagtc

SEQ ID NO: 1789595 - DNA, 19 bp, Homo sapiens
tgagtctatcctagtcttc

SEQ ID NO: 1789596 - DNA, 17 bp, Homo sapiens
tgagtctatgttcaaag

SEQ ID NO: 1789597 - DNA, 19 bp, Homo sapiens
tgagtctcaagggtggcag

SEQ ID NO: 1789598 - DNA, 16 bp, Homo sapiens
tgagtctcctctctga

SEQ ID NO: 1789599 - DNA, 19 bp, Homo sapiens
tgagtctcctctctgagac

SEQ ID NO: 1789600 - DNA, 18 bp, Homo sapiens
tgagtctgagtcctgtct

SEQ ID NO: 1789601 - DNA, 21 bp, Homo sapiens
tgagtctgagtcctgtctctg

SEQ ID NO: 1789602 - DNA, 15 bp, Homo sapiens
tgagtcttggcggca

SEQ ID NO: 1789603 - DNA, 17 bp, Homo sapiens
tgagtcttggcggcagc

SEQ ID NO: 1789604 - DNA, 21 bp, Homo sapiens
tgagtcttggcggcagcagcc

SEQ ID NO: 1789605 - DNA, 18 bp, Homo sapiens
tgagtctttggttctaag

SEQ ID NO: 1789606 - DNA, 20 bp, Homo sapiens
tgagtctttggttctaagga

SEQ ID NO: 1789607 - DNA, 23 bp, Homo sapiens
tgagtgaaaatttttacattcat

SEQ ID NO: 1789608 - DNA, 14 bp, Homo sapiens
tgagtgacagcttt

SEQ ID NO: 1789609 - DNA, 15 bp, Homo sapiens
tgagtgacagctttc

SEQ ID NO: 1789610 - DNA, 20 bp, Homo sapiens
tgagtgacagctttctggga

SEQ ID NO: 1789611 - DNA, 15 bp, Homo sapiens
tgagtgagccacaga

SEQ ID NO: 1789612 - DNA, 18 bp, Homo sapiens
tgagtgcacctgcctcca

SEQ ID NO: 1789613 - DNA, 17 bp, Homo sapiens
tgagtgccaatttctta

SEQ ID NO: 1789614 - DNA, 17 bp, Homo sapiens
tgagtgccttttgcaga

SEQ ID NO: 1789615 - DNA, 19 bp, Homo sapiens
tgagtgccttttgcagaag

SEQ ID NO: 1789616 - DNA, 22 bp, Homo sapiens
tgagtgccttttgcagaagagg

SEQ ID NO: 1789617 - DNA, 14 bp, Homo sapiens
tgagtggaatgcag

SEQ ID NO: 1789618 - DNA, 13 bp, Homo sapiens
tgagtggcagcag

SEQ ID NO: 1789619 - DNA, 15 bp, Homo sapiens
tgagtggcagcagcc

SEQ ID NO: 1789620 - DNA, 16 bp, Homo sapiens
tgagtggcagcagccc

SEQ ID NO: 1789621 - DNA, 16 bp, Homo sapiens
tgagtggcagccatgc

SEQ ID NO: 1789622 - DNA, 21 bp, Homo sapiens
tgagtggggttatctctgtgt

SEQ ID NO: 1789623 - DNA, 22 bp, Homo sapiens
tgagtggggttatctctgtgtt

SEQ ID NO: 1789624 - DNA, 14 bp, Homo sapiens
tgagtgtatgagta

SEQ ID NO: 1789625 - DNA, 23 bp, Homo sapiens
tgagtgtcccaagccgggagcca

SEQ ID NO: 1789626 - DNA, 18 bp, Homo sapiens
tgagtgtcttaattaaaa

SEQ ID NO: 1789627 - DNA, 21 bp, Homo sapiens
tgagtgtgtggtctctgcccc

SEQ ID NO: 1789628 - DNA, 14 bp, Homo sapiens
tgagtgttcatttt

SEQ ID NO: 1789629 - DNA, 17 bp, Homo sapiens
tgagtgttcctttttaa

SEQ ID NO: 1789630 - DNA, 20 bp, Homo sapiens
tgagttacttgtctgaggcc

SEQ ID NO: 1789631 - DNA, 21 bp, Homo sapiens
tgagttacttgtctgaggcct

SEQ ID NO: 1789632 - DNA, 20 bp, Homo sapiens
tgagttatcatgaattttaa

SEQ ID NO: 1789633 - DNA, 17 bp, Homo sapiens
tgagttattttaattat

SEQ ID NO: 1789634 - DNA, 16 bp, Homo sapiens
tgagttccagttgaag

SEQ ID NO: 1789635 - DNA, 17 bp, Homo sapiens
tgagttccagttgaagt

SEQ ID NO: 1789636 - DNA, 19 bp, Homo sapiens
tgagttcttgtgtcctggt

SEQ ID NO: 1789637 - DNA, 21 bp, Homo sapiens
tgagttggaacaacatgttct

SEQ ID NO: 1789638 - DNA, 17 bp, Homo sapiens
tgagttggacttcagtc

SEQ ID NO: 1789639 - DNA, 19 bp, Homo sapiens
tgagttggacttcagtctt

SEQ ID NO: 1789640 - DNA, 18 bp, Homo sapiens
tgagttgggggagggaag

SEQ ID NO: 1789641 - DNA, 18 bp, Homo sapiens
tgagttgtcacagaaatt

SEQ ID NO: 1789642 - DNA, 14 bp, Homo sapiens
tgagttgttctaac

SEQ ID NO: 1789643 - DNA, 23 bp, Homo sapiens
tgagttgttttcagactcagact

SEQ ID NO: 1789644 - DNA, 20 bp, Homo sapiens
tgagtttaaaaaaataacat

SEQ ID NO: 1789645 - DNA, 22 bp, Homo sapiens
tgagtttcactgtactgcatgt

SEQ ID NO: 1789646 - DNA, 14 bp, Homo sapiens
tgagtttcttagac

SEQ ID NO: 1789647 - DNA, 16 bp, Homo sapiens
tgagtttgagctgcct

SEQ ID NO: 1789648 - DNA, 17 bp, Homo sapiens
tgagtttgagctgcctt

SEQ ID NO: 1789649 - DNA, 19 bp, Homo sapiens
tgagtttgagctgccttcc

SEQ ID NO: 1789650 - DNA, 19 bp, Homo sapiens
tgagtttgtagaactttat

SEQ ID NO: 1789651 - DNA, 14 bp, Homo sapiens
tgagttttctcctt

SEQ ID NO: 1789652 - DNA, 21 bp, Homo sapiens
tgagttttgtgtttgttgtag

SEQ ID NO: 1789653 - DNA, 20 bp, Homo sapiens
tgagttttgttttaaaatta

SEQ ID NO: 1789654 - DNA, 12 bp, Homo sapiens
tgataaaatcat

SEQ ID NO: 1789655 - DNA, 21 bp, Homo sapiens
tgataaacattaaacactgta

SEQ ID NO: 1789656 - DNA, 12 bp, Homo sapiens
tgataaacattc

SEQ ID NO: 1789657 - DNA, 17 bp, Homo sapiens
tgataaactcagatctg

SEQ ID NO: 1789658 - DNA, 14 bp, Homo sapiens
tgataaactgacga

SEQ ID NO: 1789659 - DNA, 16 bp, Homo sapiens
tgataaagtcccctta

SEQ ID NO: 1789660 - DNA, 15 bp, Homo sapiens
tgataaagttcctta

SEQ ID NO: 1789661 - DNA, 16 bp, Homo sapiens
tgataaagttccttaa

SEQ ID NO: 1789662 - DNA, 13 bp, Homo sapiens
tgataaatccatc

SEQ ID NO: 1789663 - DNA, 16 bp, Homo sapiens
tgataacaaaaaataa

SEQ ID NO: 1789664 - DNA, 22 bp, Homo sapiens
tgataacaaccttttacattgt

SEQ ID NO: 1789665 - DNA, 23 bp, Homo sapiens
tgataacaaccttttacattgtg

SEQ ID NO: 1789666 - DNA, 13 bp, Homo sapiens
tgataacaccttg

SEQ ID NO: 1789667 - DNA, 20 bp, Homo sapiens
tgataacagggattgatttt

SEQ ID NO: 1789668 - DNA, 17 bp, Homo sapiens
tgataacttggggaggc

SEQ ID NO: 1789669 - DNA, 12 bp, Homo sapiens
tgataagaggaa

SEQ ID NO: 1789670 - DNA, 12 bp, Homo sapiens
tgataagtaaat

SEQ ID NO: 1789671 - DNA, 12 bp, Homo sapiens
tgcagaatctct

SEQ ID NO: 1789672 - DNA, 11 bp, Homo sapiens
tgcagaatgta

SEQ ID NO: 1789673 - DNA, 12 bp, Homo sapiens
tgcagaatgtaa

SEQ ID NO: 1789674 - DNA, 21 bp, Homo sapiens
tgcagaatgtaagtgggccca

SEQ ID NO: 1789675 - DNA, 23 bp, Homo sapiens
tgcagaattaactataacaatca

SEQ ID NO: 1789676 - DNA, 19 bp, Homo sapiens
tgcagacaaagccctgtcc

SEQ ID NO: 1789677 - DNA, 21 bp, Homo sapiens
tgcagacaaagccctgtcctt

SEQ ID NO: 1789678 - DNA, 23 bp, Homo sapiens
tgcagacacagattatgttcctg

SEQ ID NO: 1789679 - DNA, 21 bp, Homo sapiens
tgcagacacgccttcccctca

SEQ ID NO: 1789680 - DNA, 13 bp, Homo sapiens
tgcagacagccat

SEQ ID NO: 1789681 - DNA, 14 bp, Homo sapiens
tgcagacagccatg

SEQ ID NO: 1789682 - DNA, 15 bp, Homo sapiens
tgcagacagccatgc

SEQ ID NO: 1789683 - DNA, 16 bp, Homo sapiens
tgcagacagccatgcg

SEQ ID NO: 1789684 - DNA, 13 bp, Homo sapiens
tgcagacaggcca

SEQ ID NO: 1789685 - DNA, 21 bp, Homo sapiens
tgcagacagtctgttatgcac

SEQ ID NO: 1789686 - DNA, 16 bp, Homo sapiens
tgcagaccatgccaga

SEQ ID NO: 1789687 - DNA, 19 bp, Homo sapiens
tgcagaccccttggccagc

SEQ ID NO: 1789688 - DNA, 15 bp, Homo sapiens
tgcagacctcatgcc

SEQ ID NO: 1789689 - DNA, 23 bp, Homo sapiens
tgcagactagaattctagtgctg

SEQ ID NO: 1789690 - DNA, 15 bp, Homo sapiens
tgcagactcagtttg

SEQ ID NO: 1789691 - DNA, 22 bp, Homo sapiens
tgcagactgctgctagagccag

SEQ ID NO: 1789692 - DNA, 19 bp, Homo sapiens
tgcagacttttcagactga

SEQ ID NO: 1789693 - DNA, 18 bp, Homo sapiens
tgcagagaagattttata

SEQ ID NO: 1789694 - DNA, 17 bp, Homo sapiens
tgcagagacaggacctg

SEQ ID NO: 1789695 - DNA, 20 bp, Homo sapiens
tgcagagatttctcattgac

SEQ ID NO: 1789696 - DNA, 19 bp, Homo sapiens
tgcagagccttctcagaag

SEQ ID NO: 1789697 - DNA, 20 bp, Homo sapiens
tgcagagccttctcagaagc

SEQ ID NO: 1789698 - DNA, 17 bp, Homo sapiens
tgcagaggccagaggcc

SEQ ID NO: 1789699 - DNA, 17 bp, Homo sapiens
tgcagaggtaccctggg

SEQ ID NO: 1789700 - DNA, 18 bp, Homo sapiens
tgcagaggtaccctgggt

SEQ ID NO: 1789701 - DNA, 16 bp, Homo sapiens
tgcagaggtctccaaa

SEQ ID NO: 1789702 - DNA, 15 bp, Homo sapiens
tgcagaggtctgtgc

SEQ ID NO: 1789703 - DNA, 21 bp, Homo sapiens
tgcagaggtctgtgctgaggc

SEQ ID NO: 1789704 - DNA, 16 bp, Homo sapiens
tgcagagtaagtatta

SEQ ID NO: 1789705 - DNA, 14 bp, Homo sapiens
tgcagagtatttct

SEQ ID NO: 1789706 - DNA, 21 bp, Homo sapiens
tgcagagtggaaactcagccg

SEQ ID NO: 1789707 - DNA, 21 bp, Homo sapiens
tgcagataaactgatgtttga

SEQ ID NO: 1789708 - DNA, 16 bp, Homo sapiens
tgcagatagaaagcat

SEQ ID NO: 1789709 - DNA, 18 bp, Homo sapiens
tgcagatatctgcatgtg

SEQ ID NO: 1789710 - DNA, 15 bp, Homo sapiens
tgcagatatgttgag

SEQ ID NO: 1789711 - DNA, 14 bp, Homo sapiens
tgcagatctgtgct

SEQ ID NO: 1789712 - DNA, 15 bp, Homo sapiens
tgcagatctgtgctc

SEQ ID NO: 1789713 - DNA, 20 bp, Homo sapiens
tgcagatgagcagtcacact

SEQ ID NO: 1789714 - DNA, 22 bp, Homo sapiens
tgcagatgagcagtcacactgt

SEQ ID NO: 1789715 - DNA, 14 bp, Homo sapiens
tgcagatgcctggg

SEQ ID NO: 1789716 - DNA, 14 bp, Homo sapiens
tgcagatgttcaaa

SEQ ID NO: 1789717 - DNA, 16 bp, Homo sapiens
tgcagatgttcaaata

SEQ ID NO: 1789718 - DNA, 18 bp, Homo sapiens
tgcagattcctgggcctg

SEQ ID NO: 1789719 - DNA, 19 bp, Homo sapiens
tgcagattcctgggcctgt

SEQ ID NO: 1789720 - DNA, 20 bp, Homo sapiens
tgcagattcctgggcctgtc

SEQ ID NO: 1789721 - DNA, 16 bp, Homo sapiens
tgcagattctatttcc

SEQ ID NO: 1789722 - DNA, 13 bp, Homo sapiens
tgcagcaaaagca

SEQ ID NO: 1789723 - DNA, 22 bp, Homo sapiens
tgcagcacatgcgggctcgccc

SEQ ID NO: 1789724 - DNA, 20 bp, Homo sapiens
tgcagcacctccaggcctgt

SEQ ID NO: 1789725 - DNA, 22 bp, Homo sapiens
tgcagcagaggacagtctggag

SEQ ID NO: 1789726 - DNA, 16 bp, Homo sapiens
tgcagcagcccagctt

SEQ ID NO: 1789727 - DNA, 20 bp, Homo sapiens
tgcagcagcccagcttcctg

SEQ ID NO: 1789728 - DNA, 23 bp, Homo sapiens
tgcagcaggaatatatgtgtgcc

SEQ ID NO: 1789729 - DNA, 15 bp, Homo sapiens
tgcagcatgagactt

SEQ ID NO: 1789730 - DNA, 21 bp, Homo sapiens
tgcagcatgagactttctgct

SEQ ID NO: 1789731 - DNA, 20 bp, Homo sapiens
tgcagcatttactatgcaca

SEQ ID NO: 1789732 - DNA, 16 bp, Homo sapiens
tgcagccacttaggac

SEQ ID NO: 1789733 - DNA, 19 bp, Homo sapiens
tgcagccagcccagcccag

SEQ ID NO: 1789734 - DNA, 19 bp, Homo sapiens
tgcagcccctcctcctcgg

SEQ ID NO: 1789735 - DNA, 22 bp, Homo sapiens
tgcagccctctccaccctccgg

SEQ ID NO: 1789736 - DNA, 23 bp, Homo sapiens
tgcagccctctccaccctccggc

SEQ ID NO: 1789737 - DNA, 12 bp, Homo sapiens
tgcagccctctt

SEQ ID NO: 1789738 - DNA, 12 bp, Homo sapiens
tgcagcctccac

SEQ ID NO: 1789739 - DNA, 18 bp, Homo sapiens
tgcagcctccacttccct

SEQ ID NO: 1789740 - DNA, 14 bp, Homo sapiens
tgcagcctccgcct

SEQ ID NO: 1789741 - DNA, 14 bp, Homo sapiens
tgcagcctcctcct

SEQ ID NO: 1789742 - DNA, 17 bp, Homo sapiens
tgcagcctcctcctgac

SEQ ID NO: 1789743 - DNA, 14 bp, Homo sapiens
tgcagcctgcgcca

SEQ ID NO: 1789744 - DNA, 22 bp, Homo sapiens
tgcagcctgtggcttggagtgg

SEQ ID NO: 1789745 - DNA, 17 bp, Homo sapiens
tgcagcgcccctctgca

SEQ ID NO: 1789746 - DNA, 16 bp, Homo sapiens
tgcatccattcctcag

SEQ ID NO: 1789747 - DNA, 21 bp, Homo sapiens
tgcatccattcctcagggaca

SEQ ID NO: 1789748 - DNA, 15 bp, Homo sapiens
tgcatccattgttgt

SEQ ID NO: 1789749 - DNA, 19 bp, Homo sapiens
tgcatcccgatacctcagc

SEQ ID NO: 1789750 - DNA, 14 bp, Homo sapiens
tgcatccctgagac

SEQ ID NO: 1789751 - DNA, 16 bp, Homo sapiens
tgcatccctgtgtcca

SEQ ID NO: 1789752 - DNA, 17 bp, Homo sapiens
tgcatccctgtgtccac

SEQ ID NO: 1789753 - DNA, 14 bp, Homo sapiens
tgcatccttgtaat

SEQ ID NO: 1789754 - DNA, 14 bp, Homo sapiens
tgcatctactccca

SEQ ID NO: 1789755 - DNA, 21 bp, Homo sapiens
tgcatctcactggatgcaaag

SEQ ID NO: 1789756 - DNA, 13 bp, Homo sapiens
tgcatctggggcc

SEQ ID NO: 1789757 - DNA, 13 bp, Homo sapiens
tgcatctggtgta

SEQ ID NO: 1789758 - DNA, 22 bp, Homo sapiens
tgcatcttactgaaggtaaaat

SEQ ID NO: 1789759 - DNA, 20 bp, Homo sapiens
tgcatctttgttacttcctt

SEQ ID NO: 1789760 - DNA, 14 bp, Homo sapiens
tgcatgaaatgaat

SEQ ID NO: 1789761 - DNA, 15 bp, Homo sapiens
tgcatgaaatgaatg

SEQ ID NO: 1789762 - DNA, 18 bp, Homo sapiens
tgcatgaaatgaatgtct

SEQ ID NO: 1789763 - DNA, 18 bp, Homo sapiens
tgcatgacacttccaaag

SEQ ID NO: 1789764 - DNA, 13 bp, Homo sapiens
tgcatgagctccc

SEQ ID NO: 1789765 - DNA, 20 bp, Homo sapiens
tgcatgagctccctcgctgt

SEQ ID NO: 1789766 - DNA, 15 bp, Homo sapiens
tgcatgagcttttat

SEQ ID NO: 1789767 - DNA, 21 bp, Homo sapiens
tgcatgatatcttcaagcctg

SEQ ID NO: 1789768 - DNA, 14 bp, Homo sapiens
tgcatgatgtttgc

SEQ ID NO: 1789769 - DNA, 15 bp, Homo sapiens
tgcatgatgtttgcc

SEQ ID NO: 1789770 - DNA, 16 bp, Homo sapiens
tgcatgccctaagagt

SEQ ID NO: 1789771 - DNA, 23 bp, Homo sapiens
tgcatgccctaagagtgtcactg

SEQ ID NO: 1789772 - DNA, 16 bp, Homo sapiens
tgcatgctctctgcag

SEQ ID NO: 1789773 - DNA, 12 bp, Homo sapiens
tgcatgctctgg

SEQ ID NO: 1789774 - DNA, 14 bp, Homo sapiens
tgcatgctgcccag

SEQ ID NO: 1789775 - DNA, 15 bp, Homo sapiens
tgcatgctgtagctg

SEQ ID NO: 1789776 - DNA, 20 bp, Homo sapiens
tgcatggacctaacattcga

SEQ ID NO: 1789777 - DNA, 12 bp, Homo sapiens
tgcatggagaag

SEQ ID NO: 1789778 - DNA, 18 bp, Homo sapiens
tgcatggaggactctcct

SEQ ID NO: 1789779 - DNA, 22 bp, Homo sapiens
tgcatggaggactctcctcttc

SEQ ID NO: 1789780 - DNA, 17 bp, Homo sapiens
tgcatggattcagcatg

SEQ ID NO: 1789781 - DNA, 21 bp, Homo sapiens
tgcatggattcagcatgtcca

SEQ ID NO: 1789782 - DNA, 16 bp, Homo sapiens
tgcatggcatcagact

SEQ ID NO: 1789783 - DNA, 16 bp, Homo sapiens
tgcatggctccagaaa

SEQ ID NO: 1789784 - DNA, 20 bp, Homo sapiens
tgcatggctccagaaatgtc

SEQ ID NO: 1789785 - DNA, 15 bp, Homo sapiens
tgcatggctcctgtc

SEQ ID NO: 1789786 - DNA, 11 bp, Homo sapiens
tgcatgggctc

SEQ ID NO: 1789787 - DNA, 13 bp, Homo sapiens
tgcatgggctcgc

SEQ ID NO: 1789788 - DNA, 17 bp, Homo sapiens
tgcatggggaggcagca

SEQ ID NO: 1789789 - DNA, 17 bp, Homo sapiens
tgcatggtgccccagga

SEQ ID NO: 1789790 - DNA, 20 bp, Homo sapiens
tgcatggtgccccaggacca

SEQ ID NO: 1789791 - DNA, 22 bp, Homo sapiens
tgcatggtgccccaggaccagc

SEQ ID NO: 1789792 - DNA, 14 bp, Homo sapiens
tgcatgtagtaaca

SEQ ID NO: 1789793 - DNA, 17 bp, Homo sapiens
tgcatgtagtaacacta

SEQ ID NO: 1789794 - DNA, 16 bp, Homo sapiens
tgcatgtatgtcttgg

SEQ ID NO: 1789795 - DNA, 14 bp, Homo sapiens
tgcatgtcttttaa

SEQ ID NO: 1789796 - DNA, 15 bp, Homo sapiens
tgcatgtgaagcatg

SEQ ID NO: 1789797 - DNA, 19 bp, Homo sapiens
tgcatgtgaagcatgcttt

SEQ ID NO: 1789798 - DNA, 17 bp, Homo sapiens
tgcatgtgagcacatgc

SEQ ID NO: 1789799 - DNA, 18 bp, Homo sapiens
tgcatgtgagcacatgcg

SEQ ID NO: 1789800 - DNA, 16 bp, Homo sapiens
tgcatgtgctgtgtga

SEQ ID NO: 1789801 - DNA, 22 bp, Homo sapiens
tgcatgtgtgcgtgtctccatg

SEQ ID NO: 1789802 - DNA, 11 bp, Homo sapiens
tgcatgtgtgt

SEQ ID NO: 1789803 - DNA, 19 bp, Homo sapiens
tgcattagaaatagacagt

SEQ ID NO: 1789804 - DNA, 20 bp, Homo sapiens
tgcattagaaatagacagta

SEQ ID NO: 1789805 - DNA, 22 bp, Homo sapiens
tgcattatatcaaatctaccac

SEQ ID NO: 1789806 - DNA, 15 bp, Homo sapiens
tgcattattaaattg

SEQ ID NO: 1789807 - DNA, 14 bp, Homo sapiens
tgcattcacccaga

SEQ ID NO: 1789808 - DNA, 15 bp, Homo sapiens
tgcattcatgcaaga

SEQ ID NO: 1789809 - DNA, 13 bp, Homo sapiens
tgcattccagaat

SEQ ID NO: 1789810 - DNA, 21 bp, Homo sapiens
tgcattccagaatcttgactt

SEQ ID NO: 1789811 - DNA, 24 bp, Homo sapiens
tgcattccagaatcttgactttct

SEQ ID NO: 1789812 - DNA, 20 bp, Homo sapiens
tgcattccctgaatctgtgc

SEQ ID NO: 1789813 - DNA, 19 bp, Homo sapiens
tgcattcctgtgccctaga

SEQ ID NO: 1789814 - DNA, 21 bp, Homo sapiens
tgcattcgttgtgttttttaa

SEQ ID NO: 1789815 - DNA, 14 bp, Homo sapiens
tgcattctgcctct

SEQ ID NO: 1789816 - DNA, 20 bp, Homo sapiens
tgcattctgcctctctagga

SEQ ID NO: 1789817 - DNA, 22 bp, Homo sapiens
tgcattcttaacaaactcttca

SEQ ID NO: 1789818 - DNA, 16 bp, Homo sapiens
tgcattcttctgagca

SEQ ID NO: 1789819 - DNA, 20 bp, Homo sapiens
tgcattcttctgagcactgt

SEQ ID NO: 1789820 - DNA, 15 bp, Homo sapiens
tgcattctttggtaa

SEQ ID NO: 1789821 - DNA, 16 bp, Homo sapiens
tgcattctttggtaat

SEQ ID NO: 1789822 - DNA, 13 bp, Homo sapiens
tgcattgaatata

SEQ ID NO: 1789823 - DNA, 14 bp, Homo sapiens
tgcattgaatatat

SEQ ID NO: 1789824 - DNA, 16 bp, Homo sapiens
tgcattgaatatatta

SEQ ID NO: 1789825 - DNA, 15 bp, Homo sapiens
tgcattgagaactgc

SEQ ID NO: 1789826 - DNA, 17 bp, Homo sapiens
tgcattgagaactgcat

SEQ ID NO: 1789827 - DNA, 15 bp, Homo sapiens
tgcattgctagataa

SEQ ID NO: 1789828 - DNA, 13 bp, Homo sapiens
tgcattggcctgg

SEQ ID NO: 1789829 - DNA, 15 bp, Homo sapiens
tgcattggcctggcc

SEQ ID NO: 1789830 - DNA, 16 bp, Homo sapiens
tgcattgtcttgtgga

SEQ ID NO: 1789831 - DNA, 23 bp, Homo sapiens
tgcattgtgtcagaaacatgaaa

SEQ ID NO: 1789832 - DNA, 22 bp, Homo sapiens
tgcatttaaaacagacactggc

SEQ ID NO: 1789833 - DNA, 12 bp, Homo sapiens
tgcatttaataa

SEQ ID NO: 1789834 - DNA, 22 bp, Homo sapiens
tgcatttaataaagatgagttg

SEQ ID NO: 1789835 - DNA, 20 bp, Homo sapiens
tgcatttcaaggaacagcca

SEQ ID NO: 1789836 - DNA, 21 bp, Homo sapiens
tgcatttcattcaaatcagtg

SEQ ID NO: 1789837 - DNA, 14 bp, Homo sapiens
tgcatttcctgaca

SEQ ID NO: 1789838 - DNA, 19 bp, Homo sapiens
tgcatttctcttcctaaat

SEQ ID NO: 1789839 - DNA, 16 bp, Homo sapiens
tgcatttgatacattt

SEQ ID NO: 1789840 - DNA, 18 bp, Homo sapiens
tgcatttgtgctagaaat

SEQ ID NO: 1789841 - DNA, 15 bp, Homo sapiens
tgcatttgtggtaat

SEQ ID NO: 1789842 - DNA, 17 bp, Homo sapiens
tgcattttcaccccacc

SEQ ID NO: 1789843 - DNA, 13 bp, Homo sapiens
tgcattttcctct

SEQ ID NO: 1789844 - DNA, 23 bp, Homo sapiens
tgcattttcctcttgtcctggcc

SEQ ID NO: 1789845 - DNA, 23 bp, Homo sapiens
tgcattttggagagtttcctgaa

SEQ ID NO: 1789846 - DNA, 16 bp, Homo sapiens
tgcatttttaaacttg

SEQ ID NO: 1789847 - DNA, 17 bp, Homo sapiens
tgcatttttaaacttga

SEQ ID NO: 1789848 - DNA, 21 bp, Homo sapiens
tgcatttttaaacttgaaata

SEQ ID NO: 1789849 - DNA, 15 bp, Homo sapiens
tgcatttttattaaa

SEQ ID NO: 1789850 - DNA, 20 bp, Homo sapiens
tgcatttttggatcattttt

SEQ ID NO: 1789851 - DNA, 14 bp, Homo sapiens
tgcatttttgtgaa

SEQ ID NO: 1789852 - DNA, 19 bp, Homo sapiens
tgcatttttgtgaaatgaa

SEQ ID NO: 1789853 - DNA, 19 bp, Homo sapiens
tgccaaaataccagagcct

SEQ ID NO: 1789854 - DNA, 19 bp, Homo sapiens
tgccaaaatcattttaatg

SEQ ID NO: 1789855 - DNA, 17 bp, Homo sapiens
tgccaaacaaaaaggtt

SEQ ID NO: 1789856 - DNA, 21 bp, Homo sapiens
tgccaaagatcacttgttgtt

SEQ ID NO: 1789857 - DNA, 20 bp, Homo sapiens
tgccaaagctagggtggccc

SEQ ID NO: 1789858 - DNA, 11 bp, Homo sapiens
tgccaaagtac

SEQ ID NO: 1789859 - DNA, 21 bp, Homo sapiens
tgccaaagtgtctacatgtgc

SEQ ID NO: 1789860 - DNA, 17 bp, Homo sapiens
tgccaaatagccccaga

SEQ ID NO: 1789861 - DNA, 20 bp, Homo sapiens
tgccaaatagccccagactg

SEQ ID NO: 1789862 - DNA, 16 bp, Homo sapiens
tgccaaatatgtcctg

SEQ ID NO: 1789863 - DNA, 18 bp, Homo sapiens
tgccaaatatgtcctggg

SEQ ID NO: 1789864 - DNA, 22 bp, Homo sapiens
tgccaaattgctgcatatttgt

SEQ ID NO: 1789865 - DNA, 20 bp, Homo sapiens
tgccaacagttgtatgtttg

SEQ ID NO: 1789866 - DNA, 17 bp, Homo sapiens
tgccaacatgaggacag

SEQ ID NO: 1789867 - DNA, 18 bp, Homo sapiens
tgccaacatgaggacaga

SEQ ID NO: 1789868 - DNA, 20 bp, Homo sapiens
tgccaacatgaggacagaag

SEQ ID NO: 1789869 - DNA, 22 bp, Homo sapiens
tgccaaccataccttccttccc

SEQ ID NO: 1789870 - DNA, 16 bp, Homo sapiens
tgccaacctaaaactc

SEQ ID NO: 1789871 - DNA, 18 bp, Homo sapiens
tgccaacctaaaactctt

SEQ ID NO: 1789872 - DNA, 13 bp, Homo sapiens
tgccaactaagcc

SEQ ID NO: 1789873 - DNA, 16 bp, Homo sapiens
tgccaacttgatgttc

SEQ ID NO: 1789874 - DNA, 21 bp, Homo sapiens
tgccaagaaaagggctgacat

SEQ ID NO: 1789875 - DNA, 16 bp, Homo sapiens
tgccaagaaaatgaag

SEQ ID NO: 1789876 - DNA, 15 bp, Homo sapiens
tgccaagcacagtgc

SEQ ID NO: 1789877 - DNA, 17 bp, Homo sapiens
tgccaagccagattctc

SEQ ID NO: 1789878 - DNA, 15 bp, Homo sapiens
tgccaaggagcccct

SEQ ID NO: 1789879 - DNA, 16 bp, Homo sapiens
tgccaaggcagaggcc

SEQ ID NO: 1789880 - DNA, 16 bp, Homo sapiens
tgccaaggccagagtg

SEQ ID NO: 1789881 - DNA, 13 bp, Homo sapiens
tgccaagggcccc

SEQ ID NO: 1789882 - DNA, 15 bp, Homo sapiens
tgccaagggccccag

SEQ ID NO: 1789883 - DNA, 18 bp, Homo sapiens
tgccaagggggtgactgg

SEQ ID NO: 1789884 - DNA, 19 bp, Homo sapiens
tgccaagggggtgactgga

SEQ ID NO: 1789885 - DNA, 19 bp, Homo sapiens
tgccaaggtggagggaagg

SEQ ID NO: 1789886 - DNA, 20 bp, Homo sapiens
tgccaaggtggagggaagga

SEQ ID NO: 1789887 - DNA, 21 bp, Homo sapiens
tgccaagtcctagctcctcct

SEQ ID NO: 1789888 - DNA, 18 bp, Homo sapiens
tgccaagtctcagaagag

SEQ ID NO: 1789889 - DNA, 16 bp, Homo sapiens
tgccaagttgctgtca

SEQ ID NO: 1789890 - DNA, 20 bp, Homo sapiens
tgccaagttgctgtcactgt

SEQ ID NO: 1789891 - DNA, 23 bp, Homo sapiens
tgccaataaaagttttctccaac

SEQ ID NO: 1789892 - DNA, 13 bp, Homo sapiens
tgccaataaagct

SEQ ID NO: 1789893 - DNA, 15 bp, Homo sapiens
tgccaataaagcttt

SEQ ID NO: 1789894 - DNA, 22 bp, Homo sapiens
tgccaataaagcttttggaagc

SEQ ID NO: 1789895 - DNA, 15 bp, Homo sapiens
tgccaattagcaatt

SEQ ID NO: 1789896 - DNA, 18 bp, Homo sapiens
tgccaattgctaccgaga

SEQ ID NO: 1789897 - DNA, 12 bp, Homo sapiens
tgccaatttcct

SEQ ID NO: 1789898 - DNA, 23 bp, Homo sapiens
tgccacacagagtggtctttctg

SEQ ID NO: 1789899 - DNA, 22 bp, Homo sapiens
tgccacactcagtcccccacca

SEQ ID NO: 1789900 - DNA, 18 bp, Homo sapiens
tgccacactctccatcac

SEQ ID NO: 1789901 - DNA, 15 bp, Homo sapiens
tgccacacttcaggc

SEQ ID NO: 1789902 - DNA, 17 bp, Homo sapiens
tgccacagcttttgcaa

SEQ ID NO: 1789903 - DNA, 21 bp, Homo sapiens
tgccacatacatagatcttca

SEQ ID NO: 1789904 - DNA, 16 bp, Homo sapiens
tgccacattttcttaa

SEQ ID NO: 1789905 - DNA, 14 bp, Homo sapiens
tgccaccacccacc

SEQ ID NO: 1789906 - DNA, 18 bp, Homo sapiens
tgccaccacccaccccaa

SEQ ID NO: 1789907 - DNA, 15 bp, Homo sapiens
tgccaccacgtctgc

SEQ ID NO: 1789908 - DNA, 17 bp, Homo sapiens
tgccaccacgtctgcca

SEQ ID NO: 1789909 - DNA, 19 bp, Homo sapiens
tgccaccacgtctgccagg

SEQ ID NO: 1789910 - DNA, 20 bp, Homo sapiens
tgccaccacgtctgccaggc

SEQ ID NO: 1789911 - DNA, 21 bp, Homo sapiens
tgccaccacgtctgccaggcc

SEQ ID NO: 1789912 - DNA, 14 bp, Homo sapiens
tgccaccaggccac

SEQ ID NO: 1789913 - DNA, 18 bp, Homo sapiens
tgccaccatggccagcca

SEQ ID NO: 1789914 - DNA, 13 bp, Homo sapiens
tgccacccacctt

SEQ ID NO: 1789915 - DNA, 15 bp, Homo sapiens
tgccacccccttccc

SEQ ID NO: 1789916 - DNA, 15 bp, Homo sapiens
tgccaccccttcctc

SEQ ID NO: 1789917 - DNA, 16 bp, Homo sapiens
tgccaccccttcctcc

SEQ ID NO: 1789918 - DNA, 17 bp, Homo sapiens
tgccacccgtaggcagc

SEQ ID NO: 1789919 - DNA, 21 bp, Homo sapiens
tgccacccgtaggcagcctct

SEQ ID NO: 1789920 - DNA, 14 bp, Homo sapiens
tgccacctccctga

SEQ ID NO: 1789921 - DNA, 12 bp, Homo sapiens
tgccacctggca

SEQ ID NO: 1789922 - DNA, 21 bp, Homo sapiens
tgccacctgttaaaatgtaca

SEQ ID NO: 1789923 - DNA, 20 bp, Homo sapiens
tgccactaccccttgatttt

SEQ ID NO: 1789924 - DNA, 18 bp, Homo sapiens
tgccactcactaggcccc

SEQ ID NO: 1789925 - DNA, 20 bp, Homo sapiens
tgccactcactaggccccca

SEQ ID NO: 1789926 - DNA, 22 bp, Homo sapiens
tgccactcactaggcccccact

SEQ ID NO: 1789927 - DNA, 15 bp, Homo sapiens
tgccactccctgagc

SEQ ID NO: 1789928 - DNA, 15 bp, Homo sapiens
tgccactcctccctc

SEQ ID NO: 1789929 - DNA, 16 bp, Homo sapiens
tgccactcctccctcc

SEQ ID NO: 1789930 - DNA, 13 bp, Homo sapiens
tgccactccttgt

SEQ ID NO: 1789931 - DNA, 16 bp, Homo sapiens
tgccactctctgggac

SEQ ID NO: 1789932 - DNA, 17 bp, Homo sapiens
tgccactgaggagacag

SEQ ID NO: 1789933 - DNA, 23 bp, Homo sapiens
tgccactgaggagacagaaagcc

SEQ ID NO: 1789934 - DNA, 13 bp, Homo sapiens
tgccactgcactc

SEQ ID NO: 1789935 - DNA, 14 bp, Homo sapiens
tgccactgcactcc

SEQ ID NO: 1789936 - DNA, 12 bp, Homo sapiens
tgccactgccag

SEQ ID NO: 1789937 - DNA, 14 bp, Homo sapiens
tgccactgccaggc

SEQ ID NO: 1789938 - DNA, 15 bp, Homo sapiens
tgccactgccaggca

SEQ ID NO: 1789939 - DNA, 16 bp, Homo sapiens
tgccactgccaggcac

SEQ ID NO: 1789940 - DNA, 14 bp, Homo sapiens
tgccactgcccccc

SEQ ID NO: 1789941 - DNA, 19 bp, Homo sapiens
tgccactgccttcgcttct

SEQ ID NO: 1789942 - DNA, 20 bp, Homo sapiens
tgccactggcaaatgtaact

SEQ ID NO: 1789943 - DNA, 11 bp, Homo sapiens
tgccactggga

SEQ ID NO: 1789944 - DNA, 15 bp, Homo sapiens
tgccactgggcacct

SEQ ID NO: 1789945 - DNA, 12 bp, Homo sapiens
tgccactgttgt

SEQ ID NO: 1789946 - DNA, 19 bp, Homo sapiens
tgccattgggaccctccag

SEQ ID NO: 1789947 - DNA, 21 bp, Homo sapiens
tgccattgggaccctccagtg

SEQ ID NO: 1789948 - DNA, 14 bp, Homo sapiens
tgccatttaaaaag

SEQ ID NO: 1789949 - DNA, 20 bp, Homo sapiens
tgccatttagaatctagaaa

SEQ ID NO: 1789950 - DNA, 12 bp, Homo sapiens
tgccatttattt

SEQ ID NO: 1789951 - DNA, 14 bp, Homo sapiens
tgccatttctctgc

SEQ ID NO: 1789952 - DNA, 19 bp, Homo sapiens
tgccatttgcaccctccgc

SEQ ID NO: 1789953 - DNA, 22 bp, Homo sapiens
tgccatttgcttgtactgggac

SEQ ID NO: 1789954 - DNA, 23 bp, Homo sapiens
tgccatttgcttgtactgggaca

SEQ ID NO: 1789955 - DNA, 13 bp, Homo sapiens
tgccatttttcta

SEQ ID NO: 1789956 - DNA, 17 bp, Homo sapiens
tgccatttttctataaa

SEQ ID NO: 1789957 - DNA, 20 bp, Homo sapiens
tgccatttttctataaatca

SEQ ID NO: 1789958 - DNA, 19 bp, Homo sapiens
tgcccaaagattgatttgt

SEQ ID NO: 1789959 - DNA, 15 bp, Homo sapiens
tgcccaaagtgggga

SEQ ID NO: 1789960 - DNA, 19 bp, Homo sapiens
tgcccaacccttccctcac

SEQ ID NO: 1789961 - DNA, 14 bp, Homo sapiens
tgcccaactgttat

SEQ ID NO: 1789962 - DNA, 23 bp, Homo sapiens
tgcccaagaatagatgctgactg

SEQ ID NO: 1789963 - DNA, 11 bp, Homo sapiens
tgcccaagcca

SEQ ID NO: 1789964 - DNA, 15 bp, Homo sapiens
tgcccaagccagagg

SEQ ID NO: 1789965 - DNA, 18 bp, Homo sapiens
tgcccaagccagaggctg

SEQ ID NO: 1789966 - DNA, 14 bp, Homo sapiens
tgcccaatccatta

SEQ ID NO: 1789967 - DNA, 20 bp, Homo sapiens
tgcccaatgaataatggaaa

SEQ ID NO: 1789968 - DNA, 21 bp, Homo sapiens
tgcccacacactttccatctc

SEQ ID NO: 1789969 - DNA, 19 bp, Homo sapiens
tgcccacatgtgtccatcc

SEQ ID NO: 1789970 - DNA, 23 bp, Homo sapiens
tgcccacatgtgtccatcccagc

SEQ ID NO: 1789971 - DNA, 18 bp, Homo sapiens
tgcccacatttgggctca

SEQ ID NO: 1789972 - DNA, 19 bp, Homo sapiens
tgcccacatttgggctcag

SEQ ID NO: 1789973 - DNA, 21 bp, Homo sapiens
tgcccacatttgggctcaggg

SEQ ID NO: 1789974 - DNA, 23 bp, Homo sapiens
tgcccaccaacatcccattgccc

SEQ ID NO: 1789975 - DNA, 15 bp, Homo sapiens
tgcccacccagggaa

SEQ ID NO: 1789976 - DNA, 13 bp, Homo sapiens
tgcccaccccctc

SEQ ID NO: 1789977 - DNA, 15 bp, Homo sapiens
tgcccaccccctcaa

SEQ ID NO: 1789978 - DNA, 14 bp, Homo sapiens
tgcccaccccctgc

SEQ ID NO: 1789979 - DNA, 12 bp, Homo sapiens
tgcccacccctc

SEQ ID NO: 1789980 - DNA, 23 bp, Homo sapiens
tgcccacccctcactccccaggg

SEQ ID NO: 1789981 - DNA, 22 bp, Homo sapiens
tgcccacctcagcctcccaaag

SEQ ID NO: 1789982 - DNA, 18 bp, Homo sapiens
tgcccacctcggcctccc

SEQ ID NO: 1789983 - DNA, 14 bp, Homo sapiens
tgcccacctgccca

SEQ ID NO: 1789984 - DNA, 17 bp, Homo sapiens
tgcccacctgcccatca

SEQ ID NO: 1789985 - DNA, 19 bp, Homo sapiens
tgcccactgcctgcctccc

SEQ ID NO: 1789986 - DNA, 22 bp, Homo sapiens
tgcccacttagccgtccatggc

SEQ ID NO: 1789987 - DNA, 19 bp, Homo sapiens
tgcccacttgattgagaaa

SEQ ID NO: 1789988 - DNA, 21 bp, Homo sapiens
tgcccagaactggactcagga

SEQ ID NO: 1789989 - DNA, 17 bp, Homo sapiens
tgcccagaatttaccat

SEQ ID NO: 1789990 - DNA, 12 bp, Homo sapiens
tgcccagacaca

SEQ ID NO: 1789991 - DNA, 19 bp, Homo sapiens
tgcccagacacatgggctt

SEQ ID NO: 1789992 - DNA, 22 bp, Homo sapiens
tgcccagacacatgggcttgtg

SEQ ID NO: 1789993 - DNA, 19 bp, Homo sapiens
tgcccagacccctctggcc

SEQ ID NO: 1789994 - DNA, 11 bp, Homo sapiens
tgcccagagat

SEQ ID NO: 1789995 - DNA, 12 bp, Homo sapiens
tgcccagagatg

SEQ ID NO: 1789996 - DNA, 19 bp, Homo sapiens
tgcccagagggcccaggca

SEQ ID NO: 1789997 - DNA, 15 bp, Homo sapiens
tgcccagagttgctg

SEQ ID NO: 1789998 - DNA, 16 bp, Homo sapiens
tgcccagcagctcaag

SEQ ID NO: 1789999 - DNA, 12 bp, Homo sapiens
tgcccagcaggc

SEQ ID NO: 1790000 - DNA, 14 bp, Homo sapiens
tgcccagcaggccc

SEQ ID NO: 1790001 - DNA, 17 bp, Homo sapiens
tgcccagccactccagg

SEQ ID NO: 1790002 - DNA, 14 bp, Homo sapiens
tgcccagcccctgc

SEQ ID NO: 1790003 - DNA, 15 bp, Homo sapiens
tgcccagctaatttt

SEQ ID NO: 1790004 - DNA, 15 bp, Homo sapiens
tgcccagctgccgcc

SEQ ID NO: 1790005 - DNA, 13 bp, Homo sapiens
tgcccagcttggg

SEQ ID NO: 1790006 - DNA, 20 bp, Homo sapiens
tgcccagcttgggcccagct

SEQ ID NO: 1790007 - DNA, 21 bp, Homo sapiens
tgcccagcttgggcccagctg

SEQ ID NO: 1790008 - DNA, 19 bp, Homo sapiens
tgcccaggagagccagccc

SEQ ID NO: 1790009 - DNA, 21 bp, Homo sapiens
tgcccaggagagccagccctc

SEQ ID NO: 1790010 - DNA, 22 bp, Homo sapiens
tgcccaggagagccagccctcc

SEQ ID NO: 1790011 - DNA, 21 bp, Homo sapiens
tgcccaggcagtctttgctca

SEQ ID NO: 1790012 - DNA, 23 bp, Homo sapiens
tgcccaggcatgaaattcttcct

SEQ ID NO: 1790013 - DNA, 12 bp, Homo sapiens
tgcccaggccct

SEQ ID NO: 1790014 - DNA, 20 bp, Homo sapiens
tgcccaggcccttggctgca

SEQ ID NO: 1790015 - DNA, 18 bp, Homo sapiens
tgcccaggctggagtgca

SEQ ID NO: 1790016 - DNA, 20 bp, Homo sapiens
tgcccaggctggagtgcaat

SEQ ID NO: 1790017 - DNA, 17 bp, Homo sapiens
tgcccaggctggtctca

SEQ ID NO: 1790018 - DNA, 21 bp, Homo sapiens
tgcccagggccactctgcctc

SEQ ID NO: 1790019 - DNA, 14 bp, Homo sapiens
tgcccagggctcag

SEQ ID NO: 1790020 - DNA, 15 bp, Homo sapiens
tgcccagggctcagc

SEQ ID NO: 1790021 - DNA, 18 bp, Homo sapiens
tgcccagggctcagcctg

SEQ ID NO: 1790022 - DNA, 21 bp, Homo sapiens
tgcccagggctcagcctggtg

SEQ ID NO: 1790023 - DNA, 20 bp, Homo sapiens
tgcccaggggtgccccctcc

SEQ ID NO: 1790024 - DNA, 17 bp, Homo sapiens
tgcccagtcgaccccaa

SEQ ID NO: 1790025 - DNA, 21 bp, Homo sapiens
tgcccagtgttgtttgtaaat

SEQ ID NO: 1790026 - DNA, 20 bp, Homo sapiens
tgcccatcacagggttgggc

SEQ ID NO: 1790027 - DNA, 23 bp, Homo sapiens
tgcccatcacagggttgggccca

SEQ ID NO: 1790028 - DNA, 19 bp, Homo sapiens
tgcccatcccagtccctcg

SEQ ID NO: 1790029 - DNA, 21 bp, Homo sapiens
tgcccatcgtgaagaagcctg

SEQ ID NO: 1790030 - DNA, 14 bp, Homo sapiens
tgcccatgagcaag

SEQ ID NO: 1790031 - DNA, 16 bp, Homo sapiens
tgcccatgagcaagcc

SEQ ID NO: 1790032 - DNA, 16 bp, Homo sapiens
tgcccatggctgggaa

SEQ ID NO: 1790033 - DNA, 17 bp, Homo sapiens
tgcccatggctgggaac

SEQ ID NO: 1790034 - DNA, 14 bp, Homo sapiens
tgcccatgtgtaca

SEQ ID NO: 1790035 - DNA, 14 bp, Homo sapiens
tgccccaaacaaat

SEQ ID NO: 1790036 - DNA, 15 bp, Homo sapiens
tgccccaactcctgg

SEQ ID NO: 1790037 - DNA, 16 bp, Homo sapiens
tgccccaactcctgga

SEQ ID NO: 1790038 - DNA, 16 bp, Homo sapiens
tgccccaagcagccag

SEQ ID NO: 1790039 - DNA, 20 bp, Homo sapiens
tgccccaatcgggtccagag

SEQ ID NO: 1790040 - DNA, 21 bp, Homo sapiens
tgccccaatcgggtccagaga

SEQ ID NO: 1790041 - DNA, 15 bp, Homo sapiens
tgccccaccacgtct

SEQ ID NO: 1790042 - DNA, 16 bp, Homo sapiens
tgccccaccccacctc

SEQ ID NO: 1790043 - DNA, 13 bp, Homo sapiens
tgccccacctgcc

SEQ ID NO: 1790044 - DNA, 23 bp, Homo sapiens
tgccccacctgccgcatgctccc

SEQ ID NO: 1790045 - DNA, 21 bp, Homo sapiens
tgccccacctttattaaaatc

SEQ ID NO: 1790046 - DNA, 13 bp, Homo sapiens
tgccccactccag

SEQ ID NO: 1790047 - DNA, 14 bp, Homo sapiens
tgccccactccagc

SEQ ID NO: 1790048 - DNA, 15 bp, Homo sapiens
tgccccactctgcct

SEQ ID NO: 1790049 - DNA, 22 bp, Homo sapiens
tgccccagactgagctctccag

SEQ ID NO: 1790050 - DNA, 13 bp, Homo sapiens
tgccccagcctgt

SEQ ID NO: 1790051 - DNA, 16 bp, Homo sapiens
tgccccagctctggct

SEQ ID NO: 1790052 - DNA, 19 bp, Homo sapiens
tgccccagctgactgtggc

SEQ ID NO: 1790053 - DNA, 13 bp, Homo sapiens
tgccccaggacca

SEQ ID NO: 1790054 - DNA, 15 bp, Homo sapiens
tgccccaggccctac

SEQ ID NO: 1790055 - DNA, 14 bp, Homo sapiens
tgccccaggccgga

SEQ ID NO: 1790056 - DNA, 21 bp, Homo sapiens
tgccccaggccggagcccaga

SEQ ID NO: 1790057 - DNA, 21 bp, Homo sapiens
tgccccagtcggccccatctc

SEQ ID NO: 1790058 - DNA, 21 bp, Homo sapiens
tgccccatcattgcacctgca

SEQ ID NO: 1790059 - DNA, 23 bp, Homo sapiens
tgccccatgacttgatgcagttt

SEQ ID NO: 1790060 - DNA, 23 bp, Homo sapiens
tgccccatgcctgtccagcctgg

SEQ ID NO: 1790061 - DNA, 22 bp, Homo sapiens
tgcccccaatagtagtctctgt

SEQ ID NO: 1790062 - DNA, 20 bp, Homo sapiens
tgcaggccctggcctcccct

SEQ ID NO: 1790063 - DNA, 15 bp, Homo sapiens
tgcaggctccatgca

SEQ ID NO: 1790064 - DNA, 14 bp, Homo sapiens
tgcaggctctgggc

SEQ ID NO: 1790065 - DNA, 16 bp, Homo sapiens
tgcaggctctgggctc

SEQ ID NO: 1790066 - DNA, 23 bp, Homo sapiens
tgcaggctctgggctcagggctg

SEQ ID NO: 1790067 - DNA, 13 bp, Homo sapiens
tgcaggctgcacc

SEQ ID NO: 1790068 - DNA, 20 bp, Homo sapiens
tgcaggcttaggtcctcact

SEQ ID NO: 1790069 - DNA, 13 bp, Homo sapiens
tgcagggaagagg

SEQ ID NO: 1790070 - DNA, 18 bp, Homo sapiens
tgcagggaagagggcagt

SEQ ID NO: 1790071 - DNA, 14 bp, Homo sapiens
tgcagggagcactg

SEQ ID NO: 1790072 - DNA, 15 bp, Homo sapiens
tgcagggaggggagg

SEQ ID NO: 1790073 - DNA, 18 bp, Homo sapiens
tgcagggaggggaggcag

SEQ ID NO: 1790074 - DNA, 17 bp, Homo sapiens
tgcagggatattgcctt

SEQ ID NO: 1790075 - DNA, 18 bp, Homo sapiens
tgcagggatattgcctta

SEQ ID NO: 1790076 - DNA, 21 bp, Homo sapiens
tgcagggatattgccttattt

SEQ ID NO: 1790077 - DNA, 15 bp, Homo sapiens
tgcagggccatggct

SEQ ID NO: 1790078 - DNA, 13 bp, Homo sapiens
tgcagggcctcca

SEQ ID NO: 1790079 - DNA, 14 bp, Homo sapiens
tgcagggcctccat

SEQ ID NO: 1790080 - DNA, 15 bp, Homo sapiens
tgcagggcttctcct

SEQ ID NO: 1790081 - DNA, 19 bp, Homo sapiens
tgcaggggcctctgttcct

SEQ ID NO: 1790082 - DNA, 19 bp, Homo sapiens
tgcagggggtgtgtctgct

SEQ ID NO: 1790083 - DNA, 22 bp, Homo sapiens
tgcagggggtgtgtctgctcag

SEQ ID NO: 1790084 - DNA, 18 bp, Homo sapiens
tgcagggtggtgctggga

SEQ ID NO: 1790085 - DNA, 19 bp, Homo sapiens
tgcagggtggtgctgggac

SEQ ID NO: 1790086 - DNA, 22 bp, Homo sapiens
tgcaggtaattttttgtctgct

SEQ ID NO: 1790087 - DNA, 15 bp, Homo sapiens
tgcaggtacttcctc

SEQ ID NO: 1790088 - DNA, 22 bp, Homo sapiens
tgcaggtacttcctcctgatgg

SEQ ID NO: 1790089 - DNA, 16 bp, Homo sapiens
tgcaggtgaacttttt

SEQ ID NO: 1790090 - DNA, 18 bp, Homo sapiens
tgcaggtgggctgctgag

SEQ ID NO: 1790091 - DNA, 23 bp, Homo sapiens
tgcaggtgggggttgctgtataa

SEQ ID NO: 1790092 - DNA, 17 bp, Homo sapiens
tgcaggtgttctgctga

SEQ ID NO: 1790093 - DNA, 11 bp, Homo sapiens
tgcagtaactg

SEQ ID NO: 1790094 - DNA, 17 bp, Homo sapiens
tgcagtaacttgggagt

SEQ ID NO: 1790095 - DNA, 14 bp, Homo sapiens
tgcagtacagaatt

SEQ ID NO: 1790096 - DNA, 21 bp, Homo sapiens
tgcagtacattctaaagagag

SEQ ID NO: 1790097 - DNA, 20 bp, Homo sapiens
tgcagtactaaaattaatgc

SEQ ID NO: 1790098 - DNA, 20 bp, Homo sapiens
tgcagtatgatggcaggaga

SEQ ID NO: 1790099 - DNA, 17 bp, Homo sapiens
tgcagtcaacagttcaa

SEQ ID NO: 1790100 - DNA, 21 bp, Homo sapiens
tgcagtcaacagttcaaagaa

SEQ ID NO: 1790101 - DNA, 22 bp, Homo sapiens
tgcagtcaacagttcaaagaag

SEQ ID NO: 1790102 - DNA, 17 bp, Homo sapiens
tgcagtcactggaggtt

SEQ ID NO: 1790103 - DNA, 16 bp, Homo sapiens
tgcagtcctcaggaag

SEQ ID NO: 1790104 - DNA, 15 bp, Homo sapiens
tgcagtcggcatgcc

SEQ ID NO: 1790105 - DNA, 16 bp, Homo sapiens
tgcagtcggcatgcca

SEQ ID NO: 1790106 - DNA, 16 bp, Homo sapiens
tgcagtcttctctctg

SEQ ID NO: 1790107 - DNA, 21 bp, Homo sapiens
tgcagtcttctctctggctca

SEQ ID NO: 1790108 - DNA, 13 bp, Homo sapiens
tgcagtgaattgt

SEQ ID NO: 1790109 - DNA, 18 bp, Homo sapiens
tgcagtgattcagcaggc

SEQ ID NO: 1790110 - DNA, 17 bp, Homo sapiens
tgcagtgccagctccct

SEQ ID NO: 1790111 - DNA, 12 bp, Homo sapiens
tgcagtgccttg

SEQ ID NO: 1790112 - DNA, 22 bp, Homo sapiens
tgcagtggcatcatctcagctc

SEQ ID NO: 1790113 - DNA, 14 bp, Homo sapiens
tgcagtggcctggc

SEQ ID NO: 1790114 - DNA, 21 bp, Homo sapiens
tgcagtggcgcattctaggct

SEQ ID NO: 1790115 - DNA, 18 bp, Homo sapiens
tgcagtggcgtgatcttg

SEQ ID NO: 1790116 - DNA, 17 bp, Homo sapiens
tgcagtggcttttcatg

SEQ ID NO: 1790117 - DNA, 20 bp, Homo sapiens
tgcagtgtggagttcacctt

SEQ ID NO: 1790118 - DNA, 16 bp, Homo sapiens
tgcagttacttgaata

SEQ ID NO: 1790119 - DNA, 21 bp, Homo sapiens
tgcagttagccccagaaaatg

SEQ ID NO: 1790120 - DNA, 22 bp, Homo sapiens
tgcagttagccccagaaaatga

SEQ ID NO: 1790121 - DNA, 23 bp, Homo sapiens
tgcagttagccccagaaaatgaa

SEQ ID NO: 1790122 - DNA, 20 bp, Homo sapiens
tgcagttcaaatcctcacca

SEQ ID NO: 1790123 - DNA, 19 bp, Homo sapiens
tgcagttcagcaccaccct

SEQ ID NO: 1790124 - DNA, 12 bp, Homo sapiens
tgcagttcctgg

SEQ ID NO: 1790125 - DNA, 18 bp, Homo sapiens
tgcagttctagtttgcat

SEQ ID NO: 1790126 - DNA, 14 bp, Homo sapiens
tgcagttctgagca

SEQ ID NO: 1790127 - DNA, 20 bp, Homo sapiens
tgcagttggactctcaggga

SEQ ID NO: 1790128 - DNA, 18 bp, Homo sapiens
tgcagtttcttttcacat

SEQ ID NO: 1790129 - DNA, 15 bp, Homo sapiens
tgcagtttggccctg

SEQ ID NO: 1790130 - DNA, 19 bp, Homo sapiens
tgcagtttggccctggagc

SEQ ID NO: 1790131 - DNA, 20 bp, Homo sapiens
tgcagtttggccctggagcc

SEQ ID NO: 1790132 - DNA, 17 bp, Homo sapiens
tgcagtttttaaaaacc

SEQ ID NO: 1790133 - DNA, 16 bp, Homo sapiens
tgcagtttttcagagt

SEQ ID NO: 1790134 - DNA, 18 bp, Homo sapiens
tgcataaacacttttcaa

SEQ ID NO: 1790135 - DNA, 16 bp, Homo sapiens
tgcataaatgcataat

SEQ ID NO: 1790136 - DNA, 12 bp, Homo sapiens
tgcataagatta

SEQ ID NO: 1790137 - DNA, 21 bp, Homo sapiens
tgcataagattaaaggaagga

SEQ ID NO: 1790138 - DNA, 22 bp, Homo sapiens
tgcataagattaaaggaaggaa

SEQ ID NO: 1790139 - DNA, 23 bp, Homo sapiens
tgcataagattaaaggaaggaaa

SEQ ID NO: 1790140 - DNA, 23 bp, Homo sapiens
tgccacttctaagaaaagcctaa

SEQ ID NO: 1790141 - DNA, 16 bp, Homo sapiens
tgccacttctcactca

SEQ ID NO: 1790142 - DNA, 23 bp, Homo sapiens
tgccacttgtcaaagaaggtgct

SEQ ID NO: 1790143 - DNA, 23 bp, Homo sapiens
tgccactttggtacatggccagt

SEQ ID NO: 1790144 - DNA, 12 bp, Homo sapiens
tgccacttttta

SEQ ID NO: 1790145 - DNA, 13 bp, Homo sapiens
tgccagaagagaa

SEQ ID NO: 1790146 - DNA, 17 bp, Homo sapiens
tgccagaagagaattca

SEQ ID NO: 1790147 - DNA, 20 bp, Homo sapiens
tgccagagcaggagcccctg

SEQ ID NO: 1790148 - DNA, 12 bp, Homo sapiens
tgccagagccaa

SEQ ID NO: 1790149 - DNA, 13 bp, Homo sapiens
tgccagagccaac

SEQ ID NO: 1790150 - DNA, 16 bp, Homo sapiens
tgccagagccaacctg

SEQ ID NO: 1790151 - DNA, 18 bp, Homo sapiens
tgccagagccaacctgga

SEQ ID NO: 1790152 - DNA, 23 bp, Homo sapiens
tgccagagccaacctggacttcc

SEQ ID NO: 1790153 - DNA, 12 bp, Homo sapiens
tgccagagccgg

SEQ ID NO: 1790154 - DNA, 20 bp, Homo sapiens
tgccagagctttgttttata

SEQ ID NO: 1790155 - DNA, 20 bp, Homo sapiens
tgccagaggaatcctggcag

SEQ ID NO: 1790156 - DNA, 17 bp, Homo sapiens
tgccagaggatgctctt

SEQ ID NO: 1790157 - DNA, 12 bp, Homo sapiens
tgccagagggcc

SEQ ID NO: 1790158 - DNA, 16 bp, Homo sapiens
tgccagagggccagca

SEQ ID NO: 1790159 - DNA, 18 bp, Homo sapiens
tgccagagggccagcagg

SEQ ID NO: 1790160 - DNA, 22 bp, Homo sapiens
tgccagagggccagcaggctcc

SEQ ID NO: 1790161 - DNA, 15 bp, Homo sapiens
tgccagaggtgggca

SEQ ID NO: 1790162 - DNA, 17 bp, Homo sapiens
tgccagaggtgggcagg

SEQ ID NO: 1790163 - DNA, 17 bp, Homo sapiens
tgccgacctcgtcctcc

SEQ ID NO: 1790164 - DNA, 16 bp, Homo sapiens
tgccgactggctgtga

SEQ ID NO: 1790165 - DNA, 19 bp, Homo sapiens
tgccgacttggagactcct

SEQ ID NO: 1790166 - DNA, 20 bp, Homo sapiens
tgccgagacagaccctctgc

SEQ ID NO: 1790167 - DNA, 20 bp, Homo sapiens
tgccgcaagtctgcagcccg

SEQ ID NO: 1790168 - DNA, 12 bp, Homo sapiens
tgccgcaccagc

SEQ ID NO: 1790169 - DNA, 17 bp, Homo sapiens
tgccgcaccagcccgaa

SEQ ID NO: 1790170 - DNA, 15 bp, Homo sapiens
tgccgcagacgggca

SEQ ID NO: 1790171 - DNA, 21 bp, Homo sapiens
tgccgcagacgggcacagaca

SEQ ID NO: 1790172 - DNA, 14 bp, Homo sapiens
tgccgcatgctccc

SEQ ID NO: 1790173 - DNA, 17 bp, Homo sapiens
tgcctctgtccccttct

SEQ ID NO: 1790174 - DNA, 21 bp, Homo sapiens
tgcctctgtccccttctctca

SEQ ID NO: 1790175 - DNA, 19 bp, Homo sapiens
tgcctctgtgcacagtggc

SEQ ID NO: 1790176 - DNA, 12 bp, Homo sapiens
tgcctctgtgct

SEQ ID NO: 1790177 - DNA, 13 bp, Homo sapiens
tgcctctgtgctg

SEQ ID NO: 1790178 - DNA, 16 bp, Homo sapiens
tgcctctgtgctgtgt

SEQ ID NO: 1790179 - DNA, 19 bp, Homo sapiens
tgctatttgtacaaataaa

SEQ ID NO: 1790180 - DNA, 12 bp, Homo sapiens
tgctcaaaattg

SEQ ID NO: 1790181 - DNA, 19 bp, Homo sapiens
tgctcaaaattgcttctaa

SEQ ID NO: 1790182 - DNA, 23 bp, Homo sapiens
tgctcaacaatttatccattcaa

SEQ ID NO: 1790183 - DNA, 18 bp, Homo sapiens
tgctcaaccactgtggcg

SEQ ID NO: 1790184 - DNA, 13 bp, Homo sapiens
tgctcacagctgt

SEQ ID NO: 1790185 - DNA, 16 bp, Homo sapiens
tgctcacatgtctttg

SEQ ID NO: 1790186 - DNA, 19 bp, Homo sapiens
tgctcacccgtaggcaaat

SEQ ID NO: 1790187 - DNA, 23 bp, Homo sapiens
tgctcaccgcccatcagggttct

SEQ ID NO: 1790188 - DNA, 12 bp, Homo sapiens
tgctcacctctg

SEQ ID NO: 1790189 - DNA, 17 bp, Homo sapiens
tgctcacgtctctgccg

SEQ ID NO: 1790190 - DNA, 22 bp, Homo sapiens
tgctcacgtctctgccgcctgc

SEQ ID NO: 1790191 - DNA, 21 bp, Homo sapiens
tgctcactcccaagggacagc

SEQ ID NO: 1790192 - DNA, 16 bp, Homo sapiens
tgctcagaacttgctg

SEQ ID NO: 1790193 - DNA, 15 bp, Homo sapiens
tgctcagcagccagt

SEQ ID NO: 1790194 - DNA, 13 bp, Homo sapiens
tgctcagcatgat

SEQ ID NO: 1790195 - DNA, 17 bp, Homo sapiens
tgctcagcccgcttggc

SEQ ID NO: 1790196 - DNA, 22 bp, Homo sapiens
tgctcagcctcatcctgagaga

SEQ ID NO: 1790197 - DNA, 17 bp, Homo sapiens
tgctcagccttgctgct

SEQ ID NO: 1790198 - DNA, 19 bp, Homo sapiens
tgctcagccttgctgctct

SEQ ID NO: 1790199 - DNA, 20 bp, Homo sapiens
tgctcagccttgctgctctg

SEQ ID NO: 1790200 - DNA, 14 bp, Homo sapiens
tgctcagctgtggc

SEQ ID NO: 1790201 - DNA, 15 bp, Homo sapiens
tgctcagctgtggct

SEQ ID NO: 1790202 - DNA, 21 bp, Homo sapiens
tgctcagctgtggctggagga

SEQ ID NO: 1790203 - DNA, 20 bp, Homo sapiens
tgctcagggtcaatttcttt

SEQ ID NO: 1790204 - DNA, 16 bp, Homo sapiens
tgctcagggtcactga

SEQ ID NO: 1790205 - DNA, 15 bp, Homo sapiens
tgctcagtgtccagc

SEQ ID NO: 1790206 - DNA, 20 bp, Homo sapiens
tgctcagtgtccagcttcca

SEQ ID NO: 1790207 - DNA, 22 bp, Homo sapiens
tgctcagtgtccagcttccaaa

SEQ ID NO: 1790208 - DNA, 20 bp, Homo sapiens
tgctcatcatattccaaccc

SEQ ID NO: 1790209 - DNA, 17 bp, Homo sapiens
tgctcatcggagactgc

SEQ ID NO: 1790210 - DNA, 18 bp, Homo sapiens
tgctcatctgctggtccg

SEQ ID NO: 1790211 - DNA, 16 bp, Homo sapiens
tgctcattacagttct

SEQ ID NO: 1790212 - DNA, 19 bp, Homo sapiens
tgctcattacagttctttc

SEQ ID NO: 1790213 - DNA, 20 bp, Homo sapiens
tgctcattacagttctttcc

SEQ ID NO: 1790214 - DNA, 12 bp, Homo sapiens
tgctcatttaag

SEQ ID NO: 1790215 - DNA, 19 bp, Homo sapiens
tgctccaagattctagatg

SEQ ID NO: 1790216 - DNA, 22 bp, Homo sapiens
tgctccaagtggtgggaatcag

SEQ ID NO: 1790217 - DNA, 15 bp, Homo sapiens
tgctccaatttcccc

SEQ ID NO: 1790218 - DNA, 18 bp, Homo sapiens
tgctccaccagcagcatg

SEQ ID NO: 1790219 - DNA, 18 bp, Homo sapiens
tgctccacccttggcctg

SEQ ID NO: 1790220 - DNA, 22 bp, Homo sapiens
tgctccacccttggcctgtctc

SEQ ID NO: 1790221 - DNA, 12 bp, Homo sapiens
tgctccagaaga

SEQ ID NO: 1790222 - DNA, 16 bp, Homo sapiens
tgctccagaagatgcc

SEQ ID NO: 1790223 - DNA, 20 bp, Homo sapiens
tgctccagaagatgccagct

SEQ ID NO: 1790224 - DNA, 14 bp, Homo sapiens
tgctccagacctga

SEQ ID NO: 1790225 - DNA, 21 bp, Homo sapiens
tgctccagacctgatcctgga

SEQ ID NO: 1790226 - DNA, 13 bp, Homo sapiens
tgctccagattct

SEQ ID NO: 1790227 - DNA, 16 bp, Homo sapiens
tgctccagattctgat

SEQ ID NO: 1790228 - DNA, 17 bp, Homo sapiens
tgctccagattctgatg

SEQ ID NO: 1790229 - DNA, 18 bp, Homo sapiens
tgctccagattctgatgc

SEQ ID NO: 1790230 - DNA, 15 bp, Homo sapiens
tgctccagcaacaca

SEQ ID NO: 1790231 - DNA, 19 bp, Homo sapiens
tgctccagcaacacagcct

SEQ ID NO: 1790232 - DNA, 18 bp, Homo sapiens
tgctccagcaactgccct

SEQ ID NO: 1790233 - DNA, 16 bp, Homo sapiens
tgctccagcagcacac

SEQ ID NO: 1790234 - DNA, 21 bp, Homo sapiens
tgctccagcagcacacctcag

SEQ ID NO: 1790235 - DNA, 15 bp, Homo sapiens
tgctccagggcagcc

SEQ ID NO: 1790236 - DNA, 15 bp, Homo sapiens
tgctccagggtcagg

SEQ ID NO: 1790237 - DNA, 19 bp, Homo sapiens
tgctccagggtcaggcgga

SEQ ID NO: 1790238 - DNA, 13 bp, Homo sapiens
tgctccagggtct

SEQ ID NO: 1790239 - DNA, 23 bp, Homo sapiens
tgctccagtcaacaaactatttc

SEQ ID NO: 1790240 - DNA, 17 bp, Homo sapiens
tgctccataccttttct

SEQ ID NO: 1790241 - DNA, 18 bp, Homo sapiens
tgctccataccttttctc

SEQ ID NO: 1790242 - DNA, 20 bp, Homo sapiens
tgctccataccttttctctt

SEQ ID NO: 1790243 - DNA, 12 bp, Homo sapiens
tgctccatctcc

SEQ ID NO: 1790244 - DNA, 24 bp, Homo sapiens
tgctccatctccgcctccacactg

SEQ ID NO: 1790245 - DNA, 22 bp, Homo sapiens
tgctcccagtgggagcttcccg

SEQ ID NO: 1790246 - DNA, 17 bp, Homo sapiens
tgctcccatcattcctt

SEQ ID NO: 1790247 - DNA, 22 bp, Homo sapiens
tgctcccatcattccttctggc

SEQ ID NO: 1790248 - DNA, 16 bp, Homo sapiens
tgctcccatctcctga

SEQ ID NO: 1790249 - DNA, 19 bp, Homo sapiens
tgctcccattcctccctcc

SEQ ID NO: 1790250 - DNA, 13 bp, Homo sapiens
tgctccccacagc

SEQ ID NO: 1790251 - DNA, 19 bp, Homo sapiens
tgctccccacagcgtccct

SEQ ID NO: 1790252 - DNA, 20 bp, Homo sapiens
tgctccccacagcgtccctg

SEQ ID NO: 1790253 - DNA, 14 bp, Homo sapiens
tgctccccaggcca

SEQ ID NO: 1790254 - DNA, 16 bp, Homo sapiens
tgctccccaggccacc

SEQ ID NO: 1790255 - DNA, 15 bp, Homo sapiens
tgctcccctgccaca

SEQ ID NO: 1790256 - DNA, 16 bp, Homo sapiens
tgctcccctgccacac

SEQ ID NO: 1790257 - DNA, 14 bp, Homo sapiens
tgctcccctgttca

SEQ ID NO: 1790258 - DNA, 21 bp, Homo sapiens
tgctccctcctctcctaccca

SEQ ID NO: 1790259 - DNA, 12 bp, Homo sapiens
tgctccctctgt

SEQ ID NO: 1790260 - DNA, 13 bp, Homo sapiens
tgctccctggagg

SEQ ID NO: 1790261 - DNA, 22 bp, Homo sapiens
tgctccctggaggcacgcacca

SEQ ID NO: 1790262 - DNA, 18 bp, Homo sapiens
tgctccctgtctgtgtcc

SEQ ID NO: 1790263 - DNA, 22 bp, Homo sapiens
tgctccctgtctgtgtcccagc

SEQ ID NO: 1790264 - DNA, 13 bp, Homo sapiens
tgctccgcccgct

SEQ ID NO: 1790265 - DNA, 17 bp, Homo sapiens
tgctccgctcccaccgc

SEQ ID NO: 1790266 - DNA, 16 bp, Homo sapiens
tgctccgctgcctgga

SEQ ID NO: 1790267 - DNA, 17 bp, Homo sapiens
tgctccgctgcctggaa

SEQ ID NO: 1790268 - DNA, 13 bp, Homo sapiens
tgctccgtgcctc

SEQ ID NO: 1790269 - DNA, 16 bp, Homo sapiens
tgctccgtgcctccac

SEQ ID NO: 1790270 - DNA, 20 bp, Homo sapiens
tgctccgtgcctccaccacc

SEQ ID NO: 1790271 - DNA, 14 bp, Homo sapiens
tgctccgtggactg

SEQ ID NO: 1790272 - DNA, 15 bp, Homo sapiens
tgctccgtggactgc

SEQ ID NO: 1790273 - DNA, 20 bp, Homo sapiens
tgctcctagtttgacctcac

SEQ ID NO: 1790274 - DNA, 13 bp, Homo sapiens
tgcctgtgtcctg

SEQ ID NO: 1790275 - DNA, 16 bp, Homo sapiens
tgcctgtgtgctccgg

SEQ ID NO: 1790276 - DNA, 22 bp, Homo sapiens
tgcctgttggcaggcccactcc

SEQ ID NO: 1790277 - DNA, 23 bp, Homo sapiens
tgcctgttggcaggcccactccc

SEQ ID NO: 1790278 - DNA, 14 bp, Homo sapiens
tgcctgttggctgc

SEQ ID NO: 1790279 - DNA, 18 bp, Homo sapiens
tgccttaaaaccaaagag

SEQ ID NO: 1790280 - DNA, 17 bp, Homo sapiens
tgccttaaacacacatt

SEQ ID NO: 1790281 - DNA, 19 bp, Homo sapiens
tgccttaaacactcacctt

SEQ ID NO: 1790282 - DNA, 22 bp, Homo sapiens
tgccttaaacactcaccttcta

SEQ ID NO: 1790283 - DNA, 18 bp, Homo sapiens
tgccttaaacctacctcc

SEQ ID NO: 1790284 - DNA, 16 bp, Homo sapiens
tgccttaactggagcc

SEQ ID NO: 1790285 - DNA, 13 bp, Homo sapiens
tgccttaagcaga

SEQ ID NO: 1790286 - DNA, 19 bp, Homo sapiens
tgccttaagcagaacaaat

SEQ ID NO: 1790287 - DNA, 14 bp, Homo sapiens
tgccttaagtttta

SEQ ID NO: 1790288 - DNA, 16 bp, Homo sapiens
tgccttaataaatatg

SEQ ID NO: 1790289 - DNA, 17 bp, Homo sapiens
tgccttaataaatatgt

SEQ ID NO: 1790290 - DNA, 18 bp, Homo sapiens
tgccttaataaatatgta

SEQ ID NO: 1790291 - DNA, 16 bp, Homo sapiens
tgccttacctcctgcc

SEQ ID NO: 1790292 - DNA, 17 bp, Homo sapiens
tgccttacctcctgccc

SEQ ID NO: 1790293 - DNA, 23 bp, Homo sapiens
tgccttacctcctgcccaggaga

SEQ ID NO: 1790294 - DNA, 20 bp, Homo sapiens
tgccttactggtttccccag

SEQ ID NO: 1790295 - DNA, 17 bp, Homo sapiens
tgccttagaacctttct

SEQ ID NO: 1790296 - DNA, 22 bp, Homo sapiens
tgccttagggtttgcagagtgg

SEQ ID NO: 1790297 - DNA, 16 bp, Homo sapiens
tgccttatgggctgaa

SEQ ID NO: 1790298 - DNA, 20 bp, Homo sapiens
tgccttatgggctgaagtgt

SEQ ID NO: 1790299 - DNA, 17 bp, Homo sapiens
tgccttatttgtctgta

SEQ ID NO: 1790300 - DNA, 20 bp, Homo sapiens
tgccttcacatttggggttt

SEQ ID NO: 1790301 - DNA, 13 bp, Homo sapiens
tgccttccataat

SEQ ID NO: 1790302 - DNA, 13 bp, Homo sapiens
tgccttccctagc

SEQ ID NO: 1790303 - DNA, 17 bp, Homo sapiens
tgccttccctagcttta

SEQ ID NO: 1790304 - DNA, 14 bp, Homo sapiens
tgccttcccttctc

SEQ ID NO: 1790305 - DNA, 13 bp, Homo sapiens
tgccttcgcttct

SEQ ID NO: 1790306 - DNA, 14 bp, Homo sapiens
tgccttcgcttctt

SEQ ID NO: 1790307 - DNA, 21 bp, Homo sapiens
tgccttcgcttcttgcctctg

SEQ ID NO: 1790308 - DNA, 19 bp, Homo sapiens
tgccttctctcagctccca

SEQ ID NO: 1790309 - DNA, 14 bp, Homo sapiens
tgccttctgggaag

SEQ ID NO: 1790310 - DNA, 21 bp, Homo sapiens
tgccttcttcggggaactcct

SEQ ID NO: 1790311 - DNA, 22 bp, Homo sapiens
tgccttctttagaccctcgggc

SEQ ID NO: 1790312 - DNA, 16 bp, Homo sapiens
tgccttcttttgatta

SEQ ID NO: 1790313 - DNA, 18 bp, Homo sapiens
tgccttgctgacaataaa

SEQ ID NO: 1790314 - DNA, 16 bp, Homo sapiens
tgccttggctcagaca

SEQ ID NO: 1790315 - DNA, 13 bp, Homo sapiens
tgccttggcttca

SEQ ID NO: 1790316 - DNA, 11 bp, Homo sapiens
tgccttgggct

SEQ ID NO: 1790317 - DNA, 15 bp, Homo sapiens
tgccttgggctgctc

SEQ ID NO: 1790318 - DNA, 16 bp, Homo sapiens
tgccttgggctgctcc

SEQ ID NO: 1790319 - DNA, 19 bp, Homo sapiens
tgccttggggaatttcctc

SEQ ID NO: 1790320 - DNA, 19 bp, Homo sapiens
tgccttgtacttttcattt

SEQ ID NO: 1790321 - DNA, 13 bp, Homo sapiens
tgccttgtccctc

SEQ ID NO: 1790322 - DNA, 19 bp, Homo sapiens
tgccttgtgtacagttatt

SEQ ID NO: 1790323 - DNA, 18 bp, Homo sapiens
tgcctttaaatctgtgat

SEQ ID NO: 1790324 - DNA, 12 bp, Homo sapiens
tgcctttaacag

SEQ ID NO: 1790325 - DNA, 18 bp, Homo sapiens
tgcctttaagccaaagaa

SEQ ID NO: 1790326 - DNA, 19 bp, Homo sapiens
tgcctttatctctgaggct

SEQ ID NO: 1790327 - DNA, 22 bp, Homo sapiens
tgcctttctgcagtttttcagg

SEQ ID NO: 1790328 - DNA, 14 bp, Homo sapiens
tgcctttctttgcc

SEQ ID NO: 1790329 - DNA, 15 bp, Homo sapiens
tgcctttctttgcct

SEQ ID NO: 1790330 - DNA, 19 bp, Homo sapiens
tgcctttctttgcctctgc

SEQ ID NO: 1790331 - DNA, 22 bp, Homo sapiens
tgcctttctttgcctctgcagt

SEQ ID NO: 1790332 - DNA, 13 bp, Homo sapiens
tgcctttgaagag

SEQ ID NO: 1790333 - DNA, 17 bp, Homo sapiens
tgcctttgctctggtct

SEQ ID NO: 1790334 - DNA, 22 bp, Homo sapiens
tgcctttggaagggtctctctc

SEQ ID NO: 1790335 - DNA, 19 bp, Homo sapiens
tgcctttggcactctgact

SEQ ID NO: 1790336 - DNA, 14 bp, Homo sapiens
tgccttttatccca

SEQ ID NO: 1790337 - DNA, 15 bp, Homo sapiens
tgccttttgcacccc

SEQ ID NO: 1790338 - DNA, 19 bp, Homo sapiens
tgccttttgcacccctccc

SEQ ID NO: 1790339 - DNA, 15 bp, Homo sapiens
tgccttttgcagaag

SEQ ID NO: 1790340 - DNA, 19 bp, Homo sapiens
tgccttttttgtagttttt

SEQ ID NO: 1790341 - DNA, 18 bp, Homo sapiens
tgcgacagagagagggga

SEQ ID NO: 1790342 - DNA, 15 bp, Homo sapiens
tgcgaccccccaccc

SEQ ID NO: 1790343 - DNA, 19 bp, Homo sapiens
tgcgaccctgggggcacag

SEQ ID NO: 1790344 - DNA, 21 bp, Homo sapiens
tgcgactttctgcctggagtg

SEQ ID NO: 1790345 - DNA, 15 bp, Homo sapiens
tgcgaggctatgagt

SEQ ID NO: 1790346 - DNA, 13 bp, Homo sapiens
tgcgattctggat

SEQ ID NO: 1790347 - DNA, 23 bp, Homo sapiens
tgcgattctggataaagccactg

SEQ ID NO: 1790348 - DNA, 22 bp, Homo sapiens
tgcgcacaaggctgaccaagag

SEQ ID NO: 1790349 - DNA, 14 bp, Homo sapiens
tgcgcagtgccttg

SEQ ID NO: 1790350 - DNA, 16 bp, Homo sapiens
tgcgccaggcagagct

SEQ ID NO: 1790351 - DNA, 22 bp, Homo sapiens
tgcgccaggcagagctgagggc

SEQ ID NO: 1790352 - DNA, 16 bp, Homo sapiens
tgcgccagtcctgcta

SEQ ID NO: 1790353 - DNA, 17 bp, Homo sapiens
tgcgccattgcactcca

SEQ ID NO: 1790354 - DNA, 18 bp, Homo sapiens
tgcgcccagggctgggag

SEQ ID NO: 1790355 - DNA, 21 bp, Homo sapiens
tgcgccccctccgccctgcca

SEQ ID NO: 1790356 - DNA, 16 bp, Homo sapiens
tgcgcccttaccttcc

SEQ ID NO: 1790357 - DNA, 14 bp, Homo sapiens
tgcgcctgtgacca

SEQ ID NO: 1790358 - DNA, 23 bp, Homo sapiens
tgcgcgtgcacgtggagagctgg

SEQ ID NO: 1790359 - DNA, 20 bp, Homo sapiens
tgcgcgtgtgggtctctggg

SEQ ID NO: 1790360 - DNA, 15 bp, Homo sapiens
tgcgctcacctcaga

SEQ ID NO: 1790361 - DNA, 18 bp, Homo sapiens
tgcgctcacctcagagca

SEQ ID NO: 1790362 - DNA, 17 bp, Homo sapiens
tgcgctcacctgcagcc

SEQ ID NO: 1790363 - DNA, 15 bp, Homo sapiens
tgcgctcagggccat

SEQ ID NO: 1790364 - DNA, 19 bp, Homo sapiens
tgcgctcagggccatgctg

SEQ ID NO: 1790365 - DNA, 23 bp, Homo sapiens
tgcgctcagggccatgctgaggc

SEQ ID NO: 1790366 - DNA, 12 bp, Homo sapiens
tgcgctcttggt

SEQ ID NO: 1790367 - DNA, 23 bp, Homo sapiens
tgcgctgacctaggaatgttggt

SEQ ID NO: 1790368 - DNA, 14 bp, Homo sapiens
tgcgctgcctggcc

SEQ ID NO: 1790369 - DNA, 15 bp, Homo sapiens
tgcgctgtgtacaat

SEQ ID NO: 1790370 - DNA, 15 bp, Homo sapiens
tgcggacaagtttta

SEQ ID NO: 1790371 - DNA, 19 bp, Homo sapiens
tgcggagtcattttgtgtt

SEQ ID NO: 1790372 - DNA, 15 bp, Homo sapiens
tgcggagtctcctct

SEQ ID NO: 1790373 - DNA, 20 bp, Homo sapiens
tgcggagtgaagaggggcag

SEQ ID NO: 1790374 - DNA, 15 bp, Homo sapiens
tgcggatctcagctt

SEQ ID NO: 1790375 - DNA, 14 bp, Homo sapiens
tgcggatctctgga

SEQ ID NO: 1790376 - DNA, 15 bp, Homo sapiens
tgcggatctctggag

SEQ ID NO: 1790377 - DNA, 11 bp, Homo sapiens
tgcggctgtgg

SEQ ID NO: 1790378 - DNA, 13 bp, Homo sapiens
tgcggctgtgggc

SEQ ID NO: 1790379 - DNA, 16 bp, Homo sapiens
tgcgggacagagggtg

SEQ ID NO: 1790380 - DNA, 21 bp, Homo sapiens
tgcgggaccggtacagaaagg

SEQ ID NO: 1790381 - DNA, 17 bp, Homo sapiens
tgcgggatggtcctggg

SEQ ID NO: 1790382 - DNA, 18 bp, Homo sapiens
tgcgggatggtcctgggg

SEQ ID NO: 1790383 - DNA, 19 bp, Homo sapiens
tgcgggatggtcctggggc

SEQ ID NO: 1790384 - DNA, 16 bp, Homo sapiens
tgcgggcccagctgag

SEQ ID NO: 1790385 - DNA, 16 bp, Homo sapiens
tgcggggtggagtgag

SEQ ID NO: 1790386 - DNA, 21 bp, Homo sapiens
tgcggttaattttgaagtgct

SEQ ID NO: 1790387 - DNA, 19 bp, Homo sapiens
tgcggttataaaaaatggt

SEQ ID NO: 1790388 - DNA, 13 bp, Homo sapiens
tgctctaggaaga

SEQ ID NO: 1790389 - DNA, 15 bp, Homo sapiens
tgctctagggaatct

SEQ ID NO: 1790390 - DNA, 12 bp, Homo sapiens
tgctctattgta

SEQ ID NO: 1790391 - DNA, 19 bp, Homo sapiens
tgctctcagcctcccacaa

SEQ ID NO: 1790392 - DNA, 14 bp, Homo sapiens
tgctctcagctggc

SEQ ID NO: 1790393 - DNA, 17 bp, Homo sapiens
tgctctcagctggcagt

SEQ ID NO: 1790394 - DNA, 20 bp, Homo sapiens
tgctctcccggttcttccag

SEQ ID NO: 1790395 - DNA, 12 bp, Homo sapiens
tgctctccttcc

SEQ ID NO: 1790396 - DNA, 23 bp, Homo sapiens
tgctctccttcctggagcccaga

SEQ ID NO: 1790397 - DNA, 19 bp, Homo sapiens
tgctctcgcacctttccaa

SEQ ID NO: 1790398 - DNA, 12 bp, Homo sapiens
tgctctctctga

SEQ ID NO: 1790399 - DNA, 13 bp, Homo sapiens
tgctctctgagtt

SEQ ID NO: 1790400 - DNA, 13 bp, Homo sapiens
tgctctctgccac

SEQ ID NO: 1790401 - DNA, 20 bp, Homo sapiens
tgctctgaatgggagccaga

SEQ ID NO: 1790402 - DNA, 19 bp, Homo sapiens
tgctctgacgtagaaagat

SEQ ID NO: 1790403 - DNA, 11 bp, Homo sapiens
tgctctgagaa

SEQ ID NO: 1790404 - DNA, 16 bp, Homo sapiens
tgctctgagccacagt

SEQ ID NO: 1790405 - DNA, 11 bp, Homo sapiens
tgctctgccat

SEQ ID NO: 1790406 - DNA, 17 bp, Homo sapiens
tgctctgccatcttcag

SEQ ID NO: 1790407 - DNA, 18 bp, Homo sapiens
tgctctgccccaagcccc

SEQ ID NO: 1790408 - DNA, 13 bp, Homo sapiens
tgctctgcccctt

SEQ ID NO: 1790409 - DNA, 12 bp, Homo sapiens
tgctctgccctt

SEQ ID NO: 1790410 - DNA, 12 bp, Homo sapiens
tgctctgcctgg

SEQ ID NO: 1790411 - DNA, 17 bp, Homo sapiens
tgctctgcgtggcgcag

SEQ ID NO: 1790412 - DNA, 14 bp, Homo sapiens
tgctctggagcagc

SEQ ID NO: 1790413 - DNA, 15 bp, Homo sapiens
tgctctggagcagcc

SEQ ID NO: 1790414 - DNA, 19 bp, Homo sapiens
tgctctggaggaagttctc

SEQ ID NO: 1790415 - DNA, 21 bp, Homo sapiens
tgctctggaggaagttctcca

SEQ ID NO: 1790416 - DNA, 22 bp, Homo sapiens
tgctctggaggaagttctccag

SEQ ID NO: 1790417 - DNA, 17 bp, Homo sapiens
tgctctggcaccatcag

SEQ ID NO: 1790418 - DNA, 18 bp, Homo sapiens
tgctctggcaccatcagc

SEQ ID NO: 1790419 - DNA, 18 bp, Homo sapiens
tgctctggcggcttcctg

SEQ ID NO: 1790420 - DNA, 22 bp, Homo sapiens
tgctctggcggcttcctgtcca

SEQ ID NO: 1790421 - DNA, 23 bp, Homo sapiens
tgctctggcggcttcctgtccac

SEQ ID NO: 1790422 - DNA, 14 bp, Homo sapiens
tgctctggggattt

SEQ ID NO: 1790423 - DNA, 19 bp, Homo sapiens
tgctctggggatttctggg

SEQ ID NO: 1790424 - DNA, 21 bp, Homo sapiens
tgctctggggatttctgggat

SEQ ID NO: 1790425 - DNA, 20 bp, Homo sapiens
tgctctgtgtcaaggtgaag

SEQ ID NO: 1790426 - DNA, 17 bp, Homo sapiens
tgctctgttacccaggc

SEQ ID NO: 1790427 - DNA, 15 bp, Homo sapiens
tgctcttagctgtct

SEQ ID NO: 1790428 - DNA, 17 bp, Homo sapiens
tgctcttcagatgccac

SEQ ID NO: 1790429 - DNA, 18 bp, Homo sapiens
tgctcttcagatgccact

SEQ ID NO: 1790430 - DNA, 13 bp, Homo sapiens
tgctcttcagtgg

SEQ ID NO: 1790431 - DNA, 17 bp, Homo sapiens
tgctcttctttctgaga

SEQ ID NO: 1790432 - DNA, 20 bp, Homo sapiens
tgctcttgaaatattcagaa

SEQ ID NO: 1790433 - DNA, 19 bp, Homo sapiens
tgctcttgcagttgctctg

SEQ ID NO: 1790434 - DNA, 17 bp, Homo sapiens
tgctcttggaaagctga

SEQ ID NO: 1790435 - DNA, 18 bp, Homo sapiens
tgctcttggaaagctgat

SEQ ID NO: 1790436 - DNA, 23 bp, Homo sapiens
tgctcttgtttttattaatttat

SEQ ID NO: 1790437 - DNA, 17 bp, Homo sapiens
tgctctttattgcagaa

SEQ ID NO: 1790438 - DNA, 18 bp, Homo sapiens
tgctctttcatagtataa

SEQ ID NO: 1790439 - DNA, 23 bp, Homo sapiens
tgctctttcccccttccatctct

SEQ ID NO: 1790440 - DNA, 13 bp, Homo sapiens
tgctctttctctg

SEQ ID NO: 1790441 - DNA, 16 bp, Homo sapiens
tgctctttctctgcca

SEQ ID NO: 1790442 - DNA, 17 bp, Homo sapiens
tgctctttctctgccag

SEQ ID NO: 1790443 - DNA, 14 bp, Homo sapiens
tgctctttgtggca

SEQ ID NO: 1790444 - DNA, 15 bp, Homo sapiens
tgctcttttcctggt

SEQ ID NO: 1790445 - DNA, 13 bp, Homo sapiens
tgctcttttctcc

SEQ ID NO: 1790446 - DNA, 22 bp, Homo sapiens
tgctcttttggtggggagcact

SEQ ID NO: 1790447 - DNA, 23 bp, Homo sapiens
tgctgaacacagtgtctgttcag

SEQ ID NO: 1790448 - DNA, 14 bp, Homo sapiens
tgctgaacagtgga

SEQ ID NO: 1790449 - DNA, 13 bp, Homo sapiens
tgctgaactcagc

SEQ ID NO: 1790450 - DNA, 17 bp, Homo sapiens
tgctgaactccttgtta

SEQ ID NO: 1790451 - DNA, 14 bp, Homo sapiens
tgctgaactgtgca

SEQ ID NO: 1790452 - DNA, 15 bp, Homo sapiens
tgctgaactgtgcat

SEQ ID NO: 1790453 - DNA, 17 bp, Homo sapiens
tgctgaactgtgcatca

SEQ ID NO: 1790454 - DNA, 22 bp, Homo sapiens
tgctgaagctgctgcagccctg

SEQ ID NO: 1790455 - DNA, 17 bp, Homo sapiens
tgctgaatgcagggaat

SEQ ID NO: 1790456 - DNA, 23 bp, Homo sapiens
tgctgaatgcctcgctcccttca

SEQ ID NO: 1790457 - DNA, 17 bp, Homo sapiens
tgctgaatggttttcaa

SEQ ID NO: 1790458 - DNA, 15 bp, Homo sapiens
tgctgaattcatcta

SEQ ID NO: 1790459 - DNA, 14 bp, Homo sapiens
tgctgaatttcagg

SEQ ID NO: 1790460 - DNA, 13 bp, Homo sapiens
tgctgacaataaa

SEQ ID NO: 1790461 - DNA, 17 bp, Homo sapiens
tgctgacaataaagata

SEQ ID NO: 1790462 - DNA, 22 bp, Homo sapiens
tgctgacagacactaactttgt

SEQ ID NO: 1790463 - DNA, 14 bp, Homo sapiens
tgctgaccaaatgg

SEQ ID NO: 1790464 - DNA, 16 bp, Homo sapiens
tgctgaccaattgtgc

SEQ ID NO: 1790465 - DNA, 21 bp, Homo sapiens
tgctgaccaattgtgctgcca

SEQ ID NO: 1790466 - DNA, 23 bp, Homo sapiens
tgctgaccaattgtgctgccatt

SEQ ID NO: 1790467 - DNA, 15 bp, Homo sapiens
tgctgacctcacctg

SEQ ID NO: 1790468 - DNA, 20 bp, Homo sapiens
tgctgacctcactgtcctgt

SEQ ID NO: 1790469 - DNA, 14 bp, Homo sapiens
tgctgacggccagg

SEQ ID NO: 1790470 - DNA, 17 bp, Homo sapiens
tgctgacggccagggag

SEQ ID NO: 1790471 - DNA, 13 bp, Homo sapiens
tgctgactgaaca

SEQ ID NO: 1790472 - DNA, 16 bp, Homo sapiens
tgctgactgaggcctg

SEQ ID NO: 1790473 - DNA, 14 bp, Homo sapiens
tgctgactgtactc

SEQ ID NO: 1790474 - DNA, 16 bp, Homo sapiens
tgctgactgtactcct

SEQ ID NO: 1790475 - DNA, 22 bp, Homo sapiens
tgctgactgtactcctcccagg

SEQ ID NO: 1790476 - DNA, 18 bp, Homo sapiens
tgctgagagacccaagga

SEQ ID NO: 1790477 - DNA, 21 bp, Homo sapiens
tgctgagatcgaagaggccag

SEQ ID NO: 1790478 - DNA, 18 bp, Homo sapiens
tgctgagatgataaagtc

SEQ ID NO: 1790479 - DNA, 13 bp, Homo sapiens
tgctgagccactc

SEQ ID NO: 1790480 - DNA, 12 bp, Homo sapiens
tgctgagcctct

SEQ ID NO: 1790481 - DNA, 22 bp, Homo sapiens
tgctgaggcaccgtccaggccc

SEQ ID NO: 1790482 - DNA, 22 bp, Homo sapiens
tgctgaggccacccactgaccc

SEQ ID NO: 1790483 - DNA, 13 bp, Homo sapiens
tgctgaggcccct

SEQ ID NO: 1790484 - DNA, 13 bp, Homo sapiens
tgctgaggcctgg

SEQ ID NO: 1790485 - DNA, 18 bp, Homo sapiens
tgctgagggaccgagccc

SEQ ID NO: 1790486 - DNA, 18 bp, Homo sapiens
tgctgagggaccttggag

SEQ ID NO: 1790487 - DNA, 21 bp, Homo sapiens
tgctgagtcatctgttagggc

SEQ ID NO: 1790488 - DNA, 15 bp, Homo sapiens
tgctgagtgacagct

SEQ ID NO: 1790489 - DNA, 14 bp, Homo sapiens
tgctgagttggcct

SEQ ID NO: 1790490 - DNA, 16 bp, Homo sapiens
tgctgagttggcctgg

SEQ ID NO: 1790491 - DNA, 16 bp, Homo sapiens
tgctgagttgttctaa

SEQ ID NO: 1790492 - DNA, 20 bp, Homo sapiens
tgctgatcagagttcctcct

SEQ ID NO: 1790493 - DNA, 19 bp, Homo sapiens
tgctgatcatcgccagagg

SEQ ID NO: 1790494 - DNA, 22 bp, Homo sapiens
tgctgatcccggccggccctgg

SEQ ID NO: 1790495 - DNA, 14 bp, Homo sapiens
tgctgatcctgctg

SEQ ID NO: 1790496 - DNA, 15 bp, Homo sapiens
tgctgatcttttaaa

SEQ ID NO: 1790497 - DNA, 16 bp, Homo sapiens
tgctgatggagccttc

SEQ ID NO: 1790498 - DNA, 17 bp, Homo sapiens
tgctgatggagccttcc

SEQ ID NO: 1790499 - DNA, 19 bp, Homo sapiens
tgctgatggcccctccagc

SEQ ID NO: 1790500 - DNA, 20 bp, Homo sapiens
tgctgatggctgctagattt

SEQ ID NO: 1790501 - DNA, 16 bp, Homo sapiens
tgctgatgtaggagct

SEQ ID NO: 1790502 - DNA, 18 bp, Homo sapiens
tgctgatgtaggagctgg

SEQ ID NO: 1790503 - DNA, 15 bp, Homo sapiens
tgctgatgtcaaagt

SEQ ID NO: 1790504 - DNA, 13 bp, Homo sapiens
tgctgattattta

SEQ ID NO: 1790505 - DNA, 14 bp, Homo sapiens
tgctgattatttat

SEQ ID NO: 1790506 - DNA, 21 bp, Homo sapiens
tgctgattatttatgacctga

SEQ ID NO: 1790507 - DNA, 17 bp, Homo sapiens
tgctgattctcccgttc

SEQ ID NO: 1790508 - DNA, 16 bp, Homo sapiens
tgctgattttattctt

SEQ ID NO: 1790509 - DNA, 18 bp, Homo sapiens
tgctgattttattcttga

SEQ ID NO: 1790510 - DNA, 19 bp, Homo sapiens
tgctgattttattcttgat

SEQ ID NO: 1790511 - DNA, 16 bp, Homo sapiens
tgctgcaaaggagaag

SEQ ID NO: 1790512 - DNA, 14 bp, Homo sapiens
tgctgcaaggtggc

SEQ ID NO: 1790513 - DNA, 16 bp, Homo sapiens
tgctgcaaggtggcct

SEQ ID NO: 1790514 - DNA, 18 bp, Homo sapiens
tgctgcaaggtggcctct

SEQ ID NO: 1790515 - DNA, 22 bp, Homo sapiens
tgctgcaccctgcgcctccaga

SEQ ID NO: 1790516 - DNA, 22 bp, Homo sapiens
tgctgcagagaaacttaagcaa

SEQ ID NO: 1790517 - DNA, 16 bp, Homo sapiens
tgctgcagcagagtga

SEQ ID NO: 1790518 - DNA, 21 bp, Homo sapiens
tgctgcaggacttgagaagac

SEQ ID NO: 1790519 - DNA, 18 bp, Homo sapiens
tgctgcagtcatctactt

SEQ ID NO: 1790520 - DNA, 14 bp, Homo sapiens
tgctgcatactttg

SEQ ID NO: 1790521 - DNA, 15 bp, Homo sapiens
tgctgcatactttga

SEQ ID NO: 1790522 - DNA, 22 bp, Homo sapiens
tgctgcatactttgacaaggaa

SEQ ID NO: 1790523 - DNA, 20 bp, Homo sapiens
tgctgcatagctctatttta

SEQ ID NO: 1790524 - DNA, 14 bp, Homo sapiens
tgctgcattttata

SEQ ID NO: 1790525 - DNA, 17 bp, Homo sapiens
tgctgccaccacttttg

SEQ ID NO: 1790526 - DNA, 22 bp, Homo sapiens
tgctgccatgccactgccaggc

SEQ ID NO: 1790527 - DNA, 21 bp, Homo sapiens
tgctgccatttgatttttcta

SEQ ID NO: 1790528 - DNA, 13 bp, Homo sapiens
tgctgcccaggcc

SEQ ID NO: 1790529 - DNA, 19 bp, Homo sapiens
tgctgcccatgagcaagcc

SEQ ID NO: 1790530 - DNA, 14 bp, Homo sapiens
tgctgccccagctg

SEQ ID NO: 1790531 - DNA, 15 bp, Homo sapiens
tgctgcccccacccc

SEQ ID NO: 1790532 - DNA, 20 bp, Homo sapiens
tgctgccccgttccctgtca

SEQ ID NO: 1790533 - DNA, 21 bp, Homo sapiens
tgctgccccgttccctgtcag

SEQ ID NO: 1790534 - DNA, 17 bp, Homo sapiens
tgctgcccgctctgcag

SEQ ID NO: 1790535 - DNA, 23 bp, Homo sapiens
tgctgcccggggtggggtgcact

SEQ ID NO: 1790536 - DNA, 20 bp, Homo sapiens
tgctgcccgtcttcagccta

SEQ ID NO: 1790537 - DNA, 23 bp, Homo sapiens
tgctgccctcccacagcctcctt

SEQ ID NO: 1790538 - DNA, 14 bp, Homo sapiens
tgctgccgccgccg

SEQ ID NO: 1790539 - DNA, 13 bp, Homo sapiens
tgctgccggctct

SEQ ID NO: 1790540 - DNA, 20 bp, Homo sapiens
tgctgccggctctgggcctg

SEQ ID NO: 1790541 - DNA, 13 bp, Homo sapiens
tgctgcctgcctg

SEQ ID NO: 1790542 - DNA, 14 bp, Homo sapiens
tgctgcctgcctgt

SEQ ID NO: 1790543 - DNA, 13 bp, Homo sapiens
tgctgcctgctca

SEQ ID NO: 1790544 - DNA, 20 bp, Homo sapiens
tgctgcctgtatttgagaga

SEQ ID NO: 1790545 - DNA, 14 bp, Homo sapiens
tgctgccttgagac

SEQ ID NO: 1790546 - DNA, 21 bp, Homo sapiens
tgctgcgcgtgtgggtctctg

SEQ ID NO: 1790547 - DNA, 16 bp, Homo sapiens
tgctgctactgctgct

SEQ ID NO: 1790548 - DNA, 13 bp, Homo sapiens
tgctgctatgaaa

SEQ ID NO: 1790549 - DNA, 14 bp, Homo sapiens
tgctgctatgaaaa

SEQ ID NO: 1790550 - DNA, 20 bp, Homo sapiens
tgctgctatgaaaatgagca

SEQ ID NO: 1790551 - DNA, 15 bp, Homo sapiens
tgctgctccgcccgc

SEQ ID NO: 1790552 - DNA, 17 bp, Homo sapiens
tgctgctccgcccgctc

SEQ ID NO: 1790553 - DNA, 11 bp, Homo sapiens
tgctgctgccc

SEQ ID NO: 1790554 - DNA, 14 bp, Homo sapiens
tgctgctgccccag

SEQ ID NO: 1790555 - DNA, 18 bp, Homo sapiens
tgctgctgccccagcgtc

SEQ ID NO: 1790556 - DNA, 13 bp, Homo sapiens
tgctgctgcccct

SEQ ID NO: 1790557 - DNA, 17 bp, Homo sapiens
tgctgctgctgccccag

SEQ ID NO: 1790558 - DNA, 16 bp, Homo sapiens
tgctgctgctgcgccc

SEQ ID NO: 1790559 - DNA, 17 bp, Homo sapiens
tgctgctgctgcgccct

SEQ ID NO: 1790560 - DNA, 14 bp, Homo sapiens
tgctgctggccaaa

SEQ ID NO: 1790561 - DNA, 21 bp, Homo sapiens
tgctgctggccaaatagcaaa

SEQ ID NO: 1790562 - DNA, 16 bp, Homo sapiens
tgctgctggtgcacag

SEQ ID NO: 1790563 - DNA, 18 bp, Homo sapiens
tgctgctggtgcacagcc

SEQ ID NO: 1790564 - DNA, 24 bp, Homo sapiens
tgctgctgtaactgctgagccact

SEQ ID NO: 1790565 - DNA, 14 bp, Homo sapiens
tgctgctgtgtgct

SEQ ID NO: 1790566 - DNA, 10 bp, Homo sapiens
tgctgctgtt

SEQ ID NO: 1790567 - DNA, 18 bp, Homo sapiens
tgctgctttcccctgtgg

SEQ ID NO: 1790568 - DNA, 18 bp, Homo sapiens
tgctgctttttggcacag

SEQ ID NO: 1790569 - DNA, 15 bp, Homo sapiens
tgctggaaggggcag

SEQ ID NO: 1790570 - DNA, 17 bp, Homo sapiens
tgctggaataagttcaa

SEQ ID NO: 1790571 - DNA, 18 bp, Homo sapiens
tgctggaattccacaggg

SEQ ID NO: 1790572 - DNA, 16 bp, Homo sapiens
tgctggactgtggagg

SEQ ID NO: 1790573 - DNA, 13 bp, Homo sapiens
tgctggaggccct

SEQ ID NO: 1790574 - DNA, 17 bp, Homo sapiens
tgctggaggcctcaggt

SEQ ID NO: 1790575 - DNA, 21 bp, Homo sapiens
tgctggagggaggctgggcgg

SEQ ID NO: 1790576 - DNA, 17 bp, Homo sapiens
tgctggataaaatgagg

SEQ ID NO: 1790577 - DNA, 22 bp, Homo sapiens
tgctggatgtctgccaattttt

SEQ ID NO: 1790578 - DNA, 15 bp, Homo sapiens
tgctggattaatgtt

SEQ ID NO: 1790579 - DNA, 16 bp, Homo sapiens
tgctggattaatgttt

SEQ ID NO: 1790580 - DNA, 13 bp, Homo sapiens
tgctggccaaata

SEQ ID NO: 1790581 - DNA, 18 bp, Homo sapiens
tgctggcccagggcccag

SEQ ID NO: 1790582 - DNA, 22 bp, Homo sapiens
tgctggcccagggcccagagcc

SEQ ID NO: 1790583 - DNA, 16 bp, Homo sapiens
tgctggccccagccct

SEQ ID NO: 1790584 - DNA, 19 bp, Homo sapiens
tgctggccccagccctgct

SEQ ID NO: 1790585 - DNA, 20 bp, Homo sapiens
tgctggccccagccctgctg

SEQ ID NO: 1790586 - DNA, 16 bp, Homo sapiens
tgctggcctggatctc

SEQ ID NO: 1790587 - DNA, 14 bp, Homo sapiens
tgcttaaataaaaa

SEQ ID NO: 1790588 - DNA, 16 bp, Homo sapiens
tgcttaaattttaact

SEQ ID NO: 1790589 - DNA, 14 bp, Homo sapiens
tgcttaatcttcaa

SEQ ID NO: 1790590 - DNA, 15 bp, Homo sapiens
tgcttaatcttcaaa

SEQ ID NO: 1790591 - DNA, 11 bp, Homo sapiens
tgcttacagta

SEQ ID NO: 1790592 - DNA, 16 bp, Homo sapiens
tgcttacagtaactaa

SEQ ID NO: 1790593 - DNA, 15 bp, Homo sapiens
tgcttacatttttac

SEQ ID NO: 1790594 - DNA, 17 bp, Homo sapiens
tgcttacatttttacaa

SEQ ID NO: 1790595 - DNA, 18 bp, Homo sapiens
tgcttacccttcaccttt

SEQ ID NO: 1790596 - DNA, 14 bp, Homo sapiens
tgcttacctctcag

SEQ ID NO: 1790597 - DNA, 18 bp, Homo sapiens
tgcttactttggaataca

SEQ ID NO: 1790598 - DNA, 14 bp, Homo sapiens
tgcttagaaaagaa

SEQ ID NO: 1790599 - DNA, 20 bp, Homo sapiens
tgcttagataactcttgttt

SEQ ID NO: 1790600 - DNA, 19 bp, Homo sapiens
tgcttagctgccttgagct

SEQ ID NO: 1790601 - DNA, 17 bp, Homo sapiens
tgcttaggtctcatgga

SEQ ID NO: 1790602 - DNA, 12 bp, Homo sapiens
tgcttagtaagt

SEQ ID NO: 1790603 - DNA, 21 bp, Homo sapiens
tgcttagtaagtatttccata

SEQ ID NO: 1790604 - DNA, 15 bp, Homo sapiens
tgcttagtcactgcc

SEQ ID NO: 1790605 - DNA, 16 bp, Homo sapiens
tgcttagtcactgcct

SEQ ID NO: 1790606 - DNA, 20 bp, Homo sapiens
tgcttatgaatatttataac

SEQ ID NO: 1790607 - DNA, 22 bp, Homo sapiens
tgcttatgcagtttttcagagt

SEQ ID NO: 1790608 - DNA, 22 bp, Homo sapiens
tgcttcaagtgttgctcttgga

SEQ ID NO: 1790609 - DNA, 22 bp, Homo sapiens
tgcttcaataaatctttggaaa

SEQ ID NO: 1790610 - DNA, 23 bp, Homo sapiens
tgcttcaattaataaaaaatgga

SEQ ID NO: 1790611 - DNA, 13 bp, Homo sapiens
tgcttcagagttt

SEQ ID NO: 1790612 - DNA, 22 bp, Homo sapiens
tgcttcagcctgaggctgagac

SEQ ID NO: 1790613 - DNA, 12 bp, Homo sapiens
tgcttcattatt

SEQ ID NO: 1790614 - DNA, 23 bp, Homo sapiens
tgcttcattattcaagaatgaaa

SEQ ID NO: 1790615 - DNA, 13 bp, Homo sapiens
tgcttcattgtta

SEQ ID NO: 1790616 - DNA, 20 bp, Homo sapiens
tgcttccaacaaggacagcc

SEQ ID NO: 1790617 - DNA, 19 bp, Homo sapiens
tgcttccaggaaactccac

SEQ ID NO: 1790618 - DNA, 18 bp, Homo sapiens
tgcttcccatcctaccct

SEQ ID NO: 1790619 - DNA, 13 bp, Homo sapiens
tgcttccccctcc

SEQ ID NO: 1790620 - DNA, 23 bp, Homo sapiens
tgcttccccctccccctcctgct

SEQ ID NO: 1790621 - DNA, 15 bp, Homo sapiens
tgcttcctcccaaca

SEQ ID NO: 1790622 - DNA, 12 bp, Homo sapiens
tgcttcctcctg

SEQ ID NO: 1790623 - DNA, 13 bp, Homo sapiens
tgcttcctcctgg

SEQ ID NO: 1790624 - DNA, 15 bp, Homo sapiens
tgcttcctgatgctg

SEQ ID NO: 1790625 - DNA, 16 bp, Homo sapiens
tgcttcctgatgctgg

SEQ ID NO: 1790626 - DNA, 20 bp, Homo sapiens
tgcttcctgatgctgggcaa

SEQ ID NO: 1790627 - DNA, 14 bp, Homo sapiens
tgcttccttcagtt

SEQ ID NO: 1790628 - DNA, 20 bp, Homo sapiens
tgcttcctttctctcctggc

SEQ ID NO: 1790629 - DNA, 15 bp, Homo sapiens
tgcttcgactactgc

SEQ ID NO: 1790630 - DNA, 15 bp, Homo sapiens
tgcttctaaaacaat

SEQ ID NO: 1790631 - DNA, 18 bp, Homo sapiens
tgcttctaaaacaataaa

SEQ ID NO: 1790632 - DNA, 20 bp, Homo sapiens
tgcttctaaaacaataaaga

SEQ ID NO: 1790633 - DNA, 23 bp, Homo sapiens
tgcttctactttcatcttaaact

SEQ ID NO: 1790634 - DNA, 12 bp, Homo sapiens
tgcttctagctt

SEQ ID NO: 1790635 - DNA, 19 bp, Homo sapiens
tgcttctcatagccccggt

SEQ ID NO: 1790636 - DNA, 10 bp, Homo sapiens
tgcttctcta

SEQ ID NO: 1790637 - DNA, 21 bp, Homo sapiens
tgcttctctagctctctaggc

SEQ ID NO: 1790638 - DNA, 22 bp, Homo sapiens
tgcttctctagctctctaggcc

SEQ ID NO: 1790639 - DNA, 23 bp, Homo sapiens
tgcttctctagctctctaggcct

SEQ ID NO: 1790640 - DNA, 14 bp, Homo sapiens
tgcttctgctgccc

SEQ ID NO: 1790641 - DNA, 20 bp, Homo sapiens
tgcttctgtagtactcctta

SEQ ID NO: 1790642 - DNA, 17 bp, Homo sapiens
tgcttctgtatttcctt

SEQ ID NO: 1790643 - DNA, 15 bp, Homo sapiens
tgcttctttctagaa

SEQ ID NO: 1790644 - DNA, 17 bp, Homo sapiens
tgcttgaacttacaggt

SEQ ID NO: 1790645 - DNA, 20 bp, Homo sapiens
tgcttgacataatttcactg

SEQ ID NO: 1790646 - DNA, 18 bp, Homo sapiens
tgcttgagaatcctctcc

SEQ ID NO: 1790647 - DNA, 19 bp, Homo sapiens
tgcttgaggaatgaagacc

SEQ ID NO: 1790648 - DNA, 12 bp, Homo sapiens
tgcttgattttt

SEQ ID NO: 1790649 - DNA, 17 bp, Homo sapiens
tgcttgcacacttcccc

SEQ ID NO: 1790650 - DNA, 18 bp, Homo sapiens
tgcttgccaaagtacaga

SEQ ID NO: 1790651 - DNA, 23 bp, Homo sapiens
tgcttgccaaggcagaggcctgg

SEQ ID NO: 1790652 - DNA, 17 bp, Homo sapiens
tgcttgccgactggctg

SEQ ID NO: 1790653 - DNA, 21 bp, Homo sapiens
tgcttgccgactggctgtgag

SEQ ID NO: 1790654 - DNA, 20 bp, Homo sapiens
tgcttgccgagcctaatgaa

SEQ ID NO: 1790655 - DNA, 15 bp, Homo sapiens
tgcttgcctgcaggg

SEQ ID NO: 1790656 - DNA, 19 bp, Homo sapiens
tgcttgcctgcgttttgga

SEQ ID NO: 1790657 - DNA, 18 bp, Homo sapiens
tgcttgcggcaaaaggaa

SEQ ID NO: 1790658 - DNA, 19 bp, Homo sapiens
tgcttgcggcaaaaggaaa

SEQ ID NO: 1790659 - DNA, 19 bp, Homo sapiens
tgcttgctggccacaagga

SEQ ID NO: 1790660 - DNA, 19 bp, Homo sapiens
tgcttgctttcttttttaa

SEQ ID NO: 1790661 - DNA, 13 bp, Homo sapiens
tgcttggaagcca

SEQ ID NO: 1790662 - DNA, 20 bp, Homo sapiens
tgcttggatccatacaaaac

SEQ ID NO: 1790663 - DNA, 21 bp, Homo sapiens
tgcttggattctctgagaaat

SEQ ID NO: 1790664 - DNA, 18 bp, Homo sapiens
tgcttggcccggccggcc

SEQ ID NO: 1790665 - DNA, 12 bp, Homo sapiens
tgcttggggcta

SEQ ID NO: 1790666 - DNA, 18 bp, Homo sapiens
tgcttgtaacaagaaaac

SEQ ID NO: 1790667 - DNA, 19 bp, Homo sapiens
tgcttgtaacaagaaaaca

SEQ ID NO: 1790668 - DNA, 22 bp, Homo sapiens
tgcttgtaatttaaacatttgt

SEQ ID NO: 1790669 - DNA, 16 bp, Homo sapiens
tgcttgtactgggaca

SEQ ID NO: 1790670 - DNA, 13 bp, Homo sapiens
tgcttgtagaagt

SEQ ID NO: 1790671 - DNA, 14 bp, Homo sapiens
tgcttgtcatccac

SEQ ID NO: 1790672 - DNA, 16 bp, Homo sapiens
tgcttgtcattccaga

SEQ ID NO: 1790673 - DNA, 17 bp, Homo sapiens
tgcttgtcattccagag

SEQ ID NO: 1790674 - DNA, 22 bp, Homo sapiens
tgcttgtcctgctctcttcagg

SEQ ID NO: 1790675 - DNA, 23 bp, Homo sapiens
tgcttgtcctgctctcttcagga

SEQ ID NO: 1790676 - DNA, 16 bp, Homo sapiens
tgcttgtcctgggcct

SEQ ID NO: 1790677 - DNA, 15 bp, Homo sapiens
tgcttgtcttctggt

SEQ ID NO: 1790678 - DNA, 15 bp, Homo sapiens
tgcttgttgggattc

SEQ ID NO: 1790679 - DNA, 19 bp, Homo sapiens
tgcttgttgggattcctga

SEQ ID NO: 1790680 - DNA, 22 bp, Homo sapiens
tgcttgttgtttgttgacagct

SEQ ID NO: 1790681 - DNA, 14 bp, Homo sapiens
tgcttgtttacagc

SEQ ID NO: 1790682 - DNA, 20 bp, Homo sapiens
tgcttgtttatgatatttct

SEQ ID NO: 1790683 - DNA, 12 bp, Homo sapiens
tgcttgttttat

SEQ ID NO: 1790684 - DNA, 14 bp, Homo sapiens
tgctttaaaacaag

SEQ ID NO: 1790685 - DNA, 14 bp, Homo sapiens
tgctttaaatctta

SEQ ID NO: 1790686 - DNA, 16 bp, Homo sapiens
tgctttaaatcttaag

SEQ ID NO: 1790687 - DNA, 23 bp, Homo sapiens
tgctttaatatgagcttcaatat

SEQ ID NO: 1790688 - DNA, 12 bp, Homo sapiens
tgctttaatgag

SEQ ID NO: 1790689 - DNA, 19 bp, Homo sapiens
tgctttacagtcaatagtg

SEQ ID NO: 1790690 - DNA, 13 bp, Homo sapiens
tgctttagtttca

SEQ ID NO: 1790691 - DNA, 17 bp, Homo sapiens
tgctttattaatgtttt

SEQ ID NO: 1790692 - DNA, 23 bp, Homo sapiens
tgctttcaccagaatttctaaga

SEQ ID NO: 1790693 - DNA, 15 bp, Homo sapiens
tgctttcccagagga

SEQ ID NO: 1790694 - DNA, 13 bp, Homo sapiens
tgctttcccctgt

SEQ ID NO: 1790695 - DNA, 15 bp, Homo sapiens
tgctttccctgaagc

SEQ ID NO: 1790696 - DNA, 19 bp, Homo sapiens
tgctttccctgaggaatga

SEQ ID NO: 1790697 - DNA, 21 bp, Homo sapiens
tgctttccgtggcactgcata

SEQ ID NO: 1790698 - DNA, 13 bp, Homo sapiens
tgctttcctctga

SEQ ID NO: 1790699 - DNA, 20 bp, Homo sapiens
tgctttcctctgagattcta

SEQ ID NO: 1790700 - DNA, 23 bp, Homo sapiens
tgctttttaatattgatatgctt

SEQ ID NO: 1790701 - DNA, 12 bp, Homo sapiens
tgctttttagaa

SEQ ID NO: 1790702 - DNA, 16 bp, Homo sapiens
tgctttttagaaagca

SEQ ID NO: 1790703 - DNA, 15 bp, Homo sapiens
tgctttttcaccaga

SEQ ID NO: 1790704 - DNA, 14 bp, Homo sapiens
tgctttttctcaga

SEQ ID NO: 1790705 - DNA, 15 bp, Homo sapiens
tgctttttctcagat

SEQ ID NO: 1790706 - DNA, 20 bp, Homo sapiens
tgctttttgcgtacacagag

SEQ ID NO: 1790707 - DNA, 20 bp, Homo sapiens
tgctttttttgaaactttga

SEQ ID NO: 1790708 - DNA, 22 bp, Homo sapiens
tgcttttttttttccagcaagt

SEQ ID NO: 1790709 - DNA, 15 bp, Homo sapiens
tggaaaaaaaaaact

SEQ ID NO: 1790710 - DNA, 14 bp, Homo sapiens
tggaaaaaaacata

SEQ ID NO: 1790711 - DNA, 15 bp, Homo sapiens
tggaaaaaaacataa

SEQ ID NO: 1790712 - DNA, 17 bp, Homo sapiens
tggaaaaaaatacaaaa

SEQ ID NO: 1790713 - DNA, 22 bp, Homo sapiens
tggaaaaaactctgaaggagag

SEQ ID NO: 1790714 - DNA, 23 bp, Homo sapiens
tggaaaaacatctgaaagccacg

SEQ ID NO: 1790715 - DNA, 20 bp, Homo sapiens
tggaaaaaccacccccaaat

SEQ ID NO: 1790716 - DNA, 21 bp, Homo sapiens
tggaaaaatggttgatggaaa

SEQ ID NO: 1790717 - DNA, 16 bp, Homo sapiens
tggaaaacagaacact

SEQ ID NO: 1790718 - DNA, 17 bp, Homo sapiens
tggaaaacagaacactt

SEQ ID NO: 1790719 - DNA, 13 bp, Homo sapiens
tggaaaaccagga

SEQ ID NO: 1790720 - DNA, 22 bp, Homo sapiens
tggaaaagaagaaactttgcct

SEQ ID NO: 1790721 - DNA, 18 bp, Homo sapiens
tggaaaagcaacttcatt

SEQ ID NO: 1790722 - DNA, 14 bp, Homo sapiens
tggaaaagctgggg

SEQ ID NO: 1790723 - DNA, 16 bp, Homo sapiens
tggaaaaggaagacta

SEQ ID NO: 1790724 - DNA, 18 bp, Homo sapiens
tggaaaaggaagactaga

SEQ ID NO: 1790725 - DNA, 20 bp, Homo sapiens
tggaaaaggaagactagagg

SEQ ID NO: 1790726 - DNA, 16 bp, Homo sapiens
tggaaaataccagtgt

SEQ ID NO: 1790727 - DNA, 18 bp, Homo sapiens
tggaaaatgccatgaatt

SEQ ID NO: 1790728 - DNA, 16 bp, Homo sapiens
tggaaaattttctcct

SEQ ID NO: 1790729 - DNA, 14 bp, Homo sapiens
tggaaacagcatga

SEQ ID NO: 1790730 - DNA, 14 bp, Homo sapiens
tggaaacaggacca

SEQ ID NO: 1790731 - DNA, 23 bp, Homo sapiens
tggaaacatttacaataaatatt

SEQ ID NO: 1790732 - DNA, 16 bp, Homo sapiens
tggaaaccacagtcag

SEQ ID NO: 1790733 - DNA, 20 bp, Homo sapiens
tggaaacctgccctgcctga

SEQ ID NO: 1790734 - DNA, 16 bp, Homo sapiens
tggaaaccttccaccc

SEQ ID NO: 1790735 - DNA, 15 bp, Homo sapiens
tggaaactgaatgct

SEQ ID NO: 1790736 - DNA, 16 bp, Homo sapiens
tggaaactgaatgctc

SEQ ID NO: 1790737 - DNA, 21 bp, Homo sapiens
tggaaagacaactgttttaat

SEQ ID NO: 1790738 - DNA, 10 bp, Homo sapiens
tggaaagaga

SEQ ID NO: 1790739 - DNA, 21 bp, Homo sapiens
tggaaagatagagattgtttt

SEQ ID NO: 1790740 - DNA, 20 bp, Homo sapiens
tggaaagatgttaagcattt

SEQ ID NO: 1790741 - DNA, 21 bp, Homo sapiens
tggaaagatgttaagcattta

SEQ ID NO: 1790742 - DNA, 19 bp, Homo sapiens
tggaaagcagagttttcat

SEQ ID NO: 1790743 - DNA, 18 bp, Homo sapiens
tggaaagcctctgctgcc

SEQ ID NO: 1790744 - DNA, 14 bp, Homo sapiens
tggaaagcgcccct

SEQ ID NO: 1790745 - DNA, 14 bp, Homo sapiens
tggaaaggaaaaaa

SEQ ID NO: 1790746 - DNA, 15 bp, Homo sapiens
tggaaaggaaaaaag

SEQ ID NO: 1790747 - DNA, 14 bp, Homo sapiens
tggaaaggggagag

SEQ ID NO: 1790748 - DNA, 17 bp, Homo sapiens
tggaaaggggaggagct

SEQ ID NO: 1790749 - DNA, 16 bp, Homo sapiens
tggaaaggtcctgctg

SEQ ID NO: 1790750 - DNA, 18 bp, Homo sapiens
tggaaagttactgtaaat

SEQ ID NO: 1790751 - DNA, 20 bp, Homo sapiens
tggaaagttgggcccctgag

SEQ ID NO: 1790752 - DNA, 16 bp, Homo sapiens
tggaaataaaacagct

SEQ ID NO: 1790753 - DNA, 12 bp, Homo sapiens
tggaaataaagt

SEQ ID NO: 1790754 - DNA, 14 bp, Homo sapiens
tggaaataaagtca

SEQ ID NO: 1790755 - DNA, 13 bp, Homo sapiens
tggaaataaatgt

SEQ ID NO: 1790756 - DNA, 15 bp, Homo sapiens
tggaaataatttgaa

SEQ ID NO: 1790757 - DNA, 16 bp, Homo sapiens
tggaaataatttgaat

SEQ ID NO: 1790758 - DNA, 19 bp, Homo sapiens
tggaaataatttgaatgta

SEQ ID NO: 1790759 - DNA, 15 bp, Homo sapiens
tggaaatacagttat

SEQ ID NO: 1790760 - DNA, 21 bp, Homo sapiens
tggaaatacagttatttcatc

SEQ ID NO: 1790761 - DNA, 13 bp, Homo sapiens
tggaaatgatgtt

SEQ ID NO: 1790762 - DNA, 15 bp, Homo sapiens
tggaaatgatgttgg

SEQ ID NO: 1790763 - DNA, 20 bp, Homo sapiens
tggaaatgatgttggtccaa

SEQ ID NO: 1790764 - DNA, 15 bp, Homo sapiens
tggaaatgtctgctg

SEQ ID NO: 1790765 - DNA, 19 bp, Homo sapiens
tggaaatgtgaatcgcagc

SEQ ID NO: 1790766 - DNA, 13 bp, Homo sapiens
tggaaattcctgt

SEQ ID NO: 1790767 - DNA, 14 bp, Homo sapiens
tggaaattcctgta

SEQ ID NO: 1790768 - DNA, 22 bp, Homo sapiens
tggaaattcctgtactgtgtct

SEQ ID NO: 1790769 - DNA, 16 bp, Homo sapiens
tggaagattttaaatt

SEQ ID NO: 1790770 - DNA, 14 bp, Homo sapiens
tggaagcacaggca

SEQ ID NO: 1790771 - DNA, 23 bp, Homo sapiens
tggaagcactgccattagactga

SEQ ID NO: 1790772 - DNA, 19 bp, Homo sapiens
tggaagcatgtaggagaat

SEQ ID NO: 1790773 - DNA, 22 bp, Homo sapiens
tggaagcatgtaggagaatcca

SEQ ID NO: 1790774 - DNA, 20 bp, Homo sapiens
tggaagccaggtacaggaga

SEQ ID NO: 1790775 - DNA, 12 bp, Homo sapiens
tggaagccctcc

SEQ ID NO: 1790776 - DNA, 15 bp, Homo sapiens
tggaagccctccttc

SEQ ID NO: 1790777 - DNA, 16 bp, Homo sapiens
tggaagccctccttcc

SEQ ID NO: 1790778 - DNA, 17 bp, Homo sapiens
tggaagccctccttcca

SEQ ID NO: 1790779 - DNA, 19 bp, Homo sapiens
tggaagccctccttccacg

SEQ ID NO: 1790780 - DNA, 18 bp, Homo sapiens
tggaagctggaagactgt

SEQ ID NO: 1790781 - DNA, 16 bp, Homo sapiens
tggaagctgtgtcctt

SEQ ID NO: 1790782 - DNA, 19 bp, Homo sapiens
tggaagctgtttggaaaag

SEQ ID NO: 1790783 - DNA, 14 bp, Homo sapiens
tggaaggacacagt

SEQ ID NO: 1790784 - DNA, 22 bp, Homo sapiens
tggaaggaccacattttatatt

SEQ ID NO: 1790785 - DNA, 12 bp, Homo sapiens
tggaaggagcac

SEQ ID NO: 1790786 - DNA, 13 bp, Homo sapiens
tggaaggagcaga

SEQ ID NO: 1790787 - DNA, 19 bp, Homo sapiens
tggaaggatctgctgaggc

SEQ ID NO: 1790788 - DNA, 20 bp, Homo sapiens
tggaaggatctgctgaggcc

SEQ ID NO: 1790789 - DNA, 19 bp, Homo sapiens
tggaaggcaagccaggctc

SEQ ID NO: 1790790 - DNA, 14 bp, Homo sapiens
tggaaggcacccgc

SEQ ID NO: 1790791 - DNA, 16 bp, Homo sapiens
tggaaggccccttccc

SEQ ID NO: 1790792 - DNA, 13 bp, Homo sapiens
tggaaggctggct

SEQ ID NO: 1790793 - DNA, 18 bp, Homo sapiens
tggaagggcgttctaggt

SEQ ID NO: 1790794 - DNA, 17 bp, Homo sapiens
tggaaggggcagcagga

SEQ ID NO: 1790795 - DNA, 18 bp, Homo sapiens
tggaagggggtgtgcgtg

SEQ ID NO: 1790796 - DNA, 23 bp, Homo sapiens
tggaagggggtgtgcgtgcgtgt

SEQ ID NO: 1790797 - DNA, 15 bp, Homo sapiens
tggaagggtttgtgg

SEQ ID NO: 1790798 - DNA, 16 bp, Homo sapiens
tggaaggttcaggggc

SEQ ID NO: 1790799 - DNA, 16 bp, Homo sapiens
tggaagtctgcgccct

SEQ ID NO: 1790800 - DNA, 15 bp, Homo sapiens
tggaagtgcccagcc

SEQ ID NO: 1790801 - DNA, 16 bp, Homo sapiens
tggaagtggttctatg

SEQ ID NO: 1790802 - DNA, 16 bp, Homo sapiens
tggaagtgtatttatt

SEQ ID NO: 1790803 - DNA, 21 bp, Homo sapiens
tggaagtgtgggtctgtgtgt

SEQ ID NO: 1790804 - DNA, 17 bp, Homo sapiens
tggaagtgttcaagaaa

SEQ ID NO: 1790805 - DNA, 22 bp, Homo sapiens
tggaagtgtttcaaaaaattat

SEQ ID NO: 1790806 - DNA, 18 bp, Homo sapiens
tggaagttattaacttta

SEQ ID NO: 1790807 - DNA, 16 bp, Homo sapiens
tggaagtttatttcca

SEQ ID NO: 1790808 - DNA, 15 bp, Homo sapiens
tggaagttttcagga

SEQ ID NO: 1790809 - DNA, 14 bp, Homo sapiens
tggaagttttgcat

SEQ ID NO: 1790810 - DNA, 20 bp, Homo sapiens
tggaagttttgctagtgtgc

SEQ ID NO: 1790811 - DNA, 14 bp, Homo sapiens
tggaataaacatta

SEQ ID NO: 1790812 - DNA, 21 bp, Homo sapiens
tggaataaacattaattttgt

SEQ ID NO: 1790813 - DNA, 15 bp, Homo sapiens
tggaataacatgtaa

SEQ ID NO: 1790814 - DNA, 19 bp, Homo sapiens
tggaataacatgtaattaa

SEQ ID NO: 1790815 - DNA, 15 bp, Homo sapiens
tggaataatttctat

SEQ ID NO: 1790816 - DNA, 14 bp, Homo sapiens
tggaataggaataa

SEQ ID NO: 1790817 - DNA, 13 bp, Homo sapiens
tggaatattaaaa

SEQ ID NO: 1790818 - DNA, 16 bp, Homo sapiens
tggaatattttatcct

SEQ ID NO: 1790819 - DNA, 17 bp, Homo sapiens
tggaatattttatcctg

SEQ ID NO: 1790820 - DNA, 18 bp, Homo sapiens
tggaatattttatcctgt

SEQ ID NO: 1790821 - DNA, 22 bp, Homo sapiens
tggaatcaggaatattttccaa

SEQ ID NO: 1790822 - DNA, 23 bp, Homo sapiens
tggaatcaggaatattttccaaa

SEQ ID NO: 1790823 - DNA, 18 bp, Homo sapiens
tggaatcccactgtatga

SEQ ID NO: 1790824 - DNA, 17 bp, Homo sapiens
tggaatcttcacctcag

SEQ ID NO: 1790825 - DNA, 18 bp, Homo sapiens
tggaatcttcacctcaga

SEQ ID NO: 1790826 - DNA, 23 bp, Homo sapiens
tggaatcttcacctcagagtgga

SEQ ID NO: 1790827 - DNA, 20 bp, Homo sapiens
tggaatcttctctttgacaa

SEQ ID NO: 1790828 - DNA, 16 bp, Homo sapiens
tggaatgaagaaattg

SEQ ID NO: 1790829 - DNA, 17 bp, Homo sapiens
tggaatgaattaaataa

SEQ ID NO: 1790830 - DNA, 17 bp, Homo sapiens
tggaatgcttcctagaa

SEQ ID NO: 1790831 - DNA, 21 bp, Homo sapiens
tggaatggctgagcaaatatt

SEQ ID NO: 1790832 - DNA, 22 bp, Homo sapiens
tggaatggtacatgtcttccat

SEQ ID NO: 1790833 - DNA, 15 bp, Homo sapiens
tggacttcctggggc

SEQ ID NO: 1790834 - DNA, 18 bp, Homo sapiens
tggacttctacctgccct

SEQ ID NO: 1790835 - DNA, 20 bp, Homo sapiens
tggacttgtatatttgtaca

SEQ ID NO: 1790836 - DNA, 19 bp, Homo sapiens
tggacttgtgattggctgc

SEQ ID NO: 1790837 - DNA, 23 bp, Homo sapiens
tggacttgtgattggctgcagga

SEQ ID NO: 1790838 - DNA, 22 bp, Homo sapiens
tggactttggttctctccagga

SEQ ID NO: 1790839 - DNA, 18 bp, Homo sapiens
tggacttttttttttctt

SEQ ID NO: 1790840 - DNA, 18 bp, Homo sapiens
tggagaaaaaggtgccat

SEQ ID NO: 1790841 - DNA, 14 bp, Homo sapiens
tggagaaaccctgt

SEQ ID NO: 1790842 - DNA, 16 bp, Homo sapiens
tggagaaaccctgtct

SEQ ID NO: 1790843 - DNA, 15 bp, Homo sapiens
tggagaaagaagtgg

SEQ ID NO: 1790844 - DNA, 18 bp, Homo sapiens
tggagaaagaagtggaga

SEQ ID NO: 1790845 - DNA, 16 bp, Homo sapiens
tggagaaagagctgcc

SEQ ID NO: 1790846 - DNA, 20 bp, Homo sapiens
tggagaaagatgcagtcctc

SEQ ID NO: 1790847 - DNA, 14 bp, Homo sapiens
tggagaaagcactg

SEQ ID NO: 1790848 - DNA, 15 bp, Homo sapiens
tggagaaagctcatg

SEQ ID NO: 1790849 - DNA, 15 bp, Homo sapiens
tggagaaaggagtga

SEQ ID NO: 1790850 - DNA, 16 bp, Homo sapiens
tggagaaatgtcataa

SEQ ID NO: 1790851 - DNA, 22 bp, Homo sapiens
tggagaacagtggttgcctggg

SEQ ID NO: 1790852 - DNA, 22 bp, Homo sapiens
tggagaaccagggctcttctca

SEQ ID NO: 1790853 - DNA, 18 bp, Homo sapiens
tggagaacgccagtctcc

SEQ ID NO: 1790854 - DNA, 17 bp, Homo sapiens
tggagaagaatggcttt

SEQ ID NO: 1790855 - DNA, 13 bp, Homo sapiens
tggagaagcagtg

SEQ ID NO: 1790856 - DNA, 20 bp, Homo sapiens
tggagaagccacaggcctga

SEQ ID NO: 1790857 - DNA, 21 bp, Homo sapiens
tggagaagccacaggcctgag

SEQ ID NO: 1790858 - DNA, 13 bp, Homo sapiens
tggagaagcttgt

SEQ ID NO: 1790859 - DNA, 13 bp, Homo sapiens
tggagaagggagg

SEQ ID NO: 1790860 - DNA, 14 bp, Homo sapiens
tggagaagggaggg

SEQ ID NO: 1790861 - DNA, 16 bp, Homo sapiens
tggagaagggagggtg

SEQ ID NO: 1790862 - DNA, 20 bp, Homo sapiens
tggagaagggttctgccctg

SEQ ID NO: 1790863 - DNA, 15 bp, Homo sapiens
tggagaagtctcagc

SEQ ID NO: 1790864 - DNA, 17 bp, Homo sapiens
tggagaagtctcagcta

SEQ ID NO: 1790865 - DNA, 22 bp, Homo sapiens
tggagaagtgtcgttttcataa

SEQ ID NO: 1790866 - DNA, 17 bp, Homo sapiens
tggagacacaactattt

SEQ ID NO: 1790867 - DNA, 23 bp, Homo sapiens
tggagacactcctataaggagag

SEQ ID NO: 1790868 - DNA, 18 bp, Homo sapiens
tggagaccagggagcctt

SEQ ID NO: 1790869 - DNA, 19 bp, Homo sapiens
tggagaccagggagccttt

SEQ ID NO: 1790870 - DNA, 23 bp, Homo sapiens
tggagaccgcttcacccctgcac

SEQ ID NO: 1790871 - DNA, 18 bp, Homo sapiens
tggagactaagccctgtc

SEQ ID NO: 1790872 - DNA, 13 bp, Homo sapiens
tggagactcctgc

SEQ ID NO: 1790873 - DNA, 21 bp, Homo sapiens
tggagagagaggctgcctcag

SEQ ID NO: 1790874 - DNA, 20 bp, Homo sapiens
tggagagatgtttggaaacc

SEQ ID NO: 1790875 - DNA, 15 bp, Homo sapiens
tggagagcagcaggt

SEQ ID NO: 1790876 - DNA, 17 bp, Homo sapiens
tggagagcagccagcac

SEQ ID NO: 1790877 - DNA, 19 bp, Homo sapiens
tggagagctggtgcccgga

SEQ ID NO: 1790878 - DNA, 23 bp, Homo sapiens
tggagaggagggatgctgcctga

SEQ ID NO: 1790879 - DNA, 16 bp, Homo sapiens
tggagagggaatgtga

SEQ ID NO: 1790880 - DNA, 18 bp, Homo sapiens
tggagagggaatgtgaaa

SEQ ID NO: 1790881 - DNA, 22 bp, Homo sapiens
tggagaggttataggtcactcc

SEQ ID NO: 1790882 - DNA, 15 bp, Homo sapiens
tggagagtaaaaact

SEQ ID NO: 1790883 - DNA, 15 bp, Homo sapiens
tggagagtttcctga

SEQ ID NO: 1790884 - DNA, 14 bp, Homo sapiens
tggagataaaagca

SEQ ID NO: 1790885 - DNA, 14 bp, Homo sapiens
tggagatcctcctg

SEQ ID NO: 1790886 - DNA, 16 bp, Homo sapiens
tggagatcctcctgca

SEQ ID NO: 1790887 - DNA, 19 bp, Homo sapiens
tggagatcgcttttctcag

SEQ ID NO: 1790888 - DNA, 16 bp, Homo sapiens
tggagatggaagcttg

SEQ ID NO: 1790889 - DNA, 18 bp, Homo sapiens
tggagatggaagcttgtt

SEQ ID NO: 1790890 - DNA, 14 bp, Homo sapiens
tggagatggatcct

SEQ ID NO: 1790891 - DNA, 20 bp, Homo sapiens
tggagcactagtttgattat

SEQ ID NO: 1790892 - DNA, 15 bp, Homo sapiens
tggagcagagctctc

SEQ ID NO: 1790893 - DNA, 13 bp, Homo sapiens
tggagcagccaag

SEQ ID NO: 1790894 - DNA, 15 bp, Homo sapiens
tggagcagccaaggc

SEQ ID NO: 1790895 - DNA, 22 bp, Homo sapiens
tggagcagccaaggccgccagc

SEQ ID NO: 1790896 - DNA, 15 bp, Homo sapiens
tggagcagccagagc

SEQ ID NO: 1790897 - DNA, 14 bp, Homo sapiens
tggagcagctgcag

SEQ ID NO: 1790898 - DNA, 23 bp, Homo sapiens
tggagcaggggttggtcaaggcc

SEQ ID NO: 1790899 - DNA, 22 bp, Homo sapiens
tggagcagtacatgggaaagga

SEQ ID NO: 1790900 - DNA, 17 bp, Homo sapiens
tggagcatgggcctggc

SEQ ID NO: 1790901 - DNA, 18 bp, Homo sapiens
tggagcatgggcctggcc

SEQ ID NO: 1790902 - DNA, 17 bp, Homo sapiens
tggagccaatggagact

SEQ ID NO: 1790903 - DNA, 14 bp, Homo sapiens
tggagccactcctg

SEQ ID NO: 1790904 - DNA, 16 bp, Homo sapiens
tggagccactcctgtc

SEQ ID NO: 1790905 - DNA, 13 bp, Homo sapiens
tggagccagcagg

SEQ ID NO: 1790906 - DNA, 13 bp, Homo sapiens
tggagccagctcc

SEQ ID NO: 1790907 - DNA, 14 bp, Homo sapiens
tggagccagggagc

SEQ ID NO: 1790908 - DNA, 19 bp, Homo sapiens
tggagccagggcagaggaa

SEQ ID NO: 1790909 - DNA, 13 bp, Homo sapiens
tggagccagggcc

SEQ ID NO: 1790910 - DNA, 14 bp, Homo sapiens
tggagccagggcct

SEQ ID NO: 1790911 - DNA, 15 bp, Homo sapiens
tggagcccagaggag

SEQ ID NO: 1790912 - DNA, 20 bp, Homo sapiens
tggagcccagaggagggcag

SEQ ID NO: 1790913 - DNA, 13 bp, Homo sapiens
tggagccccaggg

SEQ ID NO: 1790914 - DNA, 17 bp, Homo sapiens
tggagccccatcggcca

SEQ ID NO: 1790915 - DNA, 12 bp, Homo sapiens
tggagcccctgg

SEQ ID NO: 1790916 - DNA, 15 bp, Homo sapiens
tggagcccctgggtg

SEQ ID NO: 1790917 - DNA, 17 bp, Homo sapiens
tggagcccgaggcacca

SEQ ID NO: 1790918 - DNA, 19 bp, Homo sapiens
tggagcccgcactgtccca

SEQ ID NO: 1790919 - DNA, 15 bp, Homo sapiens
tggagcccgtgcagt

SEQ ID NO: 1790920 - DNA, 22 bp, Homo sapiens
tggagcccgtgcagtacaggca

SEQ ID NO: 1790921 - DNA, 15 bp, Homo sapiens
tggagcctgcagggt

SEQ ID NO: 1790922 - DNA, 14 bp, Homo sapiens
tggagcctgccgcc

SEQ ID NO: 1790923 - DNA, 21 bp, Homo sapiens
tggagcgcacctgccccctgg

SEQ ID NO: 1790924 - DNA, 16 bp, Homo sapiens
tggagctactgatgaa

SEQ ID NO: 1790925 - DNA, 21 bp, Homo sapiens
tggagctcttggaagagctct

SEQ ID NO: 1790926 - DNA, 16 bp, Homo sapiens
tggagctgtcctccag

SEQ ID NO: 1790927 - DNA, 15 bp, Homo sapiens
tggaggaagaacaac

SEQ ID NO: 1790928 - DNA, 22 bp, Homo sapiens
tggaggaagaacaacaaagaca

SEQ ID NO: 1790929 - DNA, 13 bp, Homo sapiens
tggaggaagagcc

SEQ ID NO: 1790930 - DNA, 14 bp, Homo sapiens
tggaggaagagcca

SEQ ID NO: 1790931 - DNA, 16 bp, Homo sapiens
tggaggaagagccacc

SEQ ID NO: 1790932 - DNA, 17 bp, Homo sapiens
tggaggaagagccacct

SEQ ID NO: 1790933 - DNA, 18 bp, Homo sapiens
tggaggaagagccacctg

SEQ ID NO: 1790934 - DNA, 19 bp, Homo sapiens
tggaggaagagccacctgc

SEQ ID NO: 1790935 - DNA, 22 bp, Homo sapiens
tggaggaagagccacctgcaag

SEQ ID NO: 1790936 - DNA, 21 bp, Homo sapiens
tggaggaaggggggttgcagt

SEQ ID NO: 1790937 - DNA, 18 bp, Homo sapiens
tggaggaaggtgctgagc

SEQ ID NO: 1790938 - DNA, 17 bp, Homo sapiens
tggaggactctcctctt

SEQ ID NO: 1790939 - DNA, 14 bp, Homo sapiens
tggaggagaagaat

SEQ ID NO: 1790940 - DNA, 14 bp, Homo sapiens
tggaggagagagac

SEQ ID NO: 1790941 - DNA, 16 bp, Homo sapiens
tggaggagagagaccc

SEQ ID NO: 1790942 - DNA, 22 bp, Homo sapiens
tggaggagcagcttccttctgg

SEQ ID NO: 1790943 - DNA, 18 bp, Homo sapiens
tggaggagctggcctgtg

SEQ ID NO: 1790944 - DNA, 13 bp, Homo sapiens
tggaggaggaagg

SEQ ID NO: 1790945 - DNA, 17 bp, Homo sapiens
tggaggaggaaggcaag

SEQ ID NO: 1790946 - DNA, 20 bp, Homo sapiens
tggaggaggaggaggagcct

SEQ ID NO: 1790947 - DNA, 23 bp, Homo sapiens
tggaggaggaggaggagccttgc

SEQ ID NO: 1790948 - DNA, 17 bp, Homo sapiens
tggaggatcagtttttt

SEQ ID NO: 1790949 - DNA, 16 bp, Homo sapiens
tggaggattctttccc

SEQ ID NO: 1790950 - DNA, 21 bp, Homo sapiens
tggaggattctttccccagag

SEQ ID NO: 1790951 - DNA, 22 bp, Homo sapiens
tggaggattctttccccagagg

SEQ ID NO: 1790952 - DNA, 15 bp, Homo sapiens
tggaggcacgcacca

SEQ ID NO: 1790953 - DNA, 22 bp, Homo sapiens
tggaggcacgcaccactgcttc

SEQ ID NO: 1790954 - DNA, 20 bp, Homo sapiens
tggaggcagatgtggggctg

SEQ ID NO: 1790955 - DNA, 21 bp, Homo sapiens
tggaggcagatgtggggctga

SEQ ID NO: 1790956 - DNA, 14 bp, Homo sapiens
tggaggcattgttt

SEQ ID NO: 1790957 - DNA, 12 bp, Homo sapiens
tggaggcccagg

SEQ ID NO: 1790958 - DNA, 14 bp, Homo sapiens
tggaggcccaggct

SEQ ID NO: 1790959 - DNA, 15 bp, Homo sapiens
tggaggcccagttca

SEQ ID NO: 1790960 - DNA, 13 bp, Homo sapiens
tggaggcccctgg

SEQ ID NO: 1790961 - DNA, 20 bp, Homo sapiens
tggaggcccctggagccaga

SEQ ID NO: 1790962 - DNA, 15 bp, Homo sapiens
tggaggcccctgggc

SEQ ID NO: 1790963 - DNA, 17 bp, Homo sapiens
tggaggcctcaggtgct

SEQ ID NO: 1790964 - DNA, 20 bp, Homo sapiens
tggaggcctcaggtgctgtc

SEQ ID NO: 1790965 - DNA, 14 bp, Homo sapiens
tggaggcctgatgc

SEQ ID NO: 1790966 - DNA, 18 bp, Homo sapiens
tggaggccttccagctgc

SEQ ID NO: 1790967 - DNA, 14 bp, Homo sapiens
tggaggccttccct

SEQ ID NO: 1790968 - DNA, 22 bp, Homo sapiens
tggaggctacctcacctgggca

SEQ ID NO: 1790969 - DNA, 19 bp, Homo sapiens
tggaggctgacgtgtgagg

SEQ ID NO: 1790970 - DNA, 13 bp, Homo sapiens
tggaggctgagtt

SEQ ID NO: 1790971 - DNA, 16 bp, Homo sapiens
tggaggctgcagcgcc

SEQ ID NO: 1790972 - DNA, 15 bp, Homo sapiens
tggaggctgctgtga

SEQ ID NO: 1790973 - DNA, 16 bp, Homo sapiens
tggaggctgctgtgaa

SEQ ID NO: 1790974 - DNA, 13 bp, Homo sapiens
tggaggcttcctg

SEQ ID NO: 1790975 - DNA, 15 bp, Homo sapiens
tggaggcttcctgcg

SEQ ID NO: 1790976 - DNA, 16 bp, Homo sapiens
tggaggcttcctgcgt

SEQ ID NO: 1790977 - DNA, 17 bp, Homo sapiens
tggaggcttcctgcgtc

SEQ ID NO: 1790978 - DNA, 24 bp, Homo sapiens
tggagggacttttaatcagtgaag

SEQ ID NO: 1790979 - DNA, 12 bp, Homo sapiens
tggagggcacag

SEQ ID NO: 1790980 - DNA, 13 bp, Homo sapiens
tggagggcacagc

SEQ ID NO: 1790981 - DNA, 16 bp, Homo sapiens
tggagggcacagccct

SEQ ID NO: 1790982 - DNA, 17 bp, Homo sapiens
tggaggggcagcctgtg

SEQ ID NO: 1790983 - DNA, 20 bp, Homo sapiens
tggaggggcagcctgtgcct

SEQ ID NO: 1790984 - DNA, 14 bp, Homo sapiens
tggaggggcccacc

SEQ ID NO: 1790985 - DNA, 11 bp, Homo sapiens
tggaggggtgt

SEQ ID NO: 1790986 - DNA, 23 bp, Homo sapiens
tggaggggtgtggctccttccca

SEQ ID NO: 1790987 - DNA, 20 bp, Homo sapiens
tggagggtgggagagcccag

SEQ ID NO: 1790988 - DNA, 15 bp, Homo sapiens
tggaggtatttgaaa

SEQ ID NO: 1790989 - DNA, 18 bp, Homo sapiens
tggaggtcatctggcgga

SEQ ID NO: 1790990 - DNA, 18 bp, Homo sapiens
tggaggtctggctgagcc

SEQ ID NO: 1790991 - DNA, 15 bp, Homo sapiens
tggaggttctaaggc

SEQ ID NO: 1790992 - DNA, 16 bp, Homo sapiens
tggaggttctaaggcc

SEQ ID NO: 1790993 - DNA, 15 bp, Homo sapiens
tggaggttgaagcca

SEQ ID NO: 1790994 - DNA, 22 bp, Homo sapiens
tggaggttgaagccaagtgggg

SEQ ID NO: 1790995 - DNA, 14 bp, Homo sapiens
tggaggttgcagtg

SEQ ID NO: 1790996 - DNA, 20 bp, Homo sapiens
tggaggttgcagtgagctga

SEQ ID NO: 1790997 - DNA, 15 bp, Homo sapiens
tggagtactatattt

SEQ ID NO: 1790998 - DNA, 14 bp, Homo sapiens
tggagtatgattta

SEQ ID NO: 1790999 - DNA, 20 bp, Homo sapiens
tggagtcacatcagtgagga

SEQ ID NO: 1791000 - DNA, 23 bp, Homo sapiens
tggagtcaggtgtcgaggccaca

SEQ ID NO: 1791001 - DNA, 13 bp, Homo sapiens
tggagtccagctc

SEQ ID NO: 1791002 - DNA, 14 bp, Homo sapiens
tggagtccagctct

SEQ ID NO: 1791003 - DNA, 14 bp, Homo sapiens
tggagtccagtctc

SEQ ID NO: 1791004 - DNA, 15 bp, Homo sapiens
tggagtccagtctct

SEQ ID NO: 1791005 - DNA, 21 bp, Homo sapiens
tggagtcccctcacctcctct

SEQ ID NO: 1791006 - DNA, 15 bp, Homo sapiens
tggagtctcagagca

SEQ ID NO: 1791007 - DNA, 15 bp, Homo sapiens
tggatgatttcatct

SEQ ID NO: 1791008 - DNA, 21 bp, Homo sapiens
tggatgattttttaagcagac

SEQ ID NO: 1791009 - DNA, 18 bp, Homo sapiens
tggatgccaaggagcccc

SEQ ID NO: 1791010 - DNA, 18 bp, Homo sapiens
tggatgctccagggcagc

SEQ ID NO: 1791011 - DNA, 19 bp, Homo sapiens
tggatgctccagggcagcc

SEQ ID NO: 1791012 - DNA, 15 bp, Homo sapiens
tggatggaaggagac

SEQ ID NO: 1791013 - DNA, 13 bp, Homo sapiens
tggatggcaccct

SEQ ID NO: 1791014 - DNA, 21 bp, Homo sapiens
tggatggcacctcaggctgag

SEQ ID NO: 1791015 - DNA, 14 bp, Homo sapiens
tggatggccccagc

SEQ ID NO: 1791016 - DNA, 15 bp, Homo sapiens
tggatggccccagca

SEQ ID NO: 1791017 - DNA, 15 bp, Homo sapiens
tggatgggaatttgt

SEQ ID NO: 1791018 - DNA, 22 bp, Homo sapiens
tggatgggcattgggctgacac

SEQ ID NO: 1791019 - DNA, 18 bp, Homo sapiens
tggatgtagtctgaggcc

SEQ ID NO: 1791020 - DNA, 18 bp, Homo sapiens
tggatgtcccctgtccca

SEQ ID NO: 1791021 - DNA, 16 bp, Homo sapiens
tggatgttatgaacag

SEQ ID NO: 1791022 - DNA, 18 bp, Homo sapiens
tggattactattgcaaaa

SEQ ID NO: 1791023 - DNA, 20 bp, Homo sapiens
tggattactgccattcactt

SEQ ID NO: 1791024 - DNA, 19 bp, Homo sapiens
tggattataaaaaatgtaa

SEQ ID NO: 1791025 - DNA, 19 bp, Homo sapiens
tggattattcatttaaaat

SEQ ID NO: 1791026 - DNA, 20 bp, Homo sapiens
tggattattcatttaaaatg

SEQ ID NO: 1791027 - DNA, 13 bp, Homo sapiens
tggattatttcat

SEQ ID NO: 1791028 - DNA, 18 bp, Homo sapiens
tggattcacccccctctg

SEQ ID NO: 1791029 - DNA, 22 bp, Homo sapiens
tggattcacccccctctgctgc

SEQ ID NO: 1791030 - DNA, 12 bp, Homo sapiens
tggattccaaac

SEQ ID NO: 1791031 - DNA, 22 bp, Homo sapiens
tggattctacaaaaaaccagga

SEQ ID NO: 1791032 - DNA, 15 bp, Homo sapiens
tggattctatatttc

SEQ ID NO: 1791033 - DNA, 19 bp, Homo sapiens
tggattctccctgggcctc

SEQ ID NO: 1791034 - DNA, 20 bp, Homo sapiens
tggattctgaggccctgccc

SEQ ID NO: 1791035 - DNA, 18 bp, Homo sapiens
tggattcttttcatcaaa

SEQ ID NO: 1791036 - DNA, 16 bp, Homo sapiens
tggattgattcagtct

SEQ ID NO: 1791037 - DNA, 17 bp, Homo sapiens
tggattgcagactgttc

SEQ ID NO: 1791038 - DNA, 15 bp, Homo sapiens
tggattggccaaaca

SEQ ID NO: 1791039 - DNA, 14 bp, Homo sapiens
tggattgggctgca

SEQ ID NO: 1791040 - DNA, 14 bp, Homo sapiens
tggattgtggttcc

SEQ ID NO: 1791041 - DNA, 21 bp, Homo sapiens
tggattgtggttccatgcagc

SEQ ID NO: 1791042 - DNA, 18 bp, Homo sapiens
tggatttaaaagcctgct

SEQ ID NO: 1791043 - DNA, 14 bp, Homo sapiens
tggatttcagaaag

SEQ ID NO: 1791044 - DNA, 16 bp, Homo sapiens
tggatttcatttgtaa

SEQ ID NO: 1791045 - DNA, 21 bp, Homo sapiens
tggatttgatgagttaactgt

SEQ ID NO: 1791046 - DNA, 23 bp, Homo sapiens
tggatttgattcattttcctgtt

SEQ ID NO: 1791047 - DNA, 17 bp, Homo sapiens
tggatttgcctgtgcca

SEQ ID NO: 1791048 - DNA, 16 bp, Homo sapiens
tggatttggagagaaa

SEQ ID NO: 1791049 - DNA, 19 bp, Homo sapiens
tggatttggagagaaatat

SEQ ID NO: 1791050 - DNA, 14 bp, Homo sapiens
tggattttctttct

SEQ ID NO: 1791051 - DNA, 22 bp, Homo sapiens
tggattttggttttgttcccct

SEQ ID NO: 1791052 - DNA, 17 bp, Homo sapiens
tggcaaacgctaaagag

SEQ ID NO: 1791053 - DNA, 19 bp, Homo sapiens
tggcaaacgtttctcaaat

SEQ ID NO: 1791054 - DNA, 22 bp, Homo sapiens
tggcaaaggacccttgagtaag

SEQ ID NO: 1791055 - DNA, 21 bp, Homo sapiens
tggcaaatggaggcttttcac

SEQ ID NO: 1791056 - DNA, 14 bp, Homo sapiens
tggcaacagagcga

SEQ ID NO: 1791057 - DNA, 13 bp, Homo sapiens
tggcaacagatct

SEQ ID NO: 1791058 - DNA, 14 bp, Homo sapiens
tggcaaccagccag

SEQ ID NO: 1791059 - DNA, 18 bp, Homo sapiens
tggcaagagggtgacagc

SEQ ID NO: 1791060 - DNA, 15 bp, Homo sapiens
tggcaagcagggaaa

SEQ ID NO: 1791061 - DNA, 20 bp, Homo sapiens
tggcaaggactttgtacatt

SEQ ID NO: 1791062 - DNA, 20 bp, Homo sapiens
tggcaaggcagccctgtctg

SEQ ID NO: 1791063 - DNA, 20 bp, Homo sapiens
tggcaataagatacacagct

SEQ ID NO: 1791064 - DNA, 19 bp, Homo sapiens
tggcaatagggtagaatga

SEQ ID NO: 1791065 - DNA, 16 bp, Homo sapiens
tggcaatagtcaggag

SEQ ID NO: 1791066 - DNA, 20 bp, Homo sapiens
tggcaatcaaacattttctg

SEQ ID NO: 1791067 - DNA, 16 bp, Homo sapiens
tggcaatgctaattca

SEQ ID NO: 1791068 - DNA, 18 bp, Homo sapiens
tggcaattgtctatttat

SEQ ID NO: 1791069 - DNA, 18 bp, Homo sapiens
tggcaatttcctggccct

SEQ ID NO: 1791070 - DNA, 19 bp, Homo sapiens
tggcaatttcctggccctc

SEQ ID NO: 1791071 - DNA, 21 bp, Homo sapiens
tggcaatttcctggccctcca

SEQ ID NO: 1791072 - DNA, 22 bp, Homo sapiens
tggttattttaaatataaatag

SEQ ID NO: 1791073 - DNA, 23 bp, Homo sapiens
tggttatttttctcttgtaccat

SEQ ID NO: 1791074 - DNA, 15 bp, Homo sapiens
tggttcacctgtgac

SEQ ID NO: 1791075 - DNA, 23 bp, Homo sapiens
tggttcatcagtgttaaaaaatt

SEQ ID NO: 1791076 - DNA, 12 bp, Homo sapiens
tggttccagggt

SEQ ID NO: 1791077 - DNA, 21 bp, Homo sapiens
tggttccagggtccctctgtg

SEQ ID NO: 1791078 - DNA, 15 bp, Homo sapiens
tggttccatgcctga

SEQ ID NO: 1791079 - DNA, 17 bp, Homo sapiens
tggttccatgcctgagg

SEQ ID NO: 1791080 - DNA, 19 bp, Homo sapiens
tggttcccaataaaagtga

SEQ ID NO: 1791081 - DNA, 15 bp, Homo sapiens
tggttcctgctgtcc

SEQ ID NO: 1791082 - DNA, 16 bp, Homo sapiens
tggttcctgctgtcct

SEQ ID NO: 1791083 - DNA, 14 bp, Homo sapiens
tggttccttccctg

SEQ ID NO: 1791084 - DNA, 13 bp, Homo sapiens
tggttccttctct

SEQ ID NO: 1791085 - DNA, 16 bp, Homo sapiens
tggttcctttcatctc

SEQ ID NO: 1791086 - DNA, 22 bp, Homo sapiens
tgtaaatcacttgttttattga

SEQ ID NO: 1791087 - DNA, 21 bp, Homo sapiens
tgtaaatcatgttgatcatgt

SEQ ID NO: 1791088 - DNA, 13 bp, Homo sapiens
tgtaaatccttgt

SEQ ID NO: 1791089 - DNA, 20 bp, Homo sapiens
tgtaaatcctttttctttat

SEQ ID NO: 1791090 - DNA, 22 bp, Homo sapiens
tgtaaatctttttgcttctact

SEQ ID NO: 1791091 - DNA, 11 bp, Homo sapiens
tgtaaatgcct

SEQ ID NO: 1791092 - DNA, 22 bp, Homo sapiens
tgtaaatgccttgcttgtatga

SEQ ID NO: 1791093 - DNA, 13 bp, Homo sapiens
tgtaaatgctcgt

SEQ ID NO: 1791094 - DNA, 16 bp, Homo sapiens
tgtaaatggtgtacat

SEQ ID NO: 1791095 - DNA, 17 bp, Homo sapiens
tgtaaatggtgtacata

SEQ ID NO: 1791096 - DNA, 18 bp, Homo sapiens
tgtaaatggtgtacataa

SEQ ID NO: 1791097 - DNA, 19 bp, Homo sapiens
tgtaaatgtactggtaatt

SEQ ID NO: 1791098 - DNA, 21 bp, Homo sapiens
tgtaaatgtttcttttccctt

SEQ ID NO: 1791099 - DNA, 20 bp, Homo sapiens
tgtaaattatgtaatgcaaa

SEQ ID NO: 1791100 - DNA, 19 bp, Homo sapiens
tgtaaattgcagaattcaa

SEQ ID NO: 1791101 - DNA, 20 bp, Homo sapiens
tgtaaattgcagaattcaaa

SEQ ID NO: 1791102 - DNA, 21 bp, Homo sapiens
tgtaaattgcagaattcaaaa

SEQ ID NO: 1791103 - DNA, 16 bp, Homo sapiens
tgtaattaaaagcaaa

SEQ ID NO: 1791104 - DNA, 20 bp, Homo sapiens
tgtaattaaaagcaaatcat

SEQ ID NO: 1791105 - DNA, 18 bp, Homo sapiens
tgtaattaagtactatgt

SEQ ID NO: 1791106 - DNA, 19 bp, Homo sapiens
tgtaattaagtactatgta

SEQ ID NO: 1791107 - DNA, 17 bp, Homo sapiens
tgtaattacttattgta

SEQ ID NO: 1791108 - DNA, 21 bp, Homo sapiens
tgtaattagtgccacttaatg

SEQ ID NO: 1791109 - DNA, 15 bp, Homo sapiens
tgtaattatgtaaat

SEQ ID NO: 1791110 - DNA, 16 bp, Homo sapiens
tgtaattatgtaaata

SEQ ID NO: 1791111 - DNA, 20 bp, Homo sapiens
tgtaattatgtaaatacaat

SEQ ID NO: 1791112 - DNA, 13 bp, Homo sapiens
tgtaattatttga

SEQ ID NO: 1791113 - DNA, 21 bp, Homo sapiens
tgtaattcctacctccctgca

SEQ ID NO: 1791114 - DNA, 15 bp, Homo sapiens
tgtaattctaaatga

SEQ ID NO: 1791115 - DNA, 15 bp, Homo sapiens
tgtaattgaataaag

SEQ ID NO: 1791116 - DNA, 22 bp, Homo sapiens
tgtaattgacagagtaaaagta

SEQ ID NO: 1791117 - DNA, 23 bp, Homo sapiens
tgtaattgcactttttaagtttg

SEQ ID NO: 1791118 - DNA, 16 bp, Homo sapiens
tgtaattgcttacatt

SEQ ID NO: 1791119 - DNA, 23 bp, Homo sapiens
tgtaattgcttacatttttacaa

SEQ ID NO: 1791120 - DNA, 23 bp, Homo sapiens
tgtaattggaatcttcacctcag

SEQ ID NO: 1791121 - DNA, 20 bp, Homo sapiens
tgtaattgttttggaataaa

SEQ ID NO: 1791122 - DNA, 20 bp, Homo sapiens
tgtaatttaaaattgtgatg

SEQ ID NO: 1791123 - DNA, 21 bp, Homo sapiens
tgtaatttaaaattgtgatgt

SEQ ID NO: 1791124 - DNA, 22 bp, Homo sapiens
tgtaatttaaaattgtgatgtg

SEQ ID NO: 1791125 - DNA, 19 bp, Homo sapiens
tgtaatttaaacaggccca

SEQ ID NO: 1791126 - DNA, 20 bp, Homo sapiens
tgtaatttaaacaggcccag

SEQ ID NO: 1791127 - DNA, 18 bp, Homo sapiens
tgtacttctgtgttcatt

SEQ ID NO: 1791128 - DNA, 13 bp, Homo sapiens
tgtacttgaaaaa

SEQ ID NO: 1791129 - DNA, 21 bp, Homo sapiens
tgtacttgaaaaatgttttta

SEQ ID NO: 1791130 - DNA, 23 bp, Homo sapiens
tgtacttgaagtctaaaagcaga

SEQ ID NO: 1791131 - DNA, 15 bp, Homo sapiens
tgtacttgctccttt

SEQ ID NO: 1791132 - DNA, 15 bp, Homo sapiens
tgtacttgtttgcta

SEQ ID NO: 1791133 - DNA, 21 bp, Homo sapiens
tgtactttatcatgaatgctt

SEQ ID NO: 1791134 - DNA, 13 bp, Homo sapiens
tgtactttgccat

SEQ ID NO: 1791135 - DNA, 15 bp, Homo sapiens
tgtactttgccattt

SEQ ID NO: 1791136 - DNA, 21 bp, Homo sapiens
tgtactttgccatttttctat

SEQ ID NO: 1791137 - DNA, 23 bp, Homo sapiens
tgtactttgccatttttctataa

SEQ ID NO: 1791138 - DNA, 18 bp, Homo sapiens
tgtactttgcttgctcat

SEQ ID NO: 1791139 - DNA, 23 bp, Homo sapiens
tgtacttttattttacacagaaa

SEQ ID NO: 1791140 - DNA, 14 bp, Homo sapiens
tgtagaacactaat

SEQ ID NO: 1791141 - DNA, 15 bp, Homo sapiens
tgtagaacactaatt

SEQ ID NO: 1791142 - DNA, 20 bp, Homo sapiens
tgtagaacactaattcataa

SEQ ID NO: 1791143 - DNA, 20 bp, Homo sapiens
tgtagaactcactctgggct

SEQ ID NO: 1791144 - DNA, 17 bp, Homo sapiens
tgtagaactcagcagtt

SEQ ID NO: 1791145 - DNA, 21 bp, Homo sapiens
tgtagaactgttcatttccac

SEQ ID NO: 1791146 - DNA, 20 bp, Homo sapiens
tgtagaagtgagtttgtaaa

SEQ ID NO: 1791147 - DNA, 16 bp, Homo sapiens
tgtagaataggcaggg

SEQ ID NO: 1791148 - DNA, 21 bp, Homo sapiens
tgtagaatctcttcatgcttg

SEQ ID NO: 1791149 - DNA, 18 bp, Homo sapiens
tgtagaatgatttcatgc

SEQ ID NO: 1791150 - DNA, 21 bp, Homo sapiens
tgtagaatgccgcgaactggg

SEQ ID NO: 1791151 - DNA, 15 bp, Homo sapiens
tgtagagagaacagg

SEQ ID NO: 1791152 - DNA, 14 bp, Homo sapiens
tgtagagcaagcca

SEQ ID NO: 1791153 - DNA, 16 bp, Homo sapiens
tgtagagtttttggaa

SEQ ID NO: 1791154 - DNA, 18 bp, Homo sapiens
tgtagatatgtattcttt

SEQ ID NO: 1791155 - DNA, 21 bp, Homo sapiens
tgtagatattgtgaagtacat

SEQ ID NO: 1791156 - DNA, 22 bp, Homo sapiens
tgtagatattgtgaagtacata

SEQ ID NO: 1791157 - DNA, 13 bp, Homo sapiens
tgtagatcaggtt

SEQ ID NO: 1791158 - DNA, 14 bp, Homo sapiens
tgtagatgggcatt

SEQ ID NO: 1791159 - DNA, 21 bp, Homo sapiens
tgtagatgggggaactgtgaa

SEQ ID NO: 1791160 - DNA, 14 bp, Homo sapiens
tgtagattgattgt

SEQ ID NO: 1791161 - DNA, 18 bp, Homo sapiens
tgtagattgattgtattg

SEQ ID NO: 1791162 - DNA, 19 bp, Homo sapiens
tgtagcactactacagaaa

SEQ ID NO: 1791163 - DNA, 16 bp, Homo sapiens
tgtagcactgacagat

SEQ ID NO: 1791164 - DNA, 17 bp, Homo sapiens
tgtagcactgacagatt

SEQ ID NO: 1791165 - DNA, 17 bp, Homo sapiens
tgtagcaggtgtaaccg

SEQ ID NO: 1791166 - DNA, 15 bp, Homo sapiens
tgtagcatctaatga

SEQ ID NO: 1791167 - DNA, 17 bp, Homo sapiens
tgtagcatttcttgatg

SEQ ID NO: 1791168 - DNA, 20 bp, Homo sapiens
tgtagccaggtactgcattc

SEQ ID NO: 1791169 - DNA, 17 bp, Homo sapiens
tgtagccatggctcagg

SEQ ID NO: 1791170 - DNA, 16 bp, Homo sapiens
tgtagccatggctggg

SEQ ID NO: 1791171 - DNA, 16 bp, Homo sapiens
tgtagccccctggcct

SEQ ID NO: 1791172 - DNA, 14 bp, Homo sapiens
tgtagccgccctga

SEQ ID NO: 1791173 - DNA, 15 bp, Homo sapiens
tgtagccgccctgag

SEQ ID NO: 1791174 - DNA, 16 bp, Homo sapiens
tgtagcctaaagggca

SEQ ID NO: 1791175 - DNA, 18 bp, Homo sapiens
tgtagcctaaagggcagg

SEQ ID NO: 1791176 - DNA, 23 bp, Homo sapiens
tgtagcctggatattattcttgt

SEQ ID NO: 1791177 - DNA, 15 bp, Homo sapiens
tgtagccttcctcca

SEQ ID NO: 1791178 - DNA, 16 bp, Homo sapiens
tgtagccttgcccgga

SEQ ID NO: 1791179 - DNA, 16 bp, Homo sapiens
tgtagcgacagcattt

SEQ ID NO: 1791180 - DNA, 15 bp, Homo sapiens
tgtagctagaatatc

SEQ ID NO: 1791181 - DNA, 18 bp, Homo sapiens
tgtagctatagaatgagt

SEQ ID NO: 1791182 - DNA, 13 bp, Homo sapiens
tgtagctcagtca

SEQ ID NO: 1791183 - DNA, 22 bp, Homo sapiens
tgtagctcccctgctgaggcag

SEQ ID NO: 1791184 - DNA, 23 bp, Homo sapiens
tgtagctcccctgctgaggcagt

SEQ ID NO: 1791185 - DNA, 19 bp, Homo sapiens
tgtagctccctcctcccat

SEQ ID NO: 1791186 - DNA, 14 bp, Homo sapiens
tgtagctctgcctc

SEQ ID NO: 1791187 - DNA, 15 bp, Homo sapiens
tgtagctgaggaggc

SEQ ID NO: 1791188 - DNA, 17 bp, Homo sapiens
tgtagctgtaagggcag

SEQ ID NO: 1791189 - DNA, 12 bp, Homo sapiens
tgtagctgtgaa

SEQ ID NO: 1791190 - DNA, 16 bp, Homo sapiens
tgtagctttaaaacca

SEQ ID NO: 1791191 - DNA, 20 bp, Homo sapiens
tgtagctttaaaaccacagc

SEQ ID NO: 1791192 - DNA, 15 bp, Homo sapiens
tgtagctttatcaaa

SEQ ID NO: 1791193 - DNA, 15 bp, Homo sapiens
tgtagctttcctggt

SEQ ID NO: 1791194 - DNA, 13 bp, Homo sapiens
tgtagctttgctc

SEQ ID NO: 1791195 - DNA, 15 bp, Homo sapiens
tgtagctttgctctt

SEQ ID NO: 1791196 - DNA, 18 bp, Homo sapiens
tgtaggaaggttaatgtt

SEQ ID NO: 1791197 - DNA, 13 bp, Homo sapiens
tgtaggagacttg

SEQ ID NO: 1791198 - DNA, 23 bp, Homo sapiens
tgtaggccaccattataatttat

SEQ ID NO: 1791199 - DNA, 19 bp, Homo sapiens
tgtagggaaaccttggaga

SEQ ID NO: 1791200 - DNA, 15 bp, Homo sapiens
tgtagggaactttct

SEQ ID NO: 1791201 - DNA, 22 bp, Homo sapiens
tgtagggagggcggcaggggcc

SEQ ID NO: 1791202 - DNA, 19 bp, Homo sapiens
tgtagggcctgcatggaga

SEQ ID NO: 1791203 - DNA, 16 bp, Homo sapiens
tgtagggctggaccta

SEQ ID NO: 1791204 - DNA, 16 bp, Homo sapiens
tgtaggggccacctcc

SEQ ID NO: 1791205 - DNA, 17 bp, Homo sapiens
tgtaggggccacctcct

SEQ ID NO: 1791206 - DNA, 20 bp, Homo sapiens
tgtagggtccaaccagacct

SEQ ID NO: 1791207 - DNA, 16 bp, Homo sapiens
tgtaggtgatgtttcc

SEQ ID NO: 1791208 - DNA, 16 bp, Homo sapiens
tgtaggtgtctgcctt

SEQ ID NO: 1791209 - DNA, 17 bp, Homo sapiens
tgtagtaaaagtggtct

SEQ ID NO: 1791210 - DNA, 22 bp, Homo sapiens
tgtagtaaagccgttgtttact

SEQ ID NO: 1791211 - DNA, 19 bp, Homo sapiens
tgtagtataatttcaagga

SEQ ID NO: 1791212 - DNA, 19 bp, Homo sapiens
tgtagtattttttgtataa

SEQ ID NO: 1791213 - DNA, 15 bp, Homo sapiens
tgtagtcaataaaac

SEQ ID NO: 1791214 - DNA, 17 bp, Homo sapiens
tgtagtcccagctactc

SEQ ID NO: 1791215 - DNA, 17 bp, Homo sapiens
tgtagtgagaaactgat

SEQ ID NO: 1791216 - DNA, 13 bp, Homo sapiens
tgtagtgagccaa

SEQ ID NO: 1791217 - DNA, 14 bp, Homo sapiens
tgtagtgagccaag

SEQ ID NO: 1791218 - DNA, 19 bp, Homo sapiens
tgtagtgcatttttaaact

SEQ ID NO: 1791219 - DNA, 13 bp, Homo sapiens
tgtagtggaagag

SEQ ID NO: 1791220 - DNA, 19 bp, Homo sapiens
tgtagtgtctttatttgct

SEQ ID NO: 1791221 - DNA, 13 bp, Homo sapiens
tgtagttctaaga

SEQ ID NO: 1791222 - DNA, 15 bp, Homo sapiens
tgtagttctaagact

SEQ ID NO: 1791223 - DNA, 15 bp, Homo sapiens
tgtagttgcgtggac

SEQ ID NO: 1791224 - DNA, 21 bp, Homo sapiens
tgtagttgcgtggactctgca

SEQ ID NO: 1791225 - DNA, 21 bp, Homo sapiens
tgtagttgttcgttggttata

SEQ ID NO: 1791226 - DNA, 15 bp, Homo sapiens
tgtagtttagttctg

SEQ ID NO: 1791227 - DNA, 22 bp, Homo sapiens
tgtagtttgaggaaatttgcag

SEQ ID NO: 1791228 - DNA, 20 bp, Homo sapiens
tgtagtttttatatgttgta

SEQ ID NO: 1791229 - DNA, 16 bp, Homo sapiens
tgtagtttttgaaaat

SEQ ID NO: 1791230 - DNA, 17 bp, Homo sapiens
tgtagtttttgaaaatt

SEQ ID NO: 1791231 - DNA, 20 bp, Homo sapiens
tgtataaaaattatcaaaaa

SEQ ID NO: 1791232 - DNA, 13 bp, Homo sapiens
tgtataaaagtgt

SEQ ID NO: 1791233 - DNA, 18 bp, Homo sapiens
tgtataaaagtgtgaaat

SEQ ID NO: 1791234 - DNA, 13 bp, Homo sapiens
tgtataaaataca

SEQ ID NO: 1791235 - DNA, 16 bp, Homo sapiens
tgtataaaatacatag

SEQ ID NO: 1791236 - DNA, 19 bp, Homo sapiens
tgtataaaatacatagtga

SEQ ID NO: 1791237 - DNA, 22 bp, Homo sapiens
tgtataaaatacatagtgaaaa

SEQ ID NO: 1791238 - DNA, 20 bp, Homo sapiens
tgtataaaatccaaaatgaa

SEQ ID NO: 1791239 - DNA, 14 bp, Homo sapiens
tgtataaaatctga

SEQ ID NO: 1791240 - DNA, 17 bp, Homo sapiens
tgtataaaatctgaatt

SEQ ID NO: 1791241 - DNA, 18 bp, Homo sapiens
tgtataaaatctgaattt

SEQ ID NO: 1791242 - DNA, 16 bp, Homo sapiens
tgtataaagattgtac

SEQ ID NO: 1791243 - DNA, 18 bp, Homo sapiens
tgtataaagattgtactt

SEQ ID NO: 1791244 - DNA, 19 bp, Homo sapiens
tgtactacagctatatttg

SEQ ID NO: 1791245 - DNA, 20 bp, Homo sapiens
tgtactacagctatatttga

SEQ ID NO: 1791246 - DNA, 21 bp, Homo sapiens
tgtactacagctatatttgat

SEQ ID NO: 1791247 - DNA, 22 bp, Homo sapiens
tgtactacagctatatttgatt

SEQ ID NO: 1791248 - DNA, 21 bp, Homo sapiens
tgtactacgtgccagctctag

SEQ ID NO: 1791249 - DNA, 23 bp, Homo sapiens
tgtactactcctaattattgtaa

SEQ ID NO: 1791250 - DNA, 13 bp, Homo sapiens
tgtactagtttta

SEQ ID NO: 1791251 - DNA, 18 bp, Homo sapiens
tgtactatcctgtaaata

SEQ ID NO: 1791252 - DNA, 18 bp, Homo sapiens
tgtactatttaactgact

SEQ ID NO: 1791253 - DNA, 17 bp, Homo sapiens
tgtactcacatataaca

SEQ ID NO: 1791254 - DNA, 19 bp, Homo sapiens
tgtactcacatataacatg

SEQ ID NO: 1791255 - DNA, 12 bp, Homo sapiens
tgtactcctccc

SEQ ID NO: 1791256 - DNA, 13 bp, Homo sapiens
tgtactcctccca

SEQ ID NO: 1791257 - DNA, 15 bp, Homo sapiens
tgtactctgctttat

SEQ ID NO: 1791258 - DNA, 13 bp, Homo sapiens
tgtactcttgctg

SEQ ID NO: 1791259 - DNA, 16 bp, Homo sapiens
tgtactcttgctgatg

SEQ ID NO: 1791260 - DNA, 17 bp, Homo sapiens
tgtactgagccttgtaa

SEQ ID NO: 1791261 - DNA, 20 bp, Homo sapiens
tgtactgagccttgtaattc

SEQ ID NO: 1791262 - DNA, 22 bp, Homo sapiens
tgtactgagccttgtaattcta

SEQ ID NO: 1791263 - DNA, 19 bp, Homo sapiens
tgtactgcatatgaaagga

SEQ ID NO: 1791264 - DNA, 19 bp, Homo sapiens
tgtactggtaattgtacaa

SEQ ID NO: 1791265 - DNA, 21 bp, Homo sapiens
tgtacttaataaattcagata

SEQ ID NO: 1791266 - DNA, 14 bp, Homo sapiens
tgtacttcaagtta

SEQ ID NO: 1791267 - DNA, 14 bp, Homo sapiens
tgtacttcactgtc

SEQ ID NO: 1791268 - DNA, 18 bp, Homo sapiens
tgtacttcccgggccagg

SEQ ID NO: 1791269 - DNA, 15 bp, Homo sapiens
tgtacttcctgtgta

SEQ ID NO: 1791270 - DNA, 16 bp, Homo sapiens
tgtacttcctgtgtac

SEQ ID NO: 1791271 - DNA, 18 bp, Homo sapiens
tgtacttctctgtgtgca

SEQ ID NO: 1791272 - DNA, 17 bp, Homo sapiens
tgtacttctgtgttcat

SEQ ID NO: 1791273 - DNA, 14 bp, Homo sapiens
tgtataaatataca

SEQ ID NO: 1791274 - DNA, 23 bp, Homo sapiens
tgtataacaagccaaacattctt

SEQ ID NO: 1791275 - DNA, 17 bp, Homo sapiens
tgtataagatcctagat

SEQ ID NO: 1791276 - DNA, 17 bp, Homo sapiens
tgtataagtcaagcaca

SEQ ID NO: 1791277 - DNA, 13 bp, Homo sapiens
tgtataatataaa

SEQ ID NO: 1791278 - DNA, 14 bp, Homo sapiens
tgtataatatatat

SEQ ID NO: 1791279 - DNA, 13 bp, Homo sapiens
tgtataatcccac

SEQ ID NO: 1791280 - DNA, 22 bp, Homo sapiens
tgtataatgtgcagaaaatatt

SEQ ID NO: 1791281 - DNA, 18 bp, Homo sapiens
tgtataattggatttcct

SEQ ID NO: 1791282 - DNA, 16 bp, Homo sapiens
tgtatacaaccctggc

SEQ ID NO: 1791283 - DNA, 23 bp, Homo sapiens
tgtatacagtgcagagccttctc

SEQ ID NO: 1791284 - DNA, 15 bp, Homo sapiens
tgtatactcctgtca

SEQ ID NO: 1791285 - DNA, 17 bp, Homo sapiens
tgtatactcctgtcacc

SEQ ID NO: 1791286 - DNA, 12 bp, Homo sapiens
tgtatagaccaa

SEQ ID NO: 1791287 - DNA, 20 bp, Homo sapiens
tgtatagaccaaagcaaaga

SEQ ID NO: 1791288 - DNA, 18 bp, Homo sapiens
tgtatagatgcaagatat

SEQ ID NO: 1791289 - DNA, 19 bp, Homo sapiens
tgtatagatgcaagatatt

SEQ ID NO: 1791290 - DNA, 20 bp, Homo sapiens
tgtatagatgcaagatattt

SEQ ID NO: 1791291 - DNA, 14 bp, Homo sapiens
tgtatagtatctgt

SEQ ID NO: 1791292 - DNA, 17 bp, Homo sapiens
tgtatagtatctgtata

SEQ ID NO: 1791293 - DNA, 21 bp, Homo sapiens
tgtatagtgtctattatcaca

SEQ ID NO: 1791294 - DNA, 20 bp, Homo sapiens
tgtatagtgttcacaaactg

SEQ ID NO: 1791295 - DNA, 23 bp, Homo sapiens
tgtatagtgttcacaaactgtga

SEQ ID NO: 1791296 - DNA, 14 bp, Homo sapiens
tgtatagttgcttg

SEQ ID NO: 1791297 - DNA, 21 bp, Homo sapiens
tgtatagttttataaaactca

SEQ ID NO: 1791298 - DNA, 23 bp, Homo sapiens
tgtatagttttataaaactcagt

SEQ ID NO: 1791299 - DNA, 19 bp, Homo sapiens
tgtatataaaatattttca

SEQ ID NO: 1791300 - DNA, 17 bp, Homo sapiens
tgtatataagttgctgt

SEQ ID NO: 1791301 - DNA, 16 bp, Homo sapiens
tgtatatacaataaca

SEQ ID NO: 1791302 - DNA, 15 bp, Homo sapiens
tgtatatacatatat

SEQ ID NO: 1791303 - DNA, 21 bp, Homo sapiens
tgtatatacgcatctataaat

SEQ ID NO: 1791304 - DNA, 21 bp, Homo sapiens
tgtatataggacaaaatgtta

SEQ ID NO: 1791305 - DNA, 20 bp, Homo sapiens
tgtatatatattcatataca

SEQ ID NO: 1791306 - DNA, 16 bp, Homo sapiens
tgtatatatctattat

SEQ ID NO: 1791307 - DNA, 14 bp, Homo sapiens
tgtatatattatta

SEQ ID NO: 1791308 - DNA, 22 bp, Homo sapiens
tgtatatatttcctatattgtt

SEQ ID NO: 1791309 - DNA, 21 bp, Homo sapiens
tgtatatggtatatatacata

SEQ ID NO: 1791310 - DNA, 13 bp, Homo sapiens
tgtatatgtttat

SEQ ID NO: 1791311 - DNA, 23 bp, Homo sapiens
tgtatattatggaagattttaaa

SEQ ID NO: 1791312 - DNA, 15 bp, Homo sapiens
tgtatattccaccat

SEQ ID NO: 1791313 - DNA, 14 bp, Homo sapiens
tgtatattgtaatt

SEQ ID NO: 1791314 - DNA, 21 bp, Homo sapiens
tgtatattgtggatgtgttca

SEQ ID NO: 1791315 - DNA, 14 bp, Homo sapiens
tgtatatttattca

SEQ ID NO: 1791316 - DNA, 20 bp, Homo sapiens
tgtatatttattcataatga

SEQ ID NO: 1791317 - DNA, 18 bp, Homo sapiens
tgtatatttgtaatatat

SEQ ID NO: 1791318 - DNA, 15 bp, Homo sapiens
tgtatatttgtacaa

SEQ ID NO: 1791319 - DNA, 16 bp, Homo sapiens
tgtatattttaatgtt

SEQ ID NO: 1791320 - DNA, 18 bp, Homo sapiens
tgtatattttaatgtttt

SEQ ID NO: 1791321 - DNA, 14 bp, Homo sapiens
tgtatcaaatctgt

SEQ ID NO: 1791322 - DNA, 17 bp, Homo sapiens
tgtatcaatgagtaaca

SEQ ID NO: 1791323 - DNA, 15 bp, Homo sapiens
tgtatcagtgtcctt

SEQ ID NO: 1791324 - DNA, 18 bp, Homo sapiens
tgtatcagtgtcctttcc

SEQ ID NO: 1791325 - DNA, 14 bp, Homo sapiens
tgtatcatgaagaa

SEQ ID NO: 1791326 - DNA, 12 bp, Homo sapiens
tgtatcctgggg

SEQ ID NO: 1791327 - DNA, 19 bp, Homo sapiens
tgtatcctggggctccctt

SEQ ID NO: 1791328 - DNA, 17 bp, Homo sapiens
tgtatcggagacagtga

SEQ ID NO: 1791329 - DNA, 15 bp, Homo sapiens
tgtatcggatgcttt

SEQ ID NO: 1791330 - DNA, 20 bp, Homo sapiens
tgtatctaaaaaataactgt

SEQ ID NO: 1791331 - DNA, 21 bp, Homo sapiens
tgtatctagtgtgtcctgtga

SEQ ID NO: 1791332 - DNA, 15 bp, Homo sapiens
tgtatctatttgtac

SEQ ID NO: 1791333 - DNA, 24 bp, Homo sapiens
tgtatctcatactgtctgggatta

SEQ ID NO: 1791334 - DNA, 13 bp, Homo sapiens
tgtatctgagcag

SEQ ID NO: 1791335 - DNA, 13 bp, Homo sapiens
tgtatctgtgtag

SEQ ID NO: 1791336 - DNA, 22 bp, Homo sapiens
tgtatcttaatatatacatttt

SEQ ID NO: 1791337 - DNA, 14 bp, Homo sapiens
tgtatctttatgct

SEQ ID NO: 1791338 - DNA, 12 bp, Homo sapiens
tgtatctttctt

SEQ ID NO: 1791339 - DNA, 12 bp, Homo sapiens
tgtatctttgta

SEQ ID NO: 1791340 - DNA, 20 bp, Homo sapiens
tgtatgaaaaattggggagg

SEQ ID NO: 1791341 - DNA, 21 bp, Homo sapiens
tgtatgaaaaattggggagga

SEQ ID NO: 1791342 - DNA, 23 bp, Homo sapiens
tgtatgaataatgaaaataaaac

SEQ ID NO: 1791343 - DNA, 20 bp, Homo sapiens
tgtatgactaaagagagaat

SEQ ID NO: 1791344 - DNA, 23 bp, Homo sapiens
tgtatgaggcttttcccaccagc

SEQ ID NO: 1791345 - DNA, 16 bp, Homo sapiens
tgtatgatactaaaga

SEQ ID NO: 1791346 - DNA, 12 bp, Homo sapiens
tgtatgattact

SEQ ID NO: 1791347 - DNA, 22 bp, Homo sapiens
tgtatgattactggcctttttc

SEQ ID NO: 1791348 - DNA, 20 bp, Homo sapiens
tgtatgatttaggcttctat

SEQ ID NO: 1791349 - DNA, 16 bp, Homo sapiens
tgtatgcacagtaaaa

SEQ ID NO: 1791350 - DNA, 13 bp, Homo sapiens
tgtatgcagggag

SEQ ID NO: 1791351 - DNA, 18 bp, Homo sapiens
tgtatgcagggagcactg

SEQ ID NO: 1791352 - DNA, 19 bp, Homo sapiens
tgtatgccacacctggcct

SEQ ID NO: 1791353 - DNA, 21 bp, Homo sapiens
tgtatgcctttaaatctgtga

SEQ ID NO: 1791354 - DNA, 22 bp, Homo sapiens
tgtatgcctttaaatctgtgat

SEQ ID NO: 1791355 - DNA, 23 bp, Homo sapiens
tgtatgcctttaaatctgtgatg

SEQ ID NO: 1791356 - DNA, 23 bp, Homo sapiens
tgtatgctgatcatcgccagagg

SEQ ID NO: 1791357 - DNA, 19 bp, Homo sapiens
tgtatggaatacagtgtta

SEQ ID NO: 1791358 - DNA, 17 bp, Homo sapiens
tgtatggacgtgtgtga

SEQ ID NO: 1791359 - DNA, 17 bp, Homo sapiens
tgtatggatatatttga

SEQ ID NO: 1791360 - DNA, 19 bp, Homo sapiens
tgtatggatatatttgaaa

SEQ ID NO: 1791361 - DNA, 15 bp, Homo sapiens
tgtatgtaaatctgc

SEQ ID NO: 1791362 - DNA, 23 bp, Homo sapiens
tgtatgtaagtaattgcatttct

SEQ ID NO: 1791363 - DNA, 12 bp, Homo sapiens
tgtatgtacaat

SEQ ID NO: 1791364 - DNA, 15 bp, Homo sapiens
tgtatgtacaataca

SEQ ID NO: 1791365 - DNA, 17 bp, Homo sapiens
tgtatgtacaatacaat

SEQ ID NO: 1791366 - DNA, 23 bp, Homo sapiens
tgtatgtacaatacaatgtacaa

SEQ ID NO: 1791367 - DNA, 12 bp, Homo sapiens
tgtatgtataca

SEQ ID NO: 1791368 - DNA, 15 bp, Homo sapiens
tgtatgtcaaagctt

SEQ ID NO: 1791369 - DNA, 17 bp, Homo sapiens
tgtatgtcaaagctttg

SEQ ID NO: 1791370 - DNA, 15 bp, Homo sapiens
tgtatgtcagtgcta

SEQ ID NO: 1791371 - DNA, 12 bp, Homo sapiens
tgtatgtctgtg

SEQ ID NO: 1791372 - DNA, 19 bp, Homo sapiens
tgtatgtcttggacactgt

SEQ ID NO: 1791373 - DNA, 14 bp, Homo sapiens
tgtatgtgagagat

SEQ ID NO: 1791374 - DNA, 18 bp, Homo sapiens
tgtatgtgagagattctg

SEQ ID NO: 1791375 - DNA, 12 bp, Homo sapiens
tgtatgtggggg

SEQ ID NO: 1791376 - DNA, 20 bp, Homo sapiens
tgtatgtgggggtctgtgtg

SEQ ID NO: 1791377 - DNA, 21 bp, Homo sapiens
tgtatgtgggggtctgtgtgt

SEQ ID NO: 1791378 - DNA, 19 bp, Homo sapiens
tgtatgtgtggctgtgggt

SEQ ID NO: 1791379 - DNA, 11 bp, Homo sapiens
tgtatgtgtgt

SEQ ID NO: 1791380 - DNA, 22 bp, Homo sapiens
tgtatgttaaagagaatgagtc

SEQ ID NO: 1791381 - DNA, 19 bp, Homo sapiens
tgtatgttcagaagaaatt

SEQ ID NO: 1791382 - DNA, 11 bp, Homo sapiens
tgtatgtttac

SEQ ID NO: 1791383 - DNA, 16 bp, Homo sapiens
tgtatgtttacatatc

SEQ ID NO: 1791384 - DNA, 14 bp, Homo sapiens
tgtatgtttgcaca

SEQ ID NO: 1791385 - DNA, 12 bp, Homo sapiens
tgtatgtttgct

SEQ ID NO: 1791386 - DNA, 12 bp, Homo sapiens
tgtattaaatct

SEQ ID NO: 1791387 - DNA, 24 bp, Homo sapiens
tgtattaaatcttaaacaatgtat

SEQ ID NO: 1791388 - DNA, 14 bp, Homo sapiens
tgtattaaattaca

SEQ ID NO: 1791389 - DNA, 19 bp, Homo sapiens
tgtattaaattacatttgt

SEQ ID NO: 1791390 - DNA, 21 bp, Homo sapiens
tgtattaaattacatttgtaa

SEQ ID NO: 1791391 - DNA, 21 bp, Homo sapiens
tgtattaacactactcaaagc

SEQ ID NO: 1791392 - DNA, 17 bp, Homo sapiens
tgtattaagagtgaaaa

SEQ ID NO: 1791393 - DNA, 11 bp, Homo sapiens
tgtattaataa

SEQ ID NO: 1791394 - DNA, 19 bp, Homo sapiens
tgtattaataaagcattct

SEQ ID NO: 1791395 - DNA, 22 bp, Homo sapiens
tgtattaatccccatcattact

SEQ ID NO: 1791396 - DNA, 16 bp, Homo sapiens
tgtattactagaagat

SEQ ID NO: 1791397 - DNA, 23 bp, Homo sapiens
tgtattactagaagatgaataca

SEQ ID NO: 1791398 - DNA, 14 bp, Homo sapiens
tgtattaggaaaat

SEQ ID NO: 1791399 - DNA, 21 bp, Homo sapiens
tgtattatttacatttaatag

SEQ ID NO: 1791400 - DNA, 18 bp, Homo sapiens
tgtattatttcaccagca

SEQ ID NO: 1791401 - DNA, 20 bp, Homo sapiens
tgtattatttcattatgtaa

SEQ ID NO: 1791402 - DNA, 15 bp, Homo sapiens
tgtattcaaatttgt

SEQ ID NO: 1791403 - DNA, 14 bp, Homo sapiens
tgtattcaagtaat

SEQ ID NO: 1791404 - DNA, 17 bp, Homo sapiens
tgtattcagaggcagtg

SEQ ID NO: 1791405 - DNA, 16 bp, Homo sapiens
tgtattcatatttgta

SEQ ID NO: 1791406 - DNA, 17 bp, Homo sapiens
tgtattcatatttgtac

SEQ ID NO: 1791407 - DNA, 20 bp, Homo sapiens
tgtattcatgaacttggctg

SEQ ID NO: 1791408 - DNA, 12 bp, Homo sapiens
tgtattcatgtt

SEQ ID NO: 1791409 - DNA, 15 bp, Homo sapiens
tgtattcatgttcat

SEQ ID NO: 1791410 - DNA, 17 bp, Homo sapiens
tgtattcatgttcatgt

SEQ ID NO: 1791411 - DNA, 21 bp, Homo sapiens
tgtattcatgttcatgtgatt

SEQ ID NO: 1791412 - DNA, 22 bp, Homo sapiens
tgtattcatgttcatgtgatta

SEQ ID NO: 1791413 - DNA, 22 bp, Homo sapiens
tgtattcccttgtattttgtta

SEQ ID NO: 1791414 - DNA, 22 bp, Homo sapiens
tgtattctagctaatgtaataa

SEQ ID NO: 1791415 - DNA, 15 bp, Homo sapiens
tgtattctctgtaag

SEQ ID NO: 1791416 - DNA, 18 bp, Homo sapiens
tgtattctgtatccgtga

SEQ ID NO: 1791417 - DNA, 13 bp, Homo sapiens
tgtattctgtctt

SEQ ID NO: 1791418 - DNA, 16 bp, Homo sapiens
tgtattctttctgcct

SEQ ID NO: 1791419 - DNA, 15 bp, Homo sapiens
tgtattgagatttct

SEQ ID NO: 1791420 - DNA, 16 bp, Homo sapiens
tgtattgcccccatgg

SEQ ID NO: 1791421 - DNA, 16 bp, Homo sapiens
tgtatttaaaaaaatc

SEQ ID NO: 1791422 - DNA, 13 bp, Homo sapiens
tgtatttaaatat

SEQ ID NO: 1791423 - DNA, 15 bp, Homo sapiens
tgtatttaacagaaa

SEQ ID NO: 1791424 - DNA, 16 bp, Homo sapiens
tgtatttaacagaaat

SEQ ID NO: 1791425 - DNA, 14 bp, Homo sapiens
tgtatttaagaaaa

SEQ ID NO: 1791426 - DNA, 20 bp, Homo sapiens
tgtatttaattcttcacctt

SEQ ID NO: 1791427 - DNA, 21 bp, Homo sapiens
tgtatttataaatatatttaa

SEQ ID NO: 1791428 - DNA, 16 bp, Homo sapiens
tgtatttatgtgtgag

SEQ ID NO: 1791429 - DNA, 17 bp, Homo sapiens
tgtatttatttccagac

SEQ ID NO: 1791430 - DNA, 20 bp, Homo sapiens
tgtatttgagagactgccat

SEQ ID NO: 1791431 - DNA, 21 bp, Homo sapiens
tgtatttgagttggctttgct

SEQ ID NO: 1791432 - DNA, 12 bp, Homo sapiens
tgtatttgctaa

SEQ ID NO: 1791433 - DNA, 21 bp, Homo sapiens
tgtatttgtattaataaagca

SEQ ID NO: 1791434 - DNA, 18 bp, Homo sapiens
tgtattttaacactttgt

SEQ ID NO: 1791435 - DNA, 18 bp, Homo sapiens
tgtattttaactattttt

SEQ ID NO: 1791436 - DNA, 16 bp, Homo sapiens
tgtattttaataacat

SEQ ID NO: 1791437 - DNA, 13 bp, Homo sapiens
tgtattttacatg

SEQ ID NO: 1791438 - DNA, 23 bp, Homo sapiens
tgtattttatcttattttctcaa

SEQ ID NO: 1791439 - DNA, 19 bp, Homo sapiens
tgtattttatttagacaag

SEQ ID NO: 1791440 - DNA, 14 bp, Homo sapiens
tgtattttgttaaa

SEQ ID NO: 1791441 - DNA, 17 bp, Homo sapiens
tgtattttgttaaagct

SEQ ID NO: 1791442 - DNA, 17 bp, Homo sapiens
tgtatttttagtagaga

SEQ ID NO: 1791443 - DNA, 18 bp, Homo sapiens
tgtatttttcatctttaa

SEQ ID NO: 1791444 - DNA, 17 bp, Homo sapiens
tgtattttttatttaca

SEQ ID NO: 1791445 - DNA, 19 bp, Homo sapiens
tgtattttttatttacatt

SEQ ID NO: 1791446 - DNA, 14 bp, Homo sapiens
tgtatttttttaac

SEQ ID NO: 1791447 - DNA, 22 bp, Homo sapiens
tgtatttttttttctaagagaa

SEQ ID NO: 1791448 - DNA, 20 bp, Homo sapiens
tgtcaaactgaaattcagag

SEQ ID NO: 1791449 - DNA, 14 bp, Homo sapiens
tgtcaaagatgccc

SEQ ID NO: 1791450 - DNA, 22 bp, Homo sapiens
tgtcaaatgtttccttaaacat

SEQ ID NO: 1791451 - DNA, 13 bp, Homo sapiens
tgtcaacttttga

SEQ ID NO: 1791452 - DNA, 15 bp, Homo sapiens
tgtcaagacatttct

SEQ ID NO: 1791453 - DNA, 15 bp, Homo sapiens
tgtcaagccataatt

SEQ ID NO: 1791454 - DNA, 13 bp, Homo sapiens
tgtcaaggaagaa

SEQ ID NO: 1791455 - DNA, 14 bp, Homo sapiens
tgtcaaggaagaag

SEQ ID NO: 1791456 - DNA, 19 bp, Homo sapiens
tgtcaaggaagacttttgg

SEQ ID NO: 1791457 - DNA, 23 bp, Homo sapiens
tgtcaaggaagacttttggtaga

SEQ ID NO: 1791458 - DNA, 15 bp, Homo sapiens
tgtcaagtacaagca

SEQ ID NO: 1791459 - DNA, 16 bp, Homo sapiens
tgtcgctcatgtgtgc

SEQ ID NO: 1791460 - DNA, 18 bp, Homo sapiens
tgtcgctgcctccatggc

SEQ ID NO: 1791461 - DNA, 17 bp, Homo sapiens
tgtcgtaatttgcactt

SEQ ID NO: 1791462 - DNA, 15 bp, Homo sapiens
tgtcgtctctcccac

SEQ ID NO: 1791463 - DNA, 22 bp, Homo sapiens
tgtcgtcttgaacgagcagccc

SEQ ID NO: 1791464 - DNA, 14 bp, Homo sapiens
tgtcgtgggatggc

SEQ ID NO: 1791465 - DNA, 22 bp, Homo sapiens
tgtctaaaaataaaatgcattt

SEQ ID NO: 1791466 - DNA, 17 bp, Homo sapiens
tgtctaaacaatgctga

SEQ ID NO: 1791467 - DNA, 21 bp, Homo sapiens
tgtctaaacaatgctgatttg

SEQ ID NO: 1791468 - DNA, 16 bp, Homo sapiens
tgtctaagattctaga

SEQ ID NO: 1791469 - DNA, 17 bp, Homo sapiens
tgtctaagattctagat

SEQ ID NO: 1791470 - DNA, 19 bp, Homo sapiens
tgtctaattgcatctcaaa

SEQ ID NO: 1791471 - DNA, 12 bp, Homo sapiens
tgtctaattgtc

SEQ ID NO: 1791472 - DNA, 17 bp, Homo sapiens
tgtctacagtagctgct

SEQ ID NO: 1791473 - DNA, 15 bp, Homo sapiens
tgtctacatgtgcca

SEQ ID NO: 1791474 - DNA, 15 bp, Homo sapiens
tgtctactcctagaa

SEQ ID NO: 1791475 - DNA, 23 bp, Homo sapiens
tgtctactcctagaagaaccaaa

SEQ ID NO: 1791476 - DNA, 12 bp, Homo sapiens
tgtctactgctt

SEQ ID NO: 1791477 - DNA, 15 bp, Homo sapiens
tgtctagactggcct

SEQ ID NO: 1791478 - DNA, 17 bp, Homo sapiens
tgtctaggactgcagtg

SEQ ID NO: 1791479 - DNA, 18 bp, Homo sapiens
tgtctaggactgcagtgt

SEQ ID NO: 1791480 - DNA, 19 bp, Homo sapiens
tgtctaggactgcagtgtg

SEQ ID NO: 1791481 - DNA, 17 bp, Homo sapiens
tgtctaggctggaagag

SEQ ID NO: 1791482 - DNA, 21 bp, Homo sapiens
tgtctaggctggaagagccaa

SEQ ID NO: 1791483 - DNA, 19 bp, Homo sapiens
tgtctagtgaggaagacaa

SEQ ID NO: 1791484 - DNA, 15 bp, Homo sapiens
tgtctagtttgcata

SEQ ID NO: 1791485 - DNA, 21 bp, Homo sapiens
tgtctagtttgcatacttcct

SEQ ID NO: 1791486 - DNA, 16 bp, Homo sapiens
tgtctatgaagttgct

SEQ ID NO: 1791487 - DNA, 22 bp, Homo sapiens
tgtctatgaagttgctgtttat

SEQ ID NO: 1791488 - DNA, 19 bp, Homo sapiens
tgtctattaaaattctgat

SEQ ID NO: 1791489 - DNA, 14 bp, Homo sapiens
tgtctattctgagc

SEQ ID NO: 1791490 - DNA, 15 bp, Homo sapiens
tgtctattctgagcc

SEQ ID NO: 1791491 - DNA, 20 bp, Homo sapiens
tgtctatttttaatgtttgt

SEQ ID NO: 1791492 - DNA, 19 bp, Homo sapiens
tgtctcaaaaaaaaaaaga

SEQ ID NO: 1791493 - DNA, 21 bp, Homo sapiens
tgtctcaaaaatccttatgca

SEQ ID NO: 1791494 - DNA, 19 bp, Homo sapiens
tgtctcaaaggagctttct

SEQ ID NO: 1791495 - DNA, 18 bp, Homo sapiens
tgtctcaacgcctccccc

SEQ ID NO: 1791496 - DNA, 17 bp, Homo sapiens
tgtctcaagagggcact

SEQ ID NO: 1791497 - DNA, 21 bp, Homo sapiens
tgtctcaagagggcactggtg

SEQ ID NO: 1791498 - DNA, 14 bp, Homo sapiens
tgtctcacatggga

SEQ ID NO: 1791499 - DNA, 17 bp, Homo sapiens
tgtctcactaaagcatg

SEQ ID NO: 1791500 - DNA, 20 bp, Homo sapiens
tgtctcactaaagcatgaaa

SEQ ID NO: 1791501 - DNA, 23 bp, Homo sapiens
tgtctcactaaagcatgaaatgt

SEQ ID NO: 1791502 - DNA, 23 bp, Homo sapiens
tgtctcactcgttctgttaccca

SEQ ID NO: 1791503 - DNA, 22 bp, Homo sapiens
tgtctcatctagtacctttgga

SEQ ID NO: 1791504 - DNA, 21 bp, Homo sapiens
tgtctccactaaatgagctcc

SEQ ID NO: 1791505 - DNA, 22 bp, Homo sapiens
tgtctccactaaatgagctcct

SEQ ID NO: 1791506 - DNA, 23 bp, Homo sapiens
tgtctccactaaatgagctcctg

SEQ ID NO: 1791507 - DNA, 17 bp, Homo sapiens
tgtctccagctgcctgg

SEQ ID NO: 1791508 - DNA, 21 bp, Homo sapiens
tgtctccagctgcctgggccc

SEQ ID NO: 1791509 - DNA, 17 bp, Homo sapiens
tgtctccctcccctctc

SEQ ID NO: 1791510 - DNA, 17 bp, Homo sapiens
tgtctccctctttctca

SEQ ID NO: 1791511 - DNA, 14 bp, Homo sapiens
tgtctcccttctct

SEQ ID NO: 1791512 - DNA, 16 bp, Homo sapiens
tgtctcccttctctct

SEQ ID NO: 1791513 - DNA, 14 bp, Homo sapiens
tgtctcctctcaga

SEQ ID NO: 1791514 - DNA, 14 bp, Homo sapiens
tgtctcctttgctc

SEQ ID NO: 1791515 - DNA, 22 bp, Homo sapiens
tgtctctaaaaagaagccacag

SEQ ID NO: 1791516 - DNA, 13 bp, Homo sapiens
tgtctctcagaat

SEQ ID NO: 1791517 - DNA, 11 bp, Homo sapiens
tgtctctccca

SEQ ID NO: 1791518 - DNA, 15 bp, Homo sapiens
tgtctctcccacccc

SEQ ID NO: 1791519 - DNA, 16 bp, Homo sapiens
tgtctctctgccaaga

SEQ ID NO: 1791520 - DNA, 13 bp, Homo sapiens
tgtctctgccatg

SEQ ID NO: 1791521 - DNA, 23 bp, Homo sapiens
tgtctctgggcttggggcttcct

SEQ ID NO: 1791522 - DNA, 20 bp, Homo sapiens
tgtctcttaaaaaaataaaa

SEQ ID NO: 1791523 - DNA, 13 bp, Homo sapiens
tgtctcttagaaa

SEQ ID NO: 1791524 - DNA, 16 bp, Homo sapiens
tgtctcttctgagcta

SEQ ID NO: 1791525 - DNA, 15 bp, Homo sapiens
tgtctcttctgagga

SEQ ID NO: 1791526 - DNA, 17 bp, Homo sapiens
tgtctcttctttagaac

SEQ ID NO: 1791527 - DNA, 17 bp, Homo sapiens
tgtctcttgagcatcaa

SEQ ID NO: 1791528 - DNA, 21 bp, Homo sapiens
tgtctcttgagcatcaatctt

SEQ ID NO: 1791529 - DNA, 14 bp, Homo sapiens
tgtctcttgtagaa

SEQ ID NO: 1791530 - DNA, 20 bp, Homo sapiens
tgtctctttaagttttgatt

SEQ ID NO: 1791531 - DNA, 16 bp, Homo sapiens
tgtctcttttctcttt

SEQ ID NO: 1791532 - DNA, 12 bp, Homo sapiens
tgtctgaaaaat

SEQ ID NO: 1791533 - DNA, 16 bp, Homo sapiens
tgtctgaaacagagaa

SEQ ID NO: 1791534 - DNA, 18 bp, Homo sapiens
tgtctgaacaatctccaa

SEQ ID NO: 1791535 - DNA, 20 bp, Homo sapiens
tgtctgaacaatctccaaaa

SEQ ID NO: 1791536 - DNA, 13 bp, Homo sapiens
tgtctgaacttgc

SEQ ID NO: 1791537 - DNA, 17 bp, Homo sapiens
tgtctgaaggacacttc

SEQ ID NO: 1791538 - DNA, 22 bp, Homo sapiens
tgtctgaaggacacttcctgcc

SEQ ID NO: 1791539 - DNA, 16 bp, Homo sapiens
tgtctgacttttgtta

SEQ ID NO: 1791540 - DNA, 13 bp, Homo sapiens
tgtctgagcctct

SEQ ID NO: 1791541 - DNA, 13 bp, Homo sapiens
tgtctgaggcctc

SEQ ID NO: 1791542 - DNA, 12 bp, Homo sapiens
tgtctgattcta

SEQ ID NO: 1791543 - DNA, 15 bp, Homo sapiens
tgtctgattctatgc

SEQ ID NO: 1791544 - DNA, 23 bp, Homo sapiens
tgtctgcagtcctggtggggctg

SEQ ID NO: 1791545 - DNA, 15 bp, Homo sapiens
tgtctgccaaacaca

SEQ ID NO: 1791546 - DNA, 16 bp, Homo sapiens
tgtctgccaatttttg

SEQ ID NO: 1791547 - DNA, 16 bp, Homo sapiens
tgtctgccagccagca

SEQ ID NO: 1791548 - DNA, 18 bp, Homo sapiens
tgtctgccagccagcagc

SEQ ID NO: 1791549 - DNA, 15 bp, Homo sapiens
tgtctgccctctggg

SEQ ID NO: 1791550 - DNA, 21 bp, Homo sapiens
tgtctgccctctgggtccctc

SEQ ID NO: 1791551 - DNA, 15 bp, Homo sapiens
tgtctgcctgtattt

SEQ ID NO: 1791552 - DNA, 16 bp, Homo sapiens
tgtctgccttactggt

SEQ ID NO: 1791553 - DNA, 17 bp, Homo sapiens
tgtctgctgccagcaca

SEQ ID NO: 1791554 - DNA, 13 bp, Homo sapiens
tgtctgcttctct

SEQ ID NO: 1791555 - DNA, 17 bp, Homo sapiens
tgtctgcttctctctct

SEQ ID NO: 1791556 - DNA, 21 bp, Homo sapiens
tgtctggagtcccctcctcca

SEQ ID NO: 1791557 - DNA, 14 bp, Homo sapiens
tgtctggcaaggac

SEQ ID NO: 1791558 - DNA, 20 bp, Homo sapiens
tgtctggcaaggactttgta

SEQ ID NO: 1791559 - DNA, 20 bp, Homo sapiens
tgtctggcccgcaatactgt

SEQ ID NO: 1791560 - DNA, 22 bp, Homo sapiens
tgtctggcccgcaatactgtag

SEQ ID NO: 1791561 - DNA, 19 bp, Homo sapiens
tgtctggcgttctcaagaa

SEQ ID NO: 1791562 - DNA, 23 bp, Homo sapiens
tgtctggctgaggatttcaagcc

SEQ ID NO: 1791563 - DNA, 14 bp, Homo sapiens
tgtctggggtgagg

SEQ ID NO: 1791564 - DNA, 15 bp, Homo sapiens
tgtctggtgggtgga

SEQ ID NO: 1791565 - DNA, 22 bp, Homo sapiens
tgtctggtgggtggagtcaggc

SEQ ID NO: 1791566 - DNA, 19 bp, Homo sapiens
tgtctgtacacgtgtcctg

SEQ ID NO: 1791567 - DNA, 20 bp, Homo sapiens
tgtctgtacacgtgtcctgt

SEQ ID NO: 1791568 - DNA, 17 bp, Homo sapiens
tgtctgtagctcctcaa

SEQ ID NO: 1791569 - DNA, 23 bp, Homo sapiens
tgtctgtccctgaactcccagaa

SEQ ID NO: 1791570 - DNA, 21 bp, Homo sapiens
tgtctgtcccttttctttgac

SEQ ID NO: 1791571 - DNA, 17 bp, Homo sapiens
tgtctgtcctgatttct

SEQ ID NO: 1791572 - DNA, 17 bp, Homo sapiens
tgtctgtctacatttct

SEQ ID NO: 1791573 - DNA, 12 bp, Homo sapiens
tgtctgtctccc

SEQ ID NO: 1791574 - DNA, 21 bp, Homo sapiens
tgtctgtctccctcccctctc

SEQ ID NO: 1791575 - DNA, 14 bp, Homo sapiens
tgtgacagtgcctc

SEQ ID NO: 1791576 - DNA, 20 bp, Homo sapiens
tgtgacagtgcctcttccag

SEQ ID NO: 1791577 - DNA, 16 bp, Homo sapiens
tgtgacatggtgcctg

SEQ ID NO: 1791578 - DNA, 17 bp, Homo sapiens
tgtgacatggtgcctga

SEQ ID NO: 1791579 - DNA, 12 bp, Homo sapiens
tgtgacatgtaa

SEQ ID NO: 1791580 - DNA, 21 bp, Homo sapiens
tgtgaccacatacgtgttagg

SEQ ID NO: 1791581 - DNA, 14 bp, Homo sapiens
tgtgaccagcactg

SEQ ID NO: 1791582 - DNA, 14 bp, Homo sapiens
tgtgaccatgttca

SEQ ID NO: 1791583 - DNA, 16 bp, Homo sapiens
tgtgaccatgttcatt

SEQ ID NO: 1791584 - DNA, 13 bp, Homo sapiens
tgtgacccaccag

SEQ ID NO: 1791585 - DNA, 19 bp, Homo sapiens
tgtgacccaccagtgcctt

SEQ ID NO: 1791586 - DNA, 22 bp, Homo sapiens
tgtgaccctgggcaagtcactt

SEQ ID NO: 1791587 - DNA, 15 bp, Homo sapiens
tgtgacgcagacaga

SEQ ID NO: 1791588 - DNA, 17 bp, Homo sapiens
tgtgacgcagacagagg

SEQ ID NO: 1791589 - DNA, 13 bp, Homo sapiens
tgtgacgtcggcc

SEQ ID NO: 1791590 - DNA, 17 bp, Homo sapiens
tgtgacgtgcactgtga

SEQ ID NO: 1791591 - DNA, 21 bp, Homo sapiens
tgtgactcctgttgccatgga

SEQ ID NO: 1791592 - DNA, 13 bp, Homo sapiens
tgtgactctgggc

SEQ ID NO: 1791593 - DNA, 15 bp, Homo sapiens
tgtgactctgggcag

SEQ ID NO: 1791594 - DNA, 17 bp, Homo sapiens
tgtgactctgggcaggg

SEQ ID NO: 1791595 - DNA, 13 bp, Homo sapiens
tgtgactgaaggg

SEQ ID NO: 1791596 - DNA, 20 bp, Homo sapiens
tgtgactgaaggggcacacc

SEQ ID NO: 1791597 - DNA, 15 bp, Homo sapiens
tgtgactgcatcata

SEQ ID NO: 1791598 - DNA, 19 bp, Homo sapiens
tgtgactgcatcatatatt

SEQ ID NO: 1791599 - DNA, 20 bp, Homo sapiens
tgtgactgcatcatatattt

SEQ ID NO: 1791600 - DNA, 12 bp, Homo sapiens
tgtgactggatc

SEQ ID NO: 1791601 - DNA, 13 bp, Homo sapiens
tgtgacttatcta

SEQ ID NO: 1791602 - DNA, 18 bp, Homo sapiens
tgtgacttctcccctgcc

SEQ ID NO: 1791603 - DNA, 19 bp, Homo sapiens
tgtgacttctcccctgccc

SEQ ID NO: 1791604 - DNA, 20 bp, Homo sapiens
tgtgacttctcccctgccct

SEQ ID NO: 1791605 - DNA, 19 bp, Homo sapiens
tgtgactttttagccagtg

SEQ ID NO: 1791606 - DNA, 21 bp, Homo sapiens
tgtgagaagccagccagaggc

SEQ ID NO: 1791607 - DNA, 19 bp, Homo sapiens
tgtgagaaggtttattgtt

SEQ ID NO: 1791608 - DNA, 21 bp, Homo sapiens
tgtgagaagtgaatgctggga

SEQ ID NO: 1791609 - DNA, 13 bp, Homo sapiens
tgtgagaccccaa

SEQ ID NO: 1791610 - DNA, 13 bp, Homo sapiens
tgtgagaccccca

SEQ ID NO: 1791611 - DNA, 14 bp, Homo sapiens
tgtgagacccccac

SEQ ID NO: 1791612 - DNA, 16 bp, Homo sapiens
tgtgagacccccacac

SEQ ID NO: 1791613 - DNA, 18 bp, Homo sapiens
tgtgagacttaaaacatg

SEQ ID NO: 1791614 - DNA, 13 bp, Homo sapiens
tgtgagagagact

SEQ ID NO: 1791615 - DNA, 17 bp, Homo sapiens
tgtgagagcgaggctga

SEQ ID NO: 1791616 - DNA, 22 bp, Homo sapiens
tgtgagcgctggctccctgggc

SEQ ID NO: 1791617 - DNA, 16 bp, Homo sapiens
tgtgagctatgcaaac

SEQ ID NO: 1791618 - DNA, 20 bp, Homo sapiens
tgtgagctctggttattttt

SEQ ID NO: 1791619 - DNA, 14 bp, Homo sapiens
tgtgagctcttccc

SEQ ID NO: 1791620 - DNA, 17 bp, Homo sapiens
tgtgagctttgaagtag

SEQ ID NO: 1791621 - DNA, 13 bp, Homo sapiens
tgtgaggagctgc

SEQ ID NO: 1791622 - DNA, 17 bp, Homo sapiens
tgtgaggagctgctggc

SEQ ID NO: 1791623 - DNA, 14 bp, Homo sapiens
tgtgaggaggaaaa

SEQ ID NO: 1791624 - DNA, 15 bp, Homo sapiens
tgtgaggaggaaaag

SEQ ID NO: 1791625 - DNA, 22 bp, Homo sapiens
tgtgaggattatgggtcctgca

SEQ ID NO: 1791626 - DNA, 21 bp, Homo sapiens
tgtgaggcattcggggaagct

SEQ ID NO: 1791627 - DNA, 14 bp, Homo sapiens
tgtgagggaaagag

SEQ ID NO: 1791628 - DNA, 19 bp, Homo sapiens
tgtgagtaagagctggtgt

SEQ ID NO: 1791629 - DNA, 14 bp, Homo sapiens
tgtgagtaggctgg

SEQ ID NO: 1791630 - DNA, 21 bp, Homo sapiens
tgtgagtcaatacatagtgct

SEQ ID NO: 1791631 - DNA, 17 bp, Homo sapiens
tgtgagtcagaatgtga

SEQ ID NO: 1791632 - DNA, 20 bp, Homo sapiens
tgtgagtctttggttctaag

SEQ ID NO: 1791633 - DNA, 21 bp, Homo sapiens
tgtgagtctttggttctaagg

SEQ ID NO: 1791634 - DNA, 17 bp, Homo sapiens
tgtgagtgccttttgca

SEQ ID NO: 1791635 - DNA, 19 bp, Homo sapiens
tgtgagtgccttttgcaga

SEQ ID NO: 1791636 - DNA, 19 bp, Homo sapiens
tgtgagtggataatcagga

SEQ ID NO: 1791637 - DNA, 15 bp, Homo sapiens
tgtgagtggcagcca

SEQ ID NO: 1791638 - DNA, 19 bp, Homo sapiens
tgtgagtggcagccatgcc

SEQ ID NO: 1791639 - DNA, 20 bp, Homo sapiens
tgtgagtggcagccatgcct

SEQ ID NO: 1791640 - DNA, 23 bp, Homo sapiens
tgtgagtgggtgcgtggtataca

SEQ ID NO: 1791641 - DNA, 22 bp, Homo sapiens
tgtgatacccatagcttccatg

SEQ ID NO: 1791642 - DNA, 15 bp, Homo sapiens
tgtgatattctaaga

SEQ ID NO: 1791643 - DNA, 19 bp, Homo sapiens
tgtgatattctaagactta

SEQ ID NO: 1791644 - DNA, 13 bp, Homo sapiens
tgtgatatttcag

SEQ ID NO: 1791645 - DNA, 20 bp, Homo sapiens
tgtgatatttcagaaataca

SEQ ID NO: 1791646 - DNA, 22 bp, Homo sapiens
tgtgatatttcagaaatacaga

SEQ ID NO: 1791647 - DNA, 17 bp, Homo sapiens
tgtgatcactgagacag

SEQ ID NO: 1791648 - DNA, 22 bp, Homo sapiens
tgtgatcagctttcaaagcatt

SEQ ID NO: 1791649 - DNA, 20 bp, Homo sapiens
tgtgatcaggctatgtatgg

SEQ ID NO: 1791650 - DNA, 20 bp, Homo sapiens
tgtgatccagttgttttcca

SEQ ID NO: 1791651 - DNA, 18 bp, Homo sapiens
tgtgatcccaagtgccag

SEQ ID NO: 1791652 - DNA, 23 bp, Homo sapiens
tgtgatcccaagtgccagtcttg

SEQ ID NO: 1791653 - DNA, 16 bp, Homo sapiens
tgtgatccggtttctt

SEQ ID NO: 1791654 - DNA, 19 bp, Homo sapiens
tgtgatccttggtgctgtg

SEQ ID NO: 1791655 - DNA, 20 bp, Homo sapiens
tgtgatccttggtgctgtgt

SEQ ID NO: 1791656 - DNA, 15 bp, Homo sapiens
tgtgatctcattgtt

SEQ ID NO: 1791657 - DNA, 15 bp, Homo sapiens
tgtgatgaacatatt

SEQ ID NO: 1791658 - DNA, 22 bp, Homo sapiens
tgtgatgaacatattcatgaaa

SEQ ID NO: 1791659 - DNA, 20 bp, Homo sapiens
tgtgatgaatctacatttgt

SEQ ID NO: 1791660 - DNA, 15 bp, Homo sapiens
tgtgatgcatgagct

SEQ ID NO: 1791661 - DNA, 15 bp, Homo sapiens
tgtgatgccacacag

SEQ ID NO: 1791662 - DNA, 18 bp, Homo sapiens
tgtgatgtaaggcactgt

SEQ ID NO: 1791663 - DNA, 22 bp, Homo sapiens
tgtgatgtaccagtttgtccat

SEQ ID NO: 1791664 - DNA, 11 bp, Homo sapiens
tgtgatgtgtc

SEQ ID NO: 1791665 - DNA, 13 bp, Homo sapiens
tgtgatgttctaa

SEQ ID NO: 1791666 - DNA, 15 bp, Homo sapiens
tgtgatgttctaagg

SEQ ID NO: 1791667 - DNA, 16 bp, Homo sapiens
tgtgatgttctaaggc

SEQ ID NO: 1791668 - DNA, 19 bp, Homo sapiens
tgtgattagatcacatctt

SEQ ID NO: 1791669 - DNA, 18 bp, Homo sapiens
tgtgattatttcacttta

SEQ ID NO: 1791670 - DNA, 22 bp, Homo sapiens
tgtgattcaatctgtaaactgt

SEQ ID NO: 1791671 - DNA, 15 bp, Homo sapiens
tgtgattccttttga

SEQ ID NO: 1791672 - DNA, 15 bp, Homo sapiens
tgtgattggcctgta

SEQ ID NO: 1791673 - DNA, 17 bp, Homo sapiens
tgtgattggcctgtaga

SEQ ID NO: 1791674 - DNA, 14 bp, Homo sapiens
tgtgattggctgca

SEQ ID NO: 1791675 - DNA, 15 bp, Homo sapiens
tgtgattggctgcag

SEQ ID NO: 1791676 - DNA, 16 bp, Homo sapiens
tgtgattggctgcagg

SEQ ID NO: 1791677 - DNA, 17 bp, Homo sapiens
tgtgattggctgcagga

SEQ ID NO: 1791678 - DNA, 20 bp, Homo sapiens
tgtgattggctgcaggaaga

SEQ ID NO: 1791679 - DNA, 14 bp, Homo sapiens
tgtgatttcctaaa

SEQ ID NO: 1791680 - DNA, 17 bp, Homo sapiens
tgtgatttcctaaacat

SEQ ID NO: 1791681 - DNA, 15 bp, Homo sapiens
tgtgatttgaattct

SEQ ID NO: 1791682 - DNA, 17 bp, Homo sapiens
tgtgatttgaattctgt

SEQ ID NO: 1791683 - DNA, 17 bp, Homo sapiens
tgtgatttttataatac

SEQ ID NO: 1791684 - DNA, 14 bp, Homo sapiens
tgtgcaaaatcact

SEQ ID NO: 1791685 - DNA, 14 bp, Homo sapiens
tgtgcaaacatgga

SEQ ID NO: 1791686 - DNA, 18 bp, Homo sapiens
tgtgcaacagggtatgga

SEQ ID NO: 1791687 - DNA, 17 bp, Homo sapiens
tgtgcaacggccagggt

SEQ ID NO: 1791688 - DNA, 18 bp, Homo sapiens
tgtgcaacggccagggtt

SEQ ID NO: 1791689 - DNA, 13 bp, Homo sapiens
tgtgcaatagaag

SEQ ID NO: 1791690 - DNA, 16 bp, Homo sapiens
tgtgcaatagaaggtg

SEQ ID NO: 1791691 - DNA, 23 bp, Homo sapiens
tgtgcaattgtcttttttttcct

SEQ ID NO: 1791692 - DNA, 20 bp, Homo sapiens
tgtggattaatgtcaatgtt

SEQ ID NO: 1791693 - DNA, 13 bp, Homo sapiens
tgtggattctata

SEQ ID NO: 1791694 - DNA, 16 bp, Homo sapiens
tgtggattctatattt

SEQ ID NO: 1791695 - DNA, 15 bp, Homo sapiens
tgtggcaaagtgctg

SEQ ID NO: 1791696 - DNA, 20 bp, Homo sapiens
tgtggcaaagtgctgtaccc

SEQ ID NO: 1791697 - DNA, 19 bp, Homo sapiens
tgtggcaattagtgtgaca

SEQ ID NO: 1791698 - DNA, 22 bp, Homo sapiens
tgtggcacagacttctggaagg

SEQ ID NO: 1791699 - DNA, 15 bp, Homo sapiens
tgtggcacagccctg

SEQ ID NO: 1791700 - DNA, 23 bp, Homo sapiens
tgtggcacagccctgagtgtccc

SEQ ID NO: 1791701 - DNA, 15 bp, Homo sapiens
tgtggcacttgcctg

SEQ ID NO: 1791702 - DNA, 16 bp, Homo sapiens
tgtggcacttgcctgg

SEQ ID NO: 1791703 - DNA, 18 bp, Homo sapiens
tgtggcacttgcctgggt

SEQ ID NO: 1791704 - DNA, 19 bp, Homo sapiens
tgtggcagagttacagttc

SEQ ID NO: 1791705 - DNA, 21 bp, Homo sapiens
tgtggcagagttacagttctg

SEQ ID NO: 1791706 - DNA, 20 bp, Homo sapiens
tgtggcagccgtcccaggcc

SEQ ID NO: 1791707 - DNA, 22 bp, Homo sapiens
tgtggcagccgtcccaggccac

SEQ ID NO: 1791708 - DNA, 14 bp, Homo sapiens
tgtggcagctgccc

SEQ ID NO: 1791709 - DNA, 21 bp, Homo sapiens
tgtggcagctgcccctggcac

SEQ ID NO: 1791710 - DNA, 15 bp, Homo sapiens
tgtggcagtggtttt

SEQ ID NO: 1791711 - DNA, 17 bp, Homo sapiens
tgtggccatggcctctg

SEQ ID NO: 1791712 - DNA, 19 bp, Homo sapiens
tgtggccccaccctgggcc

SEQ ID NO: 1791713 - DNA, 22 bp, Homo sapiens
tgtggccctgccatcttcccag

SEQ ID NO: 1791714 - DNA, 22 bp, Homo sapiens
tgtggccctggccactaaagct

SEQ ID NO: 1791715 - DNA, 17 bp, Homo sapiens
tgtggccctggcctgct

SEQ ID NO: 1791716 - DNA, 18 bp, Homo sapiens
tgtggccgcctggcaggt

SEQ ID NO: 1791717 - DNA, 13 bp, Homo sapiens
tgtggcctcagaa

SEQ ID NO: 1791718 - DNA, 15 bp, Homo sapiens
tgtggcctcttggct

SEQ ID NO: 1791719 - DNA, 17 bp, Homo sapiens
tgtggcctgcacagtga

SEQ ID NO: 1791720 - DNA, 15 bp, Homo sapiens
tgtggcctgtggcct

SEQ ID NO: 1791721 - DNA, 13 bp, Homo sapiens
tgtggcctgtgtc

SEQ ID NO: 1791722 - DNA, 15 bp, Homo sapiens
tgtggcctgtgtcca

SEQ ID NO: 1791723 - DNA, 22 bp, Homo sapiens
tgtggccttggcatttcttctt

SEQ ID NO: 1791724 - DNA, 20 bp, Homo sapiens
tgtggcgttctgctgcccct

SEQ ID NO: 1791725 - DNA, 10 bp, Homo sapiens
tgtggctcac

SEQ ID NO: 1791726 - DNA, 22 bp, Homo sapiens
tgtggctcctgggccggctgag

SEQ ID NO: 1791727 - DNA, 14 bp, Homo sapiens
tgtggctccttccc

SEQ ID NO: 1791728 - DNA, 22 bp, Homo sapiens
tgtggctgctatttcatctggt

SEQ ID NO: 1791729 - DNA, 20 bp, Homo sapiens
tgtggctgctcccagcctct

SEQ ID NO: 1791730 - DNA, 21 bp, Homo sapiens
tgtggctggaggagctggcct

SEQ ID NO: 1791731 - DNA, 13 bp, Homo sapiens
tgtggctgggacc

SEQ ID NO: 1791732 - DNA, 22 bp, Homo sapiens
tgtggcttggtttggtcatgcc

SEQ ID NO: 1791733 - DNA, 13 bp, Homo sapiens
tgtggctttatga

SEQ ID NO: 1791734 - DNA, 19 bp, Homo sapiens
tgtggctttttgttcagaa

SEQ ID NO: 1791735 - DNA, 20 bp, Homo sapiens
tgtggctttttgttcagaat

SEQ ID NO: 1791736 - DNA, 22 bp, Homo sapiens
tgtgggaagaccaaaggaagga

SEQ ID NO: 1791737 - DNA, 23 bp, Homo sapiens
tgtgggaagaccaaaggaaggaa

SEQ ID NO: 1791738 - DNA, 15 bp, Homo sapiens
tgtgggaccagtccc

SEQ ID NO: 1791739 - DNA, 17 bp, Homo sapiens
tgtgggagacagcagcc

SEQ ID NO: 1791740 - DNA, 18 bp, Homo sapiens
tgtgggagacagcagcct

SEQ ID NO: 1791741 - DNA, 13 bp, Homo sapiens
tgtgggagcagcg

SEQ ID NO: 1791742 - DNA, 13 bp, Homo sapiens
tgtgggagtagaa

SEQ ID NO: 1791743 - DNA, 15 bp, Homo sapiens
tgtgggagtgtgtaa

SEQ ID NO: 1791744 - DNA, 22 bp, Homo sapiens
tgtgggatacttagtggtatgt

SEQ ID NO: 1791745 - DNA, 17 bp, Homo sapiens
tgtgggatattgaatgt

SEQ ID NO: 1791746 - DNA, 15 bp, Homo sapiens
tgtgggatgtcctct

SEQ ID NO: 1791747 - DNA, 13 bp, Homo sapiens
tgtgggattatgg

SEQ ID NO: 1791748 - DNA, 19 bp, Homo sapiens
tgtgggcaattgttacaag

SEQ ID NO: 1791749 - DNA, 23 bp, Homo sapiens
tgtgggcgcccaccctgggctcc

SEQ ID NO: 1791750 - DNA, 22 bp, Homo sapiens
tgtgggcttatgtctctgcctt

SEQ ID NO: 1791751 - DNA, 16 bp, Homo sapiens
tgtgggcttgaccagg

SEQ ID NO: 1791752 - DNA, 22 bp, Homo sapiens
tgtggggaacatggctggcctg

SEQ ID NO: 1791753 - DNA, 17 bp, Homo sapiens
tgtggggaagaggggct

SEQ ID NO: 1791754 - DNA, 22 bp, Homo sapiens
tgtggggcaggagtgccaggac

SEQ ID NO: 1791755 - DNA, 15 bp, Homo sapiens
tgtggggccaggtca

SEQ ID NO: 1791756 - DNA, 22 bp, Homo sapiens
tgtggggggtaatccctgcttt

SEQ ID NO: 1791757 - DNA, 15 bp, Homo sapiens
tgtggggtgaaaagt

SEQ ID NO: 1791758 - DNA, 13 bp, Homo sapiens
tgtggggtggggt

SEQ ID NO: 1791759 - DNA, 13 bp, Homo sapiens
tgtgggtaagagg

SEQ ID NO: 1791760 - DNA, 19 bp, Homo sapiens
tgtgggtaagaggagcaga

SEQ ID NO: 1791761 - DNA, 21 bp, Homo sapiens
tgtgggtaagaggagcagagg

SEQ ID NO: 1791762 - DNA, 22 bp, Homo sapiens
tgtgggtaagaggagcagaggg

SEQ ID NO: 1791763 - DNA, 13 bp, Homo sapiens
tgtgggtctctga

SEQ ID NO: 1791764 - DNA, 16 bp, Homo sapiens
tgtgggtctgtgtgtg

SEQ ID NO: 1791765 - DNA, 13 bp, Homo sapiens
tgtgggtgagcca

SEQ ID NO: 1791766 - DNA, 19 bp, Homo sapiens
tgtgggtgggagtgtgtct

SEQ ID NO: 1791767 - DNA, 23 bp, Homo sapiens
tgtgggtgggagtgtgtctgctg

SEQ ID NO: 1791768 - DNA, 13 bp, Homo sapiens
tgtgggtgtcctg

SEQ ID NO: 1791769 - DNA, 15 bp, Homo sapiens
tgtgggtgtcctgcc

SEQ ID NO: 1791770 - DNA, 21 bp, Homo sapiens
tgtgggtgtcctgcctgtctg

SEQ ID NO: 1791771 - DNA, 16 bp, Homo sapiens
tgtggtacatggtgtt

SEQ ID NO: 1791772 - DNA, 16 bp, Homo sapiens
tgtggtagctccagcg

SEQ ID NO: 1791773 - DNA, 20 bp, Homo sapiens
tgtggtagcttatcttagaa

SEQ ID NO: 1791774 - DNA, 23 bp, Homo sapiens
tgtggtcacagcggaggtgtgga

SEQ ID NO: 1791775 - DNA, 19 bp, Homo sapiens
tgtggtgaggggctttctc

SEQ ID NO: 1791776 - DNA, 22 bp, Homo sapiens
tgtggtgaggggtgtgggaaga

SEQ ID NO: 1791777 - DNA, 15 bp, Homo sapiens
tgtggtggagccagg

SEQ ID NO: 1791778 - DNA, 12 bp, Homo sapiens
tgtggtgtgacc

SEQ ID NO: 1791779 - DNA, 16 bp, Homo sapiens
tgtggttgaaaaccac

SEQ ID NO: 1791780 - DNA, 18 bp, Homo sapiens
tgtggttgaaaaccacag

SEQ ID NO: 1791781 - DNA, 15 bp, Homo sapiens
tgtggtttcagatgt

SEQ ID NO: 1791782 - DNA, 20 bp, Homo sapiens
tgtggtttcagatgtgcaat

SEQ ID NO: 1791783 - DNA, 15 bp, Homo sapiens
tgtgtaaaaaatgga

SEQ ID NO: 1791784 - DNA, 23 bp, Homo sapiens
tgtgtaaaaaatggaaaaaaaca

SEQ ID NO: 1791785 - DNA, 13 bp, Homo sapiens
tgtgtaaaaagca

SEQ ID NO: 1791786 - DNA, 21 bp, Homo sapiens
tgtgtaaagtgtaaatccttt

SEQ ID NO: 1791787 - DNA, 21 bp, Homo sapiens
tgtgtaacaattttaatgcta

SEQ ID NO: 1791788 - DNA, 19 bp, Homo sapiens
tgtgccatggatctgatct

SEQ ID NO: 1791789 - DNA, 21 bp, Homo sapiens
tgtgcccacatcccaggcttc

SEQ ID NO: 1791790 - DNA, 22 bp, Homo sapiens
tgtgcccacccgtcttcaatct

SEQ ID NO: 1791791 - DNA, 15 bp, Homo sapiens
tgtgcccagcacctg

SEQ ID NO: 1791792 - DNA, 16 bp, Homo sapiens
tgtgcccagcaggccc

SEQ ID NO: 1791793 - DNA, 17 bp, Homo sapiens
tgtgcccagcaggccca

SEQ ID NO: 1791794 - DNA, 15 bp, Homo sapiens
tgtgccccaccacgt

SEQ ID NO: 1791795 - DNA, 15 bp, Homo sapiens
tgtgccccactccag

SEQ ID NO: 1791796 - DNA, 21 bp, Homo sapiens
tgtgccccactccagcctggg

SEQ ID NO: 1791797 - DNA, 23 bp, Homo sapiens
tgtgccccactccagcctgggga

SEQ ID NO: 1791798 - DNA, 19 bp, Homo sapiens
tgtgccctagatgcacgtg

SEQ ID NO: 1791799 - DNA, 16 bp, Homo sapiens
tgtgccctcaccacca

SEQ ID NO: 1791800 - DNA, 18 bp, Homo sapiens
tgtgccctcaccaccaca

SEQ ID NO: 1791801 - DNA, 15 bp, Homo sapiens
tgtgccctccaaaga

SEQ ID NO: 1791802 - DNA, 16 bp, Homo sapiens
tgtgccctccaaagag

SEQ ID NO: 1791803 - DNA, 12 bp, Homo sapiens
tgtgccctgcct

SEQ ID NO: 1791804 - DNA, 13 bp, Homo sapiens
tgtgccgtaatta

SEQ ID NO: 1791805 - DNA, 17 bp, Homo sapiens
tgtgccgtcgtaggtat

SEQ ID NO: 1791806 - DNA, 17 bp, Homo sapiens
tgtgcctatagtcccag

SEQ ID NO: 1791807 - DNA, 16 bp, Homo sapiens
tgtgcctcagagacca

SEQ ID NO: 1791808 - DNA, 14 bp, Homo sapiens
tgtgcctcaggcca

SEQ ID NO: 1791809 - DNA, 14 bp, Homo sapiens
tgtgcctcccaaaa

SEQ ID NO: 1791810 - DNA, 15 bp, Homo sapiens
tgtgcctccccccag

SEQ ID NO: 1791811 - DNA, 14 bp, Homo sapiens
tgtgcctcctcacc

SEQ ID NO: 1791812 - DNA, 13 bp, Homo sapiens
tgtgcctctggga

SEQ ID NO: 1791813 - DNA, 18 bp, Homo sapiens
tgtgcctgcaccaggaga

SEQ ID NO: 1791814 - DNA, 14 bp, Homo sapiens
tgtgcctgcactga

SEQ ID NO: 1791815 - DNA, 20 bp, Homo sapiens
tgtgcctgctcagcagccag

SEQ ID NO: 1791816 - DNA, 15 bp, Homo sapiens
tgtgcctgggccctg

SEQ ID NO: 1791817 - DNA, 19 bp, Homo sapiens
tgtgcctgggccctgggct

SEQ ID NO: 1791818 - DNA, 12 bp, Homo sapiens
tgtgcctgtgct

SEQ ID NO: 1791819 - DNA, 14 bp, Homo sapiens
tgtgcctgtgctcc

SEQ ID NO: 1791820 - DNA, 18 bp, Homo sapiens
tgtgcctgtgctcctgcc

SEQ ID NO: 1791821 - DNA, 15 bp, Homo sapiens
tgtgcctgtggcaga

SEQ ID NO: 1791822 - DNA, 13 bp, Homo sapiens
tgtgccttccctt

SEQ ID NO: 1791823 - DNA, 23 bp, Homo sapiens
tgtgccttcgtctttcccatggg

SEQ ID NO: 1791824 - DNA, 16 bp, Homo sapiens
tgtgcctttctttgcc

SEQ ID NO: 1791825 - DNA, 16 bp, Homo sapiens
tgtgccttttgccatc

SEQ ID NO: 1791826 - DNA, 15 bp, Homo sapiens
tgtgcgctctgtgga

SEQ ID NO: 1791827 - DNA, 18 bp, Homo sapiens
tgtgcgctgcctggccag

SEQ ID NO: 1791828 - DNA, 15 bp, Homo sapiens
tgtgcggtgcataca

SEQ ID NO: 1791829 - DNA, 13 bp, Homo sapiens
tgtgcgtctgttt

SEQ ID NO: 1791830 - DNA, 23 bp, Homo sapiens
tgtgcgtgcgtgttagtgtgtgt

SEQ ID NO: 1791831 - DNA, 21 bp, Homo sapiens
tgtgctacctgggtccttttc

SEQ ID NO: 1791832 - DNA, 17 bp, Homo sapiens
tgtgctagaaattttca

SEQ ID NO: 1791833 - DNA, 20 bp, Homo sapiens
tgtgctagaaattttcaaga

SEQ ID NO: 1791834 - DNA, 13 bp, Homo sapiens
tgtgctagaacaa

SEQ ID NO: 1791835 - DNA, 14 bp, Homo sapiens
tgtgctatgcaaaa

SEQ ID NO: 1791836 - DNA, 18 bp, Homo sapiens
tgtgctatttgtacaaat

SEQ ID NO: 1791837 - DNA, 20 bp, Homo sapiens
tgtgctatttgtacaaataa

SEQ ID NO: 1791838 - DNA, 17 bp, Homo sapiens
tgtgctcacgctccccc

SEQ ID NO: 1791839 - DNA, 15 bp, Homo sapiens
tgtgctcagaagggc

SEQ ID NO: 1791840 - DNA, 22 bp, Homo sapiens
tgtgctcatgcattgcttgtgt

SEQ ID NO: 1791841 - DNA, 22 bp, Homo sapiens
tgtgctccatatttgatttcta

SEQ ID NO: 1791842 - DNA, 16 bp, Homo sapiens
tgtgctccgtgcctcc

SEQ ID NO: 1791843 - DNA, 20 bp, Homo sapiens
tgtgctccgtgcctccacca

SEQ ID NO: 1791844 - DNA, 18 bp, Homo sapiens
tgtgctctatagcagaca

SEQ ID NO: 1791845 - DNA, 16 bp, Homo sapiens
tgtgctctggaggctg

SEQ ID NO: 1791846 - DNA, 13 bp, Homo sapiens
tgtgctgaagaca

SEQ ID NO: 1791847 - DNA, 21 bp, Homo sapiens
tgtgctgacaacttagctcag

SEQ ID NO: 1791848 - DNA, 23 bp, Homo sapiens
tgtgctgacaacttagctcaggt

SEQ ID NO: 1791849 - DNA, 20 bp, Homo sapiens
tgtgctgatcctgctgacct

SEQ ID NO: 1791850 - DNA, 20 bp, Homo sapiens
tgtgctgcccgtcttcagcc

SEQ ID NO: 1791851 - DNA, 13 bp, Homo sapiens
tgtgctgcttctc

SEQ ID NO: 1791852 - DNA, 10 bp, Homo sapiens
tgtgctggga

SEQ ID NO: 1791853 - DNA, 18 bp, Homo sapiens
tgtgctggtgaacactgt

SEQ ID NO: 1791854 - DNA, 21 bp, Homo sapiens
tgtgctggtgaacactgtgac

SEQ ID NO: 1791855 - DNA, 19 bp, Homo sapiens
tgtgctggtgtcctgacca

SEQ ID NO: 1791856 - DNA, 13 bp, Homo sapiens
tgtgctgtgcctg

SEQ ID NO: 1791857 - DNA, 18 bp, Homo sapiens
tgtgctgtgcctgctaga

SEQ ID NO: 1791858 - DNA, 13 bp, Homo sapiens
tgtgcttattttt

SEQ ID NO: 1791859 - DNA, 22 bp, Homo sapiens
tgtgcttgaaggccctgctgag

SEQ ID NO: 1791860 - DNA, 19 bp, Homo sapiens
tgtgcttgagccaggaggc

SEQ ID NO: 1791861 - DNA, 18 bp, Homo sapiens
tgtgcttgtcattccaga

SEQ ID NO: 1791862 - DNA, 12 bp, Homo sapiens
tgtgcttttcca

SEQ ID NO: 1791863 - DNA, 18 bp, Homo sapiens
tgtgcttttccatctaaa

SEQ ID NO: 1791864 - DNA, 20 bp, Homo sapiens
tgtgcttttccatctaaaat

SEQ ID NO: 1791865 - DNA, 21 bp, Homo sapiens
tgtgctttttaagaatatttt

SEQ ID NO: 1791866 - DNA, 13 bp, Homo sapiens
tgtggaaaacaga

SEQ ID NO: 1791867 - DNA, 19 bp, Homo sapiens
tgtggaaagcctctgctgc

SEQ ID NO: 1791868 - DNA, 21 bp, Homo sapiens
tgtggaaatcataccagttgt

SEQ ID NO: 1791869 - DNA, 19 bp, Homo sapiens
tgtggaaggcaagccaggc

SEQ ID NO: 1791870 - DNA, 22 bp, Homo sapiens
tgtggaaggcaagccaggctca

SEQ ID NO: 1791871 - DNA, 12 bp, Homo sapiens
tgtggactctgg

SEQ ID NO: 1791872 - DNA, 23 bp, Homo sapiens
tgtggactctggtgcctccagag

SEQ ID NO: 1791873 - DNA, 14 bp, Homo sapiens
tgtggactggctgt

SEQ ID NO: 1791874 - DNA, 18 bp, Homo sapiens
tgtggactggctgtgccc

SEQ ID NO: 1791875 - DNA, 24 bp, Homo sapiens
tgtggactgtcctgaggagccctg

SEQ ID NO: 1791876 - DNA, 11 bp, Homo sapiens
tgtggactgtg

SEQ ID NO: 1791877 - DNA, 19 bp, Homo sapiens
tgtctgtgccctccaaaga

SEQ ID NO: 1791878 - DNA, 20 bp, Homo sapiens
tgtctgtggatggtcattgc

SEQ ID NO: 1791879 - DNA, 14 bp, Homo sapiens
tgtctgtgtcccag

SEQ ID NO: 1791880 - DNA, 14 bp, Homo sapiens
tgtctgttcagcaa

SEQ ID NO: 1791881 - DNA, 22 bp, Homo sapiens
tgtctgtttattaactactgaa

SEQ ID NO: 1791882 - DNA, 16 bp, Homo sapiens
tgtcttaagtgtttct

SEQ ID NO: 1791883 - DNA, 17 bp, Homo sapiens
tgtcttaagtgtttctc

SEQ ID NO: 1791884 - DNA, 18 bp, Homo sapiens
tgtcttaagtgtttctca

SEQ ID NO: 1791885 - DNA, 17 bp, Homo sapiens
tgtcttaatactgtcct

SEQ ID NO: 1791886 - DNA, 14 bp, Homo sapiens
tgtcttaattaaaa

SEQ ID NO: 1791887 - DNA, 13 bp, Homo sapiens
tgtcttatatata

SEQ ID NO: 1791888 - DNA, 22 bp, Homo sapiens
tgtcttatatatatttctttgt

SEQ ID NO: 1791889 - DNA, 15 bp, Homo sapiens
tgtcttatgaggaat

SEQ ID NO: 1791890 - DNA, 22 bp, Homo sapiens
tgtcttatgtgaaaaattaact

SEQ ID NO: 1791891 - DNA, 13 bp, Homo sapiens
tgtcttccaagga

SEQ ID NO: 1791892 - DNA, 16 bp, Homo sapiens
tgtcttccaaggagac

SEQ ID NO: 1791893 - DNA, 24 bp, Homo sapiens
tgtcttccaaggagaccaagtcct

SEQ ID NO: 1791894 - DNA, 14 bp, Homo sapiens
tgtcttccataatg

SEQ ID NO: 1791895 - DNA, 23 bp, Homo sapiens
tgtcttccgatcaacatttatga

SEQ ID NO: 1791896 - DNA, 15 bp, Homo sapiens
tgtcttcctagaatt

SEQ ID NO: 1791897 - DNA, 19 bp, Homo sapiens
tgtcttcctatttcagaag

SEQ ID NO: 1791898 - DNA, 13 bp, Homo sapiens
tgtcttcctgcat

SEQ ID NO: 1791899 - DNA, 17 bp, Homo sapiens
tgtcttctccctgcaca

SEQ ID NO: 1791900 - DNA, 13 bp, Homo sapiens
tgtcttctgcctg

SEQ ID NO: 1791901 - DNA, 18 bp, Homo sapiens
tgtcttctgcctgttata

SEQ ID NO: 1791902 - DNA, 12 bp, Homo sapiens
tgtcttctggac

SEQ ID NO: 1791903 - DNA, 23 bp, Homo sapiens
tgtcttctggacaggctctgctt

SEQ ID NO: 1791904 - DNA, 15 bp, Homo sapiens
tgtcttcttaaaatc

SEQ ID NO: 1791905 - DNA, 19 bp, Homo sapiens
tgtcttgaaagattcaggt

SEQ ID NO: 1791906 - DNA, 13 bp, Homo sapiens
tgtcttgaataag

SEQ ID NO: 1791907 - DNA, 17 bp, Homo sapiens
tgtcttgaatgtctttt

SEQ ID NO: 1791908 - DNA, 14 bp, Homo sapiens
tgtcttgatgtttt

SEQ ID NO: 1791909 - DNA, 14 bp, Homo sapiens
tgtcttgccagcca

SEQ ID NO: 1791910 - DNA, 22 bp, Homo sapiens
tgtcttggcctcccaaagtgct

SEQ ID NO: 1791911 - DNA, 16 bp, Homo sapiens
tgtcttgggcagagct

SEQ ID NO: 1791912 - DNA, 21 bp, Homo sapiens
tgtcttgggcagagctggctc

SEQ ID NO: 1791913 - DNA, 22 bp, Homo sapiens
tgtcttgggcagagctggctct

SEQ ID NO: 1791914 - DNA, 16 bp, Homo sapiens
tgtcttgtacatgtgt

SEQ ID NO: 1791915 - DNA, 17 bp, Homo sapiens
tgtcttgtacatgtgta

SEQ ID NO: 1791916 - DNA, 12 bp, Homo sapiens
tgtcttgtactt

SEQ ID NO: 1791917 - DNA, 12 bp, Homo sapiens
tgtcttgttcat

SEQ ID NO: 1791918 - DNA, 15 bp, Homo sapiens
tgtcttgttcatttt

SEQ ID NO: 1791919 - DNA, 16 bp, Homo sapiens
tgtctttaaaagagag

SEQ ID NO: 1791920 - DNA, 15 bp, Homo sapiens
tgtctttaaggaaaa

SEQ ID NO: 1791921 - DNA, 16 bp, Homo sapiens
tgtctttatttgctca

SEQ ID NO: 1791922 - DNA, 16 bp, Homo sapiens
tgtctttcagatacat

SEQ ID NO: 1791923 - DNA, 20 bp, Homo sapiens
tgtctttcagatacatggtt

SEQ ID NO: 1791924 - DNA, 12 bp, Homo sapiens
tgtgtaacacag

SEQ ID NO: 1791925 - DNA, 15 bp, Homo sapiens
tgtgtaacatccaag

SEQ ID NO: 1791926 - DNA, 18 bp, Homo sapiens
tgtgtaacatccaagcca

SEQ ID NO: 1791927 - DNA, 19 bp, Homo sapiens
tgtgtaacatccaagccag

SEQ ID NO: 1791928 - DNA, 14 bp, Homo sapiens
tgtgtaataagaaa

SEQ ID NO: 1791929 - DNA, 15 bp, Homo sapiens
tgtgtaataagaaag

SEQ ID NO: 1791930 - DNA, 23 bp, Homo sapiens
tgtgtacaaaccaagagctttta

SEQ ID NO: 1791931 - DNA, 13 bp, Homo sapiens
tgtgtacacatgg

SEQ ID NO: 1791932 - DNA, 17 bp, Homo sapiens
tgtgtacacctctggat

SEQ ID NO: 1791933 - DNA, 22 bp, Homo sapiens
tgtgtacacgggactgacgcaa

SEQ ID NO: 1791934 - DNA, 23 bp, Homo sapiens
tgtgtacagaattctgctacctc

SEQ ID NO: 1791935 - DNA, 12 bp, Homo sapiens
tgtgtacagtga

SEQ ID NO: 1791936 - DNA, 19 bp, Homo sapiens
tgtgtacagtgaattgtct

SEQ ID NO: 1791937 - DNA, 22 bp, Homo sapiens
tgtgtacagtgaattgtctttt

SEQ ID NO: 1791938 - DNA, 23 bp, Homo sapiens
tgtgtacatagagcaatgttggt

SEQ ID NO: 1791939 - DNA, 16 bp, Homo sapiens
tgtgtacatatatgta

SEQ ID NO: 1791940 - DNA, 19 bp, Homo sapiens
tgtgtacatatatgtataa

SEQ ID NO: 1791941 - DNA, 23 bp, Homo sapiens
tgtgtacatatatgtataatata

SEQ ID NO: 1791942 - DNA, 19 bp, Homo sapiens
tgtgtaccacttcctgagg

SEQ ID NO: 1791943 - DNA, 23 bp, Homo sapiens
tgtgtaccacttcctgaggcctc

SEQ ID NO: 1791944 - DNA, 17 bp, Homo sapiens
tgtgtactgattcaaga

SEQ ID NO: 1791945 - DNA, 20 bp, Homo sapiens
tgtgtagccccttttctttg

SEQ ID NO: 1791946 - DNA, 15 bp, Homo sapiens
tgtgtagcctgtgca

SEQ ID NO: 1791947 - DNA, 16 bp, Homo sapiens
tgtgtagcctgtgcat

SEQ ID NO: 1791948 - DNA, 23 bp, Homo sapiens
tgtgtagcctgtgcatgtatgtc

SEQ ID NO: 1791949 - DNA, 14 bp, Homo sapiens
tgtgtagctttgct

SEQ ID NO: 1791950 - DNA, 18 bp, Homo sapiens
tgtgtaggtgtctgcctt

SEQ ID NO: 1791951 - DNA, 14 bp, Homo sapiens
tgtgtagtatcttg

SEQ ID NO: 1791952 - DNA, 15 bp, Homo sapiens
tgtgtatacatgcca

SEQ ID NO: 1791953 - DNA, 22 bp, Homo sapiens
tgtgtatgtacttagctgtact

SEQ ID NO: 1791954 - DNA, 11 bp, Homo sapiens
tgtgtatgtgg

SEQ ID NO: 1791955 - DNA, 23 bp, Homo sapiens
tgtgtatgtgggggtctgtgtgt

SEQ ID NO: 1791956 - DNA, 19 bp, Homo sapiens
tgtgtatgtttcttagccc

SEQ ID NO: 1791957 - DNA, 23 bp, Homo sapiens
tgtgtattatgtgcctaattttc

SEQ ID NO: 1791958 - DNA, 21 bp, Homo sapiens
tgtgtattctgtggattctat

SEQ ID NO: 1791959 - DNA, 16 bp, Homo sapiens
tgtgtattgatgcaat

SEQ ID NO: 1791960 - DNA, 17 bp, Homo sapiens
tgtgtattgatgcaata

SEQ ID NO: 1791961 - DNA, 18 bp, Homo sapiens
tgtgtcacccagactgga

SEQ ID NO: 1791962 - DNA, 15 bp, Homo sapiens
tgtgtcagaaacatg

SEQ ID NO: 1791963 - DNA, 19 bp, Homo sapiens
tgtgtcagaataggaaaac

SEQ ID NO: 1791964 - DNA, 14 bp, Homo sapiens
tgtgtcagaatctc

SEQ ID NO: 1791965 - DNA, 19 bp, Homo sapiens
tgtgtcagagcccagccca

SEQ ID NO: 1791966 - DNA, 22 bp, Homo sapiens
tgtgtcagagcccagcccagga

SEQ ID NO: 1791967 - DNA, 22 bp, Homo sapiens
tgtgtcaggccctctgcctgca

SEQ ID NO: 1791968 - DNA, 21 bp, Homo sapiens
tgtgtcataccagaaagctct

SEQ ID NO: 1791969 - DNA, 22 bp, Homo sapiens
tgtgtcatctagcattaggtat

SEQ ID NO: 1791970 - DNA, 21 bp, Homo sapiens
tgtgtcatgaagaatgtttct

SEQ ID NO: 1791971 - DNA, 14 bp, Homo sapiens
tgtgtccagcagct

SEQ ID NO: 1791972 - DNA, 23 bp, Homo sapiens
tgtgtccagttttggaggctgag

SEQ ID NO: 1791973 - DNA, 17 bp, Homo sapiens
tgtgtcccagatgctgt

SEQ ID NO: 1791974 - DNA, 20 bp, Homo sapiens
tgtgtcccatgatccctgtg

SEQ ID NO: 1791975 - DNA, 17 bp, Homo sapiens
tgtgtccctcttctctt

SEQ ID NO: 1791976 - DNA, 18 bp, Homo sapiens
tgtgtccctggacacagc

SEQ ID NO: 1791977 - DNA, 22 bp, Homo sapiens
tgtgtccctggacacagctctt

SEQ ID NO: 1791978 - DNA, 15 bp, Homo sapiens
tgtgtcctccaccat

SEQ ID NO: 1791979 - DNA, 16 bp, Homo sapiens
tgtgtcctccaccatg

SEQ ID NO: 1791980 - DNA, 22 bp, Homo sapiens
tgtgtctaaatttgaatgttaa

SEQ ID NO: 1791981 - DNA, 21 bp, Homo sapiens
tgtgtctaggctggaagagcc

SEQ ID NO: 1791982 - DNA, 19 bp, Homo sapiens
tgtgtctgcgtctgtgttg

SEQ ID NO: 1791983 - DNA, 13 bp, Homo sapiens
tgtgtctgctgag

SEQ ID NO: 1791984 - DNA, 14 bp, Homo sapiens
tgtgtctggacctc

SEQ ID NO: 1791985 - DNA, 13 bp, Homo sapiens
tgtgtctggtaac

SEQ ID NO: 1791986 - DNA, 19 bp, Homo sapiens
tgtgtcttggagtgcattt

SEQ ID NO: 1791987 - DNA, 22 bp, Homo sapiens
tgtgtctttcacagctcctccc

SEQ ID NO: 1791988 - DNA, 14 bp, Homo sapiens
tgtgtgaaacaatg

SEQ ID NO: 1791989 - DNA, 18 bp, Homo sapiens
tgtgtgaattctgcaact

SEQ ID NO: 1791990 - DNA, 13 bp, Homo sapiens
tgtgtgacactga

SEQ ID NO: 1791991 - DNA, 19 bp, Homo sapiens
tgtgtgacagaatcttgta

SEQ ID NO: 1791992 - DNA, 16 bp, Homo sapiens
tgtgtgacttacagaa

SEQ ID NO: 1791993 - DNA, 21 bp, Homo sapiens
tgtgtgagtgagcacacccgt

SEQ ID NO: 1791994 - DNA, 20 bp, Homo sapiens
tgtgtgatatttcagaaata

SEQ ID NO: 1791995 - DNA, 15 bp, Homo sapiens
tgtgtgattaaaagg

SEQ ID NO: 1791996 - DNA, 16 bp, Homo sapiens
tgtgtgattgaatctg

SEQ ID NO: 1791997 - DNA, 22 bp, Homo sapiens
tgtgtgatttcctaaacataat

SEQ ID NO: 1791998 - DNA, 12 bp, Homo sapiens
tgtgtgcatgtg

SEQ ID NO: 1791999 - DNA, 13 bp, Homo sapiens
tgtgtgcatgtga

SEQ ID NO: 1792000 - DNA, 24 bp, Homo sapiens
tgtgtgcatgtgtgtgtctgtctt

SEQ ID NO: 1792001 - DNA, 21 bp, Homo sapiens
tgtgtgcccagcacctggagg

SEQ ID NO: 1792002 - DNA, 14 bp, Homo sapiens
tgtgtgcgctgcct

SEQ ID NO: 1792003 - DNA, 21 bp, Homo sapiens
tgtgtgcgtgtttgggttttt

SEQ ID NO: 1792004 - DNA, 18 bp, Homo sapiens
tgtgtgctgactgaacat

SEQ ID NO: 1792005 - DNA, 21 bp, Homo sapiens
tgtgtgcttacagtaactaat

SEQ ID NO: 1792006 - DNA, 16 bp, Homo sapiens
tgtgtggactgtgatg

SEQ ID NO: 1792007 - DNA, 19 bp, Homo sapiens
tgtgtggactgtgatgcca

SEQ ID NO: 1792008 - DNA, 23 bp, Homo sapiens
tgtgtggactgtggcacttgcct

SEQ ID NO: 1792009 - DNA, 19 bp, Homo sapiens
tgtgtggcagggggccccg

SEQ ID NO: 1792010 - DNA, 11 bp, Homo sapiens
tgtgtggcctg

SEQ ID NO: 1792011 - DNA, 22 bp, Homo sapiens
tgtgtggctgccccacctgccg

SEQ ID NO: 1792012 - DNA, 15 bp, Homo sapiens
tgtgtggctgtgggt

SEQ ID NO: 1792013 - DNA, 14 bp, Homo sapiens
tgtgtgggagtgtg

SEQ ID NO: 1792014 - DNA, 16 bp, Homo sapiens
tgtgtgggagtgtgta

SEQ ID NO: 1792015 - DNA, 15 bp, Homo sapiens
tgtgtgggatactta

SEQ ID NO: 1792016 - DNA, 12 bp, Homo sapiens
tgtgtgggcagg

SEQ ID NO: 1792017 - DNA, 14 bp, Homo sapiens
tgtgtgtatacatg

SEQ ID NO: 1792018 - DNA, 14 bp, Homo sapiens
tgtgtgtatgctga

SEQ ID NO: 1792019 - DNA, 11 bp, Homo sapiens
tgtgtgtatgt

SEQ ID NO: 1792020 - DNA, 19 bp, Homo sapiens
tgtgtgtattcagaggcag

SEQ ID NO: 1792021 - DNA, 13 bp, Homo sapiens
tgtgtgtatttgc

SEQ ID NO: 1792022 - DNA, 14 bp, Homo sapiens
tgtgtgtatttgct

SEQ ID NO: 1792023 - DNA, 15 bp, Homo sapiens
tgtgtgtatttgtat

SEQ ID NO: 1792024 - DNA, 15 bp, Homo sapiens
tgtgtgtatttgtgt

SEQ ID NO: 1792025 - DNA, 19 bp, Homo sapiens
tgtgtgtccaaaactgcct

SEQ ID NO: 1792026 - DNA, 15 bp, Homo sapiens
tgtgtgtcccaggca

SEQ ID NO: 1792027 - DNA, 16 bp, Homo sapiens
tgtgtgtcccaggcag

SEQ ID NO: 1792028 - DNA, 14 bp, Homo sapiens
tgtgtgtctgcttt

SEQ ID NO: 1792029 - DNA, 16 bp, Homo sapiens
tgtgtgtgacaattct

SEQ ID NO: 1792030 - DNA, 12 bp, Homo sapiens
tgtgtgtgagct

SEQ ID NO: 1792031 - DNA, 13 bp, Homo sapiens
tgtgtgtgcatgt

SEQ ID NO: 1792032 - DNA, 13 bp, Homo sapiens
tgtgtgtgcgtgt

SEQ ID NO: 1792033 - DNA, 21 bp, Homo sapiens
tgtgtgtggaaggcacccgcc

SEQ ID NO: 1792034 - DNA, 14 bp, Homo sapiens
tgtgtgtggcaggg

SEQ ID NO: 1792035 - DNA, 20 bp, Homo sapiens
tgtgtgtgggagtgtgtaat

SEQ ID NO: 1792036 - DNA, 11 bp, Homo sapiens
tgtgtgtgtat

SEQ ID NO: 1792037 - DNA, 15 bp, Homo sapiens
tgtgtgtgtgcacat

SEQ ID NO: 1792038 - DNA, 11 bp, Homo sapiens
tgtgtgtgtgt

SEQ ID NO: 1792039 - DNA, 12 bp, Homo sapiens
tgtgtgtgtgtg

SEQ ID NO: 1792040 - DNA, 14 bp, Homo sapiens
tgtgtgtgtgtgca

SEQ ID NO: 1792041 - DNA, 21 bp, Homo sapiens
tgttagtttagtgtgtgtgca

SEQ ID NO: 1792042 - DNA, 15 bp, Homo sapiens
tgttataactctgca

SEQ ID NO: 1792043 - DNA, 18 bp, Homo sapiens
tgttataactctgcacta

SEQ ID NO: 1792044 - DNA, 23 bp, Homo sapiens
tgttataactctgcactactcct

SEQ ID NO: 1792045 - DNA, 15 bp, Homo sapiens
tgttatagaatactt

SEQ ID NO: 1792046 - DNA, 19 bp, Homo sapiens
tgttatatataataaatac

SEQ ID NO: 1792047 - DNA, 15 bp, Homo sapiens
tgttatatcatatgt

SEQ ID NO: 1792048 - DNA, 13 bp, Homo sapiens
tgttatcaaactt

SEQ ID NO: 1792049 - DNA, 12 bp, Homo sapiens
tgttatcaaata

SEQ ID NO: 1792050 - DNA, 22 bp, Homo sapiens
tgttatcctgctagctgtagaa

SEQ ID NO: 1792051 - DNA, 23 bp, Homo sapiens
tgttatcctgctagctgtagaaa

SEQ ID NO: 1792052 - DNA, 15 bp, Homo sapiens
tgttatcttctcaag

SEQ ID NO: 1792053 - DNA, 16 bp, Homo sapiens
tgttatcttctcaagt

SEQ ID NO: 1792054 - DNA, 15 bp, Homo sapiens
tgttatgaacagctg

SEQ ID NO: 1792055 - DNA, 16 bp, Homo sapiens
tgttatgaacagctgt

SEQ ID NO: 1792056 - DNA, 20 bp, Homo sapiens
tgttatgaacagctgtgtct

SEQ ID NO: 1792057 - DNA, 24 bp, Homo sapiens
tgttatgaacagctgtgtctgcca

SEQ ID NO: 1792058 - DNA, 15 bp, Homo sapiens
tgttatgcactgtgg

SEQ ID NO: 1792059 - DNA, 19 bp, Homo sapiens
tgttatgtccagaaattgt

SEQ ID NO: 1792060 - DNA, 18 bp, Homo sapiens
tgttattacttgtaaata

SEQ ID NO: 1792061 - DNA, 21 bp, Homo sapiens
tgttattatagagcagaaatt

SEQ ID NO: 1792062 - DNA, 15 bp, Homo sapiens
tgttattatatttga

SEQ ID NO: 1792063 - DNA, 19 bp, Homo sapiens
tgttattatatttgacatg

SEQ ID NO: 1792064 - DNA, 15 bp, Homo sapiens
tgttattattcatta

SEQ ID NO: 1792065 - DNA, 19 bp, Homo sapiens
tgttattattttgcactgt

SEQ ID NO: 1792066 - DNA, 21 bp, Homo sapiens
tgttattgggcaagtgattga

SEQ ID NO: 1792067 - DNA, 15 bp, Homo sapiens
tgttattgtggaaga

SEQ ID NO: 1792068 - DNA, 16 bp, Homo sapiens
tgttattgttttgtta

SEQ ID NO: 1792069 - DNA, 15 bp, Homo sapiens
tgttatttaaatgag

SEQ ID NO: 1792070 - DNA, 15 bp, Homo sapiens
tgttatttccccagc

SEQ ID NO: 1792071 - DNA, 19 bp, Homo sapiens
tgttattttctttgaaatt

SEQ ID NO: 1792072 - DNA, 14 bp, Homo sapiens
tgttatttttacag

SEQ ID NO: 1792073 - DNA, 16 bp, Homo sapiens
tgttatttttgtttct

SEQ ID NO: 1792074 - DNA, 18 bp, Homo sapiens
tgttcaaagatgcatttt

SEQ ID NO: 1792075 - DNA, 22 bp, Homo sapiens
tgttcaaagccacattatttct

SEQ ID NO: 1792076 - DNA, 21 bp, Homo sapiens
tgttcaagcgattctcctgcc

SEQ ID NO: 1792077 - DNA, 22 bp, Homo sapiens
tgttcaatatcagctttgataa

SEQ ID NO: 1792078 - DNA, 15 bp, Homo sapiens
tgttcaatgttccat

SEQ ID NO: 1792079 - DNA, 19 bp, Homo sapiens
tgttcacaaactacctctg

SEQ ID NO: 1792080 - DNA, 14 bp, Homo sapiens
tgttcacaaactgt

SEQ ID NO: 1792081 - DNA, 17 bp, Homo sapiens
tgttcacaaactgtgaa

SEQ ID NO: 1792082 - DNA, 19 bp, Homo sapiens
tgttcacagtctctggaaa

SEQ ID NO: 1792083 - DNA, 18 bp, Homo sapiens
tgttcactgaaggtgatt

SEQ ID NO: 1792084 - DNA, 16 bp, Homo sapiens
tgttcacttttcctcc

SEQ ID NO: 1792085 - DNA, 19 bp, Homo sapiens
tgttcacttttcctccctc

SEQ ID NO: 1792086 - DNA, 22 bp, Homo sapiens
tgttcagaaggttgctctagat

SEQ ID NO: 1792087 - DNA, 19 bp, Homo sapiens
tgttcagaattaagcagaa

SEQ ID NO: 1792088 - DNA, 16 bp, Homo sapiens
tgttcagcagaacctg

SEQ ID NO: 1792089 - DNA, 18 bp, Homo sapiens
tgttcagccactgaggga

SEQ ID NO: 1792090 - DNA, 19 bp, Homo sapiens
tgttcagccactgagggac

SEQ ID NO: 1792091 - DNA, 19 bp, Homo sapiens
tgttcagctctttccaaat

SEQ ID NO: 1792092 - DNA, 21 bp, Homo sapiens
tgttcaggaaaaggttgaata

SEQ ID NO: 1792093 - DNA, 18 bp, Homo sapiens
tgttcagtgagatatcat

SEQ ID NO: 1792094 - DNA, 14 bp, Homo sapiens
tgttcataataaaa

SEQ ID NO: 1792095 - DNA, 14 bp, Homo sapiens
tgttcatacatatt

SEQ ID NO: 1792096 - DNA, 23 bp, Homo sapiens
tgttcatacatatttttgtagca

SEQ ID NO: 1792097 - DNA, 19 bp, Homo sapiens
tgttcatagcccagtagac

SEQ ID NO: 1792098 - DNA, 23 bp, Homo sapiens
tgttcatagcccagtagaccttg

SEQ ID NO: 1792099 - DNA, 16 bp, Homo sapiens
tgttcatatgtacttg

SEQ ID NO: 1792100 - DNA, 22 bp, Homo sapiens
tgttcattaaagcatgaatggt

SEQ ID NO: 1792101 - DNA, 20 bp, Homo sapiens
tgttcattataatctcaaag

SEQ ID NO: 1792102 - DNA, 16 bp, Homo sapiens
tgttcattcaagctat

SEQ ID NO: 1792103 - DNA, 20 bp, Homo sapiens
tgttcattcaagctatttaa

SEQ ID NO: 1792104 - DNA, 17 bp, Homo sapiens
tgttcattttgagctga

SEQ ID NO: 1792105 - DNA, 19 bp, Homo sapiens
tgttccaaaccctcctggg

SEQ ID NO: 1792106 - DNA, 21 bp, Homo sapiens
tgttccaaaccctcctgggaa

SEQ ID NO: 1792107 - DNA, 13 bp, Homo sapiens
tgttccaacctcc

SEQ ID NO: 1792108 - DNA, 17 bp, Homo sapiens
tgttccaacctcctgct

SEQ ID NO: 1792109 - DNA, 21 bp, Homo sapiens
tgttccaacctcctgctctgg

SEQ ID NO: 1792110 - DNA, 19 bp, Homo sapiens
tgttccacaagttaaataa

SEQ ID NO: 1792111 - DNA, 17 bp, Homo sapiens
tgttccacttgtttgca

SEQ ID NO: 1792112 - DNA, 22 bp, Homo sapiens
tgttccagactcaggttccaga

SEQ ID NO: 1792113 - DNA, 20 bp, Homo sapiens
tgttcccaccaggctgctca

SEQ ID NO: 1792114 - DNA, 21 bp, Homo sapiens
tgttcccaccaggctgctcag

SEQ ID NO: 1792115 - DNA, 22 bp, Homo sapiens
tgttccccactgacagcctccc

SEQ ID NO: 1792116 - DNA, 15 bp, Homo sapiens
tgttcccctaagtgg

SEQ ID NO: 1792117 - DNA, 17 bp, Homo sapiens
tgttcccctaagtggat

SEQ ID NO: 1792118 - DNA, 18 bp, Homo sapiens
tgttcccctaagtggatt

SEQ ID NO: 1792119 - DNA, 21 bp, Homo sapiens
tgttcccgagcgatagatggg

SEQ ID NO: 1792120 - DNA, 13 bp, Homo sapiens
tgttccctacccc

SEQ ID NO: 1792121 - DNA, 13 bp, Homo sapiens
tgttccctagaga

SEQ ID NO: 1792122 - DNA, 15 bp, Homo sapiens
tgttccctagagaga

SEQ ID NO: 1792123 - DNA, 18 bp, Homo sapiens
tgttccctagagagaata

SEQ ID NO: 1792124 - DNA, 18 bp, Homo sapiens
tgttccctctccctgttg

SEQ ID NO: 1792125 - DNA, 15 bp, Homo sapiens
tgttccctctggctt

SEQ ID NO: 1792126 - DNA, 13 bp, Homo sapiens
tgttccctgcacc

SEQ ID NO: 1792127 - DNA, 14 bp, Homo sapiens
tgttccctgcaccc

SEQ ID NO: 1792128 - DNA, 20 bp, Homo sapiens
tgttccctgcaccctggaaa

SEQ ID NO: 1792129 - DNA, 11 bp, Homo sapiens
tgttccctgga

SEQ ID NO: 1792130 - DNA, 19 bp, Homo sapiens
tgttccggcgtttatttct

SEQ ID NO: 1792131 - DNA, 14 bp, Homo sapiens
tgttcctcaaatca

SEQ ID NO: 1792132 - DNA, 23 bp, Homo sapiens
tgttcctcaaatcagtgataatt

SEQ ID NO: 1792133 - DNA, 21 bp, Homo sapiens
tgttcctcggtgggccagagc

SEQ ID NO: 1792134 - DNA, 16 bp, Homo sapiens
tgttcctgctgtattt

SEQ ID NO: 1792135 - DNA, 18 bp, Homo sapiens
tgttcctgctgtatttcc

SEQ ID NO: 1792136 - DNA, 18 bp, Homo sapiens
tgttcctggagttttgat

SEQ ID NO: 1792137 - DNA, 21 bp, Homo sapiens
tgttcctggagttttgatttg

SEQ ID NO: 1792138 - DNA, 13 bp, Homo sapiens
tgttcctggctga

SEQ ID NO: 1792139 - DNA, 14 bp, Homo sapiens
tgttcctggctgat

SEQ ID NO: 1792140 - DNA, 19 bp, Homo sapiens
tgttcctttctctgggctt

SEQ ID NO: 1792141 - DNA, 17 bp, Homo sapiens
tgttcctttttaaatgt

SEQ ID NO: 1792142 - DNA, 22 bp, Homo sapiens
tgttcgatgcctgcatgctgaa

SEQ ID NO: 1792143 - DNA, 20 bp, Homo sapiens
tgttcggaaggggttcctca

SEQ ID NO: 1792144 - DNA, 21 bp, Homo sapiens
tgttcggaaggggttcctcaa

SEQ ID NO: 1792145 - DNA, 22 bp, Homo sapiens
tgttcgtctttagttttgattt

SEQ ID NO: 1792146 - DNA, 13 bp, Homo sapiens
tgttctaaagctc

SEQ ID NO: 1792147 - DNA, 16 bp, Homo sapiens
tgttctaaagctctga

SEQ ID NO: 1792148 - DNA, 13 bp, Homo sapiens
tgttctaagatgt

SEQ ID NO: 1792149 - DNA, 12 bp, Homo sapiens
tgttctaaggct

SEQ ID NO: 1792150 - DNA, 15 bp, Homo sapiens
tgttctaaggctctg

SEQ ID NO: 1792151 - DNA, 16 bp, Homo sapiens
tgttctaaggctctga

SEQ ID NO: 1792152 - DNA, 18 bp, Homo sapiens
tgttctaaggctctgaga

SEQ ID NO: 1792153 - DNA, 14 bp, Homo sapiens
tgttctaagtttct

SEQ ID NO: 1792154 - DNA, 18 bp, Homo sapiens
tgttctaagtttctaaga

SEQ ID NO: 1792155 - DNA, 23 bp, Homo sapiens
tgttctaagtttctaagattcta

SEQ ID NO: 1792156 - DNA, 22 bp, Homo sapiens
tgttctaccgtggatttgtact

SEQ ID NO: 1792157 - DNA, 22 bp, Homo sapiens
tgttctagacttccccatcccg

SEQ ID NO: 1792158 - DNA, 19 bp, Homo sapiens
tgttctagattatgtcttt

SEQ ID NO: 1792159 - DNA, 21 bp, Homo sapiens
tgttctattaatcacctctct

SEQ ID NO: 1792160 - DNA, 22 bp, Homo sapiens
tgttctattaatcacctctctg

SEQ ID NO: 1792161 - DNA, 19 bp, Homo sapiens
tgttctatttaacaactgg

SEQ ID NO: 1792162 - DNA, 24 bp, Homo sapiens
tgttctatttaacaactgggtcat

SEQ ID NO: 1792163 - DNA, 16 bp, Homo sapiens
tgttctccattttcaa

SEQ ID NO: 1792164 - DNA, 19 bp, Homo sapiens
tgttctccattttcaagct

SEQ ID NO: 1792165 - DNA, 17 bp, Homo sapiens
tgttctcctgaatattt

SEQ ID NO: 1792166 - DNA, 17 bp, Homo sapiens
tgttctcggagtgtgta

SEQ ID NO: 1792167 - DNA, 14 bp, Homo sapiens
tgttctctgggaga

SEQ ID NO: 1792168 - DNA, 16 bp, Homo sapiens
tgttctctgggagaaa

SEQ ID NO: 1792169 - DNA, 13 bp, Homo sapiens
tgttctcttggct

SEQ ID NO: 1792170 - DNA, 13 bp, Homo sapiens
tgttctgcactga

SEQ ID NO: 1792171 - DNA, 17 bp, Homo sapiens
tgttctgcactgaaaag

SEQ ID NO: 1792172 - DNA, 16 bp, Homo sapiens
tgttctgctcctgctt

SEQ ID NO: 1792173 - DNA, 23 bp, Homo sapiens
tgttctgctcctgcttttctgtc

SEQ ID NO: 1792174 - DNA, 24 bp, Homo sapiens
tgttctgctcctgcttttctgtcc

SEQ ID NO: 1792175 - DNA, 13 bp, Homo sapiens
tgttctggccctc

SEQ ID NO: 1792176 - DNA, 21 bp, Homo sapiens
tgttctggggggacccagtgc

SEQ ID NO: 1792177 - DNA, 23 bp, Homo sapiens
tgttctggggggacccagtgcag

SEQ ID NO: 1792178 - DNA, 22 bp, Homo sapiens
tgttctgtaatggaactgaccc

SEQ ID NO: 1792179 - DNA, 19 bp, Homo sapiens
tgttctgtggttcctctgc

SEQ ID NO: 1792180 - DNA, 14 bp, Homo sapiens
tgttctgtgtcttt

SEQ ID NO: 1792181 - DNA, 18 bp, Homo sapiens
tgttctgttgtctgcgcc

SEQ ID NO: 1792182 - DNA, 10 bp, Homo sapiens
tgttctgttt

SEQ ID NO: 1792183 - DNA, 16 bp, Homo sapiens
tgttctgtttgttaaa

SEQ ID NO: 1792184 - DNA, 20 bp, Homo sapiens
tgttctgtttgttaaaactg

SEQ ID NO: 1792185 - DNA, 20 bp, Homo sapiens
tgttcttaaaaaaataaaat

SEQ ID NO: 1792186 - DNA, 21 bp, Homo sapiens
tgttcttaaaaaaataaaata

SEQ ID NO: 1792187 - DNA, 22 bp, Homo sapiens
tgttcttacctgtatgtctcca

SEQ ID NO: 1792188 - DNA, 15 bp, Homo sapiens
tgttcttagagtgta

SEQ ID NO: 1792189 - DNA, 20 bp, Homo sapiens
tgttcttagagtgtagctgt

SEQ ID NO: 1792190 - DNA, 17 bp, Homo sapiens
tgttcttaggtttactg

SEQ ID NO: 1792191 - DNA, 20 bp, Homo sapiens
tgttcttaggtttactgtga

SEQ ID NO: 1792192 - DNA, 18 bp, Homo sapiens
tgttcttcagtgtaatgt

SEQ ID NO: 1792193 - DNA, 14 bp, Homo sapiens
tgttcttccccaca

SEQ ID NO: 1792194 - DNA, 20 bp, Homo sapiens
tgttcttgaatcctctatta

SEQ ID NO: 1792195 - DNA, 14 bp, Homo sapiens
tgttcttgtattta

SEQ ID NO: 1792196 - DNA, 18 bp, Homo sapiens
tgttcttgtttttaagtt

SEQ ID NO: 1792197 - DNA, 16 bp, Homo sapiens
tgttctttagtttgct

SEQ ID NO: 1792198 - DNA, 13 bp, Homo sapiens
tgttctttgggga

SEQ ID NO: 1792199 - DNA, 13 bp, Homo sapiens
tgttctttgttta

SEQ ID NO: 1792200 - DNA, 16 bp, Homo sapiens
tgttcttttctattta

SEQ ID NO: 1792201 - DNA, 18 bp, Homo sapiens
tgttgaaaaagtttgttt

SEQ ID NO: 1792202 - DNA, 19 bp, Homo sapiens
tgttgaaaacccagactgt

SEQ ID NO: 1792203 - DNA, 15 bp, Homo sapiens
tgttgaaattatgta

SEQ ID NO: 1792204 - DNA, 14 bp, Homo sapiens
tgttgaacaaaata

SEQ ID NO: 1792205 - DNA, 15 bp, Homo sapiens
tgttgaacaaaataa

SEQ ID NO: 1792206 - DNA, 19 bp, Homo sapiens
tgttgaacaaaataaattg

SEQ ID NO: 1792207 - DNA, 15 bp, Homo sapiens
tgttgacaactgtga

SEQ ID NO: 1792208 - DNA, 14 bp, Homo sapiens
tgttgacagcttgg

SEQ ID NO: 1792209 - DNA, 23 bp, Homo sapiens
tgttgacattcggggtgatcctg

SEQ ID NO: 1792210 - DNA, 17 bp, Homo sapiens
tgttgacccttttttga

SEQ ID NO: 1792211 - DNA, 14 bp, Homo sapiens
tgttgaccttccca

SEQ ID NO: 1792212 - DNA, 23 bp, Homo sapiens
tgttgagcaagcagtagcatttg

SEQ ID NO: 1792213 - DNA, 18 bp, Homo sapiens
tgttgagtgttcatttta

SEQ ID NO: 1792214 - DNA, 19 bp, Homo sapiens
tgttgataaattccactgg

SEQ ID NO: 1792215 - DNA, 20 bp, Homo sapiens
tgttgatcatgtacttttta

SEQ ID NO: 1792216 - DNA, 12 bp, Homo sapiens
tgttgatcccaa

SEQ ID NO: 1792217 - DNA, 22 bp, Homo sapiens
tgttgattacataatcaaagct

SEQ ID NO: 1792218 - DNA, 23 bp, Homo sapiens
tgttgattacataatcaaagcta

SEQ ID NO: 1792219 - DNA, 20 bp, Homo sapiens
tgttgatttttactgtgttt

SEQ ID NO: 1792220 - DNA, 18 bp, Homo sapiens
tgttgcaaattattctag

SEQ ID NO: 1792221 - DNA, 16 bp, Homo sapiens
tgttgcaagatgtgaa

SEQ ID NO: 1792222 - DNA, 18 bp, Homo sapiens
tgttgcaagatgtgaatt

SEQ ID NO: 1792223 - DNA, 23 bp, Homo sapiens
tgttgcaagatgtgaattattga

SEQ ID NO: 1792224 - DNA, 17 bp, Homo sapiens
tgttgcaagtgcaataa

SEQ ID NO: 1792225 - DNA, 19 bp, Homo sapiens
tgttgcaccatctgcttgg

SEQ ID NO: 1792226 - DNA, 17 bp, Homo sapiens
tgttgcagatgggtgat

SEQ ID NO: 1792227 - DNA, 17 bp, Homo sapiens
tgttgcagtggcctggc

SEQ ID NO: 1792228 - DNA, 19 bp, Homo sapiens
tgttgccaaatatgtcctg

SEQ ID NO: 1792229 - DNA, 22 bp, Homo sapiens
tgttgccaaatatgtcctgggg

SEQ ID NO: 1792230 - DNA, 23 bp, Homo sapiens
tgttgccaaatatgtcctggggt

SEQ ID NO: 1792231 - DNA, 20 bp, Homo sapiens
tgttgccaagctccaagccc

SEQ ID NO: 1792232 - DNA, 21 bp, Homo sapiens
tgttgccaggttgcagctgct

SEQ ID NO: 1792233 - DNA, 14 bp, Homo sapiens
tgttgccatagccc

SEQ ID NO: 1792234 - DNA, 15 bp, Homo sapiens
tgttgccatgtgttt

SEQ ID NO: 1792235 - DNA, 20 bp, Homo sapiens
tgttgccatttctctgctta

SEQ ID NO: 1792236 - DNA, 17 bp, Homo sapiens
tgttgcccctttctctt

SEQ ID NO: 1792237 - DNA, 16 bp, Homo sapiens
tgttgccttcatcttc

SEQ ID NO: 1792238 - DNA, 19 bp, Homo sapiens
tgttgctcaaaaaatgagc

SEQ ID NO: 1792239 - DNA, 17 bp, Homo sapiens
tgttgctctaggaagac

SEQ ID NO: 1792240 - DNA, 13 bp, Homo sapiens
tgttgctcttgga

SEQ ID NO: 1792241 - DNA, 18 bp, Homo sapiens
tgttgctcttggaaagct

SEQ ID NO: 1792242 - DNA, 14 bp, Homo sapiens
tgttgctgatttta

SEQ ID NO: 1792243 - DNA, 10 bp, Homo sapiens
tgttgctgct

SEQ ID NO: 1792244 - DNA, 15 bp, Homo sapiens
tgttgctgtggctcc

SEQ ID NO: 1792245 - DNA, 16 bp, Homo sapiens
tgttgctgttgatgtt

SEQ ID NO: 1792246 - DNA, 16 bp, Homo sapiens
tgttgctttacagtta

SEQ ID NO: 1792247 - DNA, 18 bp, Homo sapiens
tgttgctttcttacctac

SEQ ID NO: 1792248 - DNA, 13 bp, Homo sapiens
tgttgcttttcaa

SEQ ID NO: 1792249 - DNA, 17 bp, Homo sapiens
tgttgcttttcaaatgt

SEQ ID NO: 1792250 - DNA, 20 bp, Homo sapiens
tgttgcttttgaaaagttga

SEQ ID NO: 1792251 - DNA, 21 bp, Homo sapiens
tgttggaaaagaatacagaaa

SEQ ID NO: 1792252 - DNA, 12 bp, Homo sapiens
tgttggaatgaa

SEQ ID NO: 1792253 - DNA, 18 bp, Homo sapiens
tgttggacagctgcttgt

SEQ ID NO: 1792254 - DNA, 14 bp, Homo sapiens
tgttggagaaagaa

SEQ ID NO: 1792255 - DNA, 14 bp, Homo sapiens
tgttggagcctgca

SEQ ID NO: 1792256 - DNA, 19 bp, Homo sapiens
tgttggataaatcagtggt

SEQ ID NO: 1792257 - DNA, 20 bp, Homo sapiens
tgttggatttgtttaaaagg

SEQ ID NO: 1792258 - DNA, 22 bp, Homo sapiens
tgttggcactcacagacctgga

SEQ ID NO: 1792259 - DNA, 18 bp, Homo sapiens
tgttggcaggctggccag

SEQ ID NO: 1792260 - DNA, 21 bp, Homo sapiens
tgttggcaggctggccagtcc

SEQ ID NO: 1792261 - DNA, 14 bp, Homo sapiens
tgttggccaggctg

SEQ ID NO: 1792262 - DNA, 13 bp, Homo sapiens
tgttggctgctcc

SEQ ID NO: 1792263 - DNA, 16 bp, Homo sapiens
tgttggctgctcccca

SEQ ID NO: 1792264 - DNA, 14 bp, Homo sapiens
tgttggctgtgtga

SEQ ID NO: 1792265 - DNA, 16 bp, Homo sapiens
tgttggctgtgtgaca

SEQ ID NO: 1792266 - DNA, 19 bp, Homo sapiens
tgttgggaaacttggctcg

SEQ ID NO: 1792267 - DNA, 19 bp, Homo sapiens
tgttgggacctgctgctcc

SEQ ID NO: 1792268 - DNA, 15 bp, Homo sapiens
tgttgggattcctga

SEQ ID NO: 1792269 - DNA, 21 bp, Homo sapiens
tgttggtaattattttggtac

SEQ ID NO: 1792270 - DNA, 18 bp, Homo sapiens
tgttggtcctctctctgt

SEQ ID NO: 1792271 - DNA, 22 bp, Homo sapiens
tgttggttaccctcctagcttt

SEQ ID NO: 1792272 - DNA, 17 bp, Homo sapiens
tgttggttcaaactttt

SEQ ID NO: 1792273 - DNA, 22 bp, Homo sapiens
tgttggttttttataaagtcta

SEQ ID NO: 1792274 - DNA, 23 bp, Homo sapiens
tgttgtaaaacaaaatttgacta

SEQ ID NO: 1792275 - DNA, 18 bp, Homo sapiens
tgttgtaagaattctgat

SEQ ID NO: 1792276 - DNA, 18 bp, Homo sapiens
tgttgtaataaaacttat

SEQ ID NO: 1792277 - DNA, 21 bp, Homo sapiens
tgttgtacatacgatttaagg

SEQ ID NO: 1792278 - DNA, 15 bp, Homo sapiens
tgttgtacttaaatg

SEQ ID NO: 1792279 - DNA, 16 bp, Homo sapiens
tgttgtacttaaatgg

SEQ ID NO: 1792280 - DNA, 21 bp, Homo sapiens
tgttgtagattgattgtattg

SEQ ID NO: 1792281 - DNA, 15 bp, Homo sapiens
tgttgtatctttgta

SEQ ID NO: 1792282 - DNA, 12 bp, Homo sapiens
tgttgtcaagga

SEQ ID NO: 1792283 - DNA, 17 bp, Homo sapiens
tgttgtcatgcattggt

SEQ ID NO: 1792284 - DNA, 20 bp, Homo sapiens
tgttgtctgcgcctgaaaag

SEQ ID NO: 1792285 - DNA, 16 bp, Homo sapiens
tgttgtcttgaaagat

SEQ ID NO: 1792286 - DNA, 16 bp, Homo sapiens
tgttgtcttttttatg

SEQ ID NO: 1792287 - DNA, 12 bp, Homo sapiens
tgttgtgaatgt

SEQ ID NO: 1792288 - DNA, 13 bp, Homo sapiens
tgttgtgagcttt

SEQ ID NO: 1792289 - DNA, 15 bp, Homo sapiens
tgttgtgtgtgcagg

SEQ ID NO: 1792290 - DNA, 16 bp, Homo sapiens
tgttgtgtgtgggagt

SEQ ID NO: 1792291 - DNA, 11 bp, Homo sapiens
tgttgttattt

SEQ ID NO: 1792292 - DNA, 13 bp, Homo sapiens
tgttgttatttaa

SEQ ID NO: 1792293 - DNA, 15 bp, Homo sapiens
tgttgttccatttta

SEQ ID NO: 1792294 - DNA, 17 bp, Homo sapiens
tgttgttccattttatg

SEQ ID NO: 1792295 - DNA, 19 bp, Homo sapiens
tgttgttcctctatacttt

SEQ ID NO: 1792296 - DNA, 22 bp, Homo sapiens
tgttgttcctctatactttgtt

SEQ ID NO: 1792297 - DNA, 11 bp, Homo sapiens
tgttgttgtgt

SEQ ID NO: 1792298 - DNA, 16 bp, Homo sapiens
tgttgttgttgctgct

SEQ ID NO: 1792299 - DNA, 12 bp, Homo sapiens
tgttgtttgtaa

SEQ ID NO: 1792300 - DNA, 14 bp, Homo sapiens
tgttgtttgtaaat

SEQ ID NO: 1792301 - DNA, 15 bp, Homo sapiens
tgttgtttgtaaata

SEQ ID NO: 1792302 - DNA, 18 bp, Homo sapiens
tgttgttttactaaagaa

SEQ ID NO: 1792303 - DNA, 21 bp, Homo sapiens
tgtttaaaactcagaatataa

SEQ ID NO: 1792304 - DNA, 14 bp, Homo sapiens
tgtttaaaatcatt

SEQ ID NO: 1792305 - DNA, 17 bp, Homo sapiens
tgtttaaaatcatttct

SEQ ID NO: 1792306 - DNA, 14 bp, Homo sapiens
tgtttaaaatgtaa

SEQ ID NO: 1792307 - DNA, 22 bp, Homo sapiens
tgtttaaaatgtaatttaaatg

SEQ ID NO: 1792308 - DNA, 23 bp, Homo sapiens
tgtttaaaccactagttgatgta

SEQ ID NO: 1792309 - DNA, 18 bp, Homo sapiens
tgtttaaatagcctaaat

SEQ ID NO: 1792310 - DNA, 22 bp, Homo sapiens
tgtttaacaaatctaatctctt

SEQ ID NO: 1792311 - DNA, 18 bp, Homo sapiens
tgtttaacaacatggctt

SEQ ID NO: 1792312 - DNA, 16 bp, Homo sapiens
tgtttaatattgagaa

SEQ ID NO: 1792313 - DNA, 20 bp, Homo sapiens
tgtttaatgggtatgctcag

SEQ ID NO: 1792314 - DNA, 17 bp, Homo sapiens
tgtttacatttgatgca

SEQ ID NO: 1792315 - DNA, 16 bp, Homo sapiens
tgtttacgatttcact

SEQ ID NO: 1792316 - DNA, 21 bp, Homo sapiens
tgtttacgatttcactaggac

SEQ ID NO: 1792317 - DNA, 12 bp, Homo sapiens
tgtttactgctt

SEQ ID NO: 1792318 - DNA, 12 bp, Homo sapiens
tgtttactgtaa

SEQ ID NO: 1792319 - DNA, 14 bp, Homo sapiens
tgtttactgtaaat

SEQ ID NO: 1792320 - DNA, 15 bp, Homo sapiens
tgtttacttaaagat

SEQ ID NO: 1792321 - DNA, 19 bp, Homo sapiens
tgtttacttaaagatttat

SEQ ID NO: 1792322 - DNA, 22 bp, Homo sapiens
tgtttagaacactggtttaaag

SEQ ID NO: 1792323 - DNA, 16 bp, Homo sapiens
tgtttagaagaagtgt

SEQ ID NO: 1792324 - DNA, 13 bp, Homo sapiens
tgtttagagagcc

SEQ ID NO: 1792325 - DNA, 20 bp, Homo sapiens
tgtttagagagcctgtcacc

SEQ ID NO: 1792326 - DNA, 22 bp, Homo sapiens
tgtttagagagcctgtcaccag

SEQ ID NO: 1792327 - DNA, 20 bp, Homo sapiens
tgtttagcctgaaaaccttt

SEQ ID NO: 1792328 - DNA, 17 bp, Homo sapiens
tgtttagcgaacttgta

SEQ ID NO: 1792329 - DNA, 17 bp, Homo sapiens
tgtttagtgatattaca

SEQ ID NO: 1792330 - DNA, 22 bp, Homo sapiens
tgtttataaaatataaacaaag

SEQ ID NO: 1792331 - DNA, 21 bp, Homo sapiens
tgtttatgagccagacaaatg

SEQ ID NO: 1792332 - DNA, 22 bp, Homo sapiens
tgtttatgatatttcttgcttt

SEQ ID NO: 1792333 - DNA, 21 bp, Homo sapiens
tgtttatgcaaggaaggaaag

SEQ ID NO: 1792334 - DNA, 14 bp, Homo sapiens
tgtttatggcctca

SEQ ID NO: 1792335 - DNA, 16 bp, Homo sapiens
tgtttatggtaaaaaa

SEQ ID NO: 1792336 - DNA, 18 bp, Homo sapiens
tgtttatgtgttatgaac

SEQ ID NO: 1792337 - DNA, 15 bp, Homo sapiens
tgtttatgtttaaaa

SEQ ID NO: 1792338 - DNA, 16 bp, Homo sapiens
tgtttattaaatgctt

SEQ ID NO: 1792339 - DNA, 13 bp, Homo sapiens
tgtttattaacaa

SEQ ID NO: 1792340 - DNA, 14 bp, Homo sapiens
tgtttattaacaaa

SEQ ID NO: 1792341 - DNA, 19 bp, Homo sapiens
tgtttattaacaaattatg

SEQ ID NO: 1792342 - DNA, 18 bp, Homo sapiens
tgtttattaactactgaa

SEQ ID NO: 1792343 - DNA, 22 bp, Homo sapiens
tgtttattacaatttttaataa

SEQ ID NO: 1792344 - DNA, 16 bp, Homo sapiens
tgtttattcaaactga

SEQ ID NO: 1792345 - DNA, 16 bp, Homo sapiens
tgtttattcttccaga

SEQ ID NO: 1792346 - DNA, 18 bp, Homo sapiens
tgtttattcttccagaat

SEQ ID NO: 1792347 - DNA, 15 bp, Homo sapiens
tgtttatttaaggat

SEQ ID NO: 1792348 - DNA, 22 bp, Homo sapiens
tgtttatttaaggatggatggc

SEQ ID NO: 1792349 - DNA, 20 bp, Homo sapiens
tgtttatttattcactgtaa

SEQ ID NO: 1792350 - DNA, 22 bp, Homo sapiens
tgtttatttatttccagtggtc

SEQ ID NO: 1792351 - DNA, 19 bp, Homo sapiens
tgtttcaaacacaaatgca

SEQ ID NO: 1792352 - DNA, 17 bp, Homo sapiens
tgtttcaaactgaattt

SEQ ID NO: 1792353 - DNA, 15 bp, Homo sapiens
tgtttcaaggcactc

SEQ ID NO: 1792354 - DNA, 20 bp, Homo sapiens
tgtttcaaggcactctagat

SEQ ID NO: 1792355 - DNA, 21 bp, Homo sapiens
tgtttcaaggcactctagatt

SEQ ID NO: 1792356 - DNA, 19 bp, Homo sapiens
tgtttcaatgacctgtatt

SEQ ID NO: 1792357 - DNA, 15 bp, Homo sapiens
tgtttcagacccccc

SEQ ID NO: 1792358 - DNA, 13 bp, Homo sapiens
tgtttcagtgtga

SEQ ID NO: 1792359 - DNA, 12 bp, Homo sapiens
tgtttcattatg

SEQ ID NO: 1792360 - DNA, 15 bp, Homo sapiens
tgtttcatttctgca

SEQ ID NO: 1792361 - DNA, 20 bp, Homo sapiens
tgtttccagaattggtaaaa

SEQ ID NO: 1792362 - DNA, 18 bp, Homo sapiens
tgtttccagcagaagaca

SEQ ID NO: 1792363 - DNA, 20 bp, Homo sapiens
tgtttccagcagaagacaaa

SEQ ID NO: 1792364 - DNA, 17 bp, Homo sapiens
tgtttccagcttgcatt

SEQ ID NO: 1792365 - DNA, 21 bp, Homo sapiens
tgtttccagtacacctttcag

SEQ ID NO: 1792366 - DNA, 20 bp, Homo sapiens
tgtttccctacttgataata

SEQ ID NO: 1792367 - DNA, 14 bp, Homo sapiens
tgtttccctgctga

SEQ ID NO: 1792368 - DNA, 15 bp, Homo sapiens
tgtttcccttgcttt

SEQ ID NO: 1792369 - DNA, 19 bp, Homo sapiens
tgtttcccttgctttgttt

SEQ ID NO: 1792370 - DNA, 23 bp, Homo sapiens
tgtttcccttgctttgttttaat

SEQ ID NO: 1792371 - DNA, 20 bp, Homo sapiens
tgtttcctatttaatacagc

SEQ ID NO: 1792372 - DNA, 14 bp, Homo sapiens
tgtttcctctagtt

SEQ ID NO: 1792373 - DNA, 14 bp, Homo sapiens
tgtttcctctgttc

SEQ ID NO: 1792374 - DNA, 16 bp, Homo sapiens
tgtttcctcttccaaa

SEQ ID NO: 1792375 - DNA, 12 bp, Homo sapiens
tgtttcctggaa

SEQ ID NO: 1792376 - DNA, 15 bp, Homo sapiens
tgtttccttaaacat

SEQ ID NO: 1792377 - DNA, 15 bp, Homo sapiens
tgtttcgtgaagtat

SEQ ID NO: 1792378 - DNA, 14 bp, Homo sapiens
tgtttctaagaaaa

SEQ ID NO: 1792379 - DNA, 14 bp, Homo sapiens
tgtttctaagagca

SEQ ID NO: 1792380 - DNA, 17 bp, Homo sapiens
ttaagataacttactgt

SEQ ID NO: 1792381 - DNA, 19 bp, Homo sapiens
ttaagataataatatatgt

SEQ ID NO: 1792382 - DNA, 15 bp, Homo sapiens
ttaagatacaaatta

SEQ ID NO: 1792383 - DNA, 14 bp, Homo sapiens
ttaagatagaacac

SEQ ID NO: 1792384 - DNA, 15 bp, Homo sapiens
ttaagatctgactgc

SEQ ID NO: 1792385 - DNA, 13 bp, Homo sapiens
ttaagatggcaat

SEQ ID NO: 1792386 - DNA, 21 bp, Homo sapiens
ttaagatggcaattactttgg

SEQ ID NO: 1792387 - DNA, 11 bp, Homo sapiens
ttaagatgtga

SEQ ID NO: 1792388 - DNA, 14 bp, Homo sapiens
ttaagatgtgaaaa

SEQ ID NO: 1792389 - DNA, 23 bp, Homo sapiens
ttaagcaaaggggacagctgtgt

SEQ ID NO: 1792390 - DNA, 19 bp, Homo sapiens
ttaagcaaatgttaaaagt

SEQ ID NO: 1792391 - DNA, 21 bp, Homo sapiens
ttaagcaaggtgtccctgcct

SEQ ID NO: 1792392 - DNA, 18 bp, Homo sapiens
ttaagcagaacaaatgtg

SEQ ID NO: 1792393 - DNA, 19 bp, Homo sapiens
ttaagcagaacaaatgtgt

SEQ ID NO: 1792394 - DNA, 19 bp, Homo sapiens
ttaagcagcatggaaaaat

SEQ ID NO: 1792395 - DNA, 16 bp, Homo sapiens
ttaagcaggtttgttt

SEQ ID NO: 1792396 - DNA, 22 bp, Homo sapiens
ttaagcatctggctctaattca

SEQ ID NO: 1792397 - DNA, 14 bp, Homo sapiens
ttaagcatttattt

SEQ ID NO: 1792398 - DNA, 22 bp, Homo sapiens
ttaagcattttgaaacaaagta

SEQ ID NO: 1792399 - DNA, 20 bp, Homo sapiens
ttaagccctttgctctggag

SEQ ID NO: 1792400 - DNA, 15 bp, Homo sapiens
ttaagcctaaagatt

SEQ ID NO: 1792401 - DNA, 19 bp, Homo sapiens
ttaagctgcaaatctgatg

SEQ ID NO: 1792402 - DNA, 21 bp, Homo sapiens
ttaagctgttcctgttcagta

SEQ ID NO: 1792403 - DNA, 13 bp, Homo sapiens
ttaagctttttgg

SEQ ID NO: 1792404 - DNA, 16 bp, Homo sapiens
ttaagctttttggaat

SEQ ID NO: 1792405 - DNA, 14 bp, Homo sapiens
ttaaggaaacaata

SEQ ID NO: 1792406 - DNA, 23 bp, Homo sapiens
ttaaggagatagacgggttgaaa

SEQ ID NO: 1792407 - DNA, 22 bp, Homo sapiens
ttaaggagcaaaaatctgagaa

SEQ ID NO: 1792408 - DNA, 16 bp, Homo sapiens
ttaaggatggatggca

SEQ ID NO: 1792409 - DNA, 20 bp, Homo sapiens
ttaaggatggatggcaccct

SEQ ID NO: 1792410 - DNA, 17 bp, Homo sapiens
ttaaggcacagtgggag

SEQ ID NO: 1792411 - DNA, 20 bp, Homo sapiens
ttaaggcacagtgggagctg

SEQ ID NO: 1792412 - DNA, 21 bp, Homo sapiens
ttaaggcacagtgggagctga

SEQ ID NO: 1792413 - DNA, 21 bp, Homo sapiens
ttaagggatggaaaaggaaga

SEQ ID NO: 1792414 - DNA, 18 bp, Homo sapiens
ttaaggggaagaatgaaa

SEQ ID NO: 1792415 - DNA, 18 bp, Homo sapiens
ttaaggggtatcatgtat

SEQ ID NO: 1792416 - DNA, 20 bp, Homo sapiens
ttaaggtgagcataaatcaa

SEQ ID NO: 1792417 - DNA, 20 bp, Homo sapiens
ttaaggtttgcaaattaaaa

SEQ ID NO: 1792418 - DNA, 13 bp, Homo sapiens
ttaagtaaatgct

SEQ ID NO: 1792419 - DNA, 17 bp, Homo sapiens
ttaagtaagacttttat

SEQ ID NO: 1792420 - DNA, 14 bp, Homo sapiens
ttaagtatatagta

SEQ ID NO: 1792421 - DNA, 15 bp, Homo sapiens
ttaagtatatagtat

SEQ ID NO: 1792422 - DNA, 19 bp, Homo sapiens
ttaagtatcttttttcaaa

SEQ ID NO: 1792423 - DNA, 11 bp, Homo sapiens
ttaagtattta

SEQ ID NO: 1792424 - DNA, 21 bp, Homo sapiens
ttaagtcttccttaaatgact

SEQ ID NO: 1792425 - DNA, 19 bp, Homo sapiens
ttaagtgaaggagaagtct

SEQ ID NO: 1792426 - DNA, 12 bp, Homo sapiens
ttaagtgacaca

SEQ ID NO: 1792427 - DNA, 15 bp, Homo sapiens
ttaagtgacacagac

SEQ ID NO: 1792428 - DNA, 19 bp, Homo sapiens
ttaagtgacacagacattt

SEQ ID NO: 1792429 - DNA, 22 bp, Homo sapiens
ttaagtgacacagacattttgt

SEQ ID NO: 1792430 - DNA, 15 bp, Homo sapiens
ttaagtgcctgagac

SEQ ID NO: 1792431 - DNA, 20 bp, Homo sapiens
ttaagtggtcccaatgctca

SEQ ID NO: 1792432 - DNA, 21 bp, Homo sapiens
ttaagtgttgtaaatatttat

SEQ ID NO: 1792433 - DNA, 14 bp, Homo sapiens
ttaagtgtttctca

SEQ ID NO: 1792434 - DNA, 22 bp, Homo sapiens
ttaagttatagtgaatactgct

SEQ ID NO: 1792435 - DNA, 12 bp, Homo sapiens
ttaagttcttat

SEQ ID NO: 1792436 - DNA, 16 bp, Homo sapiens
ttaagttgtcaaagaa

SEQ ID NO: 1792437 - DNA, 15 bp, Homo sapiens
ttaagtttcaaactt

SEQ ID NO: 1792438 - DNA, 13 bp, Homo sapiens
ttaagtttgcact

SEQ ID NO: 1792439 - DNA, 13 bp, Homo sapiens
ttaagtttgtagt

SEQ ID NO: 1792440 - DNA, 18 bp, Homo sapiens
ttaagtttgtagtaaaag

SEQ ID NO: 1792441 - DNA, 19 bp, Homo sapiens
ttaagttttaaataaacct

SEQ ID NO: 1792442 - DNA, 18 bp, Homo sapiens
ttaataaaataaactaga

SEQ ID NO: 1792443 - DNA, 13 bp, Homo sapiens
ttaataaagacag

SEQ ID NO: 1792444 - DNA, 11 bp, Homo sapiens
ttaataaagca

SEQ ID NO: 1792445 - DNA, 16 bp, Homo sapiens
ttaataaagcattctt

SEQ ID NO: 1792446 - DNA, 15 bp, Homo sapiens
ttaataaatatgtaa

SEQ ID NO: 1792447 - DNA, 22 bp, Homo sapiens
ttaataaatatgtaatataaat

SEQ ID NO: 1792448 - DNA, 16 bp, Homo sapiens
ttaataacttgtccta

SEQ ID NO: 1792449 - DNA, 17 bp, Homo sapiens
ttaataagaacagatca

SEQ ID NO: 1792450 - DNA, 12 bp, Homo sapiens
ttaataatatgt

SEQ ID NO: 1792451 - DNA, 13 bp, Homo sapiens
ttaatacaaggta

SEQ ID NO: 1792452 - DNA, 16 bp, Homo sapiens
ttaatacacagtactt

SEQ ID NO: 1792453 - DNA, 20 bp, Homo sapiens
ttaatacacagtactttatt

SEQ ID NO: 1792454 - DNA, 14 bp, Homo sapiens
ttaatacaggaaat

SEQ ID NO: 1792455 - DNA, 22 bp, Homo sapiens
ttaatacagtttatttttaaag

SEQ ID NO: 1792456 - DNA, 23 bp, Homo sapiens
ttaataccagataccttatctta

SEQ ID NO: 1792457 - DNA, 16 bp, Homo sapiens
ttaatacccatgcttt

SEQ ID NO: 1792458 - DNA, 19 bp, Homo sapiens
ttaatactataaataatat

SEQ ID NO: 1792459 - DNA, 17 bp, Homo sapiens
ttaatactattaagcaa

SEQ ID NO: 1792460 - DNA, 14 bp, Homo sapiens
ttaatactgttatt

SEQ ID NO: 1792461 - DNA, 20 bp, Homo sapiens
ttaatactgttattctttgc

SEQ ID NO: 1792462 - DNA, 14 bp, Homo sapiens
ttaatagcagcctt

SEQ ID NO: 1792463 - DNA, 15 bp, Homo sapiens
ttaatagctgtgatc

SEQ ID NO: 1792464 - DNA, 15 bp, Homo sapiens
ttaatagtcattcca

SEQ ID NO: 1792465 - DNA, 16 bp, Homo sapiens
ttaatagtttgtctat

SEQ ID NO: 1792466 - DNA, 19 bp, Homo sapiens
ttaatagtttgtctatttt

SEQ ID NO: 1792467 - DNA, 14 bp, Homo sapiens
ttaatatactgcat

SEQ ID NO: 1792468 - DNA, 17 bp, Homo sapiens
ttaatatatacattttt

SEQ ID NO: 1792469 - DNA, 19 bp, Homo sapiens
ttaatatatgtattattta

SEQ ID NO: 1792470 - DNA, 13 bp, Homo sapiens
ttaatatattaaa

SEQ ID NO: 1792471 - DNA, 21 bp, Homo sapiens
ttaatatcactaatttcttct

SEQ ID NO: 1792472 - DNA, 14 bp, Homo sapiens
ttaatatctggcac

SEQ ID NO: 1792473 - DNA, 15 bp, Homo sapiens
ttaatatgagcttca

SEQ ID NO: 1792474 - DNA, 20 bp, Homo sapiens
ttaatatgagcttcaatata

SEQ ID NO: 1792475 - DNA, 17 bp, Homo sapiens
ttaatatggtgtatttt

SEQ ID NO: 1792476 - DNA, 14 bp, Homo sapiens
ttaatatgtctttt

SEQ ID NO: 1792477 - DNA, 23 bp, Homo sapiens
ttaatattactgtctttattctt

SEQ ID NO: 1792478 - DNA, 15 bp, Homo sapiens
ttaatattctattaa

SEQ ID NO: 1792479 - DNA, 22 bp, Homo sapiens
ttaatattgatatgcttataca

SEQ ID NO: 1792480 - DNA, 17 bp, Homo sapiens
ttaatatttaacattat

SEQ ID NO: 1792481 - DNA, 12 bp, Homo sapiens
ttaatatttgct

SEQ ID NO: 1792482 - DNA, 17 bp, Homo sapiens
ttaatattttgtatttt

SEQ ID NO: 1792483 - DNA, 19 bp, Homo sapiens
ttaatattttgtattttca

SEQ ID NO: 1792484 - DNA, 18 bp, Homo sapiens
ttaatcaaaggcatatct

SEQ ID NO: 1792485 - DNA, 16 bp, Homo sapiens
ttaatcaagagaaact

SEQ ID NO: 1792486 - DNA, 20 bp, Homo sapiens
ttaatcacattttgtatgga

SEQ ID NO: 1792487 - DNA, 20 bp, Homo sapiens
ttaatcacctctctgtagtt

SEQ ID NO: 1792488 - DNA, 13 bp, Homo sapiens
ttaatcagtgaag

SEQ ID NO: 1792489 - DNA, 22 bp, Homo sapiens
ttaatcagttcattagaaatat

SEQ ID NO: 1792490 - DNA, 14 bp, Homo sapiens
ttaatcatagatta

SEQ ID NO: 1792491 - DNA, 21 bp, Homo sapiens
ttaatcatagattattataaa

SEQ ID NO: 1792492 - DNA, 18 bp, Homo sapiens
ttaatcatctataaagaa

SEQ ID NO: 1792493 - DNA, 18 bp, Homo sapiens
ttaatcatgaatgtgtaa

SEQ ID NO: 1792494 - DNA, 12 bp, Homo sapiens
ttaatcattttt

SEQ ID NO: 1792495 - DNA, 20 bp, Homo sapiens
ttaatccagttataagaaga

SEQ ID NO: 1792496 - DNA, 21 bp, Homo sapiens
ttaatccagttataagaagaa

SEQ ID NO: 1792497 - DNA, 15 bp, Homo sapiens
ttaatcccagcactt

SEQ ID NO: 1792498 - DNA, 14 bp, Homo sapiens
ttaatctctaaaat

SEQ ID NO: 1792499 - DNA, 17 bp, Homo sapiens
ttaatctctaaaattct

SEQ ID NO: 1792500 - DNA, 22 bp, Homo sapiens
ttaatctggtttatttttgttc

SEQ ID NO: 1792501 - DNA, 11 bp, Homo sapiens
ttaatcttaag

SEQ ID NO: 1792502 - DNA, 16 bp, Homo sapiens
ttaatcttagtgtatg

SEQ ID NO: 1792503 - DNA, 19 bp, Homo sapiens
ttaatcttagtgtatgatt

SEQ ID NO: 1792504 - DNA, 20 bp, Homo sapiens
ttaatcttgcttcattgtta

SEQ ID NO: 1792505 - DNA, 15 bp, Homo sapiens
ttaatcttgctttct

SEQ ID NO: 1792506 - DNA, 12 bp, Homo sapiens
ttaatctttaaa

SEQ ID NO: 1792507 - DNA, 21 bp, Homo sapiens
ttaatctttctttacctgaga

SEQ ID NO: 1792508 - DNA, 24 bp, Homo sapiens
ttaatctttctttacctgagacca

SEQ ID NO: 1792509 - DNA, 17 bp, Homo sapiens
ttaatctttgaaaggtt

SEQ ID NO: 1792510 - DNA, 14 bp, Homo sapiens
ttaatgaaaatgtc

SEQ ID NO: 1792511 - DNA, 16 bp, Homo sapiens
ttaatgaaaatgtcag

SEQ ID NO: 1792512 - DNA, 20 bp, Homo sapiens
ttaatgaaagactgtacaaa

SEQ ID NO: 1792513 - DNA, 23 bp, Homo sapiens
ttaatgaaagactgtacaaagta

SEQ ID NO: 1792514 - DNA, 19 bp, Homo sapiens
ttaatgacagagccagtgg

SEQ ID NO: 1792515 - DNA, 15 bp, Homo sapiens
ttaatgagaatagaa

SEQ ID NO: 1792516 - DNA, 18 bp, Homo sapiens
ttaatgagtgcacctgcc

SEQ ID NO: 1792517 - DNA, 18 bp, Homo sapiens
ttaatgatgatcttcaga

SEQ ID NO: 1792518 - DNA, 22 bp, Homo sapiens
ttaatgcagttgcttactaaag

SEQ ID NO: 1792519 - DNA, 18 bp, Homo sapiens
ttaatgcctgctttttgg

SEQ ID NO: 1792520 - DNA, 14 bp, Homo sapiens
ttaatgctacatgt

SEQ ID NO: 1792521 - DNA, 15 bp, Homo sapiens
ttaatgctgtttcta

SEQ ID NO: 1792522 - DNA, 22 bp, Homo sapiens
ttaatgctgtttctaagaaaat

SEQ ID NO: 1792523 - DNA, 20 bp, Homo sapiens
ttaatggaaaccaagccaat

SEQ ID NO: 1792524 - DNA, 19 bp, Homo sapiens
ttaatgtacaagttttgta

SEQ ID NO: 1792525 - DNA, 21 bp, Homo sapiens
ttaatgtacaagttttgtata

SEQ ID NO: 1792526 - DNA, 18 bp, Homo sapiens
ttaatgtatctatttgta

SEQ ID NO: 1792527 - DNA, 18 bp, Homo sapiens
ttaatgtatgttaccaaa

SEQ ID NO: 1792528 - DNA, 12 bp, Homo sapiens
ttaatgtgaaga

SEQ ID NO: 1792529 - DNA, 22 bp, Homo sapiens
ttaatgttctgaataatttctt

SEQ ID NO: 1792530 - DNA, 23 bp, Homo sapiens
ttaatgttgaacaaaataaattg

SEQ ID NO: 1792531 - DNA, 17 bp, Homo sapiens
ttaatgtttattcctga

SEQ ID NO: 1792532 - DNA, 15 bp, Homo sapiens
ttaatgttttcaaaa

SEQ ID NO: 1792533 - DNA, 12 bp, Homo sapiens
ttaatgttttta

SEQ ID NO: 1792534 - DNA, 18 bp, Homo sapiens
ttaatgttttttgccaca

SEQ ID NO: 1792535 - DNA, 15 bp, Homo sapiens
ttaattacatacaga

SEQ ID NO: 1792536 - DNA, 16 bp, Homo sapiens
ttaattacatacagat

SEQ ID NO: 1792537 - DNA, 14 bp, Homo sapiens
ttaattattattct

SEQ ID NO: 1792538 - DNA, 14 bp, Homo sapiens
ttaattattattta

SEQ ID NO: 1792539 - DNA, 13 bp, Homo sapiens
ttaattcatgttt

SEQ ID NO: 1792540 - DNA, 13 bp, Homo sapiens
ttaattctgtctt

SEQ ID NO: 1792541 - DNA, 21 bp, Homo sapiens
ttaattcttcacctttgtaag

SEQ ID NO: 1792542 - DNA, 17 bp, Homo sapiens
ttaattctttgttctgt

SEQ ID NO: 1792543 - DNA, 18 bp, Homo sapiens
ttaattgcgtagaggcta

SEQ ID NO: 1792544 - DNA, 15 bp, Homo sapiens
ttaattgctttaaat

SEQ ID NO: 1792545 - DNA, 15 bp, Homo sapiens
ttaattgtaaagtaa

SEQ ID NO: 1792546 - DNA, 22 bp, Homo sapiens
ttaattgtagttctgtgtactt

SEQ ID NO: 1792547 - DNA, 16 bp, Homo sapiens
ttaattgtataagtca

SEQ ID NO: 1792548 - DNA, 15 bp, Homo sapiens
ttaattgtggcttta

SEQ ID NO: 1792549 - DNA, 18 bp, Homo sapiens
ttaattgttttgcacttt

SEQ ID NO: 1792550 - DNA, 19 bp, Homo sapiens
ttaattgttttgcactttt

SEQ ID NO: 1792551 - DNA, 14 bp, Homo sapiens
ttaatttaaagcca

SEQ ID NO: 1792552 - DNA, 15 bp, Homo sapiens
ttaatttatgagttt

SEQ ID NO: 1792553 - DNA, 13 bp, Homo sapiens
ttaatttcaggaa

SEQ ID NO: 1792554 - DNA, 19 bp, Homo sapiens
ttaatttcaggaaaatgta

SEQ ID NO: 1792555 - DNA, 11 bp, Homo sapiens
ttaatttcctt

SEQ ID NO: 1792556 - DNA, 15 bp, Homo sapiens
ttaatttcctttttg

SEQ ID NO: 1792557 - DNA, 16 bp, Homo sapiens
ttaatttcctttttga

SEQ ID NO: 1792558 - DNA, 23 bp, Homo sapiens
ttaatttcctttttgacactgaa

SEQ ID NO: 1792559 - DNA, 14 bp, Homo sapiens
ttaatttgcacagt

SEQ ID NO: 1792560 - DNA, 22 bp, Homo sapiens
ttaatttggagcacaaaattca

SEQ ID NO: 1792561 - DNA, 13 bp, Homo sapiens
ttaatttgtgtgt

SEQ ID NO: 1792562 - DNA, 18 bp, Homo sapiens
ttaattttaaagtgcaaa

SEQ ID NO: 1792563 - DNA, 22 bp, Homo sapiens
ttaattttagagaaactttgag

SEQ ID NO: 1792564 - DNA, 16 bp, Homo sapiens
ttaattttctatgtgt

SEQ ID NO: 1792565 - DNA, 19 bp, Homo sapiens
ttaattttgatatacattg

SEQ ID NO: 1792566 - DNA, 16 bp, Homo sapiens
ttaattttgtgcattc

SEQ ID NO: 1792567 - DNA, 18 bp, Homo sapiens
ttaattttgtgcattctt

SEQ ID NO: 1792568 - DNA, 22 bp, Homo sapiens
ttaattttgtgcattctttggt

SEQ ID NO: 1792569 - DNA, 18 bp, Homo sapiens
ttaattttttttaatgta

SEQ ID NO: 1792570 - DNA, 22 bp, Homo sapiens
ttacaaaaggctcgtttggatc

SEQ ID NO: 1792571 - DNA, 13 bp, Homo sapiens
ttacaaaatgcca

SEQ ID NO: 1792572 - DNA, 13 bp, Homo sapiens
ttacaaactgcaa

SEQ ID NO: 1792573 - DNA, 14 bp, Homo sapiens
ttacaaactgcaat

SEQ ID NO: 1792574 - DNA, 22 bp, Homo sapiens
ttacaaactgcaatagagactg

SEQ ID NO: 1792575 - DNA, 19 bp, Homo sapiens
ttacaaagggaaagcctct

SEQ ID NO: 1792576 - DNA, 21 bp, Homo sapiens
ttacaaagggaaagcctctgg

SEQ ID NO: 1792577 - DNA, 22 bp, Homo sapiens
ttacaaagggaaagcctctggc

SEQ ID NO: 1792578 - DNA, 22 bp, Homo sapiens
ttacaaataaaattggcaccat

SEQ ID NO: 1792579 - DNA, 16 bp, Homo sapiens
ttacaaatcagaactt

SEQ ID NO: 1792580 - DNA, 21 bp, Homo sapiens
ttacaaattataatgtattca

SEQ ID NO: 1792581 - DNA, 16 bp, Homo sapiens
ttacaaccaagaacat

SEQ ID NO: 1792582 - DNA, 20 bp, Homo sapiens
ttacaacgccgagtgcactg

SEQ ID NO: 1792583 - DNA, 23 bp, Homo sapiens
ttacaacggagtcaaaaattaaa

SEQ ID NO: 1792584 - DNA, 16 bp, Homo sapiens
ttacaactatgtaatt

SEQ ID NO: 1792585 - DNA, 16 bp, Homo sapiens
ttacaagtgttcttag

SEQ ID NO: 1792586 - DNA, 20 bp, Homo sapiens
ttacaagtgttcttaggttt

SEQ ID NO: 1792587 - DNA, 21 bp, Homo sapiens
ttacaagtgttcttaggttta

SEQ ID NO: 1792588 - DNA, 17 bp, Homo sapiens
ttacaagtttatatata

SEQ ID NO: 1792589 - DNA, 13 bp, Homo sapiens
ttacaataaatat

SEQ ID NO: 1792590 - DNA, 14 bp, Homo sapiens
ttacaatagaattt

SEQ ID NO: 1792591 - DNA, 15 bp, Homo sapiens
ttacaatgtatcttt

SEQ ID NO: 1792592 - DNA, 19 bp, Homo sapiens
ttacaatgtatctttatta

SEQ ID NO: 1792593 - DNA, 14 bp, Homo sapiens
ttacaattgaaatg

SEQ ID NO: 1792594 - DNA, 17 bp, Homo sapiens
ttacaattgcactgctg

SEQ ID NO: 1792595 - DNA, 13 bp, Homo sapiens
ttacaattttatc

SEQ ID NO: 1792596 - DNA, 20 bp, Homo sapiens
ttacaccctttcttgacaaa

SEQ ID NO: 1792597 - DNA, 18 bp, Homo sapiens
ttacaccgactagccagg

SEQ ID NO: 1792598 - DNA, 23 bp, Homo sapiens
ttacactaaattattagcatttg

SEQ ID NO: 1792599 - DNA, 14 bp, Homo sapiens
ttacactgccatct

SEQ ID NO: 1792600 - DNA, 20 bp, Homo sapiens
ttacactgcggaagccaaag

SEQ ID NO: 1792601 - DNA, 21 bp, Homo sapiens
ttacacttggagcccgtgcag

SEQ ID NO: 1792602 - DNA, 20 bp, Homo sapiens
ttacactttatgcacaaaat

SEQ ID NO: 1792603 - DNA, 20 bp, Homo sapiens
ttacagacaataaaatggaa

SEQ ID NO: 1792604 - DNA, 18 bp, Homo sapiens
ttacagagaggatacatt

SEQ ID NO: 1792605 - DNA, 22 bp, Homo sapiens
ttacagagaggatacatttaat

SEQ ID NO: 1792606 - DNA, 19 bp, Homo sapiens
ttacagatccagaatttat

SEQ ID NO: 1792607 - DNA, 16 bp, Homo sapiens
ttacagatttaataca

SEQ ID NO: 1792608 - DNA, 20 bp, Homo sapiens
ttacagcattgtctttgctg

SEQ ID NO: 1792609 - DNA, 16 bp, Homo sapiens
ttacagctctgtagtt

SEQ ID NO: 1792610 - DNA, 15 bp, Homo sapiens
ttacaggcaccgaga

SEQ ID NO: 1792611 - DNA, 17 bp, Homo sapiens
ttacaggcaccgagaat

SEQ ID NO: 1792612 - DNA, 20 bp, Homo sapiens
ttacaggcatgagccactgc

SEQ ID NO: 1792613 - DNA, 20 bp, Homo sapiens
ttacagggatgagccaccgc

SEQ ID NO: 1792614 - DNA, 19 bp, Homo sapiens
ttacagtaactaattttgt

SEQ ID NO: 1792615 - DNA, 22 bp, Homo sapiens
ttacagtaatcccatttcccaa

SEQ ID NO: 1792616 - DNA, 20 bp, Homo sapiens
ttacagtatgatgaaaataa

SEQ ID NO: 1792617 - DNA, 23 bp, Homo sapiens
ttacagtatgatgaaaataattt

SEQ ID NO: 1792618 - DNA, 17 bp, Homo sapiens
ttacagtgcctaaaata

SEQ ID NO: 1792619 - DNA, 13 bp, Homo sapiens
ttacagttctgtg

SEQ ID NO: 1792620 - DNA, 16 bp, Homo sapiens
ttacagttctttcctc

SEQ ID NO: 1792621 - DNA, 23 bp, Homo sapiens
ttacataagagaaagaggccaga

SEQ ID NO: 1792622 - DNA, 17 bp, Homo sapiens
ttacataaggatacact

SEQ ID NO: 1792623 - DNA, 22 bp, Homo sapiens
ttacataatcaaagctacctgt

SEQ ID NO: 1792624 - DNA, 19 bp, Homo sapiens
ttacatactaggtgccttt

SEQ ID NO: 1792625 - DNA, 17 bp, Homo sapiens
ttacatagacttaggca

SEQ ID NO: 1792626 - DNA, 14 bp, Homo sapiens
ttacatctgtttta

SEQ ID NO: 1792627 - DNA, 18 bp, Homo sapiens
ttacatctgttttaaatt

SEQ ID NO: 1792628 - DNA, 15 bp, Homo sapiens
ttacatctttcacat

SEQ ID NO: 1792629 - DNA, 13 bp, Homo sapiens
ttacatcttttct

SEQ ID NO: 1792630 - DNA, 18 bp, Homo sapiens
ttacatcttttctaatca

SEQ ID NO: 1792631 - DNA, 12 bp, Homo sapiens
ttacatgaagct

SEQ ID NO: 1792632 - DNA, 18 bp, Homo sapiens
ttacatgggccagtttat

SEQ ID NO: 1792633 - DNA, 21 bp, Homo sapiens
ttacatgtaatatatttcaga

SEQ ID NO: 1792634 - DNA, 16 bp, Homo sapiens
ttacatgtaatttgat

SEQ ID NO: 1792635 - DNA, 18 bp, Homo sapiens
ttacatgttttctttgct

SEQ ID NO: 1792636 - DNA, 22 bp, Homo sapiens
ttacatgttttctttgctttaa

SEQ ID NO: 1792637 - DNA, 14 bp, Homo sapiens
ttacattaatgtta

SEQ ID NO: 1792638 - DNA, 20 bp, Homo sapiens
ttacattcctaactagaatt

SEQ ID NO: 1792639 - DNA, 15 bp, Homo sapiens
ttacatttttacaat

SEQ ID NO: 1792640 - DNA, 16 bp, Homo sapiens
ttacatttttacaata

SEQ ID NO: 1792641 - DNA, 21 bp, Homo sapiens
ttaccaaaattcactaatctt

SEQ ID NO: 1792642 - DNA, 23 bp, Homo sapiens
ttaccaaaattcactaatcttga

SEQ ID NO: 1792643 - DNA, 22 bp, Homo sapiens
ttaccaaagaagagtttacaga

SEQ ID NO: 1792644 - DNA, 10 bp, Homo sapiens
ttaccaaagc

SEQ ID NO: 1792645 - DNA, 12 bp, Homo sapiens
ttaccaacctgt

SEQ ID NO: 1792646 - DNA, 20 bp, Homo sapiens
ttaccaacctgttacctact

SEQ ID NO: 1792647 - DNA, 20 bp, Homo sapiens
ttaccaaggatgaattcttt

SEQ ID NO: 1792648 - DNA, 19 bp, Homo sapiens
ttaccagatgctgactggc

SEQ ID NO: 1792649 - DNA, 19 bp, Homo sapiens
ttaccagcaagaataaaaa

SEQ ID NO: 1792650 - DNA, 19 bp, Homo sapiens
ttaccagcttaaaacactt

SEQ ID NO: 1792651 - DNA, 19 bp, Homo sapiens
ttaccagggactatctttg

SEQ ID NO: 1792652 - DNA, 13 bp, Homo sapiens
ttacttgcaggta

SEQ ID NO: 1792653 - DNA, 13 bp, Homo sapiens
ttacttgcttcag

SEQ ID NO: 1792654 - DNA, 15 bp, Homo sapiens
ttacttgcttctcta

SEQ ID NO: 1792655 - DNA, 20 bp, Homo sapiens
ttacttgtaaataaagtcta

SEQ ID NO: 1792656 - DNA, 18 bp, Homo sapiens
ttacttgtctgtcaaatg

SEQ ID NO: 1792657 - DNA, 20 bp, Homo sapiens
ttacttgtctgtcaaatgtt

SEQ ID NO: 1792658 - DNA, 14 bp, Homo sapiens
ttacttgtggtgtg

SEQ ID NO: 1792659 - DNA, 15 bp, Homo sapiens
ttacttgtggtgtga

SEQ ID NO: 1792660 - DNA, 18 bp, Homo sapiens
ttactttaaaataaaaaa

SEQ ID NO: 1792661 - DNA, 22 bp, Homo sapiens
ttactttaacttagttttgcat

SEQ ID NO: 1792662 - DNA, 17 bp, Homo sapiens
ttactttaattactgga

SEQ ID NO: 1792663 - DNA, 19 bp, Homo sapiens
ttactttcttcaccaagtg

SEQ ID NO: 1792664 - DNA, 20 bp, Homo sapiens
ttactttgcttgagaatcct

SEQ ID NO: 1792665 - DNA, 19 bp, Homo sapiens
ttactttggcaatttcctg

SEQ ID NO: 1792666 - DNA, 20 bp, Homo sapiens
ttactttggcaatttcctgg

SEQ ID NO: 1792667 - DNA, 21 bp, Homo sapiens
ttactttggggctaatttaac

SEQ ID NO: 1792668 - DNA, 20 bp, Homo sapiens
ttacttttaaatattaactc

SEQ ID NO: 1792669 - DNA, 16 bp, Homo sapiens
ttacttttttatagct

SEQ ID NO: 1792670 - DNA, 19 bp, Homo sapiens
ttactttttttttttggtg

SEQ ID NO: 1792671 - DNA, 15 bp, Homo sapiens
ttagaaaacaaaatt

SEQ ID NO: 1792672 - DNA, 21 bp, Homo sapiens
ttagaaaacataatcttctgc

SEQ ID NO: 1792673 - DNA, 20 bp, Homo sapiens
ttagaaaaggtgataaaatc

SEQ ID NO: 1792674 - DNA, 22 bp, Homo sapiens
ttagaaaaggtgataaaatcat

SEQ ID NO: 1792675 - DNA, 14 bp, Homo sapiens
ttagaaaatgactt

SEQ ID NO: 1792676 - DNA, 19 bp, Homo sapiens
ttagaaaatgacttatttc

SEQ ID NO: 1792677 - DNA, 22 bp, Homo sapiens
ttagaaacacataattaacact

SEQ ID NO: 1792678 - DNA, 17 bp, Homo sapiens
ttagaaacatggttttg

SEQ ID NO: 1792679 - DNA, 10 bp, Homo sapiens
ttagaaactg

SEQ ID NO: 1792680 - DNA, 13 bp, Homo sapiens
ttagaaactggaa

SEQ ID NO: 1792681 - DNA, 23 bp, Homo sapiens
ttagaaactggaaatactagatt

SEQ ID NO: 1792682 - DNA, 19 bp, Homo sapiens
ttagaaaggcaaagtacat

SEQ ID NO: 1792683 - DNA, 13 bp, Homo sapiens
ttagaaaggcagc

SEQ ID NO: 1792684 - DNA, 15 bp, Homo sapiens
ttagaaatagacagt

SEQ ID NO: 1792685 - DNA, 11 bp, Homo sapiens
ttagaaatata

SEQ ID NO: 1792686 - DNA, 11 bp, Homo sapiens
ttagaaatatt

SEQ ID NO: 1792687 - DNA, 13 bp, Homo sapiens
ttagaaatattca

SEQ ID NO: 1792688 - DNA, 14 bp, Homo sapiens
ttagaaattagaaa

SEQ ID NO: 1792689 - DNA, 22 bp, Homo sapiens
ttagaaccagccgtattttaca

SEQ ID NO: 1792690 - DNA, 12 bp, Homo sapiens
ttagaagaaaga

SEQ ID NO: 1792691 - DNA, 21 bp, Homo sapiens
ttagaagaagaggaagaaatt

SEQ ID NO: 1792692 - DNA, 14 bp, Homo sapiens
ttagaagaagtgtg

SEQ ID NO: 1792693 - DNA, 16 bp, Homo sapiens
ttagaatctagaaatg

SEQ ID NO: 1792694 - DNA, 16 bp, Homo sapiens
ttagaatgaatttatc

SEQ ID NO: 1792695 - DNA, 19 bp, Homo sapiens
ttagaatgaatttatcttt

SEQ ID NO: 1792696 - DNA, 22 bp, Homo sapiens
ttagaatgaatttatctttacc

SEQ ID NO: 1792697 - DNA, 23 bp, Homo sapiens
ttagaatgaatttatctttacca

SEQ ID NO: 1792698 - DNA, 23 bp, Homo sapiens
ttagaatgccggttaaattccat

SEQ ID NO: 1792699 - DNA, 20 bp, Homo sapiens
ttagaatggaggaagaacaa

SEQ ID NO: 1792700 - DNA, 19 bp, Homo sapiens
ttagaatggtgattttaaa

SEQ ID NO: 1792701 - DNA, 18 bp, Homo sapiens
ttagacaaccatagaact

SEQ ID NO: 1792702 - DNA, 20 bp, Homo sapiens
ttagacaaccatagaactgt

SEQ ID NO: 1792703 - DNA, 21 bp, Homo sapiens
ttagacaactagatttgtcct

SEQ ID NO: 1792704 - DNA, 16 bp, Homo sapiens
ttagacaagagatggg

SEQ ID NO: 1792705 - DNA, 17 bp, Homo sapiens
ttagaccccatacaagt

SEQ ID NO: 1792706 - DNA, 16 bp, Homo sapiens
ttagacccgccaggtc

SEQ ID NO: 1792707 - DNA, 11 bp, Homo sapiens
ttagacctcag

SEQ ID NO: 1792708 - DNA, 16 bp, Homo sapiens
ttagacctcagcctgt

SEQ ID NO: 1792709 - DNA, 16 bp, Homo sapiens
ttagacctgtgttact

SEQ ID NO: 1792710 - DNA, 19 bp, Homo sapiens
ttagactatttctttttat

SEQ ID NO: 1792711 - DNA, 19 bp, Homo sapiens
ttagactcatcttactgta

SEQ ID NO: 1792712 - DNA, 22 bp, Homo sapiens
ttagacttttccaatatgtgat

SEQ ID NO: 1792713 - DNA, 13 bp, Homo sapiens
ttagagaagctga

SEQ ID NO: 1792714 - DNA, 15 bp, Homo sapiens
ttagagagcctgtca

SEQ ID NO: 1792715 - DNA, 21 bp, Homo sapiens
ttagagagcctgtcaccagag

SEQ ID NO: 1792716 - DNA, 13 bp, Homo sapiens
ttagagatgaatt

SEQ ID NO: 1792717 - DNA, 18 bp, Homo sapiens
ttagagctgcataatgtc

SEQ ID NO: 1792718 - DNA, 16 bp, Homo sapiens
ttagaggaaaatgagt

SEQ ID NO: 1792719 - DNA, 23 bp, Homo sapiens
ttagaggaaataagaaaaatcat

SEQ ID NO: 1792720 - DNA, 19 bp, Homo sapiens
ttagaggagtctgtggctt

SEQ ID NO: 1792721 - DNA, 17 bp, Homo sapiens
ttagaggcaacaggatt

SEQ ID NO: 1792722 - DNA, 24 bp, Homo sapiens
ttagagtaggtattaatcttattg

SEQ ID NO: 1792723 - DNA, 18 bp, Homo sapiens
ttagagtcgtcactctct

SEQ ID NO: 1792724 - DNA, 16 bp, Homo sapiens
ttagagttcttctttc

SEQ ID NO: 1792725 - DNA, 19 bp, Homo sapiens
ttagataaagatttctagt

SEQ ID NO: 1792726 - DNA, 20 bp, Homo sapiens
ttagatacactaaaaatctg

SEQ ID NO: 1792727 - DNA, 16 bp, Homo sapiens
ttagatcccatgtcac

SEQ ID NO: 1792728 - DNA, 17 bp, Homo sapiens
ttagatgagggtgactg

SEQ ID NO: 1792729 - DNA, 12 bp, Homo sapiens
ttagatgccaaa

SEQ ID NO: 1792730 - DNA, 15 bp, Homo sapiens
ttagatgtttcacac

SEQ ID NO: 1792731 - DNA, 21 bp, Homo sapiens
ttagattttattttactattg

SEQ ID NO: 1792732 - DNA, 22 bp, Homo sapiens
ttagattttgtgtttattcttg

SEQ ID NO: 1792733 - DNA, 22 bp, Homo sapiens
ttagcaaagcaaaaggctgaga

SEQ ID NO: 1792734 - DNA, 17 bp, Homo sapiens
ttagcaataaatgcttt

SEQ ID NO: 1792735 - DNA, 18 bp, Homo sapiens
ttagcaataaatgctttt

SEQ ID NO: 1792736 - DNA, 15 bp, Homo sapiens
ttagcagcttccaga

SEQ ID NO: 1792737 - DNA, 22 bp, Homo sapiens
ttagcaggttgggctagagaaa

SEQ ID NO: 1792738 - DNA, 19 bp, Homo sapiens
ttagcagttgctcacatgt

SEQ ID NO: 1792739 - DNA, 16 bp, Homo sapiens
ttagcatccaggctgg

SEQ ID NO: 1792740 - DNA, 20 bp, Homo sapiens
ttagcatgcgcgctgtgggc

SEQ ID NO: 1792741 - DNA, 16 bp, Homo sapiens
ttagcatttttatgca

SEQ ID NO: 1792742 - DNA, 13 bp, Homo sapiens
ttagccacaaaat

SEQ ID NO: 1792743 - DNA, 17 bp, Homo sapiens
ttagccagatttgtctt

SEQ ID NO: 1792744 - DNA, 12 bp, Homo sapiens
ttagccagtgac

SEQ ID NO: 1792745 - DNA, 22 bp, Homo sapiens
ttagccagttcaaagtgtatat

SEQ ID NO: 1792746 - DNA, 13 bp, Homo sapiens
ttagcccaagagg

SEQ ID NO: 1792747 - DNA, 18 bp, Homo sapiens
ttagccgggcatggtggc

SEQ ID NO: 1792748 - DNA, 10 bp, Homo sapiens
ttagcctgga

SEQ ID NO: 1792749 - DNA, 12 bp, Homo sapiens
ttagcctggact

SEQ ID NO: 1792750 - DNA, 17 bp, Homo sapiens
ttagccttgtgccctgc

SEQ ID NO: 1792751 - DNA, 16 bp, Homo sapiens
ttagcctttgccctgt

SEQ ID NO: 1792752 - DNA, 23 bp, Homo sapiens
ttagcgttctggactctgcccca

SEQ ID NO: 1792753 - DNA, 15 bp, Homo sapiens
ttagctactgtatgc

SEQ ID NO: 1792754 - DNA, 11 bp, Homo sapiens
ttagctcaggt

SEQ ID NO: 1792755 - DNA, 17 bp, Homo sapiens
ttagctcaggtgcctta

SEQ ID NO: 1792756 - DNA, 18 bp, Homo sapiens
ttagctccataaagtaca

SEQ ID NO: 1792757 - DNA, 24 bp, Homo sapiens
ttagctccataaagtacaaatgaa

SEQ ID NO: 1792758 - DNA, 14 bp, Homo sapiens
ttagctcccctcca

SEQ ID NO: 1792759 - DNA, 18 bp, Homo sapiens
ttagctctggacgtgaaa

SEQ ID NO: 1792760 - DNA, 23 bp, Homo sapiens
ttagctcttaattgttcattttg

SEQ ID NO: 1792761 - DNA, 16 bp, Homo sapiens
ttagctgaagaattga

SEQ ID NO: 1792762 - DNA, 13 bp, Homo sapiens
ttagctgcagaac

SEQ ID NO: 1792763 - DNA, 18 bp, Homo sapiens
ttagctggccacatggcg

SEQ ID NO: 1792764 - DNA, 13 bp, Homo sapiens
ttagctgtactat

SEQ ID NO: 1792765 - DNA, 18 bp, Homo sapiens
ttagctgtactataagta

SEQ ID NO: 1792766 - DNA, 16 bp, Homo sapiens
ttagctgtgtgaaata

SEQ ID NO: 1792767 - DNA, 14 bp, Homo sapiens
ttagctgtgttatt

SEQ ID NO: 1792768 - DNA, 14 bp, Homo sapiens
ttagcttacaggaa

SEQ ID NO: 1792769 - DNA, 18 bp, Homo sapiens
ttagcttagacctcagcc

SEQ ID NO: 1792770 - DNA, 16 bp, Homo sapiens
ttagctttactgtttg

SEQ ID NO: 1792771 - DNA, 17 bp, Homo sapiens
ttagctttactgtttgt

SEQ ID NO: 1792772 - DNA, 22 bp, Homo sapiens
ttagctttgggtgcctttgcca

SEQ ID NO: 1792773 - DNA, 18 bp, Homo sapiens
ttaggaagtatggcaaaa

SEQ ID NO: 1792774 - DNA, 17 bp, Homo sapiens
ttaggaataacactgca

SEQ ID NO: 1792775 - DNA, 12 bp, Homo sapiens
ttaggaatctct

SEQ ID NO: 1792776 - DNA, 15 bp, Homo sapiens
ttaggaatctcttca

SEQ ID NO: 1792777 - DNA, 21 bp, Homo sapiens
ttaggacaatcagtcccctcc

SEQ ID NO: 1792778 - DNA, 17 bp, Homo sapiens
ttaggactcttcttcca

SEQ ID NO: 1792779 - DNA, 17 bp, Homo sapiens
ttaggagaagccaggaa

SEQ ID NO: 1792780 - DNA, 21 bp, Homo sapiens
ttaggagatttaccacttttt

SEQ ID NO: 1792781 - DNA, 13 bp, Homo sapiens
ttaggattcaggc

SEQ ID NO: 1792782 - DNA, 20 bp, Homo sapiens
ttaggcaaggctatgtgatt

SEQ ID NO: 1792783 - DNA, 13 bp, Homo sapiens
ttaggcacacaga

SEQ ID NO: 1792784 - DNA, 19 bp, Homo sapiens
ttaggcatgtcccacccac

SEQ ID NO: 1792785 - DNA, 17 bp, Homo sapiens
ttaggcatttcctgctg

SEQ ID NO: 1792786 - DNA, 16 bp, Homo sapiens
ttaggcctctctgcct

SEQ ID NO: 1792787 - DNA, 16 bp, Homo sapiens
ttaggctatttgtaaa

SEQ ID NO: 1792788 - DNA, 19 bp, Homo sapiens
ttaggctatttgtaaatct

SEQ ID NO: 1792789 - DNA, 20 bp, Homo sapiens
ttaggctatttgtaaatctg

SEQ ID NO: 1792790 - DNA, 17 bp, Homo sapiens
ttaggctgtaactactt

SEQ ID NO: 1792791 - DNA, 18 bp, Homo sapiens
ttaggcttttaagaaaca

SEQ ID NO: 1792792 - DNA, 15 bp, Homo sapiens
ttagggcactgggct

SEQ ID NO: 1792793 - DNA, 11 bp, Homo sapiens
ttagggctgct

SEQ ID NO: 1792794 - DNA, 17 bp, Homo sapiens
ttagggctgcttttctt

SEQ ID NO: 1792795 - DNA, 19 bp, Homo sapiens
ttaggggttcattctcccg

SEQ ID NO: 1792796 - DNA, 11 bp, Homo sapiens
ttagggtacag

SEQ ID NO: 1792797 - DNA, 15 bp, Homo sapiens
ttaggtagaaaaaca

SEQ ID NO: 1792798 - DNA, 15 bp, Homo sapiens
ttaggtagcacagca

SEQ ID NO: 1792799 - DNA, 22 bp, Homo sapiens
ttaggtgcaatttcaaggttct

SEQ ID NO: 1792800 - DNA, 14 bp, Homo sapiens
ttaggttattttgc

SEQ ID NO: 1792801 - DNA, 18 bp, Homo sapiens
ttaggttattttgctttg

SEQ ID NO: 1792802 - DNA, 20 bp, Homo sapiens
ttaggttattttgctttggt

SEQ ID NO: 1792803 - DNA, 15 bp, Homo sapiens
ttaggtttactgtga

SEQ ID NO: 1792804 - DNA, 17 bp, Homo sapiens
ttaggtttactgtgaag

SEQ ID NO: 1792805 - DNA, 14 bp, Homo sapiens
ttagtaaataaaat

SEQ ID NO: 1792806 - DNA, 13 bp, Homo sapiens
ttagtaagtcttg

SEQ ID NO: 1792807 - DNA, 22 bp, Homo sapiens
ttagtactttagactaattgtg

SEQ ID NO: 1792808 - DNA, 15 bp, Homo sapiens
ttagtatctaacatg

SEQ ID NO: 1792809 - DNA, 17 bp, Homo sapiens
ttagtatctaacatgta

SEQ ID NO: 1792810 - DNA, 18 bp, Homo sapiens
ttagtatctaacatgtat

SEQ ID NO: 1792811 - DNA, 13 bp, Homo sapiens
ttagtatcttttg

SEQ ID NO: 1792812 - DNA, 20 bp, Homo sapiens
ttagtatggttcaagattgt

SEQ ID NO: 1792813 - DNA, 21 bp, Homo sapiens
ttagtatggttctcagatctt

SEQ ID NO: 1792814 - DNA, 12 bp, Homo sapiens
ttagtatgtctg

SEQ ID NO: 1792815 - DNA, 16 bp, Homo sapiens
ttagtattaaaatcta

SEQ ID NO: 1792816 - DNA, 15 bp, Homo sapiens
ttagtattcattctg

SEQ ID NO: 1792817 - DNA, 18 bp, Homo sapiens
ttagtctgaaactggctt

SEQ ID NO: 1792818 - DNA, 17 bp, Homo sapiens
ttagtcttttgtaatat

SEQ ID NO: 1792819 - DNA, 20 bp, Homo sapiens
ttagtgaaccaaaaatagaa

SEQ ID NO: 1792820 - DNA, 18 bp, Homo sapiens
ttagtgaagttgtgcaac

SEQ ID NO: 1792821 - DNA, 11 bp, Homo sapiens
ttagtgactgt

SEQ ID NO: 1792822 - DNA, 19 bp, Homo sapiens
ttagtgccacttaatgtat

SEQ ID NO: 1792823 - DNA, 19 bp, Homo sapiens
ttagtgcggacaagtttta

SEQ ID NO: 1792824 - DNA, 20 bp, Homo sapiens
ttagtggacttgttttaatt

SEQ ID NO: 1792825 - DNA, 23 bp, Homo sapiens
ttagtggctcaacattgtgttcc

SEQ ID NO: 1792826 - DNA, 19 bp, Homo sapiens
ttagtggtatgtctcttta

SEQ ID NO: 1792827 - DNA, 14 bp, Homo sapiens
ttagtgtaaaattg

SEQ ID NO: 1792828 - DNA, 11 bp, Homo sapiens
ttagtgtatta

SEQ ID NO: 1792829 - DNA, 14 bp, Homo sapiens
ttagtgtcacttac

SEQ ID NO: 1792830 - DNA, 14 bp, Homo sapiens
ttagtgtgccttcc

SEQ ID NO: 1792831 - DNA, 22 bp, Homo sapiens
ttagtgtgtgtgcatgtgtgtg

SEQ ID NO: 1792832 - DNA, 18 bp, Homo sapiens
ttagttaatgagccatca

SEQ ID NO: 1792833 - DNA, 13 bp, Homo sapiens
ttagttaccttat

SEQ ID NO: 1792834 - DNA, 21 bp, Homo sapiens
ttagttaccttatagttactg

SEQ ID NO: 1792835 - DNA, 20 bp, Homo sapiens
ttagttctgctttctgcctc

SEQ ID NO: 1792836 - DNA, 12 bp, Homo sapiens
ttagttctgttg

SEQ ID NO: 1792837 - DNA, 19 bp, Homo sapiens
ttagttgaaaaatctagtt

SEQ ID NO: 1792838 - DNA, 21 bp, Homo sapiens
ttagttgacaacctagaatgt

SEQ ID NO: 1792839 - DNA, 15 bp, Homo sapiens
ttagttgccaacagt

SEQ ID NO: 1792840 - DNA, 17 bp, Homo sapiens
ttagtttacaatcagcc

SEQ ID NO: 1792841 - DNA, 11 bp, Homo sapiens
ttagtttcctt

SEQ ID NO: 1792842 - DNA, 14 bp, Homo sapiens
ttagtttctttggg

SEQ ID NO: 1792843 - DNA, 14 bp, Homo sapiens
ttagtttggattct

SEQ ID NO: 1792844 - DNA, 22 bp, Homo sapiens
ttagtttgtatgccaagtgaga

SEQ ID NO: 1792845 - DNA, 17 bp, Homo sapiens
ttagtttttaacaatct

SEQ ID NO: 1792846 - DNA, 18 bp, Homo sapiens
ttagtttttaacaatcta

SEQ ID NO: 1792847 - DNA, 16 bp, Homo sapiens
ttagtttttcattaaa

SEQ ID NO: 1792848 - DNA, 19 bp, Homo sapiens
ttagtttttggttgggaat

SEQ ID NO: 1792849 - DNA, 23 bp, Homo sapiens
ttagtttttggttgggaatgagg

SEQ ID NO: 1792850 - DNA, 19 bp, Homo sapiens
ttagttttttttgtttgcc

SEQ ID NO: 1792851 - DNA, 14 bp, Homo sapiens
ttataaaaaatggt

SEQ ID NO: 1792852 - DNA, 19 bp, Homo sapiens
ttataaaaaggtgttttga

SEQ ID NO: 1792853 - DNA, 23 bp, Homo sapiens
ttataaaagaataaaattgcact

SEQ ID NO: 1792854 - DNA, 16 bp, Homo sapiens
ttataaaagtgttcat

SEQ ID NO: 1792855 - DNA, 13 bp, Homo sapiens
ttataaaatggct

SEQ ID NO: 1792856 - DNA, 20 bp, Homo sapiens
ttataaaatggctgtaatca

SEQ ID NO: 1792857 - DNA, 18 bp, Homo sapiens
ttataaaattttgctttt

SEQ ID NO: 1792858 - DNA, 13 bp, Homo sapiens
ttataaacagaaa

SEQ ID NO: 1792859 - DNA, 19 bp, Homo sapiens
ttataaacagacaatatgt

SEQ ID NO: 1792860 - DNA, 20 bp, Homo sapiens
ttataaaccacttgagccta

SEQ ID NO: 1792861 - DNA, 15 bp, Homo sapiens
ttataaactataaac

SEQ ID NO: 1792862 - DNA, 13 bp, Homo sapiens
ttataaagtctaa

SEQ ID NO: 1792863 - DNA, 19 bp, Homo sapiens
ttataaataaactgttgct

SEQ ID NO: 1792864 - DNA, 15 bp, Homo sapiens
ttataaatatattta

SEQ ID NO: 1792865 - DNA, 18 bp, Homo sapiens
ttataaatcttatgctct

SEQ ID NO: 1792866 - DNA, 17 bp, Homo sapiens
ttataacagcattcttg

SEQ ID NO: 1792867 - DNA, 16 bp, Homo sapiens
ttataactcatcataa

SEQ ID NO: 1792868 - DNA, 19 bp, Homo sapiens
ttataactcatcataaaat

SEQ ID NO: 1792869 - DNA, 22 bp, Homo sapiens
ttataactcatcataaaataaa

SEQ ID NO: 1792870 - DNA, 18 bp, Homo sapiens
ttataactgaaggagaag

SEQ ID NO: 1792871 - DNA, 18 bp, Homo sapiens
ttataactgtaaagatgt

SEQ ID NO: 1792872 - DNA, 17 bp, Homo sapiens
ttataacttaaaatatt

SEQ ID NO: 1792873 - DNA, 17 bp, Homo sapiens
ttataagaaaaactttt

SEQ ID NO: 1792874 - DNA, 21 bp, Homo sapiens
ttataagaagaagttcatgtc

SEQ ID NO: 1792875 - DNA, 13 bp, Homo sapiens
ttataagactctc

SEQ ID NO: 1792876 - DNA, 16 bp, Homo sapiens
ttataagcagatttaa

SEQ ID NO: 1792877 - DNA, 18 bp, Homo sapiens
ttataaggccatttcctt

SEQ ID NO: 1792878 - DNA, 14 bp, Homo sapiens
ttataagggagagc

SEQ ID NO: 1792879 - DNA, 21 bp, Homo sapiens
ttataagggagagctgagcca

SEQ ID NO: 1792880 - DNA, 15 bp, Homo sapiens
ttataaggttgtctg

SEQ ID NO: 1792881 - DNA, 18 bp, Homo sapiens
ttataagtcattgtatgt

SEQ ID NO: 1792882 - DNA, 13 bp, Homo sapiens
ttataagtgactt

SEQ ID NO: 1792883 - DNA, 14 bp, Homo sapiens
ttataataggaatt

SEQ ID NO: 1792884 - DNA, 13 bp, Homo sapiens
ttataatatacta

SEQ ID NO: 1792885 - DNA, 17 bp, Homo sapiens
ttataatatgtgcctta

SEQ ID NO: 1792886 - DNA, 20 bp, Homo sapiens
ttaccagggactatctttgc

SEQ ID NO: 1792887 - DNA, 18 bp, Homo sapiens
ttaccaggttgtcctcaa

SEQ ID NO: 1792888 - DNA, 18 bp, Homo sapiens
ttaccagtcctatttttc

SEQ ID NO: 1792889 - DNA, 14 bp, Homo sapiens
ttaccataatctta

SEQ ID NO: 1792890 - DNA, 20 bp, Homo sapiens
ttaccatgagaagagggcct

SEQ ID NO: 1792891 - DNA, 23 bp, Homo sapiens
ttaccattaattacatacagatt

SEQ ID NO: 1792892 - DNA, 14 bp, Homo sapiens
ttaccattcacaat

SEQ ID NO: 1792893 - DNA, 15 bp, Homo sapiens
ttaccatttgtaata

SEQ ID NO: 1792894 - DNA, 21 bp, Homo sapiens
ttacccagagaatatatacat

SEQ ID NO: 1792895 - DNA, 22 bp, Homo sapiens
ttacccagagaatatatacatt

SEQ ID NO: 1792896 - DNA, 16 bp, Homo sapiens
ttacccagattgtgta

SEQ ID NO: 1792897 - DNA, 14 bp, Homo sapiens
ttacccataaacag

SEQ ID NO: 1792898 - DNA, 21 bp, Homo sapiens
ttaccctaagaatgctttgcc

SEQ ID NO: 1792899 - DNA, 19 bp, Homo sapiens
ttaccctcccaccactccc

SEQ ID NO: 1792900 - DNA, 18 bp, Homo sapiens
ttaccctcctagctttcc

SEQ ID NO: 1792901 - DNA, 16 bp, Homo sapiens
ttaccctcctgtaaat

SEQ ID NO: 1792902 - DNA, 13 bp, Homo sapiens
ttaccctctttgc

SEQ ID NO: 1792903 - DNA, 22 bp, Homo sapiens
ttaccctttggccccactttga

SEQ ID NO: 1792904 - DNA, 22 bp, Homo sapiens
ttacccttttcccccttcccat

SEQ ID NO: 1792905 - DNA, 22 bp, Homo sapiens
ttaccggttgtttagaaacaga

SEQ ID NO: 1792906 - DNA, 16 bp, Homo sapiens
ttacctaaacagatat

SEQ ID NO: 1792907 - DNA, 23 bp, Homo sapiens
ttacctaatctccacttttttca

SEQ ID NO: 1792908 - DNA, 16 bp, Homo sapiens
ttacctaccacagtgt

SEQ ID NO: 1792909 - DNA, 18 bp, Homo sapiens
ttacctaccacagtgtct

SEQ ID NO: 1792910 - DNA, 17 bp, Homo sapiens
ttacctactattggccc

SEQ ID NO: 1792911 - DNA, 21 bp, Homo sapiens
ttacctactgtgtcttggaat

SEQ ID NO: 1792912 - DNA, 13 bp, Homo sapiens
ttacctactttga

SEQ ID NO: 1792913 - DNA, 16 bp, Homo sapiens
ttacctatctgtggaa

SEQ ID NO: 1792914 - DNA, 19 bp, Homo sapiens
ttacctcctgcccaggaga

SEQ ID NO: 1792915 - DNA, 19 bp, Homo sapiens
ttacctgaacaggaatcct

SEQ ID NO: 1792916 - DNA, 12 bp, Homo sapiens
ttacctgacaca

SEQ ID NO: 1792917 - DNA, 13 bp, Homo sapiens
ttacctgcaggct

SEQ ID NO: 1792918 - DNA, 19 bp, Homo sapiens
ttacctgtcattttgcact

SEQ ID NO: 1792919 - DNA, 21 bp, Homo sapiens
ttacctgtcattttgcactgt

SEQ ID NO: 1792920 - DNA, 12 bp, Homo sapiens
ttacctgtggat

SEQ ID NO: 1792921 - DNA, 13 bp, Homo sapiens
ttacctgtgtgct

SEQ ID NO: 1792922 - DNA, 20 bp, Homo sapiens
ttacctgttatttatcaatt

SEQ ID NO: 1792923 - DNA, 18 bp, Homo sapiens
ttaccttgaactgaaggc

SEQ ID NO: 1792924 - DNA, 12 bp, Homo sapiens
ttacctttcctg

SEQ ID NO: 1792925 - DNA, 15 bp, Homo sapiens
ttacctttttatttg

SEQ ID NO: 1792926 - DNA, 23 bp, Homo sapiens
ttaccttttttgataaagtttct

SEQ ID NO: 1792927 - DNA, 13 bp, Homo sapiens
ttacgaagacaaa

SEQ ID NO: 1792928 - DNA, 16 bp, Homo sapiens
ttactaaacattttgt

SEQ ID NO: 1792929 - DNA, 11 bp, Homo sapiens
ttactaaagaa

SEQ ID NO: 1792930 - DNA, 18 bp, Homo sapiens
ttactaaagaaaatatct

SEQ ID NO: 1792931 - DNA, 18 bp, Homo sapiens
ttactaaagaaagattac

SEQ ID NO: 1792932 - DNA, 18 bp, Homo sapiens
ttactaactaaataccat

SEQ ID NO: 1792933 - DNA, 13 bp, Homo sapiens
ttactaatatata

SEQ ID NO: 1792934 - DNA, 17 bp, Homo sapiens
ttactacaatatgtaca

SEQ ID NO: 1792935 - DNA, 19 bp, Homo sapiens
ttactacaatatgtacatt

SEQ ID NO: 1792936 - DNA, 22 bp, Homo sapiens
ttactacataattaaattttaa

SEQ ID NO: 1792937 - DNA, 19 bp, Homo sapiens
ttactagtactatttctta

SEQ ID NO: 1792938 - DNA, 19 bp, Homo sapiens
ttactatgtgccagttcct

SEQ ID NO: 1792939 - DNA, 21 bp, Homo sapiens
ttactatgtgccagttcctgt

SEQ ID NO: 1792940 - DNA, 22 bp, Homo sapiens
ttactatgtgccagttcctgta

SEQ ID NO: 1792941 - DNA, 23 bp, Homo sapiens
ttactattaagcagtaaaaactg

SEQ ID NO: 1792942 - DNA, 21 bp, Homo sapiens
ttactcaccaccttagagcaa

SEQ ID NO: 1792943 - DNA, 12 bp, Homo sapiens
ttactcactgct

SEQ ID NO: 1792944 - DNA, 16 bp, Homo sapiens
ttactcagcccagctg

SEQ ID NO: 1792945 - DNA, 12 bp, Homo sapiens
ttactcaggttt

SEQ ID NO: 1792946 - DNA, 18 bp, Homo sapiens
ttactccattactgtgat

SEQ ID NO: 1792947 - DNA, 14 bp, Homo sapiens
ttactccctgttat

SEQ ID NO: 1792948 - DNA, 15 bp, Homo sapiens
ttactccctgttatt

SEQ ID NO: 1792949 - DNA, 18 bp, Homo sapiens
ttactccctgttttagtt

SEQ ID NO: 1792950 - DNA, 13 bp, Homo sapiens
ttactcctcctgc

SEQ ID NO: 1792951 - DNA, 20 bp, Homo sapiens
ttactcctcctgctcctcac

SEQ ID NO: 1792952 - DNA, 22 bp, Homo sapiens
ttactcgatcaaaaccttcctt

SEQ ID NO: 1792953 - DNA, 17 bp, Homo sapiens
ttactcggcgtgctcct

SEQ ID NO: 1792954 - DNA, 19 bp, Homo sapiens
ttactctccaacctggaca

SEQ ID NO: 1792955 - DNA, 12 bp, Homo sapiens
ttactctctccg

SEQ ID NO: 1792956 - DNA, 13 bp, Homo sapiens
ttactctgaaggg

SEQ ID NO: 1792957 - DNA, 22 bp, Homo sapiens
ttactctgaagggcatcatgca

SEQ ID NO: 1792958 - DNA, 15 bp, Homo sapiens
ttactctgagcccag

SEQ ID NO: 1792959 - DNA, 17 bp, Homo sapiens
ttactctgagcccaggc

SEQ ID NO: 1792960 - DNA, 16 bp, Homo sapiens
ttactcttatgatcaa

SEQ ID NO: 1792961 - DNA, 21 bp, Homo sapiens
ttactcttcttcattagcttt

SEQ ID NO: 1792962 - DNA, 14 bp, Homo sapiens
ttactctttttcaa

SEQ ID NO: 1792963 - DNA, 19 bp, Homo sapiens
ttactgaaggtaaaattga

SEQ ID NO: 1792964 - DNA, 23 bp, Homo sapiens
ttactgaatgcaccatggtcaaa

SEQ ID NO: 1792965 - DNA, 12 bp, Homo sapiens
ttactgacttgg

SEQ ID NO: 1792966 - DNA, 18 bp, Homo sapiens
ttactgataaacctaata

SEQ ID NO: 1792967 - DNA, 23 bp, Homo sapiens
ttactgatatattttacaatttt

SEQ ID NO: 1792968 - DNA, 20 bp, Homo sapiens
ttactgctaagtatttccca

SEQ ID NO: 1792969 - DNA, 21 bp, Homo sapiens
ttactgctaagtatttcccag

SEQ ID NO: 1792970 - DNA, 14 bp, Homo sapiens
ttactgctctgaga

SEQ ID NO: 1792971 - DNA, 15 bp, Homo sapiens
ttactgctctgagaa

SEQ ID NO: 1792972 - DNA, 18 bp, Homo sapiens
ttactgctgattcttgta

SEQ ID NO: 1792973 - DNA, 19 bp, Homo sapiens
ttactgctgattcttgtaa

SEQ ID NO: 1792974 - DNA, 22 bp, Homo sapiens
ttactgcttcccattgagtaat

SEQ ID NO: 1792975 - DNA, 20 bp, Homo sapiens
ttactgcttttcattagcag

SEQ ID NO: 1792976 - DNA, 18 bp, Homo sapiens
ttactggaattcttctgc

SEQ ID NO: 1792977 - DNA, 13 bp, Homo sapiens
ttactggcctttt

SEQ ID NO: 1792978 - DNA, 16 bp, Homo sapiens
ttactggcctttttca

SEQ ID NO: 1792979 - DNA, 14 bp, Homo sapiens
ttactgggccctga

SEQ ID NO: 1792980 - DNA, 17 bp, Homo sapiens
ttactggtccaaaagat

SEQ ID NO: 1792981 - DNA, 23 bp, Homo sapiens
ttactggtttccccagggaagga

SEQ ID NO: 1792982 - DNA, 20 bp, Homo sapiens
ttactgtaaaatgcaaaaaa

SEQ ID NO: 1792983 - DNA, 20 bp, Homo sapiens
ttactgtaatataaagtatt

SEQ ID NO: 1792984 - DNA, 16 bp, Homo sapiens
ttactgtatataaact

SEQ ID NO: 1792985 - DNA, 23 bp, Homo sapiens
ttactgtctcactcgttctgtta

SEQ ID NO: 1792986 - DNA, 13 bp, Homo sapiens
ttactgtgtaatt

SEQ ID NO: 1792987 - DNA, 20 bp, Homo sapiens
ttactgtgtaattagtgcca

SEQ ID NO: 1792988 - DNA, 13 bp, Homo sapiens
ttactgtgtgtga

SEQ ID NO: 1792989 - DNA, 20 bp, Homo sapiens
ttactgtgttttataaaata

SEQ ID NO: 1792990 - DNA, 18 bp, Homo sapiens
ttactgttgaacttagaa

SEQ ID NO: 1792991 - DNA, 20 bp, Homo sapiens
ttactgttgcatttactttt

SEQ ID NO: 1792992 - DNA, 15 bp, Homo sapiens
ttactgtttgttatg

SEQ ID NO: 1792993 - DNA, 13 bp, Homo sapiens
ttacttaaagatt

SEQ ID NO: 1792994 - DNA, 19 bp, Homo sapiens
ttacttaaagatttatcaa

SEQ ID NO: 1792995 - DNA, 20 bp, Homo sapiens
ttacttaaagatttatcaaa

SEQ ID NO: 1792996 - DNA, 22 bp, Homo sapiens
ttacttaaagatttatcaaatc

SEQ ID NO: 1792997 - DNA, 16 bp, Homo sapiens
ttacttatcttatgcc

SEQ ID NO: 1792998 - DNA, 21 bp, Homo sapiens
ttacttcactatacaaacaaa

SEQ ID NO: 1792999 - DNA, 11 bp, Homo sapiens
ttacttctctt

SEQ ID NO: 1793000 - DNA, 14 bp, Homo sapiens
ttacttgacctcct

SEQ ID NO: 1793001 - DNA, 15 bp, Homo sapiens
ttacttgataaggga

SEQ ID NO: 1793002 - DNA, 22 bp, Homo sapiens
ttataatatgtgccttaagttt

SEQ ID NO: 1793003 - DNA, 16 bp, Homo sapiens
ttataatctcaaagga

SEQ ID NO: 1793004 - DNA, 18 bp, Homo sapiens
ttataatcttataattgt

SEQ ID NO: 1793005 - DNA, 19 bp, Homo sapiens
ttataatgaggatgattat

SEQ ID NO: 1793006 - DNA, 22 bp, Homo sapiens
ttataatgtattcatatttgta

SEQ ID NO: 1793007 - DNA, 19 bp, Homo sapiens
ttatacaaaataagaacga

SEQ ID NO: 1793008 - DNA, 22 bp, Homo sapiens
ttatacagatagagttccatat

SEQ ID NO: 1793009 - DNA, 15 bp, Homo sapiens
ttatacagctgtatt

SEQ ID NO: 1793010 - DNA, 16 bp, Homo sapiens
ttatacagtgtacatg

SEQ ID NO: 1793011 - DNA, 20 bp, Homo sapiens
ttatacagtgtacatgtaca

SEQ ID NO: 1793012 - DNA, 13 bp, Homo sapiens
ttataccagctta

SEQ ID NO: 1793013 - DNA, 21 bp, Homo sapiens
ttatacgctggcaacacagag

SEQ ID NO: 1793014 - DNA, 20 bp, Homo sapiens
ttatacggaaaaaattgtat

SEQ ID NO: 1793015 - DNA, 23 bp, Homo sapiens
ttatactactttgttaggatttt

SEQ ID NO: 1793016 - DNA, 11 bp, Homo sapiens
ttatagaaaat

SEQ ID NO: 1793017 - DNA, 12 bp, Homo sapiens
ttatagaaaatt

SEQ ID NO: 1793018 - DNA, 17 bp, Homo sapiens
ttatagaaggaatttgt

SEQ ID NO: 1793019 - DNA, 18 bp, Homo sapiens
ttatagaataaaagctat

SEQ ID NO: 1793020 - DNA, 13 bp, Homo sapiens
ttatagacaaaag

SEQ ID NO: 1793021 - DNA, 19 bp, Homo sapiens
ttatagacaaaagaataag

SEQ ID NO: 1793022 - DNA, 17 bp, Homo sapiens
ttatagagcagaaattc

SEQ ID NO: 1793023 - DNA, 23 bp, Homo sapiens
ttatagagcagaaattctgtttt

SEQ ID NO: 1793024 - DNA, 18 bp, Homo sapiens
ttatagatttagctattt

SEQ ID NO: 1793025 - DNA, 17 bp, Homo sapiens
ttatagcaactaatgtt

SEQ ID NO: 1793026 - DNA, 15 bp, Homo sapiens
ttataggtaaaatct

SEQ ID NO: 1793027 - DNA, 15 bp, Homo sapiens
ttatagtatatctgg

SEQ ID NO: 1793028 - DNA, 21 bp, Homo sapiens
ttatagtcctcctggaacttg

SEQ ID NO: 1793029 - DNA, 15 bp, Homo sapiens
ttatagtgaatactg

SEQ ID NO: 1793030 - DNA, 12 bp, Homo sapiens
ttatagtttctg

SEQ ID NO: 1793031 - DNA, 15 bp, Homo sapiens
ttatagtttctgagg

SEQ ID NO: 1793032 - DNA, 21 bp, Homo sapiens
ttatataaaacttaaaaacaa

SEQ ID NO: 1793033 - DNA, 19 bp, Homo sapiens
ttatataaataaagttttt

SEQ ID NO: 1793034 - DNA, 16 bp, Homo sapiens
ttatataactgtattt

SEQ ID NO: 1793035 - DNA, 14 bp, Homo sapiens
ttatataagtattc

SEQ ID NO: 1793036 - DNA, 23 bp, Homo sapiens
ttatatactgctatttacactat

SEQ ID NO: 1793037 - DNA, 23 bp, Homo sapiens
ttatatactgggttcttgtttta

SEQ ID NO: 1793038 - DNA, 19 bp, Homo sapiens
ttatatagattataacttg

SEQ ID NO: 1793039 - DNA, 22 bp, Homo sapiens
ttatatagattataacttgtct

SEQ ID NO: 1793040 - DNA, 13 bp, Homo sapiens
ttatatataataa

SEQ ID NO: 1793041 - DNA, 16 bp, Homo sapiens
ttatatatatatgtat

SEQ ID NO: 1793042 - DNA, 21 bp, Homo sapiens
ttatatatattgttaaatcct

SEQ ID NO: 1793043 - DNA, 13 bp, Homo sapiens
ttatatatccctg

SEQ ID NO: 1793044 - DNA, 19 bp, Homo sapiens
ttatatatccctgataaat

SEQ ID NO: 1793045 - DNA, 14 bp, Homo sapiens
ttatatatgtattt

SEQ ID NO: 1793046 - DNA, 12 bp, Homo sapiens
ttatatatgtga

SEQ ID NO: 1793047 - DNA, 14 bp, Homo sapiens
ttatatatttataa

SEQ ID NO: 1793048 - DNA, 20 bp, Homo sapiens
ttatatatttataactcatc

SEQ ID NO: 1793049 - DNA, 14 bp, Homo sapiens
ttatatattttgtt

SEQ ID NO: 1793050 - DNA, 17 bp, Homo sapiens
ttatatattttgttgtt

SEQ ID NO: 1793051 - DNA, 18 bp, Homo sapiens
ttatatattttgttgttc

SEQ ID NO: 1793052 - DNA, 15 bp, Homo sapiens
ttatatcacacaata

SEQ ID NO: 1793053 - DNA, 15 bp, Homo sapiens
ttatatcagcctgag

SEQ ID NO: 1793054 - DNA, 18 bp, Homo sapiens
ttatatccccctaaacta

SEQ ID NO: 1793055 - DNA, 23 bp, Homo sapiens
ttatatctcctttgtattctgtc

SEQ ID NO: 1793056 - DNA, 12 bp, Homo sapiens
ttatatctgtaa

SEQ ID NO: 1793057 - DNA, 15 bp, Homo sapiens
ttatatgagtagata

SEQ ID NO: 1793058 - DNA, 18 bp, Homo sapiens
ttatatgttgtaatattt

SEQ ID NO: 1793059 - DNA, 19 bp, Homo sapiens
ttatattaatgtacttgtt

SEQ ID NO: 1793060 - DNA, 17 bp, Homo sapiens
ttatattcaatgcattt

SEQ ID NO: 1793061 - DNA, 19 bp, Homo sapiens
ttatattggtgcgttttta

SEQ ID NO: 1793062 - DNA, 18 bp, Homo sapiens
ttatatttaaaaattgtt

SEQ ID NO: 1793063 - DNA, 19 bp, Homo sapiens
ttatatttatatttcaggt

SEQ ID NO: 1793064 - DNA, 13 bp, Homo sapiens
ttatatttattgt

SEQ ID NO: 1793065 - DNA, 17 bp, Homo sapiens
ttatatttattgttaga

SEQ ID NO: 1793066 - DNA, 13 bp, Homo sapiens
ttatatttccttt

SEQ ID NO: 1793067 - DNA, 13 bp, Homo sapiens
ttatatttggaaa

SEQ ID NO: 1793068 - DNA, 17 bp, Homo sapiens
ttatatttggaaagaga

SEQ ID NO: 1793069 - DNA, 19 bp, Homo sapiens
ttatatttggaaagagacc

SEQ ID NO: 1793070 - DNA, 20 bp, Homo sapiens
ttatattttatgaacattgt

SEQ ID NO: 1793071 - DNA, 13 bp, Homo sapiens
ttatatttttaaa

SEQ ID NO: 1793072 - DNA, 15 bp, Homo sapiens
ttatatttttataga

SEQ ID NO: 1793073 - DNA, 19 bp, Homo sapiens
ttatatttttgtacatatt

SEQ ID NO: 1793074 - DNA, 23 bp, Homo sapiens
ttatatttttgtgttttcttgta

SEQ ID NO: 1793075 - DNA, 18 bp, Homo sapiens
ttatattttttctataaa

SEQ ID NO: 1793076 - DNA, 17 bp, Homo sapiens
ttatcaaaaagtattat

SEQ ID NO: 1793077 - DNA, 15 bp, Homo sapiens
ttatcaaaactgttg

SEQ ID NO: 1793078 - DNA, 15 bp, Homo sapiens
ttatcaaaactttct

SEQ ID NO: 1793079 - DNA, 21 bp, Homo sapiens
ttatcaaaccctagccttgct

SEQ ID NO: 1793080 - DNA, 15 bp, Homo sapiens
ttatcaacaatagtg

SEQ ID NO: 1793081 - DNA, 12 bp, Homo sapiens
ttatcaacttta

SEQ ID NO: 1793082 - DNA, 15 bp, Homo sapiens
ttatcaatatctaat

SEQ ID NO: 1793083 - DNA, 17 bp, Homo sapiens
ttatcaatatctaatat

SEQ ID NO: 1793084 - DNA, 19 bp, Homo sapiens
ttatcaatttttcccagta

SEQ ID NO: 1793085 - DNA, 21 bp, Homo sapiens
ttatcaatttttcccagtatt

SEQ ID NO: 1793086 - DNA, 12 bp, Homo sapiens
ttatcacctcat

SEQ ID NO: 1793087 - DNA, 18 bp, Homo sapiens
ttatcacctcattctgaa

SEQ ID NO: 1793088 - DNA, 14 bp, Homo sapiens
ttatcagcaaagaa

SEQ ID NO: 1793089 - DNA, 23 bp, Homo sapiens
ttatcagtcataactaaataaag

SEQ ID NO: 1793090 - DNA, 20 bp, Homo sapiens
ttatcatccacattgtttta

SEQ ID NO: 1793091 - DNA, 14 bp, Homo sapiens
ttatcatgaatttt

SEQ ID NO: 1793092 - DNA, 18 bp, Homo sapiens
ttatcatgaattttaaag

SEQ ID NO: 1793093 - DNA, 19 bp, Homo sapiens
ttatcatgaattttaaagt

SEQ ID NO: 1793094 - DNA, 16 bp, Homo sapiens
ttatcatgcaaatgct

SEQ ID NO: 1793095 - DNA, 17 bp, Homo sapiens
ttatcattaaaaattac

SEQ ID NO: 1793096 - DNA, 19 bp, Homo sapiens
ttatcattcattcttagct

SEQ ID NO: 1793097 - DNA, 16 bp, Homo sapiens
ttatcattttcaaaat

SEQ ID NO: 1793098 - DNA, 22 bp, Homo sapiens
ttatccaaggtgtaactctaat

SEQ ID NO: 1793099 - DNA, 18 bp, Homo sapiens
ttatccagaaaactgtga

SEQ ID NO: 1793100 - DNA, 17 bp, Homo sapiens
ttatcccaagaatgcaa

SEQ ID NO: 1793101 - DNA, 12 bp, Homo sapiens
ttatccctctct

SEQ ID NO: 1793102 - DNA, 14 bp, Homo sapiens
ttatcccttaagaa

SEQ ID NO: 1793103 - DNA, 19 bp, Homo sapiens
ttatcctaaaacaaatagt

SEQ ID NO: 1793104 - DNA, 18 bp, Homo sapiens
ttatcctctctctcttct

SEQ ID NO: 1793105 - DNA, 16 bp, Homo sapiens
ttatcggaagcagtgc

SEQ ID NO: 1793106 - DNA, 18 bp, Homo sapiens
ttatcggctctattctct

SEQ ID NO: 1793107 - DNA, 21 bp, Homo sapiens
ttatcggctctattctctaaa

SEQ ID NO: 1793108 - DNA, 21 bp, Homo sapiens
ttatcgggagcagtgtcttcc

SEQ ID NO: 1793109 - DNA, 22 bp, Homo sapiens
ttatcgtttttgtattttcatg

SEQ ID NO: 1793110 - DNA, 20 bp, Homo sapiens
ttatctaatacctctgtgtg

SEQ ID NO: 1793111 - DNA, 11 bp, Homo sapiens
ttatctaattt

SEQ ID NO: 1793112 - DNA, 21 bp, Homo sapiens
ttatctagcaagaagattcta

SEQ ID NO: 1793113 - DNA, 23 bp, Homo sapiens
ttatctagcaagaagattctaaa

SEQ ID NO: 1793114 - DNA, 14 bp, Homo sapiens
ttatctataaaagg

SEQ ID NO: 1793115 - DNA, 18 bp, Homo sapiens
ttatctatgatgtttctt

SEQ ID NO: 1793116 - DNA, 15 bp, Homo sapiens
ttatctatgtggaaa

SEQ ID NO: 1793117 - DNA, 12 bp, Homo sapiens
ttatctgcctgg

SEQ ID NO: 1793118 - DNA, 16 bp, Homo sapiens
ttatctgcctggcctg

SEQ ID NO: 1793119 - DNA, 19 bp, Homo sapiens
ttatctgcctggcctggct

SEQ ID NO: 1793120 - DNA, 20 bp, Homo sapiens
ttatctgcctggcctggctc

SEQ ID NO: 1793121 - DNA, 19 bp, Homo sapiens
ttatctggaacaacttgta

SEQ ID NO: 1793122 - DNA, 12 bp, Homo sapiens
ttatctgggctt

SEQ ID NO: 1793123 - DNA, 16 bp, Homo sapiens
ttatctgtcagctgca

SEQ ID NO: 1793124 - DNA, 14 bp, Homo sapiens
ttatcttattttct

SEQ ID NO: 1793125 - DNA, 18 bp, Homo sapiens
ttatcttctcaagttcta

SEQ ID NO: 1793126 - DNA, 19 bp, Homo sapiens
ttatcttctcaagttctaa

SEQ ID NO: 1793127 - DNA, 14 bp, Homo sapiens
ttatcttctggatt

SEQ ID NO: 1793128 - DNA, 17 bp, Homo sapiens
ttatcttgaaggaaaaa

SEQ ID NO: 1793129 - DNA, 20 bp, Homo sapiens
ttatcttgaagtcagccaca

SEQ ID NO: 1793130 - DNA, 19 bp, Homo sapiens
ttatcttgggactgggttt

SEQ ID NO: 1793131 - DNA, 17 bp, Homo sapiens
ttatcttgtctctgggc

SEQ ID NO: 1793132 - DNA, 17 bp, Homo sapiens
ttatctttcgtgataaa

SEQ ID NO: 1793133 - DNA, 14 bp, Homo sapiens
ttatgaacagaaat

SEQ ID NO: 1793134 - DNA, 16 bp, Homo sapiens
ttatgaacattgtact

SEQ ID NO: 1793135 - DNA, 14 bp, Homo sapiens
ttatgacagttata

SEQ ID NO: 1793136 - DNA, 18 bp, Homo sapiens
ttatgacatcacttgtac

SEQ ID NO: 1793137 - DNA, 21 bp, Homo sapiens
ttatgacatcacttgtacaaa

SEQ ID NO: 1793138 - DNA, 23 bp, Homo sapiens
ttatgacatcacttgtacaaaat

SEQ ID NO: 1793139 - DNA, 18 bp, Homo sapiens
ttatgagttccctaaaca

SEQ ID NO: 1793140 - DNA, 15 bp, Homo sapiens
ttatgagtttttgat

SEQ ID NO: 1793141 - DNA, 23 bp, Homo sapiens
ttatgagtttttgatagctttat

SEQ ID NO: 1793142 - DNA, 17 bp, Homo sapiens
ttatgataatagattct

SEQ ID NO: 1793143 - DNA, 17 bp, Homo sapiens
ttatgatctaataaact

SEQ ID NO: 1793144 - DNA, 20 bp, Homo sapiens
ttatgatgcatacagttttc

SEQ ID NO: 1793145 - DNA, 21 bp, Homo sapiens
ttatgatgcatacagttttct

SEQ ID NO: 1793146 - DNA, 18 bp, Homo sapiens
ttatgatgttagaagaag

SEQ ID NO: 1793147 - DNA, 19 bp, Homo sapiens
ttatgatgttagaagaaga

SEQ ID NO: 1793148 - DNA, 19 bp, Homo sapiens
ttatgattgcattgtatga

SEQ ID NO: 1793149 - DNA, 13 bp, Homo sapiens
ttatgcaaaagca

SEQ ID NO: 1793150 - DNA, 20 bp, Homo sapiens
ttatgcaaatacaatcagcc

SEQ ID NO: 1793151 - DNA, 17 bp, Homo sapiens
ttatgcaaggaaggaaa

SEQ ID NO: 1793152 - DNA, 22 bp, Homo sapiens
ttatgcaaggaaggaaagaaag

SEQ ID NO: 1793153 - DNA, 13 bp, Homo sapiens
ttatgcactgtgg

SEQ ID NO: 1793154 - DNA, 17 bp, Homo sapiens
ttatgcagacagtctgt

SEQ ID NO: 1793155 - DNA, 17 bp, Homo sapiens
ttatgcagctgttctgg

SEQ ID NO: 1793156 - DNA, 14 bp, Homo sapiens
ttatgcatttcatt

SEQ ID NO: 1793157 - DNA, 19 bp, Homo sapiens
ttatgccaagaacagaaaa

SEQ ID NO: 1793158 - DNA, 22 bp, Homo sapiens
ttatgccacttccttttaactg

SEQ ID NO: 1793159 - DNA, 20 bp, Homo sapiens
ttatgccccagttcagaaat

SEQ ID NO: 1793160 - DNA, 17 bp, Homo sapiens
ttatgccggatgtgctt

SEQ ID NO: 1793161 - DNA, 20 bp, Homo sapiens
ttatgccggatgtgcttttc

SEQ ID NO: 1793162 - DNA, 16 bp, Homo sapiens
ttatgcggttaatttt

SEQ ID NO: 1793163 - DNA, 19 bp, Homo sapiens
ttatgcggttaattttgaa

SEQ ID NO: 1793164 - DNA, 20 bp, Homo sapiens
ttatgctgtattttaacact

SEQ ID NO: 1793165 - DNA, 24 bp, Homo sapiens
ttatgctgtattttaacactttgt

SEQ ID NO: 1793166 - DNA, 16 bp, Homo sapiens
ttatggatgatttaag

SEQ ID NO: 1793167 - DNA, 18 bp, Homo sapiens
ttatggcaagtgatatca

SEQ ID NO: 1793168 - DNA, 15 bp, Homo sapiens
ttatggcatttctat

SEQ ID NO: 1793169 - DNA, 12 bp, Homo sapiens
ttatggcctcag

SEQ ID NO: 1793170 - DNA, 16 bp, Homo sapiens
ttatggctgctgggct

SEQ ID NO: 1793171 - DNA, 16 bp, Homo sapiens
ttatgggatctcaaca

SEQ ID NO: 1793172 - DNA, 15 bp, Homo sapiens
ttatgggcccctggc

SEQ ID NO: 1793173 - DNA, 22 bp, Homo sapiens
ttatgggggggagggagggcta

SEQ ID NO: 1793174 - DNA, 15 bp, Homo sapiens
ttatgtaaacaaatc

SEQ ID NO: 1793175 - DNA, 23 bp, Homo sapiens
ttatgtaaacaaatctttccata

SEQ ID NO: 1793176 - DNA, 20 bp, Homo sapiens
ttatgtaatatattgtacaa

SEQ ID NO: 1793177 - DNA, 13 bp, Homo sapiens
ttatgtagcacta

SEQ ID NO: 1793178 - DNA, 22 bp, Homo sapiens
ttatgtagcactactacagaaa

SEQ ID NO: 1793179 - DNA, 20 bp, Homo sapiens
ttatgtattctttctgcctt

SEQ ID NO: 1793180 - DNA, 15 bp, Homo sapiens
ttatgtcatagaaat

SEQ ID NO: 1793181 - DNA, 17 bp, Homo sapiens
ttatgtcatagaaatat

SEQ ID NO: 1793182 - DNA, 15 bp, Homo sapiens
ttatgtctcttctga

SEQ ID NO: 1793183 - DNA, 13 bp, Homo sapiens
ttatgtgaaaaat

SEQ ID NO: 1793184 - DNA, 18 bp, Homo sapiens
ttatgtgaaaaattaact

SEQ ID NO: 1793185 - DNA, 15 bp, Homo sapiens
ttatgtgaactttga

SEQ ID NO: 1793186 - DNA, 20 bp, Homo sapiens
ttatgtgaatttttaagctg

SEQ ID NO: 1793187 - DNA, 14 bp, Homo sapiens
ttatgtgatcaatt

SEQ ID NO: 1793188 - DNA, 13 bp, Homo sapiens
ttatgtgctatgc

SEQ ID NO: 1793189 - DNA, 20 bp, Homo sapiens
ttatgtggttttagattttc

SEQ ID NO: 1793190 - DNA, 17 bp, Homo sapiens
ttatgtgttatgaacat

SEQ ID NO: 1793191 - DNA, 20 bp, Homo sapiens
ttatgttcctcaaggtccat

SEQ ID NO: 1793192 - DNA, 19 bp, Homo sapiens
ttatgtttaaaagaaatat

SEQ ID NO: 1793193 - DNA, 14 bp, Homo sapiens
ttatgtttattaca

SEQ ID NO: 1793194 - DNA, 15 bp, Homo sapiens
ttatgttttgtttct

SEQ ID NO: 1793195 - DNA, 16 bp, Homo sapiens
ttatgttttgtttctg

SEQ ID NO: 1793196 - DNA, 16 bp, Homo sapiens
ttattaaaatcttaaa

SEQ ID NO: 1793197 - DNA, 17 bp, Homo sapiens
ttattaaagttctgtaa

SEQ ID NO: 1793198 - DNA, 17 bp, Homo sapiens
ttattaaatgcttcatt

SEQ ID NO: 1793199 - DNA, 21 bp, Homo sapiens
ttattaaattaattgaatcta

SEQ ID NO: 1793200 - DNA, 15 bp, Homo sapiens
ttattaactttaatg

SEQ ID NO: 1793201 - DNA, 24 bp, Homo sapiens
ttattaagtctgggatgtagaact

SEQ ID NO: 1793202 - DNA, 15 bp, Homo sapiens
ttattaataaaacaa

SEQ ID NO: 1793203 - DNA, 12 bp, Homo sapiens
ttattaatgttt

SEQ ID NO: 1793204 - DNA, 20 bp, Homo sapiens
ttattaattttagtttttca

SEQ ID NO: 1793205 - DNA, 18 bp, Homo sapiens
ttattaatttttaaggat

SEQ ID NO: 1793206 - DNA, 12 bp, Homo sapiens
ttattacaatgt

SEQ ID NO: 1793207 - DNA, 21 bp, Homo sapiens
ttattacacaaagaacttgct

SEQ ID NO: 1793208 - DNA, 18 bp, Homo sapiens
ttattacatctttcacat

SEQ ID NO: 1793209 - DNA, 13 bp, Homo sapiens
ttattacatgtaa

SEQ ID NO: 1793210 - DNA, 18 bp, Homo sapiens
ttattacatgtaatttga

SEQ ID NO: 1793211 - DNA, 19 bp, Homo sapiens
ttattacccaagtcttctc

SEQ ID NO: 1793212 - DNA, 19 bp, Homo sapiens
ttattaccccctccttcag

SEQ ID NO: 1793213 - DNA, 13 bp, Homo sapiens
ttattacctctga

SEQ ID NO: 1793214 - DNA, 17 bp, Homo sapiens
ttattacttatttgtgc

SEQ ID NO: 1793215 - DNA, 12 bp, Homo sapiens
ttattagatgtt

SEQ ID NO: 1793216 - DNA, 23 bp, Homo sapiens
ttattagcatttgttttagcatt

SEQ ID NO: 1793217 - DNA, 22 bp, Homo sapiens
ttattagccaggtaatgtgaat

SEQ ID NO: 1793218 - DNA, 20 bp, Homo sapiens
ttattagtaaatgcttatca

SEQ ID NO: 1793219 - DNA, 15 bp, Homo sapiens
ttattagtttacatc

SEQ ID NO: 1793220 - DNA, 21 bp, Homo sapiens
ttattataatcttataattgt

SEQ ID NO: 1793221 - DNA, 22 bp, Homo sapiens
ttattatatatacatgggtgaa

SEQ ID NO: 1793222 - DNA, 17 bp, Homo sapiens
ttattatcaagtagact

SEQ ID NO: 1793223 - DNA, 14 bp, Homo sapiens
ttattatgcattat

SEQ ID NO: 1793224 - DNA, 14 bp, Homo sapiens
ttattatgttctta

SEQ ID NO: 1793225 - DNA, 21 bp, Homo sapiens
ttattatgtttattacaattt

SEQ ID NO: 1793226 - DNA, 14 bp, Homo sapiens
ttattatttctgtt

SEQ ID NO: 1793227 - DNA, 16 bp, Homo sapiens
ttattattttcacctg

SEQ ID NO: 1793228 - DNA, 23 bp, Homo sapiens
ttattcaaatttgatgatgttaa

SEQ ID NO: 1793229 - DNA, 16 bp, Homo sapiens
ttattcaaatttgtac

SEQ ID NO: 1793230 - DNA, 17 bp, Homo sapiens
ttattcaagaatgaaaa

SEQ ID NO: 1793231 - DNA, 18 bp, Homo sapiens
ttattcaattcctctggg

SEQ ID NO: 1793232 - DNA, 13 bp, Homo sapiens
ttattcactgtaa

SEQ ID NO: 1793233 - DNA, 13 bp, Homo sapiens
ttattcataatga

SEQ ID NO: 1793234 - DNA, 14 bp, Homo sapiens
ttattcataatgaa

SEQ ID NO: 1793235 - DNA, 12 bp, Homo sapiens
ttattcattatg

SEQ ID NO: 1793236 - DNA, 18 bp, Homo sapiens
ttattcatttaaaatgat

SEQ ID NO: 1793237 - DNA, 15 bp, Homo sapiens
ttattcatttggtga

SEQ ID NO: 1793238 - DNA, 14 bp, Homo sapiens
ttattccaggagaa

SEQ ID NO: 1793239 - DNA, 20 bp, Homo sapiens
ttattccccattcttcctag

SEQ ID NO: 1793240 - DNA, 19 bp, Homo sapiens
ttattccctttcacaaaat

SEQ ID NO: 1793241 - DNA, 16 bp, Homo sapiens
ttattccgagcattcc

SEQ ID NO: 1793242 - DNA, 16 bp, Homo sapiens
ttattcctcctgctca

SEQ ID NO: 1793243 - DNA, 20 bp, Homo sapiens
ttattcctgccctgctgttt

SEQ ID NO: 1793244 - DNA, 13 bp, Homo sapiens
ttattcctgtatg

SEQ ID NO: 1793245 - DNA, 14 bp, Homo sapiens
ttattctaataaat

SEQ ID NO: 1793246 - DNA, 11 bp, Homo sapiens
ttattctagtc

SEQ ID NO: 1793247 - DNA, 16 bp, Homo sapiens
ttattctagtcaactg

SEQ ID NO: 1793248 - DNA, 17 bp, Homo sapiens
ttattctctcacagtgt

SEQ ID NO: 1793249 - DNA, 18 bp, Homo sapiens
ttattcttccagaatgct

SEQ ID NO: 1793250 - DNA, 14 bp, Homo sapiens
ttattcttctagag

SEQ ID NO: 1793251 - DNA, 11 bp, Homo sapiens
ttattcttgat

SEQ ID NO: 1793252 - DNA, 13 bp, Homo sapiens
ttattcttgatca

SEQ ID NO: 1793253 - DNA, 13 bp, Homo sapiens
ttattcttgctgg

SEQ ID NO: 1793254 - DNA, 15 bp, Homo sapiens
ttattctttctcctt

SEQ ID NO: 1793255 - DNA, 13 bp, Homo sapiens
ttattctttttaa

SEQ ID NO: 1793256 - DNA, 16 bp, Homo sapiens
ttattgaatcttaatt

SEQ ID NO: 1793257 - DNA, 14 bp, Homo sapiens
ttattgacaataat

SEQ ID NO: 1793258 - DNA, 11 bp, Homo sapiens
ttattgacact

SEQ ID NO: 1793259 - DNA, 13 bp, Homo sapiens
ttattgacactga

SEQ ID NO: 1793260 - DNA, 17 bp, Homo sapiens
ttattgacactgaactt

SEQ ID NO: 1793261 - DNA, 19 bp, Homo sapiens
ttattgataagttcataca

SEQ ID NO: 1793262 - DNA, 17 bp, Homo sapiens
ttattgcaaagttgtat

SEQ ID NO: 1793263 - DNA, 13 bp, Homo sapiens
ttattgcattata

SEQ ID NO: 1793264 - DNA, 14 bp, Homo sapiens
ttattggctgagat

SEQ ID NO: 1793265 - DNA, 20 bp, Homo sapiens
ttattgggcaagtgattgaa

SEQ ID NO: 1793266 - DNA, 18 bp, Homo sapiens
ttattggttttgcagaag

SEQ ID NO: 1793267 - DNA, 14 bp, Homo sapiens
ttcagattcccaga

SEQ ID NO: 1793268 - DNA, 13 bp, Homo sapiens
ttcagcaaaccat

SEQ ID NO: 1793269 - DNA, 23 bp, Homo sapiens
ttcagcaaactaaccagcattcc

SEQ ID NO: 1793270 - DNA, 20 bp, Homo sapiens
ttcagcacaggaattctcaa

SEQ ID NO: 1793271 - DNA, 16 bp, Homo sapiens
ttcagcaccaccctag

SEQ ID NO: 1793272 - DNA, 13 bp, Homo sapiens
ttcagcaccctgg

SEQ ID NO: 1793273 - DNA, 23 bp, Homo sapiens
ttcagcaccctgggtgccattcc

SEQ ID NO: 1793274 - DNA, 13 bp, Homo sapiens
ttcagcactgtcc

SEQ ID NO: 1793275 - DNA, 14 bp, Homo sapiens
ttcagcactgtccc

SEQ ID NO: 1793276 - DNA, 17 bp, Homo sapiens
ttcagcagcaaattttc

SEQ ID NO: 1793277 - DNA, 19 bp, Homo sapiens
ttcagcagcaaattttcag

SEQ ID NO: 1793278 - DNA, 11 bp, Homo sapiens
ttcagcagtgc

SEQ ID NO: 1793279 - DNA, 19 bp, Homo sapiens
ttcagcatccgcaggtgct

SEQ ID NO: 1793280 - DNA, 18 bp, Homo sapiens
ttcagcattaggctttta

SEQ ID NO: 1793281 - DNA, 22 bp, Homo sapiens
ttcagcatttgatttccatggg

SEQ ID NO: 1793282 - DNA, 10 bp, Homo sapiens
ttcagccaag

SEQ ID NO: 1793283 - DNA, 15 bp, Homo sapiens
ttcagccacatgccc

SEQ ID NO: 1793284 - DNA, 17 bp, Homo sapiens
ttcagccaggagctggg

SEQ ID NO: 1793285 - DNA, 19 bp, Homo sapiens
ttcagcccctagtgctatt

SEQ ID NO: 1793286 - DNA, 17 bp, Homo sapiens
ttcagcccctcctctgc

SEQ ID NO: 1793287 - DNA, 12 bp, Homo sapiens
ttcagccctcac

SEQ ID NO: 1793288 - DNA, 22 bp, Homo sapiens
ttcagcctagccgacctcagcc

SEQ ID NO: 1793289 - DNA, 16 bp, Homo sapiens
ttcagcgttttgcaag

SEQ ID NO: 1793290 - DNA, 20 bp, Homo sapiens
ttcagctagcttttaggaaa

SEQ ID NO: 1793291 - DNA, 16 bp, Homo sapiens
ttcagctctttccaaa

SEQ ID NO: 1793292 - DNA, 18 bp, Homo sapiens
ttcagctctttccaaatt

SEQ ID NO: 1793293 - DNA, 14 bp, Homo sapiens
ttcaggacacatct

SEQ ID NO: 1793294 - DNA, 18 bp, Homo sapiens
ttcaggagcgcaagatag

SEQ ID NO: 1793295 - DNA, 20 bp, Homo sapiens
ttcaggaggccctggtgtca

SEQ ID NO: 1793296 - DNA, 14 bp, Homo sapiens
ttcaggaggctgga

SEQ ID NO: 1793297 - DNA, 16 bp, Homo sapiens
ttcaggcattttgttc

SEQ ID NO: 1793298 - DNA, 15 bp, Homo sapiens
ttcaggccagcccag

SEQ ID NO: 1793299 - DNA, 16 bp, Homo sapiens
ttcaggctcttctcct

SEQ ID NO: 1793300 - DNA, 13 bp, Homo sapiens
ttcaggctgcttg

SEQ ID NO: 1793301 - DNA, 23 bp, Homo sapiens
ttcagggccagaaggagggcaga

SEQ ID NO: 1793302 - DNA, 17 bp, Homo sapiens
ttcaggggactcagccc

SEQ ID NO: 1793303 - DNA, 20 bp, Homo sapiens
ttcaggggactcagccctga

SEQ ID NO: 1793304 - DNA, 9 bp, Homo sapiens
ttcaggtac

SEQ ID NO: 1793305 - DNA, 14 bp, Homo sapiens
ttcaggtactaaat

SEQ ID NO: 1793306 - DNA, 20 bp, Homo sapiens
ttcaggtaggcccttgtcct

SEQ ID NO: 1793307 - DNA, 21 bp, Homo sapiens
ttcaggtaggcccttgtcctg

SEQ ID NO: 1793308 - DNA, 22 bp, Homo sapiens
ttcaggtaggcccttgtcctgc

SEQ ID NO: 1793309 - DNA, 15 bp, Homo sapiens
ttcaggttttgtaaa

SEQ ID NO: 1793310 - DNA, 16 bp, Homo sapiens
ttcaggtttttccttt

SEQ ID NO: 1793311 - DNA, 14 bp, Homo sapiens
ttcagtaataactc

SEQ ID NO: 1793312 - DNA, 19 bp, Homo sapiens
ttcagtacttttttaaata

SEQ ID NO: 1793313 - DNA, 21 bp, Homo sapiens
ttcagtacttttttaaatatt

SEQ ID NO: 1793314 - DNA, 18 bp, Homo sapiens
ttcagtagaattaccatt

SEQ ID NO: 1793315 - DNA, 14 bp, Homo sapiens
ttcagtatactgtg

SEQ ID NO: 1793316 - DNA, 16 bp, Homo sapiens
ttcagtatactgtgtg

SEQ ID NO: 1793317 - DNA, 17 bp, Homo sapiens
ttcagtcacatggcatg

SEQ ID NO: 1793318 - DNA, 22 bp, Homo sapiens
ttcagtcatagcaagcttttgc

SEQ ID NO: 1793319 - DNA, 15 bp, Homo sapiens
ttcagtcccctctct

SEQ ID NO: 1793320 - DNA, 22 bp, Homo sapiens
ttcagtccgcctggccggctcc

SEQ ID NO: 1793321 - DNA, 19 bp, Homo sapiens
ttcagtctcacagagaagc

SEQ ID NO: 1793322 - DNA, 22 bp, Homo sapiens
ttcagtctcacagagaagctcc

SEQ ID NO: 1793323 - DNA, 17 bp, Homo sapiens
ttcagtctcagctgctg

SEQ ID NO: 1793324 - DNA, 21 bp, Homo sapiens
ttcagtctctataccaataaa

SEQ ID NO: 1793325 - DNA, 16 bp, Homo sapiens
ttcagtctgctccacc

SEQ ID NO: 1793326 - DNA, 17 bp, Homo sapiens
ttcagtctgctccacca

SEQ ID NO: 1793327 - DNA, 12 bp, Homo sapiens
ttcagtctgtgt

SEQ ID NO: 1793328 - DNA, 14 bp, Homo sapiens
ttcagtcttctgga

SEQ ID NO: 1793329 - DNA, 15 bp, Homo sapiens
ttcagtcttctggat

SEQ ID NO: 1793330 - DNA, 20 bp, Homo sapiens
ttcagtgaagatgctgtaaa

SEQ ID NO: 1793331 - DNA, 16 bp, Homo sapiens
ttcagtgactcctgct

SEQ ID NO: 1793332 - DNA, 18 bp, Homo sapiens
ttcagtgactcctgctgg

SEQ ID NO: 1793333 - DNA, 19 bp, Homo sapiens
ttcagtgactcctgctggt

SEQ ID NO: 1793334 - DNA, 10 bp, Homo sapiens
ttcagtgccc

SEQ ID NO: 1793335 - DNA, 14 bp, Homo sapiens
ttcagtgcccacca

SEQ ID NO: 1793336 - DNA, 13 bp, Homo sapiens
ttcagtgccttcc

SEQ ID NO: 1793337 - DNA, 20 bp, Homo sapiens
ttcagtgccttcctctctct

SEQ ID NO: 1793338 - DNA, 16 bp, Homo sapiens
ttcagtgctacatttt

SEQ ID NO: 1793339 - DNA, 13 bp, Homo sapiens
ttcagtgctgtgg

SEQ ID NO: 1793340 - DNA, 14 bp, Homo sapiens
ttcagtgggagaaa

SEQ ID NO: 1793341 - DNA, 18 bp, Homo sapiens
ttcagtgtcccgggcccg

SEQ ID NO: 1793342 - DNA, 13 bp, Homo sapiens
ttcagttcagctt

SEQ ID NO: 1793343 - DNA, 16 bp, Homo sapiens
ttcagttgatcactgg

SEQ ID NO: 1793344 - DNA, 14 bp, Homo sapiens
ttcagtttttcatt

SEQ ID NO: 1793345 - DNA, 18 bp, Homo sapiens
ttcagtttttcatttgtt

SEQ ID NO: 1793346 - DNA, 15 bp, Homo sapiens
ttcataaagaattgt

SEQ ID NO: 1793347 - DNA, 13 bp, Homo sapiens
ttcataatcagta

SEQ ID NO: 1793348 - DNA, 17 bp, Homo sapiens
ttcataatgaattataa

SEQ ID NO: 1793349 - DNA, 20 bp, Homo sapiens
ttcataatgaattataacag

SEQ ID NO: 1793350 - DNA, 19 bp, Homo sapiens
ttcatacattgtacgaaga

SEQ ID NO: 1793351 - DNA, 15 bp, Homo sapiens
ttcataccacttgaa

SEQ ID NO: 1793352 - DNA, 16 bp, Homo sapiens
ttcataccacttgaat

SEQ ID NO: 1793353 - DNA, 21 bp, Homo sapiens
ttcataccgcctcgtgccagc

SEQ ID NO: 1793354 - DNA, 15 bp, Homo sapiens
ttcatacctcagaat

SEQ ID NO: 1793355 - DNA, 14 bp, Homo sapiens
ttcataccttgatg

SEQ ID NO: 1793356 - DNA, 19 bp, Homo sapiens
ttcatactatttagatttt

SEQ ID NO: 1793357 - DNA, 22 bp, Homo sapiens
ttcatactgtaacattcaggaa

SEQ ID NO: 1793358 - DNA, 18 bp, Homo sapiens
ttcatagagatttgtcta

SEQ ID NO: 1793359 - DNA, 20 bp, Homo sapiens
ttcatagagatttgtctaat

SEQ ID NO: 1793360 - DNA, 12 bp, Homo sapiens
ttcatagatatt

SEQ ID NO: 1793361 - DNA, 20 bp, Homo sapiens
ttcataggcggtcatgtgtg

SEQ ID NO: 1793362 - DNA, 22 bp, Homo sapiens
ttcataggcggtcatgtgtgca

SEQ ID NO: 1793363 - DNA, 19 bp, Homo sapiens
ttcatagggtctcttcagg

SEQ ID NO: 1793364 - DNA, 17 bp, Homo sapiens
ttcataggttactacct

SEQ ID NO: 1793365 - DNA, 17 bp, Homo sapiens
ttcatatacaaacatgt

SEQ ID NO: 1793366 - DNA, 20 bp, Homo sapiens
ttcatatctatttattaaat

SEQ ID NO: 1793367 - DNA, 18 bp, Homo sapiens
ttcatattcatgcaagta

SEQ ID NO: 1793368 - DNA, 15 bp, Homo sapiens
ttcatattgagatca

SEQ ID NO: 1793369 - DNA, 19 bp, Homo sapiens
ttcatatttaagtgtattt

SEQ ID NO: 1793370 - DNA, 16 bp, Homo sapiens
ttcatatttacttctt

SEQ ID NO: 1793371 - DNA, 22 bp, Homo sapiens
ttcatatttgtactttctgtta

SEQ ID NO: 1793372 - DNA, 15 bp, Homo sapiens
ttcatcaaatcatca

SEQ ID NO: 1793373 - DNA, 20 bp, Homo sapiens
ttcatcaatatccctcttgt

SEQ ID NO: 1793374 - DNA, 21 bp, Homo sapiens
ttcatcaatatccctcttgta

SEQ ID NO: 1793375 - DNA, 22 bp, Homo sapiens
ttcatcaatatccctcttgtaa

SEQ ID NO: 1793376 - DNA, 16 bp, Homo sapiens
ttcatcagtgttaaaa

SEQ ID NO: 1793377 - DNA, 15 bp, Homo sapiens
ttcatcatttgcaca

SEQ ID NO: 1793378 - DNA, 21 bp, Homo sapiens
ttcatccaatcctcactgggt

SEQ ID NO: 1793379 - DNA, 16 bp, Homo sapiens
ttcatccaatgtgaag

SEQ ID NO: 1793380 - DNA, 15 bp, Homo sapiens
ttcatcccctcagaa

SEQ ID NO: 1793381 - DNA, 21 bp, Homo sapiens
ttcatcccgtatcacagtgtt

SEQ ID NO: 1793382 - DNA, 15 bp, Homo sapiens
ttcatccgcctgtgg

SEQ ID NO: 1793383 - DNA, 16 bp, Homo sapiens
ttcatccgcctgtggg

SEQ ID NO: 1793384 - DNA, 16 bp, Homo sapiens
ttcatcctcctcccca

SEQ ID NO: 1793385 - DNA, 17 bp, Homo sapiens
ttcatctaccttttctg

SEQ ID NO: 1793386 - DNA, 22 bp, Homo sapiens
ttcatctatggcagtccagcca

SEQ ID NO: 1793387 - DNA, 21 bp, Homo sapiens
ttcatctatttcgagtgttgt

SEQ ID NO: 1793388 - DNA, 17 bp, Homo sapiens
ttcatctgactatgaca

SEQ ID NO: 1793389 - DNA, 13 bp, Homo sapiens
ttcatctgctctc

SEQ ID NO: 1793390 - DNA, 14 bp, Homo sapiens
ttcatcttaaacta

SEQ ID NO: 1793391 - DNA, 13 bp, Homo sapiens
ttcatcttcctgt

SEQ ID NO: 1793392 - DNA, 16 bp, Homo sapiens
ttcatcttctggaata

SEQ ID NO: 1793393 - DNA, 19 bp, Homo sapiens
ttcatcttctggaatattg

SEQ ID NO: 1793394 - DNA, 21 bp, Homo sapiens
ttcatcttttattttggaact

SEQ ID NO: 1793395 - DNA, 15 bp, Homo sapiens
ttcatgaaaatacca

SEQ ID NO: 1793396 - DNA, 17 bp, Homo sapiens
ttcatgaacttggctgt

SEQ ID NO: 1793397 - DNA, 16 bp, Homo sapiens
ttcatgattatagcaa

SEQ ID NO: 1793398 - DNA, 17 bp, Homo sapiens
ttcatgatttcatttca

SEQ ID NO: 1793399 - DNA, 15 bp, Homo sapiens
ttcatgcaatgacat

SEQ ID NO: 1793400 - DNA, 14 bp, Homo sapiens
ttcatgcagctgtg

SEQ ID NO: 1793401 - DNA, 22 bp, Homo sapiens
ttcatgccagctacttcctcct

SEQ ID NO: 1793402 - DNA, 16 bp, Homo sapiens
ttcatgccatctgttt

SEQ ID NO: 1793403 - DNA, 18 bp, Homo sapiens
ttcatgccattctgcctc

SEQ ID NO: 1793404 - DNA, 21 bp, Homo sapiens
ttcatgcctttgtaagttatt

SEQ ID NO: 1793405 - DNA, 14 bp, Homo sapiens
ttcatgcttgacat

SEQ ID NO: 1793406 - DNA, 15 bp, Homo sapiens
ttcatgcttgacata

SEQ ID NO: 1793407 - DNA, 18 bp, Homo sapiens
ttcatgcttgacatacct

SEQ ID NO: 1793408 - DNA, 14 bp, Homo sapiens
ttcatggacacttt

SEQ ID NO: 1793409 - DNA, 15 bp, Homo sapiens
ttcatggacactttg

SEQ ID NO: 1793410 - DNA, 22 bp, Homo sapiens
ttcatggctgctgttgcttaaa

SEQ ID NO: 1793411 - DNA, 17 bp, Homo sapiens
ttcatgtgttgcaaatt

SEQ ID NO: 1793412 - DNA, 16 bp, Homo sapiens
ttcatgttagttacct

SEQ ID NO: 1793413 - DNA, 18 bp, Homo sapiens
ttcatgttagttacctta

SEQ ID NO: 1793414 - DNA, 15 bp, Homo sapiens
ttcatgttcactgtg

SEQ ID NO: 1793415 - DNA, 16 bp, Homo sapiens
ttcatgttcactgtga

SEQ ID NO: 1793416 - DNA, 17 bp, Homo sapiens
ttcatgtttgtaaatta

SEQ ID NO: 1793417 - DNA, 13 bp, Homo sapiens
ttcattaaagcat

SEQ ID NO: 1793418 - DNA, 13 bp, Homo sapiens
ttcattaaataaa

SEQ ID NO: 1793419 - DNA, 14 bp, Homo sapiens
ttcattaaataaat

SEQ ID NO: 1793420 - DNA, 18 bp, Homo sapiens
ttcattagcagttgctca

SEQ ID NO: 1793421 - DNA, 23 bp, Homo sapiens
ttcattagcagttgctcacatgt

SEQ ID NO: 1793422 - DNA, 23 bp, Homo sapiens
ttcattatgcacttttagaaatg

SEQ ID NO: 1793423 - DNA, 14 bp, Homo sapiens
ttcattatgtaaaa

SEQ ID NO: 1793424 - DNA, 13 bp, Homo sapiens
ttcattattctct

SEQ ID NO: 1793425 - DNA, 17 bp, Homo sapiens
ttcattcaaatcagtga

SEQ ID NO: 1793426 - DNA, 19 bp, Homo sapiens
ttcattcaaatcagtgatc

SEQ ID NO: 1793427 - DNA, 15 bp, Homo sapiens
ttcattcaatattga

SEQ ID NO: 1793428 - DNA, 16 bp, Homo sapiens
ttcattcaatattgac

SEQ ID NO: 1793429 - DNA, 21 bp, Homo sapiens
ttcattcaatattgacatttg

SEQ ID NO: 1793430 - DNA, 20 bp, Homo sapiens
ttcattccggactggcagaa

SEQ ID NO: 1793431 - DNA, 22 bp, Homo sapiens
ttcattccgttaggaataacac

SEQ ID NO: 1793432 - DNA, 18 bp, Homo sapiens
ttcattctccctttcact

SEQ ID NO: 1793433 - DNA, 15 bp, Homo sapiens
ttcattctccttgtt

SEQ ID NO: 1793434 - DNA, 13 bp, Homo sapiens
ttcattcttagct

SEQ ID NO: 1793435 - DNA, 13 bp, Homo sapiens
ttcattcttgaaa

SEQ ID NO: 1793436 - DNA, 19 bp, Homo sapiens
ttcattcttgaaagctgtg

SEQ ID NO: 1793437 - DNA, 15 bp, Homo sapiens
ttcattctttactgc

SEQ ID NO: 1793438 - DNA, 20 bp, Homo sapiens
ttcattgatggatgtcttct

SEQ ID NO: 1793439 - DNA, 22 bp, Homo sapiens
ttcattggcagctcaaagactt

SEQ ID NO: 1793440 - DNA, 12 bp, Homo sapiens
ttcattgtctct

SEQ ID NO: 1793441 - DNA, 15 bp, Homo sapiens
ttcatttaaaatgat

SEQ ID NO: 1793442 - DNA, 17 bp, Homo sapiens
ttcatttaaaatgatta

SEQ ID NO: 1793443 - DNA, 17 bp, Homo sapiens
ttcatttatctataatt

SEQ ID NO: 1793444 - DNA, 12 bp, Homo sapiens
ttcatttccagc

SEQ ID NO: 1793445 - DNA, 12 bp, Homo sapiens
ttcatttcctgc

SEQ ID NO: 1793446 - DNA, 13 bp, Homo sapiens
ttcatttcctgcc

SEQ ID NO: 1793447 - DNA, 13 bp, Homo sapiens
ttcatttctagac

SEQ ID NO: 1793448 - DNA, 14 bp, Homo sapiens
ttcatttctagact

SEQ ID NO: 1793449 - DNA, 15 bp, Homo sapiens
ttcatttctagactc

SEQ ID NO: 1793450 - DNA, 13 bp, Homo sapiens
ttcatttctctgc

SEQ ID NO: 1793451 - DNA, 21 bp, Homo sapiens
ttcatttgacacaaagcttct

SEQ ID NO: 1793452 - DNA, 20 bp, Homo sapiens
ttcatttgagttattttaat

SEQ ID NO: 1793453 - DNA, 13 bp, Homo sapiens
ttcatttgctatc

SEQ ID NO: 1793454 - DNA, 19 bp, Homo sapiens
ttcatttggtgttcctgga

SEQ ID NO: 1793455 - DNA, 22 bp, Homo sapiens
ttcatttggtgttcctggaagc

SEQ ID NO: 1793456 - DNA, 17 bp, Homo sapiens
ttcatttgtatgtcaaa

SEQ ID NO: 1793457 - DNA, 18 bp, Homo sapiens
ttcatttgttttgctttt

SEQ ID NO: 1793458 - DNA, 12 bp, Homo sapiens
ttcattttcctg

SEQ ID NO: 1793459 - DNA, 13 bp, Homo sapiens
ttcattttcctgt

SEQ ID NO: 1793460 - DNA, 14 bp, Homo sapiens
ttcattttcctgtt

SEQ ID NO: 1793461 - DNA, 20 bp, Homo sapiens
ttcattttgagctgaaatgc

SEQ ID NO: 1793462 - DNA, 17 bp, Homo sapiens
ttcattttgctttaatt

SEQ ID NO: 1793463 - DNA, 16 bp, Homo sapiens
ttcattttgggccttg

SEQ ID NO: 1793464 - DNA, 18 bp, Homo sapiens
ttcattttgttttgctct

SEQ ID NO: 1793465 - DNA, 14 bp, Homo sapiens
ttcatttttaatca

SEQ ID NO: 1793466 - DNA, 17 bp, Homo sapiens
ttcatttttaatcatga

SEQ ID NO: 1793467 - DNA, 23 bp, Homo sapiens
ttccaaaacctgcttccttcagt

SEQ ID NO: 1793468 - DNA, 21 bp, Homo sapiens
ttccaaaataattttaagaaa

SEQ ID NO: 1793469 - DNA, 18 bp, Homo sapiens
ttccaaaatattgacatt

SEQ ID NO: 1793470 - DNA, 16 bp, Homo sapiens
ttccaaaccctcctgg

SEQ ID NO: 1793471 - DNA, 17 bp, Homo sapiens
ttccaaaccctcctggg

SEQ ID NO: 1793472 - DNA, 17 bp, Homo sapiens
ttccaaagtctctaatt

SEQ ID NO: 1793473 - DNA, 17 bp, Homo sapiens
ttccaaatcctggaagg

SEQ ID NO: 1793474 - DNA, 13 bp, Homo sapiens
ttccaaatgcttt

SEQ ID NO: 1793475 - DNA, 17 bp, Homo sapiens
ttccaaatgctttcagt

SEQ ID NO: 1793476 - DNA, 19 bp, Homo sapiens
ttccaaattaaaacaaata

SEQ ID NO: 1793477 - DNA, 20 bp, Homo sapiens
ttccaacaaacttactgtca

SEQ ID NO: 1793478 - DNA, 17 bp, Homo sapiens
ttccaacaaggacagcc

SEQ ID NO: 1793479 - DNA, 17 bp, Homo sapiens
ttccaacaccacagaca

SEQ ID NO: 1793480 - DNA, 21 bp, Homo sapiens
ttccaacaccacagacacaca

SEQ ID NO: 1793481 - DNA, 23 bp, Homo sapiens
ttccaacaccacagacacacaca

SEQ ID NO: 1793482 - DNA, 19 bp, Homo sapiens
ttccaacagattttattga

SEQ ID NO: 1793483 - DNA, 23 bp, Homo sapiens
ttccaacagctcaagtcttccct

SEQ ID NO: 1793484 - DNA, 16 bp, Homo sapiens
ttccaacatttcttgt

SEQ ID NO: 1793485 - DNA, 18 bp, Homo sapiens
ttccaaccatttatcttg

SEQ ID NO: 1793486 - DNA, 21 bp, Homo sapiens
ttccaaccatttatcttgaag

SEQ ID NO: 1793487 - DNA, 15 bp, Homo sapiens
ttgctaatgtataat

SEQ ID NO: 1793488 - DNA, 18 bp, Homo sapiens
ttgctacaaatttatgca

SEQ ID NO: 1793489 - DNA, 22 bp, Homo sapiens
ttgctacaaatttatgcatttc

SEQ ID NO: 1793490 - DNA, 23 bp, Homo sapiens
ttgctaccacagacttgcactga

SEQ ID NO: 1793491 - DNA, 19 bp, Homo sapiens
ttgctactgttgtaagaat

SEQ ID NO: 1793492 - DNA, 16 bp, Homo sapiens
ttgctagacagccagg

SEQ ID NO: 1793493 - DNA, 18 bp, Homo sapiens
ttgctagcagtaaaagat

SEQ ID NO: 1793494 - DNA, 23 bp, Homo sapiens
ttgctagcagtaaaagatgaagt

SEQ ID NO: 1793495 - DNA, 19 bp, Homo sapiens
ttgctaggagccccagctt

SEQ ID NO: 1793496 - DNA, 20 bp, Homo sapiens
ttgctagtgatacactgtat

SEQ ID NO: 1793497 - DNA, 16 bp, Homo sapiens
ttgctagttctgctgc

SEQ ID NO: 1793498 - DNA, 19 bp, Homo sapiens
ttgctagttggagtgcttg

SEQ ID NO: 1793499 - DNA, 17 bp, Homo sapiens
ttgctataatcattagt

SEQ ID NO: 1793500 - DNA, 19 bp, Homo sapiens
ttgctatatataaagacaa

SEQ ID NO: 1793501 - DNA, 21 bp, Homo sapiens
ttgctatcgccctcctttccc

SEQ ID NO: 1793502 - DNA, 23 bp, Homo sapiens
ttgctatctggaggccttccagc

SEQ ID NO: 1793503 - DNA, 17 bp, Homo sapiens
ttgctatgtaagggtct

SEQ ID NO: 1793504 - DNA, 15 bp, Homo sapiens
ttgctatgttactat

SEQ ID NO: 1793505 - DNA, 17 bp, Homo sapiens
ttgctcaaaaaatgagc

SEQ ID NO: 1793506 - DNA, 16 bp, Homo sapiens
ttgctcaaaattgctt

SEQ ID NO: 1793507 - DNA, 17 bp, Homo sapiens
ttgctcaaaattgcttc

SEQ ID NO: 1793508 - DNA, 19 bp, Homo sapiens
ttgctcaaatctattcaga

SEQ ID NO: 1793509 - DNA, 18 bp, Homo sapiens
ttgctcaacagacaatta

SEQ ID NO: 1793510 - DNA, 22 bp, Homo sapiens
ttgctcaagttcattgatgacc

SEQ ID NO: 1793511 - DNA, 23 bp, Homo sapiens
ttgctcagagaaggaaaagactg

SEQ ID NO: 1793512 - DNA, 20 bp, Homo sapiens
ttgctcagcccgcttggcca

SEQ ID NO: 1793513 - DNA, 12 bp, Homo sapiens
ttgctccagagc

SEQ ID NO: 1793514 - DNA, 11 bp, Homo sapiens
ttgctccaggg

SEQ ID NO: 1793515 - DNA, 14 bp, Homo sapiens
ttgctccagggtct

SEQ ID NO: 1793516 - DNA, 14 bp, Homo sapiens
ttgctcccaaccca

SEQ ID NO: 1793517 - DNA, 17 bp, Homo sapiens
ttgctcccaacccattc

SEQ ID NO: 1793518 - DNA, 15 bp, Homo sapiens
ttgctccgctcccac

SEQ ID NO: 1793519 - DNA, 19 bp, Homo sapiens
ttgctccgctcccaccgcc

SEQ ID NO: 1793520 - DNA, 21 bp, Homo sapiens
ttgctcgcccagacaccatgt

SEQ ID NO: 1793521 - DNA, 18 bp, Homo sapiens
ttgctctaaaatatttat

SEQ ID NO: 1793522 - DNA, 20 bp, Homo sapiens
ttgctctaaaatatttatga

SEQ ID NO: 1793523 - DNA, 21 bp, Homo sapiens
ttgctctaaaatatttatgaa

SEQ ID NO: 1793524 - DNA, 20 bp, Homo sapiens
ttgctctatgtctgccttcg

SEQ ID NO: 1793525 - DNA, 21 bp, Homo sapiens
ttgctctcccggttcttccag

SEQ ID NO: 1793526 - DNA, 22 bp, Homo sapiens
ttgctctcccggttcttccagt

SEQ ID NO: 1793527 - DNA, 24 bp, Homo sapiens
ttgctctggaggaagttctccagc

SEQ ID NO: 1793528 - DNA, 20 bp, Homo sapiens
ttgctctgttacccaggctg

SEQ ID NO: 1793529 - DNA, 18 bp, Homo sapiens
ttgctctgttcacagtct

SEQ ID NO: 1793530 - DNA, 13 bp, Homo sapiens
ttgctcttggaaa

SEQ ID NO: 1793531 - DNA, 19 bp, Homo sapiens
ttgctcttgtcggggtggg

SEQ ID NO: 1793532 - DNA, 17 bp, Homo sapiens
ttgctgaacattggaga

SEQ ID NO: 1793533 - DNA, 14 bp, Homo sapiens
ttgctgaactcagc

SEQ ID NO: 1793534 - DNA, 15 bp, Homo sapiens
ttgctgaactcagca

SEQ ID NO: 1793535 - DNA, 15 bp, Homo sapiens
ttgctgaattcatct

SEQ ID NO: 1793536 - DNA, 14 bp, Homo sapiens
ttgctgacaataaa

SEQ ID NO: 1793537 - DNA, 23 bp, Homo sapiens
ttgctgacaataaagatatttcc

SEQ ID NO: 1793538 - DNA, 23 bp, Homo sapiens
ttgctgatccctgctctctgagt

SEQ ID NO: 1793539 - DNA, 20 bp, Homo sapiens
ttgctgatggcccctccagc

SEQ ID NO: 1793540 - DNA, 21 bp, Homo sapiens
ttgctgatggcccctccagca

SEQ ID NO: 1793541 - DNA, 19 bp, Homo sapiens
ttgctgattttattcttga

SEQ ID NO: 1793542 - DNA, 19 bp, Homo sapiens
ttgctgcatatttgacctt

SEQ ID NO: 1793543 - DNA, 16 bp, Homo sapiens
ttgctgctatgaaaat

SEQ ID NO: 1793544 - DNA, 15 bp, Homo sapiens
ttgctgctgcctctt

SEQ ID NO: 1793545 - DNA, 16 bp, Homo sapiens
ttgctgctgctaccag

SEQ ID NO: 1793546 - DNA, 21 bp, Homo sapiens
ttgctggaataagttcaaatt

SEQ ID NO: 1793547 - DNA, 23 bp, Homo sapiens
ttgctggactgtcatagaaatta

SEQ ID NO: 1793548 - DNA, 17 bp, Homo sapiens
ttgctggccccagccct

SEQ ID NO: 1793549 - DNA, 22 bp, Homo sapiens
ttgctgggacttggatcccagg

SEQ ID NO: 1793550 - DNA, 22 bp, Homo sapiens
ttgctgggagctgaaaaatcac

SEQ ID NO: 1793551 - DNA, 22 bp, Homo sapiens
ttgctgggcatactttctctct

SEQ ID NO: 1793552 - DNA, 15 bp, Homo sapiens
ttgctgggccaggga

SEQ ID NO: 1793553 - DNA, 19 bp, Homo sapiens
ttgctggtgcctgccacct

SEQ ID NO: 1793554 - DNA, 20 bp, Homo sapiens
ttgctggtgtagtcttttta

SEQ ID NO: 1793555 - DNA, 17 bp, Homo sapiens
ttgctggtttgaaagat

SEQ ID NO: 1793556 - DNA, 22 bp, Homo sapiens
ttgctggtttgaaagattatga

SEQ ID NO: 1793557 - DNA, 16 bp, Homo sapiens
ttgctgtactcttgct

SEQ ID NO: 1793558 - DNA, 16 bp, Homo sapiens
ttgctgtataagttat

SEQ ID NO: 1793559 - DNA, 17 bp, Homo sapiens
ttgctgtattgccccca

SEQ ID NO: 1793560 - DNA, 14 bp, Homo sapiens
ttgctgtcacttct

SEQ ID NO: 1793561 - DNA, 17 bp, Homo sapiens
ttgctgtccaggcagct

SEQ ID NO: 1793562 - DNA, 18 bp, Homo sapiens
ttgctgtgaacaattgtc

SEQ ID NO: 1793563 - DNA, 18 bp, Homo sapiens
ttgctgtgaggctgtcct

SEQ ID NO: 1793564 - DNA, 19 bp, Homo sapiens
ttgctgtgaggctgtcctg

SEQ ID NO: 1793565 - DNA, 16 bp, Homo sapiens
ttgctgtgcctcccaa

SEQ ID NO: 1793566 - DNA, 14 bp, Homo sapiens
ttgctgtggctcca

SEQ ID NO: 1793567 - DNA, 18 bp, Homo sapiens
ttgctgtgtcttcatttt

SEQ ID NO: 1793568 - DNA, 13 bp, Homo sapiens
ttgctgttattat

SEQ ID NO: 1793569 - DNA, 13 bp, Homo sapiens
ttgctgttttgat

SEQ ID NO: 1793570 - DNA, 21 bp, Homo sapiens
ttgctgttttgttctgtggtt

SEQ ID NO: 1793571 - DNA, 14 bp, Homo sapiens
ttgcttaaaagaca

SEQ ID NO: 1793572 - DNA, 18 bp, Homo sapiens
ttgcttacatttttacaa

SEQ ID NO: 1793573 - DNA, 23 bp, Homo sapiens
ttgcttactttggaatacatttc

SEQ ID NO: 1793574 - DNA, 22 bp, Homo sapiens
ttgcttagtcacttatttcata

SEQ ID NO: 1793575 - DNA, 12 bp, Homo sapiens
ttgcttatgaat

SEQ ID NO: 1793576 - DNA, 21 bp, Homo sapiens
ttgcttattgtaacaggcttt

SEQ ID NO: 1793577 - DNA, 13 bp, Homo sapiens
ttgcttatttaat

SEQ ID NO: 1793578 - DNA, 16 bp, Homo sapiens
ttgcttatttaataaa

SEQ ID NO: 1793579 - DNA, 15 bp, Homo sapiens
ttgcttcaagtgttt

SEQ ID NO: 1793580 - DNA, 17 bp, Homo sapiens
ttgcttcaccatggcct

SEQ ID NO: 1793581 - DNA, 17 bp, Homo sapiens
ttgcttcataaatgaag

SEQ ID NO: 1793582 - DNA, 18 bp, Homo sapiens
ttgcttcccgctgcacat

SEQ ID NO: 1793583 - DNA, 12 bp, Homo sapiens
ttgcttccgcca

SEQ ID NO: 1793584 - DNA, 16 bp, Homo sapiens
ttgcttctactttcat

SEQ ID NO: 1793585 - DNA, 18 bp, Homo sapiens
ttgcttctgtatttcctt

SEQ ID NO: 1793586 - DNA, 15 bp, Homo sapiens
ttgcttcttactgat

SEQ ID NO: 1793587 - DNA, 18 bp, Homo sapiens
ttgcttcttactgataat

SEQ ID NO: 1793588 - DNA, 14 bp, Homo sapiens
ttgcttgagcccag

SEQ ID NO: 1793589 - DNA, 14 bp, Homo sapiens
ttgcttgagcttgg

SEQ ID NO: 1793590 - DNA, 19 bp, Homo sapiens
ttgcttgcctgcagggcca

SEQ ID NO: 1793591 - DNA, 23 bp, Homo sapiens
ttgcttgttgggattcctgaccc

SEQ ID NO: 1793592 - DNA, 24 bp, Homo sapiens
ttgcttgttgggattcctgaccca

SEQ ID NO: 1793593 - DNA, 15 bp, Homo sapiens
ttgctttaaaacaag

SEQ ID NO: 1793594 - DNA, 23 bp, Homo sapiens
ttgctttaatgagtgcacctgcc

SEQ ID NO: 1793595 - DNA, 15 bp, Homo sapiens
ttgctttactgtcaa

SEQ ID NO: 1793596 - DNA, 20 bp, Homo sapiens
ttgctttatgccttcttatt

SEQ ID NO: 1793597 - DNA, 18 bp, Homo sapiens
ttgctttctttagaattt

SEQ ID NO: 1793598 - DNA, 14 bp, Homo sapiens
ttgctttgccaaaa

SEQ ID NO: 1793599 - DNA, 18 bp, Homo sapiens
ttgctttgccagagcagg

SEQ ID NO: 1793600 - DNA, 17 bp, Homo sapiens
ttgctttggttaaaaat

SEQ ID NO: 1793601 - DNA, 12 bp, Homo sapiens
ttgcttttaatt

SEQ ID NO: 1793602 - DNA, 14 bp, Homo sapiens
ttgcttttaattaa

SEQ ID NO: 1793603 - DNA, 23 bp, Homo sapiens
ttgcttttcatgtagaactcagc

SEQ ID NO: 1793604 - DNA, 19 bp, Homo sapiens
ttgcttttccactgcctgg

SEQ ID NO: 1793605 - DNA, 20 bp, Homo sapiens
ttgcttttggcaaaactcta

SEQ ID NO: 1793606 - DNA, 22 bp, Homo sapiens
ttgcttttgtttttttcctcat

SEQ ID NO: 1793607 - DNA, 15 bp, Homo sapiens
ttgctttttcaccag

SEQ ID NO: 1793608 - DNA, 13 bp, Homo sapiens
ttgcttttttgta

SEQ ID NO: 1793609 - DNA, 17 bp, Homo sapiens
ttggaaaataaattatt

SEQ ID NO: 1793610 - DNA, 17 bp, Homo sapiens
ttggaaacctgccctgc

SEQ ID NO: 1793611 - DNA, 16 bp, Homo sapiens
ttggaaagctgatgat

SEQ ID NO: 1793612 - DNA, 14 bp, Homo sapiens
ttggaaaggaccag

SEQ ID NO: 1793613 - DNA, 18 bp, Homo sapiens
ttggaaaggggaggagct

SEQ ID NO: 1793614 - DNA, 19 bp, Homo sapiens
ttggaaagttactgtaaat

SEQ ID NO: 1793615 - DNA, 13 bp, Homo sapiens
ttggaaataaagt

SEQ ID NO: 1793616 - DNA, 19 bp, Homo sapiens
ttggaacactgtttaggta

SEQ ID NO: 1793617 - DNA, 14 bp, Homo sapiens
ttggaacatttctt

SEQ ID NO: 1793618 - DNA, 15 bp, Homo sapiens
ttggaaccagactct

SEQ ID NO: 1793619 - DNA, 13 bp, Homo sapiens
ttggaactatgaa

SEQ ID NO: 1793620 - DNA, 18 bp, Homo sapiens
ttggaactctgtgcaggt

SEQ ID NO: 1793621 - DNA, 13 bp, Homo sapiens
ttggaagagaaag

SEQ ID NO: 1793622 - DNA, 22 bp, Homo sapiens
ttggaagatggcataacctgtc

SEQ ID NO: 1793623 - DNA, 15 bp, Homo sapiens
ttggaagattcagct

SEQ ID NO: 1793624 - DNA, 18 bp, Homo sapiens
ttggaagctgtttggaaa

SEQ ID NO: 1793625 - DNA, 19 bp, Homo sapiens
ttggaagctttgagttgac

SEQ ID NO: 1793626 - DNA, 15 bp, Homo sapiens
ttggaaggagcagaa

SEQ ID NO: 1793627 - DNA, 20 bp, Homo sapiens
ttggaaggatctgctgaggc

SEQ ID NO: 1793628 - DNA, 20 bp, Homo sapiens
ttggaagggcttttcaaaat

SEQ ID NO: 1793629 - DNA, 15 bp, Homo sapiens
ttggaagtctgcgcc

SEQ ID NO: 1793630 - DNA, 18 bp, Homo sapiens
ttggaatattttatcctg

SEQ ID NO: 1793631 - DNA, 19 bp, Homo sapiens
ttggaatattttatcctgt

SEQ ID NO: 1793632 - DNA, 14 bp, Homo sapiens
ttggaatcttcacc

SEQ ID NO: 1793633 - DNA, 19 bp, Homo sapiens
ttggaatcttcacctcaga

SEQ ID NO: 1793634 - DNA, 22 bp, Homo sapiens
ttggaatgcagaggtctccaaa

SEQ ID NO: 1793635 - DNA, 23 bp, Homo sapiens
ttggaatggaactactgtacttt

SEQ ID NO: 1793636 - DNA, 12 bp, Homo sapiens
ttggaatttgca

SEQ ID NO: 1793637 - DNA, 17 bp, Homo sapiens
ttggaatttttttttcc

SEQ ID NO: 1793638 - DNA, 14 bp, Homo sapiens
ttggacaaatcaca

SEQ ID NO: 1793639 - DNA, 23 bp, Homo sapiens
ttggacaatcatgaaatatgcat

SEQ ID NO: 1793640 - DNA, 18 bp, Homo sapiens
ttggacaggagatcagca

SEQ ID NO: 1793641 - DNA, 17 bp, Homo sapiens
ttggaccccagctggga

SEQ ID NO: 1793642 - DNA, 22 bp, Homo sapiens
ttggaccccagctgggaggcaa

SEQ ID NO: 1793643 - DNA, 21 bp, Homo sapiens
ttggacctaaatggcctcatg

SEQ ID NO: 1793644 - DNA, 15 bp, Homo sapiens
ttggactacacaata

SEQ ID NO: 1793645 - DNA, 17 bp, Homo sapiens
ttggactacacaataca

SEQ ID NO: 1793646 - DNA, 16 bp, Homo sapiens
ttggactccaggcctg

SEQ ID NO: 1793647 - DNA, 13 bp, Homo sapiens
ttggactctcagg

SEQ ID NO: 1793648 - DNA, 14 bp, Homo sapiens
ttggactgacattt

SEQ ID NO: 1793649 - DNA, 18 bp, Homo sapiens
ttggactgttagtgttaa

SEQ ID NO: 1793650 - DNA, 20 bp, Homo sapiens
ttggacttcaaagcaagctg

SEQ ID NO: 1793651 - DNA, 20 bp, Homo sapiens
ttggacttcctggggccccg

SEQ ID NO: 1793652 - DNA, 17 bp, Homo sapiens
ttggagaaaataacaag

SEQ ID NO: 1793653 - DNA, 13 bp, Homo sapiens
ttggagaaagaaa

SEQ ID NO: 1793654 - DNA, 16 bp, Homo sapiens
ttggagaaatgtcata

SEQ ID NO: 1793655 - DNA, 13 bp, Homo sapiens
ttggagactctgt

SEQ ID NO: 1793656 - DNA, 15 bp, Homo sapiens
ttggagactctgtgg

SEQ ID NO: 1793657 - DNA, 22 bp, Homo sapiens
ttggagagagaggctgcctcag

SEQ ID NO: 1793658 - DNA, 22 bp, Homo sapiens
ttggagagcagcaggtgctgtg

SEQ ID NO: 1793659 - DNA, 17 bp, Homo sapiens
ttggagagtaaaaactg

SEQ ID NO: 1793660 - DNA, 18 bp, Homo sapiens
ttggagagtaaaaactga

SEQ ID NO: 1793661 - DNA, 20 bp, Homo sapiens
ttggagataatctagaacac

SEQ ID NO: 1793662 - DNA, 23 bp, Homo sapiens
ttggagatcaaaatcctacagat

SEQ ID NO: 1793663 - DNA, 15 bp, Homo sapiens
ttggagcccagggca

SEQ ID NO: 1793664 - DNA, 14 bp, Homo sapiens
ttggagctgactgt

SEQ ID NO: 1793665 - DNA, 12 bp, Homo sapiens
ttggagctgaga

SEQ ID NO: 1793666 - DNA, 16 bp, Homo sapiens
ttggagctttggaata

SEQ ID NO: 1793667 - DNA, 13 bp, Homo sapiens
ttggaggagagag

SEQ ID NO: 1793668 - DNA, 17 bp, Homo sapiens
ttggaggcccctgggct

SEQ ID NO: 1793669 - DNA, 18 bp, Homo sapiens
ttggaggcccctgggctc

SEQ ID NO: 1793670 - DNA, 16 bp, Homo sapiens
ttggaggccttccctg

SEQ ID NO: 1793671 - DNA, 17 bp, Homo sapiens
ttggaggcctttcatcc

SEQ ID NO: 1793672 - DNA, 22 bp, Homo sapiens
ttggagggtgggagagcccagc

SEQ ID NO: 1793673 - DNA, 23 bp, Homo sapiens
ttggagggtgggagagcccagcc

SEQ ID NO: 1793674 - DNA, 15 bp, Homo sapiens
ttggagtcactgcca

SEQ ID NO: 1793675 - DNA, 23 bp, Homo sapiens
ttggagtcccaggggcagccaca

SEQ ID NO: 1793676 - DNA, 15 bp, Homo sapiens
ttggagtgcagtggc

SEQ ID NO: 1793677 - DNA, 16 bp, Homo sapiens
ttggagtggaggcatt

SEQ ID NO: 1793678 - DNA, 13 bp, Homo sapiens
ttggatcctgtgt

SEQ ID NO: 1793679 - DNA, 18 bp, Homo sapiens
ttggatcctgtgtggaga

SEQ ID NO: 1793680 - DNA, 21 bp, Homo sapiens
ttggatgggagtgagacagaa

SEQ ID NO: 1793681 - DNA, 17 bp, Homo sapiens
ttggattattcatttaa

SEQ ID NO: 1793682 - DNA, 18 bp, Homo sapiens
ttggattattcatttaaa

SEQ ID NO: 1793683 - DNA, 14 bp, Homo sapiens
ttggattattttct

SEQ ID NO: 1793684 - DNA, 19 bp, Homo sapiens
ttggatttaaaagcctgct

SEQ ID NO: 1793685 - DNA, 21 bp, Homo sapiens
ttggatttaaaagcctgctca

SEQ ID NO: 1793686 - DNA, 12 bp, Homo sapiens
ttggatttccta

SEQ ID NO: 1793687 - DNA, 14 bp, Homo sapiens
ttggatttggagag

SEQ ID NO: 1793688 - DNA, 14 bp, Homo sapiens
ttggatttgtttaa

SEQ ID NO: 1793689 - DNA, 19 bp, Homo sapiens
ttggcaatttcctggccct

SEQ ID NO: 1793690 - DNA, 20 bp, Homo sapiens
ttggcaccagacacccagga

SEQ ID NO: 1793691 - DNA, 23 bp, Homo sapiens
ttggcaccagacacccaggactt

SEQ ID NO: 1793692 - DNA, 21 bp, Homo sapiens
ttggcacctaatccaggcaga

SEQ ID NO: 1793693 - DNA, 13 bp, Homo sapiens
ttggcacttgtat

SEQ ID NO: 1793694 - DNA, 16 bp, Homo sapiens
ttggcacttgtattta

SEQ ID NO: 1793695 - DNA, 17 bp, Homo sapiens
ttggcacttgtatttaa

SEQ ID NO: 1793696 - DNA, 17 bp, Homo sapiens
ttggcagagaaggcctc

SEQ ID NO: 1793697 - DNA, 16 bp, Homo sapiens
ttggcagctctactct

SEQ ID NO: 1793698 - DNA, 19 bp, Homo sapiens
ttggcagcttaacattgac

SEQ ID NO: 1793699 - DNA, 23 bp, Homo sapiens
ttggcagcttaacattgacttct

SEQ ID NO: 1793700 - DNA, 19 bp, Homo sapiens
ttggcaggcccactcccca

SEQ ID NO: 1793701 - DNA, 20 bp, Homo sapiens
ttggcaggcccactccccag

SEQ ID NO: 1793702 - DNA, 14 bp, Homo sapiens
ttggcaggctggcc

SEQ ID NO: 1793703 - DNA, 21 bp, Homo sapiens
ttggcatcacagggcagagcc

SEQ ID NO: 1793704 - DNA, 12 bp, Homo sapiens
ttggcatggtga

SEQ ID NO: 1793705 - DNA, 18 bp, Homo sapiens
ttggcatgtctcctcaac

SEQ ID NO: 1793706 - DNA, 12 bp, Homo sapiens
ttggccactggg

SEQ ID NO: 1793707 - DNA, 19 bp, Homo sapiens
ttggccactgggtctcact

SEQ ID NO: 1793708 - DNA, 18 bp, Homo sapiens
ttggccagaccacagcag

SEQ ID NO: 1793709 - DNA, 18 bp, Homo sapiens
ttggccatccttctgtgt

SEQ ID NO: 1793710 - DNA, 11 bp, Homo sapiens
ttggcccagcg

SEQ ID NO: 1793711 - DNA, 15 bp, Homo sapiens
ttggcccaggagctc

SEQ ID NO: 1793712 - DNA, 16 bp, Homo sapiens
ttggccccactttgaa

SEQ ID NO: 1793713 - DNA, 17 bp, Homo sapiens
ttggccccactttgaag

SEQ ID NO: 1793714 - DNA, 20 bp, Homo sapiens
ttggccccactttgaagggc

SEQ ID NO: 1793715 - DNA, 14 bp, Homo sapiens
ttggcccctgtgtg

SEQ ID NO: 1793716 - DNA, 16 bp, Homo sapiens
ttggcccctgtgtgag

SEQ ID NO: 1793717 - DNA, 21 bp, Homo sapiens
ttggccctcttgcgggcctgg

SEQ ID NO: 1793718 - DNA, 13 bp, Homo sapiens
ttggccctggagc

SEQ ID NO: 1793719 - DNA, 14 bp, Homo sapiens
ttggccctttcctt

SEQ ID NO: 1793720 - DNA, 12 bp, Homo sapiens
ttcacacttcca

SEQ ID NO: 1793721 - DNA, 12 bp, Homo sapiens
ttcacacttgaa

SEQ ID NO: 1793722 - DNA, 18 bp, Homo sapiens
ttcacagcgtctgctcat

SEQ ID NO: 1793723 - DNA, 13 bp, Homo sapiens
ttcacagctcctc

SEQ ID NO: 1793724 - DNA, 16 bp, Homo sapiens
ttcacaggcagtgcat

SEQ ID NO: 1793725 - DNA, 15 bp, Homo sapiens
ttcacagtagagcca

SEQ ID NO: 1793726 - DNA, 15 bp, Homo sapiens
ttcacagtctctgga

SEQ ID NO: 1793727 - DNA, 16 bp, Homo sapiens
ttcacagtctctggaa

SEQ ID NO: 1793728 - DNA, 20 bp, Homo sapiens
ttcacagtgacactggacca

SEQ ID NO: 1793729 - DNA, 21 bp, Homo sapiens
ttcacagtgccaggaaagagt

SEQ ID NO: 1793730 - DNA, 15 bp, Homo sapiens
ttcacagtgctcttt

SEQ ID NO: 1793731 - DNA, 21 bp, Homo sapiens
ttcacagttctttgggccaga

SEQ ID NO: 1793732 - DNA, 17 bp, Homo sapiens
ttcacataccctccccc

SEQ ID NO: 1793733 - DNA, 17 bp, Homo sapiens
ttcacatagatgtccct

SEQ ID NO: 1793734 - DNA, 20 bp, Homo sapiens
ttcacatatctagtatgaaa

SEQ ID NO: 1793735 - DNA, 13 bp, Homo sapiens
ttcacatgccttg

SEQ ID NO: 1793736 - DNA, 22 bp, Homo sapiens
ttcacattaatatttgctgaca

SEQ ID NO: 1793737 - DNA, 18 bp, Homo sapiens
ttcacattagataaatta

SEQ ID NO: 1793738 - DNA, 16 bp, Homo sapiens
ttcacattaggctgtt

SEQ ID NO: 1793739 - DNA, 15 bp, Homo sapiens
ttcacattgcagtta

SEQ ID NO: 1793740 - DNA, 19 bp, Homo sapiens
ttcacatttaaatggttct

SEQ ID NO: 1793741 - DNA, 17 bp, Homo sapiens
ttggcctccatttctgt

SEQ ID NO: 1793742 - DNA, 14 bp, Homo sapiens
ttggcctcccagaa

SEQ ID NO: 1793743 - DNA, 13 bp, Homo sapiens
ttggcctccggcc

SEQ ID NO: 1793744 - DNA, 13 bp, Homo sapiens
ttggcctggcctc

SEQ ID NO: 1793745 - DNA, 22 bp, Homo sapiens
ttggccttcagaaccatccata

SEQ ID NO: 1793746 - DNA, 17 bp, Homo sapiens
ttggccttgcagctggc

SEQ ID NO: 1793747 - DNA, 18 bp, Homo sapiens
ttggctattgaagatgct

SEQ ID NO: 1793748 - DNA, 22 bp, Homo sapiens
ttggctattgaagatgctgcct

SEQ ID NO: 1793749 - DNA, 18 bp, Homo sapiens
ttggctatttctgtgtcc

SEQ ID NO: 1793750 - DNA, 17 bp, Homo sapiens
ttggctcacactgagaa

SEQ ID NO: 1793751 - DNA, 13 bp, Homo sapiens
ttggctcagacat

SEQ ID NO: 1793752 - DNA, 14 bp, Homo sapiens
ttggctcagacatg

SEQ ID NO: 1793753 - DNA, 17 bp, Homo sapiens
ttggctcagcccgctga

SEQ ID NO: 1793754 - DNA, 20 bp, Homo sapiens
ttggctcaggcagacaagag

SEQ ID NO: 1793755 - DNA, 22 bp, Homo sapiens
ttggctcgaatctctgtgcctt

SEQ ID NO: 1793756 - DNA, 21 bp, Homo sapiens
ttggctgaaattctcctggag

SEQ ID NO: 1793757 - DNA, 14 bp, Homo sapiens
ttggctgacccctc

SEQ ID NO: 1793758 - DNA, 18 bp, Homo sapiens
ttggctgacccctctggt

SEQ ID NO: 1793759 - DNA, 21 bp, Homo sapiens
ttggctgacccctctggtgtg

SEQ ID NO: 1793760 - DNA, 12 bp, Homo sapiens
ttggctgagacc

SEQ ID NO: 1793761 - DNA, 23 bp, Homo sapiens
ttggctgagatatgaacatattg

SEQ ID NO: 1793762 - DNA, 15 bp, Homo sapiens
ttggctgcaggaaga

SEQ ID NO: 1793763 - DNA, 21 bp, Homo sapiens
ttggctgcaggaagaaacttt

SEQ ID NO: 1793764 - DNA, 13 bp, Homo sapiens
ttggctgccctgt

SEQ ID NO: 1793765 - DNA, 15 bp, Homo sapiens
ttggctgcttcctgt

SEQ ID NO: 1793766 - DNA, 23 bp, Homo sapiens
ttggctggtagcagcaggctcag

SEQ ID NO: 1793767 - DNA, 11 bp, Homo sapiens
ttggctgtctg

SEQ ID NO: 1793768 - DNA, 12 bp, Homo sapiens
ttggctgtctga

SEQ ID NO: 1793769 - DNA, 24 bp, Homo sapiens
ttggctgtctgaccagagaatgca

SEQ ID NO: 1793770 - DNA, 17 bp, Homo sapiens
ttggcttactgcagcct

SEQ ID NO: 1793771 - DNA, 21 bp, Homo sapiens
ttggcttccagattttaaatt

SEQ ID NO: 1793772 - DNA, 22 bp, Homo sapiens
ttggcttctgatttttctcttt

SEQ ID NO: 1793773 - DNA, 17 bp, Homo sapiens
ttggcttgttattgcct

SEQ ID NO: 1793774 - DNA, 22 bp, Homo sapiens
ttggctttaaacacccttcaca

SEQ ID NO: 1793775 - DNA, 19 bp, Homo sapiens
ttggctttcacatttaaat

SEQ ID NO: 1793776 - DNA, 15 bp, Homo sapiens
ttggctttgcccacc

SEQ ID NO: 1793777 - DNA, 23 bp, Homo sapiens
ttggctttgcccacccctcactc

SEQ ID NO: 1793778 - DNA, 17 bp, Homo sapiens
ttgggaaaacatttgct

SEQ ID NO: 1793779 - DNA, 16 bp, Homo sapiens
ttgggaaacttggctc

SEQ ID NO: 1793780 - DNA, 22 bp, Homo sapiens
ttgggaaagatggataaactga

SEQ ID NO: 1793781 - DNA, 13 bp, Homo sapiens
ttgggaaagtatt

SEQ ID NO: 1793782 - DNA, 15 bp, Homo sapiens
ttgggaacactggcc

SEQ ID NO: 1793783 - DNA, 22 bp, Homo sapiens
ttgggaacagcatggaggcaga

SEQ ID NO: 1793784 - DNA, 10 bp, Homo sapiens
ttgggaagaa

SEQ ID NO: 1793785 - DNA, 22 bp, Homo sapiens
ttgggaagttaaagggaagaaa

SEQ ID NO: 1793786 - DNA, 20 bp, Homo sapiens
ttgggaatgaaattaacaca

SEQ ID NO: 1793787 - DNA, 14 bp, Homo sapiens
ttgggacaccaggg

SEQ ID NO: 1793788 - DNA, 17 bp, Homo sapiens
ttgggaccctccagtgc

SEQ ID NO: 1793789 - DNA, 19 bp, Homo sapiens
ttgggaccttgcgtgaaga

SEQ ID NO: 1793790 - DNA, 12 bp, Homo sapiens
ttgggacttcta

SEQ ID NO: 1793791 - DNA, 13 bp, Homo sapiens
ttgggagaaagca

SEQ ID NO: 1793792 - DNA, 23 bp, Homo sapiens
ttgggagagacttgttttggatg

SEQ ID NO: 1793793 - DNA, 15 bp, Homo sapiens
ttgggagcactggag

SEQ ID NO: 1793794 - DNA, 12 bp, Homo sapiens
ttgggaggctga

SEQ ID NO: 1793795 - DNA, 13 bp, Homo sapiens
ttgggagttttta

SEQ ID NO: 1793796 - DNA, 17 bp, Homo sapiens
ttgggataagagtgtga

SEQ ID NO: 1793797 - DNA, 14 bp, Homo sapiens
ttgggatccttcag

SEQ ID NO: 1793798 - DNA, 21 bp, Homo sapiens
ttgggatccttcagcacagga

SEQ ID NO: 1793799 - DNA, 16 bp, Homo sapiens
ttgggattcctgaccc

SEQ ID NO: 1793800 - DNA, 18 bp, Homo sapiens
ttgggattcctgacccag

SEQ ID NO: 1793801 - DNA, 21 bp, Homo sapiens
ttgggattgggggctggtgcc

SEQ ID NO: 1793802 - DNA, 12 bp, Homo sapiens
ttgggcagagct

SEQ ID NO: 1793803 - DNA, 16 bp, Homo sapiens
ttgggcatccacccag

SEQ ID NO: 1793804 - DNA, 22 bp, Homo sapiens
ttgggccacgctcttgaggaag

SEQ ID NO: 1793805 - DNA, 21 bp, Homo sapiens
ttgggccagaagtaccagact

SEQ ID NO: 1793806 - DNA, 13 bp, Homo sapiens
ttgggccagacat

SEQ ID NO: 1793807 - DNA, 17 bp, Homo sapiens
ttgggcccagctgggct

SEQ ID NO: 1793808 - DNA, 14 bp, Homo sapiens
ttgggcccctgagg

SEQ ID NO: 1793809 - DNA, 16 bp, Homo sapiens
ttgggcccctgaggag

SEQ ID NO: 1793810 - DNA, 14 bp, Homo sapiens
ttgggccctgcaca

SEQ ID NO: 1793811 - DNA, 23 bp, Homo sapiens
ttgggcctccatgccccagctct

SEQ ID NO: 1793812 - DNA, 16 bp, Homo sapiens
ttgggcctctcctgcc

SEQ ID NO: 1793813 - DNA, 20 bp, Homo sapiens
ttgggcctctcctgccctct

SEQ ID NO: 1793814 - DNA, 14 bp, Homo sapiens
ttgggcctggccag

SEQ ID NO: 1793815 - DNA, 15 bp, Homo sapiens
ttgggcctgttcctt

SEQ ID NO: 1793816 - DNA, 16 bp, Homo sapiens
ttgggcggctgagagc

SEQ ID NO: 1793817 - DNA, 17 bp, Homo sapiens
ttgggctactggcagct

SEQ ID NO: 1793818 - DNA, 15 bp, Homo sapiens
ttgggctcctggctg

SEQ ID NO: 1793819 - DNA, 19 bp, Homo sapiens
ttgggctcctggctgccag

SEQ ID NO: 1793820 - DNA, 14 bp, Homo sapiens
ttgggctgacccag

SEQ ID NO: 1793821 - DNA, 15 bp, Homo sapiens
ttgggctgacccagc

SEQ ID NO: 1793822 - DNA, 16 bp, Homo sapiens
ttgggctgacccagca

SEQ ID NO: 1793823 - DNA, 12 bp, Homo sapiens
ttgggctgtctt

SEQ ID NO: 1793824 - DNA, 20 bp, Homo sapiens
ttgggctttgcaggctctgg

SEQ ID NO: 1793825 - DNA, 15 bp, Homo sapiens
ttggggaatttcctc

SEQ ID NO: 1793826 - DNA, 18 bp, Homo sapiens
ttggggacagttggcaga

SEQ ID NO: 1793827 - DNA, 21 bp, Homo sapiens
ttggggagttaagacctggca

SEQ ID NO: 1793828 - DNA, 11 bp, Homo sapiens
ttggggcctgg

SEQ ID NO: 1793829 - DNA, 13 bp, Homo sapiens
ttggggcctggct

SEQ ID NO: 1793830 - DNA, 19 bp, Homo sapiens
ttggggctgtcgggggctg

SEQ ID NO: 1793831 - DNA, 15 bp, Homo sapiens
ttggggcttttggtg

SEQ ID NO: 1793832 - DNA, 23 bp, Homo sapiens
ttggggggaatgctcctctcttt

SEQ ID NO: 1793833 - DNA, 16 bp, Homo sapiens
ttggggtacaattgta

SEQ ID NO: 1793834 - DNA, 15 bp, Homo sapiens
ttggggtgcttcctt

SEQ ID NO: 1793835 - DNA, 19 bp, Homo sapiens
ttggggtgtggggtggggt

SEQ ID NO: 1793836 - DNA, 16 bp, Homo sapiens
ttggggttaagtctcc

SEQ ID NO: 1793837 - DNA, 19 bp, Homo sapiens
ttgggtcacccctccagga

SEQ ID NO: 1793838 - DNA, 17 bp, Homo sapiens
ttgggtccattcagatg

SEQ ID NO: 1793839 - DNA, 22 bp, Homo sapiens
ttgggtgaccagccactcaaag

SEQ ID NO: 1793840 - DNA, 23 bp, Homo sapiens
ttgggtgtaacaggtctcctctt

SEQ ID NO: 1793841 - DNA, 17 bp, Homo sapiens
ttgggtgtattctctgt

SEQ ID NO: 1793842 - DNA, 19 bp, Homo sapiens
ttgggtgtattctctgtaa

SEQ ID NO: 1793843 - DNA, 14 bp, Homo sapiens
ttgggtgtttccag

SEQ ID NO: 1793844 - DNA, 16 bp, Homo sapiens
ttgggttaagtatgag

SEQ ID NO: 1793845 - DNA, 19 bp, Homo sapiens
ttgggttctttctgggggg

SEQ ID NO: 1793846 - DNA, 17 bp, Homo sapiens
ttggtaaaaacagcagc

SEQ ID NO: 1793847 - DNA, 18 bp, Homo sapiens
ttggtaaaaatgctgctc

SEQ ID NO: 1793848 - DNA, 20 bp, Homo sapiens
ttggtaaaaatgctgctctc

SEQ ID NO: 1793849 - DNA, 14 bp, Homo sapiens
ttggtaaatgtttc

SEQ ID NO: 1793850 - DNA, 17 bp, Homo sapiens
ttggtaaatgtttcttt

SEQ ID NO: 1793851 - DNA, 20 bp, Homo sapiens
ttggtaactgattacctgcc

SEQ ID NO: 1793852 - DNA, 19 bp, Homo sapiens
ttggtaaggcctctggact

SEQ ID NO: 1793853 - DNA, 15 bp, Homo sapiens
ttggtaattattttg

SEQ ID NO: 1793854 - DNA, 23 bp, Homo sapiens
ttggtaattttttttgttttttg

SEQ ID NO: 1793855 - DNA, 13 bp, Homo sapiens
ttggtaggtaaat

SEQ ID NO: 1793856 - DNA, 16 bp, Homo sapiens
ttggtatcaagaaagt

SEQ ID NO: 1793857 - DNA, 17 bp, Homo sapiens
ttggtatcaagaaagtc

SEQ ID NO: 1793858 - DNA, 11 bp, Homo sapiens
ttggtcaaatt

SEQ ID NO: 1793859 - DNA, 23 bp, Homo sapiens
ttggtcaaggccacctctgcctc

SEQ ID NO: 1793860 - DNA, 21 bp, Homo sapiens
ttggtcatatcaaacattaaa

SEQ ID NO: 1793861 - DNA, 16 bp, Homo sapiens
ttggtccaaaaaaagg

SEQ ID NO: 1793862 - DNA, 19 bp, Homo sapiens
ttggtccaaaaaaaggaaa

SEQ ID NO: 1793863 - DNA, 23 bp, Homo sapiens
ttggtcccaagcctgatacttta

SEQ ID NO: 1793864 - DNA, 19 bp, Homo sapiens
ttggtcctacctattatcc

SEQ ID NO: 1793865 - DNA, 14 bp, Homo sapiens
ttggtcctgtcccc

SEQ ID NO: 1793866 - DNA, 22 bp, Homo sapiens
ttggtctcccttctctacactc

SEQ ID NO: 1793867 - DNA, 15 bp, Homo sapiens
ttggtgaacagtttt

SEQ ID NO: 1793868 - DNA, 22 bp, Homo sapiens
ttggtgagtcttggttctaaag

SEQ ID NO: 1793869 - DNA, 15 bp, Homo sapiens
ttggtgcacagtgat

SEQ ID NO: 1793870 - DNA, 18 bp, Homo sapiens
ttggtgcacagtgatttt

SEQ ID NO: 1793871 - DNA, 20 bp, Homo sapiens
ttggtgcagaggtttcttga

SEQ ID NO: 1793872 - DNA, 15 bp, Homo sapiens
ttggtgcattgttat

SEQ ID NO: 1793873 - DNA, 20 bp, Homo sapiens
ttggtgcgggcacaataaat

SEQ ID NO: 1793874 - DNA, 19 bp, Homo sapiens
ttggtggagcagccagagc

SEQ ID NO: 1793875 - DNA, 20 bp, Homo sapiens
ttggtggagcagccagagct

SEQ ID NO: 1793876 - DNA, 13 bp, Homo sapiens
ttggtggatgtga

SEQ ID NO: 1793877 - DNA, 21 bp, Homo sapiens
ttggtggcagattttacaaaa

SEQ ID NO: 1793878 - DNA, 21 bp, Homo sapiens
ttggtggggctcgtggccttc

SEQ ID NO: 1793879 - DNA, 19 bp, Homo sapiens
ttggtggggggtccagtct

SEQ ID NO: 1793880 - DNA, 23 bp, Homo sapiens
ttggtggggggtccagtctgtga

SEQ ID NO: 1793881 - DNA, 21 bp, Homo sapiens
ttggtgggtctatgttcccca

SEQ ID NO: 1793882 - DNA, 12 bp, Homo sapiens
ttggtggttttt

SEQ ID NO: 1793883 - DNA, 14 bp, Homo sapiens
ttggtgtacagact

SEQ ID NO: 1793884 - DNA, 13 bp, Homo sapiens
ttggtgtcttggc

SEQ ID NO: 1793885 - DNA, 21 bp, Homo sapiens
ttggtgttacacagcccaaga

SEQ ID NO: 1793886 - DNA, 17 bp, Homo sapiens
ttggtgtttgtctgtgt

SEQ ID NO: 1793887 - DNA, 17 bp, Homo sapiens
ttggttaaaaaaaagaa

SEQ ID NO: 1793888 - DNA, 13 bp, Homo sapiens
ttggttcacctgt

SEQ ID NO: 1793889 - DNA, 20 bp, Homo sapiens
ttggttcacctgtgactcct

SEQ ID NO: 1793890 - DNA, 20 bp, Homo sapiens
ttggttcagacacctgttca

SEQ ID NO: 1793891 - DNA, 20 bp, Homo sapiens
ttggttcatcagtgttaaaa

SEQ ID NO: 1793892 - DNA, 14 bp, Homo sapiens
ttggttcccttgtg

SEQ ID NO: 1793893 - DNA, 14 bp, Homo sapiens
ttggttccttctct

SEQ ID NO: 1793894 - DNA, 20 bp, Homo sapiens
ttggttctaaaggtaccaaa

SEQ ID NO: 1793895 - DNA, 18 bp, Homo sapiens
ttggttctaaggacctga

SEQ ID NO: 1793896 - DNA, 20 bp, Homo sapiens
ttggttgaaaataaaaagat

SEQ ID NO: 1793897 - DNA, 22 bp, Homo sapiens
ttggttgaaagttagagatttt

SEQ ID NO: 1793898 - DNA, 14 bp, Homo sapiens
ttggttggaagcta

SEQ ID NO: 1793899 - DNA, 12 bp, Homo sapiens
ttggttggaagg

SEQ ID NO: 1793900 - DNA, 22 bp, Homo sapiens
ttggttgggaatgaggaaaatt

SEQ ID NO: 1793901 - DNA, 17 bp, Homo sapiens
ttggttgggggctcctg

SEQ ID NO: 1793902 - DNA, 18 bp, Homo sapiens
ttggttggtagggtggga

SEQ ID NO: 1793903 - DNA, 22 bp, Homo sapiens
ttggttgtcaatattaaataca

SEQ ID NO: 1793904 - DNA, 19 bp, Homo sapiens
ttggtttgggggcgccctc

SEQ ID NO: 1793905 - DNA, 17 bp, Homo sapiens
ttggtttgtatgagatg

SEQ ID NO: 1793906 - DNA, 17 bp, Homo sapiens
ttggttttcctgtggca

SEQ ID NO: 1793907 - DNA, 17 bp, Homo sapiens
ttggttttgttcccctc

SEQ ID NO: 1793908 - DNA, 16 bp, Homo sapiens
ttgtaaaaaaagcaaa

SEQ ID NO: 1793909 - DNA, 21 bp, Homo sapiens
ttgtaaaaacagcattgcttt

SEQ ID NO: 1793910 - DNA, 23 bp, Homo sapiens
ttgtaaaaacagcattgctttct

SEQ ID NO: 1793911 - DNA, 18 bp, Homo sapiens
ttgtaaaacaaaatttga

SEQ ID NO: 1793912 - DNA, 14 bp, Homo sapiens
ttgtaaaacaggta

SEQ ID NO: 1793913 - DNA, 17 bp, Homo sapiens
ttgtaaaactgttattt

SEQ ID NO: 1793914 - DNA, 13 bp, Homo sapiens
ttgtaaaagaaat

SEQ ID NO: 1793915 - DNA, 15 bp, Homo sapiens
ttgtaaaagaaatca

SEQ ID NO: 1793916 - DNA, 17 bp, Homo sapiens
ttgtaaaattatttcat

SEQ ID NO: 1793917 - DNA, 22 bp, Homo sapiens
ttgtaaactgtatcaaatctgt

SEQ ID NO: 1793918 - DNA, 14 bp, Homo sapiens
ttgtaaagtttcta

SEQ ID NO: 1793919 - DNA, 17 bp, Homo sapiens
ttgtaaataaagtctat

SEQ ID NO: 1793920 - DNA, 15 bp, Homo sapiens
ttgtaaataagagat

SEQ ID NO: 1793921 - DNA, 14 bp, Homo sapiens
ttgtaaatactgga

SEQ ID NO: 1793922 - DNA, 18 bp, Homo sapiens
ttgtaaataggattttta

SEQ ID NO: 1793923 - DNA, 17 bp, Homo sapiens
ttgtaaatagtatttga

SEQ ID NO: 1793924 - DNA, 12 bp, Homo sapiens
ttgtaaatattt

SEQ ID NO: 1793925 - DNA, 14 bp, Homo sapiens
ttgtaaatgctcgt

SEQ ID NO: 1793926 - DNA, 18 bp, Homo sapiens
ttgtaaatgctcgtgtga

SEQ ID NO: 1793927 - DNA, 21 bp, Homo sapiens
ttgtaaatgctcgtgtgattt

SEQ ID NO: 1793928 - DNA, 23 bp, Homo sapiens
ttgtaaatgtactggtaattgta

SEQ ID NO: 1793929 - DNA, 12 bp, Homo sapiens
ttgtaaatgttt

SEQ ID NO: 1793930 - DNA, 22 bp, Homo sapiens
ttgtaaatgtttcttttccctt

SEQ ID NO: 1793931 - DNA, 19 bp, Homo sapiens
ttgtaaatttatgtgatgg

SEQ ID NO: 1793932 - DNA, 17 bp, Homo sapiens
ttgtaacaagaaaacat

SEQ ID NO: 1793933 - DNA, 19 bp, Homo sapiens
ttgtaacacagtcattcta

SEQ ID NO: 1793934 - DNA, 21 bp, Homo sapiens
ttgtaactacaaagctttgct

SEQ ID NO: 1793935 - DNA, 22 bp, Homo sapiens
ttgtaactacaaagctttgcta

SEQ ID NO: 1793936 - DNA, 18 bp, Homo sapiens
ttgtaacttatattgaag

SEQ ID NO: 1793937 - DNA, 18 bp, Homo sapiens
ttgtaagacaaaggtttt

SEQ ID NO: 1793938 - DNA, 16 bp, Homo sapiens
ttgtaagacaatccat

SEQ ID NO: 1793939 - DNA, 16 bp, Homo sapiens
ttgtaagacatttgta

SEQ ID NO: 1793940 - DNA, 20 bp, Homo sapiens
ttgtaagagtggaaccaaca

SEQ ID NO: 1793941 - DNA, 17 bp, Homo sapiens
ttgtaagatgctgggtt

SEQ ID NO: 1793942 - DNA, 17 bp, Homo sapiens
ttgtaagtaacacagta

SEQ ID NO: 1793943 - DNA, 20 bp, Homo sapiens
ttgtaagtgtaaaaaatgtc

SEQ ID NO: 1793944 - DNA, 14 bp, Homo sapiens
ttgtaagtttgaat

SEQ ID NO: 1793945 - DNA, 20 bp, Homo sapiens
ttgtaataagcaatcaaggt

SEQ ID NO: 1793946 - DNA, 14 bp, Homo sapiens
ttgtaatgctgcac

SEQ ID NO: 1793947 - DNA, 21 bp, Homo sapiens
ttgtaatgctgcacttcctgt

SEQ ID NO: 1793948 - DNA, 22 bp, Homo sapiens
ttgtaatggattcttttcatca

SEQ ID NO: 1793949 - DNA, 14 bp, Homo sapiens
ttgtaatgtcacca

SEQ ID NO: 1793950 - DNA, 19 bp, Homo sapiens
ttgtaatgttgtgaataat

SEQ ID NO: 1793951 - DNA, 17 bp, Homo sapiens
ttgtaattcctgatctt

SEQ ID NO: 1793952 - DNA, 17 bp, Homo sapiens
ttgtaattgtggattaa

SEQ ID NO: 1793953 - DNA, 19 bp, Homo sapiens
ttgtaattgtggattaatg

SEQ ID NO: 1793954 - DNA, 12 bp, Homo sapiens
ttgtaattgtgt

SEQ ID NO: 1793955 - DNA, 23 bp, Homo sapiens
ttgtaattgtgtaaaaaatggaa

SEQ ID NO: 1793956 - DNA, 20 bp, Homo sapiens
ttgtaatttaaggtctgttt

SEQ ID NO: 1793957 - DNA, 23 bp, Homo sapiens
ttgtacaaaataaacaaataaca

SEQ ID NO: 1793958 - DNA, 13 bp, Homo sapiens
ttgtacaaataaa

SEQ ID NO: 1793959 - DNA, 22 bp, Homo sapiens
ttgtacaaataaacctgaggca

SEQ ID NO: 1793960 - DNA, 21 bp, Homo sapiens
ttgtacaaatgtaagcaaagg

SEQ ID NO: 1793961 - DNA, 15 bp, Homo sapiens
ttgtacaaggtaatt

SEQ ID NO: 1793962 - DNA, 18 bp, Homo sapiens
ttgtacaaggtaattgtt

SEQ ID NO: 1793963 - DNA, 15 bp, Homo sapiens
ttgtacaataaattt

SEQ ID NO: 1793964 - DNA, 15 bp, Homo sapiens
ttgtacaatggttta

SEQ ID NO: 1793965 - DNA, 16 bp, Homo sapiens
ttgtacaatggtttat

SEQ ID NO: 1793966 - DNA, 14 bp, Homo sapiens
ttgtacaggactgt

SEQ ID NO: 1793967 - DNA, 16 bp, Homo sapiens
ttgtacatagttattt

SEQ ID NO: 1793968 - DNA, 13 bp, Homo sapiens
ttgtacatattgt

SEQ ID NO: 1793969 - DNA, 19 bp, Homo sapiens
ttgtacatgtatgaaattg

SEQ ID NO: 1793970 - DNA, 15 bp, Homo sapiens
ttgtaccaaaatttt

SEQ ID NO: 1793971 - DNA, 18 bp, Homo sapiens
ttgtaccaaaattttaaa

SEQ ID NO: 1793972 - DNA, 21 bp, Homo sapiens
ttgtaccatagaaaaatgtat

SEQ ID NO: 1793973 - DNA, 23 bp, Homo sapiens
ttgtaccttttgtagttttattt

SEQ ID NO: 1793974 - DNA, 14 bp, Homo sapiens
ttgtgtctgttgct

SEQ ID NO: 1793975 - DNA, 16 bp, Homo sapiens
ttgtgtgaaaaaagaa

SEQ ID NO: 1793976 - DNA, 12 bp, Homo sapiens
ttgtgtgaaatt

SEQ ID NO: 1793977 - DNA, 14 bp, Homo sapiens
ttgtgtgaaattgc

SEQ ID NO: 1793978 - DNA, 19 bp, Homo sapiens
ttgtgtgagacttaaaaca

SEQ ID NO: 1793979 - DNA, 19 bp, Homo sapiens
ttgtgtgatatttcagaaa

SEQ ID NO: 1793980 - DNA, 20 bp, Homo sapiens
ttgtgtgatttcctaaacat

SEQ ID NO: 1793981 - DNA, 14 bp, Homo sapiens
ttgtgtgcgctgcc

SEQ ID NO: 1793982 - DNA, 17 bp, Homo sapiens
ttgtgtgcgctgcctgg

SEQ ID NO: 1793983 - DNA, 19 bp, Homo sapiens
ttgtgtggaaatcatacca

SEQ ID NO: 1793984 - DNA, 22 bp, Homo sapiens
ttgtgtggaaatcataccagtt

SEQ ID NO: 1793985 - DNA, 16 bp, Homo sapiens
ttgtgtggattcttta

SEQ ID NO: 1793986 - DNA, 20 bp, Homo sapiens
ttgtgtggcaatgggatttg

SEQ ID NO: 1793987 - DNA, 18 bp, Homo sapiens
ttgtgtgtatttgtatta

SEQ ID NO: 1793988 - DNA, 15 bp, Homo sapiens
ttgtgtgtcatgcca

SEQ ID NO: 1793989 - DNA, 13 bp, Homo sapiens
ttgtgtgtgcaag

SEQ ID NO: 1793990 - DNA, 10 bp, Homo sapiens
ttgtgtgtgg

SEQ ID NO: 1793991 - DNA, 20 bp, Homo sapiens
ttgtgtgttttgtacactta

SEQ ID NO: 1793992 - DNA, 21 bp, Homo sapiens
ttgtgttcagctctttccaaa

SEQ ID NO: 1793993 - DNA, 13 bp, Homo sapiens
ttgtgttcctggc

SEQ ID NO: 1793994 - DNA, 16 bp, Homo sapiens
ttgtgttcctggctga

SEQ ID NO: 1793995 - DNA, 20 bp, Homo sapiens
ttgtgttctgtttgttaaaa

SEQ ID NO: 1793996 - DNA, 19 bp, Homo sapiens
ttgtgttcttcttcatatt

SEQ ID NO: 1793997 - DNA, 18 bp, Homo sapiens
ttgtgttgtcactaaact

SEQ ID NO: 1793998 - DNA, 21 bp, Homo sapiens
ttgtgttgttgttgctgctgt

SEQ ID NO: 1793999 - DNA, 23 bp, Homo sapiens
ttgtgttgttttttgttcaatgt

SEQ ID NO: 1794000 - DNA, 16 bp, Homo sapiens
ttgtgtttgattggct

SEQ ID NO: 1794001 - DNA, 21 bp, Homo sapiens
ttgtgttttcttgtaaatgtt

SEQ ID NO: 1794002 - DNA, 22 bp, Homo sapiens
ttgtgtttttctatagaaaaag

SEQ ID NO: 1794003 - DNA, 15 bp, Homo sapiens
ttgtgttttttaaga

SEQ ID NO: 1794004 - DNA, 13 bp, Homo sapiens
ttgttaaaaataa

SEQ ID NO: 1794005 - DNA, 16 bp, Homo sapiens
ttgttaaacaaatgat

SEQ ID NO: 1794006 - DNA, 12 bp, Homo sapiens
ttgttaaacacg

SEQ ID NO: 1794007 - DNA, 12 bp, Homo sapiens
ttgttaaatttt

SEQ ID NO: 1794008 - DNA, 14 bp, Homo sapiens
ttgttaatatgcag

SEQ ID NO: 1794009 - DNA, 17 bp, Homo sapiens
ttgttaatattcatttt

SEQ ID NO: 1794010 - DNA, 17 bp, Homo sapiens
ttgttaatggtgcaaat

SEQ ID NO: 1794011 - DNA, 15 bp, Homo sapiens
ttgttaatgtcattg

SEQ ID NO: 1794012 - DNA, 19 bp, Homo sapiens
ttgttaatgtcattgctaa

SEQ ID NO: 1794013 - DNA, 14 bp, Homo sapiens
ttgttacaagtgtt

SEQ ID NO: 1794014 - DNA, 16 bp, Homo sapiens
ttgttacaagtgttct

SEQ ID NO: 1794015 - DNA, 19 bp, Homo sapiens
ttgttacaagtgttcttag

SEQ ID NO: 1794016 - DNA, 23 bp, Homo sapiens
ttgttacctgtcattttgcactg

SEQ ID NO: 1794017 - DNA, 19 bp, Homo sapiens
ttgttactgctgattcttg

SEQ ID NO: 1794018 - DNA, 19 bp, Homo sapiens
ttgtacgaagagtattttt

SEQ ID NO: 1794019 - DNA, 21 bp, Homo sapiens
ttgtacgttttgcacattttg

SEQ ID NO: 1794020 - DNA, 22 bp, Homo sapiens
ttgtactaatctgagattgtgt

SEQ ID NO: 1794021 - DNA, 13 bp, Homo sapiens
ttgtactatttaa

SEQ ID NO: 1794022 - DNA, 22 bp, Homo sapiens
ttgtactgaatttttttgtaat

SEQ ID NO: 1794023 - DNA, 23 bp, Homo sapiens
ttgtacttagccagttcaaagtg

SEQ ID NO: 1794024 - DNA, 14 bp, Homo sapiens
ttgtacttctgtgt

SEQ ID NO: 1794025 - DNA, 15 bp, Homo sapiens
ttgtacttctgtgtt

SEQ ID NO: 1794026 - DNA, 18 bp, Homo sapiens
ttgtacttctgtgttcat

SEQ ID NO: 1794027 - DNA, 20 bp, Homo sapiens
ttgtactttctgttaaaatg

SEQ ID NO: 1794028 - DNA, 20 bp, Homo sapiens
ttgtagaagatggactctga

SEQ ID NO: 1794029 - DNA, 18 bp, Homo sapiens
ttgtagatgctaacgtgt

SEQ ID NO: 1794030 - DNA, 19 bp, Homo sapiens
ttgtagattgattgtattg

SEQ ID NO: 1794031 - DNA, 16 bp, Homo sapiens
ttgtagcactgacaga

SEQ ID NO: 1794032 - DNA, 18 bp, Homo sapiens
ttgtagcactgacagatt

SEQ ID NO: 1794033 - DNA, 23 bp, Homo sapiens
ttgtagcatataggtgatgtttg

SEQ ID NO: 1794034 - DNA, 16 bp, Homo sapiens
ttgtagcatttcttga

SEQ ID NO: 1794035 - DNA, 18 bp, Homo sapiens
ttgtagccaggtactgca

SEQ ID NO: 1794036 - DNA, 16 bp, Homo sapiens
ttgtagccttcctcca

SEQ ID NO: 1794037 - DNA, 16 bp, Homo sapiens
ttgtagtcttgtctta

SEQ ID NO: 1794038 - DNA, 19 bp, Homo sapiens
ttgtagttctgtgtacttt

SEQ ID NO: 1794039 - DNA, 13 bp, Homo sapiens
ttgtagtttacct

SEQ ID NO: 1794040 - DNA, 14 bp, Homo sapiens
ttgtataaaataga

SEQ ID NO: 1794041 - DNA, 19 bp, Homo sapiens
ttgtataaaatccaaaatg

SEQ ID NO: 1794042 - DNA, 15 bp, Homo sapiens
ttgtataaagaaact

SEQ ID NO: 1794043 - DNA, 20 bp, Homo sapiens
ttgtataaagcattactctt

SEQ ID NO: 1794044 - DNA, 21 bp, Homo sapiens
ttgtataaagcattactcttt

SEQ ID NO: 1794045 - DNA, 19 bp, Homo sapiens
ttgtataaataataaagaa

SEQ ID NO: 1794046 - DNA, 16 bp, Homo sapiens
ttgtataagtcaagca

SEQ ID NO: 1794047 - DNA, 19 bp, Homo sapiens
ttgtataagtcaagcacat

SEQ ID NO: 1794048 - DNA, 11 bp, Homo sapiens
ttgtataattg

SEQ ID NO: 1794049 - DNA, 12 bp, Homo sapiens
ttgtataattgg

SEQ ID NO: 1794050 - DNA, 16 bp, Homo sapiens
ttgtatagaccaaagc

SEQ ID NO: 1794051 - DNA, 17 bp, Homo sapiens
ttgtatagaccaaagca

SEQ ID NO: 1794052 - DNA, 15 bp, Homo sapiens
ttgtatagtaaagtg

SEQ ID NO: 1794053 - DNA, 21 bp, Homo sapiens
ttgtatatattattataatct

SEQ ID NO: 1794054 - DNA, 22 bp, Homo sapiens
ttgtatattacaacatttatgt

SEQ ID NO: 1794055 - DNA, 21 bp, Homo sapiens
ttgtatattatggaagatttt

SEQ ID NO: 1794056 - DNA, 14 bp, Homo sapiens
ttgtatatttgtac

SEQ ID NO: 1794057 - DNA, 18 bp, Homo sapiens
ttgtatatttgtacaaaa

SEQ ID NO: 1794058 - DNA, 19 bp, Homo sapiens
ttgtatcacaaatcttaac

SEQ ID NO: 1794059 - DNA, 19 bp, Homo sapiens
ttgtatcatttgaacaact

SEQ ID NO: 1794060 - DNA, 13 bp, Homo sapiens
ttgtatctctttt

SEQ ID NO: 1794061 - DNA, 12 bp, Homo sapiens
ttgtatgaaaat

SEQ ID NO: 1794062 - DNA, 13 bp, Homo sapiens
ttgtatgattcca

SEQ ID NO: 1794063 - DNA, 21 bp, Homo sapiens
ttgtatgattccaatctctgt

SEQ ID NO: 1794064 - DNA, 22 bp, Homo sapiens
ttgtatgcctttaaatctgtga

SEQ ID NO: 1794065 - DNA, 13 bp, Homo sapiens
ttgtatgtctgtg

SEQ ID NO: 1794066 - DNA, 14 bp, Homo sapiens
ttgtatgtctgtgt

SEQ ID NO: 1794067 - DNA, 15 bp, Homo sapiens
ttgtatgtctgtgta

SEQ ID NO: 1794068 - DNA, 17 bp, Homo sapiens
ttgtatgtgtgtagaca

SEQ ID NO: 1794069 - DNA, 15 bp, Homo sapiens
ttgtatgtttgctga

SEQ ID NO: 1794070 - DNA, 16 bp, Homo sapiens
ttgtattaataaagca

SEQ ID NO: 1794071 - DNA, 21 bp, Homo sapiens
ttgtattaataaagcattctt

SEQ ID NO: 1794072 - DNA, 17 bp, Homo sapiens
ttgtattatttttgtag

SEQ ID NO: 1794073 - DNA, 21 bp, Homo sapiens
ttgtattgcatgcaatttgaa

SEQ ID NO: 1794074 - DNA, 14 bp, Homo sapiens
ttgtattgttttct

SEQ ID NO: 1794075 - DNA, 22 bp, Homo sapiens
ttgtatttaacagaaattgtat

SEQ ID NO: 1794076 - DNA, 15 bp, Homo sapiens
ttgtatttaattctt

SEQ ID NO: 1794077 - DNA, 16 bp, Homo sapiens
ttgtatttatttccag

SEQ ID NO: 1794078 - DNA, 16 bp, Homo sapiens
ttgtatttctcttgtc

SEQ ID NO: 1794079 - DNA, 14 bp, Homo sapiens
ttgtattttaagat

SEQ ID NO: 1794080 - DNA, 14 bp, Homo sapiens
ttgtatttttaatg

SEQ ID NO: 1794081 - DNA, 13 bp, Homo sapiens
ttgtcacaataaa

SEQ ID NO: 1794082 - DNA, 16 bp, Homo sapiens
ttgtcacctctctctg

SEQ ID NO: 1794083 - DNA, 15 bp, Homo sapiens
ttgtcactagcagct

SEQ ID NO: 1794084 - DNA, 17 bp, Homo sapiens
ttgtcactagcagctgc

SEQ ID NO: 1794085 - DNA, 12 bp, Homo sapiens
ttgtcagacttt

SEQ ID NO: 1794086 - DNA, 20 bp, Homo sapiens
ttgtcagactttaaagaata

SEQ ID NO: 1794087 - DNA, 18 bp, Homo sapiens
ttgtcagatatgatatgt

SEQ ID NO: 1794088 - DNA, 12 bp, Homo sapiens
ttgtcagcatct

SEQ ID NO: 1794089 - DNA, 14 bp, Homo sapiens
ttgtcagcatctga

SEQ ID NO: 1794090 - DNA, 15 bp, Homo sapiens
ttgtcagcatctgac

SEQ ID NO: 1794091 - DNA, 19 bp, Homo sapiens
ttgtcatctttcttctatt

SEQ ID NO: 1794092 - DNA, 15 bp, Homo sapiens
ttgtcatgaactgta

SEQ ID NO: 1794093 - DNA, 18 bp, Homo sapiens
ttgtcatgtaccatcaat

SEQ ID NO: 1794094 - DNA, 22 bp, Homo sapiens
ttgtcatgtgtataaaaataaa

SEQ ID NO: 1794095 - DNA, 21 bp, Homo sapiens
ttgtcattcaagcctgtgaat

SEQ ID NO: 1794096 - DNA, 13 bp, Homo sapiens
ttgtcatttataa

SEQ ID NO: 1794097 - DNA, 17 bp, Homo sapiens
ttgtccaaagtttattt

SEQ ID NO: 1794098 - DNA, 20 bp, Homo sapiens
ttgtccaatgtacaggaagt

SEQ ID NO: 1794099 - DNA, 19 bp, Homo sapiens
ttgtccaattgttgacagt

SEQ ID NO: 1794100 - DNA, 14 bp, Homo sapiens
ttgtccccagggcc

SEQ ID NO: 1794101 - DNA, 20 bp, Homo sapiens
ttgtccccagggcccctccc

SEQ ID NO: 1794102 - DNA, 11 bp, Homo sapiens
ttgtccccagt

SEQ ID NO: 1794103 - DNA, 13 bp, Homo sapiens
ttgtccctctcac

SEQ ID NO: 1794104 - DNA, 20 bp, Homo sapiens
ttgtccctctcactccccag

SEQ ID NO: 1794105 - DNA, 18 bp, Homo sapiens
ttgtccctgaagagaagg

SEQ ID NO: 1794106 - DNA, 19 bp, Homo sapiens
ttgtcctccttttcacttt

SEQ ID NO: 1794107 - DNA, 16 bp, Homo sapiens
ttgtcctgccagctgc

SEQ ID NO: 1794108 - DNA, 18 bp, Homo sapiens
ttgtcctgccagctgcct

SEQ ID NO: 1794109 - DNA, 12 bp, Homo sapiens
ttgtcctggccc

SEQ ID NO: 1794110 - DNA, 18 bp, Homo sapiens
ttgtcctggcccttcagt

SEQ ID NO: 1794111 - DNA, 15 bp, Homo sapiens
ttgtcctttcccttc

SEQ ID NO: 1794112 - DNA, 21 bp, Homo sapiens
ttgtcctttttcactttgaaa

SEQ ID NO: 1794113 - DNA, 14 bp, Homo sapiens
ttgtcgctcatgtg

SEQ ID NO: 1794114 - DNA, 18 bp, Homo sapiens
ttgtctacattaaatcac

SEQ ID NO: 1794115 - DNA, 22 bp, Homo sapiens
ttgtctacgggggcacttggag

SEQ ID NO: 1794116 - DNA, 19 bp, Homo sapiens
ttgtctactcctagaagaa

SEQ ID NO: 1794117 - DNA, 16 bp, Homo sapiens
ttgtctattctgagcc

SEQ ID NO: 1794118 - DNA, 12 bp, Homo sapiens
ttgtctatttat

SEQ ID NO: 1794119 - DNA, 11 bp, Homo sapiens
ttgtctatttt

SEQ ID NO: 1794120 - DNA, 16 bp, Homo sapiens
ttgtctatttttgtct

SEQ ID NO: 1794121 - DNA, 13 bp, Homo sapiens
ttgtctcttagaa

SEQ ID NO: 1794122 - DNA, 20 bp, Homo sapiens
ttgtctgaagtcactgcaca

SEQ ID NO: 1794123 - DNA, 13 bp, Homo sapiens
ttgtctgaggcct

SEQ ID NO: 1794124 - DNA, 21 bp, Homo sapiens
ttgtctggcaaggactttgta

SEQ ID NO: 1794125 - DNA, 15 bp, Homo sapiens
ttgtctgtaaaaaat

SEQ ID NO: 1794126 - DNA, 15 bp, Homo sapiens
ttgtctgtcaaatgt

SEQ ID NO: 1794127 - DNA, 18 bp, Homo sapiens
ttgtctgtctacatttct

SEQ ID NO: 1794128 - DNA, 16 bp, Homo sapiens
ttgtctgtttgtttca

SEQ ID NO: 1794129 - DNA, 15 bp, Homo sapiens
ttgtcttaagtgttt

SEQ ID NO: 1794130 - DNA, 19 bp, Homo sapiens
ttgtcttaagtgtttctca

SEQ ID NO: 1794131 - DNA, 16 bp, Homo sapiens
ttgtcttagctctgga

SEQ ID NO: 1794132 - DNA, 13 bp, Homo sapiens
ttgtcttattgca

SEQ ID NO: 1794133 - DNA, 23 bp, Homo sapiens
ttgtcttcctatttcagaagttt

SEQ ID NO: 1794134 - DNA, 18 bp, Homo sapiens
ttgtcttgccttattaaa

SEQ ID NO: 1794135 - DNA, 20 bp, Homo sapiens
tttaagtggggttgataaca

SEQ ID NO: 1794136 - DNA, 14 bp, Homo sapiens
tttaagtgtaactg

SEQ ID NO: 1794137 - DNA, 17 bp, Homo sapiens
tttaagtgtctcactaa

SEQ ID NO: 1794138 - DNA, 19 bp, Homo sapiens
tttaagttcttatgaggag

SEQ ID NO: 1794139 - DNA, 14 bp, Homo sapiens
tttaagttgtcaaa

SEQ ID NO: 1794140 - DNA, 20 bp, Homo sapiens
tttaagttgtcaaagaagct

SEQ ID NO: 1794141 - DNA, 21 bp, Homo sapiens
tttaagttgtcaaagaagctt

SEQ ID NO: 1794142 - DNA, 15 bp, Homo sapiens
tttaagttgtttgca

SEQ ID NO: 1794143 - DNA, 21 bp, Homo sapiens
tttaagttgtttgcatgtgaa

SEQ ID NO: 1794144 - DNA, 19 bp, Homo sapiens
tttaagtttgcactcaaat

SEQ ID NO: 1794145 - DNA, 23 bp, Homo sapiens
tttaagtttgcactcaaatctta

SEQ ID NO: 1794146 - DNA, 16 bp, Homo sapiens
tttaataaagatgagt

SEQ ID NO: 1794147 - DNA, 13 bp, Homo sapiens
tttaataagaaca

SEQ ID NO: 1794148 - DNA, 14 bp, Homo sapiens
tttaatacaggaaa

SEQ ID NO: 1794149 - DNA, 15 bp, Homo sapiens
tttaatacaggaaat

SEQ ID NO: 1794150 - DNA, 17 bp, Homo sapiens
tttaatacagtttattt

SEQ ID NO: 1794151 - DNA, 15 bp, Homo sapiens
tttaatagaaataaa

SEQ ID NO: 1794152 - DNA, 19 bp, Homo sapiens
tttaatagaatataattat

SEQ ID NO: 1794153 - DNA, 11 bp, Homo sapiens
tttaatagact

SEQ ID NO: 1794154 - DNA, 12 bp, Homo sapiens
tttaatagcact

SEQ ID NO: 1794155 - DNA, 16 bp, Homo sapiens
tttaatagcctgtcat

SEQ ID NO: 1794156 - DNA, 18 bp, Homo sapiens
tttaatagtcaccttcat

SEQ ID NO: 1794157 - DNA, 17 bp, Homo sapiens
tttaatagtcattccaa

SEQ ID NO: 1794158 - DNA, 16 bp, Homo sapiens
tttaatagtgcttttt

SEQ ID NO: 1794159 - DNA, 21 bp, Homo sapiens
tttaatatagtgaaatggcca

SEQ ID NO: 1794160 - DNA, 13 bp, Homo sapiens
tttaatatcttca

SEQ ID NO: 1794161 - DNA, 17 bp, Homo sapiens
tttaatatgagcttcaa

SEQ ID NO: 1794162 - DNA, 20 bp, Homo sapiens
tttaatatgagcttcaatat

SEQ ID NO: 1794163 - DNA, 20 bp, Homo sapiens
tttaatattactgtctttat

SEQ ID NO: 1794164 - DNA, 21 bp, Homo sapiens
tttaatattactgtctttatt

SEQ ID NO: 1794165 - DNA, 14 bp, Homo sapiens
tttaatcagtgaag

SEQ ID NO: 1794166 - DNA, 12 bp, Homo sapiens
tttaatcatgaa

SEQ ID NO: 1794167 - DNA, 13 bp, Homo sapiens
tttaatcatgaaa

SEQ ID NO: 1794168 - DNA, 14 bp, Homo sapiens
tttaatccagaatt

SEQ ID NO: 1794169 - DNA, 12 bp, Homo sapiens
tttaatccagtt

SEQ ID NO: 1794170 - DNA, 21 bp, Homo sapiens
tttaatccttctagtttccca

SEQ ID NO: 1794171 - DNA, 16 bp, Homo sapiens
tttaatcttagctttt

SEQ ID NO: 1794172 - DNA, 13 bp, Homo sapiens
tttaatcttcagt

SEQ ID NO: 1794173 - DNA, 14 bp, Homo sapiens
tttaatgaaatcaa

SEQ ID NO: 1794174 - DNA, 21 bp, Homo sapiens
tttaatgagaatagaaacgta

SEQ ID NO: 1794175 - DNA, 23 bp, Homo sapiens
tttaatgagtgcacctgcctcca

SEQ ID NO: 1794176 - DNA, 23 bp, Homo sapiens
tttaatgatctcggatgaccaaa

SEQ ID NO: 1794177 - DNA, 15 bp, Homo sapiens
tttaatgctatttga

SEQ ID NO: 1794178 - DNA, 17 bp, Homo sapiens
tttaatgcttcattcaa

SEQ ID NO: 1794179 - DNA, 21 bp, Homo sapiens
tttaatggacatgagataatg

SEQ ID NO: 1794180 - DNA, 21 bp, Homo sapiens
tttaatgggggtagcagctgg

SEQ ID NO: 1794181 - DNA, 12 bp, Homo sapiens
tttaatgtgaag

SEQ ID NO: 1794182 - DNA, 13 bp, Homo sapiens
tttaatgtgaaga

SEQ ID NO: 1794183 - DNA, 13 bp, Homo sapiens
tttaatgttgaac

SEQ ID NO: 1794184 - DNA, 18 bp, Homo sapiens
tttaatgttgaacaaaat

SEQ ID NO: 1794185 - DNA, 23 bp, Homo sapiens
tttaatgttgaacaaaataaatt

SEQ ID NO: 1794186 - DNA, 13 bp, Homo sapiens
tttaattaaataa

SEQ ID NO: 1794187 - DNA, 22 bp, Homo sapiens
tttaattaatgaaatatctgta

SEQ ID NO: 1794188 - DNA, 22 bp, Homo sapiens
tttaattactggaattcttctg

SEQ ID NO: 1794189 - DNA, 13 bp, Homo sapiens
tttaattatgaaa

SEQ ID NO: 1794190 - DNA, 23 bp, Homo sapiens
tttcacttgaaagattttattgt

SEQ ID NO: 1794191 - DNA, 20 bp, Homo sapiens
tttcacttgagcaagatgat

SEQ ID NO: 1794192 - DNA, 13 bp, Homo sapiens
tttcacttgtatt

SEQ ID NO: 1794193 - DNA, 18 bp, Homo sapiens
tttcacttgtattgactt

SEQ ID NO: 1794194 - DNA, 12 bp, Homo sapiens
tttcactttaga

SEQ ID NO: 1794195 - DNA, 16 bp, Homo sapiens
tttcactttattgcta

SEQ ID NO: 1794196 - DNA, 16 bp, Homo sapiens
tttcactttgaaaagt

SEQ ID NO: 1794197 - DNA, 22 bp, Homo sapiens
tttcagaaaatattatgtgttt

SEQ ID NO: 1794198 - DNA, 13 bp, Homo sapiens
tttcagaaataca

SEQ ID NO: 1794199 - DNA, 13 bp, Homo sapiens
tttcagaaatata

SEQ ID NO: 1794200 - DNA, 22 bp, Homo sapiens
tttcagaaatataacacatttt

SEQ ID NO: 1794201 - DNA, 16 bp, Homo sapiens
tttcagaaatatgtgg

SEQ ID NO: 1794202 - DNA, 18 bp, Homo sapiens
tttcagaacctcttcccc

SEQ ID NO: 1794203 - DNA, 22 bp, Homo sapiens
tttcagaagtgagctttgctgc

SEQ ID NO: 1794204 - DNA, 16 bp, Homo sapiens
tttcagaagttagttt

SEQ ID NO: 1794205 - DNA, 20 bp, Homo sapiens
tttcagaatattttcaaaat

SEQ ID NO: 1794206 - DNA, 11 bp, Homo sapiens
tttcagacagg

SEQ ID NO: 1794207 - DNA, 20 bp, Homo sapiens
tttcagacagggtctgaagg

SEQ ID NO: 1794208 - DNA, 17 bp, Homo sapiens
tttcagacattttcact

SEQ ID NO: 1794209 - DNA, 21 bp, Homo sapiens
tttcagacattttcactggaa

SEQ ID NO: 1794210 - DNA, 12 bp, Homo sapiens
tttcagaccccc

SEQ ID NO: 1794211 - DNA, 11 bp, Homo sapiens
tttcagactcc

SEQ ID NO: 1794212 - DNA, 21 bp, Homo sapiens
tttcagactcccattcctgaa

SEQ ID NO: 1794213 - DNA, 15 bp, Homo sapiens
tttcagactgcagag

SEQ ID NO: 1794214 - DNA, 17 bp, Homo sapiens
tttcagagaccattgca

SEQ ID NO: 1794215 - DNA, 19 bp, Homo sapiens
tttcagagccagtgaagga

SEQ ID NO: 1794216 - DNA, 22 bp, Homo sapiens
tttcagagtgactacacacagt

SEQ ID NO: 1794217 - DNA, 15 bp, Homo sapiens
tttcagatatcaaaa

SEQ ID NO: 1794218 - DNA, 17 bp, Homo sapiens
tttcagatatcaaaatt

SEQ ID NO: 1794219 - DNA, 17 bp, Homo sapiens
tttcagatgtgcaataa

SEQ ID NO: 1794220 - DNA, 15 bp, Homo sapiens
tttcagcactgatgg

SEQ ID NO: 1794221 - DNA, 21 bp, Homo sapiens
tttcagccaaactgtagatga

SEQ ID NO: 1794222 - DNA, 23 bp, Homo sapiens
tttcagccaaactgtagatgaag

SEQ ID NO: 1794223 - DNA, 13 bp, Homo sapiens
tttcagctagttt

SEQ ID NO: 1794224 - DNA, 18 bp, Homo sapiens
tttcagcttgtttctata

SEQ ID NO: 1794225 - DNA, 12 bp, Homo sapiens
tttcaggaaaat

SEQ ID NO: 1794226 - DNA, 22 bp, Homo sapiens
tttcaggaggctggaggaaggg

SEQ ID NO: 1794227 - DNA, 16 bp, Homo sapiens
tttcaggatactctgt

SEQ ID NO: 1794228 - DNA, 20 bp, Homo sapiens
tttcaggatactctgtcaga

SEQ ID NO: 1794229 - DNA, 21 bp, Homo sapiens
tttcaggatactctgtcagat

SEQ ID NO: 1794230 - DNA, 19 bp, Homo sapiens
tttcaggcattggatattt

SEQ ID NO: 1794231 - DNA, 20 bp, Homo sapiens
tttcagggtcttggctgcct

SEQ ID NO: 1794232 - DNA, 24 bp, Homo sapiens
tttcaggtatttttattcatgtga

SEQ ID NO: 1794233 - DNA, 16 bp, Homo sapiens
tttcagtactttttta

SEQ ID NO: 1794234 - DNA, 19 bp, Homo sapiens
tttcagtacttttttaaat

SEQ ID NO: 1794235 - DNA, 14 bp, Homo sapiens
tttcagtatactgt

SEQ ID NO: 1794236 - DNA, 17 bp, Homo sapiens
tttcagtatactgtgtg

SEQ ID NO: 1794237 - DNA, 21 bp, Homo sapiens
tttcagtcccctctctctggg

SEQ ID NO: 1794238 - DNA, 20 bp, Homo sapiens
tttcagtgaagatgctgtaa

SEQ ID NO: 1794239 - DNA, 13 bp, Homo sapiens
tttcagtgtacat

SEQ ID NO: 1794240 - DNA, 16 bp, Homo sapiens
tttcagtgttacctgt

SEQ ID NO: 1794241 - DNA, 15 bp, Homo sapiens
tttcagtgttttcat

SEQ ID NO: 1794242 - DNA, 14 bp, Homo sapiens
tttcagtttgttgg

SEQ ID NO: 1794243 - DNA, 14 bp, Homo sapiens
tttcataatcagta

SEQ ID NO: 1794244 - DNA, 21 bp, Homo sapiens
tttcatacagcattacaaatt

SEQ ID NO: 1794245 - DNA, 16 bp, Homo sapiens
tttcataccacttgaa

SEQ ID NO: 1794246 - DNA, 18 bp, Homo sapiens
tttcataggttactacct

SEQ ID NO: 1794247 - DNA, 21 bp, Homo sapiens
tttcatagtataactttaaat

SEQ ID NO: 1794248 - DNA, 22 bp, Homo sapiens
tttcatagtttcaaatctgtaa

SEQ ID NO: 1794249 - DNA, 15 bp, Homo sapiens
tttcatatttctacc

SEQ ID NO: 1794250 - DNA, 14 bp, Homo sapiens
tttcatattttaaa

SEQ ID NO: 1794251 - DNA, 15 bp, Homo sapiens
tttcatattttaaat

SEQ ID NO: 1794252 - DNA, 16 bp, Homo sapiens
tttcatcaaaaagcct

SEQ ID NO: 1794253 - DNA, 16 bp, Homo sapiens
tttcatcattgtttct

SEQ ID NO: 1794254 - DNA, 14 bp, Homo sapiens
tttcatccatgtcc

SEQ ID NO: 1794255 - DNA, 21 bp, Homo sapiens
tttcatcccgtatcacagtgt

SEQ ID NO: 1794256 - DNA, 22 bp, Homo sapiens
tttcatcccgtatcacagtgtt

SEQ ID NO: 1794257 - DNA, 18 bp, Homo sapiens
tttcatctgctctccttc

SEQ ID NO: 1794258 - DNA, 21 bp, Homo sapiens
tttcatcttctggaatattgt

SEQ ID NO: 1794259 - DNA, 16 bp, Homo sapiens
tttcatcttgaagttt

SEQ ID NO: 1794260 - DNA, 12 bp, Homo sapiens
tttcatgaaaaa

SEQ ID NO: 1794261 - DNA, 20 bp, Homo sapiens
tttcatgaaaaagctgcttc

SEQ ID NO: 1794262 - DNA, 19 bp, Homo sapiens
tttcatgaaaataccattt

SEQ ID NO: 1794263 - DNA, 24 bp, Homo sapiens
tttcatgaccagtaaaggctgctg

SEQ ID NO: 1794264 - DNA, 16 bp, Homo sapiens
tttcatgattagaaat

SEQ ID NO: 1794265 - DNA, 18 bp, Homo sapiens
tttcatggcccttcaaat

SEQ ID NO: 1794266 - DNA, 13 bp, Homo sapiens
tttcatgtagaac

SEQ ID NO: 1794267 - DNA, 21 bp, Homo sapiens
tttcatgtgttgcaaattatt

SEQ ID NO: 1794268 - DNA, 19 bp, Homo sapiens
tttcatgttagttacctta

SEQ ID NO: 1794269 - DNA, 23 bp, Homo sapiens
ttcaaaaagcagagtggactgca

SEQ ID NO: 1794270 - DNA, 21 bp, Homo sapiens
ttcaaaacctgcagttaacag

SEQ ID NO: 1794271 - DNA, 15 bp, Homo sapiens
ttcaaaactgtttgt

SEQ ID NO: 1794272 - DNA, 12 bp, Homo sapiens
ttcaaaagaaag

SEQ ID NO: 1794273 - DNA, 13 bp, Homo sapiens
ttcaaaagaaagt

SEQ ID NO: 1794274 - DNA, 23 bp, Homo sapiens
ttcaaaagcaaaacatctctgca

SEQ ID NO: 1794275 - DNA, 14 bp, Homo sapiens
ttcaaaagtgatta

SEQ ID NO: 1794276 - DNA, 16 bp, Homo sapiens
ttcaaaagttccaaga

SEQ ID NO: 1794277 - DNA, 15 bp, Homo sapiens
ttcaaaataaaaagt

SEQ ID NO: 1794278 - DNA, 15 bp, Homo sapiens
ttcaaaataaaacat

SEQ ID NO: 1794279 - DNA, 15 bp, Homo sapiens
ttcaaaatccaaaaa

SEQ ID NO: 1794280 - DNA, 18 bp, Homo sapiens
ttcaaaatgtctgtagct

SEQ ID NO: 1794281 - DNA, 18 bp, Homo sapiens
ttcaaacgggtgcctggt

SEQ ID NO: 1794282 - DNA, 13 bp, Homo sapiens
ttcaaactgaaaa

SEQ ID NO: 1794283 - DNA, 17 bp, Homo sapiens
ttcaaactgaaaagctg

SEQ ID NO: 1794284 - DNA, 23 bp, Homo sapiens
ttcaaactgctgcatactttgac

SEQ ID NO: 1794285 - DNA, 19 bp, Homo sapiens
ttcaaactgtgaagcattt

SEQ ID NO: 1794286 - DNA, 22 bp, Homo sapiens
ttcaaacttaaacaaaaaacta

SEQ ID NO: 1794287 - DNA, 12 bp, Homo sapiens
ttcaaactttca

SEQ ID NO: 1794288 - DNA, 16 bp, Homo sapiens
ttcaaactttggaaca

SEQ ID NO: 1794289 - DNA, 13 bp, Homo sapiens
ttcaaagaagtca

SEQ ID NO: 1794290 - DNA, 15 bp, Homo sapiens
ttcaaagatgcattt

SEQ ID NO: 1794291 - DNA, 16 bp, Homo sapiens
ttcaaagatgcatttt

SEQ ID NO: 1794292 - DNA, 23 bp, Homo sapiens
ttcaaagatgcattttgagtgtt

SEQ ID NO: 1794293 - DNA, 21 bp, Homo sapiens
ttcaaagcacaataactagta

SEQ ID NO: 1794294 - DNA, 22 bp, Homo sapiens
tttcatgttttagcatttgtat

SEQ ID NO: 1794295 - DNA, 15 bp, Homo sapiens
tttcattaaataaat

SEQ ID NO: 1794296 - DNA, 19 bp, Homo sapiens
tttcattaaataaatttga

SEQ ID NO: 1794297 - DNA, 12 bp, Homo sapiens
tttcattatgca

SEQ ID NO: 1794298 - DNA, 13 bp, Homo sapiens
tttcattattagt

SEQ ID NO: 1794299 - DNA, 18 bp, Homo sapiens
tttcattcaaatcagtga

SEQ ID NO: 1794300 - DNA, 15 bp, Homo sapiens
tttcattctcagaat

SEQ ID NO: 1794301 - DNA, 20 bp, Homo sapiens
tttcatttaaatatctgtta

SEQ ID NO: 1794302 - DNA, 14 bp, Homo sapiens
tttcatttcaactg

SEQ ID NO: 1794303 - DNA, 13 bp, Homo sapiens
tttcatttccagc

SEQ ID NO: 1794304 - DNA, 11 bp, Homo sapiens
tttcatttgta

SEQ ID NO: 1794305 - DNA, 15 bp, Homo sapiens
tttcatttgtacaag

SEQ ID NO: 1794306 - DNA, 17 bp, Homo sapiens
tttcatttgtacaaggt

SEQ ID NO: 1794307 - DNA, 20 bp, Homo sapiens
tttcatttgtacaaggtaat

SEQ ID NO: 1794308 - DNA, 20 bp, Homo sapiens
tttcattttgctttaatttt

SEQ ID NO: 1794309 - DNA, 23 bp, Homo sapiens
tttcattttgctttaattttagc

SEQ ID NO: 1794310 - DNA, 15 bp, Homo sapiens
tttcatttttttcca

SEQ ID NO: 1794311 - DNA, 14 bp, Homo sapiens
tttccaaaataatt

SEQ ID NO: 1794312 - DNA, 16 bp, Homo sapiens
tttccaaatgaaaaat

SEQ ID NO: 1794313 - DNA, 23 bp, Homo sapiens
tttccaaatgatcctagtaattg

SEQ ID NO: 1794314 - DNA, 17 bp, Homo sapiens
tttccaaattaaaacaa

SEQ ID NO: 1794315 - DNA, 18 bp, Homo sapiens
tttccaacaccacagaca

SEQ ID NO: 1794316 - DNA, 22 bp, Homo sapiens
tttccaacaccacagacacaca

SEQ ID NO: 1794317 - DNA, 11 bp, Homo sapiens
tttccaacagc

SEQ ID NO: 1794318 - DNA, 14 bp, Homo sapiens
tttccaacttgtct

SEQ ID NO: 1794319 - DNA, 15 bp, Homo sapiens
tttccaacttgtctg

SEQ ID NO: 1794320 - DNA, 15 bp, Homo sapiens
tttccaagacagagt

SEQ ID NO: 1794321 - DNA, 14 bp, Homo sapiens
tttccaattccact

SEQ ID NO: 1794322 - DNA, 18 bp, Homo sapiens
tttccacacgcattaata

SEQ ID NO: 1794323 - DNA, 17 bp, Homo sapiens
tttccacatttgtcaca

SEQ ID NO: 1794324 - DNA, 22 bp, Homo sapiens
tttccaccaagggtatctgctg

SEQ ID NO: 1794325 - DNA, 19 bp, Homo sapiens
tttccaccacagccagcac

SEQ ID NO: 1794326 - DNA, 14 bp, Homo sapiens
tttccactactgct

SEQ ID NO: 1794327 - DNA, 15 bp, Homo sapiens
tttccactactgcta

SEQ ID NO: 1794328 - DNA, 20 bp, Homo sapiens
tttcctgagaccacagagag

SEQ ID NO: 1794329 - DNA, 18 bp, Homo sapiens
tttcctgagctgtcgctg

SEQ ID NO: 1794330 - DNA, 21 bp, Homo sapiens
tttcctgataaagcacagctg

SEQ ID NO: 1794331 - DNA, 14 bp, Homo sapiens
tttcctgcatctct

SEQ ID NO: 1794332 - DNA, 13 bp, Homo sapiens
tttcctgctccct

SEQ ID NO: 1794333 - DNA, 18 bp, Homo sapiens
tttcctggaagcagagca

SEQ ID NO: 1794334 - DNA, 19 bp, Homo sapiens
tttcctggccctccactcc

SEQ ID NO: 1794335 - DNA, 14 bp, Homo sapiens
tttcctggtgccaa

SEQ ID NO: 1794336 - DNA, 16 bp, Homo sapiens
tttcctggtgccaatt

SEQ ID NO: 1794337 - DNA, 22 bp, Homo sapiens
tttcctgtaaagaaacatttcc

SEQ ID NO: 1794338 - DNA, 13 bp, Homo sapiens
tttccttaaacat

SEQ ID NO: 1794339 - DNA, 16 bp, Homo sapiens
tttccttaaactgtgt

SEQ ID NO: 1794340 - DNA, 15 bp, Homo sapiens
tttccttaactaaat

SEQ ID NO: 1794341 - DNA, 16 bp, Homo sapiens
tttccttaactaaatg

SEQ ID NO: 1794342 - DNA, 22 bp, Homo sapiens
tttccttatcacccccttgttg

SEQ ID NO: 1794343 - DNA, 17 bp, Homo sapiens
tttccttatttgccttc

SEQ ID NO: 1794344 - DNA, 19 bp, Homo sapiens
tttccttccatccctaccc

SEQ ID NO: 1794345 - DNA, 17 bp, Homo sapiens
tttccttcccaggccct

SEQ ID NO: 1794346 - DNA, 23 bp, Homo sapiens
tttccttcccaggccctttggct

SEQ ID NO: 1794347 - DNA, 16 bp, Homo sapiens
tttccttccttccctg

SEQ ID NO: 1794348 - DNA, 14 bp, Homo sapiens
tttccttctgtatt

SEQ ID NO: 1794349 - DNA, 15 bp, Homo sapiens
tttccttgtgcaaaa

SEQ ID NO: 1794350 - DNA, 19 bp, Homo sapiens
tttcctttatgtgaatttt

SEQ ID NO: 1794351 - DNA, 9 bp, Homo sapiens
tttcctttg

SEQ ID NO: 1794352 - DNA, 13 bp, Homo sapiens
tttcctttgctct

SEQ ID NO: 1794353 - DNA, 13 bp, Homo sapiens
tttcctttgtcat

SEQ ID NO: 1794354 - DNA, 19 bp, Homo sapiens
tttcctttttaatatgctt

SEQ ID NO: 1794355 - DNA, 19 bp, Homo sapiens
tttcctttttgacactgaa

SEQ ID NO: 1794356 - DNA, 19 bp, Homo sapiens
tttccttttttgtctatga

SEQ ID NO: 1794357 - DNA, 20 bp, Homo sapiens
tttccttttttgtctatgaa

SEQ ID NO: 1794358 - DNA, 15 bp, Homo sapiens
tttctctgtactttt

SEQ ID NO: 1794359 - DNA, 17 bp, Homo sapiens
tttctctgtatagtact

SEQ ID NO: 1794360 - DNA, 16 bp, Homo sapiens
tttctctgtgctctga

SEQ ID NO: 1794361 - DNA, 18 bp, Homo sapiens
tttctcttacctgttatt

SEQ ID NO: 1794362 - DNA, 13 bp, Homo sapiens
tttctcttagaaa

SEQ ID NO: 1794363 - DNA, 13 bp, Homo sapiens
tttctcttccctt

SEQ ID NO: 1794364 - DNA, 15 bp, Homo sapiens
tttctcttgagctgg

SEQ ID NO: 1794365 - DNA, 14 bp, Homo sapiens
tttctctttaaact

SEQ ID NO: 1794366 - DNA, 16 bp, Homo sapiens
tttctctttctctcct

SEQ ID NO: 1794367 - DNA, 21 bp, Homo sapiens
tttctctttgggtttcttgtt

SEQ ID NO: 1794368 - DNA, 21 bp, Homo sapiens
tttctcttttcccctttcctg

SEQ ID NO: 1794369 - DNA, 17 bp, Homo sapiens
tttctcttttgctttct

SEQ ID NO: 1794370 - DNA, 19 bp, Homo sapiens
tttctcttttgctttctgt

SEQ ID NO: 1794371 - DNA, 21 bp, Homo sapiens
tttctgaaaattccagaaagg

SEQ ID NO: 1794372 - DNA, 20 bp, Homo sapiens
tttctgagacagcttgtctg

SEQ ID NO: 1794373 - DNA, 21 bp, Homo sapiens
tttctgagcccgggctgcctg

SEQ ID NO: 1794374 - DNA, 19 bp, Homo sapiens
tttctgagcttttcatgga

SEQ ID NO: 1794375 - DNA, 24 bp, Homo sapiens
tttctgataaagttccttaagcat

SEQ ID NO: 1794376 - DNA, 22 bp, Homo sapiens
tttctgcatgaatatcatacaa

SEQ ID NO: 1794377 - DNA, 21 bp, Homo sapiens
tttctgcatgaccaaagtgat

SEQ ID NO: 1794378 - DNA, 12 bp, Homo sapiens
tttctgccctgg

SEQ ID NO: 1794379 - DNA, 14 bp, Homo sapiens
tttctgcctctcct

SEQ ID NO: 1794380 - DNA, 22 bp, Homo sapiens
tttctgcctggagtgtatgact

SEQ ID NO: 1794381 - DNA, 15 bp, Homo sapiens
tttctgctctggaat

SEQ ID NO: 1794382 - DNA, 22 bp, Homo sapiens
tttctgctctggaataaagttg

SEQ ID NO: 1794383 - DNA, 23 bp, Homo sapiens
tttctggactcccactctttgaa

SEQ ID NO: 1794384 - DNA, 20 bp, Homo sapiens
ttttcctcatgtaacattgg

SEQ ID NO: 1794385 - DNA, 12 bp, Homo sapiens
ttttcctcttct

SEQ ID NO: 1794386 - DNA, 17 bp, Homo sapiens
ttttccttctgttaaaa

SEQ ID NO: 1794387 - DNA, 13 bp, Homo sapiens
ttttcgccccctg

SEQ ID NO: 1794388 - DNA, 12 bp, Homo sapiens
ttttctaaactg

SEQ ID NO: 1794389 - DNA, 15 bp, Homo sapiens
ttttctaaactgttt

SEQ ID NO: 1794390 - DNA, 16 bp, Homo sapiens
ttttctaaataaaaat

SEQ ID NO: 1794391 - DNA, 17 bp, Homo sapiens
ttttctaaataaaaata

SEQ ID NO: 1794392 - DNA, 22 bp, Homo sapiens
ttttctaaataaaaatatgtaa

SEQ ID NO: 1794393 - DNA, 20 bp, Homo sapiens
ttttctaaatgttattactt

SEQ ID NO: 1794394 - DNA, 13 bp, Homo sapiens
ttttctaaccttg

SEQ ID NO: 1794395 - DNA, 14 bp, Homo sapiens
ttttctaaccttga

SEQ ID NO: 1794396 - DNA, 13 bp, Homo sapiens
ttttctaagaaaa

SEQ ID NO: 1794397 - DNA, 13 bp, Homo sapiens
ttttctacagtgg

SEQ ID NO: 1794398 - DNA, 17 bp, Homo sapiens
ttttctacataattgtg

SEQ ID NO: 1794399 - DNA, 17 bp, Homo sapiens
ttttctactttttttaa

SEQ ID NO: 1794400 - DNA, 16 bp, Homo sapiens
ttttctagagacacat

SEQ ID NO: 1794401 - DNA, 21 bp, Homo sapiens
ttttctagctataacaactct

SEQ ID NO: 1794402 - DNA, 15 bp, Homo sapiens
ttttctagtttcagt

SEQ ID NO: 1794403 - DNA, 12 bp, Homo sapiens
ttttctataaat

SEQ ID NO: 1794404 - DNA, 23 bp, Homo sapiens
ttttctatatagttccttgcctt

SEQ ID NO: 1794405 - DNA, 22 bp, Homo sapiens
ttttctattttgttttttaagt

SEQ ID NO: 1794406 - DNA, 16 bp, Homo sapiens
ttttctcaatctcctc

SEQ ID NO: 1794407 - DNA, 19 bp, Homo sapiens
tttgaacgtgcttctttgt

SEQ ID NO: 1794408 - DNA, 22 bp, Homo sapiens
tttgaactggcaattgtctatt

SEQ ID NO: 1794409 - DNA, 13 bp, Homo sapiens
tttgaacttgtca

SEQ ID NO: 1794410 - DNA, 18 bp, Homo sapiens
tttgaagacacagcctcc

SEQ ID NO: 1794411 - DNA, 21 bp, Homo sapiens
tttgaagacacagcctccccc

SEQ ID NO: 1794412 - DNA, 21 bp, Homo sapiens
tttgaagacgtggactcctct

SEQ ID NO: 1794413 - DNA, 15 bp, Homo sapiens
tttgaagcaaataca

SEQ ID NO: 1794414 - DNA, 17 bp, Homo sapiens
tttgaagcaaatacaat

SEQ ID NO: 1794415 - DNA, 20 bp, Homo sapiens
tttgaagcaaatacaattca

SEQ ID NO: 1794416 - DNA, 20 bp, Homo sapiens
tttgaagcatgctctgtaag

SEQ ID NO: 1794417 - DNA, 20 bp, Homo sapiens
tttgaaggaaacagttaata

SEQ ID NO: 1794418 - DNA, 17 bp, Homo sapiens
tttgaatacatttgtat

SEQ ID NO: 1794419 - DNA, 22 bp, Homo sapiens
tttgaatccaaatctgtcctct

SEQ ID NO: 1794420 - DNA, 16 bp, Homo sapiens
tttgaatctcataatt

SEQ ID NO: 1794421 - DNA, 19 bp, Homo sapiens
tttgaatctcataatttat

SEQ ID NO: 1794422 - DNA, 22 bp, Homo sapiens
tttgaatctcataatttataca

SEQ ID NO: 1794423 - DNA, 13 bp, Homo sapiens
tttgaatctttaa

SEQ ID NO: 1794424 - DNA, 14 bp, Homo sapiens
tttgacaaagtgcc

SEQ ID NO: 1794425 - DNA, 16 bp, Homo sapiens
tttgacaattttgtct

SEQ ID NO: 1794426 - DNA, 17 bp, Homo sapiens
tttgacaattttgtctt

SEQ ID NO: 1794427 - DNA, 22 bp, Homo sapiens
ttttatagatgggcaactggct

SEQ ID NO: 1794428 - DNA, 19 bp, Homo sapiens
ttttatagcttaactaatt

SEQ ID NO: 1794429 - DNA, 19 bp, Homo sapiens
ttttatattactgacattt

SEQ ID NO: 1794430 - DNA, 11 bp, Homo sapiens
ttttatattta

SEQ ID NO: 1794431 - DNA, 12 bp, Homo sapiens
ttttatatttaa

SEQ ID NO: 1794432 - DNA, 13 bp, Homo sapiens
ttttatatttaaa

SEQ ID NO: 1794433 - DNA, 14 bp, Homo sapiens
ttttatatttcctt

SEQ ID NO: 1794434 - DNA, 20 bp, Homo sapiens
ttttatatttcctttatgtg

SEQ ID NO: 1794435 - DNA, 21 bp, Homo sapiens
ttttatatttcctttatgtga

SEQ ID NO: 1794436 - DNA, 14 bp, Homo sapiens
ttttatatttgtag

SEQ ID NO: 1794437 - DNA, 14 bp, Homo sapiens
ttttatcatgaatt

SEQ ID NO: 1794438 - DNA, 16 bp, Homo sapiens
ttttatcgcagatttt

SEQ ID NO: 1794439 - DNA, 12 bp, Homo sapiens
ttttatgcagac

SEQ ID NO: 1794440 - DNA, 15 bp, Homo sapiens
ttttatgctcttgaa

SEQ ID NO: 1794441 - DNA, 13 bp, Homo sapiens
tttttcacatttt

SEQ ID NO: 1794442 - DNA, 14 bp, Homo sapiens
tttttcagaaatat

SEQ ID NO: 1794443 - DNA, 13 bp, Homo sapiens
tttttcataaaca

SEQ ID NO: 1794444 - DNA, 18 bp, Homo sapiens
tttttcataaacaagttc

SEQ ID NO: 1794445 - DNA, 20 bp, Homo sapiens
tttttcattaaataaatttg

SEQ ID NO: 1794446 - DNA, 12 bp, Homo sapiens
tttttcattttt

SEQ ID NO: 1794447 - DNA, 20 bp, Homo sapiens
tttttcatttttttctctct

SEQ ID NO: 1794448 - DNA, 15 bp, Homo sapiens
tttttcctagaagtg

SEQ ID NO: 1794449 - DNA, 15 bp, Homo sapiens
tttttcctcatgtaa

SEQ ID NO: 1794450 - DNA, 15 bp, Homo sapiens
tttttccttgcctgt

SEQ ID NO: 1794451 - DNA, 17 bp, Homo sapiens
tttttccttgtatttaa

SEQ ID NO: 1794452 - DNA, 10 bp, Homo sapiens
tttttccttt

SEQ ID NO: 1794453 - DNA, 12 bp, Homo sapiens
tttttcctttat

SEQ ID NO: 1794454 - DNA, 17 bp, Homo sapiens
tttttcggtttcaaagt

SEQ ID NO: 1794455 - DNA, 15 bp, Homo sapiens
tttttctaagagaag

SEQ ID NO: 1794456 - DNA, 22 bp, Homo sapiens
tttttctacacagtaaaaactt

SEQ ID NO: 1794457 - DNA, 17 bp, Homo sapiens
tttttctacataattgt

SEQ ID NO: 1794458 - DNA, 15 bp, Homo sapiens
tttttctataaatca

SEQ ID NO: 1794459 - DNA, 19 bp, Homo sapiens
tttttctataaatcagtat

SEQ ID NO: 1794460 - DNA, 12 bp, Homo sapiens
tttttctcttca

SEQ ID NO: 1794461 - DNA, 18 bp, Homo sapiens
tttttctgtaatgtaaat

SEQ ID NO: 1794462 - DNA, 22 bp, Homo sapiens
tttttctgtaatgtaaataaac

SEQ ID NO: 1794463 - DNA, 11 bp, Homo sapiens
tttttcttaaa

SEQ ID NO: 1794464 - DNA, 13 bp, Homo sapiens
tttttcttaaggc

SEQ ID NO: 1794465 - DNA, 23 bp, Homo sapiens
tttttcttctattaatcaagaga

SEQ ID NO: 1794466 - DNA, 12 bp, Homo sapiens
tttttctttact

SEQ ID NO: 1794467 - DNA, 12 bp, Homo sapiens
tttttgaaatca

SEQ ID NO: 1794468 - DNA, 15 bp, Homo sapiens
tttttgaatttaaat

SEQ ID NO: 1794469 - DNA, 12 bp, Homo sapiens
tttttgacactg

SEQ ID NO: 1794470 - DNA, 15 bp, Homo sapiens
tttttgacactgaaa

SEQ ID NO: 1794471 - DNA, 18 bp, Homo sapiens
tttttgacactgaaagtt

SEQ ID NO: 1794472 - DNA, 22 bp, Homo sapiens
tttttgacactgaaagttttgt

SEQ ID NO: 1794473 - DNA, 16 bp, Homo sapiens
tttttgagtcaaagac

SEQ ID NO: 1794474 - DNA, 9 bp, Homo sapiens
tttttgcag

SEQ ID NO: 1794475 - DNA, 18 bp, Homo sapiens
tttttgccagttttccct

SEQ ID NO: 1794476 - DNA, 20 bp, Homo sapiens
tttttgctataatcattagt

SEQ ID NO: 1794477 - DNA, 13 bp, Homo sapiens
tttttggagaaat

SEQ ID NO: 1794478 - DNA, 9 bp, Homo sapiens
tttttggat

SEQ ID NO: 1794479 - DNA, 22 bp, Homo sapiens
tttttggggggttttcttgcct

SEQ ID NO: 1794480 - DNA, 13 bp, Homo sapiens
tttttgtaaactg

SEQ ID NO: 1794481 - DNA, 22 bp, Homo sapiens
tttttgtaaactgtatcaaatc

SEQ ID NO: 1794482 - DNA, 12 bp, Homo sapiens
tttttgtaacta

SEQ ID NO: 1794483 - DNA, 19 bp, Homo sapiens
tttttgtaactacaaagct

SEQ ID NO: 1794484 - DNA, 12 bp, Homo sapiens
tttttgtaataa

SEQ ID NO: 1794485 - DNA, 13 bp, Homo sapiens
tttttgtaattta

SEQ ID NO: 1794486 - DNA, 13 bp, Homo sapiens
tttttgtacatta

SEQ ID NO: 1794487 - DNA, 18 bp, Homo sapiens
tttttgtacattacacta

SEQ ID NO: 1794488 - DNA, 16 bp, Homo sapiens
tttttgtagccttcct

SEQ ID NO: 1794489 - DNA, 20 bp, Homo sapiens
tttttgtagtgacctgttta

SEQ ID NO: 1794490 - DNA, 12 bp, Homo sapiens
tttttgtatgtg

SEQ ID NO: 1794491 - DNA, 18 bp, Homo sapiens
tttttgtattttacatgg

SEQ ID NO: 1794492 - DNA, 18 bp, Homo sapiens
tttttgtcatgaactgta

SEQ ID NO: 1794493 - DNA, 20 bp, Homo sapiens
tttttgtctatgaagttgct

SEQ ID NO: 1794494 - DNA, 11 bp, Homo sapiens
tttttgtgggg

SEQ ID NO: 1794495 - DNA, 15 bp, Homo sapiens
tttttgttagcaaag

SEQ ID NO: 1794496 - DNA, 13 bp, Homo sapiens
tttttgttctttt

SEQ ID NO: 1794497 - DNA, 19 bp, Homo sapiens
tttttgttggagtgtttct

SEQ ID NO: 1794498 - DNA, 12 bp, Homo sapiens
tttttgtttgcc

SEQ ID NO: 1794499 - DNA, 14 bp, Homo sapiens
tttttgtttggaga

SEQ ID NO: 1794500 - DNA, 12 bp, Homo sapiens
ttttttaaaaaa

SEQ ID NO: 1794501 - DNA, 12 bp, Homo sapiens
ttttttaaagca

SEQ ID NO: 1794502 - DNA, 13 bp, Homo sapiens
ttttttaaagcaa

SEQ ID NO: 1794503 - DNA, 15 bp, Homo sapiens
ttttttaactggtga

SEQ ID NO: 1794504 - DNA, 12 bp, Homo sapiens
ttttttaagctt

SEQ ID NO: 1794505 - DNA, 23 bp, Homo sapiens
ttttttaagcttcagttgcttgt

SEQ ID NO: 1794506 - DNA, 13 bp, Homo sapiens
ttttttacaacta

SEQ ID NO: 1794507 - DNA, 16 bp, Homo sapiens
gagcaggggtctgagc

SEQ ID NO: 1794508 - DNA, 20 bp, Homo sapiens
gagcagtagaaaagcaggaa

SEQ ID NO: 1794509 - DNA, 12 bp, Homo sapiens
gagcccagctct

SEQ ID NO: 1794510 - DNA, 16 bp, Homo sapiens
gagccccattcctggg

SEQ ID NO: 1794511 - DNA, 17 bp, Homo sapiens
gagccccattcctggga

SEQ ID NO: 1794512 - DNA, 17 bp, Homo sapiens
gagccgggtctgcctct

SEQ ID NO: 1794513 - DNA, 21 bp, Homo sapiens
gagccgggtctgcctcttctg

SEQ ID NO: 1794514 - DNA, 21 bp, Homo sapiens
gagcgaggagatgctccttgg

SEQ ID NO: 1794515 - DNA, 21 bp, Homo sapiens
gagctcaggaaccgaggcagg

SEQ ID NO: 1794516 - DNA, 23 bp, Homo sapiens
gagctcaggaaccgaggcaggga

SEQ ID NO: 1794517 - DNA, 19 bp, Homo sapiens
gagcttcatggcagaaggc

SEQ ID NO: 1794518 - DNA, 13 bp, Homo sapiens
gagcttccctgac

SEQ ID NO: 1794519 - DNA, 17 bp, Homo sapiens
gagcttccctgactcat

SEQ ID NO: 1794520 - DNA, 14 bp, Homo sapiens
gaggaaaagtgcaa

SEQ ID NO: 1794521 - DNA, 19 bp, Homo sapiens
gaggaaggggccagaggct

SEQ ID NO: 1794522 - DNA, 17 bp, Homo sapiens
gaggagatgctccttgg

SEQ ID NO: 1794523 - DNA, 20 bp, Homo sapiens
gaggcagcagtgtgaggcca

SEQ ID NO: 1794524 - DNA, 14 bp, Homo sapiens
gaggcagggaagga

SEQ ID NO: 1794525 - DNA, 13 bp, Homo sapiens
gaggccagggcag

SEQ ID NO: 1794526 - DNA, 19 bp, Homo sapiens
gaggccagggcagagtgag

SEQ ID NO: 1794527 - DNA, 17 bp, Homo sapiens
gaggctccagagggcac

SEQ ID NO: 1794528 - DNA, 15 bp, Homo sapiens
gagggaatttaacca

SEQ ID NO: 1794529 - DNA, 14 bp, Homo sapiens
gagggacgcctggg

SEQ ID NO: 1794530 - DNA, 14 bp, Homo sapiens
gagggggagagggc

SEQ ID NO: 1794531 - DNA, 13 bp, Homo sapiens
gagggtgtcctgc

SEQ ID NO: 1794532 - DNA, 18 bp, Homo sapiens
gaggtaactatcaatatt

SEQ ID NO: 1794533 - DNA, 23 bp, Homo sapiens
gaggtgcttctagttctgccagg

SEQ ID NO: 1794534 - DNA, 15 bp, Homo sapiens
gagtccatcagcctc

SEQ ID NO: 1794535 - DNA, 15 bp, Homo sapiens
gagtccctgcctgga

SEQ ID NO: 1794536 - DNA, 23 bp, Homo sapiens
gagtccctgcctggaccagcctc

SEQ ID NO: 1794537 - DNA, 23 bp, Homo sapiens
gagtgacctcacttctggcactg

SEQ ID NO: 1794538 - DNA, 14 bp, Homo sapiens
gagtgcagtcctga

SEQ ID NO: 1794539 - DNA, 15 bp, Homo sapiens
gagtgtctttccacg

SEQ ID NO: 1794540 - DNA, 21 bp, Homo sapiens
gagtgtctttccacggagcca

SEQ ID NO: 1794541 - DNA, 22 bp, Homo sapiens
gagtgtgtttgtgtgcatgaaa

SEQ ID NO: 1794542 - DNA, 14 bp, Homo sapiens
gagtttagggtggg

SEQ ID NO: 1794543 - DNA, 16 bp, Homo sapiens
gataaataactttttt

SEQ ID NO: 1794544 - DNA, 13 bp, Homo sapiens
gataaattacatt

SEQ ID NO: 1794545 - DNA, 12 bp, Homo sapiens
gatatttttgta

SEQ ID NO: 1794546 - DNA, 12 bp, Homo sapiens
gatcccaacact

SEQ ID NO: 1794547 - DNA, 17 bp, Homo sapiens
gatcccaacactgccag

SEQ ID NO: 1794548 - DNA, 18 bp, Homo sapiens
gatcccaacactgccagc

SEQ ID NO: 1794549 - DNA, 14 bp, Homo sapiens
gatccccagctgtt

SEQ ID NO: 1794550 - DNA, 13 bp, Homo sapiens
gatgctccttggg

SEQ ID NO: 1794551 - DNA, 21 bp, Homo sapiens
gatgtttgtacttttgtgtta

SEQ ID NO: 1794552 - DNA, 14 bp, Homo sapiens
gattacctcctgag

SEQ ID NO: 1794553 - DNA, 15 bp, Homo sapiens
gattattcagtgtca

SEQ ID NO: 1794554 - DNA, 20 bp, Homo sapiens
gattcagtgttaaatgtgat

SEQ ID NO: 1794555 - DNA, 20 bp, Homo sapiens
gattctttcccaattcacat

SEQ ID NO: 1794556 - DNA, 14 bp, Homo sapiens
gattttcttttgtt

SEQ ID NO: 1794557 - DNA, 20 bp, Homo sapiens
ggactctcagtctctgagca

SEQ ID NO: 1794558 - DNA, 15 bp, Homo sapiens
ggagagacgggccct

SEQ ID NO: 1794559 - DNA, 21 bp, Homo sapiens
ggagctcaggaaccgaggcag

SEQ ID NO: 1794560 - DNA, 20 bp, Homo sapiens
ggagcttcatggcagaaggc

SEQ ID NO: 1794561 - DNA, 21 bp, Homo sapiens
ggaggctcacccccttctcca

SEQ ID NO: 1794562 - DNA, 15 bp, Homo sapiens
ggagggcagcagggc

SEQ ID NO: 1794563 - DNA, 13 bp, Homo sapiens
ggagggcaggcat

SEQ ID NO: 1794564 - DNA, 12 bp, Homo sapiens
ggagtgcagtgg

SEQ ID NO: 1794565 - DNA, 20 bp, Homo sapiens
ggagttgatcgcctttccca

SEQ ID NO: 1794566 - DNA, 13 bp, Homo sapiens
ggatccctcatct

SEQ ID NO: 1794567 - DNA, 23 bp, Homo sapiens
ggatgagaatttgagtgctctga

SEQ ID NO: 1794568 - DNA, 13 bp, Homo sapiens
ggcaaacccatca

SEQ ID NO: 1794569 - DNA, 19 bp, Homo sapiens
ggcagtcgatagagctgta

SEQ ID NO: 1794570 - DNA, 16 bp, Homo sapiens
ggcatccagagtccct

SEQ ID NO: 1794571 - DNA, 22 bp, Homo sapiens
ggcatccagagtccctgcctgg

SEQ ID NO: 1794572 - DNA, 11 bp, Homo sapiens
ggcatgaaagt

SEQ ID NO: 1794573 - DNA, 12 bp, Homo sapiens
ggcatgaaagtg

SEQ ID NO: 1794574 - DNA, 19 bp, Homo sapiens
ggccacatgggaggctcac

SEQ ID NO: 1794575 - DNA, 21 bp, Homo sapiens
ggccctcgctgccagctctgt

SEQ ID NO: 1794576 - DNA, 15 bp, Homo sapiens
ggccctctctgctct

SEQ ID NO: 1794577 - DNA, 22 bp, Homo sapiens
ggccctgcaaaaggactctcag

SEQ ID NO: 1794578 - DNA, 19 bp, Homo sapiens
ggcccttcccacaggacat

SEQ ID NO: 1794579 - DNA, 15 bp, Homo sapiens
ggcctaacctgccga

SEQ ID NO: 1794580 - DNA, 19 bp, Homo sapiens
ggcctgggcaggagggagg

SEQ ID NO: 1794581 - DNA, 16 bp, Homo sapiens
ggcgcggctgggagga

SEQ ID NO: 1794582 - DNA, 19 bp, Homo sapiens
ggctaccctgagctgaggc

SEQ ID NO: 1794583 - DNA, 17 bp, Homo sapiens
ggctcacccccttctcc

SEQ ID NO: 1794584 - DNA, 22 bp, Homo sapiens
ggctcacccccttctccatcca

SEQ ID NO: 1794585 - DNA, 16 bp, Homo sapiens
ggctccagagggcact

SEQ ID NO: 1794586 - DNA, 20 bp, Homo sapiens
ggctccctgtaacctcttca

SEQ ID NO: 1794587 - DNA, 18 bp, Homo sapiens
ggctcgttgactggctgt

SEQ ID NO: 1794588 - DNA, 15 bp, Homo sapiens
ggctgagggagcctg

SEQ ID NO: 1794589 - DNA, 20 bp, Homo sapiens
ggctgggaggagggcaggca

SEQ ID NO: 1794590 - DNA, 14 bp, Homo sapiens
ggcttctctctgtg

SEQ ID NO: 1794591 - DNA, 18 bp, Homo sapiens
gggaaaattatttgcata

SEQ ID NO: 1794592 - DNA, 15 bp, Homo sapiens
gggaaggatcccatg

SEQ ID NO: 1794593 - DNA, 22 bp, Homo sapiens
gggacacctaggctagggtggg

SEQ ID NO: 1794594 - DNA, 19 bp, Homo sapiens
gggagactgggctgaggga

SEQ ID NO: 1794595 - DNA, 20 bp, Homo sapiens
gggagactgggctgagggag

SEQ ID NO: 1794596 - DNA, 13 bp, Homo sapiens
gggagccgggagc

SEQ ID NO: 1794597 - DNA, 12 bp, Homo sapiens
gggagctcagga

SEQ ID NO: 1794598 - DNA, 23 bp, Homo sapiens
gggagctcaggaaccgaggcagg

SEQ ID NO: 1794599 - DNA, 11 bp, Homo sapiens
gggagggcagc

SEQ ID NO: 1794600 - DNA, 14 bp, Homo sapiens
gggcaaagcctagt

SEQ ID NO: 1794601 - DNA, 22 bp, Homo sapiens
gggccctggtggtggctcggga

SEQ ID NO: 1794602 - DNA, 15 bp, Homo sapiens
gggcctgggcaggag

SEQ ID NO: 1794603 - DNA, 17 bp, Homo sapiens
gggcctgggcaggaggg

SEQ ID NO: 1794604 - DNA, 14 bp, Homo sapiens
gggcgcggctggga

SEQ ID NO: 1794605 - DNA, 20 bp, Homo sapiens
gggctaccctgagctgaggc

SEQ ID NO: 1794606 - DNA, 23 bp, Homo sapiens
gggctctgacagccctgcggaga

SEQ ID NO: 1794607 - DNA, 14 bp, Homo sapiens
gggctgagggagcc

SEQ ID NO: 1794608 - DNA, 15 bp, Homo sapiens
ggggcagtctgagag

SEQ ID NO: 1794609 - DNA, 19 bp, Homo sapiens
ggggcagtctgagagaggc

SEQ ID NO: 1794610 - DNA, 12 bp, Homo sapiens
ggggccagaggc

SEQ ID NO: 1794611 - DNA, 18 bp, Homo sapiens
gggggcgcggctgggagg

SEQ ID NO: 1794612 - DNA, 19 bp, Homo sapiens
gggtcagacgcctgaggaa

SEQ ID NO: 1794613 - DNA, 14 bp, Homo sapiens
gggtggggagagac

SEQ ID NO: 1794614 - DNA, 23 bp, Homo sapiens
gggtgtcctgcaccggggcctgg

SEQ ID NO: 1794615 - DNA, 17 bp, Homo sapiens
gggtgttaaggcagtga

SEQ ID NO: 1794616 - DNA, 13 bp, Homo sapiens
ggtatagaaatgc

SEQ ID NO: 1794617 - DNA, 11 bp, Homo sapiens
ggtccaggaga

SEQ ID NO: 1794618 - DNA, 16 bp, Homo sapiens
ggtccatgggcagagc

SEQ ID NO: 1794619 - DNA, 15 bp, Homo sapiens
ggtctgagccacagc

SEQ ID NO: 1794620 - DNA, 22 bp, Homo sapiens
ggtgctacacccttttccagct

SEQ ID NO: 1794621 - DNA, 22 bp, Homo sapiens
ggtgcttctagttctgccagga

SEQ ID NO: 1794622 - DNA, 13 bp, Homo sapiens
ggtggagggccac

SEQ ID NO: 1794623 - DNA, 20 bp, Homo sapiens
ggtgggtccatgggcagagc

SEQ ID NO: 1794624 - DNA, 18 bp, Homo sapiens
ggtgtgatcgtctgactg

SEQ ID NO: 1794625 - DNA, 21 bp, Homo sapiens
ggtgttatcaccgtgggctcc

SEQ ID NO: 1794626 - DNA, 16 bp, Homo sapiens
ggtttttaaaacccag

SEQ ID NO: 1794627 - DNA, 15 bp, Homo sapiens
gtaaaagactttttt

SEQ ID NO: 1794628 - DNA, 13 bp, Homo sapiens
gtacagtcttgta

SEQ ID NO: 1794629 - DNA, 14 bp, Homo sapiens
gtacagtcttgtat

SEQ ID NO: 1794630 - DNA, 16 bp, Homo sapiens
gtacagtcttgtatta

SEQ ID NO: 1794631 - DNA, 16 bp, Homo sapiens
gtacgttatatattgt

SEQ ID NO: 1794632 - DNA, 18 bp, Homo sapiens
gtactcttgctttttcaa

SEQ ID NO: 1794633 - DNA, 22 bp, Homo sapiens
gtacttacatctttgtttacca

SEQ ID NO: 1794634 - DNA, 20 bp, Homo sapiens
gtagaaaagggaactgaaca

SEQ ID NO: 1794635 - DNA, 22 bp, Homo sapiens
gtagggtaattagtaacatgtg

SEQ ID NO: 1794636 - DNA, 14 bp, Homo sapiens
gtatagaaatgctg

SEQ ID NO: 1794637 - DNA, 14 bp, Homo sapiens
gtatcaggacccag

SEQ ID NO: 1794638 - DNA, 19 bp, Homo sapiens
gtatcgctgccttgccatg

SEQ ID NO: 1794639 - DNA, 21 bp, Homo sapiens
gtatgtgtgggtgtgtgttac

SEQ ID NO: 1794640 - DNA, 12 bp, Homo sapiens
gtattctctgag

SEQ ID NO: 1794641 - DNA, 19 bp, Homo sapiens
gtattctctgagctgtgca

SEQ ID NO: 1794642 - DNA, 17 bp, Homo sapiens
gtcaagtgcgtccacga

SEQ ID NO: 1794643 - DNA, 14 bp, Homo sapiens
gtcacgccagactt

SEQ ID NO: 1794644 - DNA, 18 bp, Homo sapiens
gtcagacgcctgaggaac

SEQ ID NO: 1794645 - DNA, 16 bp, Homo sapiens
gtcataccaatgaaaa

SEQ ID NO: 1794646 - DNA, 14 bp, Homo sapiens
gtccatgggcagag

SEQ ID NO: 1794647 - DNA, 16 bp, Homo sapiens
gtccatgggcagagcc

SEQ ID NO: 1794648 - DNA, 13 bp, Homo sapiens
gtccccctctgtc

SEQ ID NO: 1794649 - DNA, 23 bp, Homo sapiens
gtccctccgggacctggtgctgc

SEQ ID NO: 1794650 - DNA, 14 bp, Homo sapiens
gtccctgcctggac

SEQ ID NO: 1794651 - DNA, 12 bp, Homo sapiens
gtcctcagcccc

SEQ ID NO: 1794652 - DNA, 17 bp, Homo sapiens
gtcctgatcagagccgt

SEQ ID NO: 1794653 - DNA, 15 bp, Homo sapiens
gtcctgcaccggggc

SEQ ID NO: 1794654 - DNA, 20 bp, Homo sapiens
gtctctgtataatctattta

SEQ ID NO: 1794655 - DNA, 15 bp, Homo sapiens
gtctgttgcaaaggg

SEQ ID NO: 1794656 - DNA, 15 bp, Homo sapiens
gtcttccatttgcaa

SEQ ID NO: 1794657 - DNA, 20 bp, Homo sapiens
gtcttgtgtttctttagttt

SEQ ID NO: 1794658 - DNA, 15 bp, Homo sapiens
gtgaaaatggtccag

SEQ ID NO: 1794659 - DNA, 17 bp, Homo sapiens
gtgaaggcttctctctg

SEQ ID NO: 1794660 - DNA, 20 bp, Homo sapiens
gtgacaacatttttgtacat

SEQ ID NO: 1794661 - DNA, 15 bp, Homo sapiens
gtgagtgtgactttt

SEQ ID NO: 1794662 - DNA, 19 bp, Homo sapiens
gtgatttttatgccacctg

SEQ ID NO: 1794663 - DNA, 14 bp, Homo sapiens
ctaagtctttccat

SEQ ID NO: 1794664 - DNA, 15 bp, Homo sapiens
ctacagtcaggaaag

SEQ ID NO: 1794665 - DNA, 15 bp, Homo sapiens
ctacagtgtacagtc

SEQ ID NO: 1794666 - DNA, 13 bp, Homo sapiens
ctaccccctgtgc

SEQ ID NO: 1794667 - DNA, 12 bp, Homo sapiens
ctaccctgagct

SEQ ID NO: 1794668 - DNA, 19 bp, Homo sapiens
ctacctgacactcccttgg

SEQ ID NO: 1794669 - DNA, 23 bp, Homo sapiens
ctactaacaatcagctccttcct

SEQ ID NO: 1794670 - DNA, 15 bp, Homo sapiens
ctaggcaggacctgt

SEQ ID NO: 1794671 - DNA, 15 bp, Homo sapiens
ctaggctagggtggg

SEQ ID NO: 1794672 - DNA, 13 bp, Homo sapiens
ctagggatccctc

SEQ ID NO: 1794673 - DNA, 18 bp, Homo sapiens
ctagggccaagcccagca

SEQ ID NO: 1794674 - DNA, 16 bp, Homo sapiens
ctagttctgccaggag

SEQ ID NO: 1794675 - DNA, 23 bp, Homo sapiens
ctagttgattgcgagaattttca

SEQ ID NO: 1794676 - DNA, 13 bp, Homo sapiens
ctatatttattta

SEQ ID NO: 1794677 - DNA, 16 bp, Homo sapiens
ctatatttatttatgt

SEQ ID NO: 1794678 - DNA, 18 bp, Homo sapiens
ctatcaatatttaagttt

SEQ ID NO: 1794679 - DNA, 21 bp, Homo sapiens
ctatgaattgctaattctgag

SEQ ID NO: 1794680 - DNA, 20 bp, Homo sapiens
ctatgtttttgttcaaagcc

SEQ ID NO: 1794681 - DNA, 18 bp, Homo sapiens
ctattacttgaactttcc

SEQ ID NO: 1794682 - DNA, 22 bp, Homo sapiens
ctcacatgtcagtaccttcaaa

SEQ ID NO: 1794683 - DNA, 16 bp, Homo sapiens
ctcacccccttctcca

SEQ ID NO: 1794684 - DNA, 17 bp, Homo sapiens
ctcacccccttctccat

SEQ ID NO: 1794685 - DNA, 14 bp, Homo sapiens
ctcagcgaggtgta

SEQ ID NO: 1794686 - DNA, 17 bp, Homo sapiens
ctcaggaaccgaggcag

SEQ ID NO: 1794687 - DNA, 13 bp, Homo sapiens
ctcagtctctgag

SEQ ID NO: 1794688 - DNA, 15 bp, Homo sapiens
ctcatcattctctgt

SEQ ID NO: 1794689 - DNA, 16 bp, Homo sapiens
ctcatccatcatcatg

SEQ ID NO: 1794690 - DNA, 19 bp, Homo sapiens
ctcatccatcatcatgtgt

SEQ ID NO: 1794691 - DNA, 22 bp, Homo sapiens
ctcatcccgagcacctccacat

SEQ ID NO: 1794692 - DNA, 18 bp, Homo sapiens
ctcatctgtccctccggg

SEQ ID NO: 1794693 - DNA, 17 bp, Homo sapiens
ctcatcttcttcaccat

SEQ ID NO: 1794694 - DNA, 19 bp, Homo sapiens
ctcattctgaaggagcccc

SEQ ID NO: 1794695 - DNA, 17 bp, Homo sapiens
ctcattggacccttcca

SEQ ID NO: 1794696 - DNA, 18 bp, Homo sapiens
ctcattggacccttccat

SEQ ID NO: 1794697 - DNA, 15 bp, Homo sapiens
ctccacatcctccac

SEQ ID NO: 1794698 - DNA, 18 bp, Homo sapiens
ctccacgttctgctcatc

SEQ ID NO: 1794699 - DNA, 20 bp, Homo sapiens
ctccagagggcactctgctt

SEQ ID NO: 1794700 - DNA, 21 bp, Homo sapiens
ctccagagggcactctgcttg

SEQ ID NO: 1794701 - DNA, 20 bp, Homo sapiens
ctccatcctaccccctgtgc

SEQ ID NO: 1794702 - DNA, 20 bp, Homo sapiens
ctccccacgtcagctgggac

SEQ ID NO: 1794703 - DNA, 14 bp, Homo sapiens
ctcccctattttaa

SEQ ID NO: 1794704 - DNA, 14 bp, Homo sapiens
ctccctcctctgcc

SEQ ID NO: 1794705 - DNA, 13 bp, Homo sapiens
ctcccttgggctc

SEQ ID NO: 1794706 - DNA, 14 bp, Homo sapiens
ctcccttgggctcc

SEQ ID NO: 1794707 - DNA, 18 bp, Homo sapiens
ctcccttgggctccctgt

SEQ ID NO: 1794708 - DNA, 18 bp, Homo sapiens
ctcctccatgggagaaaa

SEQ ID NO: 1794709 - DNA, 17 bp, Homo sapiens
ctcctcgagatcccaac

SEQ ID NO: 1794710 - DNA, 21 bp, Homo sapiens
ctcctcgagatcccaacactg

SEQ ID NO: 1794711 - DNA, 20 bp, Homo sapiens
ctcctgccttcctcctgggc

SEQ ID NO: 1794712 - DNA, 12 bp, Homo sapiens
ctcctgggccct

SEQ ID NO: 1794713 - DNA, 17 bp, Homo sapiens
ctcctgtgtggaagaag

SEQ ID NO: 1794714 - DNA, 22 bp, Homo sapiens
ctccttaaggctcttttgtaag

SEQ ID NO: 1794715 - DNA, 13 bp, Homo sapiens
ctccttgggccct

SEQ ID NO: 1794716 - DNA, 16 bp, Homo sapiens
ctccttgggccctttg

SEQ ID NO: 1794717 - DNA, 17 bp, Homo sapiens
ctccttgggccctttga

SEQ ID NO: 1794718 - DNA, 13 bp, Homo sapiens
ctcgagatcccaa

SEQ ID NO: 1794719 - DNA, 22 bp, Homo sapiens
ctcgagatcccaacactgccag

SEQ ID NO: 1794720 - DNA, 13 bp, Homo sapiens
ctcgctgccagct

SEQ ID NO: 1794721 - DNA, 16 bp, Homo sapiens
ctcgctgccagctctg

SEQ ID NO: 1794722 - DNA, 19 bp, Homo sapiens
ctcgctggactctcagtct

SEQ ID NO: 1794723 - DNA, 15 bp, Homo sapiens
ctcgtgtctggcaca

SEQ ID NO: 1794724 - DNA, 18 bp, Homo sapiens
ctctacagagcttccctg

SEQ ID NO: 1794725 - DNA, 12 bp, Homo sapiens
ctctacctgaca

SEQ ID NO: 1794726 - DNA, 21 bp, Homo sapiens
ctctccattcccgtggaacgt

SEQ ID NO: 1794727 - DNA, 12 bp, Homo sapiens
ctctctgctctg

SEQ ID NO: 1794728 - DNA, 16 bp, Homo sapiens
ctctgactcagggctc

SEQ ID NO: 1794729 - DNA, 21 bp, Homo sapiens
ctctgactcagggctcctggg

SEQ ID NO: 1794730 - DNA, 20 bp, Homo sapiens
ctctgcccgggagctcagga

SEQ ID NO: 1794731 - DNA, 13 bp, Homo sapiens
ctctgctctgcgt

SEQ ID NO: 1794732 - DNA, 22 bp, Homo sapiens
ctctgtatcaggacccagagga

SEQ ID NO: 1794733 - DNA, 17 bp, Homo sapiens
ctctgtgaccaatgtct

SEQ ID NO: 1794734 - DNA, 23 bp, Homo sapiens
ctcttggggagtttagggtgggg

SEQ ID NO: 1794735 - DNA, 10 bp, Homo sapiens
ctctttgaga

SEQ ID NO: 1794736 - DNA, 13 bp, Homo sapiens
ctgaaggagcccc

SEQ ID NO: 1794737 - DNA, 15 bp, Homo sapiens
ctgaatagcagaagg

SEQ ID NO: 1794738 - DNA, 21 bp, Homo sapiens
ctgacatttggagtgttcccc

SEQ ID NO: 1794739 - DNA, 15 bp, Homo sapiens
ctgactcagggctcc

SEQ ID NO: 1794740 - DNA, 21 bp, Homo sapiens
ctgactcagggctcctgggtt

SEQ ID NO: 1794741 - DNA, 13 bp, Homo sapiens
ctggcacttcctt

SEQ ID NO: 1794742 - DNA, 17 bp, Homo sapiens
ctggccccatggtcagc

SEQ ID NO: 1794743 - DNA, 16 bp, Homo sapiens
ctgggaaatattccct

SEQ ID NO: 1794744 - DNA, 22 bp, Homo sapiens
ctgggagggcagcagggctacc

SEQ ID NO: 1794745 - DNA, 23 bp, Homo sapiens
ctgggagttgatcgcctttccca

SEQ ID NO: 1794746 - DNA, 14 bp, Homo sapiens
ctgggccctctctg

SEQ ID NO: 1794747 - DNA, 15 bp, Homo sapiens
ctgggccctctctgc

SEQ ID NO: 1794748 - DNA, 18 bp, Homo sapiens
ctgggctgagggagcctg

SEQ ID NO: 1794749 - DNA, 14 bp, Homo sapiens
ctgggggtgccagg

SEQ ID NO: 1794750 - DNA, 22 bp, Homo sapiens
ctgggttttgtattctctgagc

SEQ ID NO: 1794751 - DNA, 15 bp, Homo sapiens
ctggtttttcagttt

SEQ ID NO: 1794752 - DNA, 20 bp, Homo sapiens
ctgtaacctcttcagaggcc

SEQ ID NO: 1794753 - DNA, 20 bp, Homo sapiens
ctgtattttgtattgtttca

SEQ ID NO: 1794754 - DNA, 21 bp, Homo sapiens
ctgtccctccgggacctggtg

SEQ ID NO: 1794755 - DNA, 21 bp, Homo sapiens
ctgtctccctcctctgcccgg

SEQ ID NO: 1794756 - DNA, 21 bp, Homo sapiens
ctgtgcagccgctgagcgagg

SEQ ID NO: 1794757 - DNA, 11 bp, Homo sapiens
ctgtgcagtga

SEQ ID NO: 1794758 - DNA, 20 bp, Homo sapiens
ctgtgccttgtcacgccaga

SEQ ID NO: 1794759 - DNA, 15 bp, Homo sapiens
ctgtggtgtgtcccc

SEQ ID NO: 1794760 - DNA, 19 bp, Homo sapiens
cttaaggagaggagaaact

SEQ ID NO: 1794761 - DNA, 22 bp, Homo sapiens
cttaaggagaggagaaactgag

SEQ ID NO: 1794762 - DNA, 16 bp, Homo sapiens
cttacagtaggagccc

SEQ ID NO: 1794763 - DNA, 20 bp, Homo sapiens
cttagctgaacaatgaatgc

SEQ ID NO: 1794764 - DNA, 21 bp, Homo sapiens
cttattagagtgtctttccac

SEQ ID NO: 1794765 - DNA, 23 bp, Homo sapiens
cttcaaactagggccaagcccag

SEQ ID NO: 1794766 - DNA, 19 bp, Homo sapiens
cttcaaatatagagatatt

SEQ ID NO: 1794767 - DNA, 17 bp, Homo sapiens
cttcaccatttggcaat

SEQ ID NO: 1794768 - DNA, 19 bp, Homo sapiens
cttccaaatcccctaagca

SEQ ID NO: 1794769 - DNA, 18 bp, Homo sapiens
cttccactgagggcagtc

SEQ ID NO: 1794770 - DNA, 20 bp, Homo sapiens
cttccctgactcattctgaa

SEQ ID NO: 1794771 - DNA, 14 bp, Homo sapiens
cttcctcctgggcc

SEQ ID NO: 1794772 - DNA, 22 bp, Homo sapiens
cttcctcctgggccctctctgc

SEQ ID NO: 1794773 - DNA, 17 bp, Homo sapiens
cttcgggcccttcccac

SEQ ID NO: 1794774 - DNA, 19 bp, Homo sapiens
cttctagttctgccaggag

SEQ ID NO: 1794775 - DNA, 13 bp, Homo sapiens
cttgaactttcca

SEQ ID NO: 1794776 - DNA, 17 bp, Homo sapiens
cttgaattgtaactgtt

SEQ ID NO: 1794777 - DNA, 20 bp, Homo sapiens
cttgaattgtaactgttctt

SEQ ID NO: 1794778 - DNA, 21 bp, Homo sapiens
cttgatgcatgcactgttccc

SEQ ID NO: 1794779 - DNA, 18 bp, Homo sapiens
cttgccttattagagtgt

SEQ ID NO: 1794780 - DNA, 19 bp, Homo sapiens
cttgggccctttgagtgca

SEQ ID NO: 1794781 - DNA, 21 bp, Homo sapiens
cttgggctccctgtaacctct

SEQ ID NO: 1794782 - DNA, 17 bp, Homo sapiens
cttgtattaagttgtta

SEQ ID NO: 1794783 - DNA, 18 bp, Homo sapiens
cttgtcacgccagacttc

SEQ ID NO: 1794784 - DNA, 13 bp, Homo sapiens
cttgttgtggagg

SEQ ID NO: 1794785 - DNA, 17 bp, Homo sapiens
ctttacatatatatgta

SEQ ID NO: 1794786 - DNA, 13 bp, Homo sapiens
ctttagtttttgt

SEQ ID NO: 1794787 - DNA, 19 bp, Homo sapiens
ctttcaaaaccttttgaaa

SEQ ID NO: 1794788 - DNA, 22 bp, Homo sapiens
ctttccacggagccactcctct

SEQ ID NO: 1794789 - DNA, 13 bp, Homo sapiens
ctttcccaacacc

SEQ ID NO: 1794790 - DNA, 20 bp, Homo sapiens
ctttgattaaagactccagt

SEQ ID NO: 1794791 - DNA, 13 bp, Homo sapiens
ctttgccttccaa

SEQ ID NO: 1794792 - DNA, 23 bp, Homo sapiens
ctttgttttgcacactttgccat

SEQ ID NO: 1794793 - DNA, 19 bp, Homo sapiens
cttttaaaactatatttat

SEQ ID NO: 1794794 - DNA, 19 bp, Homo sapiens
cttttggcatgaaagtgcg

SEQ ID NO: 1794795 - DNA, 19 bp, Homo sapiens
ctttttacattcatatctt

SEQ ID NO: 1794796 - DNA, 18 bp, Homo sapiens
ctttttgaaaaaagtata

SEQ ID NO: 1794797 - DNA, 14 bp, Homo sapiens
cttttttttaagtt

SEQ ID NO: 1794798 - DNA, 14 bp, Homo sapiens
gaaaacaaggaagt

SEQ ID NO: 1794799 - DNA, 14 bp, Homo sapiens
gaaaacactgtgca

SEQ ID NO: 1794800 - DNA, 14 bp, Homo sapiens
gaaaagtgcaatgc

SEQ ID NO: 1794801 - DNA, 18 bp, Homo sapiens
gaaacaccgagtctctgt

SEQ ID NO: 1794802 - DNA, 12 bp, Homo sapiens
gaaccgaggcag

SEQ ID NO: 1794803 - DNA, 15 bp, Homo sapiens
gaaccgaggcaggga

SEQ ID NO: 1794804 - DNA, 17 bp, Homo sapiens
gaactttccaaaaccta

SEQ ID NO: 1794805 - DNA, 23 bp, Homo sapiens
gaagagtaagtcaacctgcctga

SEQ ID NO: 1794806 - DNA, 19 bp, Homo sapiens
gaagcgttgtcctcagccc

SEQ ID NO: 1794807 - DNA, 19 bp, Homo sapiens
gaaggatcccatgagctcc

SEQ ID NO: 1794808 - DNA, 16 bp, Homo sapiens
gaaggggccagaggct

SEQ ID NO: 1794809 - DNA, 13 bp, Homo sapiens
gaagtaggaagta

SEQ ID NO: 1794810 - DNA, 15 bp, Homo sapiens
gaagtcaaagcaagg

SEQ ID NO: 1794811 - DNA, 16 bp, Homo sapiens
gaagtcaaagcaagga

SEQ ID NO: 1794812 - DNA, 17 bp, Homo sapiens
gaataaagaatgaatgg

SEQ ID NO: 1794813 - DNA, 19 bp, Homo sapiens
gaatacttttgccctttga

SEQ ID NO: 1794814 - DNA, 18 bp, Homo sapiens
gaatagtcgcgcaagcat

SEQ ID NO: 1794815 - DNA, 22 bp, Homo sapiens
gaatcatttctatttctcctcc

SEQ ID NO: 1794816 - DNA, 21 bp, Homo sapiens
gaatgctgagacccccggagc

SEQ ID NO: 1794817 - DNA, 22 bp, Homo sapiens
gaatgtgagtgtgtttgtgtgc

SEQ ID NO: 1794818 - DNA, 17 bp, Homo sapiens
gaattcggtgtgcacca

SEQ ID NO: 1794819 - DNA, 19 bp, Homo sapiens
gaattttctttcatacatt

SEQ ID NO: 1794820 - DNA, 12 bp, Homo sapiens
gacaacattttt

SEQ ID NO: 1794821 - DNA, 20 bp, Homo sapiens
gacaacatttttgtacatta

SEQ ID NO: 1794822 - DNA, 21 bp, Homo sapiens
gacaacatttttgtacattat

SEQ ID NO: 1794823 - DNA, 20 bp, Homo sapiens
gacacctaggctagggtggg

SEQ ID NO: 1794824 - DNA, 18 bp, Homo sapiens
gacagccctgcggagacc

SEQ ID NO: 1794825 - DNA, 18 bp, Homo sapiens
gaccagtcaacctgggca

SEQ ID NO: 1794826 - DNA, 20 bp, Homo sapiens
gaccctcatctttcttccaa

SEQ ID NO: 1794827 - DNA, 14 bp, Homo sapiens
gacgcctgaggaac

SEQ ID NO: 1794828 - DNA, 18 bp, Homo sapiens
gacgtgaatgtctcagcg

SEQ ID NO: 1794829 - DNA, 19 bp, Homo sapiens
gacgtgagtgtgacttttt

SEQ ID NO: 1794830 - DNA, 18 bp, Homo sapiens
gactacagtcaggaaagg

SEQ ID NO: 1794831 - DNA, 12 bp, Homo sapiens
gactcagggctc

SEQ ID NO: 1794832 - DNA, 18 bp, Homo sapiens
gactctcagtctctgagc

SEQ ID NO: 1794833 - DNA, 20 bp, Homo sapiens
gactctcagtctctgagcag

SEQ ID NO: 1794834 - DNA, 22 bp, Homo sapiens
gactgaccaatattgtacagtt

SEQ ID NO: 1794835 - DNA, 11 bp, Homo sapiens
gactgtagaaa

SEQ ID NO: 1794836 - DNA, 18 bp, Homo sapiens
gactgtctccatggccct

SEQ ID NO: 1794837 - DNA, 19 bp, Homo sapiens
gagaaatgaatgctgagac

SEQ ID NO: 1794838 - DNA, 20 bp, Homo sapiens
gagaaatgaatgctgagacc

SEQ ID NO: 1794839 - DNA, 20 bp, Homo sapiens
gagaatagctttatcttggt

SEQ ID NO: 1794840 - DNA, 16 bp, Homo sapiens
gagacgggccctggtg

SEQ ID NO: 1794841 - DNA, 17 bp, Homo sapiens
gagactgggctgaggga

SEQ ID NO: 1794842 - DNA, 13 bp, Homo sapiens
gagagacgggccc

SEQ ID NO: 1794843 - DNA, 21 bp, Homo sapiens
gagagaggccattctttccca

SEQ ID NO: 1794844 - DNA, 20 bp, Homo sapiens
gagatcccaacactgccagc

SEQ ID NO: 1794845 - DNA, 15 bp, Homo sapiens
gagattacctcctga

SEQ ID NO: 1794846 - DNA, 16 bp, Homo sapiens
gagcagaggggctgaa

SEQ ID NO: 1794847 - DNA, 22 bp, Homo sapiens
agtcttgtattaagttgttaat

SEQ ID NO: 1794848 - DNA, 21 bp, Homo sapiens
agtgaaggcttctctctgtgg

SEQ ID NO: 1794849 - DNA, 17 bp, Homo sapiens
agtgaatacattttgca

SEQ ID NO: 1794850 - DNA, 16 bp, Homo sapiens
agtgaatgattcagtg

SEQ ID NO: 1794851 - DNA, 19 bp, Homo sapiens
agtgaatgattcagtgtta

SEQ ID NO: 1794852 - DNA, 19 bp, Homo sapiens
agtgacctgccctacatat

SEQ ID NO: 1794853 - DNA, 23 bp, Homo sapiens
agtgcagtcctgatcagagccgt

SEQ ID NO: 1794854 - DNA, 15 bp, Homo sapiens
agtggtatagaaatg

SEQ ID NO: 1794855 - DNA, 16 bp, Homo sapiens
agtggtatagaaatgc

SEQ ID NO: 1794856 - DNA, 13 bp, Homo sapiens
agtgtacagtctt

SEQ ID NO: 1794857 - DNA, 16 bp, Homo sapiens
agtgtacagtcttgta

SEQ ID NO: 1794858 - DNA, 17 bp, Homo sapiens
agtgtacagtcttgtat

SEQ ID NO: 1794859 - DNA, 23 bp, Homo sapiens
agtgtctttccacggagccactc

SEQ ID NO: 1794860 - DNA, 18 bp, Homo sapiens
agtgtgaggccagggcag

SEQ ID NO: 1794861 - DNA, 18 bp, Homo sapiens
agtgttagggaagggcct

SEQ ID NO: 1794862 - DNA, 19 bp, Homo sapiens
agtgttagggaagggcctg

SEQ ID NO: 1794863 - DNA, 23 bp, Homo sapiens
agtgttagggaagggcctgccac

SEQ ID NO: 1794864 - DNA, 16 bp, Homo sapiens
agttacacatttttca

SEQ ID NO: 1794865 - DNA, 18 bp, Homo sapiens
agttctagttgattgcga

SEQ ID NO: 1794866 - DNA, 12 bp, Homo sapiens
agttctgccagg

SEQ ID NO: 1794867 - DNA, 21 bp, Homo sapiens
agttcttagttgctgtatgtc

SEQ ID NO: 1794868 - DNA, 20 bp, Homo sapiens
agttgattgcgagaattttc

SEQ ID NO: 1794869 - DNA, 17 bp, Homo sapiens
agttggtgttcataatt

SEQ ID NO: 1794870 - DNA, 16 bp, Homo sapiens
agttgttaataaaagt

SEQ ID NO: 1794871 - DNA, 23 bp, Homo sapiens
agttgttaataaaagtacatgtt

SEQ ID NO: 1794872 - DNA, 14 bp, Homo sapiens
agtttaattgactt

SEQ ID NO: 1794873 - DNA, 15 bp, Homo sapiens
agtttaattgactta

SEQ ID NO: 1794874 - DNA, 14 bp, Homo sapiens
agtttagggtgggg

SEQ ID NO: 1794875 - DNA, 23 bp, Homo sapiens
agtttgattattcagtgtcactg

SEQ ID NO: 1794876 - DNA, 15 bp, Homo sapiens
ataaagttctgtact

SEQ ID NO: 1794877 - DNA, 16 bp, Homo sapiens
ataaccttcatgatga

SEQ ID NO: 1794878 - DNA, 15 bp, Homo sapiens
atacagaactctttc

SEQ ID NO: 1794879 - DNA, 20 bp, Homo sapiens
atacagaactctttcaaaac

SEQ ID NO: 1794880 - DNA, 16 bp, Homo sapiens
atacagaggtaactat

SEQ ID NO: 1794881 - DNA, 20 bp, Homo sapiens
atacagtcttccatttgcaa

SEQ ID NO: 1794882 - DNA, 20 bp, Homo sapiens
atacattatattcctctaaa

SEQ ID NO: 1794883 - DNA, 16 bp, Homo sapiens
ataccagcgaggaggc

SEQ ID NO: 1794884 - DNA, 13 bp, Homo sapiens
atagaaatgctgg

SEQ ID NO: 1794885 - DNA, 12 bp, Homo sapiens
atagagtgaatt

SEQ ID NO: 1794886 - DNA, 17 bp, Homo sapiens
ataggataaattacatt

SEQ ID NO: 1794887 - DNA, 18 bp, Homo sapiens
ataggataaattacatta

SEQ ID NO: 1794888 - DNA, 14 bp, Homo sapiens
atatgcacttataa

SEQ ID NO: 1794889 - DNA, 18 bp, Homo sapiens
atatgtacatacatatat

SEQ ID NO: 1794890 - DNA, 17 bp, Homo sapiens
atattccctagaaactt

SEQ ID NO: 1794891 - DNA, 12 bp, Homo sapiens
atattgtacagt

SEQ ID NO: 1794892 - DNA, 13 bp, Homo sapiens
atattgtacagtt

SEQ ID NO: 1794893 - DNA, 16 bp, Homo sapiens
atattgtattaagggc

SEQ ID NO: 1794894 - DNA, 14 bp, Homo sapiens
atatttaagtttgt

SEQ ID NO: 1794895 - DNA, 15 bp, Homo sapiens
atatttatttatgta

SEQ ID NO: 1794896 - DNA, 21 bp, Homo sapiens
atattttcaccatttgattat

SEQ ID NO: 1794897 - DNA, 22 bp, Homo sapiens
atatttttgtacgttatatatt

SEQ ID NO: 1794898 - DNA, 19 bp, Homo sapiens
atcaccgtgggctccctga

SEQ ID NO: 1794899 - DNA, 15 bp, Homo sapiens
atcagctccttcctg

SEQ ID NO: 1794900 - DNA, 20 bp, Homo sapiens
atcaggacccagaggaaggg

SEQ ID NO: 1794901 - DNA, 15 bp, Homo sapiens
atcagtgctccctca

SEQ ID NO: 1794902 - DNA, 20 bp, Homo sapiens
atcatctcctgccttcctcc

SEQ ID NO: 1794903 - DNA, 23 bp, Homo sapiens
atcatctcctgccttcctcctgg

SEQ ID NO: 1794904 - DNA, 12 bp, Homo sapiens
atcattctctgt

SEQ ID NO: 1794905 - DNA, 15 bp, Homo sapiens
atccagctatgttat

SEQ ID NO: 1794906 - DNA, 16 bp, Homo sapiens
atcccaacactgccag

SEQ ID NO: 1794907 - DNA, 17 bp, Homo sapiens
atcccaacactgccagc

SEQ ID NO: 1794908 - DNA, 17 bp, Homo sapiens
atccctctacagagctt

SEQ ID NO: 1794909 - DNA, 14 bp, Homo sapiens
atccgaatctcttt

SEQ ID NO: 1794910 - DNA, 20 bp, Homo sapiens
atcctatgtttttgttcaaa

SEQ ID NO: 1794911 - DNA, 19 bp, Homo sapiens
atcctccacgttctgctca

SEQ ID NO: 1794912 - DNA, 13 bp, Homo sapiens
atctaacctcatc

SEQ ID NO: 1794913 - DNA, 14 bp, Homo sapiens
atctaacctcatct

SEQ ID NO: 1794914 - DNA, 15 bp, Homo sapiens
atctaacctcatctt

SEQ ID NO: 1794915 - DNA, 19 bp, Homo sapiens
atctcattggacccttcca

SEQ ID NO: 1794916 - DNA, 20 bp, Homo sapiens
atctcattggacccttccat

SEQ ID NO: 1794917 - DNA, 13 bp, Homo sapiens
atctgtgtcttgt

SEQ ID NO: 1794918 - DNA, 14 bp, Homo sapiens
atcttcttcaccat

SEQ ID NO: 1794919 - DNA, 17 bp, Homo sapiens
atcttgactacagtcag

SEQ ID NO: 1794920 - DNA, 14 bp, Homo sapiens
atgaagaaagtgga

SEQ ID NO: 1794921 - DNA, 13 bp, Homo sapiens
atgaatgctgacc

SEQ ID NO: 1794922 - DNA, 18 bp, Homo sapiens
atgacatttatttttcat

SEQ ID NO: 1794923 - DNA, 15 bp, Homo sapiens
atgattttcttttgt

SEQ ID NO: 1794924 - DNA, 16 bp, Homo sapiens
atgccatcatctcctg

SEQ ID NO: 1794925 - DNA, 15 bp, Homo sapiens
atgctccttgggccc

SEQ ID NO: 1794926 - DNA, 17 bp, Homo sapiens
atgggagccgggtctgc

SEQ ID NO: 1794927 - DNA, 20 bp, Homo sapiens
atgggagccgggtctgcctc

SEQ ID NO: 1794928 - DNA, 23 bp, Homo sapiens
atgggaggctcacccccttctcc

SEQ ID NO: 1794929 - DNA, 18 bp, Homo sapiens
atgggatggtggagggcc

SEQ ID NO: 1794930 - DNA, 16 bp, Homo sapiens
atggtccaggagaagg

SEQ ID NO: 1794931 - DNA, 18 bp, Homo sapiens
atggtccaggagaaggcc

SEQ ID NO: 1794932 - DNA, 17 bp, Homo sapiens
atgtaaaagactttttt

SEQ ID NO: 1794933 - DNA, 14 bp, Homo sapiens
atgtaaactgtgca

SEQ ID NO: 1794934 - DNA, 19 bp, Homo sapiens
atgtaatcttgaattgtaa

SEQ ID NO: 1794935 - DNA, 21 bp, Homo sapiens
atgtagcaaaatacatgacat

SEQ ID NO: 1794936 - DNA, 14 bp, Homo sapiens
atgtaggaagtagg

SEQ ID NO: 1794937 - DNA, 23 bp, Homo sapiens
atgtcagaagtttctttttacat

SEQ ID NO: 1794938 - DNA, 18 bp, Homo sapiens
attacttgaactttccaa

SEQ ID NO: 1794939 - DNA, 20 bp, Homo sapiens
attagagattacctcctgag

SEQ ID NO: 1794940 - DNA, 23 bp, Homo sapiens
attagagtgtctttccacggagc

SEQ ID NO: 1794941 - DNA, 16 bp, Homo sapiens
attagtaacatgtgtt

SEQ ID NO: 1794942 - DNA, 17 bp, Homo sapiens
attagtaacatgtgtta

SEQ ID NO: 1794943 - DNA, 20 bp, Homo sapiens
attatgagtctctatgatct

SEQ ID NO: 1794944 - DNA, 20 bp, Homo sapiens
attatgttattggaattttc

SEQ ID NO: 1794945 - DNA, 22 bp, Homo sapiens
attatgttattggaattttctt

SEQ ID NO: 1794946 - DNA, 13 bp, Homo sapiens
attattcagtgtc

SEQ ID NO: 1794947 - DNA, 15 bp, Homo sapiens
attattcagtgtcac

SEQ ID NO: 1794948 - DNA, 22 bp, Homo sapiens
attatttcaaccgcttgccata

SEQ ID NO: 1794949 - DNA, 11 bp, Homo sapiens
attatttgcat

SEQ ID NO: 1794950 - DNA, 12 bp, Homo sapiens
attcatatctta

SEQ ID NO: 1794951 - DNA, 20 bp, Homo sapiens
attccctagaaacttccaaa

SEQ ID NO: 1794952 - DNA, 21 bp, Homo sapiens
attccctagaaacttccaaat

SEQ ID NO: 1794953 - DNA, 17 bp, Homo sapiens
attcctgggaaatattc

SEQ ID NO: 1794954 - DNA, 17 bp, Homo sapiens
attctctgagctgtgca

SEQ ID NO: 1794955 - DNA, 19 bp, Homo sapiens
attctttcccaacacctct

SEQ ID NO: 1794956 - DNA, 14 bp, Homo sapiens
attgaaaaaataga

SEQ ID NO: 1794957 - DNA, 18 bp, Homo sapiens
attgaaaaaatagagcct

SEQ ID NO: 1794958 - DNA, 22 bp, Homo sapiens
attgaattcttggttgaggaaa

SEQ ID NO: 1794959 - DNA, 16 bp, Homo sapiens
attgagttttcagtgg

SEQ ID NO: 1794960 - DNA, 15 bp, Homo sapiens
attgcatctcccaga

SEQ ID NO: 1794961 - DNA, 15 bp, Homo sapiens
attgcgagaattttc

SEQ ID NO: 1794962 - DNA, 20 bp, Homo sapiens
attgctgccccatcagtgct

SEQ ID NO: 1794963 - DNA, 16 bp, Homo sapiens
attgcttgttggattt

SEQ ID NO: 1794964 - DNA, 13 bp, Homo sapiens
attggaattttct

SEQ ID NO: 1794965 - DNA, 17 bp, Homo sapiens
attggaattttctttca

SEQ ID NO: 1794966 - DNA, 21 bp, Homo sapiens
attgtacagtttttattgctt

SEQ ID NO: 1794967 - DNA, 22 bp, Homo sapiens
attgtttcaattgcatctccca

SEQ ID NO: 1794968 - DNA, 14 bp, Homo sapiens
atttatatgtacat

SEQ ID NO: 1794969 - DNA, 14 bp, Homo sapiens
atttatttatgtag

SEQ ID NO: 1794970 - DNA, 17 bp, Homo sapiens
atttcaaattggagctt

SEQ ID NO: 1794971 - DNA, 18 bp, Homo sapiens
atttctactttgaagtca

SEQ ID NO: 1794972 - DNA, 18 bp, Homo sapiens
atttctatttctcctcca

SEQ ID NO: 1794973 - DNA, 20 bp, Homo sapiens
atttctatttctcctccatg

SEQ ID NO: 1794974 - DNA, 14 bp, Homo sapiens
atttgagtgctctg

SEQ ID NO: 1794975 - DNA, 20 bp, Homo sapiens
atttgcaagggaaaagtctc

SEQ ID NO: 1794976 - DNA, 23 bp, Homo sapiens
attttaagacgtgaatgtctcag

SEQ ID NO: 1794977 - DNA, 16 bp, Homo sapiens
attttctttcatacat

SEQ ID NO: 1794978 - DNA, 17 bp, Homo sapiens
attttctttcatacatt

SEQ ID NO: 1794979 - DNA, 19 bp, Homo sapiens
attttctttcatacattat

SEQ ID NO: 1794980 - DNA, 21 bp, Homo sapiens
attttctttcatacattatat

SEQ ID NO: 1794981 - DNA, 16 bp, Homo sapiens
atttttgctcttctgt

SEQ ID NO: 1794982 - DNA, 13 bp, Homo sapiens
atttttgtacatt

SEQ ID NO: 1794983 - DNA, 15 bp, Homo sapiens
atttttgtacattat

SEQ ID NO: 1794984 - DNA, 15 bp, Homo sapiens
attttttttgtaact

SEQ ID NO: 1794985 - DNA, 15 bp, Homo sapiens
caaacaggctcagag

SEQ ID NO: 1794986 - DNA, 20 bp, Homo sapiens
caaagccagcgtcctcctct

SEQ ID NO: 1794987 - DNA, 21 bp, Homo sapiens
caaagccagcgtcctcctctg

SEQ ID NO: 1794988 - DNA, 19 bp, Homo sapiens
caaagcccaaagtggtata

SEQ ID NO: 1794989 - DNA, 18 bp, Homo sapiens
caaagtggtatagaaatg

SEQ ID NO: 1794990 - DNA, 19 bp, Homo sapiens
caacaatttctactttgaa

SEQ ID NO: 1794991 - DNA, 18 bp, Homo sapiens
caacatttttgtacatta

SEQ ID NO: 1794992 - DNA, 19 bp, Homo sapiens
caacatttttgtacattat

SEQ ID NO: 1794993 - DNA, 21 bp, Homo sapiens
caacatttttgtacattatgt

SEQ ID NO: 1794994 - DNA, 23 bp, Homo sapiens
caacatttttgtacattatgtta

SEQ ID NO: 1794995 - DNA, 16 bp, Homo sapiens
caaccgcttgccatat

SEQ ID NO: 1794996 - DNA, 13 bp, Homo sapiens
caaccggctttgt

SEQ ID NO: 1794997 - DNA, 21 bp, Homo sapiens
caacctgcctgacatttggag

SEQ ID NO: 1794998 - DNA, 19 bp, Homo sapiens
caagagggacgcctggggg

SEQ ID NO: 1794999 - DNA, 20 bp, Homo sapiens
caagattttttttgtaactt

SEQ ID NO: 1795000 - DNA, 17 bp, Homo sapiens
caagcaggaaatgaaaa

SEQ ID NO: 1795001 - DNA, 17 bp, Homo sapiens
caagcccagcactgctt

SEQ ID NO: 1795002 - DNA, 15 bp, Homo sapiens
caagggaaaagtctc

SEQ ID NO: 1795003 - DNA, 20 bp, Homo sapiens
caagggctttgttttgcaca

SEQ ID NO: 1795004 - DNA, 15 bp, Homo sapiens
caatattgtacagtt

SEQ ID NO: 1795005 - DNA, 17 bp, Homo sapiens
caatattgtacagtttt

SEQ ID NO: 1795006 - DNA, 11 bp, Homo sapiens
caatcctggac

SEQ ID NO: 1795007 - DNA, 16 bp, Homo sapiens
caatttctactttgaa

SEQ ID NO: 1795008 - DNA, 22 bp, Homo sapiens
cacaaaataaccaatcctggac

SEQ ID NO: 1795009 - DNA, 12 bp, Homo sapiens
cacaacttgttt

SEQ ID NO: 1795010 - DNA, 17 bp, Homo sapiens
cacagcctcccctgcca

SEQ ID NO: 1795011 - DNA, 19 bp, Homo sapiens
cacagcctcccctgccagg

SEQ ID NO: 1795012 - DNA, 15 bp, Homo sapiens
cacaggacatttctc

SEQ ID NO: 1795013 - DNA, 14 bp, Homo sapiens
cacatgattttctt

SEQ ID NO: 1795014 - DNA, 20 bp, Homo sapiens
cacatgtcagtaccttcaaa

SEQ ID NO: 1795015 - DNA, 14 bp, Homo sapiens
cacatttttcagat

SEQ ID NO: 1795016 - DNA, 19 bp, Homo sapiens
caccagggttgaccccaga

SEQ ID NO: 1795017 - DNA, 22 bp, Homo sapiens
caccagggttgaccccagagga

SEQ ID NO: 1795018 - DNA, 17 bp, Homo sapiens
caccatttggcaatgcc

SEQ ID NO: 1795019 - DNA, 18 bp, Homo sapiens
cacccccttctccatcca

SEQ ID NO: 1795020 - DNA, 14 bp, Homo sapiens
caccggggcctggg

SEQ ID NO: 1795021 - DNA, 17 bp, Homo sapiens
caccgtgggctccctga

SEQ ID NO: 1795022 - DNA, 16 bp, Homo sapiens
cacctccacatcctcc

SEQ ID NO: 1795023 - DNA, 19 bp, Homo sapiens
cacctgtgcttcgggccct

SEQ ID NO: 1795024 - DNA, 13 bp, Homo sapiens
cacgactgtctcc

SEQ ID NO: 1795025 - DNA, 16 bp, Homo sapiens
cacgactgtctccatg

SEQ ID NO: 1795026 - DNA, 16 bp, Homo sapiens
ccacaaactgatttct

SEQ ID NO: 1795027 - DNA, 16 bp, Homo sapiens
ccacaggacatttctc

SEQ ID NO: 1795028 - DNA, 21 bp, Homo sapiens
ccaccaagagggacgcctggg

SEQ ID NO: 1795029 - DNA, 20 bp, Homo sapiens
ccacctgaataaagaatgaa

SEQ ID NO: 1795030 - DNA, 15 bp, Homo sapiens
ccacgactgtctcca

SEQ ID NO: 1795031 - DNA, 20 bp, Homo sapiens
ccacggagccactcctctga

SEQ ID NO: 1795032 - DNA, 13 bp, Homo sapiens
ccacttaaaatgt

SEQ ID NO: 1795033 - DNA, 21 bp, Homo sapiens
ccagaggattgctgccccatc

SEQ ID NO: 1795034 - DNA, 17 bp, Homo sapiens
ccagagtccctgcctgg

SEQ ID NO: 1795035 - DNA, 22 bp, Homo sapiens
ccagcactgcttgaggaaaaca

SEQ ID NO: 1795036 - DNA, 17 bp, Homo sapiens
ccagcgtcctcctctgt

SEQ ID NO: 1795037 - DNA, 15 bp, Homo sapiens
ccagctctgaaacca

SEQ ID NO: 1795038 - DNA, 21 bp, Homo sapiens
ccagctctgaaaccagtgtta

SEQ ID NO: 1795039 - DNA, 13 bp, Homo sapiens
ccaggagacaggt

SEQ ID NO: 1795040 - DNA, 16 bp, Homo sapiens
ccaggcattgccaagg

SEQ ID NO: 1795041 - DNA, 22 bp, Homo sapiens
ccaggtgctacacccttttcca

SEQ ID NO: 1795042 - DNA, 14 bp, Homo sapiens
ccagtcaacctggg

SEQ ID NO: 1795043 - DNA, 17 bp, Homo sapiens
ccagtgttagggaaggg

SEQ ID NO: 1795044 - DNA, 17 bp, Homo sapiens
ccagtttttgcagagaa

SEQ ID NO: 1795045 - DNA, 17 bp, Homo sapiens
ccatcctaccccctgtg

SEQ ID NO: 1795046 - DNA, 21 bp, Homo sapiens
ccatgagctccttaaggctct

SEQ ID NO: 1795047 - DNA, 18 bp, Homo sapiens
tacatacagaggtaacta

SEQ ID NO: 1795048 - DNA, 12 bp, Homo sapiens
tacattatgtta

SEQ ID NO: 1795049 - DNA, 15 bp, Homo sapiens
tacattatgttattg

SEQ ID NO: 1795050 - DNA, 15 bp, Homo sapiens
taccaatgaaaaaat

SEQ ID NO: 1795051 - DNA, 17 bp, Homo sapiens
taccaatgaaaaaatgt

SEQ ID NO: 1795052 - DNA, 14 bp, Homo sapiens
tacctcctgagaaa

SEQ ID NO: 1795053 - DNA, 21 bp, Homo sapiens
tacctgaaaacactgtgcaca

SEQ ID NO: 1795054 - DNA, 22 bp, Homo sapiens
taccttggttcccccactgatc

SEQ ID NO: 1795055 - DNA, 14 bp, Homo sapiens
tacgaatacttttg

SEQ ID NO: 1795056 - DNA, 14 bp, Homo sapiens
tacgttatatattg

SEQ ID NO: 1795057 - DNA, 23 bp, Homo sapiens
tactgtattttgtattgtttcaa

SEQ ID NO: 1795058 - DNA, 18 bp, Homo sapiens
tacttacatctttgttta

SEQ ID NO: 1795059 - DNA, 14 bp, Homo sapiens
tacttgtttcgtaa

SEQ ID NO: 1795060 - DNA, 23 bp, Homo sapiens
tagactaaggccattattgtact

SEQ ID NO: 1795061 - DNA, 16 bp, Homo sapiens
tagagcacttttaaca

SEQ ID NO: 1795062 - DNA, 14 bp, Homo sapiens
tagagcctgaggga

SEQ ID NO: 1795063 - DNA, 23 bp, Homo sapiens
tagcagaaggttgcacctccccc

SEQ ID NO: 1795064 - DNA, 14 bp, Homo sapiens
tagcctagaaatat

SEQ ID NO: 1795065 - DNA, 13 bp, Homo sapiens
taggactgtagaa

SEQ ID NO: 1795066 - DNA, 14 bp, Homo sapiens
taggactgtagaaa

SEQ ID NO: 1795067 - DNA, 12 bp, Homo sapiens
taggataaatta

SEQ ID NO: 1795068 - DNA, 13 bp, Homo sapiens
taggctagggtgg

SEQ ID NO: 1795069 - DNA, 19 bp, Homo sapiens
tagtgaaggcttctctctg

SEQ ID NO: 1795070 - DNA, 21 bp, Homo sapiens
tagttgattgcgagaattttc

SEQ ID NO: 1795071 - DNA, 14 bp, Homo sapiens
tataaaagactgac

SEQ ID NO: 1795072 - DNA, 13 bp, Homo sapiens
tataatctattta

SEQ ID NO: 1795073 - DNA, 18 bp, Homo sapiens
tataatctatttacataa

SEQ ID NO: 1795074 - DNA, 18 bp, Homo sapiens
tatacgataaataacttt

SEQ ID NO: 1795075 - DNA, 11 bp, Homo sapiens
tatagaaatgc

SEQ ID NO: 1795076 - DNA, 21 bp, Homo sapiens
tatagagatatttttgtacgt

SEQ ID NO: 1795077 - DNA, 18 bp, Homo sapiens
tatagtgatgtaatcttg

SEQ ID NO: 1795078 - DNA, 16 bp, Homo sapiens
tatatgtacatacata

SEQ ID NO: 1795079 - DNA, 21 bp, Homo sapiens
tatcaggacccagaggaaggg

SEQ ID NO: 1795080 - DNA, 21 bp, Homo sapiens
tatgcatttaaatacagtctt

SEQ ID NO: 1795081 - DNA, 17 bp, Homo sapiens
tatgtacatacatatat

SEQ ID NO: 1795082 - DNA, 15 bp, Homo sapiens
tatgtagcaaaatac

SEQ ID NO: 1795083 - DNA, 12 bp, Homo sapiens
tattacttgaac

SEQ ID NO: 1795084 - DNA, 15 bp, Homo sapiens
tattagagtgtcttt

SEQ ID NO: 1795085 - DNA, 21 bp, Homo sapiens
tattccctagaaacttccaaa

SEQ ID NO: 1795086 - DNA, 18 bp, Homo sapiens
tattctctgagctgtgca

SEQ ID NO: 1795087 - DNA, 19 bp, Homo sapiens
tattctctgagctgtgcag

SEQ ID NO: 1795088 - DNA, 19 bp, Homo sapiens
tattgcttgttggattttt

SEQ ID NO: 1795089 - DNA, 14 bp, Homo sapiens
tattggaattttct

SEQ ID NO: 1795090 - DNA, 15 bp, Homo sapiens
tattggaattttctt

SEQ ID NO: 1795091 - DNA, 18 bp, Homo sapiens
cacatctgtgtcttgttt

SEQ ID NO: 1795092 - DNA, 23 bp, Homo sapiens
cacatctgtgtcttgtttggaat

SEQ ID NO: 1795093 - DNA, 22 bp, Homo sapiens
cacattctgctatgaattattt

SEQ ID NO: 1795094 - DNA, 18 bp, Homo sapiens
cacatttttcagatataa

SEQ ID NO: 1795095 - DNA, 13 bp, Homo sapiens
caccccaccaggg

SEQ ID NO: 1795096 - DNA, 17 bp, Homo sapiens
cacccttttccagctgg

SEQ ID NO: 1795097 - DNA, 21 bp, Homo sapiens
caccggggcctgggcaggagg

SEQ ID NO: 1795098 - DNA, 18 bp, Homo sapiens
caccgtgggctccctgac

SEQ ID NO: 1795099 - DNA, 17 bp, Homo sapiens
cacctacagtgtacagt

SEQ ID NO: 1795100 - DNA, 18 bp, Homo sapiens
cacctaggctagggtggg

SEQ ID NO: 1795101 - DNA, 18 bp, Homo sapiens
cacggagccactcctctg

SEQ ID NO: 1795102 - DNA, 21 bp, Homo sapiens
cacggagccactcctctgact

SEQ ID NO: 1795103 - DNA, 21 bp, Homo sapiens
gaaggatcccatgagctcctt

SEQ ID NO: 1795104 - DNA, 16 bp, Homo sapiens
gaaggcttctctctgt

SEQ ID NO: 1795105 - DNA, 18 bp, Homo sapiens
gaagtttaattgacttat

SEQ ID NO: 1795106 - DNA, 19 bp, Homo sapiens
gaattcttggttgaggaaa

SEQ ID NO: 1795107 - DNA, 13 bp, Homo sapiens
gaattttctttca

SEQ ID NO: 1795108 - DNA, 21 bp, Homo sapiens
gaattttctttcatacattat

SEQ ID NO: 1795109 - DNA, 22 bp, Homo sapiens
gaattttctttcatacattata

SEQ ID NO: 1795110 - DNA, 15 bp, Homo sapiens
gacacctaggctagg

SEQ ID NO: 1795111 - DNA, 17 bp, Homo sapiens
gacagaaaagaaagctg

SEQ ID NO: 1795112 - DNA, 16 bp, Homo sapiens
gacatttctctaagag

SEQ ID NO: 1795113 - DNA, 17 bp, Homo sapiens
gaccaatattgtacagt

SEQ ID NO: 1795114 - DNA, 14 bp, Homo sapiens
gaccagcctctcca

SEQ ID NO: 1795115 - DNA, 17 bp, Homo sapiens
gaccagtcaacctgggc

SEQ ID NO: 1795116 - DNA, 16 bp, Homo sapiens
gacccagccctcatcc

SEQ ID NO: 1795117 - DNA, 16 bp, Homo sapiens
gaccctaaatcttgac

SEQ ID NO: 1795118 - DNA, 19 bp, Homo sapiens
gaccctgagtccgggaggc

SEQ ID NO: 1795119 - DNA, 20 bp, Homo sapiens
gaccctgagtccgggaggca

SEQ ID NO: 1795120 - DNA, 12 bp, Homo sapiens
gacgcctggggg

SEQ ID NO: 1795121 - DNA, 13 bp, Homo sapiens
gactcagggctcc

SEQ ID NO: 1795122 - DNA, 19 bp, Homo sapiens
gactcagggctcctgggtt

SEQ ID NO: 1795123 - DNA, 14 bp, Homo sapiens
gactctcagtctct

SEQ ID NO: 1795124 - DNA, 14 bp, Homo sapiens
gactgggctgaggg

SEQ ID NO: 1795125 - DNA, 22 bp, Homo sapiens
gactggtgttatcaccgtgggc

SEQ ID NO: 1795126 - DNA, 11 bp, Homo sapiens
gagaaactgag

SEQ ID NO: 1795127 - DNA, 15 bp, Homo sapiens
gagactgcccagcta

SEQ ID NO: 1795128 - DNA, 18 bp, Homo sapiens
gagatcccaacactgcca

SEQ ID NO: 1795129 - DNA, 19 bp, Homo sapiens
gagatcccaacactgccag

SEQ ID NO: 1795130 - DNA, 18 bp, Homo sapiens
gagcaggggtctgagcca

SEQ ID NO: 1795131 - DNA, 21 bp, Homo sapiens
gagcagtgaatgattcagtgt

SEQ ID NO: 1795132 - DNA, 17 bp, Homo sapiens
gagccgtggtcctttgg

SEQ ID NO: 1795133 - DNA, 15 bp, Homo sapiens
gagcctgagggatct

SEQ ID NO: 1795134 - DNA, 18 bp, Homo sapiens
gagcgaggagatgctcct

SEQ ID NO: 1795135 - DNA, 20 bp, Homo sapiens
gagctccttaaggctctttt

SEQ ID NO: 1795136 - DNA, 18 bp, Homo sapiens
gagctgtgcaggtgggga

SEQ ID NO: 1795137 - DNA, 17 bp, Homo sapiens
gagctgtttactaggga

SEQ ID NO: 1795138 - DNA, 14 bp, Homo sapiens
gaggagggcaggca

SEQ ID NO: 1795139 - DNA, 17 bp, Homo sapiens
gaggccctcgctgccag

SEQ ID NO: 1795140 - DNA, 21 bp, Homo sapiens
gaggcgaagcgttgtcctcag

SEQ ID NO: 1795141 - DNA, 23 bp, Homo sapiens
gagggacgcctgggggtgccagg

SEQ ID NO: 1795142 - DNA, 16 bp, Homo sapiens
gagggcagcagggcta

SEQ ID NO: 1795143 - DNA, 19 bp, Homo sapiens
gagggcagcagggctaccc

SEQ ID NO: 1795144 - DNA, 16 bp, Homo sapiens
gagtccatcagcctcc

SEQ ID NO: 1795145 - DNA, 22 bp, Homo sapiens
gagtgcagtcctgatcagagcc

SEQ ID NO: 1795146 - DNA, 19 bp, Homo sapiens
gagtgtctttccacggagc

SEQ ID NO: 1795147 - DNA, 15 bp, Homo sapiens
gagtgtgactttttg

SEQ ID NO: 1795148 - DNA, 15 bp, Homo sapiens
gataccagcgaggag

SEQ ID NO: 1795149 - DNA, 18 bp, Homo sapiens
gatataaaagactgacca

SEQ ID NO: 1795150 - DNA, 16 bp, Homo sapiens
gatcagagccgtggtc

SEQ ID NO: 1795151 - DNA, 23 bp, Homo sapiens
gatcagagccgtggtcctttggg

SEQ ID NO: 1795152 - DNA, 15 bp, Homo sapiens
gatcccatgagctcc

SEQ ID NO: 1795153 - DNA, 12 bp, Homo sapiens
gatccctcatct

SEQ ID NO: 1795154 - DNA, 18 bp, Homo sapiens
gatccctcatctgtccct

SEQ ID NO: 1795155 - DNA, 23 bp, Homo sapiens
gatccctctacagagcttccctg

SEQ ID NO: 1795156 - DNA, 16 bp, Homo sapiens
gatgctccttgggccc

SEQ ID NO: 1795157 - DNA, 14 bp, Homo sapiens
gatggtggagggcc

SEQ ID NO: 1795158 - DNA, 15 bp, Homo sapiens
gatggtggagggcca

SEQ ID NO: 1795159 - DNA, 19 bp, Homo sapiens
gatgttctaagtctttcca

SEQ ID NO: 1795160 - DNA, 20 bp, Homo sapiens
gattacctcctgtgtggaag

SEQ ID NO: 1795161 - DNA, 16 bp, Homo sapiens
gattgagtctgtgcca

SEQ ID NO: 1795162 - DNA, 16 bp, Homo sapiens
gattgcgagaattttc

SEQ ID NO: 1795163 - DNA, 16 bp, Homo sapiens
gattttgctgtagaag

SEQ ID NO: 1795164 - DNA, 21 bp, Homo sapiens
gatttttgctcttctgtatgt

SEQ ID NO: 1795165 - DNA, 15 bp, Homo sapiens
gatttttgtcttgtg

SEQ ID NO: 1795166 - DNA, 19 bp, Homo sapiens
gcaatgccatcatctcctg

SEQ ID NO: 1795167 - DNA, 19 bp, Homo sapiens
gcacagcctggctgtggcc

SEQ ID NO: 1795168 - DNA, 18 bp, Homo sapiens
gcacatctgtgtcttgtt

SEQ ID NO: 1795169 - DNA, 18 bp, Homo sapiens
gcacctacagtgtacagt

SEQ ID NO: 1795170 - DNA, 21 bp, Homo sapiens
gcactgagataccagcgagga

SEQ ID NO: 1795171 - DNA, 16 bp, Homo sapiens
gcactgcttgaggaaa

SEQ ID NO: 1795172 - DNA, 20 bp, Homo sapiens
gcactgttccccctgtgcag

SEQ ID NO: 1795173 - DNA, 21 bp, Homo sapiens
gcacttttaacaaaaaaggaa

SEQ ID NO: 1795174 - DNA, 16 bp, Homo sapiens
gcagagcccaagggaa

SEQ ID NO: 1795175 - DNA, 20 bp, Homo sapiens
gcagcagtgtgaggccaggg

SEQ ID NO: 1795176 - DNA, 22 bp, Homo sapiens
gcaggcatcggggagccgggag

SEQ ID NO: 1795177 - DNA, 23 bp, Homo sapiens
gcaggcatcggggagccgggagc

SEQ ID NO: 1795178 - DNA, 21 bp, Homo sapiens
gcagggctaccctgagctgag

SEQ ID NO: 1795179 - DNA, 19 bp, Homo sapiens
gcaggggccgggggcagtc

SEQ ID NO: 1795180 - DNA, 14 bp, Homo sapiens
gcaggggtctgagc

SEQ ID NO: 1795181 - DNA, 21 bp, Homo sapiens
gcaggtggggagactgggctg

SEQ ID NO: 1795182 - DNA, 19 bp, Homo sapiens
gcagtcctgatcagagccg

SEQ ID NO: 1795183 - DNA, 20 bp, Homo sapiens
gcagtgaatgattcagtgtt

SEQ ID NO: 1795184 - DNA, 15 bp, Homo sapiens
gcagtgtgaggccag

SEQ ID NO: 1795185 - DNA, 19 bp, Homo sapiens
gcagtgtgaggccagggca

SEQ ID NO: 1795186 - DNA, 21 bp, Homo sapiens
gcagtgtgaggccagggcaga

SEQ ID NO: 1795187 - DNA, 16 bp, Homo sapiens
gcataacaattcctct

SEQ ID NO: 1795188 - DNA, 17 bp, Homo sapiens
gcatcggggagccggga

SEQ ID NO: 1795189 - DNA, 21 bp, Homo sapiens
gcatctcccagataatgtgaa

SEQ ID NO: 1795190 - DNA, 16 bp, Homo sapiens
gcattgccaagggctt

SEQ ID NO: 1795191 - DNA, 13 bp, Homo sapiens
gccactcctctga

SEQ ID NO: 1795192 - DNA, 18 bp, Homo sapiens
gccacttaaaatgttcac

SEQ ID NO: 1795193 - DNA, 13 bp, Homo sapiens
gccagcgtcctcc

SEQ ID NO: 1795194 - DNA, 13 bp, Homo sapiens
gccagctctgtat

SEQ ID NO: 1795195 - DNA, 15 bp, Homo sapiens
gccagctctgtatca

SEQ ID NO: 1795196 - DNA, 22 bp, Homo sapiens
gccaggaccagtcaacctgggc

SEQ ID NO: 1795197 - DNA, 14 bp, Homo sapiens
gccagggcagggcc

SEQ ID NO: 1795198 - DNA, 13 bp, Homo sapiens
gcccagctctgaa

SEQ ID NO: 1795199 - DNA, 20 bp, Homo sapiens
gcccaggctggagtgcagtg

SEQ ID NO: 1795200 - DNA, 12 bp, Homo sapiens
gccccattcctg

SEQ ID NO: 1795201 - DNA, 12 bp, Homo sapiens
gccctcatcccg

SEQ ID NO: 1795202 - DNA, 14 bp, Homo sapiens
gccctcgctgccag

SEQ ID NO: 1795203 - DNA, 16 bp, Homo sapiens
gccctctctgctctgc

SEQ ID NO: 1795204 - DNA, 18 bp, Homo sapiens
gccctgcaaaaggactct

SEQ ID NO: 1795205 - DNA, 21 bp, Homo sapiens
gccctgcaaaaggactctcag

SEQ ID NO: 1795206 - DNA, 14 bp, Homo sapiens
gccctgcggagacc

SEQ ID NO: 1795207 - DNA, 19 bp, Homo sapiens
gccgcgtggaatgtgagtg

SEQ ID NO: 1795208 - DNA, 17 bp, Homo sapiens
ggtgctgcctctacctg

SEQ ID NO: 1795209 - DNA, 17 bp, Homo sapiens
ggtgtaaagttgttcgc

SEQ ID NO: 1795210 - DNA, 15 bp, Homo sapiens
ctgaggcagcagtgt

SEQ ID NO: 1795211 - DNA, 17 bp, Homo sapiens
ctgaggcagcagtgtga

SEQ ID NO: 1795212 - DNA, 24 bp, Homo sapiens
ctgaggcagcagtgtgaggccagg

SEQ ID NO: 1795213 - DNA, 13 bp, Homo sapiens
ctgagggagcctg

SEQ ID NO: 1795214 - DNA, 16 bp, Homo sapiens
ctgagggcagtcgata

SEQ ID NO: 1795215 - DNA, 19 bp, Homo sapiens
ctgataaaaccatgtagaa

SEQ ID NO: 1795216 - DNA, 12 bp, Homo sapiens
ctgatccctcta

SEQ ID NO: 1795217 - DNA, 13 bp, Homo sapiens
ctgatccctctac

SEQ ID NO: 1795218 - DNA, 17 bp, Homo sapiens
ctgcaaaaggactctca

SEQ ID NO: 1795219 - DNA, 16 bp, Homo sapiens
ctgcaccggggcctgg

SEQ ID NO: 1795220 - DNA, 11 bp, Homo sapiens
ctgccagggca

SEQ ID NO: 1795221 - DNA, 13 bp, Homo sapiens
ctgccagggcagg

SEQ ID NO: 1795222 - DNA, 16 bp, Homo sapiens
ctgccagggcagggcc

SEQ ID NO: 1795223 - DNA, 19 bp, Homo sapiens
ctgcccgggagctcaggaa

SEQ ID NO: 1795224 - DNA, 20 bp, Homo sapiens
ctgcctgacatttggagtgt

SEQ ID NO: 1795225 - DNA, 18 bp, Homo sapiens
ctgccttcctcctgggcc

SEQ ID NO: 1795226 - DNA, 18 bp, Homo sapiens
ctgcggagaccctgagtc

SEQ ID NO: 1795227 - DNA, 19 bp, Homo sapiens
ctgcgtgtcacctgtgctt

SEQ ID NO: 1795228 - DNA, 23 bp, Homo sapiens
ctggacatgaagattctttccca

SEQ ID NO: 1795229 - DNA, 20 bp, Homo sapiens
ctggactctcagtctctgag

SEQ ID NO: 1795230 - DNA, 15 bp, Homo sapiens
ctggcacagcctggc

SEQ ID NO: 1795231 - DNA, 19 bp, Homo sapiens
ctgggaggagggcaggcat

SEQ ID NO: 1795232 - DNA, 11 bp, Homo sapiens
ctgggagggca

SEQ ID NO: 1795233 - DNA, 13 bp, Homo sapiens
ctgggagggcagc

SEQ ID NO: 1795234 - DNA, 17 bp, Homo sapiens
ctgggagggcagcaggg

SEQ ID NO: 1795235 - DNA, 13 bp, Homo sapiens
ctgggccctctct

SEQ ID NO: 1795236 - DNA, 23 bp, Homo sapiens
ctgggctgagggagcctggcccc

SEQ ID NO: 1795237 - DNA, 15 bp, Homo sapiens
ctgggggtgccagga

SEQ ID NO: 1795238 - DNA, 19 bp, Homo sapiens
ctgggggtgccaggaccag

SEQ ID NO: 1795239 - DNA, 20 bp, Homo sapiens
ctgggttttgtattctctga

SEQ ID NO: 1795240 - DNA, 14 bp, Homo sapiens
ctggtgctgcctct

SEQ ID NO: 1795241 - DNA, 14 bp, Homo sapiens
ctggtggtggctcg

SEQ ID NO: 1795242 - DNA, 14 bp, Homo sapiens
ctggtttttcagtt

SEQ ID NO: 1795243 - DNA, 16 bp, Homo sapiens
ctggtttttcagtttt

SEQ ID NO: 1795244 - DNA, 15 bp, Homo sapiens
ctgtaacctcttcag

SEQ ID NO: 1795245 - DNA, 22 bp, Homo sapiens
ctgtatcaggacccagaggaag

SEQ ID NO: 1795246 - DNA, 19 bp, Homo sapiens
ctgtatgtgacaacatttt

SEQ ID NO: 1795247 - DNA, 16 bp, Homo sapiens
ctgtccaggcactgag

SEQ ID NO: 1795248 - DNA, 17 bp, Homo sapiens
ctgtccctccgggacct

SEQ ID NO: 1795249 - DNA, 17 bp, Homo sapiens
ctgtctcatccatcatc

SEQ ID NO: 1795250 - DNA, 20 bp, Homo sapiens
ctgtctcatccatcatcatg

SEQ ID NO: 1795251 - DNA, 19 bp, Homo sapiens
ctgtgcttcgggcccttcc

SEQ ID NO: 1795252 - DNA, 18 bp, Homo sapiens
ctgtggccaagttcttag

SEQ ID NO: 1795253 - DNA, 14 bp, Homo sapiens
ctgtgggatgggat

SEQ ID NO: 1795254 - DNA, 17 bp, Homo sapiens
ctgttccccctgtgcag

SEQ ID NO: 1795255 - DNA, 18 bp, Homo sapiens
ctgttcttaagacgtgat

SEQ ID NO: 1795256 - DNA, 18 bp, Homo sapiens
ctgtttagaactactgat

SEQ ID NO: 1795257 - DNA, 13 bp, Homo sapiens
cttaaacaaaaat

SEQ ID NO: 1795258 - DNA, 15 bp, Homo sapiens
cttaaggctcttttg

SEQ ID NO: 1795259 - DNA, 23 bp, Homo sapiens
cttacagtaggagcccagctctg

SEQ ID NO: 1795260 - DNA, 19 bp, Homo sapiens
cttacatctttgtttacca

SEQ ID NO: 1795261 - DNA, 23 bp, Homo sapiens
cttacgaatacttttgccctttg

SEQ ID NO: 1795262 - DNA, 14 bp, Homo sapiens
cttagatgttctaa

SEQ ID NO: 1795263 - DNA, 18 bp, Homo sapiens
cttagatgttctaagtct

SEQ ID NO: 1795264 - DNA, 20 bp, Homo sapiens
cttattagagtgtctttcca

SEQ ID NO: 1795265 - DNA, 16 bp, Homo sapiens
cttcaaatatagagat

SEQ ID NO: 1795266 - DNA, 19 bp, Homo sapiens
cttccaaacaggctcagag

SEQ ID NO: 1795267 - DNA, 16 bp, Homo sapiens
cttccaaatcccctaa

SEQ ID NO: 1795268 - DNA, 15 bp, Homo sapiens
cttccactgagggca

SEQ ID NO: 1795269 - DNA, 13 bp, Homo sapiens
cttccctgactca

SEQ ID NO: 1795270 - DNA, 14 bp, Homo sapiens
cttccctgactcat

SEQ ID NO: 1795271 - DNA, 12 bp, Homo sapiens
cttcctcctggg

SEQ ID NO: 1795272 - DNA, 15 bp, Homo sapiens
cttcctcctgggccc

SEQ ID NO: 1795273 - DNA, 19 bp, Homo sapiens
cttcctctcctgtctccct

SEQ ID NO: 1795274 - DNA, 16 bp, Homo sapiens
cttctagttctgccag

SEQ ID NO: 1795275 - DNA, 18 bp, Homo sapiens
cttctagttctgccagga

SEQ ID NO: 1795276 - DNA, 16 bp, Homo sapiens
cttctccatccacatg

SEQ ID NO: 1795277 - DNA, 13 bp, Homo sapiens
cttctctctgtgg

SEQ ID NO: 1795278 - DNA, 22 bp, Homo sapiens
cttctgggagggcagcagggct

SEQ ID NO: 1795279 - DNA, 13 bp, Homo sapiens
cttcttcaccatt

SEQ ID NO: 1795280 - DNA, 16 bp, Homo sapiens
cttgaactttccaaaa

SEQ ID NO: 1795281 - DNA, 21 bp, Homo sapiens
cttgccttattagagtgtctt

SEQ ID NO: 1795282 - DNA, 18 bp, Homo sapiens
cttggatgtacctgcccc

SEQ ID NO: 1795283 - DNA, 17 bp, Homo sapiens
cttgggccctttgagtg

SEQ ID NO: 1795284 - DNA, 13 bp, Homo sapiens
cttggttccccca

SEQ ID NO: 1795285 - DNA, 14 bp, Homo sapiens
cttggttgaggaaa

SEQ ID NO: 1795286 - DNA, 16 bp, Homo sapiens
cttggttgaggaaaca

SEQ ID NO: 1795287 - DNA, 22 bp, Homo sapiens
cttgtattaagttgttaataaa

SEQ ID NO: 1795288 - DNA, 13 bp, Homo sapiens
cttgtcacgccag

SEQ ID NO: 1795289 - DNA, 16 bp, Homo sapiens
cttgtcacgccagact

SEQ ID NO: 1795290 - DNA, 23 bp, Homo sapiens
cttgtcacgccagacttcccacg

SEQ ID NO: 1795291 - DNA, 14 bp, Homo sapiens
ctttcatacattat

SEQ ID NO: 1795292 - DNA, 15 bp, Homo sapiens
ctttcatacattata

SEQ ID NO: 1795293 - DNA, 17 bp, Homo sapiens
ctttcatgtaaactgtg

SEQ ID NO: 1795294 - DNA, 22 bp, Homo sapiens
ctttccaaaacctaaagaggaa

SEQ ID NO: 1795295 - DNA, 17 bp, Homo sapiens
ctttcccaacacctctt

SEQ ID NO: 1795296 - DNA, 13 bp, Homo sapiens
ctttcttccaaac

SEQ ID NO: 1795297 - DNA, 22 bp, Homo sapiens
ctttcttccaaacaggctcaga

SEQ ID NO: 1795298 - DNA, 14 bp, Homo sapiens
ctttgtggcactgg

SEQ ID NO: 1795299 - DNA, 18 bp, Homo sapiens
gaaaacaaaaatatcttg

SEQ ID NO: 1795300 - DNA, 12 bp, Homo sapiens
gaaaacaaggaa

SEQ ID NO: 1795301 - DNA, 21 bp, Homo sapiens
gaaaacactgtgcacatctgt

SEQ ID NO: 1795302 - DNA, 19 bp, Homo sapiens
gaaaacctcatttaccata

SEQ ID NO: 1795303 - DNA, 17 bp, Homo sapiens
gaaaagaaagctgcttt

SEQ ID NO: 1795304 - DNA, 18 bp, Homo sapiens
gaaaagggaactgaacat

SEQ ID NO: 1795305 - DNA, 18 bp, Homo sapiens
gaaaatggtccaggagaa

SEQ ID NO: 1795306 - DNA, 14 bp, Homo sapiens
gaaaatgtcttgtg

SEQ ID NO: 1795307 - DNA, 15 bp, Homo sapiens
gaaaattatttgcat

SEQ ID NO: 1795308 - DNA, 12 bp, Homo sapiens
gaaagctgcttt

SEQ ID NO: 1795309 - DNA, 21 bp, Homo sapiens
gaaagctgctttcgaataaag

SEQ ID NO: 1795310 - DNA, 16 bp, Homo sapiens
gaaatagagtgaatta

SEQ ID NO: 1795311 - DNA, 15 bp, Homo sapiens
gaaatattccctaga

SEQ ID NO: 1795312 - DNA, 23 bp, Homo sapiens
gaaatgctggtttttcagttttc

SEQ ID NO: 1795313 - DNA, 13 bp, Homo sapiens
gaacaatgaatgc

SEQ ID NO: 1795314 - DNA, 15 bp, Homo sapiens
gaacgtttttcctgt

SEQ ID NO: 1795315 - DNA, 17 bp, Homo sapiens
gaagaggggtcttttat

SEQ ID NO: 1795316 - DNA, 21 bp, Homo sapiens
gaaggagccccattcctggga

SEQ ID NO: 1795317 - DNA, 19 bp, Homo sapiens
agaagatggcacttataac

SEQ ID NO: 1795318 - DNA, 17 bp, Homo sapiens
agacccagccctcatcc

SEQ ID NO: 1795319 - DNA, 14 bp, Homo sapiens
agacgggccctggt

SEQ ID NO: 1795320 - DNA, 17 bp, Homo sapiens
agacgtgaatgtctcag

SEQ ID NO: 1795321 - DNA, 17 bp, Homo sapiens
agacgtgattttgctgt

SEQ ID NO: 1795322 - DNA, 22 bp, Homo sapiens
agactgaccaatattgtacagt

SEQ ID NO: 1795323 - DNA, 12 bp, Homo sapiens
agactgggctga

SEQ ID NO: 1795324 - DNA, 14 bp, Homo sapiens
agactgggctgagg

SEQ ID NO: 1795325 - DNA, 22 bp, Homo sapiens
agagaggccattctttcccaac

SEQ ID NO: 1795326 - DNA, 19 bp, Homo sapiens
agagattacctcctgagaa

SEQ ID NO: 1795327 - DNA, 20 bp, Homo sapiens
agagattacctcctgagaaa

SEQ ID NO: 1795328 - DNA, 15 bp, Homo sapiens
agagccaccaagagg

SEQ ID NO: 1795329 - DNA, 19 bp, Homo sapiens
agagccaccaagagggacg

SEQ ID NO: 1795330 - DNA, 13 bp, Homo sapiens
agagcctgaggga

SEQ ID NO: 1795331 - DNA, 19 bp, Homo sapiens
agagctgtattaagccact

SEQ ID NO: 1795332 - DNA, 13 bp, Homo sapiens
agagcttccctga

SEQ ID NO: 1795333 - DNA, 20 bp, Homo sapiens
agagcttccctgactcattc

SEQ ID NO: 1795334 - DNA, 14 bp, Homo sapiens
agaggagaaactga

SEQ ID NO: 1795335 - DNA, 22 bp, Homo sapiens
agaggctcgttgactggctgtg

SEQ ID NO: 1795336 - DNA, 16 bp, Homo sapiens
agagggcactctgctt

SEQ ID NO: 1795337 - DNA, 21 bp, Homo sapiens
agaggtaactatcaatattta

SEQ ID NO: 1795338 - DNA, 23 bp, Homo sapiens
agagtccatcagcctccatccta

SEQ ID NO: 1795339 - DNA, 15 bp, Homo sapiens
agagtgtctttccac

SEQ ID NO: 1795340 - DNA, 19 bp, Homo sapiens
agagttggtgttcataatt

SEQ ID NO: 1795341 - DNA, 13 bp, Homo sapiens
agataatgtgaaa

SEQ ID NO: 1795342 - DNA, 18 bp, Homo sapiens
agataatgtgaaaatggt

SEQ ID NO: 1795343 - DNA, 20 bp, Homo sapiens
agatacagaactctttcaaa

SEQ ID NO: 1795344 - DNA, 21 bp, Homo sapiens
agataccagcgaggaggctcc

SEQ ID NO: 1795345 - DNA, 15 bp, Homo sapiens
agatataaaagactg

SEQ ID NO: 1795346 - DNA, 12 bp, Homo sapiens
agatatttttgt

SEQ ID NO: 1795347 - DNA, 18 bp, Homo sapiens
agatcccaacactgccag

SEQ ID NO: 1795348 - DNA, 15 bp, Homo sapiens
agatgctccttgggc

SEQ ID NO: 1795349 - DNA, 17 bp, Homo sapiens
agatgttctaagtcttt

SEQ ID NO: 1795350 - DNA, 15 bp, Homo sapiens
agcaattatattgtc

SEQ ID NO: 1795351 - DNA, 15 bp, Homo sapiens
agcacctacagtgta

SEQ ID NO: 1795352 - DNA, 22 bp, Homo sapiens
agcacctacagtgtacagtctt

SEQ ID NO: 1795353 - DNA, 21 bp, Homo sapiens
agcacttgtgggtttttgttt

SEQ ID NO: 1795354 - DNA, 15 bp, Homo sapiens
agcaggggtctgagc

SEQ ID NO: 1795355 - DNA, 21 bp, Homo sapiens
agcagtgaatgattcagtgtt

SEQ ID NO: 1795356 - DNA, 22 bp, Homo sapiens
agcagtgaatgattcagtgtta

SEQ ID NO: 1795357 - DNA, 15 bp, Homo sapiens
agccacagccgtgct

SEQ ID NO: 1795358 - DNA, 13 bp, Homo sapiens
agccactcctctg

SEQ ID NO: 1795359 - DNA, 21 bp, Homo sapiens
agccactcctctgactcaggg

SEQ ID NO: 1795360 - DNA, 22 bp, Homo sapiens
agccactcctctgactcagggc

SEQ ID NO: 1795361 - DNA, 23 bp, Homo sapiens
agccagcgtcctcctctgtgacc

SEQ ID NO: 1795362 - DNA, 16 bp, Homo sapiens
agccctagggtggaga

SEQ ID NO: 1795363 - DNA, 20 bp, Homo sapiens
agccctagggtggagagcca

SEQ ID NO: 1795364 - DNA, 16 bp, Homo sapiens
agccctcatcccgagc

SEQ ID NO: 1795365 - DNA, 23 bp, Homo sapiens
agcctcactattacttgaacttt

SEQ ID NO: 1795366 - DNA, 15 bp, Homo sapiens
agcctcccctgccag

SEQ ID NO: 1795367 - DNA, 20 bp, Homo sapiens
agcctcccctgccagggcag

SEQ ID NO: 1795368 - DNA, 16 bp, Homo sapiens
agcctggccccatggt

SEQ ID NO: 1795369 - DNA, 12 bp, Homo sapiens
agccttgctcag

SEQ ID NO: 1795370 - DNA, 16 bp, Homo sapiens
agccttgctcaggtgc

SEQ ID NO: 1795371 - DNA, 20 bp, Homo sapiens
agcgaggagatgctccttgg

SEQ ID NO: 1795372 - DNA, 15 bp, Homo sapiens
agcgtcctcctctgt

SEQ ID NO: 1795373 - DNA, 16 bp, Homo sapiens
agcgtcctcctctgtg

SEQ ID NO: 1795374 - DNA, 18 bp, Homo sapiens
agctccttaaggctcttt

SEQ ID NO: 1795375 - DNA, 13 bp, Homo sapiens
agctccttcctgg

SEQ ID NO: 1795376 - DNA, 18 bp, Homo sapiens
agctctgaaaccagtgtt

SEQ ID NO: 1795377 - DNA, 19 bp, Homo sapiens
agctctgaaaccagtgtta

SEQ ID NO: 1795378 - DNA, 12 bp, Homo sapiens
agctctgtatca

SEQ ID NO: 1795379 - DNA, 16 bp, Homo sapiens
agctgaacaatgaatg

SEQ ID NO: 1795380 - DNA, 15 bp, Homo sapiens
agctgaggcagcagt

SEQ ID NO: 1795381 - DNA, 16 bp, Homo sapiens
agctgaggcagcagtg

SEQ ID NO: 1795382 - DNA, 14 bp, Homo sapiens
agctgctccccacg

SEQ ID NO: 1795383 - DNA, 17 bp, Homo sapiens
agctgctccccacgtca

SEQ ID NO: 1795384 - DNA, 14 bp, Homo sapiens
agctggatgagaat

SEQ ID NO: 1795385 - DNA, 12 bp, Homo sapiens
agctgtgcaggt

SEQ ID NO: 1795386 - DNA, 18 bp, Homo sapiens
agctgtgcaggtggggag

SEQ ID NO: 1795387 - DNA, 16 bp, Homo sapiens
agctgtttactaggga

SEQ ID NO: 1795388 - DNA, 19 bp, Homo sapiens
agcttcatggcagaaggca

SEQ ID NO: 1795389 - DNA, 18 bp, Homo sapiens
aggaaggggccagaggct

SEQ ID NO: 1795390 - DNA, 14 bp, Homo sapiens
aggaagtaggaagt

SEQ ID NO: 1795391 - DNA, 14 bp, Homo sapiens
aggacatttctcta

SEQ ID NO: 1795392 - DNA, 15 bp, Homo sapiens
aggacccagaggaag

SEQ ID NO: 1795393 - DNA, 20 bp, Homo sapiens
aggagacaggttagctgctc

SEQ ID NO: 1795394 - DNA, 18 bp, Homo sapiens
aggagatgctccttgggc

SEQ ID NO: 1795395 - DNA, 16 bp, Homo sapiens
aggagccccattcctg

SEQ ID NO: 1795396 - DNA, 19 bp, Homo sapiens
aggaggctccagagggcac

SEQ ID NO: 1795397 - DNA, 15 bp, Homo sapiens
aggagggaggtgctt

SEQ ID NO: 1795398 - DNA, 13 bp, Homo sapiens
aggagggcaggca

SEQ ID NO: 1795399 - DNA, 15 bp, Homo sapiens
aggataaattacatt

SEQ ID NO: 1795400 - DNA, 19 bp, Homo sapiens
aggatcccatgagctcctt

SEQ ID NO: 1795401 - DNA, 19 bp, Homo sapiens
aggcagcagtgtgaggcca

SEQ ID NO: 1795402 - DNA, 19 bp, Homo sapiens
aggcatcggggagccggga

SEQ ID NO: 1795403 - DNA, 15 bp, Homo sapiens
atcctcaatccagct

SEQ ID NO: 1795404 - DNA, 12 bp, Homo sapiens
atcgcctttccc

SEQ ID NO: 1795405 - DNA, 16 bp, Homo sapiens
atcggggagccgggag

SEQ ID NO: 1795406 - DNA, 16 bp, Homo sapiens
atctcctgccttcctc

SEQ ID NO: 1795407 - DNA, 17 bp, Homo sapiens
atctcctgccttcctcc

SEQ ID NO: 1795408 - DNA, 16 bp, Homo sapiens
atgaaaatgtcttgtg

SEQ ID NO: 1795409 - DNA, 21 bp, Homo sapiens
atgagaatttgagtgctctga

SEQ ID NO: 1795410 - DNA, 22 bp, Homo sapiens
atgcactgttccccctgtgcag

SEQ ID NO: 1795411 - DNA, 15 bp, Homo sapiens
atgccatcatctcct

SEQ ID NO: 1795412 - DNA, 16 bp, Homo sapiens
atgctccttgggccct

SEQ ID NO: 1795413 - DNA, 13 bp, Homo sapiens
atgctggtttttc

SEQ ID NO: 1795414 - DNA, 15 bp, Homo sapiens
atggcagaaggcaaa

SEQ ID NO: 1795415 - DNA, 21 bp, Homo sapiens
atggcagaaggcaaacccatc

SEQ ID NO: 1795416 - DNA, 14 bp, Homo sapiens
atgtagaaaatttg

SEQ ID NO: 1795417 - DNA, 17 bp, Homo sapiens
atgtcagtaccttcaaa

SEQ ID NO: 1795418 - DNA, 16 bp, Homo sapiens
atgtctcgtggtagga

SEQ ID NO: 1795419 - DNA, 23 bp, Homo sapiens
atgtgacaacatttttgtacatt

SEQ ID NO: 1795420 - DNA, 16 bp, Homo sapiens
atgtgactctttccaa

SEQ ID NO: 1795421 - DNA, 19 bp, Homo sapiens
atgtgatgaatactgtatt

SEQ ID NO: 1795422 - DNA, 20 bp, Homo sapiens
atgtgtgggtgtgtgttaca

SEQ ID NO: 1795423 - DNA, 21 bp, Homo sapiens
atgttaaacttacttagtgtt

SEQ ID NO: 1795424 - DNA, 12 bp, Homo sapiens
atgttattggaa

SEQ ID NO: 1795425 - DNA, 15 bp, Homo sapiens
atgttattggaattt

SEQ ID NO: 1795426 - DNA, 14 bp, Homo sapiens
atgttcacttttga

SEQ ID NO: 1795427 - DNA, 22 bp, Homo sapiens
atgttcacttttgacaaaggca

SEQ ID NO: 1795428 - DNA, 18 bp, Homo sapiens
atgttctaagtctttcca

SEQ ID NO: 1795429 - DNA, 19 bp, Homo sapiens
atgtttttgttcaaagcca

SEQ ID NO: 1795430 - DNA, 20 bp, Homo sapiens
attaagccacttaaaatgtt

SEQ ID NO: 1795431 - DNA, 14 bp, Homo sapiens
attaagttgttaat

SEQ ID NO: 1795432 - DNA, 13 bp, Homo sapiens
attacattaaaat

SEQ ID NO: 1795433 - DNA, 12 bp, Homo sapiens
attacctcctga

SEQ ID NO: 1795434 - DNA, 19 bp, Homo sapiens
attacctcctgtgtggaag

SEQ ID NO: 1795435 - DNA, 14 bp, Homo sapiens
attacttgaacttt

SEQ ID NO: 1795436 - DNA, 16 bp, Homo sapiens
attagagtgtctttcc

SEQ ID NO: 1795437 - DNA, 13 bp, Homo sapiens
attagtaacatgt

SEQ ID NO: 1795438 - DNA, 23 bp, Homo sapiens
attatattcctctaaaactctca

SEQ ID NO: 1795439 - DNA, 17 bp, Homo sapiens
attatccaggtaatcca

SEQ ID NO: 1795440 - DNA, 14 bp, Homo sapiens
attatgttattgga

SEQ ID NO: 1795441 - DNA, 15 bp, Homo sapiens
attatgttattggaa

SEQ ID NO: 1795442 - DNA, 21 bp, Homo sapiens
attatgttattggaattttct

SEQ ID NO: 1795443 - DNA, 21 bp, Homo sapiens
attccactgaaatagagtgaa

SEQ ID NO: 1795444 - DNA, 19 bp, Homo sapiens
attccagagcgtgtagtga

SEQ ID NO: 1795445 - DNA, 15 bp, Homo sapiens
attcctctaaaactc

SEQ ID NO: 1795446 - DNA, 11 bp, Homo sapiens
attctctgagc

SEQ ID NO: 1795447 - DNA, 18 bp, Homo sapiens
attctctgagctgtgcag

SEQ ID NO: 1795448 - DNA, 14 bp, Homo sapiens
attctctgtctcat

SEQ ID NO: 1795449 - DNA, 15 bp, Homo sapiens
attctgaaggagccc

SEQ ID NO: 1795450 - DNA, 15 bp, Homo sapiens
attctgctatgaatt

SEQ ID NO: 1795451 - DNA, 16 bp, Homo sapiens
attctttcccaacacc

SEQ ID NO: 1795452 - DNA, 21 bp, Homo sapiens
attctttcccaattcacatct

SEQ ID NO: 1795453 - DNA, 15 bp, Homo sapiens
attgagttttcagtg

SEQ ID NO: 1795454 - DNA, 22 bp, Homo sapiens
attgcatctcccagataatgtg

SEQ ID NO: 1795455 - DNA, 14 bp, Homo sapiens
attgccaagggctt

SEQ ID NO: 1795456 - DNA, 14 bp, Homo sapiens
attggaattttctt

SEQ ID NO: 1795457 - DNA, 13 bp, Homo sapiens
attgtaactgttc

SEQ ID NO: 1795458 - DNA, 14 bp, Homo sapiens
attgtacagttttt

SEQ ID NO: 1795459 - DNA, 15 bp, Homo sapiens
attgtacagttttta

SEQ ID NO: 1795460 - DNA, 20 bp, Homo sapiens
attgtacttttggcatgaaa

SEQ ID NO: 1795461 - DNA, 23 bp, Homo sapiens
attgtcctcccctattttaagac

SEQ ID NO: 1795462 - DNA, 13 bp, Homo sapiens
attgtttcaattg

SEQ ID NO: 1795463 - DNA, 21 bp, Homo sapiens
atttaaatacagtcttccatt

SEQ ID NO: 1795464 - DNA, 12 bp, Homo sapiens
atttaagtttgt

SEQ ID NO: 1795465 - DNA, 21 bp, Homo sapiens
atttaagtttgttgctgtcaa

SEQ ID NO: 1795466 - DNA, 15 bp, Homo sapiens
atttagtttgattat

SEQ ID NO: 1795467 - DNA, 15 bp, Homo sapiens
atttatataaatttt

SEQ ID NO: 1795468 - DNA, 13 bp, Homo sapiens
atttatttatgta

SEQ ID NO: 1795469 - DNA, 18 bp, Homo sapiens
atttcaaccgcttgccat

SEQ ID NO: 1795470 - DNA, 20 bp, Homo sapiens
atttcccttccttcctctcc

SEQ ID NO: 1795471 - DNA, 15 bp, Homo sapiens
atttctatttctcct

SEQ ID NO: 1795472 - DNA, 20 bp, Homo sapiens
attttaaaagcaattatatt

SEQ ID NO: 1795473 - DNA, 23 bp, Homo sapiens
attttaatgaagaaagtggaaaa

SEQ ID NO: 1795474 - DNA, 18 bp, Homo sapiens
attttagctcatgtatat

SEQ ID NO: 1795475 - DNA, 21 bp, Homo sapiens
attttcctaataaagttctgt

SEQ ID NO: 1795476 - DNA, 20 bp, Homo sapiens
attttctttcatacattata

SEQ ID NO: 1795477 - DNA, 16 bp, Homo sapiens
atttttcagatataaa

SEQ ID NO: 1795478 - DNA, 16 bp, Homo sapiens
atttttgtacattatg

SEQ ID NO: 1795479 - DNA, 22 bp, Homo sapiens
atttttgtacgttatatattgt

SEQ ID NO: 1795480 - DNA, 15 bp, Homo sapiens
attttttttgtttca

SEQ ID NO: 1795481 - DNA, 14 bp, Homo sapiens
caaacaggctcaga

SEQ ID NO: 1795482 - DNA, 13 bp, Homo sapiens
caaactagggcca

SEQ ID NO: 1795483 - DNA, 19 bp, Homo sapiens
caaactagggccaagccca

SEQ ID NO: 1795484 - DNA, 23 bp, Homo sapiens
caaagccagcgtcctcctctgtg

SEQ ID NO: 1795485 - DNA, 21 bp, Homo sapiens
caaagctatatgttgtaactt

SEQ ID NO: 1795486 - DNA, 15 bp, Homo sapiens
caaaggcaagcactt

SEQ ID NO: 1795487 - DNA, 13 bp, Homo sapiens
caacaatttctac

SEQ ID NO: 1795488 - DNA, 14 bp, Homo sapiens
caacactgccagca

SEQ ID NO: 1795489 - DNA, 17 bp, Homo sapiens
caacatttttgtacatt

SEQ ID NO: 1795490 - DNA, 18 bp, Homo sapiens
caaccttagatgttctaa

SEQ ID NO: 1795491 - DNA, 21 bp, Homo sapiens
caagatattttaaaatctgtc

SEQ ID NO: 1795492 - DNA, 23 bp, Homo sapiens
caagatattttaaaatctgtcac

SEQ ID NO: 1795493 - DNA, 23 bp, Homo sapiens
caagcagacgtgagtgtgacttt

SEQ ID NO: 1795494 - DNA, 12 bp, Homo sapiens
caaggaagtcaa

SEQ ID NO: 1795495 - DNA, 15 bp, Homo sapiens
caagggacagaaaag

SEQ ID NO: 1795496 - DNA, 18 bp, Homo sapiens
caatcagctccttcctgg

SEQ ID NO: 1795497 - DNA, 14 bp, Homo sapiens
caatcctatgtttt

SEQ ID NO: 1795498 - DNA, 20 bp, Homo sapiens
caatcctatgtttttgttca

SEQ ID NO: 1795499 - DNA, 13 bp, Homo sapiens
caatgccatcatc

SEQ ID NO: 1795500 - DNA, 14 bp, Homo sapiens
caatgccatcatct

SEQ ID NO: 1795501 - DNA, 14 bp, Homo sapiens
caatgcgtgttgta

SEQ ID NO: 1795502 - DNA, 23 bp, Homo sapiens
caatgtcttgatgcatgcactgt

SEQ ID NO: 1795503 - DNA, 13 bp, Homo sapiens
caattatattgtc

SEQ ID NO: 1795504 - DNA, 14 bp, Homo sapiens
caattgcatctccc

SEQ ID NO: 1795505 - DNA, 20 bp, Homo sapiens
cacaacttgtttttggtttt

SEQ ID NO: 1795506 - DNA, 20 bp, Homo sapiens
cacagcctcccctgccaggg

SEQ ID NO: 1795507 - DNA, 21 bp, Homo sapiens
cacagcctcccctgccagggc

SEQ ID NO: 1795508 - DNA, 23 bp, Homo sapiens
cacagcctcccctgccagggcag

SEQ ID NO: 1795509 - DNA, 17 bp, Homo sapiens
cacatctgtgtcttgtt

SEQ ID NO: 1795510 - DNA, 23 bp, Homo sapiens
aaatgatccccagctgtttatgc

SEQ ID NO: 1795511 - DNA, 14 bp, Homo sapiens
aaatggtccaggag

SEQ ID NO: 1795512 - DNA, 13 bp, Homo sapiens
aaatgtcttgtgt

SEQ ID NO: 1795513 - DNA, 17 bp, Homo sapiens
aaattttttttgtttca

SEQ ID NO: 1795514 - DNA, 17 bp, Homo sapiens
aacaattaattttctat

SEQ ID NO: 1795515 - DNA, 12 bp, Homo sapiens
aacactgccagc

SEQ ID NO: 1795516 - DNA, 22 bp, Homo sapiens
aacactgtgcacatctgtgtct

SEQ ID NO: 1795517 - DNA, 14 bp, Homo sapiens
aacctgaattattc

SEQ ID NO: 1795518 - DNA, 23 bp, Homo sapiens
aaccttagatgttctaagtcttt

SEQ ID NO: 1795519 - DNA, 22 bp, Homo sapiens
aaccttcatgatgaattacttc

SEQ ID NO: 1795520 - DNA, 13 bp, Homo sapiens
aacgtattttgat

SEQ ID NO: 1795521 - DNA, 22 bp, Homo sapiens
aacgtattttgatgttttgtac

SEQ ID NO: 1795522 - DNA, 18 bp, Homo sapiens
aactatcaatatttaagt

SEQ ID NO: 1795523 - DNA, 15 bp, Homo sapiens
aactgaacattccag

SEQ ID NO: 1795524 - DNA, 14 bp, Homo sapiens
aactgatttctcac

SEQ ID NO: 1795525 - DNA, 22 bp, Homo sapiens
aacttaacaattaattttctat

SEQ ID NO: 1795526 - DNA, 16 bp, Homo sapiens
aacttcaaatatagag

SEQ ID NO: 1795527 - DNA, 19 bp, Homo sapiens
aagaaacaactctttgaga

SEQ ID NO: 1795528 - DNA, 20 bp, Homo sapiens
aagagtagaaactgcaggga

SEQ ID NO: 1795529 - DNA, 20 bp, Homo sapiens
aagatacagaactctttcaa

SEQ ID NO: 1795530 - DNA, 16 bp, Homo sapiens
aagattttttttgtaa

SEQ ID NO: 1795531 - DNA, 23 bp, Homo sapiens
aagcccagcactgcttgaggaaa

SEQ ID NO: 1795532 - DNA, 22 bp, Homo sapiens
aagcctcactattacttgaact

SEQ ID NO: 1795533 - DNA, 21 bp, Homo sapiens
aaggaatagtcgcgcaagcat

SEQ ID NO: 1795534 - DNA, 17 bp, Homo sapiens
aaggagccccattcctg

SEQ ID NO: 1795535 - DNA, 17 bp, Homo sapiens
aaggcttctctctgtgg

SEQ ID NO: 1795536 - DNA, 18 bp, Homo sapiens
aaggcttctctctgtggg

SEQ ID NO: 1795537 - DNA, 16 bp, Homo sapiens
aagggaaaagtctctt

SEQ ID NO: 1795538 - DNA, 13 bp, Homo sapiens
aagggagggggag

SEQ ID NO: 1795539 - DNA, 23 bp, Homo sapiens
aagtataggataaattacattaa

SEQ ID NO: 1795540 - DNA, 22 bp, Homo sapiens
aagtattttcataagtatttca

SEQ ID NO: 1795541 - DNA, 20 bp, Homo sapiens
aagtcaaagcaaggaaacta

SEQ ID NO: 1795542 - DNA, 20 bp, Homo sapiens
aagtgcaatgcgtgttgtac

SEQ ID NO: 1795543 - DNA, 22 bp, Homo sapiens
aagtgcgtccacgagctgttta

SEQ ID NO: 1795544 - DNA, 17 bp, Homo sapiens
aagtggtatagaaatgc

SEQ ID NO: 1795545 - DNA, 15 bp, Homo sapiens
aagttcttagttgct

SEQ ID NO: 1795546 - DNA, 15 bp, Homo sapiens
aagttgttaataaaa

SEQ ID NO: 1795547 - DNA, 16 bp, Homo sapiens
aataaagtgaatacat

SEQ ID NO: 1795548 - DNA, 16 bp, Homo sapiens
aatactgtattttgta

SEQ ID NO: 1795549 - DNA, 11 bp, Homo sapiens
aatatagagat

SEQ ID NO: 1795550 - DNA, 16 bp, Homo sapiens
aatatagagatatttt

SEQ ID NO: 1795551 - DNA, 18 bp, Homo sapiens
aatatagagatatttttg

SEQ ID NO: 1795552 - DNA, 23 bp, Homo sapiens
aatatttaagtttgttgctgtca

SEQ ID NO: 1795553 - DNA, 23 bp, Homo sapiens
aatctatttacataaaatgggtg

SEQ ID NO: 1795554 - DNA, 22 bp, Homo sapiens
aatctgtcacgtagaacttgga

SEQ ID NO: 1795555 - DNA, 22 bp, Homo sapiens
aatcttgactacagtcaggaaa

SEQ ID NO: 1795556 - DNA, 19 bp, Homo sapiens
aatgatccccagctgttta

SEQ ID NO: 1795557 - DNA, 17 bp, Homo sapiens
attccctagaaacttcc

SEQ ID NO: 1795558 - DNA, 20 bp, Homo sapiens
attcctctactaacaatcag

SEQ ID NO: 1795559 - DNA, 21 bp, Homo sapiens
attcggtgtgcaccagggttg

SEQ ID NO: 1795560 - DNA, 13 bp, Homo sapiens
attctctgagctg

SEQ ID NO: 1795561 - DNA, 19 bp, Homo sapiens
attctctgtctcatccatc

SEQ ID NO: 1795562 - DNA, 13 bp, Homo sapiens
attctgagggaat

SEQ ID NO: 1795563 - DNA, 17 bp, Homo sapiens
attctgagggaatttaa

SEQ ID NO: 1795564 - DNA, 20 bp, Homo sapiens
attctgagggaatttaacca

SEQ ID NO: 1795565 - DNA, 18 bp, Homo sapiens
attcttggttgaggaaac

SEQ ID NO: 1795566 - DNA, 13 bp, Homo sapiens
attctttcccaac

SEQ ID NO: 1795567 - DNA, 20 bp, Homo sapiens
attgaattcttggttgagga

SEQ ID NO: 1795568 - DNA, 16 bp, Homo sapiens
attgcgagaattttca

SEQ ID NO: 1795569 - DNA, 15 bp, Homo sapiens
attgctaattctgag

SEQ ID NO: 1795570 - DNA, 19 bp, Homo sapiens
attgtaactgttcttgaat

SEQ ID NO: 1795571 - DNA, 13 bp, Homo sapiens
attgtacagtttt

SEQ ID NO: 1795572 - DNA, 21 bp, Homo sapiens
attgtcctcccctattttaag

SEQ ID NO: 1795573 - DNA, 20 bp, Homo sapiens
atttctcctccatgggagaa

SEQ ID NO: 1795574 - DNA, 16 bp, Homo sapiens
atttgagtgctctgat

SEQ ID NO: 1795575 - DNA, 15 bp, Homo sapiens
atttgcaagggaaaa

SEQ ID NO: 1795576 - DNA, 21 bp, Homo sapiens
atttgcataacaattcctcta

SEQ ID NO: 1795577 - DNA, 22 bp, Homo sapiens
atttgcataacaattcctctac

SEQ ID NO: 1795578 - DNA, 19 bp, Homo sapiens
atttggcaatgccatcatc

SEQ ID NO: 1795579 - DNA, 16 bp, Homo sapiens
atttgttattttgcaa

SEQ ID NO: 1795580 - DNA, 17 bp, Homo sapiens
atttgttattttgcaac

SEQ ID NO: 1795581 - DNA, 21 bp, Homo sapiens
attttaaaagcaattatattg

SEQ ID NO: 1795582 - DNA, 17 bp, Homo sapiens
attttaagacgtgaatg

SEQ ID NO: 1795583 - DNA, 14 bp, Homo sapiens
attttagctcatgt

SEQ ID NO: 1795584 - DNA, 20 bp, Homo sapiens
attttcataagtatttcaaa

SEQ ID NO: 1795585 - DNA, 22 bp, Homo sapiens
attttcataagtatttcaaatt

SEQ ID NO: 1795586 - DNA, 18 bp, Homo sapiens
attttctttcatacatta

SEQ ID NO: 1795587 - DNA, 17 bp, Homo sapiens
atttttatgccacctga

SEQ ID NO: 1795588 - DNA, 17 bp, Homo sapiens
atttttgtacattatgt

SEQ ID NO: 1795589 - DNA, 18 bp, Homo sapiens
atttttgtacattatgtt

SEQ ID NO: 1795590 - DNA, 19 bp, Homo sapiens
atttttgtacattatgtta

SEQ ID NO: 1795591 - DNA, 14 bp, Homo sapiens
atttttgtcttgtg

SEQ ID NO: 1795592 - DNA, 14 bp, Homo sapiens
caaaaagatttatt

SEQ ID NO: 1795593 - DNA, 13 bp, Homo sapiens
caaagcaaggaaa

SEQ ID NO: 1795594 - DNA, 15 bp, Homo sapiens
caaagcaaggaaact

SEQ ID NO: 1795595 - DNA, 22 bp, Homo sapiens
caaagccagcgtcctcctctgt

SEQ ID NO: 1795596 - DNA, 19 bp, Homo sapiens
caaagtggtatagaaatgc

SEQ ID NO: 1795597 - DNA, 22 bp, Homo sapiens
caaatatagagatatttttgta

SEQ ID NO: 1795598 - DNA, 21 bp, Homo sapiens
caaattggagcttcatggcag

SEQ ID NO: 1795599 - DNA, 20 bp, Homo sapiens
caacaatttctactttgaag

SEQ ID NO: 1795600 - DNA, 13 bp, Homo sapiens
caacactgccagc

SEQ ID NO: 1795601 - DNA, 14 bp, Homo sapiens
caactctttgagaa

SEQ ID NO: 1795602 - DNA, 17 bp, Homo sapiens
caagagggacgcctggg

SEQ ID NO: 1795603 - DNA, 18 bp, Homo sapiens
caagcctcactattactt

SEQ ID NO: 1795604 - DNA, 19 bp, Homo sapiens
caagctgatgtttgtactt

SEQ ID NO: 1795605 - DNA, 18 bp, Homo sapiens
caatattgtacagttttt

SEQ ID NO: 1795606 - DNA, 20 bp, Homo sapiens
caatatttaagtttgttgct

SEQ ID NO: 1795607 - DNA, 15 bp, Homo sapiens
caatgaaaaaatgta

SEQ ID NO: 1795608 - DNA, 11 bp, Homo sapiens
caatgtcttga

SEQ ID NO: 1795609 - DNA, 21 bp, Homo sapiens
caatgtcttgatgcatgcact

SEQ ID NO: 1795610 - DNA, 12 bp, Homo sapiens
caattatattgt

SEQ ID NO: 1795611 - DNA, 17 bp, Homo sapiens
caattgcatctcccaga

SEQ ID NO: 1795612 - DNA, 14 bp, Homo sapiens
cacagcctcccctg

SEQ ID NO: 1795613 - DNA, 17 bp, Homo sapiens
cacatctaacctcatct

SEQ ID NO: 1795614 - DNA, 12 bp, Homo sapiens
cacatctgtgtc

SEQ ID NO: 1795615 - DNA, 16 bp, Homo sapiens
cacatctgtgtcttgt

SEQ ID NO: 1795616 - DNA, 18 bp, Homo sapiens
cacatgattttcttttgt

SEQ ID NO: 1795617 - DNA, 23 bp, Homo sapiens
caccagggttgaccccagaggat

SEQ ID NO: 1795618 - DNA, 16 bp, Homo sapiens
caccccgacttttgtt

SEQ ID NO: 1795619 - DNA, 21 bp, Homo sapiens
cacccttttccagctggatga

SEQ ID NO: 1795620 - DNA, 13 bp, Homo sapiens
caccgtgggctcc

SEQ ID NO: 1795621 - DNA, 13 bp, Homo sapiens
cacctacagtgta

SEQ ID NO: 1795622 - DNA, 19 bp, Homo sapiens
cacctaggctagggtgggg

SEQ ID NO: 1795623 - DNA, 20 bp, Homo sapiens
cacgagctgtttactaggga

SEQ ID NO: 1795624 - DNA, 17 bp, Homo sapiens
cacggagccactcctct

SEQ ID NO: 1795625 - DNA, 18 bp, Homo sapiens
cacgtgcaaaaatgtatt

SEQ ID NO: 1795626 - DNA, 17 bp, Homo sapiens
cactattacttgaactt

SEQ ID NO: 1795627 - DNA, 16 bp, Homo sapiens
cactcatgtgactctt

SEQ ID NO: 1795628 - DNA, 13 bp, Homo sapiens
cactcccttgggc

SEQ ID NO: 1795629 - DNA, 16 bp, Homo sapiens
cactcccttgggctcc

SEQ ID NO: 1795630 - DNA, 20 bp, Homo sapiens
cactcctctgactcagggct

SEQ ID NO: 1795631 - DNA, 23 bp, Homo sapiens
cactcctctgactcagggctcct

SEQ ID NO: 1795632 - DNA, 15 bp, Homo sapiens
cactgcttgaggaaa

SEQ ID NO: 1795633 - DNA, 20 bp, Homo sapiens
cactgcttgaggaaaacaag

SEQ ID NO: 1795634 - DNA, 22 bp, Homo sapiens
cactgtgcacatctgtgtcttg

SEQ ID NO: 1795635 - DNA, 19 bp, Homo sapiens
cactgttccccctgtgcag

SEQ ID NO: 1795636 - DNA, 19 bp, Homo sapiens
cactgtttaactgggagtg

SEQ ID NO: 1795637 - DNA, 16 bp, Homo sapiens
cagaaaagaaagctgc

SEQ ID NO: 1795638 - DNA, 18 bp, Homo sapiens
cagaaggcaaacccatca

SEQ ID NO: 1795639 - DNA, 17 bp, Homo sapiens
cagacgtgagtgtgact

SEQ ID NO: 1795640 - DNA, 18 bp, Homo sapiens
cagagcttccctgactca

SEQ ID NO: 1795641 - DNA, 19 bp, Homo sapiens
cagaggaaggggccagagg

SEQ ID NO: 1795642 - DNA, 20 bp, Homo sapiens
cagaggaaggggccagaggc

SEQ ID NO: 1795643 - DNA, 19 bp, Homo sapiens
cagaggccctcgctgccag

SEQ ID NO: 1795644 - DNA, 20 bp, Homo sapiens
cagaggccctcgctgccagc

SEQ ID NO: 1795645 - DNA, 14 bp, Homo sapiens
cagagtgagaccca

SEQ ID NO: 1795646 - DNA, 22 bp, Homo sapiens
cagatataaaagactgaccaat

SEQ ID NO: 1795647 - DNA, 11 bp, Homo sapiens
cagcagggcta

SEQ ID NO: 1795648 - DNA, 19 bp, Homo sapiens
cagcagggctaccctgagc

SEQ ID NO: 1795649 - DNA, 13 bp, Homo sapiens
cagccctcatccc

SEQ ID NO: 1795650 - DNA, 19 bp, Homo sapiens
cagccgctgagcgaggaga

SEQ ID NO: 1795651 - DNA, 19 bp, Homo sapiens
cagcctcccctgccagggc

SEQ ID NO: 1795652 - DNA, 23 bp, Homo sapiens
cagcctggctgtggcctaacctg

SEQ ID NO: 1795653 - DNA, 16 bp, Homo sapiens
cagcgtcctcctctgt

SEQ ID NO: 1795654 - DNA, 20 bp, Homo sapiens
cagctatgttatattgaaaa

SEQ ID NO: 1795655 - DNA, 19 bp, Homo sapiens
cagctctgaaaccagtgtt

SEQ ID NO: 1795656 - DNA, 19 bp, Homo sapiens
caggaaaggaatcatttct

SEQ ID NO: 1795657 - DNA, 13 bp, Homo sapiens
caggaaatgaaaa

SEQ ID NO: 1795658 - DNA, 15 bp, Homo sapiens
caggaaccgaggcag

SEQ ID NO: 1795659 - DNA, 15 bp, Homo sapiens
caggacccagaggaa

SEQ ID NO: 1795660 - DNA, 16 bp, Homo sapiens
caggacccagaggaag

SEQ ID NO: 1795661 - DNA, 20 bp, Homo sapiens
caggcatcggggagccggga

SEQ ID NO: 1795662 - DNA, 21 bp, Homo sapiens
caggcatcggggagccgggag

SEQ ID NO: 1795663 - DNA, 15 bp, Homo sapiens
caggctcagagggtg

SEQ ID NO: 1795664 - DNA, 19 bp, Homo sapiens
cagggcagagtgagaccca

SEQ ID NO: 1795665 - DNA, 22 bp, Homo sapiens
cagggctaccctgagctgaggc

SEQ ID NO: 1795666 - DNA, 12 bp, Homo sapiens
cagggctcctgg

SEQ ID NO: 1795667 - DNA, 13 bp, Homo sapiens
caggggtctgagc

SEQ ID NO: 1795668 - DNA, 20 bp, Homo sapiens
cagggttgaccccagaggat

SEQ ID NO: 1795669 - DNA, 20 bp, Homo sapiens
caggtggggagactgggctg

SEQ ID NO: 1795670 - DNA, 23 bp, Homo sapiens
caggtggggagactgggctgagg

SEQ ID NO: 1795671 - DNA, 12 bp, Homo sapiens
cagtaggagccc

SEQ ID NO: 1795672 - DNA, 15 bp, Homo sapiens
cagtaggagcccagc

SEQ ID NO: 1795673 - DNA, 21 bp, Homo sapiens
cagtaggagcccagctctgaa

SEQ ID NO: 1795674 - DNA, 16 bp, Homo sapiens
cagtcaacctgggcaa

SEQ ID NO: 1795675 - DNA, 15 bp, Homo sapiens
cagtcgatagagctg

SEQ ID NO: 1795676 - DNA, 15 bp, Homo sapiens
cagtcttccatttgc

SEQ ID NO: 1795677 - DNA, 18 bp, Homo sapiens
cagtgacctgccctacat

SEQ ID NO: 1795678 - DNA, 17 bp, Homo sapiens
cagtgactgtagttact

SEQ ID NO: 1795679 - DNA, 15 bp, Homo sapiens
cagtgtacagtcttg

SEQ ID NO: 1795680 - DNA, 17 bp, Homo sapiens
cagtgtacagtcttgta

SEQ ID NO: 1795681 - DNA, 18 bp, Homo sapiens
cagtgtgaggccagggca

SEQ ID NO: 1795682 - DNA, 19 bp, Homo sapiens
cagtgtgaggccagggcag

SEQ ID NO: 1795683 - DNA, 19 bp, Homo sapiens
cagtgttagggaagggcct

SEQ ID NO: 1795684 - DNA, 16 bp, Homo sapiens
cagttctagttgattg

SEQ ID NO: 1795685 - DNA, 19 bp, Homo sapiens
cataaaatgggtgatatgc

SEQ ID NO: 1795686 - DNA, 16 bp, Homo sapiens
cataacaattcctcta

SEQ ID NO: 1795687 - DNA, 13 bp, Homo sapiens
catacattatatt

SEQ ID NO: 1795688 - DNA, 14 bp, Homo sapiens
catacattatattc

SEQ ID NO: 1795689 - DNA, 18 bp, Homo sapiens
catattttcaccatttga

SEQ ID NO: 1795690 - DNA, 13 bp, Homo sapiens
catcaacaaaaat

SEQ ID NO: 1795691 - DNA, 13 bp, Homo sapiens
catcatctcctgc

SEQ ID NO: 1795692 - DNA, 15 bp, Homo sapiens
catcattctctgtct

SEQ ID NO: 1795693 - DNA, 21 bp, Homo sapiens
catcattctctgtctcatcca

SEQ ID NO: 1795694 - DNA, 17 bp, Homo sapiens
catccacatgggagccg

SEQ ID NO: 1795695 - DNA, 17 bp, Homo sapiens
catccagagtccctgcc

SEQ ID NO: 1795696 - DNA, 20 bp, Homo sapiens
catccagagtccctgcctgg

SEQ ID NO: 1795697 - DNA, 18 bp, Homo sapiens
catcctaccccctgtgcc

SEQ ID NO: 1795698 - DNA, 20 bp, Homo sapiens
catcctccacgttctgctca

SEQ ID NO: 1795699 - DNA, 21 bp, Homo sapiens
catcctccacgttctgctcat

SEQ ID NO: 1795700 - DNA, 22 bp, Homo sapiens
catctcccagataatgtgaaaa

SEQ ID NO: 1795701 - DNA, 17 bp, Homo sapiens
catctgtccctccggga

SEQ ID NO: 1795702 - DNA, 20 bp, Homo sapiens
catctgtccctccgggacct

SEQ ID NO: 1795703 - DNA, 11 bp, Homo sapiens
catctgtgtct

SEQ ID NO: 1795704 - DNA, 13 bp, Homo sapiens
catctgtgtcttg

SEQ ID NO: 1795705 - DNA, 14 bp, Homo sapiens
catctgtgtcttgt

SEQ ID NO: 1795706 - DNA, 13 bp, Homo sapiens
catggcagaaggc

SEQ ID NO: 1795707 - DNA, 18 bp, Homo sapiens
catggtgtgatcgtctga

SEQ ID NO: 1795708 - DNA, 16 bp, Homo sapiens
catgtaaactgtgcac

SEQ ID NO: 1795709 - DNA, 22 bp, Homo sapiens
catgtgtgtccacgactgtctc

SEQ ID NO: 1795710 - DNA, 19 bp, Homo sapiens
cattatgttattggaattt

SEQ ID NO: 1795711 - DNA, 20 bp, Homo sapiens
cattatgttattggaatttt

SEQ ID NO: 1795712 - DNA, 14 bp, Homo sapiens
cattctctgtctca

SEQ ID NO: 1795713 - DNA, 12 bp, Homo sapiens
cattctttccca

SEQ ID NO: 1795714 - DNA, 14 bp, Homo sapiens
cattctttcccaac

SEQ ID NO: 1795715 - DNA, 17 bp, Homo sapiens
cattggacccttccatg

SEQ ID NO: 1795716 - DNA, 17 bp, Homo sapiens
catttaaatacagtctt

SEQ ID NO: 1795717 - DNA, 17 bp, Homo sapiens
catttagtttgattatt

SEQ ID NO: 1795718 - DNA, 19 bp, Homo sapiens
catttctatttctcctcca

SEQ ID NO: 1795719 - DNA, 22 bp, Homo sapiens
catttgcaagggaaaagtctct

SEQ ID NO: 1795720 - DNA, 23 bp, Homo sapiens
catttggagtgttccccttccac

SEQ ID NO: 1795721 - DNA, 16 bp, Homo sapiens
cattttaaaagcaatt

SEQ ID NO: 1795722 - DNA, 18 bp, Homo sapiens
catttttgtacattatgt

SEQ ID NO: 1795723 - DNA, 23 bp, Homo sapiens
catttttgtacattatgttattg

SEQ ID NO: 1795724 - DNA, 16 bp, Homo sapiens
ccaaaagtacttaccc

SEQ ID NO: 1795725 - DNA, 13 bp, Homo sapiens
ccaacactgccag

SEQ ID NO: 1795726 - DNA, 14 bp, Homo sapiens
ccaacactgccagc

SEQ ID NO: 1795727 - DNA, 15 bp, Homo sapiens
ccaacactgccagca

SEQ ID NO: 1795728 - DNA, 16 bp, Homo sapiens
ccaacactgccagcat

SEQ ID NO: 1795729 - DNA, 23 bp, Homo sapiens
ccaaccttagatgttctaagtct

SEQ ID NO: 1795730 - DNA, 14 bp, Homo sapiens
ccaatattgtacag

SEQ ID NO: 1795731 - DNA, 13 bp, Homo sapiens
ccaatcctatgtt

SEQ ID NO: 1795732 - DNA, 13 bp, Homo sapiens
ccacatcctccac

SEQ ID NO: 1795733 - DNA, 16 bp, Homo sapiens
ccacatgggaggctca

SEQ ID NO: 1795734 - DNA, 17 bp, Homo sapiens
ccaccaagagggacgcc

SEQ ID NO: 1795735 - DNA, 14 bp, Homo sapiens
ccacgactgtctcc

SEQ ID NO: 1795736 - DNA, 21 bp, Homo sapiens
ccacggagccactcctctgac

SEQ ID NO: 1795737 - DNA, 21 bp, Homo sapiens
ccacgtcagctgggacacccc

SEQ ID NO: 1795738 - DNA, 19 bp, Homo sapiens
ccactcatgtgactctttc

SEQ ID NO: 1795739 - DNA, 22 bp, Homo sapiens
ccactcatgtgactctttccaa

SEQ ID NO: 1795740 - DNA, 23 bp, Homo sapiens
ccagacttcccacggctcctcga

SEQ ID NO: 1795741 - DNA, 19 bp, Homo sapiens
ccagagtccctgcctggac

SEQ ID NO: 1795742 - DNA, 19 bp, Homo sapiens
ccagcactgcttgaggaaa

SEQ ID NO: 1795743 - DNA, 16 bp, Homo sapiens
ccagcatttcccttcc

SEQ ID NO: 1795744 - DNA, 14 bp, Homo sapiens
ccagccctcatccc

SEQ ID NO: 1795745 - DNA, 16 bp, Homo sapiens
ccagggttgaccccag

SEQ ID NO: 1795746 - DNA, 18 bp, Homo sapiens
ccagggttgaccccagag

SEQ ID NO: 1795747 - DNA, 21 bp, Homo sapiens
ccagggttgaccccagaggat

SEQ ID NO: 1795748 - DNA, 12 bp, Homo sapiens
ccatgagctcct

SEQ ID NO: 1795749 - DNA, 14 bp, Homo sapiens
ccatgggcagagcc

SEQ ID NO: 1795750 - DNA, 16 bp, Homo sapiens
ccatgggcagagccca

SEQ ID NO: 1795751 - DNA, 15 bp, Homo sapiens
ccatgtagaaaattt

SEQ ID NO: 1795752 - DNA, 16 bp, Homo sapiens
ccatgtagaaaatttg

SEQ ID NO: 1795753 - DNA, 22 bp, Homo sapiens
ccattcctgggaaatattccct

SEQ ID NO: 1795754 - DNA, 14 bp, Homo sapiens
ccattctttcccaa

SEQ ID NO: 1795755 - DNA, 21 bp, Homo sapiens
cccaaagtggtatagaaatgc

SEQ ID NO: 1795756 - DNA, 15 bp, Homo sapiens
cccacgtcagctggg

SEQ ID NO: 1795757 - DNA, 22 bp, Homo sapiens
cccagaggaaggggccagaggc

SEQ ID NO: 1795758 - DNA, 16 bp, Homo sapiens
cccagaggattgctgc

SEQ ID NO: 1795759 - DNA, 16 bp, Homo sapiens
cccagccctcatcccg

SEQ ID NO: 1795760 - DNA, 21 bp, Homo sapiens
cccaggcattgccaagggctt

SEQ ID NO: 1795761 - DNA, 19 bp, Homo sapiens
cccaggctggagtgcagtg

SEQ ID NO: 1795762 - DNA, 14 bp, Homo sapiens
cccattcctgggaa

SEQ ID NO: 1795763 - DNA, 17 bp, Homo sapiens
ccccaaaagtacttacc

SEQ ID NO: 1795764 - DNA, 20 bp, Homo sapiens
ccccatcagtgctccctcac

SEQ ID NO: 1795765 - DNA, 19 bp, Homo sapiens
ccccatggtcagccctagg

SEQ ID NO: 1795766 - DNA, 21 bp, Homo sapiens
ccccctgtgcagccgctgagc

SEQ ID NO: 1795767 - DNA, 14 bp, Homo sapiens
cccctgccagggca

SEQ ID NO: 1795768 - DNA, 23 bp, Homo sapiens
cccctgccagggcagggccccag

SEQ ID NO: 1795769 - DNA, 19 bp, Homo sapiens
cccctgtgcagccgctgag

SEQ ID NO: 1795770 - DNA, 20 bp, Homo sapiens
cccctgtgcagccgctgagc

SEQ ID NO: 1795771 - DNA, 14 bp, Homo sapiens
ccctcatctgtccc

SEQ ID NO: 1795772 - DNA, 14 bp, Homo sapiens
ccctcatctttctt

SEQ ID NO: 1795773 - DNA, 14 bp, Homo sapiens
ccctcgctgccagc

SEQ ID NO: 1795774 - DNA, 15 bp, Homo sapiens
ccctctacagagctt

SEQ ID NO: 1795775 - DNA, 15 bp, Homo sapiens
ccctgactcattctg

SEQ ID NO: 1795776 - DNA, 16 bp, Homo sapiens
ccctgagctgaggcag

SEQ ID NO: 1795777 - DNA, 17 bp, Homo sapiens
ccctgagctgaggcagc

SEQ ID NO: 1795778 - DNA, 12 bp, Homo sapiens
ccctgcctggac

SEQ ID NO: 1795779 - DNA, 22 bp, Homo sapiens
ccctgtgcagccgctgagcgag

SEQ ID NO: 1795780 - DNA, 13 bp, Homo sapiens
cccttccactgag

SEQ ID NO: 1795781 - DNA, 16 bp, Homo sapiens
cccttccactgagggc

SEQ ID NO: 1795782 - DNA, 14 bp, Homo sapiens
ccctttgagtgcag

SEQ ID NO: 1795783 - DNA, 23 bp, Homo sapiens
ccgaatctctttttgctttcgaa

SEQ ID NO: 1795784 - DNA, 20 bp, Homo sapiens
ccgagagtccatcagcctcc

SEQ ID NO: 1795785 - DNA, 21 bp, Homo sapiens
ccgagagtccatcagcctcca

SEQ ID NO: 1795786 - DNA, 23 bp, Homo sapiens
ccgctgagcgaggagatgctcct

SEQ ID NO: 1795787 - DNA, 22 bp, Homo sapiens
ccgctggtgcctcccgggacga

SEQ ID NO: 1795788 - DNA, 13 bp, Homo sapiens
ccgggagctcagg

SEQ ID NO: 1795789 - DNA, 14 bp, Homo sapiens
ccgtggtcctttgg

SEQ ID NO: 1795790 - DNA, 23 bp, Homo sapiens
cctagtgaaggcttctctctgtg

SEQ ID NO: 1795791 - DNA, 20 bp, Homo sapiens
cctcatcccgagcacctcca

SEQ ID NO: 1795792 - DNA, 15 bp, Homo sapiens
cctcatctgtccctc

SEQ ID NO: 1795793 - DNA, 18 bp, Homo sapiens
cctcatcttcttcaccat

SEQ ID NO: 1795794 - DNA, 15 bp, Homo sapiens
cctccacatcctcca

SEQ ID NO: 1795795 - DNA, 20 bp, Homo sapiens
cctccacatcctccacgttc

SEQ ID NO: 1795796 - DNA, 18 bp, Homo sapiens
cctccacgttctgctcat

SEQ ID NO: 1795797 - DNA, 22 bp, Homo sapiens
cctccatcctaccccctgtgcc

SEQ ID NO: 1795798 - DNA, 11 bp, Homo sapiens
cctccatggga

SEQ ID NO: 1795799 - DNA, 15 bp, Homo sapiens
cctcctctgcccggg

SEQ ID NO: 1795800 - DNA, 12 bp, Homo sapiens
cctcctctgtga

SEQ ID NO: 1795801 - DNA, 12 bp, Homo sapiens
cctcctgagaaa

SEQ ID NO: 1795802 - DNA, 13 bp, Homo sapiens
cctcgctgccagc

SEQ ID NO: 1795803 - DNA, 16 bp, Homo sapiens
cctctctgctctgcgt

SEQ ID NO: 1795804 - DNA, 12 bp, Homo sapiens
cctctgactcag

SEQ ID NO: 1795805 - DNA, 22 bp, Homo sapiens
cctctgcccgggagctcaggaa

SEQ ID NO: 1795806 - DNA, 18 bp, Homo sapiens
cctctgtgaccaatgtct

SEQ ID NO: 1795807 - DNA, 13 bp, Homo sapiens
cctcttcagaggc

SEQ ID NO: 1795808 - DNA, 16 bp, Homo sapiens
cctcttcagaggccct

SEQ ID NO: 1795809 - DNA, 17 bp, Homo sapiens
cctcttctgggagggca

SEQ ID NO: 1795810 - DNA, 18 bp, Homo sapiens
cctcttctgggagggcag

SEQ ID NO: 1795811 - DNA, 18 bp, Homo sapiens
cctgaccctcatctttct

SEQ ID NO: 1795812 - DNA, 13 bp, Homo sapiens
cctgactcattct

SEQ ID NO: 1795813 - DNA, 15 bp, Homo sapiens
cctgcaccggggcct

SEQ ID NO: 1795814 - DNA, 17 bp, Homo sapiens
cctgccagggcagggcc

SEQ ID NO: 1795815 - DNA, 12 bp, Homo sapiens
cctgcctggacc

SEQ ID NO: 1795816 - DNA, 14 bp, Homo sapiens
cctgccttcctcct

SEQ ID NO: 1795817 - DNA, 24 bp, Homo sapiens
cctggacatgaagattctttccca

SEQ ID NO: 1795818 - DNA, 14 bp, Homo sapiens
cctggaccagcctc

SEQ ID NO: 1795819 - DNA, 17 bp, Homo sapiens
cctggcatgggtgtctg

SEQ ID NO: 1795820 - DNA, 18 bp, Homo sapiens
cctggccccatggtcagc

SEQ ID NO: 1795821 - DNA, 17 bp, Homo sapiens
cctgggaaatattccct

SEQ ID NO: 1795822 - DNA, 13 bp, Homo sapiens
cctgggcaaagcc

SEQ ID NO: 1795823 - DNA, 14 bp, Homo sapiens
cctgggcaggaggg

SEQ ID NO: 1795824 - DNA, 14 bp, Homo sapiens
cctgggggtgccag

SEQ ID NO: 1795825 - DNA, 19 bp, Homo sapiens
cctgggttttgtattctct

SEQ ID NO: 1795826 - DNA, 16 bp, Homo sapiens
cctgtaacctcttcag

SEQ ID NO: 1795827 - DNA, 11 bp, Homo sapiens
ccttctccatc

SEQ ID NO: 1795828 - DNA, 18 bp, Homo sapiens
ccttgtcacgccagactt

SEQ ID NO: 1795829 - DNA, 22 bp, Homo sapiens
cctttgagtgcagtcctgatca

SEQ ID NO: 1795830 - DNA, 21 bp, Homo sapiens
ccttttgaaattaacctctca

SEQ ID NO: 1795831 - DNA, 16 bp, Homo sapiens
cgaagcgttgtcctca

SEQ ID NO: 1795832 - DNA, 17 bp, Homo sapiens
cgaagcgttgtcctcag

SEQ ID NO: 1795833 - DNA, 11 bp, Homo sapiens
cgactgtctcc

SEQ ID NO: 1795834 - DNA, 15 bp, Homo sapiens
cgagatcccaacact

SEQ ID NO: 1795835 - DNA, 11 bp, Homo sapiens
cgcggctggga

SEQ ID NO: 1795836 - DNA, 21 bp, Homo sapiens
cgcttccttagccttgctcag

SEQ ID NO: 1795837 - DNA, 14 bp, Homo sapiens
cgcttggagcagag

SEQ ID NO: 1795838 - DNA, 19 bp, Homo sapiens
cggagcaggggtctgagcc

SEQ ID NO: 1795839 - DNA, 21 bp, Homo sapiens
cggagccactcctctgactca

SEQ ID NO: 1795840 - DNA, 23 bp, Homo sapiens
cggctgggaggagggcaggcatc

SEQ ID NO: 1795841 - DNA, 18 bp, Homo sapiens
cgggacacctaggctagg

SEQ ID NO: 1795842 - DNA, 19 bp, Homo sapiens
cgggacacctaggctaggg

SEQ ID NO: 1795843 - DNA, 17 bp, Homo sapiens
cgggggcagtctgagag

SEQ ID NO: 1795844 - DNA, 18 bp, Homo sapiens
cgggggcagtctgagaga

SEQ ID NO: 1795845 - DNA, 19 bp, Homo sapiens
cgtcagctgggacaccccg

SEQ ID NO: 1795846 - DNA, 12 bp, Homo sapiens
cgtcctcctctg

SEQ ID NO: 1795847 - DNA, 15 bp, Homo sapiens
cgtcctcctctgtga

SEQ ID NO: 1795848 - DNA, 16 bp, Homo sapiens
cgtgtcacctgtgctt

SEQ ID NO: 1795849 - DNA, 14 bp, Homo sapiens
cgttctgctcatca

SEQ ID NO: 1795850 - DNA, 12 bp, Homo sapiens
ctaacctcatct

SEQ ID NO: 1795851 - DNA, 16 bp, Homo sapiens
ctaagtctttccattg

SEQ ID NO: 1795852 - DNA, 16 bp, Homo sapiens
ctacacccttttccag

SEQ ID NO: 1795853 - DNA, 18 bp, Homo sapiens
ctacagagcttccctgac

SEQ ID NO: 1795854 - DNA, 20 bp, Homo sapiens
ctacagagcttccctgactc

SEQ ID NO: 1795855 - DNA, 18 bp, Homo sapiens
ctacagtcaggaaaggaa

SEQ ID NO: 1795856 - DNA, 21 bp, Homo sapiens
ctacagtcaggaaaggaatca

SEQ ID NO: 1795857 - DNA, 14 bp, Homo sapiens
ctacagtgtacagt

SEQ ID NO: 1795858 - DNA, 17 bp, Homo sapiens
ctacagtgtacagtctt

SEQ ID NO: 1795859 - DNA, 20 bp, Homo sapiens
ctacagtgtacagtcttgta

SEQ ID NO: 1795860 - DNA, 20 bp, Homo sapiens
ctgggagggcagcagggcta

SEQ ID NO: 1795861 - DNA, 15 bp, Homo sapiens
ctgggcaaagcctag

SEQ ID NO: 1795862 - DNA, 13 bp, Homo sapiens
ctgggcaggaggg

SEQ ID NO: 1795863 - DNA, 19 bp, Homo sapiens
gacctgtggccaagttctt

SEQ ID NO: 1795864 - DNA, 19 bp, Homo sapiens
gacgcctgggggtgccagg

SEQ ID NO: 1795865 - DNA, 21 bp, Homo sapiens
gacgcctgggggtgccaggac

SEQ ID NO: 1795866 - DNA, 19 bp, Homo sapiens
gacgtgaatgtctcagcga

SEQ ID NO: 1795867 - DNA, 16 bp, Homo sapiens
gacgtgattttgctgt

SEQ ID NO: 1795868 - DNA, 17 bp, Homo sapiens
gacgtgattttgctgta

SEQ ID NO: 1795869 - DNA, 12 bp, Homo sapiens
gactaactaaaa

SEQ ID NO: 1795870 - DNA, 14 bp, Homo sapiens
gactcagggctcct

SEQ ID NO: 1795871 - DNA, 17 bp, Homo sapiens
gactcagggctcctggg

SEQ ID NO: 1795872 - DNA, 13 bp, Homo sapiens
gactcattctgaa

SEQ ID NO: 1795873 - DNA, 17 bp, Homo sapiens
gactcattctgaaggag

SEQ ID NO: 1795874 - DNA, 16 bp, Homo sapiens
gactctcagtctctga

SEQ ID NO: 1795875 - DNA, 15 bp, Homo sapiens
gactgggctgaggga

SEQ ID NO: 1795876 - DNA, 20 bp, Homo sapiens
aatctctttttgctttcgaa

SEQ ID NO: 1795877 - DNA, 14 bp, Homo sapiens
aatgaaaaaatgta

SEQ ID NO: 1795878 - DNA, 15 bp, Homo sapiens
aatgaaaatgtcttg

SEQ ID NO: 1795879 - DNA, 16 bp, Homo sapiens
aatgaaaatgtcttgt

SEQ ID NO: 1795880 - DNA, 23 bp, Homo sapiens
aatgattcagtgttaaatgtgat

SEQ ID NO: 1795881 - DNA, 13 bp, Homo sapiens
aatgggtgatatg

SEQ ID NO: 1795882 - DNA, 13 bp, Homo sapiens
aatgtcttgtgtt

SEQ ID NO: 1795883 - DNA, 22 bp, Homo sapiens
aatgtgaaaatggtccaggaga

SEQ ID NO: 1795884 - DNA, 23 bp, Homo sapiens
aattaaaccagactctgttgcaa

SEQ ID NO: 1795885 - DNA, 22 bp, Homo sapiens
aattcacatctaacctcatctt

SEQ ID NO: 1795886 - DNA, 17 bp, Homo sapiens
aattctgagggaattta

SEQ ID NO: 1795887 - DNA, 19 bp, Homo sapiens
aattcttggttgaggaaac

SEQ ID NO: 1795888 - DNA, 20 bp, Homo sapiens
aattcttggttgaggaaaca

SEQ ID NO: 1795889 - DNA, 14 bp, Homo sapiens
aattgacttattta

SEQ ID NO: 1795890 - DNA, 14 bp, Homo sapiens
aattgctaattctg

SEQ ID NO: 1795891 - DNA, 16 bp, Homo sapiens
aattgctaattctgag

SEQ ID NO: 1795892 - DNA, 17 bp, Homo sapiens
aatttctactttgaagt

SEQ ID NO: 1795893 - DNA, 19 bp, Homo sapiens
aattttcctaataaagttc

SEQ ID NO: 1795894 - DNA, 19 bp, Homo sapiens
aattttctttcatacatta

SEQ ID NO: 1795895 - DNA, 14 bp, Homo sapiens
acaaaaatatcttg

SEQ ID NO: 1795896 - DNA, 22 bp, Homo sapiens
acaaaataaccaatcctggaca

SEQ ID NO: 1795897 - DNA, 21 bp, Homo sapiens
acaaggaagtcaaagcaagga

SEQ ID NO: 1795898 - DNA, 18 bp, Homo sapiens
acaatcagctccttcctg

SEQ ID NO: 1795899 - DNA, 20 bp, Homo sapiens
acacctaggctagggtgggg

SEQ ID NO: 1795900 - DNA, 19 bp, Homo sapiens
acactttgccatattttca

SEQ ID NO: 1795901 - DNA, 18 bp, Homo sapiens
acagaactctttcaaaac

SEQ ID NO: 1795902 - DNA, 15 bp, Homo sapiens
acagagcttccctga

SEQ ID NO: 1795903 - DNA, 13 bp, Homo sapiens
acagaggtaacta

SEQ ID NO: 1795904 - DNA, 18 bp, Homo sapiens
acagagttggtgttcata

SEQ ID NO: 1795905 - DNA, 19 bp, Homo sapiens
acagcctcccctgccaggg

SEQ ID NO: 1795906 - DNA, 22 bp, Homo sapiens
acagcctcccctgccagggcag

SEQ ID NO: 1795907 - DNA, 15 bp, Homo sapiens
acaggttagctgctc

SEQ ID NO: 1795908 - DNA, 14 bp, Homo sapiens
acagtcttgtatta

SEQ ID NO: 1795909 - DNA, 18 bp, Homo sapiens
acagtcttgtattaagtt

SEQ ID NO: 1795910 - DNA, 18 bp, Homo sapiens
acagtgtacagtcttgta

SEQ ID NO: 1795911 - DNA, 15 bp, Homo sapiens
acatctgtgtcttgt

SEQ ID NO: 1795912 - DNA, 16 bp, Homo sapiens
acatctgtgtcttgtt

SEQ ID NO: 1795913 - DNA, 15 bp, Homo sapiens
acatgaagattcttt

SEQ ID NO: 1795914 - DNA, 18 bp, Homo sapiens
acatgaagattctttccc

SEQ ID NO: 1795915 - DNA, 12 bp, Homo sapiens
acatgattttct

SEQ ID NO: 1795916 - DNA, 13 bp, Homo sapiens
acatgattttctt

SEQ ID NO: 1795917 - DNA, 17 bp, Homo sapiens
acatggattccactgaa

SEQ ID NO: 1795918 - DNA, 20 bp, Homo sapiens
acatgggagccgggtctgcc

SEQ ID NO: 1795919 - DNA, 18 bp, Homo sapiens
acatgtcagtaccttcaa

SEQ ID NO: 1795920 - DNA, 20 bp, Homo sapiens
acatgtgttaagtattttca

SEQ ID NO: 1795921 - DNA, 17 bp, Homo sapiens
acatgttaaacttactt

SEQ ID NO: 1795922 - DNA, 20 bp, Homo sapiens
acattatgttattggaattt

SEQ ID NO: 1795923 - DNA, 12 bp, Homo sapiens
acattctgctat

SEQ ID NO: 1795924 - DNA, 15 bp, Homo sapiens
acatttggagtgttc

SEQ ID NO: 1795925 - DNA, 20 bp, Homo sapiens
acatttggagtgttcccctt

SEQ ID NO: 1795926 - DNA, 21 bp, Homo sapiens
acatttttcagatataaaaga

SEQ ID NO: 1795927 - DNA, 15 bp, Homo sapiens
acatttttgtacatt

SEQ ID NO: 1795928 - DNA, 13 bp, Homo sapiens
accaagcaggaaa

SEQ ID NO: 1795929 - DNA, 14 bp, Homo sapiens
accaatattgtaca

SEQ ID NO: 1795930 - DNA, 19 bp, Homo sapiens
accaatattgtacagtttt

SEQ ID NO: 1795931 - DNA, 13 bp, Homo sapiens
accaatcctggac

SEQ ID NO: 1795932 - DNA, 12 bp, Homo sapiens
accaatgtcttg

SEQ ID NO: 1795933 - DNA, 13 bp, Homo sapiens
accaatgtcttga

SEQ ID NO: 1795934 - DNA, 23 bp, Homo sapiens
accagcgaggaggctccagaggg

SEQ ID NO: 1795935 - DNA, 16 bp, Homo sapiens
accagggcgcaagcct

SEQ ID NO: 1795936 - DNA, 22 bp, Homo sapiens
accagtgttagggaagggcctg

SEQ ID NO: 1795937 - DNA, 17 bp, Homo sapiens
accatgtagaaaatttg

SEQ ID NO: 1795938 - DNA, 16 bp, Homo sapiens
acccagtccacaaaat

SEQ ID NO: 1795939 - DNA, 15 bp, Homo sapiens
acccatcaacaaaaa

SEQ ID NO: 1795940 - DNA, 22 bp, Homo sapiens
accctgagctgaggcagcagtg

SEQ ID NO: 1795941 - DNA, 13 bp, Homo sapiens
acccttacagtag

SEQ ID NO: 1795942 - DNA, 19 bp, Homo sapiens
accggggcctgggcaggag

SEQ ID NO: 1795943 - DNA, 14 bp, Homo sapiens
accgtgggctccct

SEQ ID NO: 1795944 - DNA, 15 bp, Homo sapiens
acctacagtgtacag

SEQ ID NO: 1795945 - DNA, 17 bp, Homo sapiens
acctaggctagggtggg

SEQ ID NO: 1795946 - DNA, 19 bp, Homo sapiens
acctcacttctggcactgt

SEQ ID NO: 1795947 - DNA, 14 bp, Homo sapiens
acctccacatcctc

SEQ ID NO: 1795948 - DNA, 16 bp, Homo sapiens
acctccacatcctcca

SEQ ID NO: 1795949 - DNA, 16 bp, Homo sapiens
acctcgctggactctc

SEQ ID NO: 1795950 - DNA, 15 bp, Homo sapiens
acctcttcagaggcc

SEQ ID NO: 1795951 - DNA, 18 bp, Homo sapiens
acctgaataaagaatgaa

SEQ ID NO: 1795952 - DNA, 17 bp, Homo sapiens
acctgacactcccttgg

SEQ ID NO: 1795953 - DNA, 19 bp, Homo sapiens
acctgacactcccttgggc

SEQ ID NO: 1795954 - DNA, 23 bp, Homo sapiens
acctgccgagagtccatcagcct

SEQ ID NO: 1795955 - DNA, 21 bp, Homo sapiens
acctgcctgacatttggagtg

SEQ ID NO: 1795956 - DNA, 22 bp, Homo sapiens
accttagatgttctaagtcttt

SEQ ID NO: 1795957 - DNA, 22 bp, Homo sapiens
acgaatacttttgccctttgat

SEQ ID NO: 1795958 - DNA, 19 bp, Homo sapiens
acgagctgtttactaggga

SEQ ID NO: 1795959 - DNA, 21 bp, Homo sapiens
acgcctgaggaacccttacag

SEQ ID NO: 1795960 - DNA, 18 bp, Homo sapiens
acggagccactcctctga

SEQ ID NO: 1795961 - DNA, 20 bp, Homo sapiens
acggagccactcctctgact

SEQ ID NO: 1795962 - DNA, 22 bp, Homo sapiens
acgtagatttttgctcttctgt

SEQ ID NO: 1795963 - DNA, 14 bp, Homo sapiens
acgtgaatgtctca

SEQ ID NO: 1795964 - DNA, 19 bp, Homo sapiens
acgtgattttgctgtagaa

SEQ ID NO: 1795965 - DNA, 15 bp, Homo sapiens
actacagtcaggaaa

SEQ ID NO: 1795966 - DNA, 18 bp, Homo sapiens
actaccttggttccccca

SEQ ID NO: 1795967 - DNA, 18 bp, Homo sapiens
actagggatccctcatct

SEQ ID NO: 1795968 - DNA, 16 bp, Homo sapiens
actatcaatatttaag

SEQ ID NO: 1795969 - DNA, 14 bp, Homo sapiens
actatgtaacatgt

SEQ ID NO: 1795970 - DNA, 15 bp, Homo sapiens
actattacttgaact

SEQ ID NO: 1795971 - DNA, 16 bp, Homo sapiens
actattacttgaactt

SEQ ID NO: 1795972 - DNA, 17 bp, Homo sapiens
actcatgtgactctttc

SEQ ID NO: 1795973 - DNA, 16 bp, Homo sapiens
actctcagtctctgag

SEQ ID NO: 1795974 - DNA, 17 bp, Homo sapiens
actctcagtctctgagc

SEQ ID NO: 1795975 - DNA, 20 bp, Homo sapiens
actctttagttttattttaa

SEQ ID NO: 1795976 - DNA, 16 bp, Homo sapiens
actctttgagaaacaa

SEQ ID NO: 1795977 - DNA, 18 bp, Homo sapiens
actgaaatagagtgaatt

SEQ ID NO: 1795978 - DNA, 22 bp, Homo sapiens
actgaccaatattgtacagttt

SEQ ID NO: 1795979 - DNA, 18 bp, Homo sapiens
actgagataccagcgagg

SEQ ID NO: 1795980 - DNA, 19 bp, Homo sapiens
actgagataccagcgagga

SEQ ID NO: 1795981 - DNA, 22 bp, Homo sapiens
cagaggtaactatcaatattta

SEQ ID NO: 1795982 - DNA, 18 bp, Homo sapiens
cagagtccctgcctggac

SEQ ID NO: 1795983 - DNA, 15 bp, Homo sapiens
cagagtgagacccag

SEQ ID NO: 1795984 - DNA, 17 bp, Homo sapiens
cagagtgagacccagcc

SEQ ID NO: 1795985 - DNA, 13 bp, Homo sapiens
cagataatgtgaa

SEQ ID NO: 1795986 - DNA, 14 bp, Homo sapiens
cagataatgtgaaa

SEQ ID NO: 1795987 - DNA, 20 bp, Homo sapiens
cagcacctacagtgtacagt

SEQ ID NO: 1795988 - DNA, 16 bp, Homo sapiens
cagcactgcttgagga

SEQ ID NO: 1795989 - DNA, 21 bp, Homo sapiens
cagcagggctaccctgagctg

SEQ ID NO: 1795990 - DNA, 17 bp, Homo sapiens
cagcagtgtgaggccag

SEQ ID NO: 1795991 - DNA, 24 bp, Homo sapiens
cagccccgcgtggaactcgtgtct

SEQ ID NO: 1795992 - DNA, 17 bp, Homo sapiens
cagccctcatcccgagc

SEQ ID NO: 1795993 - DNA, 20 bp, Homo sapiens
cagccgctgagcgaggagat

SEQ ID NO: 1795994 - DNA, 20 bp, Homo sapiens
cagcctcccctgccagggca

SEQ ID NO: 1795995 - DNA, 22 bp, Homo sapiens
cagcctcccctgccagggcagg

SEQ ID NO: 1795996 - DNA, 23 bp, Homo sapiens
cagcctctccactcatgtgactc

SEQ ID NO: 1795997 - DNA, 24 bp, Homo sapiens
cagcctctccactcatgtgactct

SEQ ID NO: 1795998 - DNA, 15 bp, Homo sapiens
cagcgtcctcctctg

SEQ ID NO: 1795999 - DNA, 18 bp, Homo sapiens
cagcgtcctcctctgtga

SEQ ID NO: 1796000 - DNA, 19 bp, Homo sapiens
cagcgtgctttaaaaaata

SEQ ID NO: 1796001 - DNA, 12 bp, Homo sapiens
cagctaaagcaa

SEQ ID NO: 1796002 - DNA, 19 bp, Homo sapiens
cagctaaagcaatatgcat

SEQ ID NO: 1796003 - DNA, 21 bp, Homo sapiens
cagctatgttatattgaaaaa

SEQ ID NO: 1796004 - DNA, 14 bp, Homo sapiens
cagctccttcctgg

SEQ ID NO: 1796005 - DNA, 21 bp, Homo sapiens
cagctgtttatgcatagataa

SEQ ID NO: 1796006 - DNA, 15 bp, Homo sapiens
caggaaaggaatcat

SEQ ID NO: 1796007 - DNA, 21 bp, Homo sapiens
caggaaatgaaaatgtcttgt

SEQ ID NO: 1796008 - DNA, 21 bp, Homo sapiens
caggaccagtcaacctgggca

SEQ ID NO: 1796009 - DNA, 17 bp, Homo sapiens
caggacctgtggccaag

SEQ ID NO: 1796010 - DNA, 22 bp, Homo sapiens
caggcactgagataccagcgag

SEQ ID NO: 1796011 - DNA, 19 bp, Homo sapiens
caggcattgccaagggctt

SEQ ID NO: 1796012 - DNA, 12 bp, Homo sapiens
caggccagaaaa

SEQ ID NO: 1796013 - DNA, 13 bp, Homo sapiens
cagggaaggatcc

SEQ ID NO: 1796014 - DNA, 14 bp, Homo sapiens
cagggctaccctga

SEQ ID NO: 1796015 - DNA, 16 bp, Homo sapiens
cagggctaccctgagc

SEQ ID NO: 1796016 - DNA, 18 bp, Homo sapiens
cagggctaccctgagctg

SEQ ID NO: 1796017 - DNA, 24 bp, Homo sapiens
cagggctaccctgagctgaggcag

SEQ ID NO: 1796018 - DNA, 14 bp, Homo sapiens
caggggtctgagcc

SEQ ID NO: 1796019 - DNA, 19 bp, Homo sapiens
cagggttgaccccagagga

SEQ ID NO: 1796020 - DNA, 19 bp, Homo sapiens
caggtggggagactgggct

SEQ ID NO: 1796021 - DNA, 23 bp, Homo sapiens
cagtataattgagttttcagtgg

SEQ ID NO: 1796022 - DNA, 15 bp, Homo sapiens
cagtcaacctgggca

SEQ ID NO: 1796023 - DNA, 22 bp, Homo sapiens
cagtcaacctgggcaaagccta

SEQ ID NO: 1796024 - DNA, 22 bp, Homo sapiens
cagtcctgatcagagccgtggt

SEQ ID NO: 1796025 - DNA, 18 bp, Homo sapiens
cagtctgagagaggccat

SEQ ID NO: 1796026 - DNA, 17 bp, Homo sapiens
cagtcttccatttgcaa

SEQ ID NO: 1796027 - DNA, 18 bp, Homo sapiens
cagtcttccatttgcaag

SEQ ID NO: 1796028 - DNA, 21 bp, Homo sapiens
cagtcttccatttgcaaggga

SEQ ID NO: 1796029 - DNA, 17 bp, Homo sapiens
cagtgaatgattcagtg

SEQ ID NO: 1796030 - DNA, 20 bp, Homo sapiens
cagtgaatgattcagtgtta

SEQ ID NO: 1796031 - DNA, 23 bp, Homo sapiens
cagtgacctgccctacatatcta

SEQ ID NO: 1796032 - DNA, 16 bp, Homo sapiens
cagtgtgaggccaggg

SEQ ID NO: 1796033 - DNA, 19 bp, Homo sapiens
cagttaaaaaaaattttaa

SEQ ID NO: 1796034 - DNA, 14 bp, Homo sapiens
cataacaattcctc

SEQ ID NO: 1796035 - DNA, 17 bp, Homo sapiens
cataacaattcctctac

SEQ ID NO: 1796036 - DNA, 15 bp, Homo sapiens
cataagtatttcaaa

SEQ ID NO: 1796037 - DNA, 17 bp, Homo sapiens
catacagaggtaactat

SEQ ID NO: 1796038 - DNA, 15 bp, Homo sapiens
catcaacaaaaattg

SEQ ID NO: 1796039 - DNA, 16 bp, Homo sapiens
catcattctctgtctc

SEQ ID NO: 1796040 - DNA, 17 bp, Homo sapiens
catcattctctgtctca

SEQ ID NO: 1796041 - DNA, 14 bp, Homo sapiens
catccatcatcatg

SEQ ID NO: 1796042 - DNA, 18 bp, Homo sapiens
catctaacctcatcttct

SEQ ID NO: 1796043 - DNA, 17 bp, Homo sapiens
catctcccagataatgt

SEQ ID NO: 1796044 - DNA, 16 bp, Homo sapiens
catctcctgccttcct

SEQ ID NO: 1796045 - DNA, 18 bp, Homo sapiens
catctgtccctccgggac

SEQ ID NO: 1796046 - DNA, 14 bp, Homo sapiens
catcttcttcacca

SEQ ID NO: 1796047 - DNA, 19 bp, Homo sapiens
catcttcttcaccatttgg

SEQ ID NO: 1796048 - DNA, 18 bp, Homo sapiens
catgaagattctttccca

SEQ ID NO: 1796049 - DNA, 17 bp, Homo sapiens
catggattccactgaaa

SEQ ID NO: 1796050 - DNA, 22 bp, Homo sapiens
catgggagccgggtctgcctct

SEQ ID NO: 1796051 - DNA, 16 bp, Homo sapiens
catggtcagccctagg

SEQ ID NO: 1796052 - DNA, 21 bp, Homo sapiens
catggtgggtccatgggcaga

SEQ ID NO: 1796053 - DNA, 22 bp, Homo sapiens
catggtgggtccatgggcagag

SEQ ID NO: 1796054 - DNA, 15 bp, Homo sapiens
catgtaaactgtgca

SEQ ID NO: 1796055 - DNA, 12 bp, Homo sapiens
catgtgtgtcca

SEQ ID NO: 1796056 - DNA, 21 bp, Homo sapiens
catgtgtgtccacgactgtct

SEQ ID NO: 1796057 - DNA, 16 bp, Homo sapiens
catgtgttaagtattt

SEQ ID NO: 1796058 - DNA, 22 bp, Homo sapiens
cattatgttattggaattttct

SEQ ID NO: 1796059 - DNA, 21 bp, Homo sapiens
cattcctgggaaatattccct

SEQ ID NO: 1796060 - DNA, 23 bp, Homo sapiens
cattgaattcttggttgaggaaa

SEQ ID NO: 1796061 - DNA, 16 bp, Homo sapiens
cattggacccttccat

SEQ ID NO: 1796062 - DNA, 21 bp, Homo sapiens
cattgtccaatcctatgtttt

SEQ ID NO: 1796063 - DNA, 23 bp, Homo sapiens
catttagtttgattattcagtgt

SEQ ID NO: 1796064 - DNA, 20 bp, Homo sapiens
cattttaaaagcaattatat

SEQ ID NO: 1796065 - DNA, 20 bp, Homo sapiens
catttttgtacattatgtta

SEQ ID NO: 1796066 - DNA, 19 bp, Homo sapiens
ccaaagtggtatagaaatg

SEQ ID NO: 1796067 - DNA, 22 bp, Homo sapiens
ccaaagtggtatagaaatgctg

SEQ ID NO: 1796068 - DNA, 18 bp, Homo sapiens
ccaatacgtagatttttg

SEQ ID NO: 1796069 - DNA, 15 bp, Homo sapiens
ccaatgaaaaaatgt

SEQ ID NO: 1796070 - DNA, 16 bp, Homo sapiens
ccacagcctcccctgc

SEQ ID NO: 1796071 - DNA, 20 bp, Homo sapiens
ccacagcctcccctgccagg

SEQ ID NO: 1796072 - DNA, 23 bp, Homo sapiens
ccacgttctgctcatcattctct

SEQ ID NO: 1796073 - DNA, 13 bp, Homo sapiens
ccactcctctgac

SEQ ID NO: 1796074 - DNA, 13 bp, Homo sapiens
ccactgagggcag

SEQ ID NO: 1796075 - DNA, 22 bp, Homo sapiens
ccagaacatggattccactgaa

SEQ ID NO: 1796076 - DNA, 18 bp, Homo sapiens
ccagagaaaaagggaggg

SEQ ID NO: 1796077 - DNA, 17 bp, Homo sapiens
ccagaggaaggggccag

SEQ ID NO: 1796078 - DNA, 11 bp, Homo sapiens
ccagaggctcg

SEQ ID NO: 1796079 - DNA, 16 bp, Homo sapiens
ccagagtccctgcctg

SEQ ID NO: 1796080 - DNA, 18 bp, Homo sapiens
ccagagtccctgcctgga

SEQ ID NO: 1796081 - DNA, 22 bp, Homo sapiens
ccagagtccctgcctggaccag

SEQ ID NO: 1796082 - DNA, 18 bp, Homo sapiens
ccagcactgcttgaggaa

SEQ ID NO: 1796083 - DNA, 21 bp, Homo sapiens
ccagcatttcccttccttcct

SEQ ID NO: 1796084 - DNA, 13 bp, Homo sapiens
ccagccctcatcc

SEQ ID NO: 1796085 - DNA, 22 bp, Homo sapiens
gcattttaaaagcaattatatt

SEQ ID NO: 1796086 - DNA, 12 bp, Homo sapiens
gccaagttctta

SEQ ID NO: 1796087 - DNA, 13 bp, Homo sapiens
gccaattcctata

SEQ ID NO: 1796088 - DNA, 16 bp, Homo sapiens
gccacagcctcccctg

SEQ ID NO: 1796089 - DNA, 15 bp, Homo sapiens
gccacatgggaggct

SEQ ID NO: 1796090 - DNA, 14 bp, Homo sapiens
gccaccaagaggga

SEQ ID NO: 1796091 - DNA, 19 bp, Homo sapiens
gccaccaagagggacgcct

SEQ ID NO: 1796092 - DNA, 22 bp, Homo sapiens
gccaccaagagggacgcctggg

SEQ ID NO: 1796093 - DNA, 23 bp, Homo sapiens
gccacgtgtttgtgctgtggtgt

SEQ ID NO: 1796094 - DNA, 17 bp, Homo sapiens
gccactcctctgactca

SEQ ID NO: 1796095 - DNA, 23 bp, Homo sapiens
gccactcctctgactcagggctc

SEQ ID NO: 1796096 - DNA, 19 bp, Homo sapiens
gccagcgtcctcctctgtg

SEQ ID NO: 1796097 - DNA, 16 bp, Homo sapiens
gccagggcagagtgag

SEQ ID NO: 1796098 - DNA, 15 bp, Homo sapiens
gccatgtcttgttca

SEQ ID NO: 1796099 - DNA, 12 bp, Homo sapiens
gccattctttcc

SEQ ID NO: 1796100 - DNA, 14 bp, Homo sapiens
gcccacaaactgat

SEQ ID NO: 1796101 - DNA, 19 bp, Homo sapiens
gcccaggctggagtgcagt

SEQ ID NO: 1796102 - DNA, 20 bp, Homo sapiens
gccccagggggcggggtgca

SEQ ID NO: 1796103 - DNA, 14 bp, Homo sapiens
gccccatcagtgct

SEQ ID NO: 1796104 - DNA, 17 bp, Homo sapiens
gcccgggagctcaggaa

SEQ ID NO: 1796105 - DNA, 19 bp, Homo sapiens
gcccgggagctcaggaacc

SEQ ID NO: 1796106 - DNA, 14 bp, Homo sapiens
gccctgcaaaagga

SEQ ID NO: 1796107 - DNA, 23 bp, Homo sapiens
gccctggtggtggctcgggaggc

SEQ ID NO: 1796108 - DNA, 18 bp, Homo sapiens
gccctttgagtgcagtcc

SEQ ID NO: 1796109 - DNA, 21 bp, Homo sapiens
gccgagagtccatcagcctcc

SEQ ID NO: 1796110 - DNA, 17 bp, Homo sapiens
gccgctgagcgaggaga

SEQ ID NO: 1796111 - DNA, 19 bp, Homo sapiens
gcctcactattacttgaac

SEQ ID NO: 1796112 - DNA, 15 bp, Homo sapiens
gcctcccctgccagg

SEQ ID NO: 1796113 - DNA, 21 bp, Homo sapiens
gcctctccactcatgtgactc

SEQ ID NO: 1796114 - DNA, 14 bp, Homo sapiens
gcctcttctgggag

SEQ ID NO: 1796115 - DNA, 17 bp, Homo sapiens
gcctgggggtgccagga

SEQ ID NO: 1796116 - DNA, 19 bp, Homo sapiens
gccttattagagtgtcttt

SEQ ID NO: 1796117 - DNA, 17 bp, Homo sapiens
gccttcctcctgggccc

SEQ ID NO: 1796118 - DNA, 18 bp, Homo sapiens
gcctttggacttgtcccg

SEQ ID NO: 1796119 - DNA, 15 bp, Homo sapiens
gcgaggaggctccag

SEQ ID NO: 1796120 - DNA, 16 bp, Homo sapiens
gcgaggaggctccaga

SEQ ID NO: 1796121 - DNA, 13 bp, Homo sapiens
gcgaggtgtaaag

SEQ ID NO: 1796122 - DNA, 15 bp, Homo sapiens
gcgataacttaacaa

SEQ ID NO: 1796123 - DNA, 18 bp, Homo sapiens
gcgcggctgggaggaggg

SEQ ID NO: 1796124 - DNA, 13 bp, Homo sapiens
gcggctgggagga

SEQ ID NO: 1796125 - DNA, 14 bp, Homo sapiens
gcggctgggaggag

SEQ ID NO: 1796126 - DNA, 17 bp, Homo sapiens
gcggctgggaggagggc

SEQ ID NO: 1796127 - DNA, 18 bp, Homo sapiens
gcggctgggaggagggca

SEQ ID NO: 1796128 - DNA, 19 bp, Homo sapiens
gctaaagcaatatgcattt

SEQ ID NO: 1796129 - DNA, 12 bp, Homo sapiens
gctaccctgagc

SEQ ID NO: 1796130 - DNA, 18 bp, Homo sapiens
gctagggtggggagagac

SEQ ID NO: 1796131 - DNA, 16 bp, Homo sapiens
gctcacccccttctcc

SEQ ID NO: 1796132 - DNA, 22 bp, Homo sapiens
gctcacccccttctccatccac

SEQ ID NO: 1796133 - DNA, 15 bp, Homo sapiens
gctcaggtgcaagtg

SEQ ID NO: 1796134 - DNA, 19 bp, Homo sapiens
gctcatcattctctgtctc

SEQ ID NO: 1796135 - DNA, 20 bp, Homo sapiens
gctcatcattctctgtctca

SEQ ID NO: 1796136 - DNA, 12 bp, Homo sapiens
gctccagagggc

SEQ ID NO: 1796137 - DNA, 21 bp, Homo sapiens
gctccagagggcactctgctt

SEQ ID NO: 1796138 - DNA, 16 bp, Homo sapiens
gctccctgactgggag

SEQ ID NO: 1796139 - DNA, 18 bp, Homo sapiens
gctccctgactgggagtt

SEQ ID NO: 1796140 - DNA, 21 bp, Homo sapiens
gctccctgtaacctcttcaga

SEQ ID NO: 1796141 - DNA, 18 bp, Homo sapiens
gctcctcgagatcccaac

SEQ ID NO: 1796142 - DNA, 17 bp, Homo sapiens
gctccttaaggctcttt

SEQ ID NO: 1796143 - DNA, 17 bp, Homo sapiens
gctccttgggccctttg

SEQ ID NO: 1796144 - DNA, 16 bp, Homo sapiens
gctctgaaaccagtgt

SEQ ID NO: 1796145 - DNA, 23 bp, Homo sapiens
gctctgatccctctacagagctt

SEQ ID NO: 1796146 - DNA, 19 bp, Homo sapiens
gctctgtatcaggacccag

SEQ ID NO: 1796147 - DNA, 16 bp, Homo sapiens
gctgaacaatgaatgc

SEQ ID NO: 1796148 - DNA, 15 bp, Homo sapiens
gctgcctttggactt

SEQ ID NO: 1796149 - DNA, 20 bp, Homo sapiens
gctggagtgcagtggtgcga

SEQ ID NO: 1796150 - DNA, 14 bp, Homo sapiens
gctggtttttcagt

SEQ ID NO: 1796151 - DNA, 14 bp, Homo sapiens
gcttccctgactca

SEQ ID NO: 1796152 - DNA, 17 bp, Homo sapiens
gcttccttagccttgct

SEQ ID NO: 1796153 - DNA, 19 bp, Homo sapiens
gcttctagttctgccagga

SEQ ID NO: 1796154 - DNA, 21 bp, Homo sapiens
gcttctagttctgccaggaga

SEQ ID NO: 1796155 - DNA, 16 bp, Homo sapiens
gcttggagcagagggg

SEQ ID NO: 1796156 - DNA, 12 bp, Homo sapiens
gctttcatgtaa

SEQ ID NO: 1796157 - DNA, 23 bp, Homo sapiens
gctttgttttgcacactttgcca

SEQ ID NO: 1796158 - DNA, 14 bp, Homo sapiens
ggaaaagtgcaatg

SEQ ID NO: 1796159 - DNA, 12 bp, Homo sapiens
ggaaaattattt

SEQ ID NO: 1796160 - DNA, 22 bp, Homo sapiens
ggaaacaccgagtctctgtata

SEQ ID NO: 1796161 - DNA, 24 bp, Homo sapiens
ggaacccttacagtaggagcccag

SEQ ID NO: 1796162 - DNA, 20 bp, Homo sapiens
ggaaccgaggcagggaagga

SEQ ID NO: 1796163 - DNA, 17 bp, Homo sapiens
ggaaggatcccatgagc

SEQ ID NO: 1796164 - DNA, 15 bp, Homo sapiens
ggaaggggccagagg

SEQ ID NO: 1796165 - DNA, 17 bp, Homo sapiens
ggaaggggccagaggct

SEQ ID NO: 1796166 - DNA, 14 bp, Homo sapiens
ggacatcatgaagc

SEQ ID NO: 1796167 - DNA, 21 bp, Homo sapiens
ggacccagaggaaggggccag

SEQ ID NO: 1796168 - DNA, 17 bp, Homo sapiens
ggacctggtgctgcctc

SEQ ID NO: 1796169 - DNA, 20 bp, Homo sapiens
ggacgcctgggggtgccagg

SEQ ID NO: 1796170 - DNA, 17 bp, Homo sapiens
ggactctcagtctctga

SEQ ID NO: 1796171 - DNA, 21 bp, Homo sapiens
ggactctcagtctctgagcag

SEQ ID NO: 1796172 - DNA, 17 bp, Homo sapiens
ggagactgggctgaggg

SEQ ID NO: 1796173 - DNA, 17 bp, Homo sapiens
ggagagacgggccctgg

SEQ ID NO: 1796174 - DNA, 19 bp, Homo sapiens
ggagcaggggtctgagcca

SEQ ID NO: 1796175 - DNA, 16 bp, Homo sapiens
ggagccactcctctga

SEQ ID NO: 1796176 - DNA, 21 bp, Homo sapiens
ggagccactcctctgactcag

SEQ ID NO: 1796177 - DNA, 16 bp, Homo sapiens
ggagcccagctctgaa

SEQ ID NO: 1796178 - DNA, 17 bp, Homo sapiens
ggagccccattcctggg

SEQ ID NO: 1796179 - DNA, 16 bp, Homo sapiens
ggagccgggagcctga

SEQ ID NO: 1796180 - DNA, 14 bp, Homo sapiens
ggaggagggcaggc

SEQ ID NO: 1796181 - DNA, 15 bp, Homo sapiens
ggaggagggcaggca

SEQ ID NO: 1796182 - DNA, 20 bp, Homo sapiens
ggaggagggcaggcatcggg

SEQ ID NO: 1796183 - DNA, 15 bp, Homo sapiens
ggaggctccagaggg

SEQ ID NO: 1796184 - DNA, 13 bp, Homo sapiens
ggagggcagcagg

SEQ ID NO: 1796185 - DNA, 16 bp, Homo sapiens
ggagggcagcagggct

SEQ ID NO: 1796186 - DNA, 14 bp, Homo sapiens
ggagggggagaggg

SEQ ID NO: 1796187 - DNA, 17 bp, Homo sapiens
ggatctcattggaccct

SEQ ID NO: 1796188 - DNA, 21 bp, Homo sapiens
ggatgagaatttgagtgctct

SEQ ID NO: 1796189 - DNA, 13 bp, Homo sapiens
ggattgagtctgt

SEQ ID NO: 1796190 - DNA, 14 bp, Homo sapiens
ggatttttgtcttg

SEQ ID NO: 1796191 - DNA, 22 bp, Homo sapiens
tggactctcagtctctgagcag

SEQ ID NO: 1796192 - DNA, 18 bp, Homo sapiens
tggatctcattggaccct

SEQ ID NO: 1796193 - DNA, 22 bp, Homo sapiens
tggcacagcctggctgtggcct

SEQ ID NO: 1796194 - DNA, 23 bp, Homo sapiens
tgggagccgggtctgcctcttct

SEQ ID NO: 1796195 - DNA, 22 bp, Homo sapiens
tgggaggctcacccccttctcc

SEQ ID NO: 1796196 - DNA, 14 bp, Homo sapiens
tgggagggcagcag

SEQ ID NO: 1796197 - DNA, 19 bp, Homo sapiens
tgggagggcagcagggcta

SEQ ID NO: 1796198 - DNA, 22 bp, Homo sapiens
tgggagttgatcgcctttccca

SEQ ID NO: 1796199 - DNA, 15 bp, Homo sapiens
tgggcaaagcctagt

SEQ ID NO: 1796200 - DNA, 16 bp, Homo sapiens
tgggccctctctgctc

SEQ ID NO: 1796201 - DNA, 18 bp, Homo sapiens
tgggccctctctgctctg

SEQ ID NO: 1796202 - DNA, 19 bp, Homo sapiens
tgggctccctgactgggag

SEQ ID NO: 1796203 - DNA, 16 bp, Homo sapiens
tgggctgagggagcct

SEQ ID NO: 1796204 - DNA, 18 bp, Homo sapiens
tggggagtttagggtggg

SEQ ID NO: 1796205 - DNA, 14 bp, Homo sapiens
tgggtccatgggca

SEQ ID NO: 1796206 - DNA, 17 bp, Homo sapiens
tgggtccatgggcagag

SEQ ID NO: 1796207 - DNA, 14 bp, Homo sapiens
tgggtgtgtgttac

SEQ ID NO: 1796208 - DNA, 16 bp, Homo sapiens
tggtatagaaatgctg

SEQ ID NO: 1796209 - DNA, 12 bp, Homo sapiens
tggtccaggaga

SEQ ID NO: 1796210 - DNA, 12 bp, Homo sapiens
tggtcctttggg

SEQ ID NO: 1796211 - DNA, 16 bp, Homo sapiens
tggtgggtccatgggc

SEQ ID NO: 1796212 - DNA, 17 bp, Homo sapiens
tggtgggtccatgggca

SEQ ID NO: 1796213 - DNA, 18 bp, Homo sapiens
tggtgggtccatgggcag

SEQ ID NO: 1796214 - DNA, 18 bp, Homo sapiens
tggtgtgatcgtctgact

SEQ ID NO: 1796215 - DNA, 16 bp, Homo sapiens
tggtttttcagttttc

SEQ ID NO: 1796216 - DNA, 15 bp, Homo sapiens
tgtaaactgtgcacc

SEQ ID NO: 1796217 - DNA, 19 bp, Homo sapiens
tgtaacttttttttagaga

SEQ ID NO: 1796218 - DNA, 15 bp, Homo sapiens
tgtaatcttgaattg

SEQ ID NO: 1796219 - DNA, 12 bp, Homo sapiens
tgtacagtcttg

SEQ ID NO: 1796220 - DNA, 15 bp, Homo sapiens
tgtacagtcttgtat

SEQ ID NO: 1796221 - DNA, 12 bp, Homo sapiens
tgtacagttttt

SEQ ID NO: 1796222 - DNA, 15 bp, Homo sapiens
tgtacgttatatatt

SEQ ID NO: 1796223 - DNA, 20 bp, Homo sapiens
tgtagaaaagggaactgaac

SEQ ID NO: 1796224 - DNA, 21 bp, Homo sapiens
tgtagtgatttttatgccacc

SEQ ID NO: 1796225 - DNA, 14 bp, Homo sapiens
tgtataatctattt

SEQ ID NO: 1796226 - DNA, 21 bp, Homo sapiens
tgtattaagttgttaataaaa

SEQ ID NO: 1796227 - DNA, 13 bp, Homo sapiens
tgtattctctgag

SEQ ID NO: 1796228 - DNA, 21 bp, Homo sapiens
tgtattctctgagctgtgcag

SEQ ID NO: 1796229 - DNA, 14 bp, Homo sapiens
tgtattttgtattg

SEQ ID NO: 1796230 - DNA, 14 bp, Homo sapiens
tgtcacctgtgctt

SEQ ID NO: 1796231 - DNA, 19 bp, Homo sapiens
tgtccacgactgtctccat

SEQ ID NO: 1796232 - DNA, 17 bp, Homo sapiens
tgtctaggcaggacctg

SEQ ID NO: 1796233 - DNA, 19 bp, Homo sapiens
tgtctaggcaggacctgtg

SEQ ID NO: 1796234 - DNA, 11 bp, Homo sapiens
tgtctcatcca

SEQ ID NO: 1796235 - DNA, 16 bp, Homo sapiens
tgtctcatccatcatc

SEQ ID NO: 1796236 - DNA, 18 bp, Homo sapiens
tgtctcgtggtaggactg

SEQ ID NO: 1796237 - DNA, 19 bp, Homo sapiens
tgtctcgtggtaggactgt

SEQ ID NO: 1796238 - DNA, 20 bp, Homo sapiens
tgtctcgtggtaggactgta

SEQ ID NO: 1796239 - DNA, 18 bp, Homo sapiens
tgtcttgtgtttctttag

SEQ ID NO: 1796240 - DNA, 12 bp, Homo sapiens
tgtgacaacatt

SEQ ID NO: 1796241 - DNA, 13 bp, Homo sapiens
tgtgaggccaggg

SEQ ID NO: 1796242 - DNA, 14 bp, Homo sapiens
tgtgcaccagggtt

SEQ ID NO: 1796243 - DNA, 17 bp, Homo sapiens
tgtgcatgaaagagaaa

SEQ ID NO: 1796244 - DNA, 19 bp, Homo sapiens
tgtgccttgtcacgccaga

SEQ ID NO: 1796245 - DNA, 19 bp, Homo sapiens
tgtggcatccagagtccct

SEQ ID NO: 1796246 - DNA, 20 bp, Homo sapiens
tgtgtctaggcaggacctgt

SEQ ID NO: 1796247 - DNA, 22 bp, Homo sapiens
tgtgtgtccacgactgtctcca

SEQ ID NO: 1796248 - DNA, 22 bp, Homo sapiens
tgtgttgggattgagtctgtgc

SEQ ID NO: 1796249 - DNA, 16 bp, Homo sapiens
tgttacctgaaaacac

SEQ ID NO: 1796250 - DNA, 22 bp, Homo sapiens
tgttacctgaaaacactgtgca

SEQ ID NO: 1796251 - DNA, 15 bp, Homo sapiens
tgttactgcagtgac

SEQ ID NO: 1796252 - DNA, 17 bp, Homo sapiens
tgttattggaattttct

SEQ ID NO: 1796253 - DNA, 15 bp, Homo sapiens
tgttccccctgtgca

SEQ ID NO: 1796254 - DNA, 20 bp, Homo sapiens
tgttccccttccactgaggg

SEQ ID NO: 1796255 - DNA, 21 bp, Homo sapiens
tgttccccttccactgagggc

SEQ ID NO: 1796256 - DNA, 23 bp, Homo sapiens
tgttccccttccactgagggcag

SEQ ID NO: 1796257 - DNA, 16 bp, Homo sapiens
tgttcttaagacgtga

SEQ ID NO: 1796258 - DNA, 13 bp, Homo sapiens
tgttgctgtcaag

SEQ ID NO: 1796259 - DNA, 20 bp, Homo sapiens
tgttggatttttgtcttgtg

SEQ ID NO: 1796260 - DNA, 13 bp, Homo sapiens
tgtttgtgctgtg

SEQ ID NO: 1796261 - DNA, 18 bp, Homo sapiens
tgttttcttcatttctct

SEQ ID NO: 1796262 - DNA, 16 bp, Homo sapiens
ttaacctgaattattc

SEQ ID NO: 1796263 - DNA, 19 bp, Homo sapiens
ttaagacgtgaatgtctca

SEQ ID NO: 1796264 - DNA, 21 bp, Homo sapiens
ttaagccacttaaaatgttca

SEQ ID NO: 1796265 - DNA, 14 bp, Homo sapiens
ttaatgaagaaagt

SEQ ID NO: 1796266 - DNA, 18 bp, Homo sapiens
ttaatgaagaaagtggaa

SEQ ID NO: 1796267 - DNA, 17 bp, Homo sapiens
ttacacatttttcagat

SEQ ID NO: 1796268 - DNA, 19 bp, Homo sapiens
ttacagtaggagcccagct

SEQ ID NO: 1796269 - DNA, 22 bp, Homo sapiens
ttacattaaaatagcacatgat

SEQ ID NO: 1796270 - DNA, 16 bp, Homo sapiens
ttacattcatatctta

SEQ ID NO: 1796271 - DNA, 18 bp, Homo sapiens
ttaccctaaaacatgtgt

SEQ ID NO: 1796272 - DNA, 11 bp, Homo sapiens
ttacctcctga

SEQ ID NO: 1796273 - DNA, 19 bp, Homo sapiens
ttacctcctgagaaaaaag

SEQ ID NO: 1796274 - DNA, 18 bp, Homo sapiens
ttacctgaaaacactgtg

SEQ ID NO: 1796275 - DNA, 23 bp, Homo sapiens
ttactagggatccctcatctgtc

SEQ ID NO: 1796276 - DNA, 12 bp, Homo sapiens
ttactgcagtga

SEQ ID NO: 1796277 - DNA, 12 bp, Homo sapiens
ttacttgaactt

SEQ ID NO: 1796278 - DNA, 23 bp, Homo sapiens
ttagaaacaaatttttttcttgt

SEQ ID NO: 1796279 - DNA, 16 bp, Homo sapiens
ttagagtgtctttcca

SEQ ID NO: 1796280 - DNA, 20 bp, Homo sapiens
ttagatgttctaagtctttc

SEQ ID NO: 1796281 - DNA, 12 bp, Homo sapiens
ttagtaacatgt

SEQ ID NO: 1796282 - DNA, 18 bp, Homo sapiens
ttagtttttgtgaagttt

SEQ ID NO: 1796283 - DNA, 21 bp, Homo sapiens
ttagtttttgtgaagtttaat

SEQ ID NO: 1796284 - DNA, 14 bp, Homo sapiens
ttatgcatagataa

SEQ ID NO: 1796285 - DNA, 16 bp, Homo sapiens
ttatgttattggaatt

SEQ ID NO: 1796286 - DNA, 21 bp, Homo sapiens
ttattagagattacctcctga

SEQ ID NO: 1796287 - DNA, 19 bp, Homo sapiens
ttattggaattttctttca

SEQ ID NO: 1796288 - DNA, 12 bp, Homo sapiens
ttattgtacttg

SEQ ID NO: 1796289 - DNA, 21 bp, Homo sapiens
ttcaaagccagcgtcctcctc

SEQ ID NO: 1796290 - DNA, 23 bp, Homo sapiens
ttcaaagccagcgtcctcctctg

SEQ ID NO: 1796291 - DNA, 15 bp, Homo sapiens
ttcagatataaaaga

SEQ ID NO: 1796292 - DNA, 22 bp, Homo sapiens
ttcagtgttaaatgtgatgaat

SEQ ID NO: 1796293 - DNA, 12 bp, Homo sapiens
ttcagttttcag

SEQ ID NO: 1796294 - DNA, 17 bp, Homo sapiens
ttcataagtatttcaaa

SEQ ID NO: 1796295 - DNA, 12 bp, Homo sapiens
ttcataatttca

SEQ ID NO: 1796296 - DNA, 20 bp, Homo sapiens
ttcatatcttaaaaattaaa

SEQ ID NO: 1796297 - DNA, 14 bp, Homo sapiens
aataaagtgaatac

SEQ ID NO: 1796298 - DNA, 21 bp, Homo sapiens
aatacagtcttccatttgcaa

SEQ ID NO: 1796299 - DNA, 23 bp, Homo sapiens
aatacatgacatttatttttcat

SEQ ID NO: 1796300 - DNA, 11 bp, Homo sapiens
aatacttttgc

SEQ ID NO: 1796301 - DNA, 14 bp, Homo sapiens
aatatagagatatt

SEQ ID NO: 1796302 - DNA, 21 bp, Homo sapiens
aatatagagatatttttgtac

SEQ ID NO: 1796303 - DNA, 19 bp, Homo sapiens
aatcatttctatttctcct

SEQ ID NO: 1796304 - DNA, 16 bp, Homo sapiens
aatctctccattcccg

SEQ ID NO: 1796305 - DNA, 16 bp, Homo sapiens
aatgatccccagctgt

SEQ ID NO: 1796306 - DNA, 22 bp, Homo sapiens
aatgatccccagctgtttatgc

SEQ ID NO: 1796307 - DNA, 14 bp, Homo sapiens
aatgattcagtgtt

SEQ ID NO: 1796308 - DNA, 23 bp, Homo sapiens
aatgcgtgttgtacatacagagg

SEQ ID NO: 1796309 - DNA, 19 bp, Homo sapiens
aatggtccaggagaaggcc

SEQ ID NO: 1796310 - DNA, 20 bp, Homo sapiens
aatgtctcagcgaggtgtaa

SEQ ID NO: 1796311 - DNA, 20 bp, Homo sapiens
aatgtcttgatgcatgcact

SEQ ID NO: 1796312 - DNA, 23 bp, Homo sapiens
aatgtgagtgacctcacttctgg

SEQ ID NO: 1796313 - DNA, 17 bp, Homo sapiens
aatgtgagtgtgtttgt

SEQ ID NO: 1796314 - DNA, 13 bp, Homo sapiens
aattaatatatta

SEQ ID NO: 1796315 - DNA, 15 bp, Homo sapiens
aattcggtgtgcacc

SEQ ID NO: 1796316 - DNA, 17 bp, Homo sapiens
aattgagttttcagtgg

SEQ ID NO: 1796317 - DNA, 15 bp, Homo sapiens
aattgctaattctga

SEQ ID NO: 1796318 - DNA, 14 bp, Homo sapiens
aattgtaactgttc

SEQ ID NO: 1796319 - DNA, 16 bp, Homo sapiens
aattgtcccttaaaca

SEQ ID NO: 1796320 - DNA, 18 bp, Homo sapiens
aattgtcccttaaacaaa

SEQ ID NO: 1796321 - DNA, 17 bp, Homo sapiens
aatttcagttctagttg

SEQ ID NO: 1796322 - DNA, 13 bp, Homo sapiens
aggcattgccaag

SEQ ID NO: 1796323 - DNA, 21 bp, Homo sapiens
aggcattgccaagggctttgt

SEQ ID NO: 1796324 - DNA, 13 bp, Homo sapiens
aggccagggcaga

SEQ ID NO: 1796325 - DNA, 14 bp, Homo sapiens
aggccattctttcc

SEQ ID NO: 1796326 - DNA, 15 bp, Homo sapiens
aggccctcgctgcca

SEQ ID NO: 1796327 - DNA, 17 bp, Homo sapiens
aggccctcgctgccagc

SEQ ID NO: 1796328 - DNA, 14 bp, Homo sapiens
aggctagggtgggg

SEQ ID NO: 1796329 - DNA, 15 bp, Homo sapiens
aggctagggtgggga

SEQ ID NO: 1796330 - DNA, 19 bp, Homo sapiens
aggctcacccccttctcca

SEQ ID NO: 1796331 - DNA, 23 bp, Homo sapiens
aggctcacccccttctccatcca

SEQ ID NO: 1796332 - DNA, 18 bp, Homo sapiens
aggctcagagggtgtcct

SEQ ID NO: 1796333 - DNA, 19 bp, Homo sapiens
aggctcagagggtgtcctg

SEQ ID NO: 1796334 - DNA, 23 bp, Homo sapiens
aggcttaaggagaggagaaactg

SEQ ID NO: 1796335 - DNA, 22 bp, Homo sapiens
agggaaggatcccatgagctcc

SEQ ID NO: 1796336 - DNA, 13 bp, Homo sapiens
agggacgcctggg

SEQ ID NO: 1796337 - DNA, 15 bp, Homo sapiens
agggacgcctggggg

SEQ ID NO: 1796338 - DNA, 12 bp, Homo sapiens
agggcagggccc

SEQ ID NO: 1796339 - DNA, 19 bp, Homo sapiens
actgataacgtattttgat

SEQ ID NO: 1796340 - DNA, 13 bp, Homo sapiens
actgatttctcac

SEQ ID NO: 1796341 - DNA, 19 bp, Homo sapiens
actgcaacttctacctccg

SEQ ID NO: 1796342 - DNA, 10 bp, Homo sapiens
actgcaggga

SEQ ID NO: 1796343 - DNA, 14 bp, Homo sapiens
actgggctgaggga

SEQ ID NO: 1796344 - DNA, 23 bp, Homo sapiens
actgtagaaaagggaactgaaca

SEQ ID NO: 1796345 - DNA, 21 bp, Homo sapiens
actgtattttgtattgtttca

SEQ ID NO: 1796346 - DNA, 22 bp, Homo sapiens
actgtctccatggccctgcaaa

SEQ ID NO: 1796347 - DNA, 19 bp, Homo sapiens
actgtgcacatctgtgtct

SEQ ID NO: 1796348 - DNA, 18 bp, Homo sapiens
actgtgcaccaagcagga

SEQ ID NO: 1796349 - DNA, 16 bp, Homo sapiens
actgttccccctgtgc

SEQ ID NO: 1796350 - DNA, 17 bp, Homo sapiens
acttataattttcctaa

SEQ ID NO: 1796351 - DNA, 15 bp, Homo sapiens
acttatttatataaa

SEQ ID NO: 1796352 - DNA, 17 bp, Homo sapiens
acttcaaatatagagat

SEQ ID NO: 1796353 - DNA, 14 bp, Homo sapiens
actttccaaaacct

SEQ ID NO: 1796354 - DNA, 19 bp, Homo sapiens
acttttggcatgaaagtgc

SEQ ID NO: 1796355 - DNA, 13 bp, Homo sapiens
acttttgtgttac

SEQ ID NO: 1796356 - DNA, 18 bp, Homo sapiens
agaaaagaaagctgcttt

SEQ ID NO: 1796357 - DNA, 15 bp, Homo sapiens
agaaactgcagggaa

SEQ ID NO: 1796358 - DNA, 15 bp, Homo sapiens
agaacaatgtgctat

SEQ ID NO: 1796359 - DNA, 19 bp, Homo sapiens
agaagaatccgagtgtttg

SEQ ID NO: 1796360 - DNA, 21 bp, Homo sapiens
cctgtgcagccgctgagcgag

SEQ ID NO: 1796361 - DNA, 22 bp, Homo sapiens
cctgtgcttcgggcccttccca

SEQ ID NO: 1796362 - DNA, 21 bp, Homo sapiens
cctgtgtggaagaaggaaaca

SEQ ID NO: 1796363 - DNA, 20 bp, Homo sapiens
ccttaaacaaaaattaaaat

SEQ ID NO: 1796364 - DNA, 13 bp, Homo sapiens
ccttaaggctctt

SEQ ID NO: 1796365 - DNA, 18 bp, Homo sapiens
ccttaaggctcttttgta

SEQ ID NO: 1796366 - DNA, 17 bp, Homo sapiens
ccttacagtaggagccc

SEQ ID NO: 1796367 - DNA, 21 bp, Homo sapiens
ggtgtcctgcaccggggcctg

SEQ ID NO: 1796368 - DNA, 15 bp, Homo sapiens
ggtgtgatcgtctga

SEQ ID NO: 1796369 - DNA, 17 bp, Homo sapiens
ggtgtgcaccagggttg

SEQ ID NO: 1796370 - DNA, 13 bp, Homo sapiens
ggtgtgtgttaca

SEQ ID NO: 1796371 - DNA, 15 bp, Homo sapiens
ggttccgcttggagc

SEQ ID NO: 1796372 - DNA, 22 bp, Homo sapiens
ggttccgcttggagcagagggg

SEQ ID NO: 1796373 - DNA, 15 bp, Homo sapiens
ggttgaccccagagg

SEQ ID NO: 1796374 - DNA, 17 bp, Homo sapiens
ggttttgtattctctga

SEQ ID NO: 1796375 - DNA, 18 bp, Homo sapiens
ggttttgtattctctgag

SEQ ID NO: 1796376 - DNA, 19 bp, Homo sapiens
ggttttgtattctctgagc

SEQ ID NO: 1796377 - DNA, 20 bp, Homo sapiens
gtaacctcttcagaggccct

SEQ ID NO: 1796378 - DNA, 19 bp, Homo sapiens
gtaactatcaatatttaag

SEQ ID NO: 1796379 - DNA, 23 bp, Homo sapiens
gtaattagtaacatgtgttaagt

SEQ ID NO: 1796380 - DNA, 12 bp, Homo sapiens
gtacagttttta

SEQ ID NO: 1796381 - DNA, 15 bp, Homo sapiens
gtactcaaatgtagc

SEQ ID NO: 1796382 - DNA, 23 bp, Homo sapiens
gtacttttgtgttactgcagtga

SEQ ID NO: 1796383 - DNA, 19 bp, Homo sapiens
gtagatttttgctcttctg

SEQ ID NO: 1796384 - DNA, 15 bp, Homo sapiens
gtaggactgtagaaa

SEQ ID NO: 1796385 - DNA, 18 bp, Homo sapiens
gtaggagcccagctctga

SEQ ID NO: 1796386 - DNA, 18 bp, Homo sapiens
gtagttaattttattcca

SEQ ID NO: 1796387 - DNA, 15 bp, Homo sapiens
gtatagaaatgctgg

SEQ ID NO: 1796388 - DNA, 23 bp, Homo sapiens
gtatagaaatgctggtttttcag

SEQ ID NO: 1796389 - DNA, 15 bp, Homo sapiens
gtataggataaatta

SEQ ID NO: 1796390 - DNA, 18 bp, Homo sapiens
gtatcaggacccagagga

SEQ ID NO: 1796391 - DNA, 22 bp, Homo sapiens
gtattaagttgttaataaaagt

SEQ ID NO: 1796392 - DNA, 13 bp, Homo sapiens
gtattctctgagc

SEQ ID NO: 1796393 - DNA, 13 bp, Homo sapiens
gtatttcaaattg

SEQ ID NO: 1796394 - DNA, 14 bp, Homo sapiens
gtcaacctgggcaa

SEQ ID NO: 1796395 - DNA, 16 bp, Homo sapiens
gtcagacgcctgagga

SEQ ID NO: 1796396 - DNA, 17 bp, Homo sapiens
gtcagacgcctgaggaa

SEQ ID NO: 1796397 - DNA, 16 bp, Homo sapiens
gtcagtaccttcaaac

SEQ ID NO: 1796398 - DNA, 15 bp, Homo sapiens
gtcatttatattttc

SEQ ID NO: 1796399 - DNA, 12 bp, Homo sapiens
gtccaatcctat

SEQ ID NO: 1796400 - DNA, 17 bp, Homo sapiens
gtccaatcctatgtttt

SEQ ID NO: 1796401 - DNA, 20 bp, Homo sapiens
gtccacaaaataaccaatcc

SEQ ID NO: 1796402 - DNA, 13 bp, Homo sapiens
gtccatgggcaga

SEQ ID NO: 1796403 - DNA, 18 bp, Homo sapiens
gtccatgggcagagccca

SEQ ID NO: 1796404 - DNA, 16 bp, Homo sapiens
gtccattgtccaatcc

SEQ ID NO: 1796405 - DNA, 21 bp, Homo sapiens
gtccccctctgtccaggcact

SEQ ID NO: 1796406 - DNA, 22 bp, Homo sapiens
gtccctgcctggaccagcctct

SEQ ID NO: 1796407 - DNA, 14 bp, Homo sapiens
gtcctcctctgtga

SEQ ID NO: 1796408 - DNA, 15 bp, Homo sapiens
gtcctgatcagagcc

SEQ ID NO: 1796409 - DNA, 16 bp, Homo sapiens
gtctcatccatcatca

SEQ ID NO: 1796410 - DNA, 14 bp, Homo sapiens
gtctccatggccct

SEQ ID NO: 1796411 - DNA, 12 bp, Homo sapiens
gtctccctcctc

SEQ ID NO: 1796412 - DNA, 19 bp, Homo sapiens
gtctcgtggtaggactgta

SEQ ID NO: 1796413 - DNA, 11 bp, Homo sapiens
gtctgcctctt

SEQ ID NO: 1796414 - DNA, 20 bp, Homo sapiens
gtctttccattggatctcat

SEQ ID NO: 1796415 - DNA, 17 bp, Homo sapiens
gtgaaaatggtccagga

SEQ ID NO: 1796416 - DNA, 14 bp, Homo sapiens
gtgaaggcttctct

SEQ ID NO: 1796417 - DNA, 16 bp, Homo sapiens
gtgaatcacgtaaagc

SEQ ID NO: 1796418 - DNA, 17 bp, Homo sapiens
gtgaggccagggcagag

SEQ ID NO: 1796419 - DNA, 18 bp, Homo sapiens
gtgagtgtgactttttga

SEQ ID NO: 1796420 - DNA, 16 bp, Homo sapiens
gtgattttgctgtaga

SEQ ID NO: 1796421 - DNA, 17 bp, Homo sapiens
gtgatttttatgccacc

SEQ ID NO: 1796422 - DNA, 20 bp, Homo sapiens
gtgatttttatgccacctga

SEQ ID NO: 1796423 - DNA, 21 bp, Homo sapiens
gtgcaatgcgtgttgtacata

SEQ ID NO: 1796424 - DNA, 18 bp, Homo sapiens
gtgcacatctgtgtcttg

SEQ ID NO: 1796425 - DNA, 18 bp, Homo sapiens
gtgcagccgctgagcgag

SEQ ID NO: 1796426 - DNA, 16 bp, Homo sapiens
gtgccaggaccagtca

SEQ ID NO: 1796427 - DNA, 21 bp, Homo sapiens
gtgcttctagttctgccagga

SEQ ID NO: 1796428 - DNA, 16 bp, Homo sapiens
gtggctcgggaggcga

SEQ ID NO: 1796429 - DNA, 18 bp, Homo sapiens
gtgggtccatgggcagag

SEQ ID NO: 1796430 - DNA, 22 bp, Homo sapiens
gtgggtccatgggcagagccca

SEQ ID NO: 1796431 - DNA, 16 bp, Homo sapiens
gtgtacagtcttgtat

SEQ ID NO: 1796432 - DNA, 22 bp, Homo sapiens
gtgtacagtcttgtattaagtt

SEQ ID NO: 1796433 - DNA, 14 bp, Homo sapiens
gtgtcacctgtgct

SEQ ID NO: 1796434 - DNA, 21 bp, Homo sapiens
gtgtcctgcaccggggcctgg

SEQ ID NO: 1796435 - DNA, 14 bp, Homo sapiens
gtgtgaggccaggg

SEQ ID NO: 1796436 - DNA, 20 bp, Homo sapiens
gtgtgtccacgactgtctcc

SEQ ID NO: 1796437 - DNA, 16 bp, Homo sapiens
gtgttacctgaaaaca

SEQ ID NO: 1796438 - DNA, 15 bp, Homo sapiens
gtgttactgcagtga

SEQ ID NO: 1796439 - DNA, 18 bp, Homo sapiens
gtgttccccttccactga

SEQ ID NO: 1796440 - DNA, 19 bp, Homo sapiens
gtgttccccttccactgag

SEQ ID NO: 1796441 - DNA, 23 bp, Homo sapiens
gtgttccccttccactgagggca

SEQ ID NO: 1796442 - DNA, 13 bp, Homo sapiens
gtgtttctttagt

SEQ ID NO: 1796443 - DNA, 16 bp, Homo sapiens
gtgtttctttagtttt

SEQ ID NO: 1796444 - DNA, 20 bp, Homo sapiens
gttaaaggaagtttgttcac

SEQ ID NO: 1796445 - DNA, 22 bp, Homo sapiens
gttacctgaaaacactgtgcac

SEQ ID NO: 1796446 - DNA, 13 bp, Homo sapiens
gttactgcagtga

SEQ ID NO: 1796447 - DNA, 14 bp, Homo sapiens
gttataaagataca

SEQ ID NO: 1796448 - DNA, 17 bp, Homo sapiens
gttatatattgtattaa

SEQ ID NO: 1796449 - DNA, 23 bp, Homo sapiens
gttatatattgtattaagggcat

SEQ ID NO: 1796450 - DNA, 22 bp, Homo sapiens
gttattagagattacctcctga

SEQ ID NO: 1796451 - DNA, 16 bp, Homo sapiens
gttcgccgcgtggaat

SEQ ID NO: 1796452 - DNA, 16 bp, Homo sapiens
gttctaagtctttcca

SEQ ID NO: 1796453 - DNA, 17 bp, Homo sapiens
gttctaagtctttccat

SEQ ID NO: 1796454 - DNA, 13 bp, Homo sapiens
gttctgccaggag

SEQ ID NO: 1796455 - DNA, 15 bp, Homo sapiens
gttctgctcatcatt

SEQ ID NO: 1796456 - DNA, 19 bp, Homo sapiens
gttcttagttgctgtatgt

SEQ ID NO: 1796457 - DNA, 14 bp, Homo sapiens
gttgaccccagagg

SEQ ID NO: 1796458 - DNA, 15 bp, Homo sapiens
gttgaccccagagga

SEQ ID NO: 1796459 - DNA, 14 bp, Homo sapiens
gttggatttttgtc

SEQ ID NO: 1796460 - DNA, 17 bp, Homo sapiens
gttgtcctcagccccgc

SEQ ID NO: 1796461 - DNA, 17 bp, Homo sapiens
gtttcaattgcatctcc

SEQ ID NO: 1796462 - DNA, 22 bp, Homo sapiens
gtttcaattgcatctcccagat

SEQ ID NO: 1796463 - DNA, 16 bp, Homo sapiens
gtttctttagtttttg

SEQ ID NO: 1796464 - DNA, 15 bp, Homo sapiens
gttttgtattctctg

SEQ ID NO: 1796465 - DNA, 15 bp, Homo sapiens
gtttttgttcaaagc

SEQ ID NO: 1796466 - DNA, 13 bp, Homo sapiens
taaaagacttttt

SEQ ID NO: 1796467 - DNA, 18 bp, Homo sapiens
taaaatagcacatgattt

SEQ ID NO: 1796468 - DNA, 14 bp, Homo sapiens
taaaatctgtcacg

SEQ ID NO: 1796469 - DNA, 15 bp, Homo sapiens
taaagcaatatgcat

SEQ ID NO: 1796470 - DNA, 23 bp, Homo sapiens
taaagttctgtactcaaatgtag

SEQ ID NO: 1796471 - DNA, 22 bp, Homo sapiens
taaagttgttcgccgcgtggaa

SEQ ID NO: 1796472 - DNA, 20 bp, Homo sapiens
taaatacagtcttccatttg

SEQ ID NO: 1796473 - DNA, 11 bp, Homo sapiens
taaatatattt

SEQ ID NO: 1796474 - DNA, 14 bp, Homo sapiens
gccgggtctgcctc

SEQ ID NO: 1796475 - DNA, 21 bp, Homo sapiens
gccgggtctgcctcttctggg

SEQ ID NO: 1796476 - DNA, 16 bp, Homo sapiens
gccgtggtcctttggg

SEQ ID NO: 1796477 - DNA, 17 bp, Homo sapiens
gcctaacctgccgagag

SEQ ID NO: 1796478 - DNA, 23 bp, Homo sapiens
gcctagtgaaggcttctctctgt

SEQ ID NO: 1796479 - DNA, 18 bp, Homo sapiens
gcctcccctgccagggca

SEQ ID NO: 1796480 - DNA, 24 bp, Homo sapiens
gcctctccactcatgtgactcttt

SEQ ID NO: 1796481 - DNA, 10 bp, Homo sapiens
gcctgaggga

SEQ ID NO: 1796482 - DNA, 16 bp, Homo sapiens
gcctggaccagcctct

SEQ ID NO: 1796483 - DNA, 16 bp, Homo sapiens
gcctgggcaggaggga

SEQ ID NO: 1796484 - DNA, 21 bp, Homo sapiens
gcctgggggtgccaggaccag

SEQ ID NO: 1796485 - DNA, 13 bp, Homo sapiens
gccttcctcctgg

SEQ ID NO: 1796486 - DNA, 16 bp, Homo sapiens
gccttcctcctgggcc

SEQ ID NO: 1796487 - DNA, 15 bp, Homo sapiens
gccttgtcacgccag

SEQ ID NO: 1796488 - DNA, 18 bp, Homo sapiens
gcgaggaggctccagagg

SEQ ID NO: 1796489 - DNA, 18 bp, Homo sapiens
gcggagaccctgagtccg

SEQ ID NO: 1796490 - DNA, 14 bp, Homo sapiens
gcgtcctcctctgt

SEQ ID NO: 1796491 - DNA, 17 bp, Homo sapiens
gctaaagcaatatgcat

SEQ ID NO: 1796492 - DNA, 17 bp, Homo sapiens
gctacacccttttccag

SEQ ID NO: 1796493 - DNA, 16 bp, Homo sapiens
gctaccctgagctgag

SEQ ID NO: 1796494 - DNA, 21 bp, Homo sapiens
gctcagagggtgtcctgcacc

SEQ ID NO: 1796495 - DNA, 21 bp, Homo sapiens
gctcaggaaccgaggcaggga

SEQ ID NO: 1796496 - DNA, 18 bp, Homo sapiens
gctcatcattctctgtct

SEQ ID NO: 1796497 - DNA, 20 bp, Homo sapiens
gctccagagggcactctgct

SEQ ID NO: 1796498 - DNA, 11 bp, Homo sapiens
gctccttgggc

SEQ ID NO: 1796499 - DNA, 14 bp, Homo sapiens
gctccttgggccct

SEQ ID NO: 1796500 - DNA, 13 bp, Homo sapiens
gctctgatccctc

SEQ ID NO: 1796501 - DNA, 22 bp, Homo sapiens
gctctgatccctctacagagct

SEQ ID NO: 1796502 - DNA, 19 bp, Homo sapiens
gctcttctgtatgtgacaa

SEQ ID NO: 1796503 - DNA, 17 bp, Homo sapiens
gctgccagctctgtatc

SEQ ID NO: 1796504 - DNA, 18 bp, Homo sapiens
gctgccagctctgtatca

SEQ ID NO: 1796505 - DNA, 20 bp, Homo sapiens
gctgcctttggacttgtccc

SEQ ID NO: 1796506 - DNA, 22 bp, Homo sapiens
gctgctccccacgtcagctggg

SEQ ID NO: 1796507 - DNA, 20 bp, Homo sapiens
gctggatgagaatttgagtg

SEQ ID NO: 1796508 - DNA, 17 bp, Homo sapiens
gctgggaggagggcagg

SEQ ID NO: 1796509 - DNA, 15 bp, Homo sapiens
gctggtttttcagtt

SEQ ID NO: 1796510 - DNA, 19 bp, Homo sapiens
gctgtggcctaacctgccg

SEQ ID NO: 1796511 - DNA, 20 bp, Homo sapiens
gctgtggcctaacctgccga

SEQ ID NO: 1796512 - DNA, 21 bp, Homo sapiens
gcttaaggagaggagaaactg

SEQ ID NO: 1796513 - DNA, 23 bp, Homo sapiens
gcttaaggagaggagaaactgag

SEQ ID NO: 1796514 - DNA, 20 bp, Homo sapiens
gcttcgggcccttcccacag

SEQ ID NO: 1796515 - DNA, 20 bp, Homo sapiens
gcttgcagaaacctagaggg

SEQ ID NO: 1796516 - DNA, 18 bp, Homo sapiens
gcttggagcagaggggct

SEQ ID NO: 1796517 - DNA, 14 bp, Homo sapiens
gctttgttttgcac

SEQ ID NO: 1796518 - DNA, 16 bp, Homo sapiens
ggaaccgaggcaggga

SEQ ID NO: 1796519 - DNA, 21 bp, Homo sapiens
ggaattttctttcatacatta

SEQ ID NO: 1796520 - DNA, 23 bp, Homo sapiens
ggaattttctttcatacattata

SEQ ID NO: 1796521 - DNA, 16 bp, Homo sapiens
ggacaccccgactttt

SEQ ID NO: 1796522 - DNA, 22 bp, Homo sapiens
ggacagaaaagaaagctgcttt

SEQ ID NO: 1796523 - DNA, 14 bp, Homo sapiens
ggacatttctctaa

SEQ ID NO: 1796524 - DNA, 12 bp, Homo sapiens
ggaccagcctct

SEQ ID NO: 1796525 - DNA, 14 bp, Homo sapiens
ggacgcctgggggt

SEQ ID NO: 1796526 - DNA, 19 bp, Homo sapiens
ggacgcctgggggtgccag

SEQ ID NO: 1796527 - DNA, 13 bp, Homo sapiens
ggactccagttca

SEQ ID NO: 1796528 - DNA, 19 bp, Homo sapiens
ggagacaggttagctgctc

SEQ ID NO: 1796529 - DNA, 16 bp, Homo sapiens
ggagaccctgagtccg

SEQ ID NO: 1796530 - DNA, 13 bp, Homo sapiens
ggagactgggctg

SEQ ID NO: 1796531 - DNA, 20 bp, Homo sapiens
ggagactgggctgagggagc

SEQ ID NO: 1796532 - DNA, 22 bp, Homo sapiens
ggagagccaccaagagggacgc

SEQ ID NO: 1796533 - DNA, 12 bp, Homo sapiens
ggagcagagggg

SEQ ID NO: 1796534 - DNA, 19 bp, Homo sapiens
ggagccactcctctgactc

SEQ ID NO: 1796535 - DNA, 17 bp, Homo sapiens
ggagccgggtctgcctc

SEQ ID NO: 1796536 - DNA, 16 bp, Homo sapiens
ggaggctccagagggc

SEQ ID NO: 1796537 - DNA, 17 bp, Homo sapiens
ggagggcagcagggcta

SEQ ID NO: 1796538 - DNA, 19 bp, Homo sapiens
ggagggccacatgggaggc

SEQ ID NO: 1796539 - DNA, 23 bp, Homo sapiens
ggagggccacatgggaggctcac

SEQ ID NO: 1796540 - DNA, 20 bp, Homo sapiens
ggagtgttccccttccactg

SEQ ID NO: 1796541 - DNA, 17 bp, Homo sapiens
ggatcccatgagctcct

SEQ ID NO: 1796542 - DNA, 18 bp, Homo sapiens
ggatccctcatctgtccc

SEQ ID NO: 1796543 - DNA, 22 bp, Homo sapiens
ggatccctcatctgtccctccg

SEQ ID NO: 1796544 - DNA, 13 bp, Homo sapiens
ggcagcagggcta

SEQ ID NO: 1796545 - DNA, 21 bp, Homo sapiens
ggcagcagggctaccctgagc

SEQ ID NO: 1796546 - DNA, 13 bp, Homo sapiens
ggcagcagtgtga

SEQ ID NO: 1796547 - DNA, 22 bp, Homo sapiens
ggcagcagtgtgaggccagggc

SEQ ID NO: 1796548 - DNA, 23 bp, Homo sapiens
ggcaggcatcggggagccgggag

SEQ ID NO: 1796549 - DNA, 18 bp, Homo sapiens
ggcatccagagtccctgc

SEQ ID NO: 1796550 - DNA, 18 bp, Homo sapiens
ggccacatgggaggctca

SEQ ID NO: 1796551 - DNA, 15 bp, Homo sapiens
ggccctcgctgccag

SEQ ID NO: 1796552 - DNA, 19 bp, Homo sapiens
ggccctcgctgccagctct

SEQ ID NO: 1796553 - DNA, 22 bp, Homo sapiens
ggccctcgctgccagctctgta

SEQ ID NO: 1796554 - DNA, 14 bp, Homo sapiens
ggccctctctgctc

SEQ ID NO: 1796555 - DNA, 19 bp, Homo sapiens
ggccctgcaaaaggactct

SEQ ID NO: 1796556 - DNA, 13 bp, Homo sapiens
ggcctgggcagga

SEQ ID NO: 1796557 - DNA, 17 bp, Homo sapiens
ggcctgggcaggaggga

SEQ ID NO: 1796558 - DNA, 22 bp, Homo sapiens
ggctccagagggcactctgctt

SEQ ID NO: 1796559 - DNA, 16 bp, Homo sapiens
ggctgaatagcagaag

SEQ ID NO: 1796560 - DNA, 20 bp, Homo sapiens
ggctggagtgcagtggtgcg

SEQ ID NO: 1796561 - DNA, 23 bp, Homo sapiens
ggctgtggcatccagagtccctg

SEQ ID NO: 1796562 - DNA, 13 bp, Homo sapiens
gggagggcagcag

SEQ ID NO: 1796563 - DNA, 14 bp, Homo sapiens
gggagggggagagg

SEQ ID NO: 1796564 - DNA, 17 bp, Homo sapiens
gggcagtcattatccag

SEQ ID NO: 1796565 - DNA, 19 bp, Homo sapiens
gggcagtctgagagaggcc

SEQ ID NO: 1796566 - DNA, 20 bp, Homo sapiens
gggcagtctgagagaggcca

SEQ ID NO: 1796567 - DNA, 19 bp, Homo sapiens
gggccacatgggaggctca

SEQ ID NO: 1796568 - DNA, 21 bp, Homo sapiens
gggctaccctgagctgaggca

SEQ ID NO: 1796569 - DNA, 12 bp, Homo sapiens
gggctccctgac

SEQ ID NO: 1796570 - DNA, 18 bp, Homo sapiens
ggggagtttagggtgggg

SEQ ID NO: 1796571 - DNA, 18 bp, Homo sapiens
ggggcagtctgagagagg

SEQ ID NO: 1796572 - DNA, 13 bp, Homo sapiens
ggggccagaggct

SEQ ID NO: 1796573 - DNA, 17 bp, Homo sapiens
ggggccgggggcagtct

SEQ ID NO: 1796574 - DNA, 15 bp, Homo sapiens
ggggcctgggcagga

SEQ ID NO: 1796575 - DNA, 15 bp, Homo sapiens
gggggagagggctgc

SEQ ID NO: 1796576 - DNA, 17 bp, Homo sapiens
gggtgtcctgcaccggg

SEQ ID NO: 1796577 - DNA, 18 bp, Homo sapiens
gggttttgtattctctga

SEQ ID NO: 1796578 - DNA, 17 bp, Homo sapiens
ggtccatgggcagagcc

SEQ ID NO: 1796579 - DNA, 15 bp, Homo sapiens
tccatccacatggga

SEQ ID NO: 1796580 - DNA, 20 bp, Homo sapiens
tccatggccctgcaaaagga

SEQ ID NO: 1796581 - DNA, 18 bp, Homo sapiens
tccatgggagaaaataga

SEQ ID NO: 1796582 - DNA, 15 bp, Homo sapiens
tccatgggcagagcc

SEQ ID NO: 1796583 - DNA, 17 bp, Homo sapiens
tccatgggcagagccca

SEQ ID NO: 1796584 - DNA, 18 bp, Homo sapiens
tccatgggcagagcccaa

SEQ ID NO: 1796585 - DNA, 23 bp, Homo sapiens
tccatgggcagagcccaagggaa

SEQ ID NO: 1796586 - DNA, 16 bp, Homo sapiens
tccattggatctcatt

SEQ ID NO: 1796587 - DNA, 12 bp, Homo sapiens
tccatttgcaag

SEQ ID NO: 1796588 - DNA, 16 bp, Homo sapiens
tcccagataatgtgaa

SEQ ID NO: 1796589 - DNA, 14 bp, Homo sapiens
tccccagctgttta

SEQ ID NO: 1796590 - DNA, 15 bp, Homo sapiens
tccccctctgtccag

SEQ ID NO: 1796591 - DNA, 12 bp, Homo sapiens
tcccctgccagg

SEQ ID NO: 1796592 - DNA, 15 bp, Homo sapiens
tcccctgccagggca

SEQ ID NO: 1796593 - DNA, 20 bp, Homo sapiens
tcccctgccagggcagggcc

SEQ ID NO: 1796594 - DNA, 13 bp, Homo sapiens
tccccttccactg

SEQ ID NO: 1796595 - DNA, 18 bp, Homo sapiens
tccccttccactgagggc

SEQ ID NO: 1796596 - DNA, 23 bp, Homo sapiens
tcccgtggaacgtttttcctgtt

SEQ ID NO: 1796597 - DNA, 18 bp, Homo sapiens
tccctagaaacttccaaa

SEQ ID NO: 1796598 - DNA, 16 bp, Homo sapiens
tccctcatctgtccct

SEQ ID NO: 1796599 - DNA, 14 bp, Homo sapiens
tccctgactcattc

SEQ ID NO: 1796600 - DNA, 19 bp, Homo sapiens
tccctgactcattctgaag

SEQ ID NO: 1796601 - DNA, 14 bp, Homo sapiens
tccctgtaacctct

SEQ ID NO: 1796602 - DNA, 19 bp, Homo sapiens
tccctgtaacctcttcaga

SEQ ID NO: 1796603 - DNA, 22 bp, Homo sapiens
tcccttaaacaaaaattaaaat

SEQ ID NO: 1796604 - DNA, 14 bp, Homo sapiens
tcccttgggctccc

SEQ ID NO: 1796605 - DNA, 19 bp, Homo sapiens
tccggcggcgagctctggc

SEQ ID NO: 1796606 - DNA, 15 bp, Homo sapiens
tcctaccccctgtgc

SEQ ID NO: 1796607 - DNA, 18 bp, Homo sapiens
tcctatacgcagcgtgct

SEQ ID NO: 1796608 - DNA, 19 bp, Homo sapiens
tcctatacgcagcgtgctt

SEQ ID NO: 1796609 - DNA, 12 bp, Homo sapiens
tcctcaatccag

SEQ ID NO: 1796610 - DNA, 21 bp, Homo sapiens
tcctccacgttctgctcatca

SEQ ID NO: 1796611 - DNA, 23 bp, Homo sapiens
tcctccacgttctgctcatcatt

SEQ ID NO: 1796612 - DNA, 17 bp, Homo sapiens
tcctcccctattttaag

SEQ ID NO: 1796613 - DNA, 19 bp, Homo sapiens
tcctctactaacaatcagc

SEQ ID NO: 1796614 - DNA, 13 bp, Homo sapiens
tcctctcctgtct

SEQ ID NO: 1796615 - DNA, 15 bp, Homo sapiens
tcctctgactcaggg

SEQ ID NO: 1796616 - DNA, 22 bp, Homo sapiens
tcctctgcccgggagctcagga

SEQ ID NO: 1796617 - DNA, 19 bp, Homo sapiens
tcctctgtgaccaatgtct

SEQ ID NO: 1796618 - DNA, 20 bp, Homo sapiens
tcctctgtgaccaatgtctt

SEQ ID NO: 1796619 - DNA, 21 bp, Homo sapiens
tcctgcaccggggcctgggca

SEQ ID NO: 1796620 - DNA, 14 bp, Homo sapiens
tcctgccttcctcc

SEQ ID NO: 1796621 - DNA, 21 bp, Homo sapiens
tcctggacatgaagattcttt

SEQ ID NO: 1796622 - DNA, 22 bp, Homo sapiens
tcctggacatgaagattctttc

SEQ ID NO: 1796623 - DNA, 21 bp, Homo sapiens
tcctgggccctctctgctctg

SEQ ID NO: 1796624 - DNA, 20 bp, Homo sapiens
tcctgggttttgtattctct

SEQ ID NO: 1796625 - DNA, 22 bp, Homo sapiens
tcctgggttttgtattctctga

SEQ ID NO: 1796626 - DNA, 19 bp, Homo sapiens
tccttaaggctcttttgta

SEQ ID NO: 1796627 - DNA, 16 bp, Homo sapiens
tccttgggccctttga

SEQ ID NO: 1796628 - DNA, 23 bp, Homo sapiens
tcgagatcccaacactgccagca

SEQ ID NO: 1796629 - DNA, 19 bp, Homo sapiens
tcgctgccagctctgtatc

SEQ ID NO: 1796630 - DNA, 20 bp, Homo sapiens
tcgctgccagctctgtatca

SEQ ID NO: 1796631 - DNA, 23 bp, Homo sapiens
tcgctggactctcagtctctgag

SEQ ID NO: 1796632 - DNA, 15 bp, Homo sapiens
tcgtggtaggactgt

SEQ ID NO: 1796633 - DNA, 18 bp, Homo sapiens
tctaacctcatcttcttc

SEQ ID NO: 1796634 - DNA, 20 bp, Homo sapiens
tctaacctcatcttcttcac

SEQ ID NO: 1796635 - DNA, 14 bp, Homo sapiens
tctaagtctttcca

SEQ ID NO: 1796636 - DNA, 18 bp, Homo sapiens
tctacagagcttccctga

SEQ ID NO: 1796637 - DNA, 19 bp, Homo sapiens
tctactccatgcacatagt

SEQ ID NO: 1796638 - DNA, 17 bp, Homo sapiens
tctactgagacatgact

SEQ ID NO: 1796639 - DNA, 16 bp, Homo sapiens
tctagttctgccagga

SEQ ID NO: 1796640 - DNA, 17 bp, Homo sapiens
tctagttctgccaggag

SEQ ID NO: 1796641 - DNA, 13 bp, Homo sapiens
tctcatccatcat

SEQ ID NO: 1796642 - DNA, 14 bp, Homo sapiens
tctcatccatcatc

SEQ ID NO: 1796643 - DNA, 19 bp, Homo sapiens
tctcattggacccttccat

SEQ ID NO: 1796644 - DNA, 14 bp, Homo sapiens
tctccatggccctg

SEQ ID NO: 1796645 - DNA, 15 bp, Homo sapiens
tctccatggccctgc

SEQ ID NO: 1796646 - DNA, 16 bp, Homo sapiens
tctcctccatgggaga

SEQ ID NO: 1796647 - DNA, 20 bp, Homo sapiens
tctcctccatgggagaaaat

SEQ ID NO: 1796648 - DNA, 16 bp, Homo sapiens
tctcctgccttcctcc

SEQ ID NO: 1796649 - DNA, 18 bp, Homo sapiens
tctcctgccttcctcctg

SEQ ID NO: 1796650 - DNA, 20 bp, Homo sapiens
tctcctgccttcctcctggg

SEQ ID NO: 1796651 - DNA, 19 bp, Homo sapiens
tctcgtggtaggactgtag

SEQ ID NO: 1796652 - DNA, 22 bp, Homo sapiens
tctctgtataatctatttacat

SEQ ID NO: 1796653 - DNA, 23 bp, Homo sapiens
tctctgtctcatccatcatcatg

SEQ ID NO: 1796654 - DNA, 15 bp, Homo sapiens
tctgaaaccagtgtt

SEQ ID NO: 1796655 - DNA, 13 bp, Homo sapiens
tctgactcagggc

SEQ ID NO: 1796656 - DNA, 14 bp, Homo sapiens
tctgagagaggcca

SEQ ID NO: 1796657 - DNA, 18 bp, Homo sapiens
tctgagggaatttaacca

SEQ ID NO: 1796658 - DNA, 21 bp, Homo sapiens
tctgatccctctacagagctt

SEQ ID NO: 1796659 - DNA, 18 bp, Homo sapiens
tctgctcatcattctctg

SEQ ID NO: 1796660 - DNA, 19 bp, Homo sapiens
tctgcttgttattagagat

SEQ ID NO: 1796661 - DNA, 13 bp, Homo sapiens
tctgggagggcag

SEQ ID NO: 1796662 - DNA, 13 bp, Homo sapiens
tctgtctcatcca

SEQ ID NO: 1796663 - DNA, 15 bp, Homo sapiens
tcttcagaggccctc

SEQ ID NO: 1796664 - DNA, 22 bp, Homo sapiens
tcttctgggagggcagcagggc

SEQ ID NO: 1796665 - DNA, 14 bp, Homo sapiens
tcttcttcaccatt

SEQ ID NO: 1796666 - DNA, 16 bp, Homo sapiens
tcttgtattaagttgt

SEQ ID NO: 1796667 - DNA, 23 bp, Homo sapiens
tctttagttttattttaagaggg

SEQ ID NO: 1796668 - DNA, 23 bp, Homo sapiens
tctttcaaaaccttttgaaatta

SEQ ID NO: 1796669 - DNA, 15 bp, Homo sapiens
tctttcatacattat

SEQ ID NO: 1796670 - DNA, 19 bp, Homo sapiens
tctttcatacattatattc

SEQ ID NO: 1796671 - DNA, 19 bp, Homo sapiens
tctttccaaccggctttgt

SEQ ID NO: 1796672 - DNA, 23 bp, Homo sapiens
tctttccacggagccactcctct

SEQ ID NO: 1796673 - DNA, 13 bp, Homo sapiens
tgaaaatgtcttg

SEQ ID NO: 1796674 - DNA, 18 bp, Homo sapiens
tgaccaatattgtacagt

SEQ ID NO: 1796675 - DNA, 15 bp, Homo sapiens
tgacctcacttctgg

SEQ ID NO: 1796676 - DNA, 19 bp, Homo sapiens
tgacctgccctacatatct

SEQ ID NO: 1796677 - DNA, 17 bp, Homo sapiens
tgactacagtcaggaaa

SEQ ID NO: 1796678 - DNA, 13 bp, Homo sapiens
tgactcagggctc

SEQ ID NO: 1796679 - DNA, 14 bp, Homo sapiens
tgactcagggctcc

SEQ ID NO: 1796680 - DNA, 19 bp, Homo sapiens
tgactcagggctcctgggt

SEQ ID NO: 1796681 - DNA, 13 bp, Homo sapiens
tgactctttccaa

SEQ ID NO: 1796682 - DNA, 19 bp, Homo sapiens
tgactctttccaaccggct

SEQ ID NO: 1796683 - DNA, 17 bp, Homo sapiens
tgacttatttatataaa

SEQ ID NO: 1796684 - DNA, 14 bp, Homo sapiens
tgactttagaaaca

SEQ ID NO: 1796685 - DNA, 13 bp, Homo sapiens
tgagagaggccat

SEQ ID NO: 1796686 - DNA, 23 bp, Homo sapiens
tgagcgaggagatgctccttggg

SEQ ID NO: 1796687 - DNA, 21 bp, Homo sapiens
tgaggcagcagtgtgaggcca

SEQ ID NO: 1796688 - DNA, 16 bp, Homo sapiens
tgaggccagggcagag

SEQ ID NO: 1796689 - DNA, 18 bp, Homo sapiens
tgagtgacctcacttctg

SEQ ID NO: 1796690 - DNA, 13 bp, Homo sapiens
tgagtgctctgat

SEQ ID NO: 1796691 - DNA, 23 bp, Homo sapiens
tgatcagagccgtggtcctttgg

SEQ ID NO: 1796692 - DNA, 15 bp, Homo sapiens
tgatcgcctttccca

SEQ ID NO: 1796693 - DNA, 14 bp, Homo sapiens
tgatgaatactgta

SEQ ID NO: 1796694 - DNA, 17 bp, Homo sapiens
tgatgcatgcactgttc

SEQ ID NO: 1796695 - DNA, 18 bp, Homo sapiens
tgatgcatgcactgttcc

SEQ ID NO: 1796696 - DNA, 12 bp, Homo sapiens
tgattcagtgtt

SEQ ID NO: 1796697 - DNA, 21 bp, Homo sapiens
tgattcagtgttaaatgtgat

SEQ ID NO: 1796698 - DNA, 20 bp, Homo sapiens
tgatttcagcacctacagtg

SEQ ID NO: 1796699 - DNA, 14 bp, Homo sapiens
tgattttgctgtag

SEQ ID NO: 1796700 - DNA, 19 bp, Homo sapiens
tgcaaaaggactctcagga

SEQ ID NO: 1796701 - DNA, 19 bp, Homo sapiens
tgcaacctcgctggactct

SEQ ID NO: 1796702 - DNA, 20 bp, Homo sapiens
tgcaacctcgctggactctc

SEQ ID NO: 1796703 - DNA, 11 bp, Homo sapiens
tgcaagggaaa

SEQ ID NO: 1796704 - DNA, 22 bp, Homo sapiens
tgcaccaagcaggaaatgaaaa

SEQ ID NO: 1796705 - DNA, 16 bp, Homo sapiens
tgcaccggggcctggg

SEQ ID NO: 1796706 - DNA, 20 bp, Homo sapiens
tgcactgttccccctgtgca

SEQ ID NO: 1796707 - DNA, 20 bp, Homo sapiens
tgcagggaaaattatttgca

SEQ ID NO: 1796708 - DNA, 22 bp, Homo sapiens
tgcagggaaaattatttgcata

SEQ ID NO: 1796709 - DNA, 22 bp, Homo sapiens
tgcagtcctgatcagagccgtg

SEQ ID NO: 1796710 - DNA, 17 bp, Homo sapiens
tgcataacaattcctct

SEQ ID NO: 1796711 - DNA, 13 bp, Homo sapiens
tgcatctcccaga

SEQ ID NO: 1796712 - DNA, 22 bp, Homo sapiens
tgcatttaaatacagtcttcca

SEQ ID NO: 1796713 - DNA, 21 bp, Homo sapiens
tgccacagcctcccctgccag

SEQ ID NO: 1796714 - DNA, 22 bp, Homo sapiens
tgccagctctgtatcaggaccc

SEQ ID NO: 1796715 - DNA, 12 bp, Homo sapiens
tgccagggcagg

SEQ ID NO: 1796716 - DNA, 13 bp, Homo sapiens
tgccatcatctcc

SEQ ID NO: 1796717 - DNA, 15 bp, Homo sapiens
tgccatcatctcctg

SEQ ID NO: 1796718 - DNA, 23 bp, Homo sapiens
tgccatcatctcctgccttcctc

SEQ ID NO: 1796719 - DNA, 18 bp, Homo sapiens
tgccccatcagtgctccc

SEQ ID NO: 1796720 - DNA, 20 bp, Homo sapiens
tgccccatcagtgctccctc

SEQ ID NO: 1796721 - DNA, 22 bp, Homo sapiens
tgccgagagtccatcagcctcc

SEQ ID NO: 1796722 - DNA, 15 bp, Homo sapiens
tgcctctacctgaca

SEQ ID NO: 1796723 - DNA, 20 bp, Homo sapiens
tgcctcttctgggagggcag

SEQ ID NO: 1796724 - DNA, 19 bp, Homo sapiens
tgccttcctcctgggccct

SEQ ID NO: 1796725 - DNA, 17 bp, Homo sapiens
tgccttgtcacgccaga

SEQ ID NO: 1796726 - DNA, 20 bp, Homo sapiens
tgctcatcattctctgtctc

SEQ ID NO: 1796727 - DNA, 21 bp, Homo sapiens
tgctcatcattctctgtctca

SEQ ID NO: 1796728 - DNA, 23 bp, Homo sapiens
tgctcatcattctctgtctcatc

SEQ ID NO: 1796729 - DNA, 13 bp, Homo sapiens
tgctccccacgtc

SEQ ID NO: 1796730 - DNA, 14 bp, Homo sapiens
tgctccttgggccc

SEQ ID NO: 1796731 - DNA, 15 bp, Homo sapiens
tgctccttgggccct

SEQ ID NO: 1796732 - DNA, 16 bp, Homo sapiens
tgctccttgggccctt

SEQ ID NO: 1796733 - DNA, 18 bp, Homo sapiens
tgctccttgggccctttg

SEQ ID NO: 1796734 - DNA, 14 bp, Homo sapiens
tgctctgatccctc

SEQ ID NO: 1796735 - DNA, 19 bp, Homo sapiens
tgctctgatccctctacag

SEQ ID NO: 1796736 - DNA, 18 bp, Homo sapiens
tgctgccccatcagtgct

SEQ ID NO: 1796737 - DNA, 19 bp, Homo sapiens
tgctgccccatcagtgctc

SEQ ID NO: 1796738 - DNA, 21 bp, Homo sapiens
tgctgccccatcagtgctccc

SEQ ID NO: 1796739 - DNA, 15 bp, Homo sapiens
tgctggtttttcagt

SEQ ID NO: 1796740 - DNA, 23 bp, Homo sapiens
tgctgtggtgtgtccccctctgt

SEQ ID NO: 1796741 - DNA, 13 bp, Homo sapiens
tgcttcgggccct

SEQ ID NO: 1796742 - DNA, 12 bp, Homo sapiens
tgcttgaggaaa

SEQ ID NO: 1796743 - DNA, 16 bp, Homo sapiens
tgcttgaggaaaacaa

SEQ ID NO: 1796744 - DNA, 17 bp, Homo sapiens
tggaaaacaaggaagtc

SEQ ID NO: 1796745 - DNA, 20 bp, Homo sapiens
tggaattttctttcatacat

SEQ ID NO: 1796746 - DNA, 21 bp, Homo sapiens
tggaattttctttcatacatt

SEQ ID NO: 1796747 - DNA, 18 bp, Homo sapiens
tggacatgaagattcttt

SEQ ID NO: 1796748 - DNA, 21 bp, Homo sapiens
tggacatgaagattctttccc

SEQ ID NO: 1796749 - DNA, 22 bp, Homo sapiens
tggacatgaagattctttccca

SEQ ID NO: 1796750 - DNA, 22 bp, Homo sapiens
tggaccagcctctccactcatg

SEQ ID NO: 1796751 - DNA, 21 bp, Homo sapiens
tggagcttcatggcagaaggc

SEQ ID NO: 1796752 - DNA, 19 bp, Homo sapiens
tggagtgttccccttccac

SEQ ID NO: 1796753 - DNA, 22 bp, Homo sapiens
tggagtgttccccttccactga

SEQ ID NO: 1796754 - DNA, 17 bp, Homo sapiens
tggatttttgtcttgtg

SEQ ID NO: 1796755 - DNA, 19 bp, Homo sapiens
tggcaatgccatcatctcc

SEQ ID NO: 1796756 - DNA, 21 bp, Homo sapiens
tggcatccagagtccctgcct

SEQ ID NO: 1796757 - DNA, 15 bp, Homo sapiens
tggccctgcaaaagg

SEQ ID NO: 1796758 - DNA, 23 bp, Homo sapiens
tggcctaacctgccgagagtcca

SEQ ID NO: 1796759 - DNA, 18 bp, Homo sapiens
tgggagccgggtctgcct

SEQ ID NO: 1796760 - DNA, 17 bp, Homo sapiens
tgggaggagggcaggca

SEQ ID NO: 1796761 - DNA, 13 bp, Homo sapiens
tgggaggctcacc

SEQ ID NO: 1796762 - DNA, 18 bp, Homo sapiens
tgggagggcagcagggct

SEQ ID NO: 1796763 - DNA, 18 bp, Homo sapiens
tgggatggtggagggcca

SEQ ID NO: 1796764 - DNA, 13 bp, Homo sapiens
tgggcaggaggga

SEQ ID NO: 1796765 - DNA, 13 bp, Homo sapiens
tgggccctctctg

SEQ ID NO: 1796766 - DNA, 22 bp, Homo sapiens
ttccctagaaacttccaaatcc

SEQ ID NO: 1796767 - DNA, 19 bp, Homo sapiens
ttccgcttggagcagaggg

SEQ ID NO: 1796768 - DNA, 15 bp, Homo sapiens
ttcctcctgggccct

SEQ ID NO: 1796769 - DNA, 21 bp, Homo sapiens
ttcctcctgggccctctctgc

SEQ ID NO: 1796770 - DNA, 17 bp, Homo sapiens
ttcctgggaaatattcc

SEQ ID NO: 1796771 - DNA, 15 bp, Homo sapiens
ttctaagtctttcca

SEQ ID NO: 1796772 - DNA, 16 bp, Homo sapiens
ttctagttctgccagg

SEQ ID NO: 1796773 - DNA, 22 bp, Homo sapiens
ttctatgaattgctaattctga

SEQ ID NO: 1796774 - DNA, 19 bp, Homo sapiens
ttctatttctcctccatgg

SEQ ID NO: 1796775 - DNA, 20 bp, Homo sapiens
ttctccatccacatgggagc

SEQ ID NO: 1796776 - DNA, 24 bp, Homo sapiens
ttctctaagagaacaatgtgctat

SEQ ID NO: 1796777 - DNA, 16 bp, Homo sapiens
ttctctgagctgtgca

SEQ ID NO: 1796778 - DNA, 12 bp, Homo sapiens
ttctctgtctca

SEQ ID NO: 1796779 - DNA, 13 bp, Homo sapiens
ttctctgtctcat

SEQ ID NO: 1796780 - DNA, 12 bp, Homo sapiens
aaaaaaataata

SEQ ID NO: 1796781 - DNA, 12 bp, Homo sapiens
aaaaattaaaat

SEQ ID NO: 1796782 - DNA, 14 bp, Homo sapiens
aaaaccttttgaaa

SEQ ID NO: 1796783 - DNA, 13 bp, Homo sapiens
aaaagtgcaatgc

SEQ ID NO: 1796784 - DNA, 18 bp, Homo sapiens
aaaatgtcttgtgttacc

SEQ ID NO: 1796785 - DNA, 14 bp, Homo sapiens
aaaattatttgcat

SEQ ID NO: 1796786 - DNA, 14 bp, Homo sapiens
aaacaaaaatatct

SEQ ID NO: 1796787 - DNA, 19 bp, Homo sapiens
aaacaaaaattaaaatcct

SEQ ID NO: 1796788 - DNA, 16 bp, Homo sapiens
aaacaacaatttctac

SEQ ID NO: 1796789 - DNA, 19 bp, Homo sapiens
aaaccagtgttagggaagg

SEQ ID NO: 1796790 - DNA, 13 bp, Homo sapiens
aaaccttttgaaa

SEQ ID NO: 1796791 - DNA, 18 bp, Homo sapiens
aaactagggccaagccca

SEQ ID NO: 1796792 - DNA, 20 bp, Homo sapiens
aaactgaggccattatttca

SEQ ID NO: 1796793 - DNA, 17 bp, Homo sapiens
aaactgatttctcacgg

SEQ ID NO: 1796794 - DNA, 16 bp, Homo sapiens
aaagactaactaaaat

SEQ ID NO: 1796795 - DNA, 21 bp, Homo sapiens
aaagccagcgtcctcctctgt

SEQ ID NO: 1796796 - DNA, 18 bp, Homo sapiens
aaagcccaaagtggtata

SEQ ID NO: 1796797 - DNA, 13 bp, Homo sapiens
aaagctagaaatg

SEQ ID NO: 1796798 - DNA, 21 bp, Homo sapiens
aaagggaactgaacattccag

SEQ ID NO: 1796799 - DNA, 21 bp, Homo sapiens
aaagtaaaattaatatattaa

SEQ ID NO: 1796800 - DNA, 21 bp, Homo sapiens
aaagttctgtactcaaatgta

SEQ ID NO: 1796801 - DNA, 22 bp, Homo sapiens
aaatacagtcttccatttgcaa

SEQ ID NO: 1796802 - DNA, 23 bp, Homo sapiens
aaatacagtcttccatttgcaag

SEQ ID NO: 1796803 - DNA, 14 bp, Homo sapiens
aaatcagtcttgga

SEQ ID NO: 1796804 - DNA, 20 bp, Homo sapiens
aatgatccccagctgtttat

SEQ ID NO: 1796805 - DNA, 13 bp, Homo sapiens
aatgattcagtgt

SEQ ID NO: 1796806 - DNA, 21 bp, Homo sapiens
aatgattcagtgttaaatgtg

SEQ ID NO: 1796807 - DNA, 22 bp, Homo sapiens
aatgattcagtgttaaatgtga

SEQ ID NO: 1796808 - DNA, 15 bp, Homo sapiens
aatgccatcatctcc

SEQ ID NO: 1796809 - DNA, 18 bp, Homo sapiens
aatgctggtttttcagtt

SEQ ID NO: 1796810 - DNA, 14 bp, Homo sapiens
aatggtccaggaga

SEQ ID NO: 1796811 - DNA, 13 bp, Homo sapiens
aatgtatatgcac

SEQ ID NO: 1796812 - DNA, 12 bp, Homo sapiens
aatgtgatgaat

SEQ ID NO: 1796813 - DNA, 20 bp, Homo sapiens
aatgtgatgaatactgtatt

SEQ ID NO: 1796814 - DNA, 21 bp, Homo sapiens
aattcacatctaacctcatct

SEQ ID NO: 1796815 - DNA, 18 bp, Homo sapiens
aattcttggttgaggaaa

SEQ ID NO: 1796816 - DNA, 16 bp, Homo sapiens
aattgtaactgttctt

SEQ ID NO: 1796817 - DNA, 17 bp, Homo sapiens
aatttaaccagcaacat

SEQ ID NO: 1796818 - DNA, 18 bp, Homo sapiens
aatttgttattttgcaac

SEQ ID NO: 1796819 - DNA, 14 bp, Homo sapiens
acaaacatgaccct

SEQ ID NO: 1796820 - DNA, 17 bp, Homo sapiens
acaaactgatttctcac

SEQ ID NO: 1796821 - DNA, 15 bp, Homo sapiens
acaaagcaccctgta

SEQ ID NO: 1796822 - DNA, 20 bp, Homo sapiens
acaacatttttgtacattat

SEQ ID NO: 1796823 - DNA, 23 bp, Homo sapiens
acaattcctctactaacaatcag

SEQ ID NO: 1796824 - DNA, 23 bp, Homo sapiens
acacctaggctagggtggggaga

SEQ ID NO: 1796825 - DNA, 14 bp, Homo sapiens
acactcccttgggc

SEQ ID NO: 1796826 - DNA, 16 bp, Homo sapiens
acagagcttccctgac

SEQ ID NO: 1796827 - DNA, 20 bp, Homo sapiens
acagagttggtgttcataat

SEQ ID NO: 1796828 - DNA, 20 bp, Homo sapiens
acagatgtaaaagacttttt

SEQ ID NO: 1796829 - DNA, 17 bp, Homo sapiens
acagcctcccctgccag

SEQ ID NO: 1796830 - DNA, 18 bp, Homo sapiens
acagcctcccctgccagg

SEQ ID NO: 1796831 - DNA, 14 bp, Homo sapiens
acagtaggagccca

SEQ ID NO: 1796832 - DNA, 19 bp, Homo sapiens
acagtcttccatttgcaag

SEQ ID NO: 1796833 - DNA, 13 bp, Homo sapiens
acagtgtacagtc

SEQ ID NO: 1796834 - DNA, 15 bp, Homo sapiens
acagtgtacagtctt

SEQ ID NO: 1796835 - DNA, 17 bp, Homo sapiens
acatacatatatatatc

SEQ ID NO: 1796836 - DNA, 17 bp, Homo sapiens
acatctaacctcatctt

SEQ ID NO: 1796837 - DNA, 17 bp, Homo sapiens
acatgaagattctttcc

SEQ ID NO: 1796838 - DNA, 19 bp, Homo sapiens
acatgaccctaaatcttga

SEQ ID NO: 1796839 - DNA, 22 bp, Homo sapiens
acatgattttcttttgttttct

SEQ ID NO: 1796840 - DNA, 21 bp, Homo sapiens
acatgtcagtaccttcaaact

SEQ ID NO: 1796841 - DNA, 20 bp, Homo sapiens
acattaaaatagcacatgat

SEQ ID NO: 1796842 - DNA, 21 bp, Homo sapiens
acattaaaatagcacatgatt

SEQ ID NO: 1796843 - DNA, 13 bp, Homo sapiens
acattatgttatt

SEQ ID NO: 1796844 - DNA, 17 bp, Homo sapiens
acattatgttattggaa

SEQ ID NO: 1796845 - DNA, 13 bp, Homo sapiens
acattcatatctt

SEQ ID NO: 1796846 - DNA, 19 bp, Homo sapiens
acattgacccagaaatgta

SEQ ID NO: 1796847 - DNA, 18 bp, Homo sapiens
acatttttgtacattatg

SEQ ID NO: 1796848 - DNA, 15 bp, Homo sapiens
accaatattgtacag

SEQ ID NO: 1796849 - DNA, 18 bp, Homo sapiens
accaatattgtacagttt

SEQ ID NO: 1796850 - DNA, 14 bp, Homo sapiens
accaatgaaaaaat

SEQ ID NO: 1796851 - DNA, 14 bp, Homo sapiens
accagggcgcaagc

SEQ ID NO: 1796852 - DNA, 20 bp, Homo sapiens
accagggttgaccccagagg

SEQ ID NO: 1796853 - DNA, 21 bp, Homo sapiens
accagggttgaccccagagga

SEQ ID NO: 1796854 - DNA, 18 bp, Homo sapiens
accattgaattcttggtt

SEQ ID NO: 1796855 - DNA, 15 bp, Homo sapiens
acccagccctcatcc

SEQ ID NO: 1796856 - DNA, 16 bp, Homo sapiens
accctaaatcttgact

SEQ ID NO: 1796857 - DNA, 13 bp, Homo sapiens
accctcatctttc

SEQ ID NO: 1796858 - DNA, 14 bp, Homo sapiens
accctcatctttct

SEQ ID NO: 1796859 - DNA, 16 bp, Homo sapiens
accctcatctttcttc

SEQ ID NO: 1796860 - DNA, 17 bp, Homo sapiens
accctgagctgaggcag

SEQ ID NO: 1796861 - DNA, 13 bp, Homo sapiens
accggggcctggg

SEQ ID NO: 1796862 - DNA, 18 bp, Homo sapiens
acctacagtgtacagtct

SEQ ID NO: 1796863 - DNA, 11 bp, Homo sapiens
acctgaaaaca

SEQ ID NO: 1796864 - DNA, 16 bp, Homo sapiens
acctgccctacatatc

SEQ ID NO: 1796865 - DNA, 19 bp, Homo sapiens
acctgccctacatatctaa

SEQ ID NO: 1796866 - DNA, 16 bp, Homo sapiens
acctggtgctgcctct

SEQ ID NO: 1796867 - DNA, 18 bp, Homo sapiens
acctgtggccaagttctt

SEQ ID NO: 1796868 - DNA, 19 bp, Homo sapiens
accttcaaactagggccaa

SEQ ID NO: 1796869 - DNA, 17 bp, Homo sapiens
acgtaaagctagaaatg

SEQ ID NO: 1796870 - DNA, 14 bp, Homo sapiens
acgttatatattgt

SEQ ID NO: 1796871 - DNA, 15 bp, Homo sapiens
acgttatatattgta

SEQ ID NO: 1796872 - DNA, 18 bp, Homo sapiens
actatcaatatttaagtt

SEQ ID NO: 1796873 - DNA, 15 bp, Homo sapiens
actcattctgaagga

SEQ ID NO: 1796874 - DNA, 19 bp, Homo sapiens
actcattctgaaggagccc

SEQ ID NO: 1796875 - DNA, 14 bp, Homo sapiens
actcccttgggctc

SEQ ID NO: 1796876 - DNA, 22 bp, Homo sapiens
actcgtgtctggcacagcctgg

SEQ ID NO: 1796877 - DNA, 13 bp, Homo sapiens
actctcagtctct

SEQ ID NO: 1796878 - DNA, 18 bp, Homo sapiens
actctcagtctctgagca

SEQ ID NO: 1796879 - DNA, 13 bp, Homo sapiens
actctttcaaaac

SEQ ID NO: 1796880 - DNA, 13 bp, Homo sapiens
actctttgagaaa

SEQ ID NO: 1796881 - DNA, 18 bp, Homo sapiens
actctttgagaaacaaca

SEQ ID NO: 1796882 - DNA, 16 bp, Homo sapiens
actgaacattccagag

SEQ ID NO: 1796883 - DNA, 21 bp, Homo sapiens
actgaccaatattgtacagtt

SEQ ID NO: 1796884 - DNA, 15 bp, Homo sapiens
actgagaaatgaatg

SEQ ID NO: 1796885 - DNA, 15 bp, Homo sapiens
actgatcacaaaaac

SEQ ID NO: 1796886 - DNA, 23 bp, Homo sapiens
actgcagggaaaattatttgcat

SEQ ID NO: 1796887 - DNA, 15 bp, Homo sapiens
actgcttgaggaaaa

SEQ ID NO: 1796888 - DNA, 18 bp, Homo sapiens
actgcttgaggaaaacaa

SEQ ID NO: 1796889 - DNA, 13 bp, Homo sapiens
actgggctgaggg

SEQ ID NO: 1796890 - DNA, 21 bp, Homo sapiens
actggtgttatcaccgtgggc

SEQ ID NO: 1796891 - DNA, 20 bp, Homo sapiens
actgtgcacatctgtgtctt

SEQ ID NO: 1796892 - DNA, 13 bp, Homo sapiens
actgtgcagtgac

SEQ ID NO: 1796893 - DNA, 15 bp, Homo sapiens
actgttccccctgtg

SEQ ID NO: 1796894 - DNA, 13 bp, Homo sapiens
actgttcttgaat

SEQ ID NO: 1796895 - DNA, 15 bp, Homo sapiens
acttcaaatatagag

SEQ ID NO: 1796896 - DNA, 21 bp, Homo sapiens
acttccaaatcccctaagcag

SEQ ID NO: 1796897 - DNA, 15 bp, Homo sapiens
acttgttttatttaa

SEQ ID NO: 1796898 - DNA, 16 bp, Homo sapiens
acttttaaaactatat

SEQ ID NO: 1796899 - DNA, 12 bp, Homo sapiens
acttttgacaaa

SEQ ID NO: 1796900 - DNA, 14 bp, Homo sapiens
ctaccccctgtgcc

SEQ ID NO: 1796901 - DNA, 21 bp, Homo sapiens
ctaccttggttcccccactga

SEQ ID NO: 1796902 - DNA, 16 bp, Homo sapiens
ctactatggctgttta

SEQ ID NO: 1796903 - DNA, 21 bp, Homo sapiens
ctactgataacgtattttgat

SEQ ID NO: 1796904 - DNA, 14 bp, Homo sapiens
ctagaaacttccaa

SEQ ID NO: 1796905 - DNA, 23 bp, Homo sapiens
ctagaaatgatccccagctgttt

SEQ ID NO: 1796906 - DNA, 14 bp, Homo sapiens
ctagttctgccagg

SEQ ID NO: 1796907 - DNA, 15 bp, Homo sapiens
ctagttctgccagga

SEQ ID NO: 1796908 - DNA, 13 bp, Homo sapiens
ctatcaatattta

SEQ ID NO: 1796909 - DNA, 16 bp, Homo sapiens
ctattacttgaacttt

SEQ ID NO: 1796910 - DNA, 16 bp, Homo sapiens
ctatttctcctccatg

SEQ ID NO: 1796911 - DNA, 19 bp, Homo sapiens
ctcacccccttctccatcc

SEQ ID NO: 1796912 - DNA, 20 bp, Homo sapiens
ctcacccccttctccatcca

SEQ ID NO: 1796913 - DNA, 21 bp, Homo sapiens
ctcacccccttctccatccac

SEQ ID NO: 1796914 - DNA, 17 bp, Homo sapiens
ctcactataccagtata

SEQ ID NO: 1796915 - DNA, 20 bp, Homo sapiens
ctcactattacttgaacttt

SEQ ID NO: 1796916 - DNA, 17 bp, Homo sapiens
ctcagccccgcgtggaa

SEQ ID NO: 1796917 - DNA, 18 bp, Homo sapiens
ctcaggaaccgaggcagg

SEQ ID NO: 1796918 - DNA, 19 bp, Homo sapiens
ctcaggaaccgaggcaggg

SEQ ID NO: 1796919 - DNA, 20 bp, Homo sapiens
ctcagtctctgagcagtgaa

SEQ ID NO: 1796920 - DNA, 17 bp, Homo sapiens
ctcatcattctctgtct

SEQ ID NO: 1796921 - DNA, 14 bp, Homo sapiens
ctcatgtgactctt

SEQ ID NO: 1796922 - DNA, 13 bp, Homo sapiens
ctccacatcctcc

SEQ ID NO: 1796923 - DNA, 22 bp, Homo sapiens
ctccactcatgtgactctttcc

SEQ ID NO: 1796924 - DNA, 13 bp, Homo sapiens
ctccagagggcac

SEQ ID NO: 1796925 - DNA, 18 bp, Homo sapiens
ctccatcctaccccctgt

SEQ ID NO: 1796926 - DNA, 22 bp, Homo sapiens
ctccatcctaccccctgtgcct

SEQ ID NO: 1796927 - DNA, 19 bp, Homo sapiens
ctcccctattttaagacgt

SEQ ID NO: 1796928 - DNA, 15 bp, Homo sapiens
ctcccctgccagggc

SEQ ID NO: 1796929 - DNA, 16 bp, Homo sapiens
ctcccctgccagggca

SEQ ID NO: 1796930 - DNA, 21 bp, Homo sapiens
ctcccctgccagggcagggcc

SEQ ID NO: 1796931 - DNA, 19 bp, Homo sapiens
ctccctgtaacctcttcag

SEQ ID NO: 1796932 - DNA, 18 bp, Homo sapiens
ctcctctgactcagggct

SEQ ID NO: 1796933 - DNA, 22 bp, Homo sapiens
ctcctctgactcagggctcctg

SEQ ID NO: 1796934 - DNA, 24 bp, Homo sapiens
ctcctctgcccgggagctcaggaa

SEQ ID NO: 1796935 - DNA, 16 bp, Homo sapiens
ctcctgccttcctcct

SEQ ID NO: 1796936 - DNA, 14 bp, Homo sapiens
ctcctgggccctct

SEQ ID NO: 1796937 - DNA, 17 bp, Homo sapiens
ctcctgggccctctctg

SEQ ID NO: 1796938 - DNA, 19 bp, Homo sapiens
ctcctgggccctctctgct

SEQ ID NO: 1796939 - DNA, 22 bp, Homo sapiens
ctcctgggttttgtattctctg

SEQ ID NO: 1796940 - DNA, 23 bp, Homo sapiens
ctcctgggttttgtattctctga

SEQ ID NO: 1796941 - DNA, 12 bp, Homo sapiens
ctccttgggccc

SEQ ID NO: 1796942 - DNA, 23 bp, Homo sapiens
ctcgagatcccaacactgccagc

SEQ ID NO: 1796943 - DNA, 12 bp, Homo sapiens
ctcgctgccagc

SEQ ID NO: 1796944 - DNA, 15 bp, Homo sapiens
ctcgtggtaggactg

SEQ ID NO: 1796945 - DNA, 16 bp, Homo sapiens
ctcgtggtaggactgt

SEQ ID NO: 1796946 - DNA, 17 bp, Homo sapiens
ctcgtggtaggactgta

SEQ ID NO: 1796947 - DNA, 23 bp, Homo sapiens
ctcgttgactggctgtgtgttgg

SEQ ID NO: 1796948 - DNA, 20 bp, Homo sapiens
ctctacagagcttccctgac

SEQ ID NO: 1796949 - DNA, 22 bp, Homo sapiens
ctctacagagcttccctgactc

SEQ ID NO: 1796950 - DNA, 22 bp, Homo sapiens
ctctacctgacactcccttggg

SEQ ID NO: 1796951 - DNA, 13 bp, Homo sapiens
ctctcagtctctg

SEQ ID NO: 1796952 - DNA, 17 bp, Homo sapiens
ctctcagtctctgagca

SEQ ID NO: 1796953 - DNA, 17 bp, Homo sapiens
ctctcctgtctccctcc

SEQ ID NO: 1796954 - DNA, 12 bp, Homo sapiens
ctctgaaaccag

SEQ ID NO: 1796955 - DNA, 13 bp, Homo sapiens
ctctgagcagtga

SEQ ID NO: 1796956 - DNA, 14 bp, Homo sapiens
ctctgcccgggagc

SEQ ID NO: 1796957 - DNA, 22 bp, Homo sapiens
ctctgtataatctatttacata

SEQ ID NO: 1796958 - DNA, 14 bp, Homo sapiens
ctctgtccaggcac

SEQ ID NO: 1796959 - DNA, 19 bp, Homo sapiens
ctctgtccaggcactgaga

SEQ ID NO: 1796960 - DNA, 14 bp, Homo sapiens
ctctgtgaccaatg

SEQ ID NO: 1796961 - DNA, 18 bp, Homo sapiens
ctctgtgaccaatgtctt

SEQ ID NO: 1796962 - DNA, 19 bp, Homo sapiens
ctctgtgaccaatgtcttg

SEQ ID NO: 1796963 - DNA, 22 bp, Homo sapiens
ctctgttgcccaggctggagtg

SEQ ID NO: 1796964 - DNA, 22 bp, Homo sapiens
ctcttctgggagggcagcaggg

SEQ ID NO: 1796965 - DNA, 17 bp, Homo sapiens
ctgaaaacactgtgcac

SEQ ID NO: 1796966 - DNA, 14 bp, Homo sapiens
ctgaaaccagtgtt

SEQ ID NO: 1796967 - DNA, 17 bp, Homo sapiens
ctgaaatagagtgaatt

SEQ ID NO: 1796968 - DNA, 15 bp, Homo sapiens
ctgaacattccagag

SEQ ID NO: 1796969 - DNA, 18 bp, Homo sapiens
ctgacatttggagtgttc

SEQ ID NO: 1796970 - DNA, 21 bp, Homo sapiens
ctgaccaatattgtacagttt

SEQ ID NO: 1796971 - DNA, 18 bp, Homo sapiens
ctgaccctcatctttctt

SEQ ID NO: 1796972 - DNA, 22 bp, Homo sapiens
ctgagaaatgaatgctgagacc

SEQ ID NO: 1796973 - DNA, 18 bp, Homo sapiens
ctgagataccagcgagga

SEQ ID NO: 1796974 - DNA, 20 bp, Homo sapiens
ctgagcgaggagatgctcct

SEQ ID NO: 1796975 - DNA, 18 bp, Homo sapiens
ctgagctgaggcagcagt

SEQ ID NO: 1796976 - DNA, 18 bp, Homo sapiens
ctgaggccattatttcaa

SEQ ID NO: 1796977 - DNA, 16 bp, Homo sapiens
ctgagtccgggaggca

SEQ ID NO: 1796978 - DNA, 18 bp, Homo sapiens
ctgcaaaaggactctcag

SEQ ID NO: 1796979 - DNA, 14 bp, Homo sapiens
ctgcaccggggcct

SEQ ID NO: 1796980 - DNA, 18 bp, Homo sapiens
ctgcaccggggcctgggc

SEQ ID NO: 1796981 - DNA, 19 bp, Homo sapiens
ctgcaccggggcctgggca

SEQ ID NO: 1796982 - DNA, 23 bp, Homo sapiens
ctgcagggaaaattatttgcata

SEQ ID NO: 1796983 - DNA, 20 bp, Homo sapiens
ctgccagcatttcccttcct

SEQ ID NO: 1796984 - DNA, 11 bp, Homo sapiens
ctgccaggaga

SEQ ID NO: 1796985 - DNA, 18 bp, Homo sapiens
ctgcccgggagctcagga

SEQ ID NO: 1796986 - DNA, 16 bp, Homo sapiens
ctgccctacatatcta

SEQ ID NO: 1796987 - DNA, 22 bp, Homo sapiens
ctgccgagagtccatcagcctc

SEQ ID NO: 1796988 - DNA, 13 bp, Homo sapiens
ctgccttcctcct

SEQ ID NO: 1796989 - DNA, 14 bp, Homo sapiens
ctgccttcctcctg

SEQ ID NO: 1796990 - DNA, 15 bp, Homo sapiens
ctgccttcctcctgg

SEQ ID NO: 1796991 - DNA, 18 bp, Homo sapiens
ctgctcatcattctctgt

SEQ ID NO: 1796992 - DNA, 21 bp, Homo sapiens
ctgctctgcgtgtcacctgtg

SEQ ID NO: 1796993 - DNA, 22 bp, Homo sapiens
ctgctctgcgtgtcacctgtgc

SEQ ID NO: 1796994 - DNA, 17 bp, Homo sapiens
ctgctttcgaataaagt

SEQ ID NO: 1796995 - DNA, 18 bp, Homo sapiens
ctggaccagcctctccac

SEQ ID NO: 1796996 - DNA, 23 bp, Homo sapiens
ctggactctcagtctctgagcag

SEQ ID NO: 1796997 - DNA, 14 bp, Homo sapiens
ctggagtgcagtgg

SEQ ID NO: 1796998 - DNA, 14 bp, Homo sapiens
ctggcacagcctgg

SEQ ID NO: 1796999 - DNA, 16 bp, Homo sapiens
ctggcacagcctggct

SEQ ID NO: 1797000 - DNA, 23 bp, Homo sapiens
ctggcacagcctggctgtggcct

SEQ ID NO: 1797001 - DNA, 15 bp, Homo sapiens
ctgggagggcagcag

SEQ ID NO: 1797002 - DNA, 19 bp, Homo sapiens
ctgggagggcagcagggct

SEQ ID NO: 1797003 - DNA, 18 bp, Homo sapiens
gctctgtatcaggaccca

SEQ ID NO: 1797004 - DNA, 23 bp, Homo sapiens
gctgagcgaggagatgctccttg

SEQ ID NO: 1797005 - DNA, 13 bp, Homo sapiens
gctgaggcagcag

SEQ ID NO: 1797006 - DNA, 14 bp, Homo sapiens
gctgagggagcctg

SEQ ID NO: 1797007 - DNA, 14 bp, Homo sapiens
gctgccttgccatg

SEQ ID NO: 1797008 - DNA, 13 bp, Homo sapiens
gctgctccccacg

SEQ ID NO: 1797009 - DNA, 21 bp, Homo sapiens
gctgctttcgaataaagtgaa

SEQ ID NO: 1797010 - DNA, 21 bp, Homo sapiens
gctggactctcagtctctgag

SEQ ID NO: 1797011 - DNA, 22 bp, Homo sapiens
gctggactctcagtctctgagc

SEQ ID NO: 1797012 - DNA, 19 bp, Homo sapiens
gctgggaggagggcaggca

SEQ ID NO: 1797013 - DNA, 21 bp, Homo sapiens
gctgggaggagggcaggcatc

SEQ ID NO: 1797014 - DNA, 17 bp, Homo sapiens
gctgtattaagccactt

SEQ ID NO: 1797015 - DNA, 18 bp, Homo sapiens
gcttcgggcccttcccac

SEQ ID NO: 1797016 - DNA, 17 bp, Homo sapiens
gcttctagttctgccag

SEQ ID NO: 1797017 - DNA, 14 bp, Homo sapiens
gcttctctctgtgg

SEQ ID NO: 1797018 - DNA, 14 bp, Homo sapiens
gcttgttggatttt

SEQ ID NO: 1797019 - DNA, 15 bp, Homo sapiens
gctttcatgtaaact

SEQ ID NO: 1797020 - DNA, 20 bp, Homo sapiens
gctttcatgtaaactgtgca

SEQ ID NO: 1797021 - DNA, 18 bp, Homo sapiens
gcttttttttgagaatac

SEQ ID NO: 1797022 - DNA, 17 bp, Homo sapiens
ggaactcgtgtctggca

SEQ ID NO: 1797023 - DNA, 17 bp, Homo sapiens
ggaactgaacattccag

SEQ ID NO: 1797024 - DNA, 22 bp, Homo sapiens
ggaaggatcccatgagctcctt

SEQ ID NO: 1797025 - DNA, 16 bp, Homo sapiens
ggaagtaggaagtaaa

SEQ ID NO: 1797026 - DNA, 11 bp, Homo sapiens
ggaattttctt

SEQ ID NO: 1797027 - DNA, 18 bp, Homo sapiens
ggactctcagtctctgag

SEQ ID NO: 1797028 - DNA, 15 bp, Homo sapiens
ggagactgcccagct

SEQ ID NO: 1797029 - DNA, 23 bp, Homo sapiens
ggagactgggctgagggagcctg

SEQ ID NO: 1797030 - DNA, 15 bp, Homo sapiens
ggagatgctccttgg

SEQ ID NO: 1797031 - DNA, 16 bp, Homo sapiens
ggagccccattcctgg

SEQ ID NO: 1797032 - DNA, 18 bp, Homo sapiens
ggagccgggtctgcctct

SEQ ID NO: 1797033 - DNA, 18 bp, Homo sapiens
ggaggctccagagggcac

SEQ ID NO: 1797034 - DNA, 14 bp, Homo sapiens
ggagggcaggcatc

SEQ ID NO: 1797035 - DNA, 12 bp, Homo sapiens
ggagtgttcccc

SEQ ID NO: 1797036 - DNA, 23 bp, Homo sapiens
ggagttgatcgcctttcccaggt

SEQ ID NO: 1797037 - DNA, 14 bp, Homo sapiens
ggataaattacatt

SEQ ID NO: 1797038 - DNA, 15 bp, Homo sapiens
ggataaattacatta

SEQ ID NO: 1797039 - DNA, 20 bp, Homo sapiens
ggatcccatgagctccttaa

SEQ ID NO: 1797040 - DNA, 24 bp, Homo sapiens
ggatctcattggacccttccatgg

SEQ ID NO: 1797041 - DNA, 12 bp, Homo sapiens
ggcacagcctgg

SEQ ID NO: 1797042 - DNA, 12 bp, Homo sapiens
ggcagagcccaa

SEQ ID NO: 1797043 - DNA, 18 bp, Homo sapiens
ggcagcagggctaccctg

SEQ ID NO: 1797044 - DNA, 14 bp, Homo sapiens
ggcagcagtgtgag

SEQ ID NO: 1797045 - DNA, 19 bp, Homo sapiens
ggcagcagtgtgaggccag

SEQ ID NO: 1797046 - DNA, 16 bp, Homo sapiens
ggcagggccccaggca

SEQ ID NO: 1797047 - DNA, 12 bp, Homo sapiens
ggcaggggccgg

SEQ ID NO: 1797048 - DNA, 22 bp, Homo sapiens
ggcatcggggagccgggagcct

SEQ ID NO: 1797049 - DNA, 11 bp, Homo sapiens
ggccagaggct

SEQ ID NO: 1797050 - DNA, 13 bp, Homo sapiens
ggccagggcagag

SEQ ID NO: 1797051 - DNA, 20 bp, Homo sapiens
ggccattctttcccaacacc

SEQ ID NO: 1797052 - DNA, 22 bp, Homo sapiens
ggccccaggcattgccaagggc

SEQ ID NO: 1797053 - DNA, 16 bp, Homo sapiens
ggccctcgctgccagc

SEQ ID NO: 1797054 - DNA, 16 bp, Homo sapiens
ggcctaacctgccgag

SEQ ID NO: 1797055 - DNA, 16 bp, Homo sapiens
ggctagggtggggaga

SEQ ID NO: 1797056 - DNA, 20 bp, Homo sapiens
ggctcagagggtgtcctgca

SEQ ID NO: 1797057 - DNA, 13 bp, Homo sapiens
ggctccagagggc

SEQ ID NO: 1797058 - DNA, 17 bp, Homo sapiens
ggctccctgactgggag

SEQ ID NO: 1797059 - DNA, 18 bp, Homo sapiens
ggctccctgactgggagt

SEQ ID NO: 1797060 - DNA, 13 bp, Homo sapiens
ggctgggaggagg

SEQ ID NO: 1797061 - DNA, 21 bp, Homo sapiens
ggctgggaggagggcaggcat

SEQ ID NO: 1797062 - DNA, 21 bp, Homo sapiens
ggctgtggcatccagagtccc

SEQ ID NO: 1797063 - DNA, 16 bp, Homo sapiens
ggctgttgatattaaa

SEQ ID NO: 1797064 - DNA, 22 bp, Homo sapiens
gggaaaacaaaaatatcttgca

SEQ ID NO: 1797065 - DNA, 17 bp, Homo sapiens
gggaaaattatttgcat

SEQ ID NO: 1797066 - DNA, 20 bp, Homo sapiens
gggacagaaaagaaagctgc

SEQ ID NO: 1797067 - DNA, 21 bp, Homo sapiens
gggacgcctgggggtgccagg

SEQ ID NO: 1797068 - DNA, 22 bp, Homo sapiens
gggacgcctgggggtgccagga

SEQ ID NO: 1797069 - DNA, 16 bp, Homo sapiens
gggagactgggctgag

SEQ ID NO: 1797070 - DNA, 16 bp, Homo sapiens
gggaggagggcaggca

SEQ ID NO: 1797071 - DNA, 23 bp, Homo sapiens
gggaggtgcttctagttctgcca

SEQ ID NO: 1797072 - DNA, 16 bp, Homo sapiens
gggagtttagggtggg

SEQ ID NO: 1797073 - DNA, 17 bp, Homo sapiens
gggcagagtgagaccca

SEQ ID NO: 1797074 - DNA, 14 bp, Homo sapiens
gggcagcagggcta

SEQ ID NO: 1797075 - DNA, 17 bp, Homo sapiens
gggcagtctgagagagg

SEQ ID NO: 1797076 - DNA, 18 bp, Homo sapiens
gggcagtctgagagaggc

SEQ ID NO: 1797077 - DNA, 13 bp, Homo sapiens
gggccaagcccag

SEQ ID NO: 1797078 - DNA, 16 bp, Homo sapiens
gggccctctctgctct

SEQ ID NO: 1797079 - DNA, 13 bp, Homo sapiens
gggcctgggcagg

SEQ ID NO: 1797080 - DNA, 16 bp, Homo sapiens
gggcctgggcaggagg

SEQ ID NO: 1797081 - DNA, 13 bp, Homo sapiens
gggctaccctgag

SEQ ID NO: 1797082 - DNA, 16 bp, Homo sapiens
gggctaccctgagctg

SEQ ID NO: 1797083 - DNA, 22 bp, Homo sapiens
gggctaccctgagctgaggcag

SEQ ID NO: 1797084 - DNA, 14 bp, Homo sapiens
gggctccctgactg

SEQ ID NO: 1797085 - DNA, 18 bp, Homo sapiens
gggctccctgactgggag

SEQ ID NO: 1797086 - DNA, 13 bp, Homo sapiens
gggctgagggagc

SEQ ID NO: 1797087 - DNA, 18 bp, Homo sapiens
ggggagactgggctgagg

SEQ ID NO: 1797088 - DNA, 12 bp, Homo sapiens
ggggcctgggca

SEQ ID NO: 1797089 - DNA, 13 bp, Homo sapiens
gggtggggagaga

SEQ ID NO: 1797090 - DNA, 13 bp, Homo sapiens
ggtccatgggcag

SEQ ID NO: 1797091 - DNA, 23 bp, Homo sapiens
ggtctgcctcttctgggagggca

SEQ ID NO: 1797092 - DNA, 21 bp, Homo sapiens
ggtgcttctagttctgccagg

SEQ ID NO: 1797093 - DNA, 21 bp, Homo sapiens
ggtggggagagacgggccctg

SEQ ID NO: 1797094 - DNA, 10 bp, Homo sapiens
ggtgggtcca

SEQ ID NO: 1797095 - DNA, 14 bp, Homo sapiens
ggtgggtccatggg

SEQ ID NO: 1797096 - DNA, 17 bp, Homo sapiens
ggtgggtccatgggcag

SEQ ID NO: 1797097 - DNA, 15 bp, Homo sapiens
ggtggtggctcggga

SEQ ID NO: 1797098 - DNA, 16 bp, Homo sapiens
ggtgtgcaccagggtt

SEQ ID NO: 1797099 - DNA, 23 bp, Homo sapiens
ggtgtgtccccctctgtccaggc

SEQ ID NO: 1797100 - DNA, 16 bp, Homo sapiens
ggtgttcataatttca

SEQ ID NO: 1797101 - DNA, 16 bp, Homo sapiens
ggttgaccccagagga

SEQ ID NO: 1797102 - DNA, 24 bp, Homo sapiens
gtaaactgtgcaccaagcaggaaa

SEQ ID NO: 1797103 - DNA, 13 bp, Homo sapiens
gtaactgttcttg

SEQ ID NO: 1797104 - DNA, 21 bp, Homo sapiens
gtaaggaacggcccttttagt

SEQ ID NO: 1797105 - DNA, 15 bp, Homo sapiens
gtaattagtaacatg

SEQ ID NO: 1797106 - DNA, 18 bp, Homo sapiens
gtacgttatatattgtat

SEQ ID NO: 1797107 - DNA, 19 bp, Homo sapiens
gtagaaactgcagggaaaa

SEQ ID NO: 1797108 - DNA, 12 bp, Homo sapiens
gtagaagatggc

SEQ ID NO: 1797109 - DNA, 22 bp, Homo sapiens
gtatagaaatgctggtttttca

SEQ ID NO: 1797110 - DNA, 16 bp, Homo sapiens
gacttatttatataaa

SEQ ID NO: 1797111 - DNA, 13 bp, Homo sapiens
gagactgggctga

SEQ ID NO: 1797112 - DNA, 21 bp, Homo sapiens
gagactgggctgagggagcct

SEQ ID NO: 1797113 - DNA, 13 bp, Homo sapiens
gagagaggccatt

SEQ ID NO: 1797114 - DNA, 14 bp, Homo sapiens
gagcacctccacat

SEQ ID NO: 1797115 - DNA, 16 bp, Homo sapiens
gagcacttttaacaaa

SEQ ID NO: 1797116 - DNA, 15 bp, Homo sapiens
gagcagaggggctga

SEQ ID NO: 1797117 - DNA, 14 bp, Homo sapiens
gagccactcctctg

SEQ ID NO: 1797118 - DNA, 15 bp, Homo sapiens
gagccactcctctga

SEQ ID NO: 1797119 - DNA, 20 bp, Homo sapiens
gagccgggtctgcctcttct

SEQ ID NO: 1797120 - DNA, 22 bp, Homo sapiens
gagccgggtctgcctcttctgg

SEQ ID NO: 1797121 - DNA, 13 bp, Homo sapiens
gagccgtggtcct

SEQ ID NO: 1797122 - DNA, 21 bp, Homo sapiens
gagcctgaccctcatctttct

SEQ ID NO: 1797123 - DNA, 20 bp, Homo sapiens
gagctcaggaaccgaggcag

SEQ ID NO: 1797124 - DNA, 16 bp, Homo sapiens
gagctgaggcagcagt

SEQ ID NO: 1797125 - DNA, 16 bp, Homo sapiens
gagcttcatggcagaa

SEQ ID NO: 1797126 - DNA, 16 bp, Homo sapiens
gaggaaaagtgcaatg

SEQ ID NO: 1797127 - DNA, 13 bp, Homo sapiens
gaggagggcaggc

SEQ ID NO: 1797128 - DNA, 13 bp, Homo sapiens
gaggcagcagtgt

SEQ ID NO: 1797129 - DNA, 21 bp, Homo sapiens
gaggcagcagtgtgaggccag

SEQ ID NO: 1797130 - DNA, 15 bp, Homo sapiens
gagggacgcctgggg

SEQ ID NO: 1797131 - DNA, 16 bp, Homo sapiens
gagggacgcctggggg

SEQ ID NO: 1797132 - DNA, 12 bp, Homo sapiens
gagggcagcagg

SEQ ID NO: 1797133 - DNA, 16 bp, Homo sapiens
gagggccacatgggag

SEQ ID NO: 1797134 - DNA, 9 bp, Homo sapiens
gagggctgc

SEQ ID NO: 1797135 - DNA, 16 bp, Homo sapiens
gagggctgcctttgga

SEQ ID NO: 1797136 - DNA, 19 bp, Homo sapiens
gagtagaaactgcagggaa

SEQ ID NO: 1797137 - DNA, 14 bp, Homo sapiens
gagtccatcagcct

SEQ ID NO: 1797138 - DNA, 16 bp, Homo sapiens
gagtccctgcctggac

SEQ ID NO: 1797139 - DNA, 19 bp, Homo sapiens
gagtccctgcctggaccag

SEQ ID NO: 1797140 - DNA, 22 bp, Homo sapiens
gagtgagacccagccctcatcc

SEQ ID NO: 1797141 - DNA, 17 bp, Homo sapiens
gagtgcagtcctgatca

SEQ ID NO: 1797142 - DNA, 21 bp, Homo sapiens
gataaataacttttttttaag

SEQ ID NO: 1797143 - DNA, 22 bp, Homo sapiens
gataagagtagaaactgcaggg

SEQ ID NO: 1797144 - DNA, 12 bp, Homo sapiens
gatacagaatga

SEQ ID NO: 1797145 - DNA, 15 bp, Homo sapiens
gatacagaatgaatc

SEQ ID NO: 1797146 - DNA, 22 bp, Homo sapiens
gatatttttgtacgttatatat

SEQ ID NO: 1797147 - DNA, 16 bp, Homo sapiens
gatcccaacactgcca

SEQ ID NO: 1797148 - DNA, 19 bp, Homo sapiens
gatcccaacactgccagca

SEQ ID NO: 1797149 - DNA, 21 bp, Homo sapiens
gatggcacttataaccaaagc

SEQ ID NO: 1797150 - DNA, 20 bp, Homo sapiens
gatgggatggtggagggcca

SEQ ID NO: 1797151 - DNA, 16 bp, Homo sapiens
gattgctgccccatca

SEQ ID NO: 1797152 - DNA, 21 bp, Homo sapiens
gattgctgccccatcagtgct

SEQ ID NO: 1797153 - DNA, 16 bp, Homo sapiens
gcaattatattgtcct

SEQ ID NO: 1797154 - DNA, 14 bp, Homo sapiens
gcacactttgccat

SEQ ID NO: 1797155 - DNA, 17 bp, Homo sapiens
gcacatctgtgtcttgt

SEQ ID NO: 1797156 - DNA, 14 bp, Homo sapiens
gcacatgattttct

SEQ ID NO: 1797157 - DNA, 19 bp, Homo sapiens
gcacatgattttcttttgt

SEQ ID NO: 1797158 - DNA, 14 bp, Homo sapiens
gcaccggggcctgg

SEQ ID NO: 1797159 - DNA, 16 bp, Homo sapiens
gcaccggggcctgggc

SEQ ID NO: 1797160 - DNA, 19 bp, Homo sapiens
gcaccggggcctgggcagg

SEQ ID NO: 1797161 - DNA, 20 bp, Homo sapiens
gcaccggggcctgggcagga

SEQ ID NO: 1797162 - DNA, 19 bp, Homo sapiens
gcacctacagtgtacagtc

SEQ ID NO: 1797163 - DNA, 12 bp, Homo sapiens
gcagcagggcta

SEQ ID NO: 1797164 - DNA, 19 bp, Homo sapiens
gcagcagggctaccctgag

SEQ ID NO: 1797165 - DNA, 22 bp, Homo sapiens
gcagcagtgtgaggccagggca

SEQ ID NO: 1797166 - DNA, 23 bp, Homo sapiens
gcagcagtgtgaggccagggcag

SEQ ID NO: 1797167 - DNA, 17 bp, Homo sapiens
gcagggctaccctgagc

SEQ ID NO: 1797168 - DNA, 23 bp, Homo sapiens
gcagggctaccctgagctgaggc

SEQ ID NO: 1797169 - DNA, 17 bp, Homo sapiens
gcaggggtctgagccac

SEQ ID NO: 1797170 - DNA, 23 bp, Homo sapiens
gcatccagagtccctgcctggac

SEQ ID NO: 1797171 - DNA, 13 bp, Homo sapiens
gcatctcccagat

SEQ ID NO: 1797172 - DNA, 16 bp, Homo sapiens
gcatgcactgttcccc

SEQ ID NO: 1797173 - DNA, 17 bp, Homo sapiens
gcatgcactgttccccc

SEQ ID NO: 1797174 - DNA, 22 bp, Homo sapiens
gcatgcactgttccccctgtgc

SEQ ID NO: 1797175 - DNA, 16 bp, Homo sapiens
gccaagggctttgttt

SEQ ID NO: 1797176 - DNA, 16 bp, Homo sapiens
gccacctgaataaaga

SEQ ID NO: 1797177 - DNA, 21 bp, Homo sapiens
gccactcctctgactcagggc

SEQ ID NO: 1797178 - DNA, 22 bp, Homo sapiens
gccagcgtcctcctctgtgacc

SEQ ID NO: 1797179 - DNA, 19 bp, Homo sapiens
gccagggcagggccccagg

SEQ ID NO: 1797180 - DNA, 17 bp, Homo sapiens
gccatattttcaccatt

SEQ ID NO: 1797181 - DNA, 23 bp, Homo sapiens
gccatcatctcctgccttcctcc

SEQ ID NO: 1797182 - DNA, 19 bp, Homo sapiens
gcccaaagtggtatagaaa

SEQ ID NO: 1797183 - DNA, 21 bp, Homo sapiens
gcccagcactgcttgaggaaa

SEQ ID NO: 1797184 - DNA, 15 bp, Homo sapiens
gccccattcctggga

SEQ ID NO: 1797185 - DNA, 13 bp, Homo sapiens
gccccgcgtggaa

SEQ ID NO: 1797186 - DNA, 15 bp, Homo sapiens
gcccgggagctcagg

SEQ ID NO: 1797187 - DNA, 17 bp, Homo sapiens
gccctcgctgccagctc

SEQ ID NO: 1797188 - DNA, 15 bp, Homo sapiens
gccgctgagcgagga

SEQ ID NO: 1797189 - DNA, 13 bp, Homo sapiens
gccgggagcctga

SEQ ID NO: 1797190 - DNA, 19 bp, Homo sapiens
gccgggagcctgaccctca

SEQ ID NO: 1797191 - DNA, 17 bp, Homo sapiens
gcctcccctgccagggc

SEQ ID NO: 1797192 - DNA, 23 bp, Homo sapiens
gcctctacctgacactcccttgg

SEQ ID NO: 1797193 - DNA, 18 bp, Homo sapiens
gcctcttctgggagggca

SEQ ID NO: 1797194 - DNA, 22 bp, Homo sapiens
gcctgacatttggagtgttccc

SEQ ID NO: 1797195 - DNA, 16 bp, Homo sapiens
gcctggccccatggtc

SEQ ID NO: 1797196 - DNA, 16 bp, Homo sapiens
gcctgggggtgccagg

SEQ ID NO: 1797197 - DNA, 14 bp, Homo sapiens
gccttcctcctggg

SEQ ID NO: 1797198 - DNA, 22 bp, Homo sapiens
gccttcctcctgggccctctct

SEQ ID NO: 1797199 - DNA, 16 bp, Homo sapiens
gccttgtcacgccaga

SEQ ID NO: 1797200 - DNA, 17 bp, Homo sapiens
gcgaagcgttgtcctca

SEQ ID NO: 1797201 - DNA, 14 bp, Homo sapiens
gcgaggtgtaaagt

SEQ ID NO: 1797202 - DNA, 13 bp, Homo sapiens
gcggggtgcagaa

SEQ ID NO: 1797203 - DNA, 21 bp, Homo sapiens
gcgtggaactcgtgtctggca

SEQ ID NO: 1797204 - DNA, 14 bp, Homo sapiens
gctaccctgagctg

SEQ ID NO: 1797205 - DNA, 20 bp, Homo sapiens
gctaccctgagctgaggcag

SEQ ID NO: 1797206 - DNA, 20 bp, Homo sapiens
gctatctactgagacatgac

SEQ ID NO: 1797207 - DNA, 18 bp, Homo sapiens
gctcacccccttctccat

SEQ ID NO: 1797208 - DNA, 20 bp, Homo sapiens
gctcacccccttctccatcc

SEQ ID NO: 1797209 - DNA, 19 bp, Homo sapiens
gctcagagggtgtcctgca

SEQ ID NO: 1797210 - DNA, 16 bp, Homo sapiens
gctcaggaaccgaggc

SEQ ID NO: 1797211 - DNA, 19 bp, Homo sapiens
gctcaggaaccgaggcagg

SEQ ID NO: 1797212 - DNA, 20 bp, Homo sapiens
gctcaggaaccgaggcaggg

SEQ ID NO: 1797213 - DNA, 16 bp, Homo sapiens
gctcatcattctctgt

SEQ ID NO: 1797214 - DNA, 17 bp, Homo sapiens
gctctgcgtgtcacctg

SEQ ID NO: 1797215 - DNA, 22 bp, Homo sapiens
gctctgcgtgtcacctgtgctt

SEQ ID NO: 1797216 - DNA, 14 bp, Homo sapiens
taacctcatcttct

SEQ ID NO: 1797217 - DNA, 18 bp, Homo sapiens
taacctcatcttcttcac

SEQ ID NO: 1797218 - DNA, 15 bp, Homo sapiens
taacgtattttgatg

SEQ ID NO: 1797219 - DNA, 16 bp, Homo sapiens
taactatcaatattta

SEQ ID NO: 1797220 - DNA, 14 bp, Homo sapiens
taactgtgcagtga

SEQ ID NO: 1797221 - DNA, 20 bp, Homo sapiens
taagaaacaactctttgaga

SEQ ID NO: 1797222 - DNA, 21 bp, Homo sapiens
taagagtagaaactgcaggga

SEQ ID NO: 1797223 - DNA, 20 bp, Homo sapiens
taagcagaccactgataaaa

SEQ ID NO: 1797224 - DNA, 17 bp, Homo sapiens
taagccacttaaaatgt

SEQ ID NO: 1797225 - DNA, 20 bp, Homo sapiens
taaggaagaggggtctttta

SEQ ID NO: 1797226 - DNA, 15 bp, Homo sapiens
taagtcaacctgcct

SEQ ID NO: 1797227 - DNA, 21 bp, Homo sapiens
taagttacacatttttcagat

SEQ ID NO: 1797228 - DNA, 22 bp, Homo sapiens
taatcttgaattgtaactgttc

SEQ ID NO: 1797229 - DNA, 23 bp, Homo sapiens
taatgaagaaagtggaaaacaag

SEQ ID NO: 1797230 - DNA, 17 bp, Homo sapiens
taattttcctaataaag

SEQ ID NO: 1797231 - DNA, 15 bp, Homo sapiens
tacacatttttcaga

SEQ ID NO: 1797232 - DNA, 20 bp, Homo sapiens
tacagtaggagcccagctct

SEQ ID NO: 1797233 - DNA, 19 bp, Homo sapiens
tacagtcttccatttgcaa

SEQ ID NO: 1797234 - DNA, 12 bp, Homo sapiens
tacagtcttgta

SEQ ID NO: 1797235 - DNA, 13 bp, Homo sapiens
tacagtgtacagt

SEQ ID NO: 1797236 - DNA, 15 bp, Homo sapiens
tacagtgtacagtct

SEQ ID NO: 1797237 - DNA, 21 bp, Homo sapiens
tacatacagaggtaactatca

SEQ ID NO: 1797238 - DNA, 16 bp, Homo sapiens
tacatgacatttattt

SEQ ID NO: 1797239 - DNA, 21 bp, Homo sapiens
tacattaaaatagcacatgat

SEQ ID NO: 1797240 - DNA, 14 bp, Homo sapiens
tacattatgttatt

SEQ ID NO: 1797241 - DNA, 13 bp, Homo sapiens
taccaatgaaaaa

SEQ ID NO: 1797242 - DNA, 18 bp, Homo sapiens
tctcccagataatgtgaa

SEQ ID NO: 1797243 - DNA, 21 bp, Homo sapiens
tctcgtggtaggactgtagaa

SEQ ID NO: 1797244 - DNA, 14 bp, Homo sapiens
tctctccattcccg

SEQ ID NO: 1797245 - DNA, 11 bp, Homo sapiens
tctctctgtgg

SEQ ID NO: 1797246 - DNA, 15 bp, Homo sapiens
tctctgagctgtgca

SEQ ID NO: 1797247 - DNA, 16 bp, Homo sapiens
tctctgtctcatccat

SEQ ID NO: 1797248 - DNA, 18 bp, Homo sapiens
tctctttttgctttcgaa

SEQ ID NO: 1797249 - DNA, 20 bp, Homo sapiens
tctgaaaccagtgttaggga

SEQ ID NO: 1797250 - DNA, 20 bp, Homo sapiens
tctgaaggagccccattcct

SEQ ID NO: 1797251 - DNA, 21 bp, Homo sapiens
tctgaaggagccccattcctg

SEQ ID NO: 1797252 - DNA, 20 bp, Homo sapiens
tctgagagaggccattcttt

SEQ ID NO: 1797253 - DNA, 17 bp, Homo sapiens
tctgcctcttctgggag

SEQ ID NO: 1797254 - DNA, 20 bp, Homo sapiens
tctgcgtgtcacctgtgctt

SEQ ID NO: 1797255 - DNA, 15 bp, Homo sapiens
tctgctcatcattct

SEQ ID NO: 1797256 - DNA, 16 bp, Homo sapiens
tctgctctgcgtgtca

SEQ ID NO: 1797257 - DNA, 22 bp, Homo sapiens
tctggcacagcctggctgtggc

SEQ ID NO: 1797258 - DNA, 14 bp, Homo sapiens
tctgtataatctat

SEQ ID NO: 1797259 - DNA, 19 bp, Homo sapiens
tctgtatgtgacaacattt

SEQ ID NO: 1797260 - DNA, 21 bp, Homo sapiens
tctgtctcatccatcatcatg

SEQ ID NO: 1797261 - DNA, 19 bp, Homo sapiens
tctgtgaccaatgtcttga

SEQ ID NO: 1797262 - DNA, 12 bp, Homo sapiens
tctgtgtcttgt

SEQ ID NO: 1797263 - DNA, 13 bp, Homo sapiens
tcttccatttgca

SEQ ID NO: 1797264 - DNA, 14 bp, Homo sapiens
tcttccatttgcaa

SEQ ID NO: 1797265 - DNA, 23 bp, Homo sapiens
tcttctgggagggcagcagggct

SEQ ID NO: 1797266 - DNA, 13 bp, Homo sapiens
tcttgaatttaat

SEQ ID NO: 1797267 - DNA, 23 bp, Homo sapiens
tcttgaatttaataatctgtagg

SEQ ID NO: 1797268 - DNA, 13 bp, Homo sapiens
tcttgatgcatgc

SEQ ID NO: 1797269 - DNA, 22 bp, Homo sapiens
tcttggggagtttagggtgggg

SEQ ID NO: 1797270 - DNA, 15 bp, Homo sapiens
tcttggttgaggaaa

SEQ ID NO: 1797271 - DNA, 12 bp, Homo sapiens
tcttgtgtttct

SEQ ID NO: 1797272 - DNA, 21 bp, Homo sapiens
tctttcaaaaccttttgaaat

SEQ ID NO: 1797273 - DNA, 12 bp, Homo sapiens
tctttcatacat

SEQ ID NO: 1797274 - DNA, 17 bp, Homo sapiens
tctttcatacattatat

SEQ ID NO: 1797275 - DNA, 20 bp, Homo sapiens
tctttccattggatctcatt

SEQ ID NO: 1797276 - DNA, 13 bp, Homo sapiens
tctttcttccaaa

SEQ ID NO: 1797277 - DNA, 19 bp, Homo sapiens
tcttttgtaaggtttttgt

SEQ ID NO: 1797278 - DNA, 20 bp, Homo sapiens
tgaaaccagtgttagggaag

SEQ ID NO: 1797279 - DNA, 19 bp, Homo sapiens
tgaacaggttctttaaaat

SEQ ID NO: 1797280 - DNA, 16 bp, Homo sapiens
tgaagattctttccca

SEQ ID NO: 1797281 - DNA, 13 bp, Homo sapiens
tgaaggcttctct

SEQ ID NO: 1797282 - DNA, 16 bp, Homo sapiens
tgaatgattcagtgtt

SEQ ID NO: 1797283 - DNA, 18 bp, Homo sapiens
tgaatgtctcagcgaggt

SEQ ID NO: 1797284 - DNA, 21 bp, Homo sapiens
tgaattcttggttgaggaaac

SEQ ID NO: 1797285 - DNA, 22 bp, Homo sapiens
tgacactcccttgggctccctg

SEQ ID NO: 1797286 - DNA, 19 bp, Homo sapiens
tgaccaatattgtacagtt

SEQ ID NO: 1797287 - DNA, 21 bp, Homo sapiens
tgaccaatattgtacagtttt

SEQ ID NO: 1797288 - DNA, 21 bp, Homo sapiens
tgaccctcatctttcttccaa

SEQ ID NO: 1797289 - DNA, 15 bp, Homo sapiens
tgactcagggctcct

SEQ ID NO: 1797290 - DNA, 20 bp, Homo sapiens
tgactcattctgaaggagcc

SEQ ID NO: 1797291 - DNA, 21 bp, Homo sapiens
tgacttatttatataaatttt

SEQ ID NO: 1797292 - DNA, 20 bp, Homo sapiens
tgagaaacaacaatttctac

SEQ ID NO: 1797293 - DNA, 20 bp, Homo sapiens
tgagaatttgagtgctctga

SEQ ID NO: 1797294 - DNA, 20 bp, Homo sapiens
tgagacccagccctcatccc

SEQ ID NO: 1797295 - DNA, 22 bp, Homo sapiens
tgagcgaggagatgctccttgg

SEQ ID NO: 1797296 - DNA, 21 bp, Homo sapiens
tgagctccttaaggctctttt

SEQ ID NO: 1797297 - DNA, 14 bp, Homo sapiens
tgaggccagggcag

SEQ ID NO: 1797298 - DNA, 14 bp, Homo sapiens
tgagggagcctggc

SEQ ID NO: 1797299 - DNA, 19 bp, Homo sapiens
tgagtgacctcacttctgg

SEQ ID NO: 1797300 - DNA, 19 bp, Homo sapiens
tgagtgctctgatccctct

SEQ ID NO: 1797301 - DNA, 23 bp, Homo sapiens
tgatgcatgcactgttccccctg

SEQ ID NO: 1797302 - DNA, 22 bp, Homo sapiens
tgatgtaatcttgaattgtaac

SEQ ID NO: 1797303 - DNA, 20 bp, Homo sapiens
tgattacctcctgtgtggaa

SEQ ID NO: 1797304 - DNA, 14 bp, Homo sapiens
tgattattcagtgt

SEQ ID NO: 1797305 - DNA, 16 bp, Homo sapiens
tgattattcagtgtca

SEQ ID NO: 1797306 - DNA, 24 bp, Homo sapiens
tgattcagtgttaaatgtgatgaa

SEQ ID NO: 1797307 - DNA, 16 bp, Homo sapiens
tgattgcgagaatttt

SEQ ID NO: 1797308 - DNA, 18 bp, Homo sapiens
tgattgcgagaattttca

SEQ ID NO: 1797309 - DNA, 17 bp, Homo sapiens
tgattttgctgtagaag

SEQ ID NO: 1797310 - DNA, 19 bp, Homo sapiens
tgattttgctgtagaagat

SEQ ID NO: 1797311 - DNA, 18 bp, Homo sapiens
tgatttttatgccacctg

SEQ ID NO: 1797312 - DNA, 22 bp, Homo sapiens
tgcaaaaggactctcaggacca

SEQ ID NO: 1797313 - DNA, 14 bp, Homo sapiens
tgcaacctcgctgg

SEQ ID NO: 1797314 - DNA, 16 bp, Homo sapiens
tgcacatctgtgtctt

SEQ ID NO: 1797315 - DNA, 19 bp, Homo sapiens
tgcacatctgtgtcttgtt

SEQ ID NO: 1797316 - DNA, 14 bp, Homo sapiens
tgcaccaagcagga

SEQ ID NO: 1797317 - DNA, 13 bp, Homo sapiens
tgcactgttcccc

SEQ ID NO: 1797318 - DNA, 19 bp, Homo sapiens
tgcactgttccccctgtgc

SEQ ID NO: 1797319 - DNA, 23 bp, Homo sapiens
tgcactgttccccctgtgcagcc

SEQ ID NO: 1797320 - DNA, 19 bp, Homo sapiens
tgcagagaaacgtgtaccc

SEQ ID NO: 1797321 - DNA, 21 bp, Homo sapiens
tgcagggaaaattatttgcat

SEQ ID NO: 1797322 - DNA, 19 bp, Homo sapiens
tgcagtcctgatcagagcc

SEQ ID NO: 1797323 - DNA, 23 bp, Homo sapiens
tgcagtgacctgccctacatatc

SEQ ID NO: 1797324 - DNA, 22 bp, Homo sapiens
tgcatgcactgttccccctgtg

SEQ ID NO: 1797325 - DNA, 16 bp, Homo sapiens
tgcatttaaatacagt

SEQ ID NO: 1797326 - DNA, 23 bp, Homo sapiens
tgccagctctgtatcaggaccca

SEQ ID NO: 1797327 - DNA, 11 bp, Homo sapiens
tgccagggcag

SEQ ID NO: 1797328 - DNA, 15 bp, Homo sapiens
tgccagggcagggcc

SEQ ID NO: 1797329 - DNA, 14 bp, Homo sapiens
tgccatattttcac

SEQ ID NO: 1797330 - DNA, 20 bp, Homo sapiens
tgcccaggctggagtgcagt

SEQ ID NO: 1797331 - DNA, 18 bp, Homo sapiens
tgcccgggagctcaggaa

SEQ ID NO: 1797332 - DNA, 19 bp, Homo sapiens
tgcctcttctgggagggca

SEQ ID NO: 1797333 - DNA, 13 bp, Homo sapiens
tgcgagaattttc

SEQ ID NO: 1797334 - DNA, 12 bp, Homo sapiens
tgctaattctga

SEQ ID NO: 1797335 - DNA, 19 bp, Homo sapiens
tgctccttgggccctttga

SEQ ID NO: 1797336 - DNA, 21 bp, Homo sapiens
tgctccttgggccctttgagt

SEQ ID NO: 1797337 - DNA, 16 bp, Homo sapiens
tgctctgatccctcta

SEQ ID NO: 1797338 - DNA, 22 bp, Homo sapiens
tgctctgcgtgtcacctgtgct

SEQ ID NO: 1797339 - DNA, 23 bp, Homo sapiens
tgctctgcgtgtcacctgtgctt

SEQ ID NO: 1797340 - DNA, 13 bp, Homo sapiens
tgctcttctgtat

SEQ ID NO: 1797341 - DNA, 16 bp, Homo sapiens
tgctggtttttcagtt

SEQ ID NO: 1797342 - DNA, 15 bp, Homo sapiens
tgctgtggtgtgtcc

SEQ ID NO: 1797343 - DNA, 18 bp, Homo sapiens
tgcttctagttctgccag

SEQ ID NO: 1797344 - DNA, 19 bp, Homo sapiens
tgcttctagttctgccagg

SEQ ID NO: 1797345 - DNA, 20 bp, Homo sapiens
tgcttctagttctgccagga

SEQ ID NO: 1797346 - DNA, 13 bp, Homo sapiens
tgcttgaggaaaa

SEQ ID NO: 1797347 - DNA, 18 bp, Homo sapiens
tggaactcgtgtctggca

SEQ ID NO: 1797348 - DNA, 20 bp, Homo sapiens
tggaatattgtccattgtcc

SEQ ID NO: 1797349 - DNA, 11 bp, Homo sapiens
tggaattttct

SEQ ID NO: 1797350 - DNA, 12 bp, Homo sapiens
tggaattttctt

SEQ ID NO: 1797351 - DNA, 16 bp, Homo sapiens
tggaccagcctctcca

SEQ ID NO: 1797352 - DNA, 13 bp, Homo sapiens
tggacccttccat

SEQ ID NO: 1797353 - DNA, 12 bp, Homo sapiens
tggagcagaggg

SEQ ID NO: 1797354 - DNA, 17 bp, Homo sapiens
tggagcagaggggctga

SEQ ID NO: 1797355 - DNA, 16 bp, Homo sapiens
tggattccactgaaat

SEQ ID NO: 1797356 - DNA, 16 bp, Homo sapiens
tggccaagttcttagt

SEQ ID NO: 1797357 - DNA, 16 bp, Homo sapiens
tggcctaacctgccga

SEQ ID NO: 1797358 - DNA, 17 bp, Homo sapiens
tggctgtggcatccaga

SEQ ID NO: 1797359 - DNA, 14 bp, Homo sapiens
tgggagccgggtct

SEQ ID NO: 1797360 - DNA, 14 bp, Homo sapiens
tgggaggagggcag

SEQ ID NO: 1797361 - DNA, 16 bp, Homo sapiens
tgggatggtggagggc

SEQ ID NO: 1797362 - DNA, 17 bp, Homo sapiens
tgggatggtggagggcc

SEQ ID NO: 1797363 - DNA, 16 bp, Homo sapiens
tgggattgagtctgtg

SEQ ID NO: 1797364 - DNA, 15 bp, Homo sapiens
tgggcaggagggagg

SEQ ID NO: 1797365 - DNA, 19 bp, Homo sapiens
tggggagtttagggtgggg

SEQ ID NO: 1797366 - DNA, 14 bp, Homo sapiens
tgggggtgccagga

SEQ ID NO: 1797367 - DNA, 19 bp, Homo sapiens
tgggttttgtattctctga

SEQ ID NO: 1797368 - DNA, 18 bp, Homo sapiens
tggtaggactgtagaaaa

SEQ ID NO: 1797369 - DNA, 22 bp, Homo sapiens
tggtatagaaatgctggttttt

SEQ ID NO: 1797370 - DNA, 15 bp, Homo sapiens
tggtcagccctaggg

SEQ ID NO: 1797371 - DNA, 13 bp, Homo sapiens
tggtggagggcca

SEQ ID NO: 1797372 - DNA, 19 bp, Homo sapiens
tggtgtgtccccctctgtc

SEQ ID NO: 1797373 - DNA, 11 bp, Homo sapiens
tgtaacatgta

SEQ ID NO: 1797374 - DNA, 19 bp, Homo sapiens
tgtaacctcttcagaggcc

SEQ ID NO: 1797375 - DNA, 12 bp, Homo sapiens
tgtaacttcaaa

SEQ ID NO: 1797376 - DNA, 13 bp, Homo sapiens
tgtaacttcaaat

SEQ ID NO: 1797377 - DNA, 14 bp, Homo sapiens
tgtaacttcaaata

SEQ ID NO: 1797378 - DNA, 21 bp, Homo sapiens
tgtacagtcttgtattaagtt

SEQ ID NO: 1797379 - DNA, 18 bp, Homo sapiens
tgtagaaaagggaactga

SEQ ID NO: 1797380 - DNA, 19 bp, Homo sapiens
tgtagaaaagggaactgaa

SEQ ID NO: 1797381 - DNA, 18 bp, Homo sapiens
ctgggccctctctgctct

SEQ ID NO: 1797382 - DNA, 13 bp, Homo sapiens
ctgggctgaggga

SEQ ID NO: 1797383 - DNA, 23 bp, Homo sapiens
ctgggggcttcgcttccttagcc

SEQ ID NO: 1797384 - DNA, 19 bp, Homo sapiens
ctgtaacctcttcagaggc

SEQ ID NO: 1797385 - DNA, 22 bp, Homo sapiens
ctgtaacctcttcagaggccct

SEQ ID NO: 1797386 - DNA, 23 bp, Homo sapiens
ctgtaacctcttcagaggccctc

SEQ ID NO: 1797387 - DNA, 24 bp, Homo sapiens
ctgtagggtaattagtaacatgtg

SEQ ID NO: 1797388 - DNA, 14 bp, Homo sapiens
ctgtataatctatt

SEQ ID NO: 1797389 - DNA, 18 bp, Homo sapiens
ctgtataatctatttaca

SEQ ID NO: 1797390 - DNA, 19 bp, Homo sapiens
ctgtataatctatttacat

SEQ ID NO: 1797391 - DNA, 23 bp, Homo sapiens
ctgtatcaggacccagaggaagg

SEQ ID NO: 1797392 - DNA, 12 bp, Homo sapiens
ctgtctcatcca

SEQ ID NO: 1797393 - DNA, 15 bp, Homo sapiens
ctgtctcatccatca

SEQ ID NO: 1797394 - DNA, 16 bp, Homo sapiens
ctgtctcatccatcat

SEQ ID NO: 1797395 - DNA, 20 bp, Homo sapiens
ctgtctccatggccctgcaa

SEQ ID NO: 1797396 - DNA, 15 bp, Homo sapiens
ctgtgaccaatgtct

SEQ ID NO: 1797397 - DNA, 17 bp, Homo sapiens
ctgtgaccaatgtcttg

SEQ ID NO: 1797398 - DNA, 21 bp, Homo sapiens
ctgtgactactatggctgttt

SEQ ID NO: 1797399 - DNA, 19 bp, Homo sapiens
ctgtgcacatctgtgtctt

SEQ ID NO: 1797400 - DNA, 21 bp, Homo sapiens
ctgtgcacatctgtgtcttgt

SEQ ID NO: 1797401 - DNA, 16 bp, Homo sapiens
ctgtgcagccgctgag

SEQ ID NO: 1797402 - DNA, 17 bp, Homo sapiens
ctgtgcagccgctgagc

SEQ ID NO: 1797403 - DNA, 19 bp, Homo sapiens
ctgtgcagccgctgagcga

SEQ ID NO: 1797404 - DNA, 12 bp, Homo sapiens
ctgtgcagtgac

SEQ ID NO: 1797405 - DNA, 18 bp, Homo sapiens
ctgtggcctaacctgccg

SEQ ID NO: 1797406 - DNA, 14 bp, Homo sapiens
ctgtggtgtgtccc

SEQ ID NO: 1797407 - DNA, 12 bp, Homo sapiens
ctgttccccctg

SEQ ID NO: 1797408 - DNA, 15 bp, Homo sapiens
ctgttccccctgtgc

SEQ ID NO: 1797409 - DNA, 16 bp, Homo sapiens
ctgttccccctgtgca

SEQ ID NO: 1797410 - DNA, 23 bp, Homo sapiens
ctgttgttgaggtggtggtagtg

SEQ ID NO: 1797411 - DNA, 19 bp, Homo sapiens
cttaaacaaaaattaaaat

SEQ ID NO: 1797412 - DNA, 18 bp, Homo sapiens
cttacctgcaaactcctt

SEQ ID NO: 1797413 - DNA, 14 bp, Homo sapiens
cttacttagtgtta

SEQ ID NO: 1797414 - DNA, 19 bp, Homo sapiens
cttagctgaacaatgaatg

SEQ ID NO: 1797415 - DNA, 17 bp, Homo sapiens
cttattagagtgtcttt

SEQ ID NO: 1797416 - DNA, 23 bp, Homo sapiens
cttcagaggccctcgctgccagc

SEQ ID NO: 1797417 - DNA, 21 bp, Homo sapiens
cttccaaaaagatttattaat

SEQ ID NO: 1797418 - DNA, 14 bp, Homo sapiens
cttccactgagggc

SEQ ID NO: 1797419 - DNA, 13 bp, Homo sapiens
cttccatttgcaa

SEQ ID NO: 1797420 - DNA, 22 bp, Homo sapiens
cttcctggagactgcccagcta

SEQ ID NO: 1797421 - DNA, 14 bp, Homo sapiens
cttccttcctctcc

SEQ ID NO: 1797422 - DNA, 14 bp, Homo sapiens
cttctccatccaca

SEQ ID NO: 1797423 - DNA, 16 bp, Homo sapiens
cttctctctgtgggat

SEQ ID NO: 1797424 - DNA, 15 bp, Homo sapiens
cttctgggagggcag

SEQ ID NO: 1797425 - DNA, 19 bp, Homo sapiens
cttctgggagggcagcagg

SEQ ID NO: 1797426 - DNA, 22 bp, Homo sapiens
cttctgtatgtgacaacatttt

SEQ ID NO: 1797427 - DNA, 14 bp, Homo sapiens
cttgaactttccaa

SEQ ID NO: 1797428 - DNA, 15 bp, Homo sapiens
cttgaactttccaaa

SEQ ID NO: 1797429 - DNA, 21 bp, Homo sapiens
cttgaattgtaactgttcttg

SEQ ID NO: 1797430 - DNA, 22 bp, Homo sapiens
cttgaattgtaactgttcttga

SEQ ID NO: 1797431 - DNA, 16 bp, Homo sapiens
cttgctcaggtgcaag

SEQ ID NO: 1797432 - DNA, 19 bp, Homo sapiens
cttggttcccccactgatc

SEQ ID NO: 1797433 - DNA, 23 bp, Homo sapiens
cttgtattaagttgttaataaaa

SEQ ID NO: 1797434 - DNA, 21 bp, Homo sapiens
cttgttggatttttgtcttgt

SEQ ID NO: 1797435 - DNA, 23 bp, Homo sapiens
cttgttggatttttgtcttgtgt

SEQ ID NO: 1797436 - DNA, 13 bp, Homo sapiens
ctttcatacatta

SEQ ID NO: 1797437 - DNA, 21 bp, Homo sapiens
ctttccacggagccactcctc

SEQ ID NO: 1797438 - DNA, 18 bp, Homo sapiens
ctttcgaataaagtgaat

SEQ ID NO: 1797439 - DNA, 19 bp, Homo sapiens
ctttcttccaaacaggctc

SEQ ID NO: 1797440 - DNA, 16 bp, Homo sapiens
cttttggcatgaaagt

SEQ ID NO: 1797441 - DNA, 13 bp, Homo sapiens
cttttgtgttact

SEQ ID NO: 1797442 - DNA, 20 bp, Homo sapiens
cttttgttttcttcatttct

SEQ ID NO: 1797443 - DNA, 16 bp, Homo sapiens
gaaaattatttgcata

SEQ ID NO: 1797444 - DNA, 17 bp, Homo sapiens
gaaacaaatttttttct

SEQ ID NO: 1797445 - DNA, 17 bp, Homo sapiens
gaacatggattccactg

SEQ ID NO: 1797446 - DNA, 12 bp, Homo sapiens
gaacgtttttcc

SEQ ID NO: 1797447 - DNA, 15 bp, Homo sapiens
gaagaaagtggaaaa

SEQ ID NO: 1797448 - DNA, 14 bp, Homo sapiens
gaagattctttccc

SEQ ID NO: 1797449 - DNA, 13 bp, Homo sapiens
gaagcgttgtcct

SEQ ID NO: 1797450 - DNA, 20 bp, Homo sapiens
gaagcgttgtcctcagcccc

SEQ ID NO: 1797451 - DNA, 20 bp, Homo sapiens
gaaggagccccattcctggg

SEQ ID NO: 1797452 - DNA, 22 bp, Homo sapiens
gaaggagccccattcctgggaa

SEQ ID NO: 1797453 - DNA, 17 bp, Homo sapiens
gaaggggccagaggctc

SEQ ID NO: 1797454 - DNA, 14 bp, Homo sapiens
gaataaagtgaata

SEQ ID NO: 1797455 - DNA, 18 bp, Homo sapiens
gaatacattttgcacaaa

SEQ ID NO: 1797456 - DNA, 16 bp, Homo sapiens
gaatagctttatcttg

SEQ ID NO: 1797457 - DNA, 15 bp, Homo sapiens
gaatgattcagtgtt

SEQ ID NO: 1797458 - DNA, 11 bp, Homo sapiens
gaatgtctcag

SEQ ID NO: 1797459 - DNA, 16 bp, Homo sapiens
gaattgtaactgttct

SEQ ID NO: 1797460 - DNA, 16 bp, Homo sapiens
gaatttaataatctgt

SEQ ID NO: 1797461 - DNA, 16 bp, Homo sapiens
gaattttctttcatac

SEQ ID NO: 1797462 - DNA, 20 bp, Homo sapiens
gaattttctttcatacatta

SEQ ID NO: 1797463 - DNA, 22 bp, Homo sapiens
gacaacatttttgtacattatg

SEQ ID NO: 1797464 - DNA, 16 bp, Homo sapiens
gacacctaggctaggg

SEQ ID NO: 1797465 - DNA, 15 bp, Homo sapiens
gacactcccttgggc

SEQ ID NO: 1797466 - DNA, 21 bp, Homo sapiens
gacactcccttgggctccctg

SEQ ID NO: 1797467 - DNA, 16 bp, Homo sapiens
gacaggttagctgctc

SEQ ID NO: 1797468 - DNA, 13 bp, Homo sapiens
gacatttctctaa

SEQ ID NO: 1797469 - DNA, 18 bp, Homo sapiens
gaccaatattgtacagtt

SEQ ID NO: 1797470 - DNA, 12 bp, Homo sapiens
gaccccagagga

SEQ ID NO: 1797471 - DNA, 17 bp, Homo sapiens
gaccgggctctgacagc

SEQ ID NO: 1797472 - DNA, 18 bp, Homo sapiens
gacctgccctacatatct

SEQ ID NO: 1797473 - DNA, 17 bp, Homo sapiens
gacctggtgctgcctct

SEQ ID NO: 1797474 - DNA, 23 bp, Homo sapiens
actgagggcagtcgatagagctg

SEQ ID NO: 1797475 - DNA, 19 bp, Homo sapiens
actggcgacacgtagcagc

SEQ ID NO: 1797476 - DNA, 22 bp, Homo sapiens
actggtgttatcaccgtgggct

SEQ ID NO: 1797477 - DNA, 15 bp, Homo sapiens
actgtgcacatctgt

SEQ ID NO: 1797478 - DNA, 21 bp, Homo sapiens
actgtgcacatctgtgtcttg

SEQ ID NO: 1797479 - DNA, 18 bp, Homo sapiens
actgttccccctgtgcag

SEQ ID NO: 1797480 - DNA, 20 bp, Homo sapiens
acttacatctttgtttacca

SEQ ID NO: 1797481 - DNA, 19 bp, Homo sapiens
acttccaaatcccctaagc

SEQ ID NO: 1797482 - DNA, 15 bp, Homo sapiens
acttttgccctttga

SEQ ID NO: 1797483 - DNA, 18 bp, Homo sapiens
acttttggcatgaaagtg

SEQ ID NO: 1797484 - DNA, 13 bp, Homo sapiens
agaaaacaccctt

SEQ ID NO: 1797485 - DNA, 13 bp, Homo sapiens
agaaaacttccaa

SEQ ID NO: 1797486 - DNA, 14 bp, Homo sapiens
agaaacttccaaat

SEQ ID NO: 1797487 - DNA, 19 bp, Homo sapiens
agaaacttccaaatcccct

SEQ ID NO: 1797488 - DNA, 20 bp, Homo sapiens
agaaagtggaaaacaaggaa

SEQ ID NO: 1797489 - DNA, 23 bp, Homo sapiens
agaaagtggaaaacaaggaagtc

SEQ ID NO: 1797490 - DNA, 21 bp, Homo sapiens
agaaatgctggtttttcagtt

SEQ ID NO: 1797491 - DNA, 22 bp, Homo sapiens
agaacatggattccactgaaat

SEQ ID NO: 1797492 - DNA, 14 bp, Homo sapiens
agaactactgataa

SEQ ID NO: 1797493 - DNA, 18 bp, Homo sapiens
agaacttggatgtacctg

SEQ ID NO: 1797494 - DNA, 17 bp, Homo sapiens
agaatttgagtgctctg

SEQ ID NO: 1797495 - DNA, 18 bp, Homo sapiens
agacccagccctcatccc

SEQ ID NO: 1797496 - DNA, 15 bp, Homo sapiens
agacgcctgaggaac

SEQ ID NO: 1797497 - DNA, 18 bp, Homo sapiens
agacgtgaatgtctcagc

SEQ ID NO: 1797498 - DNA, 19 bp, Homo sapiens
agacgtgaatgtctcagcg

SEQ ID NO: 1797499 - DNA, 21 bp, Homo sapiens
agacgtgagtgtgactttttg

SEQ ID NO: 1797500 - DNA, 21 bp, Homo sapiens
agactgaccaatattgtacag

SEQ ID NO: 1797501 - DNA, 15 bp, Homo sapiens
agactgggctgaggg

SEQ ID NO: 1797502 - DNA, 16 bp, Homo sapiens
agactgggctgaggga

SEQ ID NO: 1797503 - DNA, 20 bp, Homo sapiens
agactgggctgagggagcct

SEQ ID NO: 1797504 - DNA, 12 bp, Homo sapiens
agagaggccatt

SEQ ID NO: 1797505 - DNA, 23 bp, Homo sapiens
agagaggccattctttcccaaca

SEQ ID NO: 1797506 - DNA, 19 bp, Homo sapiens
agagcacttttaacaaaaa

SEQ ID NO: 1797507 - DNA, 21 bp, Homo sapiens
agaggccattctttcccaaca

SEQ ID NO: 1797508 - DNA, 19 bp, Homo sapiens
agaggccctcgctgccagc

SEQ ID NO: 1797509 - DNA, 15 bp, Homo sapiens
agagggacgcctggg

SEQ ID NO: 1797510 - DNA, 21 bp, Homo sapiens
agagggacgcctgggggtgcc

SEQ ID NO: 1797511 - DNA, 14 bp, Homo sapiens
agagtccctgcctg

SEQ ID NO: 1797512 - DNA, 17 bp, Homo sapiens
agagtccctgcctggac

SEQ ID NO: 1797513 - DNA, 15 bp, Homo sapiens
agagtgaattatatt

SEQ ID NO: 1797514 - DNA, 14 bp, Homo sapiens
agagtgtctttcca

SEQ ID NO: 1797515 - DNA, 19 bp, Homo sapiens
agataccagcgaggaggct

SEQ ID NO: 1797516 - DNA, 23 bp, Homo sapiens
agataccagcgaggaggctccag

SEQ ID NO: 1797517 - DNA, 14 bp, Homo sapiens
agatatttttgtac

SEQ ID NO: 1797518 - DNA, 20 bp, Homo sapiens
agatcccaacactgccagca

SEQ ID NO: 1797519 - DNA, 20 bp, Homo sapiens
agatgctccttgggcccttt

SEQ ID NO: 1797520 - DNA, 18 bp, Homo sapiens
agatttttgctcttctgt

SEQ ID NO: 1797521 - DNA, 16 bp, Homo sapiens
agcacatgattttctt

SEQ ID NO: 1797522 - DNA, 20 bp, Homo sapiens
agcacatgattttcttttgt

SEQ ID NO: 1797523 - DNA, 14 bp, Homo sapiens
agcagaggggctga

SEQ ID NO: 1797524 - DNA, 18 bp, Homo sapiens
agcagcttagactaaggc

SEQ ID NO: 1797525 - DNA, 18 bp, Homo sapiens
agcattcacaacttgttt

SEQ ID NO: 1797526 - DNA, 17 bp, Homo sapiens
agccagcgtcctcctct

SEQ ID NO: 1797527 - DNA, 23 bp, Homo sapiens
agcccaaagtggtatagaaatgc

SEQ ID NO: 1797528 - DNA, 21 bp, Homo sapiens
agcccagcactgcttgaggaa

SEQ ID NO: 1797529 - DNA, 13 bp, Homo sapiens
agccccattcctg

SEQ ID NO: 1797530 - DNA, 16 bp, Homo sapiens
agccccattcctggga

SEQ ID NO: 1797531 - DNA, 15 bp, Homo sapiens
agccgctgagcgagg

SEQ ID NO: 1797532 - DNA, 20 bp, Homo sapiens
agccgggtctgcctcttctg

SEQ ID NO: 1797533 - DNA, 21 bp, Homo sapiens
agccgggtctgcctcttctgg

SEQ ID NO: 1797534 - DNA, 16 bp, Homo sapiens
agccgtggtcctttgg

SEQ ID NO: 1797535 - DNA, 14 bp, Homo sapiens
agcctagtgaaggc

SEQ ID NO: 1797536 - DNA, 18 bp, Homo sapiens
agcctcactattacttga

SEQ ID NO: 1797537 - DNA, 14 bp, Homo sapiens
agcctcccctgcca

SEQ ID NO: 1797538 - DNA, 16 bp, Homo sapiens
agcctcccctgccagg

SEQ ID NO: 1797539 - DNA, 18 bp, Homo sapiens
agcctcccctgccagggc

SEQ ID NO: 1797540 - DNA, 16 bp, Homo sapiens
agcctctccactcatg

SEQ ID NO: 1797541 - DNA, 19 bp, Homo sapiens
agcgaggaggctccagagg

SEQ ID NO: 1797542 - DNA, 19 bp, Homo sapiens
agcgtcctcctctgtgacc

SEQ ID NO: 1797543 - DNA, 17 bp, Homo sapiens
agcgtgctttaaaaaat

SEQ ID NO: 1797544 - DNA, 11 bp, Homo sapiens
agctagaaatg

SEQ ID NO: 1797545 - DNA, 20 bp, Homo sapiens
agctatgttatattgaaaaa

SEQ ID NO: 1797546 - DNA, 22 bp, Homo sapiens
agctatgttatattgaaaaaat

SEQ ID NO: 1797547 - DNA, 20 bp, Homo sapiens
agctcaggaaccgaggcagg

SEQ ID NO: 1797548 - DNA, 17 bp, Homo sapiens
agctccttaaggctctt

SEQ ID NO: 1797549 - DNA, 23 bp, Homo sapiens
agctctgtatcaggacccagagg

SEQ ID NO: 1797550 - DNA, 21 bp, Homo sapiens
agctgctttcgaataaagtga

SEQ ID NO: 1797551 - DNA, 15 bp, Homo sapiens
agcttagactaaggc

SEQ ID NO: 1797552 - DNA, 22 bp, Homo sapiens
agctttcatgtaaactgtgcac

SEQ ID NO: 1797553 - DNA, 16 bp, Homo sapiens
aggaaaagtgcaatgc

SEQ ID NO: 1797554 - DNA, 18 bp, Homo sapiens
aggaaaagtgcaatgcgt

SEQ ID NO: 1797555 - DNA, 19 bp, Homo sapiens
aggaagaggggtcttttat

SEQ ID NO: 1797556 - DNA, 15 bp, Homo sapiens
aggaagtaggaagta

SEQ ID NO: 1797557 - DNA, 18 bp, Homo sapiens
aggaagtcaaagcaagga

SEQ ID NO: 1797558 - DNA, 20 bp, Homo sapiens
aggaccagtcaacctgggca

SEQ ID NO: 1797559 - DNA, 13 bp, Homo sapiens
aggacccagagga

SEQ ID NO: 1797560 - DNA, 14 bp, Homo sapiens
aggacttcccgagc

SEQ ID NO: 1797561 - DNA, 13 bp, Homo sapiens
aggagaaactgag

SEQ ID NO: 1797562 - DNA, 16 bp, Homo sapiens
aggagatgctccttgg

SEQ ID NO: 1797563 - DNA, 21 bp, Homo sapiens
aggagccccattcctgggaaa

SEQ ID NO: 1797564 - DNA, 15 bp, Homo sapiens
aggagggcaggcatc

SEQ ID NO: 1797565 - DNA, 20 bp, Homo sapiens
aggcagcagtgtgaggccag

SEQ ID NO: 1797566 - DNA, 14 bp, Homo sapiens
aggcattgccaagg

SEQ ID NO: 1797567 - DNA, 15 bp, Homo sapiens
aggccagggcagagt

SEQ ID NO: 1797568 - DNA, 17 bp, Homo sapiens
aggccattctttcccaa

SEQ ID NO: 1797569 - DNA, 22 bp, Homo sapiens
aggccctcgctgccagctctgt

SEQ ID NO: 1797570 - DNA, 16 bp, Homo sapiens
aggctagggtggggag

SEQ ID NO: 1797571 - DNA, 16 bp, Homo sapiens
aggctcacccccttct

SEQ ID NO: 1797572 - DNA, 20 bp, Homo sapiens
aggctcagagggtgtcctgc

SEQ ID NO: 1797573 - DNA, 16 bp, Homo sapiens
aggctccagagggcac

SEQ ID NO: 1797574 - DNA, 16 bp, Homo sapiens
aggcttctctctgtgg

SEQ ID NO: 1797575 - DNA, 14 bp, Homo sapiens
agggaagggcctgc

SEQ ID NO: 1797576 - DNA, 22 bp, Homo sapiens
agggacgcctgggggtgccagg

SEQ ID NO: 1797577 - DNA, 14 bp, Homo sapiens
agggagcctggccc

SEQ ID NO: 1797578 - DNA, 15 bp, Homo sapiens
agggatccctcatct

SEQ ID NO: 1797579 - DNA, 16 bp, Homo sapiens
ccagcgaggaggctcc

SEQ ID NO: 1797580 - DNA, 13 bp, Homo sapiens
ccagcgtcctcct

SEQ ID NO: 1797581 - DNA, 20 bp, Homo sapiens
ccagctctgaaaccagtgtt

SEQ ID NO: 1797582 - DNA, 14 bp, Homo sapiens
ccagctctgtatca

SEQ ID NO: 1797583 - DNA, 21 bp, Homo sapiens
ccagctctgtatcaggaccca

SEQ ID NO: 1797584 - DNA, 23 bp, Homo sapiens
ccaggaccagtcaacctgggcaa

SEQ ID NO: 1797585 - DNA, 20 bp, Homo sapiens
ccaggagaaggccaattcct

SEQ ID NO: 1797586 - DNA, 23 bp, Homo sapiens
ccaggcttaaggagaggagaaac

SEQ ID NO: 1797587 - DNA, 20 bp, Homo sapiens
ccagtgttagggaagggcct

SEQ ID NO: 1797588 - DNA, 17 bp, Homo sapiens
ccagttaaaaaaaattt

SEQ ID NO: 1797589 - DNA, 12 bp, Homo sapiens
ccatcagtgctc

SEQ ID NO: 1797590 - DNA, 18 bp, Homo sapiens
ccatcctaccccctgtgc

SEQ ID NO: 1797591 - DNA, 15 bp, Homo sapiens
ccatgaaccaagacc

SEQ ID NO: 1797592 - DNA, 19 bp, Homo sapiens
ccatggtgtgatcgtctga

SEQ ID NO: 1797593 - DNA, 20 bp, Homo sapiens
ccattctttcccaacacctc

SEQ ID NO: 1797594 - DNA, 13 bp, Homo sapiens
ccattgaattctt

SEQ ID NO: 1797595 - DNA, 13 bp, Homo sapiens
cccaacacctctt

SEQ ID NO: 1797596 - DNA, 16 bp, Homo sapiens
cccaacactgccagca

SEQ ID NO: 1797597 - DNA, 14 bp, Homo sapiens
cccagccctcatcc

SEQ ID NO: 1797598 - DNA, 11 bp, Homo sapiens
cccagctgttt

SEQ ID NO: 1797599 - DNA, 23 bp, Homo sapiens
cccatcagtgctccctcacatgt

SEQ ID NO: 1797600 - DNA, 13 bp, Homo sapiens
cccatgagctcct

SEQ ID NO: 1797601 - DNA, 23 bp, Homo sapiens
ccccagggggcggggtgcagaag

SEQ ID NO: 1797602 - DNA, 14 bp, Homo sapiens
ccccatcagtgctc

SEQ ID NO: 1797603 - DNA, 12 bp, Homo sapiens
ccccctctgtcc

SEQ ID NO: 1797604 - DNA, 12 bp, Homo sapiens
ccccctgtgcag

SEQ ID NO: 1797605 - DNA, 22 bp, Homo sapiens
ccccctgtgccttgtcacgcca

SEQ ID NO: 1797606 - DNA, 14 bp, Homo sapiens
ccccgacttttgtt

SEQ ID NO: 1797607 - DNA, 22 bp, Homo sapiens
cccctctgtccaggcactgaga

SEQ ID NO: 1797608 - DNA, 15 bp, Homo sapiens
cccctgccagggcag

SEQ ID NO: 1797609 - DNA, 18 bp, Homo sapiens
cccggagcaggggtctga

SEQ ID NO: 1797610 - DNA, 12 bp, Homo sapiens
ccctattttaag

SEQ ID NO: 1797611 - DNA, 13 bp, Homo sapiens
ccctcatctgtcc

SEQ ID NO: 1797612 - DNA, 18 bp, Homo sapiens
ccctctacagagcttccc

SEQ ID NO: 1797613 - DNA, 24 bp, Homo sapiens
ccctctgtccaggcactgagatac

SEQ ID NO: 1797614 - DNA, 19 bp, Homo sapiens
ccctgactcattctgaagg

SEQ ID NO: 1797615 - DNA, 13 bp, Homo sapiens
ccctgagctgagg

SEQ ID NO: 1797616 - DNA, 14 bp, Homo sapiens
ccctgagctgaggc

SEQ ID NO: 1797617 - DNA, 20 bp, Homo sapiens
ccctgcaaaaggactctcag

SEQ ID NO: 1797618 - DNA, 13 bp, Homo sapiens
ccctgcctggacc

SEQ ID NO: 1797619 - DNA, 18 bp, Homo sapiens
ccctgcctggaccagcct

SEQ ID NO: 1797620 - DNA, 13 bp, Homo sapiens
ccctgcggagacc

SEQ ID NO: 1797621 - DNA, 14 bp, Homo sapiens
cccttcccacagga

SEQ ID NO: 1797622 - DNA, 23 bp, Homo sapiens
cccttcccacaggacatttctct

SEQ ID NO: 1797623 - DNA, 22 bp, Homo sapiens
ccgacttttgtttaccagagaa

SEQ ID NO: 1797624 - DNA, 18 bp, Homo sapiens
ccgagcggtgtggggacc

SEQ ID NO: 1797625 - DNA, 19 bp, Homo sapiens
ccggagcaggggtctgagc

SEQ ID NO: 1797626 - DNA, 19 bp, Homo sapiens
ccggctttgtggcactggg

SEQ ID NO: 1797627 - DNA, 17 bp, Homo sapiens
ccgggacctggtgctgc

SEQ ID NO: 1797628 - DNA, 12 bp, Homo sapiens
ccgggctctgac

SEQ ID NO: 1797629 - DNA, 15 bp, Homo sapiens
ccggggcctgggcag

SEQ ID NO: 1797630 - DNA, 14 bp, Homo sapiens
ccgggtctgcctct

SEQ ID NO: 1797631 - DNA, 14 bp, Homo sapiens
ccgtgggctccctg

SEQ ID NO: 1797632 - DNA, 13 bp, Homo sapiens
cctaacctgccga

SEQ ID NO: 1797633 - DNA, 19 bp, Homo sapiens
cctagtgaaggcttctctc

SEQ ID NO: 1797634 - DNA, 18 bp, Homo sapiens
cctcaatccagctatgtt

SEQ ID NO: 1797635 - DNA, 18 bp, Homo sapiens
cctcagccccgcgtggaa

SEQ ID NO: 1797636 - DNA, 14 bp, Homo sapiens
cctcatcccgagca

SEQ ID NO: 1797637 - DNA, 17 bp, Homo sapiens
cctcatcttcttcacca

SEQ ID NO: 1797638 - DNA, 21 bp, Homo sapiens
cctccacgttctgctcatcat

SEQ ID NO: 1797639 - DNA, 13 bp, Homo sapiens
cctcccctgccag

SEQ ID NO: 1797640 - DNA, 18 bp, Homo sapiens
cctcccctgccagggcag

SEQ ID NO: 1797641 - DNA, 14 bp, Homo sapiens
cctcctctgcccgg

SEQ ID NO: 1797642 - DNA, 14 bp, Homo sapiens
cctcgctgccagct

SEQ ID NO: 1797643 - DNA, 19 bp, Homo sapiens
cctcgctgccagctctgta

SEQ ID NO: 1797644 - DNA, 17 bp, Homo sapiens
cctcgctggactctcag

SEQ ID NO: 1797645 - DNA, 24 bp, Homo sapiens
cctctacagagcttccctgactca

SEQ ID NO: 1797646 - DNA, 23 bp, Homo sapiens
cctctccactcatgtgactcttt

SEQ ID NO: 1797647 - DNA, 12 bp, Homo sapiens
cctctctgctct

SEQ ID NO: 1797648 - DNA, 17 bp, Homo sapiens
cctctgactcagggctc

SEQ ID NO: 1797649 - DNA, 21 bp, Homo sapiens
cctctgactcagggctcctgg

SEQ ID NO: 1797650 - DNA, 22 bp, Homo sapiens
cctctgactcagggctcctggg

SEQ ID NO: 1797651 - DNA, 15 bp, Homo sapiens
cctctgtccaggcac

SEQ ID NO: 1797652 - DNA, 21 bp, Homo sapiens
cctctgtccaggcactgagat

SEQ ID NO: 1797653 - DNA, 21 bp, Homo sapiens
cctctgtgaccaatgtcttga

SEQ ID NO: 1797654 - DNA, 18 bp, Homo sapiens
cctgaaaacactgtgcac

SEQ ID NO: 1797655 - DNA, 13 bp, Homo sapiens
cctgacactccct

SEQ ID NO: 1797656 - DNA, 22 bp, Homo sapiens
cctgaccctcatctttcttcca

SEQ ID NO: 1797657 - DNA, 13 bp, Homo sapiens
cctgatcagagcc

SEQ ID NO: 1797658 - DNA, 17 bp, Homo sapiens
cctgcaccggggcctgg

SEQ ID NO: 1797659 - DNA, 23 bp, Homo sapiens
cctgccgagagtccatcagcctc

SEQ ID NO: 1797660 - DNA, 19 bp, Homo sapiens
cctgcctggaccagcctct

SEQ ID NO: 1797661 - DNA, 21 bp, Homo sapiens
cctggacatgaagattctttc

SEQ ID NO: 1797662 - DNA, 23 bp, Homo sapiens
cctggacatgaagattctttccc

SEQ ID NO: 1797663 - DNA, 16 bp, Homo sapiens
cctggaccagcctctc

SEQ ID NO: 1797664 - DNA, 12 bp, Homo sapiens
cctgggcaggag

SEQ ID NO: 1797665 - DNA, 15 bp, Homo sapiens
cctgggggtgccagg

SEQ ID NO: 1797666 - DNA, 21 bp, Homo sapiens
cctgggttttgtattctctga

SEQ ID NO: 1797667 - DNA, 23 bp, Homo sapiens
cctgggttttgtattctctgagc

SEQ ID NO: 1797668 - DNA, 15 bp, Homo sapiens
cctggtgctgcctct

SEQ ID NO: 1797669 - DNA, 21 bp, Homo sapiens
cctggtggtggctcgggaggc

SEQ ID NO: 1797670 - DNA, 20 bp, Homo sapiens
cctgtgcagccgctgagcga

SEQ ID NO: 1797671 - DNA, 21 bp, Homo sapiens
ccttattagagtgtctttcca

SEQ ID NO: 1797672 - DNA, 12 bp, Homo sapiens
ccttcctcctgg

SEQ ID NO: 1797673 - DNA, 13 bp, Homo sapiens
ccttctccatcca

SEQ ID NO: 1797674 - DNA, 22 bp, Homo sapiens
ccttctccatccacatgggagc

SEQ ID NO: 1797675 - DNA, 15 bp, Homo sapiens
cgaagcgttgtcctc

SEQ ID NO: 1797676 - DNA, 21 bp, Homo sapiens
cgaagcgttgtcctcagcccc

SEQ ID NO: 1797677 - DNA, 19 bp, Homo sapiens
cgaatacttttgccctttg

SEQ ID NO: 1797678 - DNA, 12 bp, Homo sapiens
cgagaattttca

SEQ ID NO: 1797679 - DNA, 13 bp, Homo sapiens
cgagcacctccac

SEQ ID NO: 1797680 - DNA, 20 bp, Homo sapiens
cgaggaggctccagagggca

SEQ ID NO: 1797681 - DNA, 15 bp, Homo sapiens
cgctgccagctctgt

SEQ ID NO: 1797682 - DNA, 15 bp, Homo sapiens
cgctgccttgccatg

SEQ ID NO: 1797683 - DNA, 14 bp, Homo sapiens
cggagaccctgagt

SEQ ID NO: 1797684 - DNA, 11 bp, Homo sapiens
cggagccactc

SEQ ID NO: 1797685 - DNA, 19 bp, Homo sapiens
gacaacatttttgtacatt

SEQ ID NO: 1797686 - DNA, 21 bp, Homo sapiens
gacagaaaagaaagctgcttt

SEQ ID NO: 1797687 - DNA, 19 bp, Homo sapiens
gacagagttggtgttcata

SEQ ID NO: 1797688 - DNA, 20 bp, Homo sapiens
gacatgaagattctttccca

SEQ ID NO: 1797689 - DNA, 19 bp, Homo sapiens
gaccaatattgtacagttt

SEQ ID NO: 1797690 - DNA, 21 bp, Homo sapiens
gaccaatattgtacagttttt

SEQ ID NO: 1797691 - DNA, 17 bp, Homo sapiens
gacccagccctcatccc

SEQ ID NO: 1797692 - DNA, 15 bp, Homo sapiens
gaccctcatctttct

SEQ ID NO: 1797693 - DNA, 19 bp, Homo sapiens
gaccctcatctttcttcca

SEQ ID NO: 1797694 - DNA, 22 bp, Homo sapiens
gacctggtgctgcctctacctg

SEQ ID NO: 1797695 - DNA, 13 bp, Homo sapiens
gacgcctgaggaa

SEQ ID NO: 1797696 - DNA, 16 bp, Homo sapiens
gactcagggctcctgg

SEQ ID NO: 1797697 - DNA, 16 bp, Homo sapiens
gactcattctgaagga

SEQ ID NO: 1797698 - DNA, 21 bp, Homo sapiens
gactgaccaatattgtacagt

SEQ ID NO: 1797699 - DNA, 16 bp, Homo sapiens
gactgggctgagggag

SEQ ID NO: 1797700 - DNA, 21 bp, Homo sapiens
gactgggctgagggagcctgg

SEQ ID NO: 1797701 - DNA, 18 bp, Homo sapiens
gacttcccacggctcctc

SEQ ID NO: 1797702 - DNA, 18 bp, Homo sapiens
gacttgtcccgggacacc

SEQ ID NO: 1797703 - DNA, 22 bp, Homo sapiens
gagaaactgagaaatgaatgct

SEQ ID NO: 1797704 - DNA, 15 bp, Homo sapiens
gagaaagactgatta

SEQ ID NO: 1797705 - DNA, 18 bp, Homo sapiens
gagacccagccctcatcc

SEQ ID NO: 1797706 - DNA, 14 bp, Homo sapiens
gagactgggctgag

SEQ ID NO: 1797707 - DNA, 15 bp, Homo sapiens
gagactgggctgagg

SEQ ID NO: 1797708 - DNA, 20 bp, Homo sapiens
gagactgggctgagggagcc

SEQ ID NO: 1797709 - DNA, 16 bp, Homo sapiens
gagagccaccaagagg

SEQ ID NO: 1797710 - DNA, 19 bp, Homo sapiens
gagaggagaaactgagaaa

SEQ ID NO: 1797711 - DNA, 15 bp, Homo sapiens
gagataccagcgagg

SEQ ID NO: 1797712 - DNA, 19 bp, Homo sapiens
gagcacctccacatcctcc

SEQ ID NO: 1797713 - DNA, 17 bp, Homo sapiens
gagcaggggtctgagcc

SEQ ID NO: 1797714 - DNA, 14 bp, Homo sapiens
gagcccaagggaat

SEQ ID NO: 1797715 - DNA, 14 bp, Homo sapiens
gagcccagctctga

SEQ ID NO: 1797716 - DNA, 21 bp, Homo sapiens
gagcccagctctgaaaccagt

SEQ ID NO: 1797717 - DNA, 18 bp, Homo sapiens
gagccccattcctgggaa

SEQ ID NO: 1797718 - DNA, 10 bp, Homo sapiens
gagcctgagg

SEQ ID NO: 1797719 - DNA, 12 bp, Homo sapiens
gagcctgaggga

SEQ ID NO: 1797720 - DNA, 22 bp, Homo sapiens
gagctcaggaaccgaggcaggg

SEQ ID NO: 1797721 - DNA, 18 bp, Homo sapiens
gagctgtattaagccact

SEQ ID NO: 1797722 - DNA, 20 bp, Homo sapiens
gaggaaaagtgcaatgcgtg

SEQ ID NO: 1797723 - DNA, 16 bp, Homo sapiens
gaggagaaactgagaa

SEQ ID NO: 1797724 - DNA, 18 bp, Homo sapiens
gaggaggctccagagggc

SEQ ID NO: 1797725 - DNA, 15 bp, Homo sapiens
gaggagggcaggcat

SEQ ID NO: 1797726 - DNA, 22 bp, Homo sapiens
gaggcagcagtgtgaggccagg

SEQ ID NO: 1797727 - DNA, 15 bp, Homo sapiens
gaggccagggcagag

SEQ ID NO: 1797728 - DNA, 20 bp, Homo sapiens
gaggcgaagcgttgtcctca

SEQ ID NO: 1797729 - DNA, 14 bp, Homo sapiens
gaggctccagaggg

SEQ ID NO: 1797730 - DNA, 14 bp, Homo sapiens
gagggcagcagggc

SEQ ID NO: 1797731 - DNA, 15 bp, Homo sapiens
gagggcagcagggct

SEQ ID NO: 1797732 - DNA, 20 bp, Homo sapiens
gagggccccctacttgtttt

SEQ ID NO: 1797733 - DNA, 13 bp, Homo sapiens
gaggggtctttta

SEQ ID NO: 1797734 - DNA, 21 bp, Homo sapiens
gaggtaactatcaatatttaa

SEQ ID NO: 1797735 - DNA, 13 bp, Homo sapiens
gagtccatcagcc

SEQ ID NO: 1797736 - DNA, 17 bp, Homo sapiens
gagtccatcagcctcca

SEQ ID NO: 1797737 - DNA, 14 bp, Homo sapiens
gagtccctgcctgg

SEQ ID NO: 1797738 - DNA, 21 bp, Homo sapiens
gagtccctgcctggaccagcc

SEQ ID NO: 1797739 - DNA, 24 bp, Homo sapiens
gagtgacctcacttctggcactgt

SEQ ID NO: 1797740 - DNA, 23 bp, Homo sapiens
gagtgagacccagccctcatccc

SEQ ID NO: 1797741 - DNA, 18 bp, Homo sapiens
gagtgcagtcctgatcag

SEQ ID NO: 1797742 - DNA, 15 bp, Homo sapiens
gagtgggttgatttc

SEQ ID NO: 1797743 - DNA, 13 bp, Homo sapiens
gagtgtctttcca

SEQ ID NO: 1797744 - DNA, 22 bp, Homo sapiens
gagtgtctttccacggagccac

SEQ ID NO: 1797745 - DNA, 19 bp, Homo sapiens
gagtgttccccttccactg

SEQ ID NO: 1797746 - DNA, 15 bp, Homo sapiens
gagttatattaaaga

SEQ ID NO: 1797747 - DNA, 15 bp, Homo sapiens
gagtttagggtgggg

SEQ ID NO: 1797748 - DNA, 14 bp, Homo sapiens
gataaattacatta

SEQ ID NO: 1797749 - DNA, 15 bp, Homo sapiens
gataaattacattaa

SEQ ID NO: 1797750 - DNA, 22 bp, Homo sapiens
gataccagcgaggaggctccag

SEQ ID NO: 1797751 - DNA, 13 bp, Homo sapiens
gatcacaaaaaca

SEQ ID NO: 1797752 - DNA, 17 bp, Homo sapiens
gatcccatgagctcctt

SEQ ID NO: 1797753 - DNA, 14 bp, Homo sapiens
gatccctcatctgt

SEQ ID NO: 1797754 - DNA, 18 bp, Homo sapiens
gatcgtctgactggtgtt

SEQ ID NO: 1797755 - DNA, 21 bp, Homo sapiens
gatctcattggacccttccat

SEQ ID NO: 1797756 - DNA, 14 bp, Homo sapiens
gatgctccttgggc

SEQ ID NO: 1797757 - DNA, 21 bp, Homo sapiens
gatgctccttgggccctttga

SEQ ID NO: 1797758 - DNA, 19 bp, Homo sapiens
gatgggatggtggagggcc

SEQ ID NO: 1797759 - DNA, 18 bp, Homo sapiens
gatgtaaaagactttttt

SEQ ID NO: 1797760 - DNA, 13 bp, Homo sapiens
gattacctcctga

SEQ ID NO: 1797761 - DNA, 17 bp, Homo sapiens
gattacctcctgagaaa

SEQ ID NO: 1797762 - DNA, 19 bp, Homo sapiens
gattatgtagcaaaataca

SEQ ID NO: 1797763 - DNA, 13 bp, Homo sapiens
gattattcagtgt

SEQ ID NO: 1797764 - DNA, 14 bp, Homo sapiens
gattattcagtgtc

SEQ ID NO: 1797765 - DNA, 20 bp, Homo sapiens
gattgctgccccatcagtgc

SEQ ID NO: 1797766 - DNA, 15 bp, Homo sapiens
gcaatgccatcatct

SEQ ID NO: 1797767 - DNA, 18 bp, Homo sapiens
gcaatgcgtgttgtacat

SEQ ID NO: 1797768 - DNA, 18 bp, Homo sapiens
gcacatgattttcttttg

SEQ ID NO: 1797769 - DNA, 15 bp, Homo sapiens
gcaccaagcaggaaa

SEQ ID NO: 1797770 - DNA, 18 bp, Homo sapiens
gcacctccacatcctcca

SEQ ID NO: 1797771 - DNA, 15 bp, Homo sapiens
gcactggggcagggg

SEQ ID NO: 1797772 - DNA, 18 bp, Homo sapiens
gcactggggcaggggccg

SEQ ID NO: 1797773 - DNA, 15 bp, Homo sapiens
gcactgttccccctg

SEQ ID NO: 1797774 - DNA, 13 bp, Homo sapiens
gcacttttaacaa

SEQ ID NO: 1797775 - DNA, 17 bp, Homo sapiens
gcagcagggctaccctg

SEQ ID NO: 1797776 - DNA, 15 bp, Homo sapiens
gcagcagtgtgaggc

SEQ ID NO: 1797777 - DNA, 19 bp, Homo sapiens
gcagcagtgtgaggccagg

SEQ ID NO: 1797778 - DNA, 21 bp, Homo sapiens
gcagcagtgtgaggccagggc

SEQ ID NO: 1797779 - DNA, 17 bp, Homo sapiens
gcagccgctgagcgagg

SEQ ID NO: 1797780 - DNA, 23 bp, Homo sapiens
gcaggaaatgaaaatgtcttgtg

SEQ ID NO: 1797781 - DNA, 21 bp, Homo sapiens
gcaggcatcggggagccggga

SEQ ID NO: 1797782 - DNA, 21 bp, Homo sapiens
gcagggccccaggcattgcca

SEQ ID NO: 1797783 - DNA, 20 bp, Homo sapiens
gcagggctaccctgagctga

SEQ ID NO: 1797784 - DNA, 20 bp, Homo sapiens
gcaggggccgggggcagtct

SEQ ID NO: 1797785 - DNA, 19 bp, Homo sapiens
gcagtcattatccaggtaa

SEQ ID NO: 1797786 - DNA, 22 bp, Homo sapiens
gcatccagagtccctgcctgga

SEQ ID NO: 1797787 - DNA, 23 bp, Homo sapiens
gcatgcactgttccccctgtgca

SEQ ID NO: 1797788 - DNA, 18 bp, Homo sapiens
gcatttcccttccttcct

SEQ ID NO: 1797789 - DNA, 15 bp, Homo sapiens
gcattttaaaagcaa

SEQ ID NO: 1797790 - DNA, 12 bp, Homo sapiens
tattctctgagc

SEQ ID NO: 1797791 - DNA, 11 bp, Homo sapiens
tattgtacagt

SEQ ID NO: 1797792 - DNA, 14 bp, Homo sapiens
tattgtacagtttt

SEQ ID NO: 1797793 - DNA, 17 bp, Homo sapiens
tattgtacagtttttat

SEQ ID NO: 1797794 - DNA, 17 bp, Homo sapiens
tattgtccattgtccaa

SEQ ID NO: 1797795 - DNA, 18 bp, Homo sapiens
tattgtttcaattgcatc

SEQ ID NO: 1797796 - DNA, 13 bp, Homo sapiens
tatttatataaat

SEQ ID NO: 1797797 - DNA, 21 bp, Homo sapiens
tatttatgtaggatctgtcaa

SEQ ID NO: 1797798 - DNA, 13 bp, Homo sapiens
tatttatttatgt

SEQ ID NO: 1797799 - DNA, 12 bp, Homo sapiens
tatttccttaaa

SEQ ID NO: 1797800 - DNA, 18 bp, Homo sapiens
tattttaaaatctgtcac

SEQ ID NO: 1797801 - DNA, 17 bp, Homo sapiens
tattttaagacgtgaat

SEQ ID NO: 1797802 - DNA, 13 bp, Homo sapiens
tattttcaccatt

SEQ ID NO: 1797803 - DNA, 14 bp, Homo sapiens
tattttcaccattt

SEQ ID NO: 1797804 - DNA, 15 bp, Homo sapiens
tcaaagcaaggaaac

SEQ ID NO: 1797805 - DNA, 16 bp, Homo sapiens
tcaaagcaaggaaact

SEQ ID NO: 1797806 - DNA, 12 bp, Homo sapiens
tcaaagccagcg

SEQ ID NO: 1797807 - DNA, 21 bp, Homo sapiens
tcaagattttttttgtaactt

SEQ ID NO: 1797808 - DNA, 22 bp, Homo sapiens
tcaagcagacgtgagtgtgact

SEQ ID NO: 1797809 - DNA, 12 bp, Homo sapiens
tcaatatttaag

SEQ ID NO: 1797810 - DNA, 18 bp, Homo sapiens
tcaattgcatctcccaga

SEQ ID NO: 1797811 - DNA, 23 bp, Homo sapiens
tcaccatttggcaatgccatcat

SEQ ID NO: 1797812 - DNA, 16 bp, Homo sapiens
tcacccccttctccat

SEQ ID NO: 1797813 - DNA, 18 bp, Homo sapiens
tcacccccttctccatcc

SEQ ID NO: 1797814 - DNA, 22 bp, Homo sapiens
tcacccccttctccatccacat

SEQ ID NO: 1797815 - DNA, 16 bp, Homo sapiens
tcaccgtgggctccct

SEQ ID NO: 1797816 - DNA, 18 bp, Homo sapiens
tcacgccagacttcccac

SEQ ID NO: 1797817 - DNA, 16 bp, Homo sapiens
tcactattacttgaac

SEQ ID NO: 1797818 - DNA, 22 bp, Homo sapiens
tcactggcgacacgtagcagct

SEQ ID NO: 1797819 - DNA, 20 bp, Homo sapiens
tcagagccgtggtcctttgg

SEQ ID NO: 1797820 - DNA, 22 bp, Homo sapiens
tcagaggccctcgctgccagct

SEQ ID NO: 1797821 - DNA, 20 bp, Homo sapiens
tcagcacctacagtgtacag

SEQ ID NO: 1797822 - DNA, 16 bp, Homo sapiens
tcagccccgcgtggaa

SEQ ID NO: 1797823 - DNA, 22 bp, Homo sapiens
tcaggaaaggaatcatttctat

SEQ ID NO: 1797824 - DNA, 17 bp, Homo sapiens
tcaggaaccgaggcagg

SEQ ID NO: 1797825 - DNA, 20 bp, Homo sapiens
tcaggaccaaagctttcatg

SEQ ID NO: 1797826 - DNA, 20 bp, Homo sapiens
tcagtctctgagcagtgaat

SEQ ID NO: 1797827 - DNA, 12 bp, Homo sapiens
tcagtgctccct

SEQ ID NO: 1797828 - DNA, 14 bp, Homo sapiens
tcagtggggcagtc

SEQ ID NO: 1797829 - DNA, 15 bp, Homo sapiens
tcagtgttaaatgtg

SEQ ID NO: 1797830 - DNA, 17 bp, Homo sapiens
tcagtgttaaatgtgat

SEQ ID NO: 1797831 - DNA, 15 bp, Homo sapiens
tcagttctagttgat

SEQ ID NO: 1797832 - DNA, 13 bp, Homo sapiens
tcatacattatat

SEQ ID NO: 1797833 - DNA, 13 bp, Homo sapiens
tcatcattctctg

SEQ ID NO: 1797834 - DNA, 12 bp, Homo sapiens
tcatccatcatc

SEQ ID NO: 1797835 - DNA, 14 bp, Homo sapiens
tcatccatcatcat

SEQ ID NO: 1797836 - DNA, 23 bp, Homo sapiens
tcatctcctgccttcctcctggg

SEQ ID NO: 1797837 - DNA, 12 bp, Homo sapiens
tcatctgtccct

SEQ ID NO: 1797838 - DNA, 18 bp, Homo sapiens
tcatctgtccctccggga

SEQ ID NO: 1797839 - DNA, 12 bp, Homo sapiens
tcatctttcttc

SEQ ID NO: 1797840 - DNA, 13 bp, Homo sapiens
tcatgtaaactgt

SEQ ID NO: 1797841 - DNA, 14 bp, Homo sapiens
tcatgtaaactgtg

SEQ ID NO: 1797842 - DNA, 17 bp, Homo sapiens
tcatgtaaactgtgcac

SEQ ID NO: 1797843 - DNA, 14 bp, Homo sapiens
tcatgtgactcttt

SEQ ID NO: 1797844 - DNA, 21 bp, Homo sapiens
tcatgtgtgtccacgactgtc

SEQ ID NO: 1797845 - DNA, 14 bp, Homo sapiens
tcattctctgtctc

SEQ ID NO: 1797846 - DNA, 19 bp, Homo sapiens
tcatttagtttgattattc

SEQ ID NO: 1797847 - DNA, 17 bp, Homo sapiens
tcatttctatttctcct

SEQ ID NO: 1797848 - DNA, 12 bp, Homo sapiens
tccacaaaataa

SEQ ID NO: 1797849 - DNA, 13 bp, Homo sapiens
tccacatcctcca

SEQ ID NO: 1797850 - DNA, 15 bp, Homo sapiens
tccacgactgtctcc

SEQ ID NO: 1797851 - DNA, 16 bp, Homo sapiens
tccacgactgtctcca

SEQ ID NO: 1797852 - DNA, 21 bp, Homo sapiens
tccactgaaatagagtgaatt

SEQ ID NO: 1797853 - DNA, 15 bp, Homo sapiens
tccacttttaaaact

SEQ ID NO: 1797854 - DNA, 17 bp, Homo sapiens
tccagagggcactctgc

SEQ ID NO: 1797855 - DNA, 20 bp, Homo sapiens
tccagagtccctgcctggac

SEQ ID NO: 1797856 - DNA, 16 bp, Homo sapiens
tcccaacactgccagc

SEQ ID NO: 1797857 - DNA, 23 bp, Homo sapiens
tcccatgagctccttaaggctct

SEQ ID NO: 1797858 - DNA, 21 bp, Homo sapiens
tcccgggacacctaggctagg

SEQ ID NO: 1797859 - DNA, 16 bp, Homo sapiens
tcccgtggaacgtttt

SEQ ID NO: 1797860 - DNA, 22 bp, Homo sapiens
tcccgtggaacgtttttcctgt

SEQ ID NO: 1797861 - DNA, 19 bp, Homo sapiens
tccctagaaacttccaaat

SEQ ID NO: 1797862 - DNA, 16 bp, Homo sapiens
tccctcctctgcccgg

SEQ ID NO: 1797863 - DNA, 21 bp, Homo sapiens
tccctctacagagcttccctg

SEQ ID NO: 1797864 - DNA, 15 bp, Homo sapiens
tcccttaaacaaaaa

SEQ ID NO: 1797865 - DNA, 13 bp, Homo sapiens
tcctaccccctgt

SEQ ID NO: 1797866 - DNA, 19 bp, Homo sapiens
tcctatgtttttgttcaaa

SEQ ID NO: 1797867 - DNA, 19 bp, Homo sapiens
tcctccacgttctgctcat

SEQ ID NO: 1797868 - DNA, 22 bp, Homo sapiens
tcctccacgttctgctcatcat

SEQ ID NO: 1797869 - DNA, 22 bp, Homo sapiens
tcctcctgggccctctctgctc

SEQ ID NO: 1797870 - DNA, 16 bp, Homo sapiens
tcctcgagatcccaac

SEQ ID NO: 1797871 - DNA, 17 bp, Homo sapiens
tcctctactaacaatca

SEQ ID NO: 1797872 - DNA, 18 bp, Homo sapiens
tcctctactaacaatcag

SEQ ID NO: 1797873 - DNA, 18 bp, Homo sapiens
tcctctgactcagggctc

SEQ ID NO: 1797874 - DNA, 24 bp, Homo sapiens
tcctgagaaaaaaggttccgcttg

SEQ ID NO: 1797875 - DNA, 18 bp, Homo sapiens
tcctgcaccggggcctgg

SEQ ID NO: 1797876 - DNA, 16 bp, Homo sapiens
tcctgccttcctcctg

SEQ ID NO: 1797877 - DNA, 19 bp, Homo sapiens
tcctgccttcctcctgggc

SEQ ID NO: 1797878 - DNA, 22 bp, Homo sapiens
tcctgccttcctcctgggccct

SEQ ID NO: 1797879 - DNA, 23 bp, Homo sapiens
tcctgccttcctcctgggccctc

SEQ ID NO: 1797880 - DNA, 17 bp, Homo sapiens
tcctgggttttgtattc

SEQ ID NO: 1797881 - DNA, 23 bp, Homo sapiens
tcctgggttttgtattctctgag

SEQ ID NO: 1797882 - DNA, 23 bp, Homo sapiens
tcctgtctccctcctctgcccgg

SEQ ID NO: 1797883 - DNA, 20 bp, Homo sapiens
tcgtggtaggactgtagaaa

SEQ ID NO: 1797884 - DNA, 14 bp, Homo sapiens
tcgtgtctggcaca

SEQ ID NO: 1797885 - DNA, 19 bp, Homo sapiens
tctacagagcttccctgac

SEQ ID NO: 1797886 - DNA, 12 bp, Homo sapiens
tctactttgaag

SEQ ID NO: 1797887 - DNA, 20 bp, Homo sapiens
tctatttctcctccatggga

SEQ ID NO: 1797888 - DNA, 16 bp, Homo sapiens
tctcactataccagta

SEQ ID NO: 1797889 - DNA, 15 bp, Homo sapiens
tctcagtctctgagc

SEQ ID NO: 1797890 - DNA, 17 bp, Homo sapiens
tctcagtctctgagcag

SEQ ID NO: 1797891 - DNA, 18 bp, Homo sapiens
tctcagtctctgagcagt

SEQ ID NO: 1797892 - DNA, 23 bp, Homo sapiens
tctcccagataatgtgaaaatgg

SEQ ID NO: 1797893 - DNA, 17 bp, Homo sapiens
tctcctgccttcctcct

SEQ ID NO: 1797894 - DNA, 14 bp, Homo sapiens
tctctgagcagtga

SEQ ID NO: 1797895 - DNA, 16 bp, Homo sapiens
tctctgagctgtgcag

SEQ ID NO: 1797896 - DNA, 13 bp, Homo sapiens
ttttttgtttcat

SEQ ID NO: 1797897 - DNA, 14 bp, Homo sapiens
tttttttgtaactt

SEQ ID NO: 1797898 - DNA, 12 bp, Homo sapiens
aataactttttt

SEQ ID NO: 1797899 - DNA, 22 bp, Homo sapiens
aataagaaacaactctttgaga

SEQ ID NO: 1797900 - DNA, 23 bp, Homo sapiens
aatacattttgcacaaagtaagc

SEQ ID NO: 1797901 - DNA, 16 bp, Homo sapiens
aatagagcctgaggga

SEQ ID NO: 1797902 - DNA, 14 bp, Homo sapiens
aatagagtgaatta

SEQ ID NO: 1797903 - DNA, 14 bp, Homo sapiens
aatagcacatgatt

SEQ ID NO: 1797904 - DNA, 19 bp, Homo sapiens
aatagcacatgattttctt

SEQ ID NO: 1797905 - DNA, 20 bp, Homo sapiens
aatatagagatatttttgta

SEQ ID NO: 1797906 - DNA, 15 bp, Homo sapiens
aatattccctagaaa

SEQ ID NO: 1797907 - DNA, 17 bp, Homo sapiens
aatattccctagaaact

SEQ ID NO: 1797908 - DNA, 15 bp, Homo sapiens
aatcacgtaaagcta

SEQ ID NO: 1797909 - DNA, 20 bp, Homo sapiens
aatcacgtaaagctagaaat

SEQ ID NO: 1797910 - DNA, 21 bp, Homo sapiens
aatcacgtaaagctagaaatg

SEQ ID NO: 1797911 - DNA, 16 bp, Homo sapiens
aatccgagtgtttgcc

SEQ ID NO: 1797912 - DNA, 11 bp, Homo sapiens
aatgaagaaag

SEQ ID NO: 1797913 - DNA, 14 bp, Homo sapiens
aatgtatatgcact

SEQ ID NO: 1797914 - DNA, 14 bp, Homo sapiens
aatgtatggcatgt

SEQ ID NO: 1797915 - DNA, 11 bp, Homo sapiens
aatgtcttgtg

SEQ ID NO: 1797916 - DNA, 16 bp, Homo sapiens
aatgtgatgaatactg

SEQ ID NO: 1797917 - DNA, 17 bp, Homo sapiens
aattagtaacatgtgtt

SEQ ID NO: 1797918 - DNA, 22 bp, Homo sapiens
aattatagtgatgtaatcttga

SEQ ID NO: 1797919 - DNA, 12 bp, Homo sapiens
aattatttgcat

SEQ ID NO: 1797920 - DNA, 22 bp, Homo sapiens
aattcctatacgcagcgtgctt

SEQ ID NO: 1797921 - DNA, 13 bp, Homo sapiens
aattctgagggaa

SEQ ID NO: 1797922 - DNA, 21 bp, Homo sapiens
aattctgagggaatttaacca

SEQ ID NO: 1797923 - DNA, 21 bp, Homo sapiens
aattgacttatttatataaat

SEQ ID NO: 1797924 - DNA, 11 bp, Homo sapiens
aattgtccctt

SEQ ID NO: 1797925 - DNA, 15 bp, Homo sapiens
aatttctactttgaa

SEQ ID NO: 1797926 - DNA, 16 bp, Homo sapiens
aatttctactttgaag

SEQ ID NO: 1797927 - DNA, 16 bp, Homo sapiens
aattttaatgaagaaa

SEQ ID NO: 1797928 - DNA, 17 bp, Homo sapiens
aattttcaaataaggaa

SEQ ID NO: 1797929 - DNA, 18 bp, Homo sapiens
aattttctttcatacatt

SEQ ID NO: 1797930 - DNA, 20 bp, Homo sapiens
aattttctttcatacattat

SEQ ID NO: 1797931 - DNA, 23 bp, Homo sapiens
aattttctttcatacattatatt

SEQ ID NO: 1797932 - DNA, 15 bp, Homo sapiens
acaaacaaataaata

SEQ ID NO: 1797933 - DNA, 11 bp, Homo sapiens
acaaaggcaag

SEQ ID NO: 1797934 - DNA, 23 bp, Homo sapiens
acaacatttttgtacattatgtt

SEQ ID NO: 1797935 - DNA, 21 bp, Homo sapiens
acaaggaatagtcgcgcaagc

SEQ ID NO: 1797936 - DNA, 22 bp, Homo sapiens
acaatcagctccttcctggaga

SEQ ID NO: 1797937 - DNA, 17 bp, Homo sapiens
acaccccgacttttgtt

SEQ ID NO: 1797938 - DNA, 11 bp, Homo sapiens
acactgccagc

SEQ ID NO: 1797939 - DNA, 18 bp, Homo sapiens
acactgtgcacatctgtg

SEQ ID NO: 1797940 - DNA, 14 bp, Homo sapiens
acagaaaagaaagc

SEQ ID NO: 1797941 - DNA, 20 bp, Homo sapiens
acagaactctttcaaaacct

SEQ ID NO: 1797942 - DNA, 14 bp, Homo sapiens
acagaggtaactat

SEQ ID NO: 1797943 - DNA, 17 bp, Homo sapiens
acagagttggtgttcat

SEQ ID NO: 1797944 - DNA, 22 bp, Homo sapiens
acagtaggagcccagctctgaa

SEQ ID NO: 1797945 - DNA, 15 bp, Homo sapiens
acagtcttgtattaa

SEQ ID NO: 1797946 - DNA, 17 bp, Homo sapiens
acagtgtacagtcttgt

SEQ ID NO: 1797947 - DNA, 15 bp, Homo sapiens
acagtttttattgct

SEQ ID NO: 1797948 - DNA, 19 bp, Homo sapiens
acatggtgggtccatgggc

SEQ ID NO: 1797949 - DNA, 17 bp, Homo sapiens
acatgtaggaagtagga

SEQ ID NO: 1797950 - DNA, 15 bp, Homo sapiens
acattatattcctct

SEQ ID NO: 1797951 - DNA, 21 bp, Homo sapiens
acattatgttattggaatttt

SEQ ID NO: 1797952 - DNA, 23 bp, Homo sapiens
acattatgttattggaattttct

SEQ ID NO: 1797953 - DNA, 14 bp, Homo sapiens
acattcatatctta

SEQ ID NO: 1797954 - DNA, 15 bp, Homo sapiens
acattcatatcttaa

SEQ ID NO: 1797955 - DNA, 21 bp, Homo sapiens
acatttttgtacattatgtta

SEQ ID NO: 1797956 - DNA, 17 bp, Homo sapiens
accaatattgtacagtt

SEQ ID NO: 1797957 - DNA, 18 bp, Homo sapiens
accagagaaaaagggagg

SEQ ID NO: 1797958 - DNA, 20 bp, Homo sapiens
accagagaaaaagggagggg

SEQ ID NO: 1797959 - DNA, 22 bp, Homo sapiens
acccagaggaaggggccagagg

SEQ ID NO: 1797960 - DNA, 13 bp, Homo sapiens
acccatgccatag

SEQ ID NO: 1797961 - DNA, 19 bp, Homo sapiens
accctcatctttcttccaa

SEQ ID NO: 1797962 - DNA, 19 bp, Homo sapiens
acccttacagtaggagccc

SEQ ID NO: 1797963 - DNA, 12 bp, Homo sapiens
acccttttccag

SEQ ID NO: 1797964 - DNA, 13 bp, Homo sapiens
accgaggcaggga

SEQ ID NO: 1797965 - DNA, 16 bp, Homo sapiens
acctacagtgtacagt

SEQ ID NO: 1797966 - DNA, 17 bp, Homo sapiens
acctacagtgtacagtc

SEQ ID NO: 1797967 - DNA, 18 bp, Homo sapiens
acctcgctggactctcag

SEQ ID NO: 1797968 - DNA, 17 bp, Homo sapiens
acctcttcagaggccct

SEQ ID NO: 1797969 - DNA, 20 bp, Homo sapiens
acctgaaaacactgtgcaca

SEQ ID NO: 1797970 - DNA, 21 bp, Homo sapiens
acctgaaaacactgtgcacat

SEQ ID NO: 1797971 - DNA, 16 bp, Homo sapiens
acctgcccccaatcca

SEQ ID NO: 1797972 - DNA, 22 bp, Homo sapiens
acctgtgcttcgggcccttccc

SEQ ID NO: 1797973 - DNA, 23 bp, Homo sapiens
acctgtgcttcgggcccttccca

SEQ ID NO: 1797974 - DNA, 17 bp, Homo sapiens
acctgtggccaagttct

SEQ ID NO: 1797975 - DNA, 19 bp, Homo sapiens
acctgtggccaagttctta

SEQ ID NO: 1797976 - DNA, 14 bp, Homo sapiens
acgaatacttttgc

SEQ ID NO: 1797977 - DNA, 16 bp, Homo sapiens
acgccagacttcccac

SEQ ID NO: 1797978 - DNA, 19 bp, Homo sapiens
acggagccactcctctgac

SEQ ID NO: 1797979 - DNA, 19 bp, Homo sapiens
acgtattttgatgttttgt

SEQ ID NO: 1797980 - DNA, 15 bp, Homo sapiens
acgtgaatgtctcag

SEQ ID NO: 1797981 - DNA, 16 bp, Homo sapiens
acgtgtttgtgctgtg

SEQ ID NO: 1797982 - DNA, 16 bp, Homo sapiens
acgttatatattgtat

SEQ ID NO: 1797983 - DNA, 17 bp, Homo sapiens
acgttatatattgtatt

SEQ ID NO: 1797984 - DNA, 14 bp, Homo sapiens
actactatggctgt

SEQ ID NO: 1797985 - DNA, 22 bp, Homo sapiens
actactgataacgtattttgat

SEQ ID NO: 1797986 - DNA, 16 bp, Homo sapiens
actagggatccctcat

SEQ ID NO: 1797987 - DNA, 19 bp, Homo sapiens
actagggatccctcatctg

SEQ ID NO: 1797988 - DNA, 20 bp, Homo sapiens
actagggatccctcatctgt

SEQ ID NO: 1797989 - DNA, 16 bp, Homo sapiens
actagggccaagccca

SEQ ID NO: 1797990 - DNA, 16 bp, Homo sapiens
actatatttatttatg

SEQ ID NO: 1797991 - DNA, 14 bp, Homo sapiens
actcctctgactca

SEQ ID NO: 1797992 - DNA, 20 bp, Homo sapiens
actcctctgactcagggctc

SEQ ID NO: 1797993 - DNA, 14 bp, Homo sapiens
actctcagtctctg

SEQ ID NO: 1797994 - DNA, 15 bp, Homo sapiens
actgaggccattatt

SEQ ID NO: 1797995 - DNA, 12 bp, Homo sapiens
actgagggcagt

SEQ ID NO: 1797996 - DNA, 10 bp, Homo sapiens
actgcagtga

SEQ ID NO: 1797997 - DNA, 11 bp, Homo sapiens
actgcagtgac

SEQ ID NO: 1797998 - DNA, 12 bp, Homo sapiens
actgccagcatt

SEQ ID NO: 1797999 - DNA, 14 bp, Homo sapiens
actgcttgaggaaa

SEQ ID NO: 1798000 - DNA, 17 bp, Homo sapiens
actgggctgagggagcc

SEQ ID NO: 1798001 - DNA, 14 bp, Homo sapiens
actggggcaggggc

SEQ ID NO: 1798002 - DNA, 16 bp, Homo sapiens
actggggcaggggccg

SEQ ID NO: 1798003 - DNA, 12 bp, Homo sapiens
actgtgcagtga

SEQ ID NO: 1798004 - DNA, 16 bp, Homo sapiens
acttactcccattttc

SEQ ID NO: 1798005 - DNA, 19 bp, Homo sapiens
aagttctgtactcaaatgt

SEQ ID NO: 1798006 - DNA, 13 bp, Homo sapiens
aataaagtgaata

SEQ ID NO: 1798007 - DNA, 17 bp, Homo sapiens
ccatgggcagagcccaa

SEQ ID NO: 1798008 - DNA, 12 bp, Homo sapiens
ccattctttccc

SEQ ID NO: 1798009 - DNA, 15 bp, Homo sapiens
ccattggatctcatt

SEQ ID NO: 1798010 - DNA, 19 bp, Homo sapiens
ccattgtccaatcctatgt

SEQ ID NO: 1798011 - DNA, 20 bp, Homo sapiens
cccaaagtggtatagaaatg

SEQ ID NO: 1798012 - DNA, 14 bp, Homo sapiens
cccaacactgccag

SEQ ID NO: 1798013 - DNA, 15 bp, Homo sapiens
cccacggctcctcga

SEQ ID NO: 1798014 - DNA, 23 bp, Homo sapiens
cccagaggaaggggccagaggct

SEQ ID NO: 1798015 - DNA, 12 bp, Homo sapiens
cccagctctgaa

SEQ ID NO: 1798016 - DNA, 22 bp, Homo sapiens
cccatcagtgctccctcacatg

SEQ ID NO: 1798017 - DNA, 14 bp, Homo sapiens
cccatgagctcctt

SEQ ID NO: 1798018 - DNA, 23 bp, Homo sapiens
ccccattcctgggaaatattccc

SEQ ID NO: 1798019 - DNA, 12 bp, Homo sapiens
cccctctgtcca

SEQ ID NO: 1798020 - DNA, 11 bp, Homo sapiens
cccctgtgcag

SEQ ID NO: 1798021 - DNA, 14 bp, Homo sapiens
ccccttccactgag

SEQ ID NO: 1798022 - DNA, 17 bp, Homo sapiens
ccctcatcccgagcacc

SEQ ID NO: 1798023 - DNA, 21 bp, Homo sapiens
ccctctacagagcttccctga

SEQ ID NO: 1798024 - DNA, 15 bp, Homo sapiens
ccctctctgctctgc

SEQ ID NO: 1798025 - DNA, 16 bp, Homo sapiens
ccctctctgctctgcg

SEQ ID NO: 1798026 - DNA, 20 bp, Homo sapiens
ccctctgtccaggcactgag

SEQ ID NO: 1798027 - DNA, 21 bp, Homo sapiens
ccctgactcattctgaaggag

SEQ ID NO: 1798028 - DNA, 13 bp, Homo sapiens
ccctgactgggag

SEQ ID NO: 1798029 - DNA, 21 bp, Homo sapiens
ccctgagctgaggcagcagtg

SEQ ID NO: 1798030 - DNA, 12 bp, Homo sapiens
ccctgccagggc

SEQ ID NO: 1798031 - DNA, 14 bp, Homo sapiens
ccctgccagggcag

SEQ ID NO: 1798032 - DNA, 22 bp, Homo sapiens
ccctgtgccttgtcacgccaga

SEQ ID NO: 1798033 - DNA, 12 bp, Homo sapiens
ccctttgagtgc

SEQ ID NO: 1798034 - DNA, 19 bp, Homo sapiens
ccgggacacctaggctagg

SEQ ID NO: 1798035 - DNA, 15 bp, Homo sapiens
ccgggagctcaggaa

SEQ ID NO: 1798036 - DNA, 21 bp, Homo sapiens
ccgggggcagtctgagagagg

SEQ ID NO: 1798037 - DNA, 23 bp, Homo sapiens
ccgtggctgtggcatccagagtc

SEQ ID NO: 1798038 - DNA, 15 bp, Homo sapiens
cctaaagaggaaaag

SEQ ID NO: 1798039 - DNA, 16 bp, Homo sapiens
cctaataaagttctgt

SEQ ID NO: 1798040 - DNA, 16 bp, Homo sapiens
cctacagtgtacagtc

SEQ ID NO: 1798041 - DNA, 16 bp, Homo sapiens
cctaggctagggtggg

SEQ ID NO: 1798042 - DNA, 21 bp, Homo sapiens
cctagtgaaggcttctctctg

SEQ ID NO: 1798043 - DNA, 22 bp, Homo sapiens
cctatacgcagcgtgctttaaa

SEQ ID NO: 1798044 - DNA, 13 bp, Homo sapiens
cctcaatccagct

SEQ ID NO: 1798045 - DNA, 17 bp, Homo sapiens
cctcatctgtccctccg

SEQ ID NO: 1798046 - DNA, 15 bp, Homo sapiens
cctcatcttcttcac

SEQ ID NO: 1798047 - DNA, 16 bp, Homo sapiens
cctccacatcctccac

SEQ ID NO: 1798048 - DNA, 17 bp, Homo sapiens
cctccacgttctgctca

SEQ ID NO: 1798049 - DNA, 17 bp, Homo sapiens
cctccatcctaccccct

SEQ ID NO: 1798050 - DNA, 21 bp, Homo sapiens
cctcctgggccctctctgctc

SEQ ID NO: 1798051 - DNA, 20 bp, Homo sapiens
cctcgctgccagctctgtat

SEQ ID NO: 1798052 - DNA, 21 bp, Homo sapiens
cctctacagagcttccctgac

SEQ ID NO: 1798053 - DNA, 15 bp, Homo sapiens
cctctctgctctgcg

SEQ ID NO: 1798054 - DNA, 16 bp, Homo sapiens
cctctgactcagggct

SEQ ID NO: 1798055 - DNA, 19 bp, Homo sapiens
cctctgtgaccaatgtctt

SEQ ID NO: 1798056 - DNA, 21 bp, Homo sapiens
cctcttctgggagggcagcag

SEQ ID NO: 1798057 - DNA, 15 bp, Homo sapiens
cctgaattattccaa

SEQ ID NO: 1798058 - DNA, 19 bp, Homo sapiens
cctgaccctcatctttctt

SEQ ID NO: 1798059 - DNA, 16 bp, Homo sapiens
cctgagctgaggcagc

SEQ ID NO: 1798060 - DNA, 18 bp, Homo sapiens
cctgagctgaggcagcag

SEQ ID NO: 1798061 - DNA, 19 bp, Homo sapiens
cctgcaaaaggactctcag

SEQ ID NO: 1798062 - DNA, 13 bp, Homo sapiens
cctgccagggcag

SEQ ID NO: 1798063 - DNA, 16 bp, Homo sapiens
cctgcccccaatccat

SEQ ID NO: 1798064 - DNA, 22 bp, Homo sapiens
cctgccgagagtccatcagcct

SEQ ID NO: 1798065 - DNA, 17 bp, Homo sapiens
cctgccttcctcctggg

SEQ ID NO: 1798066 - DNA, 22 bp, Homo sapiens
cctgccttcctcctgggccctc

SEQ ID NO: 1798067 - DNA, 20 bp, Homo sapiens
cctgcggagaccctgagtcc

SEQ ID NO: 1798068 - DNA, 15 bp, Homo sapiens
cctggaccagcctct

SEQ ID NO: 1798069 - DNA, 11 bp, Homo sapiens
cctgggccctc

SEQ ID NO: 1798070 - DNA, 14 bp, Homo sapiens
cctgggccctctct

SEQ ID NO: 1798071 - DNA, 18 bp, Homo sapiens
cctgggccctctctgctc

SEQ ID NO: 1798072 - DNA, 16 bp, Homo sapiens
cctgggggtgccagga

SEQ ID NO: 1798073 - DNA, 22 bp, Homo sapiens
cctgggttttgtattctctgag

SEQ ID NO: 1798074 - DNA, 20 bp, Homo sapiens
cctggtgctgcctctacctg

SEQ ID NO: 1798075 - DNA, 18 bp, Homo sapiens
cctggtggtggctcggga

SEQ ID NO: 1798076 - DNA, 21 bp, Homo sapiens
cctgtctccctcctctgcccg

SEQ ID NO: 1798077 - DNA, 18 bp, Homo sapiens
cctgtgcagccgctgagc

SEQ ID NO: 1798078 - DNA, 20 bp, Homo sapiens
cctgtggccaagttcttagt

SEQ ID NO: 1798079 - DNA, 16 bp, Homo sapiens
ccttaaggctcttttg

SEQ ID NO: 1798080 - DNA, 16 bp, Homo sapiens
ccttattagagtgtct

SEQ ID NO: 1798081 - DNA, 23 bp, Homo sapiens
ccttccatggtgtgatcgtctga

SEQ ID NO: 1798082 - DNA, 16 bp, Homo sapiens
ccttctccatccacat

SEQ ID NO: 1798083 - DNA, 12 bp, Homo sapiens
ccttgggccctt

SEQ ID NO: 1798084 - DNA, 14 bp, Homo sapiens
ccttgggccctttg

SEQ ID NO: 1798085 - DNA, 16 bp, Homo sapiens
ccttggttcccccact

SEQ ID NO: 1798086 - DNA, 19 bp, Homo sapiens
cctttcccaggtgctacac

SEQ ID NO: 1798087 - DNA, 19 bp, Homo sapiens
cctttgagtgcagtcctga

SEQ ID NO: 1798088 - DNA, 22 bp, Homo sapiens
cgaatctctttttgctttcgaa

SEQ ID NO: 1798089 - DNA, 23 bp, Homo sapiens
aggtgcttctagttctgccagga

SEQ ID NO: 1798090 - DNA, 19 bp, Homo sapiens
aggtggggagactgggctg

SEQ ID NO: 1798091 - DNA, 18 bp, Homo sapiens
aggttccgcttggagcag

SEQ ID NO: 1798092 - DNA, 21 bp, Homo sapiens
aggttccgcttggagcagagg

SEQ ID NO: 1798093 - DNA, 22 bp, Homo sapiens
agtataggataaattacattaa

SEQ ID NO: 1798094 - DNA, 14 bp, Homo sapiens
agtccctgcctgga

SEQ ID NO: 1798095 - DNA, 15 bp, Homo sapiens
agtccctgcctggac

SEQ ID NO: 1798096 - DNA, 20 bp, Homo sapiens
agtcctgatcagagccgtgg

SEQ ID NO: 1798097 - DNA, 13 bp, Homo sapiens
agtctctgagcag

SEQ ID NO: 1798098 - DNA, 23 bp, Homo sapiens
agtctgagagaggccattctttc

SEQ ID NO: 1798099 - DNA, 16 bp, Homo sapiens
agtcttacgaatactt

SEQ ID NO: 1798100 - DNA, 16 bp, Homo sapiens
agtcttccatttgcaa

SEQ ID NO: 1798101 - DNA, 16 bp, Homo sapiens
agtcttggaatacttg

SEQ ID NO: 1798102 - DNA, 16 bp, Homo sapiens
tgaggccattatttca

SEQ ID NO: 1798103 - DNA, 11 bp, Homo sapiens
tgagggcagtc

SEQ ID NO: 1798104 - DNA, 15 bp, Homo sapiens
tgagtgcagtcctga

SEQ ID NO: 1798105 - DNA, 12 bp, Homo sapiens
tgagtgctctga

SEQ ID NO: 1798106 - DNA, 14 bp, Homo sapiens
tgagtgtgactttt

SEQ ID NO: 1798107 - DNA, 17 bp, Homo sapiens
tgagtgtgactttttga

SEQ ID NO: 1798108 - DNA, 21 bp, Homo sapiens
tgatcagagccgtggtccttt

SEQ ID NO: 1798109 - DNA, 22 bp, Homo sapiens
tgatcagagccgtggtcctttg

SEQ ID NO: 1798110 - DNA, 17 bp, Homo sapiens
tgattgcgagaattttc

SEQ ID NO: 1798111 - DNA, 21 bp, Homo sapiens
tgatttcagcacctacagtgt

SEQ ID NO: 1798112 - DNA, 16 bp, Homo sapiens
tgattttgctgtagaa

SEQ ID NO: 1798113 - DNA, 14 bp, Homo sapiens
tgcacactttgcca

SEQ ID NO: 1798114 - DNA, 22 bp, Homo sapiens
tgcacactttgccatattttca

SEQ ID NO: 1798115 - DNA, 15 bp, Homo sapiens
tgcacatctgtgtct

SEQ ID NO: 1798116 - DNA, 23 bp, Homo sapiens
tgcaccagggttgaccccagagg

SEQ ID NO: 1798117 - DNA, 21 bp, Homo sapiens
tgcactgttccccctgtgcag

SEQ ID NO: 1798118 - DNA, 14 bp, Homo sapiens
tgcagccgctgagc

SEQ ID NO: 1798119 - DNA, 21 bp, Homo sapiens
tgcagtgacctgccctacata

SEQ ID NO: 1798120 - DNA, 18 bp, Homo sapiens
tgcataacaattcctcta

SEQ ID NO: 1798121 - DNA, 18 bp, Homo sapiens
tgcatctcccagataatg

SEQ ID NO: 1798122 - DNA, 21 bp, Homo sapiens
tgccaagggctttgttttgca

SEQ ID NO: 1798123 - DNA, 13 bp, Homo sapiens
tgccacagcctcc

SEQ ID NO: 1798124 - DNA, 22 bp, Homo sapiens
tgccacagcctcccctgccagg

SEQ ID NO: 1798125 - DNA, 20 bp, Homo sapiens
tgccaggaccagtcaacctg

SEQ ID NO: 1798126 - DNA, 17 bp, Homo sapiens
tgccatattttcaccat

SEQ ID NO: 1798127 - DNA, 16 bp, Homo sapiens
tgccatcatctcctgc

SEQ ID NO: 1798128 - DNA, 17 bp, Homo sapiens
tgcctctacctgacact

SEQ ID NO: 1798129 - DNA, 13 bp, Homo sapiens
tgcctcttctggg

SEQ ID NO: 1798130 - DNA, 15 bp, Homo sapiens
tgcctcttctgggag

SEQ ID NO: 1798131 - DNA, 21 bp, Homo sapiens
tgcctcttctgggagggcagc

SEQ ID NO: 1798132 - DNA, 18 bp, Homo sapiens
tgcctgacatttggagtg

SEQ ID NO: 1798133 - DNA, 21 bp, Homo sapiens
tgccttattagagtgtctttc

SEQ ID NO: 1798134 - DNA, 14 bp, Homo sapiens
tgccttcctcctgg

SEQ ID NO: 1798135 - DNA, 16 bp, Homo sapiens
tgccttcctcctgggc

SEQ ID NO: 1798136 - DNA, 20 bp, Homo sapiens
tgccttcctcctgggccctc

SEQ ID NO: 1798137 - DNA, 19 bp, Homo sapiens
tgcgtccacgagctgttta

SEQ ID NO: 1798138 - DNA, 13 bp, Homo sapiens
tgctaattctgag

SEQ ID NO: 1798139 - DNA, 16 bp, Homo sapiens
cacggagccactcctc

SEQ ID NO: 1798140 - DNA, 23 bp, Homo sapiens
cacggagccactcctctgactca

SEQ ID NO: 1798141 - DNA, 14 bp, Homo sapiens
cactgagggcagtc

SEQ ID NO: 1798142 - DNA, 20 bp, Homo sapiens
cactgcaacttctacctccg

SEQ ID NO: 1798143 - DNA, 14 bp, Homo sapiens
cactgcttgaggaa

SEQ ID NO: 1798144 - DNA, 15 bp, Homo sapiens
cactggggcaggggc

SEQ ID NO: 1798145 - DNA, 20 bp, Homo sapiens
cactgtgcacatctgtgtct

SEQ ID NO: 1798146 - DNA, 17 bp, Homo sapiens
cactgttccccctgtgc

SEQ ID NO: 1798147 - DNA, 22 bp, Homo sapiens
cacttgtgggtttttgttttgt

SEQ ID NO: 1798148 - DNA, 13 bp, Homo sapiens
cacttttaaaact

SEQ ID NO: 1798149 - DNA, 23 bp, Homo sapiens
cacttttaacaaaaaaggaaaat

SEQ ID NO: 1798150 - DNA, 20 bp, Homo sapiens
cagaaaagaaagctgctttc

SEQ ID NO: 1798151 - DNA, 23 bp, Homo sapiens
cagaaatgtatggcatgtgtagt

SEQ ID NO: 1798152 - DNA, 14 bp, Homo sapiens
cagaactctttcaa

SEQ ID NO: 1798153 - DNA, 16 bp, Homo sapiens
cagaactctttcaaaa

SEQ ID NO: 1798154 - DNA, 22 bp, Homo sapiens
cagacaagtctggcacttcctt

SEQ ID NO: 1798155 - DNA, 20 bp, Homo sapiens
cagacgtgagtgtgactttt

SEQ ID NO: 1798156 - DNA, 12 bp, Homo sapiens
cagacttcccac

SEQ ID NO: 1798157 - DNA, 21 bp, Homo sapiens
ttatagtgatgtaatcttgaa

SEQ ID NO: 1798158 - DNA, 21 bp, Homo sapiens
ttatcaccgtgggctccctga

SEQ ID NO: 1798159 - DNA, 13 bp, Homo sapiens
ttattcagtgtca

SEQ ID NO: 1798160 - DNA, 22 bp, Homo sapiens
ttatttcaaccgcttgccatat

SEQ ID NO: 1798161 - DNA, 11 bp, Homo sapiens
ttatttgcata

SEQ ID NO: 1798162 - DNA, 15 bp, Homo sapiens
ttcaattgcatctcc

SEQ ID NO: 1798163 - DNA, 19 bp, Homo sapiens
ttcacatctaacctcatct

SEQ ID NO: 1798164 - DNA, 24 bp, Homo sapiens
ttcaccatttggcaatgccatcat

SEQ ID NO: 1798165 - DNA, 17 bp, Homo sapiens
ttcacttttgacaaagg

SEQ ID NO: 1798166 - DNA, 22 bp, Homo sapiens
ttcagaagacacaggggagcag

SEQ ID NO: 1798167 - DNA, 13 bp, Homo sapiens
ttcatacattata

SEQ ID NO: 1798168 - DNA, 16 bp, Homo sapiens
ttcatacattatattc

SEQ ID NO: 1798169 - DNA, 18 bp, Homo sapiens
ttcatgatgaattacttc

SEQ ID NO: 1798170 - DNA, 17 bp, Homo sapiens
ttcatggcagaaggcaa

SEQ ID NO: 1798171 - DNA, 21 bp, Homo sapiens
ttccactgaaatagagtgaat

SEQ ID NO: 1798172 - DNA, 18 bp, Homo sapiens
ttccagctggatgagaat

SEQ ID NO: 1798173 - DNA, 18 bp, Homo sapiens
ttcccacaggacatttct

SEQ ID NO: 1798174 - DNA, 14 bp, Homo sapiens
ttccccttccactg

SEQ ID NO: 1798175 - DNA, 13 bp, Homo sapiens
ttccgcttggagc

SEQ ID NO: 1798176 - DNA, 16 bp, Homo sapiens
ttcctaataaagttct

SEQ ID NO: 1798177 - DNA, 19 bp, Homo sapiens
ttcctatacgcagcgtgct

SEQ ID NO: 1798178 - DNA, 21 bp, Homo sapiens
ttcctgggaaatattccctag

SEQ ID NO: 1798179 - DNA, 17 bp, Homo sapiens
ttctaagtctttccatt

SEQ ID NO: 1798180 - DNA, 17 bp, Homo sapiens
ttctagttctgccagga

SEQ ID NO: 1798181 - DNA, 22 bp, Homo sapiens
ttctagttgattgcgagaattt

SEQ ID NO: 1798182 - DNA, 23 bp, Homo sapiens
ttctcctccatgggagaaaatag

SEQ ID NO: 1798183 - DNA, 19 bp, Homo sapiens
ttctctaagagaacaatgt

SEQ ID NO: 1798184 - DNA, 14 bp, Homo sapiens
ttctgctcatcatt

SEQ ID NO: 1798185 - DNA, 20 bp, Homo sapiens
ttctgtatgtgacaacattt

SEQ ID NO: 1798186 - DNA, 22 bp, Homo sapiens
ttcttggttgaggaaacaaaca

SEQ ID NO: 1798187 - DNA, 20 bp, Homo sapiens
ttcttttgttttcttcattt

SEQ ID NO: 1798188 - DNA, 22 bp, Homo sapiens
ttgaaaaaatagagcctgaggg

SEQ ID NO: 1798189 - DNA, 18 bp, Homo sapiens
ttgaaattaacctctcac

SEQ ID NO: 1798190 - DNA, 18 bp, Homo sapiens
ttgacaaaggcaagcact

SEQ ID NO: 1798191 - DNA, 22 bp, Homo sapiens
ttgacagagttggtgttcataa

SEQ ID NO: 1798192 - DNA, 16 bp, Homo sapiens
ttgatgtgtgtctagg

SEQ ID NO: 1798193 - DNA, 15 bp, Homo sapiens
ttgattattcagtgt

SEQ ID NO: 1798194 - DNA, 15 bp, Homo sapiens
ttgattgcgagaatt

SEQ ID NO: 1798195 - DNA, 16 bp, Homo sapiens
ttgccaggcttaagga

SEQ ID NO: 1798196 - DNA, 19 bp, Homo sapiens
ttgccatattttcaccatt

SEQ ID NO: 1798197 - DNA, 15 bp, Homo sapiens
ttgcgagaattttca

SEQ ID NO: 1798198 - DNA, 19 bp, Homo sapiens
ttgctgccccatcagtgct

SEQ ID NO: 1798199 - DNA, 20 bp, Homo sapiens
ttgctgtagaagatggcact

SEQ ID NO: 1798200 - DNA, 16 bp, Homo sapiens
ttggacttgtcccggg

SEQ ID NO: 1798201 - DNA, 19 bp, Homo sapiens
ttggagtgttccccttcca

SEQ ID NO: 1798202 - DNA, 18 bp, Homo sapiens
ttggtttttaaaacccag

SEQ ID NO: 1798203 - DNA, 22 bp, Homo sapiens
ttgtacatacagaggtaactat

SEQ ID NO: 1798204 - DNA, 11 bp, Homo sapiens
ttgtacattat

SEQ ID NO: 1798205 - DNA, 12 bp, Homo sapiens
ttgtacattatg

SEQ ID NO: 1798206 - DNA, 21 bp, Homo sapiens
ttgtacttttgtgttactgca

SEQ ID NO: 1798207 - DNA, 15 bp, Homo sapiens
ttgtattctctgagc

SEQ ID NO: 1798208 - DNA, 16 bp, Homo sapiens
ttgtattctctgagct

SEQ ID NO: 1798209 - DNA, 13 bp, Homo sapiens
ttgtcacgccaga

SEQ ID NO: 1798210 - DNA, 21 bp, Homo sapiens
ttgttaataaaagtacatgtt

SEQ ID NO: 1798211 - DNA, 13 bp, Homo sapiens
tttaaaactatat

SEQ ID NO: 1798212 - DNA, 23 bp, Homo sapiens
tttaaaatgccaagcaagggaca

SEQ ID NO: 1798213 - DNA, 20 bp, Homo sapiens
tttaagtttgttgctgtcaa

SEQ ID NO: 1798214 - DNA, 23 bp, Homo sapiens
tttactagggatccctcatctgt

SEQ ID NO: 1798215 - DNA, 14 bp, Homo sapiens
tttagaactactga

SEQ ID NO: 1798216 - DNA, 14 bp, Homo sapiens
tttcaaataaggaa

SEQ ID NO: 1798217 - DNA, 18 bp, Homo sapiens
tttcaaccgcttgccata

SEQ ID NO: 1798218 - DNA, 20 bp, Homo sapiens
tttcaattgcatctcccaga

SEQ ID NO: 1798219 - DNA, 16 bp, Homo sapiens
tttcagatataaaaga

SEQ ID NO: 1798220 - DNA, 14 bp, Homo sapiens
tttcataagtattt

SEQ ID NO: 1798221 - DNA, 19 bp, Homo sapiens
tttcataagtatttcaaat

SEQ ID NO: 1798222 - DNA, 12 bp, Homo sapiens
tttcatacatta

SEQ ID NO: 1798223 - DNA, 17 bp, Homo sapiens
tttcatacattatattc

SEQ ID NO: 1798224 - DNA, 15 bp, Homo sapiens
tttcccaattcacat

SEQ ID NO: 1798225 - DNA, 16 bp, Homo sapiens
tttcgaataaagtgaa

SEQ ID NO: 1798226 - DNA, 17 bp, Homo sapiens
tttcgaataaagtgaat

SEQ ID NO: 1798227 - DNA, 22 bp, Homo sapiens
tttctactttgaagtcatacca

SEQ ID NO: 1798228 - DNA, 17 bp, Homo sapiens
tttctatttctcctcca

SEQ ID NO: 1798229 - DNA, 21 bp, Homo sapiens
tttctttagtttttgtgaagt

SEQ ID NO: 1798230 - DNA, 14 bp, Homo sapiens
tttctttcatacat

SEQ ID NO: 1798231 - DNA, 21 bp, Homo sapiens
tttgagaaacaacaatttcta

SEQ ID NO: 1798232 - DNA, 14 bp, Homo sapiens
tttgagtgctctga

SEQ ID NO: 1798233 - DNA, 14 bp, Homo sapiens
tttgcaacctcgct

SEQ ID NO: 1798234 - DNA, 17 bp, Homo sapiens
tttgcataacaattcct

SEQ ID NO: 1798235 - DNA, 21 bp, Homo sapiens
tttgctgtagaagatggcact

SEQ ID NO: 1798236 - DNA, 14 bp, Homo sapiens
tttggcatgaaagt

SEQ ID NO: 1798237 - DNA, 13 bp, Homo sapiens
tttgtacattatg

SEQ ID NO: 1798238 - DNA, 22 bp, Homo sapiens
tttgtacattatgttattggaa

SEQ ID NO: 1798239 - DNA, 18 bp, Homo sapiens
tttgtacgttatatattg

SEQ ID NO: 1798240 - DNA, 12 bp, Homo sapiens
tttgtttttcat

SEQ ID NO: 1798241 - DNA, 13 bp, Homo sapiens
ttttaaaacccag

SEQ ID NO: 1798242 - DNA, 22 bp, Homo sapiens
ttttaagttacacatttttcag

SEQ ID NO: 1798243 - DNA, 23 bp, Homo sapiens
ttttatttaactgtgcagtgact

SEQ ID NO: 1798244 - DNA, 15 bp, Homo sapiens
ttttcagatataaaa

SEQ ID NO: 1798245 - DNA, 22 bp, Homo sapiens
ttttcagatataaaagactgac

SEQ ID NO: 1798246 - DNA, 12 bp, Homo sapiens
ttttcagttttc

SEQ ID NO: 1798247 - DNA, 14 bp, Homo sapiens
ttttcagttttcag

SEQ ID NO: 1798248 - DNA, 20 bp, Homo sapiens
ttttccagctggatgagaat

SEQ ID NO: 1798249 - DNA, 16 bp, Homo sapiens
ttttgctcttctgtat

SEQ ID NO: 1798250 - DNA, 13 bp, Homo sapiens
ttttgctgtagaa

SEQ ID NO: 1798251 - DNA, 17 bp, Homo sapiens
ttttgtaacttcaaata

SEQ ID NO: 1798252 - DNA, 15 bp, Homo sapiens
ttttgtacattatgt

SEQ ID NO: 1798253 - DNA, 20 bp, Homo sapiens
ttttgtacgttatatattgt

SEQ ID NO: 1798254 - DNA, 13 bp, Homo sapiens
ttttgtcttgtgt

SEQ ID NO: 1798255 - DNA, 16 bp, Homo sapiens
ttttgtttaccagaga

SEQ ID NO: 1798256 - DNA, 12 bp, Homo sapiens
ttttgtttcata

SEQ ID NO: 1798257 - DNA, 17 bp, Homo sapiens
ttttgtttttcattcag

SEQ ID NO: 1798258 - DNA, 18 bp, Homo sapiens
tttttaagttacacattt

SEQ ID NO: 1798259 - DNA, 19 bp, Homo sapiens
tttttgctcttctgtatgt

SEQ ID NO: 1798260 - DNA, 18 bp, Homo sapiens
tttttgtaacttcaaata

SEQ ID NO: 1798261 - DNA, 21 bp, Homo sapiens
tttttgtacgttatatattgt

SEQ ID NO: 1798262 - DNA, 17 bp, Homo sapiens
gcgaggaggctccagag

SEQ ID NO: 1798263 - DNA, 12 bp, Homo sapiens
gcgcggctggga

SEQ ID NO: 1798264 - DNA, 19 bp, Homo sapiens
gcggctgggaggagggcag

SEQ ID NO: 1798265 - DNA, 22 bp, Homo sapiens
gcggctgggaggagggcaggca

SEQ ID NO: 1798266 - DNA, 15 bp, Homo sapiens
gcgtcctcctctgtg

SEQ ID NO: 1798267 - DNA, 16 bp, Homo sapiens
gcgtcctcctctgtga

SEQ ID NO: 1798268 - DNA, 17 bp, Homo sapiens
gcgtgtcacctgtgctt

SEQ ID NO: 1798269 - DNA, 19 bp, Homo sapiens
gctacacccttttccagct

SEQ ID NO: 1798270 - DNA, 19 bp, Homo sapiens
gctaccctgagctgaggca

SEQ ID NO: 1798271 - DNA, 11 bp, Homo sapiens
gctagaaatga

SEQ ID NO: 1798272 - DNA, 17 bp, Homo sapiens
gctagggtggggagaga

SEQ ID NO: 1798273 - DNA, 18 bp, Homo sapiens
gctcagagggtgtcctgc

SEQ ID NO: 1798274 - DNA, 13 bp, Homo sapiens
gctcaggtgcaag

SEQ ID NO: 1798275 - DNA, 15 bp, Homo sapiens
gctccttaaggctct

SEQ ID NO: 1798276 - DNA, 21 bp, Homo sapiens
gctccttaaggctcttttgta

SEQ ID NO: 1798277 - DNA, 14 bp, Homo sapiens
gctccttcctggag

SEQ ID NO: 1798278 - DNA, 23 bp, Homo sapiens
gctccttcctggagactgcccag

SEQ ID NO: 1798279 - DNA, 19 bp, Homo sapiens
gctccttgggccctttgag

SEQ ID NO: 1798280 - DNA, 16 bp, Homo sapiens
gctcgcccacaaactg

SEQ ID NO: 1798281 - DNA, 16 bp, Homo sapiens
gctctgacagccctgc

SEQ ID NO: 1798282 - DNA, 22 bp, Homo sapiens
gctctgtatcaggacccagagg

SEQ ID NO: 1798283 - DNA, 23 bp, Homo sapiens
gctctgtatcaggacccagagga

SEQ ID NO: 1798284 - DNA, 23 bp, Homo sapiens
gctgaggcagcagtgtgaggcca

SEQ ID NO: 1798285 - DNA, 18 bp, Homo sapiens
gctgccccatcagtgctc

SEQ ID NO: 1798286 - DNA, 21 bp, Homo sapiens
gctgcctctacctgacactcc

SEQ ID NO: 1798287 - DNA, 15 bp, Homo sapiens
gctggagtgcagtgg

SEQ ID NO: 1798288 - DNA, 23 bp, Homo sapiens
gctgggacaccccgacttttgtt

SEQ ID NO: 1798289 - DNA, 23 bp, Homo sapiens
gctgtggtgtgtccccctctgtc

SEQ ID NO: 1798290 - DNA, 15 bp, Homo sapiens
gctgtttactaggga

SEQ ID NO: 1798291 - DNA, 17 bp, Homo sapiens
gcttcatggcagaaggc

SEQ ID NO: 1798292 - DNA, 18 bp, Homo sapiens
gcttccctgactcattct

SEQ ID NO: 1798293 - DNA, 22 bp, Homo sapiens
gcttcgcttccttagccttgct

SEQ ID NO: 1798294 - DNA, 16 bp, Homo sapiens
gcttctagttctgcca

SEQ ID NO: 1798295 - DNA, 18 bp, Homo sapiens
gcttctagttctgccagg

SEQ ID NO: 1798296 - DNA, 20 bp, Homo sapiens
gcttctagttctgccaggag

SEQ ID NO: 1798297 - DNA, 16 bp, Homo sapiens
gcttctctctgtggga

SEQ ID NO: 1798298 - DNA, 14 bp, Homo sapiens
gcttggagcagagg

SEQ ID NO: 1798299 - DNA, 21 bp, Homo sapiens
gctttcatgtaaactgtgcac

SEQ ID NO: 1798300 - DNA, 16 bp, Homo sapiens
gctttcgaactgctag

SEQ ID NO: 1798301 - DNA, 14 bp, Homo sapiens
gctttgtggcactg

SEQ ID NO: 1798302 - DNA, 22 bp, Homo sapiens
gctttgtggcactggggcaggg

SEQ ID NO: 1798303 - DNA, 17 bp, Homo sapiens
ggaaaacaaaaatatct

SEQ ID NO: 1798304 - DNA, 15 bp, Homo sapiens
ggaaccgaggcaggg

SEQ ID NO: 1798305 - DNA, 13 bp, Homo sapiens
ggaagtcaaagca

SEQ ID NO: 1798306 - DNA, 24 bp, Homo sapiens
ggaatcatttctatttctcctcca

SEQ ID NO: 1798307 - DNA, 16 bp, Homo sapiens
ggacacctaggctagg

SEQ ID NO: 1798308 - DNA, 19 bp, Homo sapiens
ggaccagtcaacctgggca

SEQ ID NO: 1798309 - DNA, 21 bp, Homo sapiens
gtgatttttatgccacctgaa

SEQ ID NO: 1798310 - DNA, 18 bp, Homo sapiens
gtgctcgcccacaaactg

SEQ ID NO: 1798311 - DNA, 12 bp, Homo sapiens
gtgctgcctcta

SEQ ID NO: 1798312 - DNA, 14 bp, Homo sapiens
gtgcttcgggccct

SEQ ID NO: 1798313 - DNA, 17 bp, Homo sapiens
gtgcttcgggcccttcc

SEQ ID NO: 1798314 - DNA, 22 bp, Homo sapiens
gtggaacgtttttcctgttctt

SEQ ID NO: 1798315 - DNA, 16 bp, Homo sapiens
gtggacatcatgaagc

SEQ ID NO: 1798316 - DNA, 14 bp, Homo sapiens
gtggccaagttctt

SEQ ID NO: 1798317 - DNA, 18 bp, Homo sapiens
gtggctcgggaggcgaag

SEQ ID NO: 1798318 - DNA, 21 bp, Homo sapiens
gtggggagagacgggccctgg

SEQ ID NO: 1798319 - DNA, 14 bp, Homo sapiens
gtgtccccctctgt

SEQ ID NO: 1798320 - DNA, 19 bp, Homo sapiens
gtgtgtccacgactgtctc

SEQ ID NO: 1798321 - DNA, 18 bp, Homo sapiens
gtgtgtccccctctgtcc

SEQ ID NO: 1798322 - DNA, 22 bp, Homo sapiens
gtgttagggaagggcctgccac

SEQ ID NO: 1798323 - DNA, 22 bp, Homo sapiens
gtgttccccttccactgagggc

SEQ ID NO: 1798324 - DNA, 19 bp, Homo sapiens
gttaaacttacttagtgtt

SEQ ID NO: 1798325 - DNA, 12 bp, Homo sapiens
gttaataaaagt

SEQ ID NO: 1798326 - DNA, 13 bp, Homo sapiens
gttatatattgta

SEQ ID NO: 1798327 - DNA, 14 bp, Homo sapiens
gttatatattgtat

SEQ ID NO: 1798328 - DNA, 16 bp, Homo sapiens
gttatatattgtatta

SEQ ID NO: 1798329 - DNA, 19 bp, Homo sapiens
gttatattgaaaaaataga

SEQ ID NO: 1798330 - DNA, 20 bp, Homo sapiens
gttcacttttgacaaaggca

SEQ ID NO: 1798331 - DNA, 14 bp, Homo sapiens
gttcataatttcag

SEQ ID NO: 1798332 - DNA, 13 bp, Homo sapiens
gttccccttccac

SEQ ID NO: 1798333 - DNA, 15 bp, Homo sapiens
gttccccttccactg

SEQ ID NO: 1798334 - DNA, 23 bp, Homo sapiens
gttgatttcagcacctacagtgt

SEQ ID NO: 1798335 - DNA, 19 bp, Homo sapiens
gtttaaaagtccactttta

SEQ ID NO: 1798336 - DNA, 16 bp, Homo sapiens
gtttcaattgcatctc

SEQ ID NO: 1798337 - DNA, 22 bp, Homo sapiens
gttttatttaactgtgcagtga

SEQ ID NO: 1798338 - DNA, 19 bp, Homo sapiens
gtttttcctgttcttaaga

SEQ ID NO: 1798339 - DNA, 21 bp, Homo sapiens
taaaaccatgtagaaaatttg

SEQ ID NO: 1798340 - DNA, 15 bp, Homo sapiens
taaaatcctcaatcc

SEQ ID NO: 1798341 - DNA, 13 bp, Homo sapiens
taaaatctgtcac

SEQ ID NO: 1798342 - DNA, 17 bp, Homo sapiens
taaaatgttcacttttg

SEQ ID NO: 1798343 - DNA, 16 bp, Homo sapiens
taaaattaatatatta

SEQ ID NO: 1798344 - DNA, 12 bp, Homo sapiens
taaactgtgcac

SEQ ID NO: 1798345 - DNA, 23 bp, Homo sapiens
taaagatacagaactctttcaaa

SEQ ID NO: 1798346 - DNA, 17 bp, Homo sapiens
taaagcaatatgcattt

SEQ ID NO: 1798347 - DNA, 14 bp, Homo sapiens
taaagctagaaatg

SEQ ID NO: 1798348 - DNA, 13 bp, Homo sapiens
taaataacttttt

SEQ ID NO: 1798349 - DNA, 17 bp, Homo sapiens
taaatacagtcttccat

SEQ ID NO: 1798350 - DNA, 21 bp, Homo sapiens
taagaaacaactctttgagaa

SEQ ID NO: 1798351 - DNA, 20 bp, Homo sapiens
taaggagaggagaaactgag

SEQ ID NO: 1798352 - DNA, 19 bp, Homo sapiens
taaggccattattgtactt

SEQ ID NO: 1798353 - DNA, 13 bp, Homo sapiens
taagtatttcaaa

SEQ ID NO: 1798354 - DNA, 17 bp, Homo sapiens
taagtcaacctgcctga

SEQ ID NO: 1798355 - DNA, 19 bp, Homo sapiens
taagttataattggaatat

SEQ ID NO: 1798356 - DNA, 14 bp, Homo sapiens
taatctatttacat

SEQ ID NO: 1798357 - DNA, 22 bp, Homo sapiens
taatgaagaaagtggaaaacaa

SEQ ID NO: 1798358 - DNA, 22 bp, Homo sapiens
taattaaaccagactctgttgc

SEQ ID NO: 1798359 - DNA, 22 bp, Homo sapiens
taatttcagttctagttgattg

SEQ ID NO: 1798360 - DNA, 21 bp, Homo sapiens
tacacatttttcagatataaa

SEQ ID NO: 1798361 - DNA, 16 bp, Homo sapiens
tacagaactctttcaa

SEQ ID NO: 1798362 - DNA, 19 bp, Homo sapiens
tacagaactctttcaaaac

SEQ ID NO: 1798363 - DNA, 15 bp, Homo sapiens
tacagagcttccctg

SEQ ID NO: 1798364 - DNA, 16 bp, Homo sapiens
tacagagcttccctga

SEQ ID NO: 1798365 - DNA, 13 bp, Homo sapiens
tacagtaggagcc

SEQ ID NO: 1798366 - DNA, 15 bp, Homo sapiens
tacagtaggagccca

SEQ ID NO: 1798367 - DNA, 18 bp, Homo sapiens
tacagtcttccatttgca

SEQ ID NO: 1798368 - DNA, 20 bp, Homo sapiens
tacagtcttccatttgcaag

SEQ ID NO: 1798369 - DNA, 13 bp, Homo sapiens
tctccatccacat

SEQ ID NO: 1798370 - DNA, 19 bp, Homo sapiens
tctccatccacatgggagc

SEQ ID NO: 1798371 - DNA, 16 bp, Homo sapiens
tctcccagataatgtg

SEQ ID NO: 1798372 - DNA, 21 bp, Homo sapiens
tctcccagataatgtgaaaat

SEQ ID NO: 1798373 - DNA, 18 bp, Homo sapiens
tctccctcctctgcccgg

SEQ ID NO: 1798374 - DNA, 18 bp, Homo sapiens
tctctgctctgcgtgtca

SEQ ID NO: 1798375 - DNA, 23 bp, Homo sapiens
tctctgctctgcgtgtcacctgt

SEQ ID NO: 1798376 - DNA, 16 bp, Homo sapiens
tctctgtataatctat

SEQ ID NO: 1798377 - DNA, 21 bp, Homo sapiens
tctctgtctcatccatcatca

SEQ ID NO: 1798378 - DNA, 15 bp, Homo sapiens
tctgactcagggctc

SEQ ID NO: 1798379 - DNA, 15 bp, Homo sapiens
tctgccaggagacag

SEQ ID NO: 1798380 - DNA, 14 bp, Homo sapiens
tctgcctcttctgg

SEQ ID NO: 1798381 - DNA, 18 bp, Homo sapiens
tctgcctcttctgggagg

SEQ ID NO: 1798382 - DNA, 15 bp, Homo sapiens
tctgcgtgtcacctg

SEQ ID NO: 1798383 - DNA, 19 bp, Homo sapiens
tctgcgtgtcacctgtgct

SEQ ID NO: 1798384 - DNA, 12 bp, Homo sapiens
tctgctcatcat

SEQ ID NO: 1798385 - DNA, 22 bp, Homo sapiens
tctgctcatcattctctgtctc

SEQ ID NO: 1798386 - DNA, 23 bp, Homo sapiens
tctgctcatcattctctgtctca

SEQ ID NO: 1798387 - DNA, 19 bp, Homo sapiens
tctgggagggcagcagggc

SEQ ID NO: 1798388 - DNA, 21 bp, Homo sapiens
tctgggagggcagcagggcta

SEQ ID NO: 1798389 - DNA, 20 bp, Homo sapiens
tctgtagggtaattagtaac

SEQ ID NO: 1798390 - DNA, 17 bp, Homo sapiens
tctgtataatctattta

SEQ ID NO: 1798391 - DNA, 20 bp, Homo sapiens
tctgtatcaggacccagagg

SEQ ID NO: 1798392 - DNA, 17 bp, Homo sapiens
tctgtctcatccatcat

SEQ ID NO: 1798393 - DNA, 14 bp, Homo sapiens
tcttcagaggccct

SEQ ID NO: 1798394 - DNA, 13 bp, Homo sapiens
tcttcatttctct

SEQ ID NO: 1798395 - DNA, 13 bp, Homo sapiens
tcttcttcaccat

SEQ ID NO: 1798396 - DNA, 15 bp, Homo sapiens
tcttcttcaccattt

SEQ ID NO: 1798397 - DNA, 16 bp, Homo sapiens
tcttgactacagtcag

SEQ ID NO: 1798398 - DNA, 23 bp, Homo sapiens
tcttggggagtttagggtggggg

SEQ ID NO: 1798399 - DNA, 13 bp, Homo sapiens
tcttggttgagga

SEQ ID NO: 1798400 - DNA, 18 bp, Homo sapiens
tcttgtattaagttgtta

SEQ ID NO: 1798401 - DNA, 20 bp, Homo sapiens
tctttcaaaaccttttgaaa

SEQ ID NO: 1798402 - DNA, 14 bp, Homo sapiens
tctttcatacatta

SEQ ID NO: 1798403 - DNA, 16 bp, Homo sapiens
tctttcatacattata

SEQ ID NO: 1798404 - DNA, 19 bp, Homo sapiens
tctttccacggagccactc

SEQ ID NO: 1798405 - DNA, 22 bp, Homo sapiens
tctttccacggagccactcctc

SEQ ID NO: 1798406 - DNA, 22 bp, Homo sapiens
tgaaaaaagtataggataaatt

SEQ ID NO: 1798407 - DNA, 22 bp, Homo sapiens
tgaaaaaatagagcctgaggga

SEQ ID NO: 1798408 - DNA, 18 bp, Homo sapiens
tgaaaaaatgtatatgca

SEQ ID NO: 1798409 - DNA, 14 bp, Homo sapiens
tgaaattaacctct

SEQ ID NO: 1798410 - DNA, 17 bp, Homo sapiens
tgaaattaacctctcac

SEQ ID NO: 1798411 - DNA, 14 bp, Homo sapiens
tgaacattccagag

SEQ ID NO: 1798412 - DNA, 17 bp, Homo sapiens
tgaactttccaaaacct

SEQ ID NO: 1798413 - DNA, 23 bp, Homo sapiens
tgaagagtaagtcaacctgcctg

SEQ ID NO: 1798414 - DNA, 11 bp, Homo sapiens
tgaaggagccc

SEQ ID NO: 1798415 - DNA, 22 bp, Homo sapiens
tgaaggagccccattcctggga

SEQ ID NO: 1798416 - DNA, 23 bp, Homo sapiens
tgaaggagccccattcctgggaa

SEQ ID NO: 1798417 - DNA, 15 bp, Homo sapiens
tgaaggcttctctct

SEQ ID NO: 1798418 - DNA, 19 bp, Homo sapiens
tgaaggcttctctctgtgg

SEQ ID NO: 1798419 - DNA, 13 bp, Homo sapiens
tgaatacattttg

SEQ ID NO: 1798420 - DNA, 22 bp, Homo sapiens
tgaattcttggttgaggaaaca

SEQ ID NO: 1798421 - DNA, 18 bp, Homo sapiens
tgaattgtaactgttctt

SEQ ID NO: 1798422 - DNA, 17 bp, Homo sapiens
tgacaaaggcaagcact

SEQ ID NO: 1798423 - DNA, 20 bp, Homo sapiens
tgacaacatttttgtacatt

SEQ ID NO: 1798424 - DNA, 22 bp, Homo sapiens
tgacaacatttttgtacattat

SEQ ID NO: 1798425 - DNA, 18 bp, Homo sapiens
tgacatttatttttcatt

SEQ ID NO: 1798426 - DNA, 14 bp, Homo sapiens
tgaccaatgtcttg

SEQ ID NO: 1798427 - DNA, 13 bp, Homo sapiens
tgaccccagagga

SEQ ID NO: 1798428 - DNA, 16 bp, Homo sapiens
tgacctcacttctggc

SEQ ID NO: 1798429 - DNA, 18 bp, Homo sapiens
tgactacagtcaggaaag

SEQ ID NO: 1798430 - DNA, 20 bp, Homo sapiens
tgacttatttatataaattt

SEQ ID NO: 1798431 - DNA, 20 bp, Homo sapiens
tgagataccagcgaggaggc

SEQ ID NO: 1798432 - DNA, 21 bp, Homo sapiens
tgagataccagcgaggaggct

SEQ ID NO: 1798433 - DNA, 15 bp, Homo sapiens
tgaggccagggcaga

SEQ ID NO: 1798434 - DNA, 15 bp, Homo sapiens
tgaggccattatttc

SEQ ID NO: 1798435 - DNA, 20 bp, Homo sapiens
aaaaagccccacacataact

SEQ ID NO: 1798436 - DNA, 13 bp, Homo sapiens
aaaacactgtgca

SEQ ID NO: 1798437 - DNA, 10 bp, Homo sapiens
aaaagaaagc

SEQ ID NO: 1798438 - DNA, 18 bp, Homo sapiens
aaaagcaattatattgtc

SEQ ID NO: 1798439 - DNA, 16 bp, Homo sapiens
aaaagtccacttttaa

SEQ ID NO: 1798440 - DNA, 14 bp, Homo sapiens
aaaagtgcaatgcg

SEQ ID NO: 1798441 - DNA, 16 bp, Homo sapiens
aaaatagcacatgatt

SEQ ID NO: 1798442 - DNA, 14 bp, Homo sapiens
aaaatgtatatgca

SEQ ID NO: 1798443 - DNA, 19 bp, Homo sapiens
aaacatgaccctaaatctt

SEQ ID NO: 1798444 - DNA, 21 bp, Homo sapiens
aaacatgaccctaaatcttga

SEQ ID NO: 1798445 - DNA, 13 bp, Homo sapiens
aaaccatgtagaa

SEQ ID NO: 1798446 - DNA, 16 bp, Homo sapiens
aaacctaaagaggaaa

SEQ ID NO: 1798447 - DNA, 18 bp, Homo sapiens
aaactatatttatttatg

SEQ ID NO: 1798448 - DNA, 20 bp, Homo sapiens
aaactgagaaatgaatgctg

SEQ ID NO: 1798449 - DNA, 13 bp, Homo sapiens
aaactgatttctc

SEQ ID NO: 1798450 - DNA, 14 bp, Homo sapiens
aaagcaaggaaact

SEQ ID NO: 1798451 - DNA, 14 bp, Homo sapiens
aaagcaatatgcat

SEQ ID NO: 1798452 - DNA, 16 bp, Homo sapiens
aaagcaattatattgt

SEQ ID NO: 1798453 - DNA, 16 bp, Homo sapiens
aaagtacatgttaaac

SEQ ID NO: 1798454 - DNA, 12 bp, Homo sapiens
aaagtctcttgt

SEQ ID NO: 1798455 - DNA, 19 bp, Homo sapiens
aaagtggaaaacaaggaag

SEQ ID NO: 1798456 - DNA, 20 bp, Homo sapiens
aaagtggaaaacaaggaagt

SEQ ID NO: 1798457 - DNA, 20 bp, Homo sapiens
aaagtggtatagaaatgctg

SEQ ID NO: 1798458 - DNA, 14 bp, Homo sapiens
aaagttctgtactc

SEQ ID NO: 1798459 - DNA, 24 bp, Homo sapiens
aaataagaaacaactctttgagaa

SEQ ID NO: 1798460 - DNA, 13 bp, Homo sapiens
aaatacatgacat

SEQ ID NO: 1798461 - DNA, 16 bp, Homo sapiens
aaatgaaaatgtcttg

SEQ ID NO: 1798462 - DNA, 17 bp, Homo sapiens
aaatgaaaatgtcttgt

SEQ ID NO: 1798463 - DNA, 15 bp, Homo sapiens
aaatgtatatgcact

SEQ ID NO: 1798464 - DNA, 16 bp, Homo sapiens
aaatgttcacttttga

SEQ ID NO: 1798465 - DNA, 18 bp, Homo sapiens
aaattttttttgtttcat

SEQ ID NO: 1798466 - DNA, 13 bp, Homo sapiens
aacaaaaattgtc

SEQ ID NO: 1798467 - DNA, 14 bp, Homo sapiens
aacaaggaagtcaa

SEQ ID NO: 1798468 - DNA, 22 bp, Homo sapiens
aacactgccagcatttcccttc

SEQ ID NO: 1798469 - DNA, 19 bp, Homo sapiens
aacatttttgtacattatg

SEQ ID NO: 1798470 - DNA, 13 bp, Homo sapiens
aaccaatcctgga

SEQ ID NO: 1798471 - DNA, 14 bp, Homo sapiens
aacctcgctggact

SEQ ID NO: 1798472 - DNA, 19 bp, Homo sapiens
aacctgcctgacatttgga

SEQ ID NO: 1798473 - DNA, 14 bp, Homo sapiens
aacgtattttgatg

SEQ ID NO: 1798474 - DNA, 17 bp, Homo sapiens
aactatcaatatttaag

SEQ ID NO: 1798475 - DNA, 19 bp, Homo sapiens
aactatcaatatttaagtt

SEQ ID NO: 1798476 - DNA, 12 bp, Homo sapiens
aactctttcaaa

SEQ ID NO: 1798477 - DNA, 17 bp, Homo sapiens
aactgagaaatgaatgc

SEQ ID NO: 1798478 - DNA, 13 bp, Homo sapiens
aactgtgcagtga

SEQ ID NO: 1798479 - DNA, 14 bp, Homo sapiens
aagaaaacttccaa

SEQ ID NO: 1798480 - DNA, 21 bp, Homo sapiens
aagaaactgattttagctcat

SEQ ID NO: 1798481 - DNA, 23 bp, Homo sapiens
aagacgtgattttgctgtagaag

SEQ ID NO: 1798482 - DNA, 16 bp, Homo sapiens
aagattctttcccaat

SEQ ID NO: 1798483 - DNA, 20 bp, Homo sapiens
aagattttttttgtaacttc

SEQ ID NO: 1798484 - DNA, 13 bp, Homo sapiens
aagcaatatgcat

SEQ ID NO: 1798485 - DNA, 19 bp, Homo sapiens
aagcaatatgcatttaaat

SEQ ID NO: 1798486 - DNA, 22 bp, Homo sapiens
aagcactgtttaactgggagtg

SEQ ID NO: 1798487 - DNA, 12 bp, Homo sapiens
aagcattcacaa

SEQ ID NO: 1798488 - DNA, 17 bp, Homo sapiens
aagccagcgtcctcctc

SEQ ID NO: 1798489 - DNA, 20 bp, Homo sapiens
aagcccagcactgcttgagg

SEQ ID NO: 1798490 - DNA, 13 bp, Homo sapiens
aagctagaaatga

SEQ ID NO: 1798491 - DNA, 22 bp, Homo sapiens
aagctttcatgtaaactgtgca

SEQ ID NO: 1798492 - DNA, 19 bp, Homo sapiens
aagggacagaaaagaaagc

SEQ ID NO: 1798493 - DNA, 23 bp, Homo sapiens
aaggttccgcttggagcagaggg

SEQ ID NO: 1798494 - DNA, 20 bp, Homo sapiens
aagtataggataaattacat

SEQ ID NO: 1798495 - DNA, 22 bp, Homo sapiens
aagtataggataaattacatta

SEQ ID NO: 1798496 - DNA, 21 bp, Homo sapiens
aagtatttcaaattggagctt

SEQ ID NO: 1798497 - DNA, 22 bp, Homo sapiens
aagtatttcaaattggagcttc

SEQ ID NO: 1798498 - DNA, 22 bp, Homo sapiens
aagttcttagttgctgtatgtc

SEQ ID NO: 1798499 - DNA, 14 bp, Homo sapiens
aagtttaattgact

SEQ ID NO: 1798500 - DNA, 17 bp, Homo sapiens
aatacatgacatttatt

SEQ ID NO: 1798501 - DNA, 14 bp, Homo sapiens
aatagagcctgagg

SEQ ID NO: 1798502 - DNA, 20 bp, Homo sapiens
aatagataagagtagaaact

SEQ ID NO: 1798503 - DNA, 13 bp, Homo sapiens
aatagcacatgat

SEQ ID NO: 1798504 - DNA, 13 bp, Homo sapiens
aatattgtacagt

SEQ ID NO: 1798505 - DNA, 14 bp, Homo sapiens
aatattgtacagtt

SEQ ID NO: 1798506 - DNA, 15 bp, Homo sapiens
aatattgtacagttt

SEQ ID NO: 1798507 - DNA, 17 bp, Homo sapiens
aatattgtacagttttt

SEQ ID NO: 1798508 - DNA, 23 bp, Homo sapiens
aatattgtacagtttttattgct

SEQ ID NO: 1798509 - DNA, 13 bp, Homo sapiens
aatattgtccatt

SEQ ID NO: 1798510 - DNA, 18 bp, Homo sapiens
aatatttaagtttgttgc

SEQ ID NO: 1798511 - DNA, 20 bp, Homo sapiens
aatcagctccttcctggaga

SEQ ID NO: 1798512 - DNA, 12 bp, Homo sapiens
aatcatttctat

SEQ ID NO: 1798513 - DNA, 20 bp, Homo sapiens
aatcatttctatttctcctc

SEQ ID NO: 1798514 - DNA, 22 bp, Homo sapiens
aatccaagatattttaaaatct

SEQ ID NO: 1798515 - DNA, 16 bp, Homo sapiens
atgtgacaacattttt

SEQ ID NO: 1798516 - DNA, 12 bp, Homo sapiens
atgtgactcttt

SEQ ID NO: 1798517 - DNA, 17 bp, Homo sapiens
atgtgatgaatactgta

SEQ ID NO: 1798518 - DNA, 21 bp, Homo sapiens
atgtgtgtccacgactgtctc

SEQ ID NO: 1798519 - DNA, 22 bp, Homo sapiens
atgtgtgtccacgactgtctcc

SEQ ID NO: 1798520 - DNA, 19 bp, Homo sapiens
atgttattggaattttctt

SEQ ID NO: 1798521 - DNA, 16 bp, Homo sapiens
attaaaatcctcaatc

SEQ ID NO: 1798522 - DNA, 19 bp, Homo sapiens
attaacaaagtaaaattaa

SEQ ID NO: 1798523 - DNA, 17 bp, Homo sapiens
attaagccacttaaaat

SEQ ID NO: 1798524 - DNA, 19 bp, Homo sapiens
attaagttgttaataaaag

SEQ ID NO: 1798525 - DNA, 13 bp, Homo sapiens
attacctcctgag

SEQ ID NO: 1798526 - DNA, 17 bp, Homo sapiens
attacctcctgagaaaa

SEQ ID NO: 1798527 - DNA, 13 bp, Homo sapiens
attacttgaactt

SEQ ID NO: 1798528 - DNA, 23 bp, Homo sapiens
attatagtgatgtaatcttgaat

SEQ ID NO: 1798529 - DNA, 13 bp, Homo sapiens
attatgttattgg

SEQ ID NO: 1798530 - DNA, 17 bp, Homo sapiens
attcacatctaacctca

SEQ ID NO: 1798531 - DNA, 20 bp, Homo sapiens
attcatatcttaaaaattaa

SEQ ID NO: 1798532 - DNA, 21 bp, Homo sapiens
attcctatacgcagcgtgctt

SEQ ID NO: 1798533 - DNA, 14 bp, Homo sapiens
attcctctaaaact

SEQ ID NO: 1798534 - DNA, 22 bp, Homo sapiens
attcctgggaaatattccctag

SEQ ID NO: 1798535 - DNA, 12 bp, Homo sapiens
attctctgtctc

SEQ ID NO: 1798536 - DNA, 13 bp, Homo sapiens
attctctgtctca

SEQ ID NO: 1798537 - DNA, 16 bp, Homo sapiens
attctctgtctcatcc

SEQ ID NO: 1798538 - DNA, 17 bp, Homo sapiens
attctctgtctcatcca

SEQ ID NO: 1798539 - DNA, 18 bp, Homo sapiens
attctctgtctcatccat

SEQ ID NO: 1798540 - DNA, 16 bp, Homo sapiens
attctgaaggagcccc

SEQ ID NO: 1798541 - DNA, 17 bp, Homo sapiens
attcttggttgaggaaa

SEQ ID NO: 1798542 - DNA, 19 bp, Homo sapiens
attgaaaaaatagagcctg

SEQ ID NO: 1798543 - DNA, 22 bp, Homo sapiens
attgaaaaaatagagcctgagg

SEQ ID NO: 1798544 - DNA, 23 bp, Homo sapiens
attgaattcttggttgaggaaac

SEQ ID NO: 1798545 - DNA, 23 bp, Homo sapiens
attgcatctcccagataatgtga

SEQ ID NO: 1798546 - DNA, 21 bp, Homo sapiens
attgctaattctgagggaatt

SEQ ID NO: 1798547 - DNA, 21 bp, Homo sapiens
attgctgccccatcagtgctc

SEQ ID NO: 1798548 - DNA, 12 bp, Homo sapiens
attggaattttc

SEQ ID NO: 1798549 - DNA, 14 bp, Homo sapiens
attggacccttcca

SEQ ID NO: 1798550 - DNA, 15 bp, Homo sapiens
attggacccttccat

SEQ ID NO: 1798551 - DNA, 15 bp, Homo sapiens
attgtaactgttctt

SEQ ID NO: 1798552 - DNA, 18 bp, Homo sapiens
attgtccaatcctatgtt

SEQ ID NO: 1798553 - DNA, 22 bp, Homo sapiens
atttaagtttgttgctgtcaag

SEQ ID NO: 1798554 - DNA, 15 bp, Homo sapiens
atttaataatctgta

SEQ ID NO: 1798555 - DNA, 22 bp, Homo sapiens
atttagtttgattattcagtgt

SEQ ID NO: 1798556 - DNA, 16 bp, Homo sapiens
atttcccttccttcct

SEQ ID NO: 1798557 - DNA, 21 bp, Homo sapiens
atttggagtgttccccttcca

SEQ ID NO: 1798558 - DNA, 22 bp, Homo sapiens
attttaaaagcaattatattgt

SEQ ID NO: 1798559 - DNA, 21 bp, Homo sapiens
attttcataagtatttcaaat

SEQ ID NO: 1798560 - DNA, 20 bp, Homo sapiens
attttcttttgttttcttca

SEQ ID NO: 1798561 - DNA, 21 bp, Homo sapiens
attttcttttgttttcttcat

SEQ ID NO: 1798562 - DNA, 20 bp, Homo sapiens
attttgctgtagaagatggc

SEQ ID NO: 1798563 - DNA, 19 bp, Homo sapiens
attttgtattgtttcaatt

SEQ ID NO: 1798564 - DNA, 23 bp, Homo sapiens
atttttgctcttctgtatgtgac

SEQ ID NO: 1798565 - DNA, 14 bp, Homo sapiens
atttttgtacatta

SEQ ID NO: 1798566 - DNA, 20 bp, Homo sapiens
atttttgtacattatgttat

SEQ ID NO: 1798567 - DNA, 20 bp, Homo sapiens
atttttgtacgttatatatt

SEQ ID NO: 1798568 - DNA, 16 bp, Homo sapiens
attttttttgtaactt

SEQ ID NO: 1798569 - DNA, 21 bp, Homo sapiens
caaacatgaccctaaatcttg

SEQ ID NO: 1798570 - DNA, 16 bp, Homo sapiens
caaactgatttctcac

SEQ ID NO: 1798571 - DNA, 17 bp, Homo sapiens
caaagcccaaagtggta

SEQ ID NO: 1798572 - DNA, 18 bp, Homo sapiens
caacaatttctactttga

SEQ ID NO: 1798573 - DNA, 18 bp, Homo sapiens
caacacctcttggggagt

SEQ ID NO: 1798574 - DNA, 12 bp, Homo sapiens
caacactgccag

SEQ ID NO: 1798575 - DNA, 22 bp, Homo sapiens
caaccggctttgtggcactggg

SEQ ID NO: 1798576 - DNA, 17 bp, Homo sapiens
caaccttagatgttcta

SEQ ID NO: 1798577 - DNA, 13 bp, Homo sapiens
caactctttgaga

SEQ ID NO: 1798578 - DNA, 15 bp, Homo sapiens
caactctttgagaaa

SEQ ID NO: 1798579 - DNA, 16 bp, Homo sapiens
caactctttgagaaac

SEQ ID NO: 1798580 - DNA, 19 bp, Homo sapiens
caagattttttttgtaact

SEQ ID NO: 1798581 - DNA, 21 bp, Homo sapiens
caagattttttttgtaacttc

SEQ ID NO: 1798582 - DNA, 23 bp, Homo sapiens
caagcaggaaatgaaaatgtctt

SEQ ID NO: 1798583 - DNA, 16 bp, Homo sapiens
caagggaaaagtctct

SEQ ID NO: 1798584 - DNA, 14 bp, Homo sapiens
caatattgtacagt

SEQ ID NO: 1798585 - DNA, 16 bp, Homo sapiens
caatattgtacagttt

SEQ ID NO: 1798586 - DNA, 15 bp, Homo sapiens
caatcagctccttcc

SEQ ID NO: 1798587 - DNA, 16 bp, Homo sapiens
caatcagctccttcct

SEQ ID NO: 1798588 - DNA, 20 bp, Homo sapiens
caattcacatctaacctcat

SEQ ID NO: 1798589 - DNA, 20 bp, Homo sapiens
caatttctactttgaagtca

SEQ ID NO: 1798590 - DNA, 21 bp, Homo sapiens
caatttctactttgaagtcat

SEQ ID NO: 1798591 - DNA, 17 bp, Homo sapiens
cacaggacatttctcta

SEQ ID NO: 1798592 - DNA, 22 bp, Homo sapiens
cacatcctccacgttctgctca

SEQ ID NO: 1798593 - DNA, 13 bp, Homo sapiens
cacatgattttct

SEQ ID NO: 1798594 - DNA, 21 bp, Homo sapiens
caccaagcaggaaatgaaaat

SEQ ID NO: 1798595 - DNA, 14 bp, Homo sapiens
cacccatgccatag

SEQ ID NO: 1798596 - DNA, 15 bp, Homo sapiens
cacccttttccagct

SEQ ID NO: 1798597 - DNA, 22 bp, Homo sapiens
caccggggcctgggcaggaggg

SEQ ID NO: 1798598 - DNA, 16 bp, Homo sapiens
cacctacagtgtacag

SEQ ID NO: 1798599 - DNA, 20 bp, Homo sapiens
cacctacagtgtacagtctt

SEQ ID NO: 1798600 - DNA, 23 bp, Homo sapiens
cacctacagtgtacagtcttgta

SEQ ID NO: 1798601 - DNA, 17 bp, Homo sapiens
cacctaggctagggtgg

SEQ ID NO: 1798602 - DNA, 15 bp, Homo sapiens
cacggagccactcct

SEQ ID NO: 1798603 - DNA, 19 bp, Homo sapiens
cacggagccactcctctga

SEQ ID NO: 1798604 - DNA, 20 bp, Homo sapiens
cacggctcctcgagatccca

SEQ ID NO: 1798605 - DNA, 20 bp, Homo sapiens
cactcccttgggctccctgt

SEQ ID NO: 1798606 - DNA, 16 bp, Homo sapiens
cactctgcttgttatt

SEQ ID NO: 1798607 - DNA, 14 bp, Homo sapiens
cactgaaatagagt

SEQ ID NO: 1798608 - DNA, 18 bp, Homo sapiens
cactgaaatagagtgaat

SEQ ID NO: 1798609 - DNA, 18 bp, Homo sapiens
cactgagataccagcgag

SEQ ID NO: 1798610 - DNA, 15 bp, Homo sapiens
cagaactctttcaaa

SEQ ID NO: 1798611 - DNA, 11 bp, Homo sapiens
cagaatgaatc

SEQ ID NO: 1798612 - DNA, 16 bp, Homo sapiens
cagacgcctgaggaac

SEQ ID NO: 1798613 - DNA, 22 bp, Homo sapiens
cagacttcccacggctcctcga

SEQ ID NO: 1798614 - DNA, 13 bp, Homo sapiens
cagagcttccctg

SEQ ID NO: 1798615 - DNA, 14 bp, Homo sapiens
cagagcttccctga

SEQ ID NO: 1798616 - DNA, 23 bp, Homo sapiens
cagagcttccctgactcattctg

SEQ ID NO: 1798617 - DNA, 18 bp, Homo sapiens
cagaggaaggggccagag

SEQ ID NO: 1798618 - DNA, 21 bp, Homo sapiens
cagaggattgctgccccatca

SEQ ID NO: 1798619 - DNA, 17 bp, Homo sapiens
cagagggtgtcctgcac

SEQ ID NO: 1798620 - DNA, 22 bp, Homo sapiens
cggctgggaggagggcaggcat

SEQ ID NO: 1798621 - DNA, 21 bp, Homo sapiens
cgggcccttcccacaggacat

SEQ ID NO: 1798622 - DNA, 13 bp, Homo sapiens
cgggtctgcctct

SEQ ID NO: 1798623 - DNA, 15 bp, Homo sapiens
cggtgtgcaccaggg

SEQ ID NO: 1798624 - DNA, 16 bp, Homo sapiens
cgtaaagctagaaatg

SEQ ID NO: 1798625 - DNA, 21 bp, Homo sapiens
cgtagatttttgctcttctgt

SEQ ID NO: 1798626 - DNA, 13 bp, Homo sapiens
cgtcctcctctgt

SEQ ID NO: 1798627 - DNA, 14 bp, Homo sapiens
cgtgaatgtctcag

SEQ ID NO: 1798628 - DNA, 15 bp, Homo sapiens
cgtgaatgtctcagc

SEQ ID NO: 1798629 - DNA, 15 bp, Homo sapiens
cgtgagtgtgacttt

SEQ ID NO: 1798630 - DNA, 20 bp, Homo sapiens
cgtggaacgtttttcctgtt

SEQ ID NO: 1798631 - DNA, 13 bp, Homo sapiens
cgtgggctccctg

SEQ ID NO: 1798632 - DNA, 13 bp, Homo sapiens
cgtgtctggcaca

SEQ ID NO: 1798633 - DNA, 21 bp, Homo sapiens
cgtgtctggcacagcctggct

SEQ ID NO: 1798634 - DNA, 13 bp, Homo sapiens
cgttatatattgt

SEQ ID NO: 1798635 - DNA, 14 bp, Homo sapiens
cgttatatattgta

SEQ ID NO: 1798636 - DNA, 22 bp, Homo sapiens
ctaaatgtggacatcatgaagc

SEQ ID NO: 1798637 - DNA, 18 bp, Homo sapiens
ctacacccttttccagct

SEQ ID NO: 1798638 - DNA, 14 bp, Homo sapiens
ctacagtcaggaaa

SEQ ID NO: 1798639 - DNA, 13 bp, Homo sapiens
ctacagtgtacag

SEQ ID NO: 1798640 - DNA, 16 bp, Homo sapiens
ctacagtgtacagtct

SEQ ID NO: 1798641 - DNA, 17 bp, Homo sapiens
ctaccctgagctgaggc

SEQ ID NO: 1798642 - DNA, 18 bp, Homo sapiens
ctaccctgagctgaggca

SEQ ID NO: 1798643 - DNA, 20 bp, Homo sapiens
ctacctgacactcccttggg

SEQ ID NO: 1798644 - DNA, 19 bp, Homo sapiens
ctacttgttttatttaact

SEQ ID NO: 1798645 - DNA, 16 bp, Homo sapiens
ctaggcaggacctgtg

SEQ ID NO: 1798646 - DNA, 17 bp, Homo sapiens
ctagggatccctcatct

SEQ ID NO: 1798647 - DNA, 23 bp, Homo sapiens
ctagggatccctcatctgtccct

SEQ ID NO: 1798648 - DNA, 16 bp, Homo sapiens
ctagggccaagcccag

SEQ ID NO: 1798649 - DNA, 17 bp, Homo sapiens
ctagggccaagcccagc

SEQ ID NO: 1798650 - DNA, 15 bp, Homo sapiens
ctagggtggggagag

SEQ ID NO: 1798651 - DNA, 17 bp, Homo sapiens
ctagtgaaggcttctct

SEQ ID NO: 1798652 - DNA, 21 bp, Homo sapiens
ctagttgattgcgagaatttt

SEQ ID NO: 1798653 - DNA, 19 bp, Homo sapiens
ctatacgcagcgtgcttta

SEQ ID NO: 1798654 - DNA, 14 bp, Homo sapiens
ctatcaatatttaa

SEQ ID NO: 1798655 - DNA, 22 bp, Homo sapiens
ctatgtaacatgtaggaagtag

SEQ ID NO: 1798656 - DNA, 15 bp, Homo sapiens
ctattacttgaactt

SEQ ID NO: 1798657 - DNA, 20 bp, Homo sapiens
ctattacttgaactttccaa

SEQ ID NO: 1798658 - DNA, 15 bp, Homo sapiens
ctatttctcctccat

SEQ ID NO: 1798659 - DNA, 15 bp, Homo sapiens
ctcacccccttctcc

SEQ ID NO: 1798660 - DNA, 20 bp, Homo sapiens
ctcaggaccaaagctttcat

SEQ ID NO: 1798661 - DNA, 21 bp, Homo sapiens
ctcaggaccaaagctttcatg

SEQ ID NO: 1798662 - DNA, 22 bp, Homo sapiens
ctcaggaccaaagctttcatgt

SEQ ID NO: 1798663 - DNA, 13 bp, Homo sapiens
ctcagggctcctg

SEQ ID NO: 1798664 - DNA, 14 bp, Homo sapiens
ctcagggctcctgg

SEQ ID NO: 1798665 - DNA, 15 bp, Homo sapiens
ctcagggctcctggg

SEQ ID NO: 1798666 - DNA, 17 bp, Homo sapiens
ctcagggctcctgggtt

SEQ ID NO: 1798667 - DNA, 18 bp, Homo sapiens
ctcatcattctctgtctc

SEQ ID NO: 1798668 - DNA, 19 bp, Homo sapiens
ctcatcattctctgtctca

SEQ ID NO: 1798669 - DNA, 17 bp, Homo sapiens
ctcattctgaaggagcc

SEQ ID NO: 1798670 - DNA, 13 bp, Homo sapiens
ctcattggaccct

SEQ ID NO: 1798671 - DNA, 14 bp, Homo sapiens
ctccacatcctcca

SEQ ID NO: 1798672 - DNA, 17 bp, Homo sapiens
ctccacatcctccacgt

SEQ ID NO: 1798673 - DNA, 17 bp, Homo sapiens
ctccacgttctgctcat

SEQ ID NO: 1798674 - DNA, 20 bp, Homo sapiens
ctccacgttctgctcatcat

SEQ ID NO: 1798675 - DNA, 20 bp, Homo sapiens
ctccatccacatgggagccg

SEQ ID NO: 1798676 - DNA, 24 bp, Homo sapiens
ctccattcccgtggaacgtttttc

SEQ ID NO: 1798677 - DNA, 15 bp, Homo sapiens
ctcccctattttaag

SEQ ID NO: 1798678 - DNA, 15 bp, Homo sapiens
ctccgggacctggtg

SEQ ID NO: 1798679 - DNA, 15 bp, Homo sapiens
ctcctccatgggaga

SEQ ID NO: 1798680 - DNA, 24 bp, Homo sapiens
ctcctcgagatcccaacactgcca

SEQ ID NO: 1798681 - DNA, 13 bp, Homo sapiens
ctcctctgactca

SEQ ID NO: 1798682 - DNA, 19 bp, Homo sapiens
ctcctctgactcagggctc

SEQ ID NO: 1798683 - DNA, 20 bp, Homo sapiens
ctcctctgactcagggctcc

SEQ ID NO: 1798684 - DNA, 13 bp, Homo sapiens
ctcctctgtgacc

SEQ ID NO: 1798685 - DNA, 23 bp, Homo sapiens
ctcctctgtgaccaatgtcttga

SEQ ID NO: 1798686 - DNA, 20 bp, Homo sapiens
ctcctgagaaaaaaggttcc

SEQ ID NO: 1798687 - DNA, 15 bp, Homo sapiens
ctcctgggccctctc

SEQ ID NO: 1798688 - DNA, 20 bp, Homo sapiens
ctcctgggccctctctgctc

SEQ ID NO: 1798689 - DNA, 21 bp, Homo sapiens
ctcctgggttttgtattctct

SEQ ID NO: 1798690 - DNA, 14 bp, Homo sapiens
ctccttcctggaga

SEQ ID NO: 1798691 - DNA, 18 bp, Homo sapiens
ctccttgggccctttgag

SEQ ID NO: 1798692 - DNA, 19 bp, Homo sapiens
ctccttgggccctttgagt

SEQ ID NO: 1798693 - DNA, 19 bp, Homo sapiens
ctcgctgccagctctgtat

SEQ ID NO: 1798694 - DNA, 21 bp, Homo sapiens
ctcgtggtaggactgtagaaa

SEQ ID NO: 1798695 - DNA, 20 bp, Homo sapiens
ctcgttgactggctgtgtgt

SEQ ID NO: 1798696 - DNA, 17 bp, Homo sapiens
ctctacagagcttccct

SEQ ID NO: 1798697 - DNA, 21 bp, Homo sapiens
ctctactaacaatcagctcct

SEQ ID NO: 1798698 - DNA, 14 bp, Homo sapiens
ctctcagtctctga

SEQ ID NO: 1798699 - DNA, 16 bp, Homo sapiens
ctctcagtctctgagc

SEQ ID NO: 1798700 - DNA, 18 bp, Homo sapiens
ctctcagtctctgagcag

SEQ ID NO: 1798701 - DNA, 21 bp, Homo sapiens
ctctccactcatgtgactctt

SEQ ID NO: 1798702 - DNA, 22 bp, Homo sapiens
ctctgacagccctgcggagacc

SEQ ID NO: 1798703 - DNA, 17 bp, Homo sapiens
ctctgactcagggctcc

SEQ ID NO: 1798704 - DNA, 20 bp, Homo sapiens
ctctgactcagggctcctgg

SEQ ID NO: 1798705 - DNA, 16 bp, Homo sapiens
ctctgagctgtgcagg

SEQ ID NO: 1798706 - DNA, 12 bp, Homo sapiens
ctctgatccctc

SEQ ID NO: 1798707 - DNA, 22 bp, Homo sapiens
ctctgatccctctacagagctt

SEQ ID NO: 1798708 - DNA, 15 bp, Homo sapiens
ctctgtctcatccat

SEQ ID NO: 1798709 - DNA, 15 bp, Homo sapiens
ctctgtgaccaatgt

SEQ ID NO: 1798710 - DNA, 17 bp, Homo sapiens
ctcttcagaggccctcg

SEQ ID NO: 1798711 - DNA, 21 bp, Homo sapiens
ctcttgtaatccgaatctctt

SEQ ID NO: 1798712 - DNA, 14 bp, Homo sapiens
ctgaacaatgaatg

SEQ ID NO: 1798713 - DNA, 12 bp, Homo sapiens
ctgaaggagccc

SEQ ID NO: 1798714 - DNA, 21 bp, Homo sapiens
ctgaaggagccccattcctgg

SEQ ID NO: 1798715 - DNA, 18 bp, Homo sapiens
ctgaccaatattgtacag

SEQ ID NO: 1798716 - DNA, 12 bp, Homo sapiens
ctgactcagggc

SEQ ID NO: 1798717 - DNA, 16 bp, Homo sapiens
ctgactcagggctcct

SEQ ID NO: 1798718 - DNA, 12 bp, Homo sapiens
ctgactgggagt

SEQ ID NO: 1798719 - DNA, 21 bp, Homo sapiens
ctgagagaggccattctttcc

SEQ ID NO: 1798720 - DNA, 22 bp, Homo sapiens
ctgagagaggccattctttccc

SEQ ID NO: 1798721 - DNA, 13 bp, Homo sapiens
ctgagctgtgcag

SEQ ID NO: 1798722 - DNA, 22 bp, Homo sapiens
ctgaggcagcagtgtgaggcca

SEQ ID NO: 1798723 - DNA, 23 bp, Homo sapiens
ctgaggcagcagtgtgaggccag

SEQ ID NO: 1798724 - DNA, 12 bp, Homo sapiens
ctgagggagcct

SEQ ID NO: 1798725 - DNA, 16 bp, Homo sapiens
ggatttttgtcttgtg

SEQ ID NO: 1798726 - DNA, 13 bp, Homo sapiens
ggcacagcctggc

SEQ ID NO: 1798727 - DNA, 15 bp, Homo sapiens
ggcactggggcaggg

SEQ ID NO: 1798728 - DNA, 17 bp, Homo sapiens
ggcagaaggcaaaccca

SEQ ID NO: 1798729 - DNA, 16 bp, Homo sapiens
ggcagagcccaaggga

SEQ ID NO: 1798730 - DNA, 20 bp, Homo sapiens
ggcagcagtgtgaggccagg

SEQ ID NO: 1798731 - DNA, 14 bp, Homo sapiens
ggcaggagggaggt

SEQ ID NO: 1798732 - DNA, 20 bp, Homo sapiens
ggcagtctgagagaggccat

SEQ ID NO: 1798733 - DNA, 23 bp, Homo sapiens
ggcatcggggagccgggagcctg

SEQ ID NO: 1798734 - DNA, 18 bp, Homo sapiens
ggcatgtgtagttaattt

SEQ ID NO: 1798735 - DNA, 12 bp, Homo sapiens
ggccaagttctt

SEQ ID NO: 1798736 - DNA, 23 bp, Homo sapiens
ggccctcgctgccagctctgtat

SEQ ID NO: 1798737 - DNA, 21 bp, Homo sapiens
ggccctctctgctctgcgtgt

SEQ ID NO: 1798738 - DNA, 21 bp, Homo sapiens
ggcctaacctgccgagagtcc

SEQ ID NO: 1798739 - DNA, 22 bp, Homo sapiens
ggcctaacctgccgagagtcca

SEQ ID NO: 1798740 - DNA, 14 bp, Homo sapiens
ggcctgggcaggag

SEQ ID NO: 1798741 - DNA, 15 bp, Homo sapiens
ggcctgggcaggagg

SEQ ID NO: 1798742 - DNA, 22 bp, Homo sapiens
ggcgaagcgttgtcctcagccc

SEQ ID NO: 1798743 - DNA, 21 bp, Homo sapiens
ggctccctgtaacctcttcag

SEQ ID NO: 1798744 - DNA, 20 bp, Homo sapiens
ggctcctcgagatcccaaca

SEQ ID NO: 1798745 - DNA, 16 bp, Homo sapiens
ggctgagggagcctgg

SEQ ID NO: 1798746 - DNA, 15 bp, Homo sapiens
ggcttaaggagagga

SEQ ID NO: 1798747 - DNA, 14 bp, Homo sapiens
gggacacctaggct

SEQ ID NO: 1798748 - DNA, 14 bp, Homo sapiens
gggagactgggctg

SEQ ID NO: 1798749 - DNA, 22 bp, Homo sapiens
gggagctcaggaaccgaggcag

SEQ ID NO: 1798750 - DNA, 12 bp, Homo sapiens
gggaggagggca

SEQ ID NO: 1798751 - DNA, 17 bp, Homo sapiens
gggatggtggagggcca

SEQ ID NO: 1798752 - DNA, 18 bp, Homo sapiens
gggatggtggagggccac

SEQ ID NO: 1798753 - DNA, 12 bp, Homo sapiens
gggcagagccca

SEQ ID NO: 1798754 - DNA, 14 bp, Homo sapiens
gggcagagcccaag

SEQ ID NO: 1798755 - DNA, 21 bp, Homo sapiens
gggcagtctgagagaggccat

SEQ ID NO: 1798756 - DNA, 12 bp, Homo sapiens
gggccagaggct

SEQ ID NO: 1798757 - DNA, 17 bp, Homo sapiens
gggccctttgagtgcag

SEQ ID NO: 1798758 - DNA, 12 bp, Homo sapiens
gggcctgggcag

SEQ ID NO: 1798759 - DNA, 19 bp, Homo sapiens
gggctaccctgagctgagg

SEQ ID NO: 1798760 - DNA, 21 bp, Homo sapiens
gggctccctgtaacctcttca

SEQ ID NO: 1798761 - DNA, 12 bp, Homo sapiens
gggctgagggag

SEQ ID NO: 1798762 - DNA, 18 bp, Homo sapiens
gggcttcgcttccttagc

SEQ ID NO: 1798763 - DNA, 17 bp, Homo sapiens
ggggagactgggctgag

SEQ ID NO: 1798764 - DNA, 15 bp, Homo sapiens
ggggcgcggctggga

SEQ ID NO: 1798765 - DNA, 16 bp, Homo sapiens
ggggcgcggctgggag

SEQ ID NO: 1798766 - DNA, 22 bp, Homo sapiens
gggggcagtctgagagaggcca

SEQ ID NO: 1798767 - DNA, 12 bp, Homo sapiens
gggtccatgggc

SEQ ID NO: 1798768 - DNA, 18 bp, Homo sapiens
gggtggggagagacgggc

SEQ ID NO: 1798769 - DNA, 21 bp, Homo sapiens
gggtgtcctgcaccggggcct

SEQ ID NO: 1798770 - DNA, 14 bp, Homo sapiens
ggtccatgggcaga

SEQ ID NO: 1798771 - DNA, 18 bp, Homo sapiens
ggtccatgggcagagccc

SEQ ID NO: 1798772 - DNA, 15 bp, Homo sapiens
ggtcctttggggtga

SEQ ID NO: 1798773 - DNA, 23 bp, Homo sapiens
ggtgctacacccttttccagctg

SEQ ID NO: 1798774 - DNA, 23 bp, Homo sapiens
ggtggagggccacatgggaggct

SEQ ID NO: 1798775 - DNA, 22 bp, Homo sapiens
ggtggggggggggcgcggctgg

SEQ ID NO: 1798776 - DNA, 21 bp, Homo sapiens
ggttccgcttggagcagaggg

SEQ ID NO: 1798777 - DNA, 23 bp, Homo sapiens
ggttccgcttggagcagaggggc

SEQ ID NO: 1798778 - DNA, 11 bp, Homo sapiens
ggttgaggaaa

SEQ ID NO: 1798779 - DNA, 15 bp, Homo sapiens
gtaaagctagaaatg

SEQ ID NO: 1798780 - DNA, 16 bp, Homo sapiens
gtaaagctagaaatga

SEQ ID NO: 1798781 - DNA, 23 bp, Homo sapiens
gtaacatgtgttaagtattttca

SEQ ID NO: 1798782 - DNA, 18 bp, Homo sapiens
gtaacctcttcagaggcc

SEQ ID NO: 1798783 - DNA, 11 bp, Homo sapiens
gtaacttcaaa

SEQ ID NO: 1798784 - DNA, 13 bp, Homo sapiens
gtacagtttttat

SEQ ID NO: 1798785 - DNA, 17 bp, Homo sapiens
gtacctgcccccaatcc

SEQ ID NO: 1798786 - DNA, 15 bp, Homo sapiens
gtacgttatatattg

SEQ ID NO: 1798787 - DNA, 22 bp, Homo sapiens
gtacttgccttattagagtgtc

SEQ ID NO: 1798788 - DNA, 19 bp, Homo sapiens
gtacttttggcatgaaagt

SEQ ID NO: 1798789 - DNA, 16 bp, Homo sapiens
gtacttttgtgttact

SEQ ID NO: 1798790 - DNA, 15 bp, Homo sapiens
gtagaaactgcaggg

SEQ ID NO: 1798791 - DNA, 15 bp, Homo sapiens
gtaggaagtaggaag

SEQ ID NO: 1798792 - DNA, 19 bp, Homo sapiens
gtagtgatttttatgccac

SEQ ID NO: 1798793 - DNA, 14 bp, Homo sapiens
gtataatctattta

SEQ ID NO: 1798794 - DNA, 20 bp, Homo sapiens
gtataggataaattacatta

SEQ ID NO: 1798795 - DNA, 21 bp, Homo sapiens
gtatcaggacccagaggaagg

SEQ ID NO: 1798796 - DNA, 18 bp, Homo sapiens
gtatcgctgccttgccat

SEQ ID NO: 1798797 - DNA, 19 bp, Homo sapiens
gtattaagggcattttaaa

SEQ ID NO: 1798798 - DNA, 11 bp, Homo sapiens
gtattctctga

SEQ ID NO: 1798799 - DNA, 18 bp, Homo sapiens
gtcaagattttttttgta

SEQ ID NO: 1798800 - DNA, 16 bp, Homo sapiens
gtccacgactgtctcc

SEQ ID NO: 1798801 - DNA, 18 bp, Homo sapiens
gtccacgactgtctccat

SEQ ID NO: 1798802 - DNA, 15 bp, Homo sapiens
gtccaggcactgaga

SEQ ID NO: 1798803 - DNA, 21 bp, Homo sapiens
gtccattgtccaatcctatgt

SEQ ID NO: 1798804 - DNA, 19 bp, Homo sapiens
gtccccctctgtccaggca

SEQ ID NO: 1798805 - DNA, 13 bp, Homo sapiens
gtccctgcctgga

SEQ ID NO: 1798806 - DNA, 20 bp, Homo sapiens
gtccctgcctggaccagcct

SEQ ID NO: 1798807 - DNA, 23 bp, Homo sapiens
gtccctgcctggaccagcctctc

SEQ ID NO: 1798808 - DNA, 16 bp, Homo sapiens
gtcctcccctatttta

SEQ ID NO: 1798809 - DNA, 20 bp, Homo sapiens
gtcctgcaccggggcctggg

SEQ ID NO: 1798810 - DNA, 23 bp, Homo sapiens
gtctaggcaggacctgtggccaa

SEQ ID NO: 1798811 - DNA, 15 bp, Homo sapiens
gtctcatccatcatc

SEQ ID NO: 1798812 - DNA, 19 bp, Homo sapiens
gtctccctcctctgcccgg

SEQ ID NO: 1798813 - DNA, 13 bp, Homo sapiens
gtctcgtggtagg

SEQ ID NO: 1798814 - DNA, 17 bp, Homo sapiens
gtctctgtataatctat

SEQ ID NO: 1798815 - DNA, 13 bp, Homo sapiens
gtctcttgtaatc

SEQ ID NO: 1798816 - DNA, 14 bp, Homo sapiens
gtctgagagaggcc

SEQ ID NO: 1798817 - DNA, 17 bp, Homo sapiens
gtctggcacagcctggc

SEQ ID NO: 1798818 - DNA, 18 bp, Homo sapiens
gtctttccacggagccac

SEQ ID NO: 1798819 - DNA, 19 bp, Homo sapiens
gtgaagtttaattgactta

SEQ ID NO: 1798820 - DNA, 18 bp, Homo sapiens
gtgaatacattttgcaca

SEQ ID NO: 1798821 - DNA, 13 bp, Homo sapiens
gtgaatgtctcag

SEQ ID NO: 1798822 - DNA, 15 bp, Homo sapiens
gtgaccaatgtcttg

SEQ ID NO: 1798823 - DNA, 12 bp, Homo sapiens
gtgactctttcc

SEQ ID NO: 1798824 - DNA, 15 bp, Homo sapiens
gtgaggccagggcag

SEQ ID NO: 1798825 - DNA, 17 bp, Homo sapiens
gtgcagccgctgagcga

SEQ ID NO: 1798826 - DNA, 15 bp, Homo sapiens
gtgcaggtggggaga

SEQ ID NO: 1798827 - DNA, 15 bp, Homo sapiens
gtgcatgaaagagaa

SEQ ID NO: 1798828 - DNA, 15 bp, Homo sapiens
gtgcgtccacgagct

SEQ ID NO: 1798829 - DNA, 11 bp, Homo sapiens
gtgctgcctct

SEQ ID NO: 1798830 - DNA, 20 bp, Homo sapiens
gtgcttctagttctgccagg

SEQ ID NO: 1798831 - DNA, 18 bp, Homo sapiens
ttcatgtaaactgtgcac

SEQ ID NO: 1798832 - DNA, 19 bp, Homo sapiens
ttcatgtaaactgtgcacc

SEQ ID NO: 1798833 - DNA, 9 bp, Homo sapiens
ttcattcag

SEQ ID NO: 1798834 - DNA, 24 bp, Homo sapiens
ttccacggagccactcctctgact

SEQ ID NO: 1798835 - DNA, 21 bp, Homo sapiens
ttccatggtgtgatcgtctga

SEQ ID NO: 1798836 - DNA, 17 bp, Homo sapiens
ttccattggatctcatt

SEQ ID NO: 1798837 - DNA, 12 bp, Homo sapiens
ttcccaggtgct

SEQ ID NO: 1798838 - DNA, 15 bp, Homo sapiens
ttcccccactgatca

SEQ ID NO: 1798839 - DNA, 23 bp, Homo sapiens
ttcccgtggaacgtttttcctgt

SEQ ID NO: 1798840 - DNA, 13 bp, Homo sapiens
ttccctgactcat

SEQ ID NO: 1798841 - DNA, 16 bp, Homo sapiens
ttccctgactcattct

SEQ ID NO: 1798842 - DNA, 15 bp, Homo sapiens
ttcctaataaagttc

SEQ ID NO: 1798843 - DNA, 22 bp, Homo sapiens
ttcctaataaagttctgtactc

SEQ ID NO: 1798844 - DNA, 14 bp, Homo sapiens
ttcctcctgggccc

SEQ ID NO: 1798845 - DNA, 23 bp, Homo sapiens
ttcctcctgggccctctctgctc

SEQ ID NO: 1798846 - DNA, 17 bp, Homo sapiens
ttcgaataaagtgaata

SEQ ID NO: 1798847 - DNA, 17 bp, Homo sapiens
ttctatttctcctccat

SEQ ID NO: 1798848 - DNA, 17 bp, Homo sapiens
ttctctgagctgtgcag

SEQ ID NO: 1798849 - DNA, 18 bp, Homo sapiens
ttctctgagctgtgcagg

SEQ ID NO: 1798850 - DNA, 17 bp, Homo sapiens
ttctctgtctcatccat

SEQ ID NO: 1798851 - DNA, 13 bp, Homo sapiens
ttctgccaggaga

SEQ ID NO: 1798852 - DNA, 20 bp, Homo sapiens
ttctgctcatcattctctgt

SEQ ID NO: 1798853 - DNA, 21 bp, Homo sapiens
ttctgggagggcagcagggct

SEQ ID NO: 1798854 - DNA, 15 bp, Homo sapiens
ttctgtatgtgacaa

SEQ ID NO: 1798855 - DNA, 23 bp, Homo sapiens
ttcttaagacgtgattttgctgt

SEQ ID NO: 1798856 - DNA, 14 bp, Homo sapiens
ttcttagttgctgt

SEQ ID NO: 1798857 - DNA, 15 bp, Homo sapiens
ttcttagttgctgta

SEQ ID NO: 1798858 - DNA, 23 bp, Homo sapiens
ttcttagttgctgtatgtctcgt

SEQ ID NO: 1798859 - DNA, 16 bp, Homo sapiens
ttcttggttgaggaaa

SEQ ID NO: 1798860 - DNA, 20 bp, Homo sapiens
ttgaaaaaatagagcctgag

SEQ ID NO: 1798861 - DNA, 15 bp, Homo sapiens
ttgaattgtaactgt

SEQ ID NO: 1798862 - DNA, 21 bp, Homo sapiens
ttgacagagttggtgttcata

SEQ ID NO: 1798863 - DNA, 13 bp, Homo sapiens
ttgaggaaaacaa

SEQ ID NO: 1798864 - DNA, 15 bp, Homo sapiens
ttgagtgctctgatc

SEQ ID NO: 1798865 - DNA, 17 bp, Homo sapiens
ttgattattcagtgtca

SEQ ID NO: 1798866 - DNA, 19 bp, Homo sapiens
ttgctcaggtgcaagtgcc

SEQ ID NO: 1798867 - DNA, 12 bp, Homo sapiens
ttgctcttctgt

SEQ ID NO: 1798868 - DNA, 14 bp, Homo sapiens
ttggacccttccat

SEQ ID NO: 1798869 - DNA, 14 bp, Homo sapiens
ttggagcttcatgg

SEQ ID NO: 1798870 - DNA, 18 bp, Homo sapiens
ttggttcccccactgatc

SEQ ID NO: 1798871 - DNA, 15 bp, Homo sapiens
ttgtaacttcaaata

SEQ ID NO: 1798872 - DNA, 16 bp, Homo sapiens
ttgtaacttcaaatat

SEQ ID NO: 1798873 - DNA, 13 bp, Homo sapiens
ttgtacagttttt

SEQ ID NO: 1798874 - DNA, 16 bp, Homo sapiens
ttgtacagtttttatt

SEQ ID NO: 1798875 - DNA, 20 bp, Homo sapiens
ttgtacattatgttattgga

SEQ ID NO: 1798876 - DNA, 15 bp, Homo sapiens
ttgtacgttatatat

SEQ ID NO: 1798877 - DNA, 18 bp, Homo sapiens
ttgtacgttatatattgt

SEQ ID NO: 1798878 - DNA, 19 bp, Homo sapiens
ttgtactcttgctttttca

SEQ ID NO: 1798879 - DNA, 20 bp, Homo sapiens
ttgtacttttggcatgaaag

SEQ ID NO: 1798880 - DNA, 14 bp, Homo sapiens
ttgtattctctgag

SEQ ID NO: 1798881 - DNA, 20 bp, Homo sapiens
ttgtattctctgagctgtgc

SEQ ID NO: 1798882 - DNA, 15 bp, Homo sapiens
ttgtattgtttcaat

SEQ ID NO: 1798883 - DNA, 13 bp, Homo sapiens
ttgtccattgtcc

SEQ ID NO: 1798884 - DNA, 22 bp, Homo sapiens
ttgtcctcagccccgcgtggaa

SEQ ID NO: 1798885 - DNA, 19 bp, Homo sapiens
ttgtgttactgcagtgacc

SEQ ID NO: 1798886 - DNA, 19 bp, Homo sapiens
ttgttaataaaagtacatg

SEQ ID NO: 1798887 - DNA, 15 bp, Homo sapiens
ttgttattttgcaac

SEQ ID NO: 1798888 - DNA, 22 bp, Homo sapiens
ttgttcgccgcgtggaatgtga

SEQ ID NO: 1798889 - DNA, 14 bp, Homo sapiens
ttgttttcttcatt

SEQ ID NO: 1798890 - DNA, 19 bp, Homo sapiens
ttgtttttcattcagtctt

SEQ ID NO: 1798891 - DNA, 20 bp, Homo sapiens
tttaaaagcaattatattgt

SEQ ID NO: 1798892 - DNA, 19 bp, Homo sapiens
tttaacaaaaaaggaaaat

SEQ ID NO: 1798893 - DNA, 16 bp, Homo sapiens
tttaactgtgcagtga

SEQ ID NO: 1798894 - DNA, 18 bp, Homo sapiens
tttaactgtgcagtgact

SEQ ID NO: 1798895 - DNA, 16 bp, Homo sapiens
tttaagacgtgaatgt

SEQ ID NO: 1798896 - DNA, 21 bp, Homo sapiens
tttaagacgtgaatgtctcag

SEQ ID NO: 1798897 - DNA, 18 bp, Homo sapiens
tttaagttacacattttt

SEQ ID NO: 1798898 - DNA, 15 bp, Homo sapiens
tttacattcatatct

SEQ ID NO: 1798899 - DNA, 16 bp, Homo sapiens
tttaccattaaaaagt

SEQ ID NO: 1798900 - DNA, 14 bp, Homo sapiens
tttatgccacctga

SEQ ID NO: 1798901 - DNA, 12 bp, Homo sapiens
tttatttttcat

SEQ ID NO: 1798902 - DNA, 17 bp, Homo sapiens
tttatttttcatttagt

SEQ ID NO: 1798903 - DNA, 22 bp, Homo sapiens
tttcaccatttgattatgtagc

SEQ ID NO: 1798904 - DNA, 23 bp, Homo sapiens
tttcagcacctacagtgtacagt

SEQ ID NO: 1798905 - DNA, 17 bp, Homo sapiens
tttcataagtatttcaa

SEQ ID NO: 1798906 - DNA, 15 bp, Homo sapiens
tttcatacattatat

SEQ ID NO: 1798907 - DNA, 23 bp, Homo sapiens
tttccacggagccactcctctga

SEQ ID NO: 1798908 - DNA, 18 bp, Homo sapiens
tttctactttgaagtcat

SEQ ID NO: 1798909 - DNA, 17 bp, Homo sapiens
tttctttcatacattat

SEQ ID NO: 1798910 - DNA, 18 bp, Homo sapiens
tttgaaattaacctctca

SEQ ID NO: 1798911 - DNA, 22 bp, Homo sapiens
tttgaagtcataccaatgaaaa

SEQ ID NO: 1798912 - DNA, 22 bp, Homo sapiens
tttgacagagttggtgttcata

SEQ ID NO: 1798913 - DNA, 20 bp, Homo sapiens
tttgcaagggaaaagtctct

SEQ ID NO: 1798914 - DNA, 18 bp, Homo sapiens
tttgcacccatgccatag

SEQ ID NO: 1798915 - DNA, 22 bp, Homo sapiens
tttgcataacaattcctctact

SEQ ID NO: 1798916 - DNA, 13 bp, Homo sapiens
tttgctgtagaag

SEQ ID NO: 1798917 - DNA, 15 bp, Homo sapiens
tttgtacattatgtt

SEQ ID NO: 1798918 - DNA, 16 bp, Homo sapiens
tttgtacattatgtta

SEQ ID NO: 1798919 - DNA, 17 bp, Homo sapiens
tttgtacttttgtgtta

SEQ ID NO: 1798920 - DNA, 15 bp, Homo sapiens
tttgtagtgattttt

SEQ ID NO: 1798921 - DNA, 21 bp, Homo sapiens
tttgtattgtttcaattgcat

SEQ ID NO: 1798922 - DNA, 21 bp, Homo sapiens
tttgtcttgtgtttctttagt

SEQ ID NO: 1798923 - DNA, 15 bp, Homo sapiens
tttgttattttgcaa

SEQ ID NO: 1798924 - DNA, 13 bp, Homo sapiens
tttgttttcttca

SEQ ID NO: 1798925 - DNA, 22 bp, Homo sapiens
ttttaagacgtgaatgtctcag

SEQ ID NO: 1798926 - DNA, 21 bp, Homo sapiens
ttttgcaacctcgctggactc

SEQ ID NO: 1798927 - DNA, 20 bp, Homo sapiens
ttttgctcttctgtatgtga

SEQ ID NO: 1798928 - DNA, 16 bp, Homo sapiens
ttttgtaacttcaaat

SEQ ID NO: 1798929 - DNA, 13 bp, Homo sapiens
ttttgtacattat

SEQ ID NO: 1798930 - DNA, 17 bp, Homo sapiens
ttttgtacattatgtta

SEQ ID NO: 1798931 - DNA, 19 bp, Homo sapiens
ttttgtttcatattgatgt

SEQ ID NO: 1798932 - DNA, 14 bp, Homo sapiens
ttttgttttcttca

SEQ ID NO: 1798933 - DNA, 12 bp, Homo sapiens
tttttcagtttt

SEQ ID NO: 1798934 - DNA, 15 bp, Homo sapiens
tttttcagttttcag

SEQ ID NO: 1798935 - DNA, 16 bp, Homo sapiens
tttttgtaacttcaaa

SEQ ID NO: 1798936 - DNA, 13 bp, Homo sapiens
aatttgagtgctc

SEQ ID NO: 1798937 - DNA, 21 bp, Homo sapiens
aattttctttcatacattata

SEQ ID NO: 1798938 - DNA, 14 bp, Homo sapiens
acaaaaattaaaat

SEQ ID NO: 1798939 - DNA, 16 bp, Homo sapiens
acaaactgatttctca

SEQ ID NO: 1798940 - DNA, 18 bp, Homo sapiens
acaacatttttgtacatt

SEQ ID NO: 1798941 - DNA, 21 bp, Homo sapiens
acaacatttttgtacattatg

SEQ ID NO: 1798942 - DNA, 22 bp, Homo sapiens
acaattcctctactaacaatca

SEQ ID NO: 1798943 - DNA, 14 bp, Homo sapiens
acacatttttcaga

SEQ ID NO: 1798944 - DNA, 24 bp, Homo sapiens
acaccgagtctctgtataatctat

SEQ ID NO: 1798945 - DNA, 16 bp, Homo sapiens
acacctcttggggagt

SEQ ID NO: 1798946 - DNA, 20 bp, Homo sapiens
acactgtgcacatctgtgtc

SEQ ID NO: 1798947 - DNA, 21 bp, Homo sapiens
acactgtgcacatctgtgtct

SEQ ID NO: 1798948 - DNA, 16 bp, Homo sapiens
acagaaaagaaagctg

SEQ ID NO: 1798949 - DNA, 14 bp, Homo sapiens
acagagcttccctg

SEQ ID NO: 1798950 - DNA, 15 bp, Homo sapiens
acagcctcccctgcc

SEQ ID NO: 1798951 - DNA, 21 bp, Homo sapiens
acagcctcccctgccagggca

SEQ ID NO: 1798952 - DNA, 12 bp, Homo sapiens
acagcctggctg

SEQ ID NO: 1798953 - DNA, 13 bp, Homo sapiens
acagtaggagccc

SEQ ID NO: 1798954 - DNA, 14 bp, Homo sapiens
acagtcttccattt

SEQ ID NO: 1798955 - DNA, 22 bp, Homo sapiens
acagtcttgtattaagttgtta

SEQ ID NO: 1798956 - DNA, 12 bp, Homo sapiens
acagtgtacagt

SEQ ID NO: 1798957 - DNA, 14 bp, Homo sapiens
acataaaatgtcat

SEQ ID NO: 1798958 - DNA, 19 bp, Homo sapiens
acatatatatatcccttta

SEQ ID NO: 1798959 - DNA, 16 bp, Homo sapiens
acatctaacctcatct

SEQ ID NO: 1798960 - DNA, 22 bp, Homo sapiens
acatgaagattctttcccaatt

SEQ ID NO: 1798961 - DNA, 21 bp, Homo sapiens
acatgaccctaaatcttgact

SEQ ID NO: 1798962 - DNA, 23 bp, Homo sapiens
acatgggagccgggtctgcctct

SEQ ID NO: 1798963 - DNA, 18 bp, Homo sapiens
acatggtgggtccatggg

SEQ ID NO: 1798964 - DNA, 19 bp, Homo sapiens
acatgtcagtaccttcaaa

SEQ ID NO: 1798965 - DNA, 16 bp, Homo sapiens
acattatgttattgga

SEQ ID NO: 1798966 - DNA, 23 bp, Homo sapiens
acatttctctaagagaacaatgt

SEQ ID NO: 1798967 - DNA, 17 bp, Homo sapiens
acatttttgtacattat

SEQ ID NO: 1798968 - DNA, 20 bp, Homo sapiens
acatttttgtacattatgtt

SEQ ID NO: 1798969 - DNA, 16 bp, Homo sapiens
accaatattgtacagt

SEQ ID NO: 1798970 - DNA, 17 bp, Homo sapiens
accaatgaaaaaatgta

SEQ ID NO: 1798971 - DNA, 16 bp, Homo sapiens
acccagccctcatccc

SEQ ID NO: 1798972 - DNA, 13 bp, Homo sapiens
accccctgtgcct

SEQ ID NO: 1798973 - DNA, 18 bp, Homo sapiens
acccccttctccatccac

SEQ ID NO: 1798974 - DNA, 19 bp, Homo sapiens
acccccttctccatccaca

SEQ ID NO: 1798975 - DNA, 12 bp, Homo sapiens
accccgactttt

SEQ ID NO: 1798976 - DNA, 15 bp, Homo sapiens
accccgacttttgtt

SEQ ID NO: 1798977 - DNA, 23 bp, Homo sapiens
accctgagctgaggcagcagtgt

SEQ ID NO: 1798978 - DNA, 17 bp, Homo sapiens
accgagtctctgtataa

SEQ ID NO: 1798979 - DNA, 16 bp, Homo sapiens
accgtgggctccctga

SEQ ID NO: 1798980 - DNA, 20 bp, Homo sapiens
acctacagtgtacagtcttg

SEQ ID NO: 1798981 - DNA, 12 bp, Homo sapiens
acctaggctagg

SEQ ID NO: 1798982 - DNA, 13 bp, Homo sapiens
acctcctgagaaa

SEQ ID NO: 1798983 - DNA, 14 bp, Homo sapiens
acctcgctggactc

SEQ ID NO: 1798984 - DNA, 18 bp, Homo sapiens
acctcttcagaggccctc

SEQ ID NO: 1798985 - DNA, 18 bp, Homo sapiens
acctgaaaacactgtgca

SEQ ID NO: 1798986 - DNA, 19 bp, Homo sapiens
acctgaaaacactgtgcac

SEQ ID NO: 1798987 - DNA, 16 bp, Homo sapiens
acctgacactcccttg

SEQ ID NO: 1798988 - DNA, 16 bp, Homo sapiens
acctgccgagagtcca

SEQ ID NO: 1798989 - DNA, 19 bp, Homo sapiens
acctgtgcttcgggccctt

SEQ ID NO: 1798990 - DNA, 12 bp, Homo sapiens
acgactgtctcc

SEQ ID NO: 1798991 - DNA, 16 bp, Homo sapiens
acgcatgagatattca

SEQ ID NO: 1798992 - DNA, 22 bp, Homo sapiens
acgccagacttcccacggctcc

SEQ ID NO: 1798993 - DNA, 13 bp, Homo sapiens
acgcctgaggaac

SEQ ID NO: 1798994 - DNA, 18 bp, Homo sapiens
acgcctgggggtgccagg

SEQ ID NO: 1798995 - DNA, 21 bp, Homo sapiens
acggagccactcctctgactc

SEQ ID NO: 1798996 - DNA, 18 bp, Homo sapiens
acgtaaagctagaaatga

SEQ ID NO: 1798997 - DNA, 17 bp, Homo sapiens
acgtgtctttagaactc

SEQ ID NO: 1798998 - DNA, 19 bp, Homo sapiens
acgttatatattgtattaa

SEQ ID NO: 1798999 - DNA, 18 bp, Homo sapiens
actatatttatttatgta

SEQ ID NO: 1799000 - DNA, 17 bp, Homo sapiens
actatcaatatttaagt

SEQ ID NO: 1799001 - DNA, 14 bp, Homo sapiens
actatggctgttta

SEQ ID NO: 1799002 - DNA, 13 bp, Homo sapiens
actattacttgaa

SEQ ID NO: 1799003 - DNA, 16 bp, Homo sapiens
actcagggctcctggg

SEQ ID NO: 1799004 - DNA, 15 bp, Homo sapiens
actcatgtgactctt

SEQ ID NO: 1799005 - DNA, 16 bp, Homo sapiens
actcatgtgactcttt

SEQ ID NO: 1799006 - DNA, 18 bp, Homo sapiens
actcatgtgactctttcc

SEQ ID NO: 1799007 - DNA, 19 bp, Homo sapiens
actcatgtgactctttcca

SEQ ID NO: 1799008 - DNA, 18 bp, Homo sapiens
actccagttaaaaaaaat

SEQ ID NO: 1799009 - DNA, 20 bp, Homo sapiens
actccagttaaaaaaaattt

SEQ ID NO: 1799010 - DNA, 23 bp, Homo sapiens
actcgtgtctggcacagcctggc

SEQ ID NO: 1799011 - DNA, 22 bp, Homo sapiens
actctcaggaccaaagctttca

SEQ ID NO: 1799012 - DNA, 13 bp, Homo sapiens
actctgcttgtta

SEQ ID NO: 1799013 - DNA, 11 bp, Homo sapiens
actctttcaaa

SEQ ID NO: 1799014 - DNA, 13 bp, Homo sapiens
actgaacattcca

SEQ ID NO: 1799015 - DNA, 20 bp, Homo sapiens
actgaccaatattgtacagt

SEQ ID NO: 1799016 - DNA, 16 bp, Homo sapiens
actgagaaatgaatgc

SEQ ID NO: 1799017 - DNA, 16 bp, Homo sapiens
aaaaaatgtatatgca

SEQ ID NO: 1799018 - DNA, 16 bp, Homo sapiens
aaaaatgtatatgcac

SEQ ID NO: 1799019 - DNA, 14 bp, Homo sapiens
aaaagggaggggga

SEQ ID NO: 1799020 - DNA, 21 bp, Homo sapiens
aaaagtgcaatgcgtgttgta

SEQ ID NO: 1799021 - DNA, 22 bp, Homo sapiens
aaaatagataagagtagaaact

SEQ ID NO: 1799022 - DNA, 17 bp, Homo sapiens
aaaatgaacaggttctt

SEQ ID NO: 1799023 - DNA, 17 bp, Homo sapiens
aaaatgtatatgcactt

SEQ ID NO: 1799024 - DNA, 13 bp, Homo sapiens
aaaattatttgca

SEQ ID NO: 1799025 - DNA, 18 bp, Homo sapiens
aaaatttgttattttgca

SEQ ID NO: 1799026 - DNA, 16 bp, Homo sapiens
aaacaaaaatatcttg

SEQ ID NO: 1799027 - DNA, 17 bp, Homo sapiens
aaacaactctttgagaa

SEQ ID NO: 1799028 - DNA, 23 bp, Homo sapiens
aaacctaaagaggaaaagtgcaa

SEQ ID NO: 1799029 - DNA, 19 bp, Homo sapiens
aaactgaggccattatttc

SEQ ID NO: 1799030 - DNA, 19 bp, Homo sapiens
aaactgatgtttaaaagtc

SEQ ID NO: 1799031 - DNA, 19 bp, Homo sapiens
aaagactgaccaatattgt

SEQ ID NO: 1799032 - DNA, 21 bp, Homo sapiens
aaagatacagaactctttcaa

SEQ ID NO: 1799033 - DNA, 20 bp, Homo sapiens
aaagcaaggaaactatgtaa

SEQ ID NO: 1799034 - DNA, 13 bp, Homo sapiens
aaagcaattatat

SEQ ID NO: 1799035 - DNA, 15 bp, Homo sapiens
aaagcccaaagtggt

SEQ ID NO: 1799036 - DNA, 14 bp, Homo sapiens
aaaggcaagcactt

SEQ ID NO: 1799037 - DNA, 14 bp, Homo sapiens
aaagtgcaatgcgt

SEQ ID NO: 1799038 - DNA, 16 bp, Homo sapiens
aaagtggtatagaaat

SEQ ID NO: 1799039 - DNA, 17 bp, Homo sapiens
aaagtggtatagaaatg

SEQ ID NO: 1799040 - DNA, 21 bp, Homo sapiens
aaatagataagagtagaaact

SEQ ID NO: 1799041 - DNA, 15 bp, Homo sapiens
aaatagcacatgatt

SEQ ID NO: 1799042 - DNA, 10 bp, Homo sapiens
aaatatcttg

SEQ ID NO: 1799043 - DNA, 12 bp, Homo sapiens
aaatgtcttgtg

SEQ ID NO: 1799044 - DNA, 13 bp, Homo sapiens
aaatgtgatgaat

SEQ ID NO: 1799045 - DNA, 21 bp, Homo sapiens
aaatgtgatgaatactgtatt

SEQ ID NO: 1799046 - DNA, 13 bp, Homo sapiens
aaatgttcacttt

SEQ ID NO: 1799047 - DNA, 21 bp, Homo sapiens
aaattgtcccttaaacaaaaa

SEQ ID NO: 1799048 - DNA, 15 bp, Homo sapiens
aacaactctttgaga

SEQ ID NO: 1799049 - DNA, 22 bp, Homo sapiens
aacaattaattttctatgaatt

SEQ ID NO: 1799050 - DNA, 20 bp, Homo sapiens
aacactgtgcacatctgtgt

SEQ ID NO: 1799051 - DNA, 14 bp, Homo sapiens
aacaggctcagagg

SEQ ID NO: 1799052 - DNA, 15 bp, Homo sapiens
aacatgtaggaagta

SEQ ID NO: 1799053 - DNA, 18 bp, Homo sapiens
aacatttttgtacattat

SEQ ID NO: 1799054 - DNA, 17 bp, Homo sapiens
aaccatgtagaaaattt

SEQ ID NO: 1799055 - DNA, 18 bp, Homo sapiens
aacctaaagaggaaaagt

SEQ ID NO: 1799056 - DNA, 16 bp, Homo sapiens
aacctcatttaccata

SEQ ID NO: 1799057 - DNA, 19 bp, Homo sapiens
aacctcgctggactctcag

SEQ ID NO: 1799058 - DNA, 17 bp, Homo sapiens
aacctgaattattccaa

SEQ ID NO: 1799059 - DNA, 17 bp, Homo sapiens
aacgtttttcctgttct

SEQ ID NO: 1799060 - DNA, 17 bp, Homo sapiens
aactagggccaagccca

SEQ ID NO: 1799061 - DNA, 22 bp, Homo sapiens
aactatcaatatttaagtttgt

SEQ ID NO: 1799062 - DNA, 13 bp, Homo sapiens
aactctttcaaaa

SEQ ID NO: 1799063 - DNA, 14 bp, Homo sapiens
aactctttgagaaa

SEQ ID NO: 1799064 - DNA, 18 bp, Homo sapiens
aactgagaaatgaatgct

SEQ ID NO: 1799065 - DNA, 14 bp, Homo sapiens
aactgcagggaaaa

SEQ ID NO: 1799066 - DNA, 23 bp, Homo sapiens
aactgcagggaaaattatttgca

SEQ ID NO: 1799067 - DNA, 14 bp, Homo sapiens
aacttacttagtgt

SEQ ID NO: 1799068 - DNA, 14 bp, Homo sapiens
aacttttttttaag

SEQ ID NO: 1799069 - DNA, 20 bp, Homo sapiens
aacttttttttaagttacac

SEQ ID NO: 1799070 - DNA, 14 bp, Homo sapiens
aagaaagctgcttt

SEQ ID NO: 1799071 - DNA, 18 bp, Homo sapiens
aagacgtgaatgtctcag

SEQ ID NO: 1799072 - DNA, 15 bp, Homo sapiens
aagactaactaaaat

SEQ ID NO: 1799073 - DNA, 19 bp, Homo sapiens
aagaggaaaagtgcaatgc

SEQ ID NO: 1799074 - DNA, 16 bp, Homo sapiens
aagagggacgcctggg

SEQ ID NO: 1799075 - DNA, 17 bp, Homo sapiens
aagagggacgcctgggg

SEQ ID NO: 1799076 - DNA, 22 bp, Homo sapiens
aagatacagaactctttcaaaa

SEQ ID NO: 1799077 - DNA, 13 bp, Homo sapiens
aagattctttccc

SEQ ID NO: 1799078 - DNA, 15 bp, Homo sapiens
aagattttttttgta

SEQ ID NO: 1799079 - DNA, 19 bp, Homo sapiens
aagattttttttgtaactt

SEQ ID NO: 1799080 - DNA, 16 bp, Homo sapiens
aagcaattatattgtc

SEQ ID NO: 1799081 - DNA, 22 bp, Homo sapiens
aagcctagtgaaggcttctctc

SEQ ID NO: 1799082 - DNA, 23 bp, Homo sapiens
aagctttcatgtaaactgtgcac

SEQ ID NO: 1799083 - DNA, 18 bp, Homo sapiens
aaggaaaaactgatgttt

SEQ ID NO: 1799084 - DNA, 15 bp, Homo sapiens
aaggcaaacccatca

SEQ ID NO: 1799085 - DNA, 14 bp, Homo sapiens
aaggctcttttgta

SEQ ID NO: 1799086 - DNA, 15 bp, Homo sapiens
aagggacagaaaaga

SEQ ID NO: 1799087 - DNA, 21 bp, Homo sapiens
aagtataggataaattacatt

SEQ ID NO: 1799088 - DNA, 13 bp, Homo sapiens
aagtatttcaaat

SEQ ID NO: 1799089 - DNA, 15 bp, Homo sapiens
ccaaatcccctaagc

SEQ ID NO: 1799090 - DNA, 17 bp, Homo sapiens
ccaactgccagaacatg

SEQ ID NO: 1799091 - DNA, 18 bp, Homo sapiens
ccaagcaggaaatgaaaa

SEQ ID NO: 1799092 - DNA, 18 bp, Homo sapiens
ccaatattgtacagtttt

SEQ ID NO: 1799093 - DNA, 23 bp, Homo sapiens
ccacaaaataaccaatcctggac

SEQ ID NO: 1799094 - DNA, 19 bp, Homo sapiens
ccacagcctcccctgccag

SEQ ID NO: 1799095 - DNA, 21 bp, Homo sapiens
ccacaggacatttctctaaga

SEQ ID NO: 1799096 - DNA, 16 bp, Homo sapiens
ccacgactgtctccat

SEQ ID NO: 1799097 - DNA, 12 bp, Homo sapiens
ccacggagccac

SEQ ID NO: 1799098 - DNA, 12 bp, Homo sapiens
ccactcctctga

SEQ ID NO: 1799099 - DNA, 14 bp, Homo sapiens
ccactcctctgact

SEQ ID NO: 1799100 - DNA, 20 bp, Homo sapiens
ccactcctctgactcagggc

SEQ ID NO: 1799101 - DNA, 19 bp, Homo sapiens
ccagaggaaggggccagag

SEQ ID NO: 1799102 - DNA, 22 bp, Homo sapiens
ccagaggaaggggccagaggct

SEQ ID NO: 1799103 - DNA, 12 bp, Homo sapiens
ccagcactgctt

SEQ ID NO: 1799104 - DNA, 15 bp, Homo sapiens
ccagcactgcttgag

SEQ ID NO: 1799105 - DNA, 19 bp, Homo sapiens
ccagcgtcctcctctgtga

SEQ ID NO: 1799106 - DNA, 22 bp, Homo sapiens
ccagctatgttatattgaaaaa

SEQ ID NO: 1799107 - DNA, 18 bp, Homo sapiens
ccagctctgtatcaggac

SEQ ID NO: 1799108 - DNA, 17 bp, Homo sapiens
ccatcaacaaaaattgt

SEQ ID NO: 1799109 - DNA, 18 bp, Homo sapiens
ccatcaacaaaaattgtc

SEQ ID NO: 1799110 - DNA, 13 bp, Homo sapiens
ccatcagcctcca

SEQ ID NO: 1799111 - DNA, 16 bp, Homo sapiens
ccatcatcatgtgtgt

SEQ ID NO: 1799112 - DNA, 13 bp, Homo sapiens
ccatcatctcctg

SEQ ID NO: 1799113 - DNA, 17 bp, Homo sapiens
ccatccacatgggagcc

SEQ ID NO: 1799114 - DNA, 22 bp, Homo sapiens
ccattgaattcttggttgagga

SEQ ID NO: 1799115 - DNA, 15 bp, Homo sapiens
cccaacactgccagc

SEQ ID NO: 1799116 - DNA, 13 bp, Homo sapiens
cccacaaactgat

SEQ ID NO: 1799117 - DNA, 19 bp, Homo sapiens
cccacaggacatttctcta

SEQ ID NO: 1799118 - DNA, 20 bp, Homo sapiens
cccacaggacatttctctaa

SEQ ID NO: 1799119 - DNA, 21 bp, Homo sapiens
cccagaggaaggggccagagg

SEQ ID NO: 1799120 - DNA, 24 bp, Homo sapiens
cccagaggaaggggccagaggctc

SEQ ID NO: 1799121 - DNA, 21 bp, Homo sapiens
cccagcactgcttgaggaaaa

SEQ ID NO: 1799122 - DNA, 15 bp, Homo sapiens
cccagccctcatccc

SEQ ID NO: 1799123 - DNA, 19 bp, Homo sapiens
cccagccctcatcccgagc

SEQ ID NO: 1799124 - DNA, 14 bp, Homo sapiens
cccagctctgaaac

SEQ ID NO: 1799125 - DNA, 22 bp, Homo sapiens
cccagctctgaaaccagtgtta

SEQ ID NO: 1799126 - DNA, 15 bp, Homo sapiens
cccatgagctcctta

SEQ ID NO: 1799127 - DNA, 22 bp, Homo sapiens
cccatgagctccttaaggctct

SEQ ID NO: 1799128 - DNA, 13 bp, Homo sapiens
ccccatcagtgct

SEQ ID NO: 1799129 - DNA, 13 bp, Homo sapiens
cccccaatccatg

SEQ ID NO: 1799130 - DNA, 21 bp, Homo sapiens
ccccgcgtggaactcgtgtct

SEQ ID NO: 1799131 - DNA, 14 bp, Homo sapiens
cccctctgtccagg

SEQ ID NO: 1799132 - DNA, 19 bp, Homo sapiens
cccctgccagggcagggcc

SEQ ID NO: 1799133 - DNA, 14 bp, Homo sapiens
cccctgtgccttgt

SEQ ID NO: 1799134 - DNA, 14 bp, Homo sapiens
cccgggagctcagg

SEQ ID NO: 1799135 - DNA, 17 bp, Homo sapiens
ccctagaaacttccaaa

SEQ ID NO: 1799136 - DNA, 14 bp, Homo sapiens
ccctctctgctctg

SEQ ID NO: 1799137 - DNA, 19 bp, Homo sapiens
ccctgagctgaggcagcag

SEQ ID NO: 1799138 - DNA, 18 bp, Homo sapiens
ccctgcaaaaggactctc

SEQ ID NO: 1799139 - DNA, 15 bp, Homo sapiens
ccctgtgccttgtca

SEQ ID NO: 1799140 - DNA, 14 bp, Homo sapiens
cccttacagtagga

SEQ ID NO: 1799141 - DNA, 23 bp, Homo sapiens
cccttctccatccacatgggagc

SEQ ID NO: 1799142 - DNA, 15 bp, Homo sapiens
ccgaggcagggaagg

SEQ ID NO: 1799143 - DNA, 15 bp, Homo sapiens
ccgcttggagcagag

SEQ ID NO: 1799144 - DNA, 17 bp, Homo sapiens
ccgcttggagcagaggg

SEQ ID NO: 1799145 - DNA, 18 bp, Homo sapiens
ccgcttggagcagagggg

SEQ ID NO: 1799146 - DNA, 20 bp, Homo sapiens
ccggagcaggggtctgagcc

SEQ ID NO: 1799147 - DNA, 16 bp, Homo sapiens
ccggctttgtggcact

SEQ ID NO: 1799148 - DNA, 17 bp, Homo sapiens
ccggctttgtggcactg

SEQ ID NO: 1799149 - DNA, 20 bp, Homo sapiens
ccgggacacctaggctaggg

SEQ ID NO: 1799150 - DNA, 19 bp, Homo sapiens
ccggggcctgggcaggagg

SEQ ID NO: 1799151 - DNA, 20 bp, Homo sapiens
ccggggcctgggcaggaggg

SEQ ID NO: 1799152 - DNA, 20 bp, Homo sapiens
cctaaagaggaaaagtgcaa

SEQ ID NO: 1799153 - DNA, 22 bp, Homo sapiens
cctaaagaggaaaagtgcaatg

SEQ ID NO: 1799154 - DNA, 12 bp, Homo sapiens
cctaacctgccg

SEQ ID NO: 1799155 - DNA, 21 bp, Homo sapiens
cctaataaagttctgtactca

SEQ ID NO: 1799156 - DNA, 15 bp, Homo sapiens
cctacagtgtacagt

SEQ ID NO: 1799157 - DNA, 20 bp, Homo sapiens
cctacagtgtacagtcttgt

SEQ ID NO: 1799158 - DNA, 18 bp, Homo sapiens
cctagtgaaggcttctct

SEQ ID NO: 1799159 - DNA, 22 bp, Homo sapiens
cctagtgaaggcttctctctgt

SEQ ID NO: 1799160 - DNA, 22 bp, Homo sapiens
cctatgtttttgttcaaagcca

SEQ ID NO: 1799161 - DNA, 20 bp, Homo sapiens
cctcactattacttgaactt

SEQ ID NO: 1799162 - DNA, 14 bp, Homo sapiens
cctccacatcctcc

SEQ ID NO: 1799163 - DNA, 23 bp, Homo sapiens
cctccatcctaccccctgtgcct

SEQ ID NO: 1799164 - DNA, 12 bp, Homo sapiens
cctcccctgcca

SEQ ID NO: 1799165 - DNA, 16 bp, Homo sapiens
cctcccctgccagggc

SEQ ID NO: 1799166 - DNA, 18 bp, Homo sapiens
cctccgggacctggtgct

SEQ ID NO: 1799167 - DNA, 22 bp, Homo sapiens
cctcctctgtgaccaatgtctt

SEQ ID NO: 1799168 - DNA, 20 bp, Homo sapiens
cctcctgtgtggaagaagga

SEQ ID NO: 1799169 - DNA, 18 bp, Homo sapiens
cctcgctggactctcagt

SEQ ID NO: 1799170 - DNA, 18 bp, Homo sapiens
cctctacagagcttccct

SEQ ID NO: 1799171 - DNA, 20 bp, Homo sapiens
cctctacagagcttccctga

SEQ ID NO: 1799172 - DNA, 18 bp, Homo sapiens
cctctccactcatgtgac

SEQ ID NO: 1799173 - DNA, 19 bp, Homo sapiens
cctctgactcagggctcct

SEQ ID NO: 1799174 - DNA, 21 bp, Homo sapiens
cctctgcccgggagctcagga

SEQ ID NO: 1799175 - DNA, 19 bp, Homo sapiens
cctctgtccaggcactgag

SEQ ID NO: 1799176 - DNA, 20 bp, Homo sapiens
cctctgtccaggcactgaga

SEQ ID NO: 1799177 - DNA, 14 bp, Homo sapiens
cctcttcagaggcc

SEQ ID NO: 1799178 - DNA, 13 bp, Homo sapiens
cctcttctgggag

SEQ ID NO: 1799179 - DNA, 22 bp, Homo sapiens
cctcttggggagtttagggtgg

SEQ ID NO: 1799180 - DNA, 23 bp, Homo sapiens
cctcttggggagtttagggtggg

SEQ ID NO: 1799181 - DNA, 17 bp, Homo sapiens
cctgaaaacactgtgca

SEQ ID NO: 1799182 - DNA, 15 bp, Homo sapiens
cctgagctgaggcag

SEQ ID NO: 1799183 - DNA, 18 bp, Homo sapiens
cctgaggaacccttacag

SEQ ID NO: 1799184 - DNA, 17 bp, Homo sapiens
cctgcaaaaggactctc

SEQ ID NO: 1799185 - DNA, 12 bp, Homo sapiens
cctgccacagcc

SEQ ID NO: 1799186 - DNA, 19 bp, Homo sapiens
cctgccagggcagggcccc

SEQ ID NO: 1799187 - DNA, 15 bp, Homo sapiens
cctgcccccaatcca

SEQ ID NO: 1799188 - DNA, 14 bp, Homo sapiens
cctgccgagagtcc

SEQ ID NO: 1799189 - DNA, 16 bp, Homo sapiens
cctgccttcctcctgg

SEQ ID NO: 1799190 - DNA, 18 bp, Homo sapiens
cctggagactgcccagct

SEQ ID NO: 1799191 - DNA, 18 bp, Homo sapiens
cctgggaaatattcccta

SEQ ID NO: 1799192 - DNA, 15 bp, Homo sapiens
cctgggccctctctg

SEQ ID NO: 1799193 - DNA, 20 bp, Homo sapiens
cctgggttttgtattctctg

SEQ ID NO: 1799194 - DNA, 21 bp, Homo sapiens
cctgtaacctcttcagaggcc

SEQ ID NO: 1799195 - DNA, 22 bp, Homo sapiens
cacggctcctcgagatcccaac

SEQ ID NO: 1799196 - DNA, 16 bp, Homo sapiens
cacgtgtttgtgctgt

SEQ ID NO: 1799197 - DNA, 22 bp, Homo sapiens
cactcatgtgactctttccaac

SEQ ID NO: 1799198 - DNA, 12 bp, Homo sapiens
cactcctctgac

SEQ ID NO: 1799199 - DNA, 13 bp, Homo sapiens
cactcctctgact

SEQ ID NO: 1799200 - DNA, 21 bp, Homo sapiens
cactcctctgactcagggctc

SEQ ID NO: 1799201 - DNA, 19 bp, Homo sapiens
cactgagataccagcgagg

SEQ ID NO: 1799202 - DNA, 23 bp, Homo sapiens
cactgagataccagcgaggaggc

SEQ ID NO: 1799203 - DNA, 18 bp, Homo sapiens
cactgccagcatttccct

SEQ ID NO: 1799204 - DNA, 13 bp, Homo sapiens
cactgcttgagga

SEQ ID NO: 1799205 - DNA, 13 bp, Homo sapiens
cactggggcaggg

SEQ ID NO: 1799206 - DNA, 19 bp, Homo sapiens
cactggggcaggggccggg

SEQ ID NO: 1799207 - DNA, 17 bp, Homo sapiens
cacttttgacaaaggca

SEQ ID NO: 1799208 - DNA, 18 bp, Homo sapiens
cacttttgacaaaggcaa

SEQ ID NO: 1799209 - DNA, 17 bp, Homo sapiens
cagaaaagaaagctgct

SEQ ID NO: 1799210 - DNA, 17 bp, Homo sapiens
cagagaaaaagggaggg

SEQ ID NO: 1799211 - DNA, 16 bp, Homo sapiens
cagaggaaggggccag

SEQ ID NO: 1799212 - DNA, 14 bp, Homo sapiens
cagagggcactctg

SEQ ID NO: 1799213 - DNA, 14 bp, Homo sapiens
cagagtccctgcct

SEQ ID NO: 1799214 - DNA, 20 bp, Homo sapiens
cagagtgagacccagccctc

SEQ ID NO: 1799215 - DNA, 18 bp, Homo sapiens
cagcactgcttgaggaaa

SEQ ID NO: 1799216 - DNA, 19 bp, Homo sapiens
cagcactgcttgaggaaaa

SEQ ID NO: 1799217 - DNA, 19 bp, Homo sapiens
cagcagtgtgaggccaggg

SEQ ID NO: 1799218 - DNA, 22 bp, Homo sapiens
cagcagtgtgaggccagggcag

SEQ ID NO: 1799219 - DNA, 15 bp, Homo sapiens
cagcatttcccttcc

SEQ ID NO: 1799220 - DNA, 18 bp, Homo sapiens
cagcctccatcctacccc

SEQ ID NO: 1799221 - DNA, 18 bp, Homo sapiens
cagcctcccctgccaggg

SEQ ID NO: 1799222 - DNA, 16 bp, Homo sapiens
cagcgaggaggctcca

SEQ ID NO: 1799223 - DNA, 17 bp, Homo sapiens
cagcgaggaggctccag

SEQ ID NO: 1799224 - DNA, 18 bp, Homo sapiens
cagcgaggaggctccaga

SEQ ID NO: 1799225 - DNA, 15 bp, Homo sapiens
cagcgtgctttaaaa

SEQ ID NO: 1799226 - DNA, 18 bp, Homo sapiens
cagctctgaaaccagtgt

SEQ ID NO: 1799227 - DNA, 23 bp, Homo sapiens
cagctggatgagaatttgagtgc

SEQ ID NO: 1799228 - DNA, 12 bp, Homo sapiens
caggacatttct

SEQ ID NO: 1799229 - DNA, 14 bp, Homo sapiens
caggacatttctct

SEQ ID NO: 1799230 - DNA, 13 bp, Homo sapiens
caggacccagagg

SEQ ID NO: 1799231 - DNA, 14 bp, Homo sapiens
caggacccagagga

SEQ ID NO: 1799232 - DNA, 19 bp, Homo sapiens
caggagaaggccaattcct

SEQ ID NO: 1799233 - DNA, 21 bp, Homo sapiens
caggagaaggccaattcctat

SEQ ID NO: 1799234 - DNA, 23 bp, Homo sapiens
caggagacaggttagctgctccc

SEQ ID NO: 1799235 - DNA, 17 bp, Homo sapiens
caggagtgggttgattt

SEQ ID NO: 1799236 - DNA, 23 bp, Homo sapiens
caggcactgagataccagcgagg

SEQ ID NO: 1799237 - DNA, 18 bp, Homo sapiens
cagggaaggatcccatga

SEQ ID NO: 1799238 - DNA, 13 bp, Homo sapiens
cagggcagagtga

SEQ ID NO: 1799239 - DNA, 13 bp, Homo sapiens
cagggcagggccc

SEQ ID NO: 1799240 - DNA, 13 bp, Homo sapiens
cagggcgcaagcc

SEQ ID NO: 1799241 - DNA, 23 bp, Homo sapiens
cagggctaccctgagctgaggca

SEQ ID NO: 1799242 - DNA, 15 bp, Homo sapiens
caggggtctgagcca

SEQ ID NO: 1799243 - DNA, 22 bp, Homo sapiens
caggtggggagactgggctgag

SEQ ID NO: 1799244 - DNA, 14 bp, Homo sapiens
cagtaggagcccag

SEQ ID NO: 1799245 - DNA, 21 bp, Homo sapiens
cagtcaacctgggcaaagcct

SEQ ID NO: 1799246 - DNA, 21 bp, Homo sapiens
cagtcaggaaaggaatcattt

SEQ ID NO: 1799247 - DNA, 18 bp, Homo sapiens
cagtgaatgattcagtgt

SEQ ID NO: 1799248 - DNA, 22 bp, Homo sapiens
cagtgacctgccctacatatct

SEQ ID NO: 1799249 - DNA, 15 bp, Homo sapiens
cagtggggcagtcat

SEQ ID NO: 1799250 - DNA, 12 bp, Homo sapiens
cagtgtacagtc

SEQ ID NO: 1799251 - DNA, 18 bp, Homo sapiens
cagtgtacagtcttgtat

SEQ ID NO: 1799252 - DNA, 17 bp, Homo sapiens
cagtgtgaggccagggc

SEQ ID NO: 1799253 - DNA, 15 bp, Homo sapiens
cagttaaaaaaaatt

SEQ ID NO: 1799254 - DNA, 15 bp, Homo sapiens
cagtttttattgctt

SEQ ID NO: 1799255 - DNA, 15 bp, Homo sapiens
catcagtgctccctc

SEQ ID NO: 1799256 - DNA, 16 bp, Homo sapiens
catcagtgctccctca

SEQ ID NO: 1799257 - DNA, 24 bp, Homo sapiens
catcagtgctccctcacatgtcag

SEQ ID NO: 1799258 - DNA, 20 bp, Homo sapiens
catcatctcctgccttcctc

SEQ ID NO: 1799259 - DNA, 13 bp, Homo sapiens
catccagagtccc

SEQ ID NO: 1799260 - DNA, 18 bp, Homo sapiens
catccagagtccctgcct

SEQ ID NO: 1799261 - DNA, 13 bp, Homo sapiens
catccatcatcat

SEQ ID NO: 1799262 - DNA, 17 bp, Homo sapiens
catcccgagcacctcca

SEQ ID NO: 1799263 - DNA, 22 bp, Homo sapiens
catcccgctggtgcctcccggg

SEQ ID NO: 1799264 - DNA, 15 bp, Homo sapiens
catcctaccccctgt

SEQ ID NO: 1799265 - DNA, 19 bp, Homo sapiens
catcctaccccctgtgcct

SEQ ID NO: 1799266 - DNA, 18 bp, Homo sapiens
catctcccagataatgtg

SEQ ID NO: 1799267 - DNA, 22 bp, Homo sapiens
catctcctgccttcctcctggg

SEQ ID NO: 1799268 - DNA, 23 bp, Homo sapiens
catgagctccttaaggctctttt

SEQ ID NO: 1799269 - DNA, 23 bp, Homo sapiens
catgcactgttccccctgtgcag

SEQ ID NO: 1799270 - DNA, 15 bp, Homo sapiens
catgggcagagccca

SEQ ID NO: 1799271 - DNA, 17 bp, Homo sapiens
catgggcagagcccaag

SEQ ID NO: 1799272 - DNA, 19 bp, Homo sapiens
catggtcagccctagggtg

SEQ ID NO: 1799273 - DNA, 20 bp, Homo sapiens
catgtagaaaatttgttatt

SEQ ID NO: 1799274 - DNA, 23 bp, Homo sapiens
catgtgtgtccacgactgtctcc

SEQ ID NO: 1799275 - DNA, 20 bp, Homo sapiens
cattaaaatagcacatgatt

SEQ ID NO: 1799276 - DNA, 20 bp, Homo sapiens
cattatattcctctaaaact

SEQ ID NO: 1799277 - DNA, 23 bp, Homo sapiens
cattatttcaaccgcttgccata

SEQ ID NO: 1799278 - DNA, 19 bp, Homo sapiens
cattctctgtctcatccat

SEQ ID NO: 1799279 - DNA, 22 bp, Homo sapiens
cattgaattcttggttgaggaa

SEQ ID NO: 1799280 - DNA, 19 bp, Homo sapiens
cattgtccaatcctatgtt

SEQ ID NO: 1799281 - DNA, 18 bp, Homo sapiens
catttaaatacagtcttc

SEQ ID NO: 1799282 - DNA, 13 bp, Homo sapiens
catttgagtgtct

SEQ ID NO: 1799283 - DNA, 22 bp, Homo sapiens
cattttaaaagcaattatattg

SEQ ID NO: 1799284 - DNA, 23 bp, Homo sapiens
cattttaaaagcaattatattgt

SEQ ID NO: 1799285 - DNA, 18 bp, Homo sapiens
catttttcagatataaaa

SEQ ID NO: 1799286 - DNA, 20 bp, Homo sapiens
catttttcagatataaaaga

SEQ ID NO: 1799287 - DNA, 16 bp, Homo sapiens
catttttgtacattat

SEQ ID NO: 1799288 - DNA, 20 bp, Homo sapiens
agggcagtcgatagagctgt

SEQ ID NO: 1799289 - DNA, 17 bp, Homo sapiens
agggctaccctgagctg

SEQ ID NO: 1799290 - DNA, 22 bp, Homo sapiens
agggctaccctgagctgaggca

SEQ ID NO: 1799291 - DNA, 21 bp, Homo sapiens
agggtggggggggggcgcggc

SEQ ID NO: 1799292 - DNA, 16 bp, Homo sapiens
agggttgaccccagag

SEQ ID NO: 1799293 - DNA, 17 bp, Homo sapiens
agggttgaccccagagg

SEQ ID NO: 1799294 - DNA, 18 bp, Homo sapiens
agggttgaccccagagga

SEQ ID NO: 1799295 - DNA, 17 bp, Homo sapiens
aggtaactatcaatatt

SEQ ID NO: 1799296 - DNA, 20 bp, Homo sapiens
aggtaactatcaatatttaa

SEQ ID NO: 1799297 - DNA, 22 bp, Homo sapiens
aggtgcttctagttctgccagg

SEQ ID NO: 1799298 - DNA, 19 bp, Homo sapiens
aggtttttgtagtgatttt

SEQ ID NO: 1799299 - DNA, 13 bp, Homo sapiens
agtaggagcccag

SEQ ID NO: 1799300 - DNA, 16 bp, Homo sapiens
agtataggataaatta

SEQ ID NO: 1799301 - DNA, 15 bp, Homo sapiens
agtcaacctgcctga

SEQ ID NO: 1799302 - DNA, 15 bp, Homo sapiens
agtcaacctgggcaa

SEQ ID NO: 1799303 - DNA, 20 bp, Homo sapiens
agtcaagtgcgtccacgagc

SEQ ID NO: 1799304 - DNA, 12 bp, Homo sapiens
agtcaggaaagg

SEQ ID NO: 1799305 - DNA, 23 bp, Homo sapiens
agtcataccaatgaaaaaatgta

SEQ ID NO: 1799306 - DNA, 13 bp, Homo sapiens
agtccatcagcct

SEQ ID NO: 1799307 - DNA, 14 bp, Homo sapiens
agtccatcagcctc

SEQ ID NO: 1799308 - DNA, 13 bp, Homo sapiens
agtccctgcctgg

SEQ ID NO: 1799309 - DNA, 22 bp, Homo sapiens
agtccctgcctggaccagcctc

SEQ ID NO: 1799310 - DNA, 19 bp, Homo sapiens
agtcgatagagctgtatta

SEQ ID NO: 1799311 - DNA, 18 bp, Homo sapiens
agtctctatgatcttggc

SEQ ID NO: 1799312 - DNA, 19 bp, Homo sapiens
agtcttccatttgcaaggg

SEQ ID NO: 1799313 - DNA, 15 bp, Homo sapiens
agtgaaggcttctct

SEQ ID NO: 1799314 - DNA, 17 bp, Homo sapiens
agtgacctcacttctgg

SEQ ID NO: 1799315 - DNA, 22 bp, Homo sapiens
agtgacctgccctacatatcta

SEQ ID NO: 1799316 - DNA, 19 bp, Homo sapiens
agtgactgtagttacttaa

SEQ ID NO: 1799317 - DNA, 20 bp, Homo sapiens
agtgatttttatgccacctg

SEQ ID NO: 1799318 - DNA, 14 bp, Homo sapiens
agtgcaatgcgtgt

SEQ ID NO: 1799319 - DNA, 22 bp, Homo sapiens
agtgcagtcctgatcagagccg

SEQ ID NO: 1799320 - DNA, 17 bp, Homo sapiens
agtgctccctcacatgt

SEQ ID NO: 1799321 - DNA, 16 bp, Homo sapiens
agtgctctgatccctc

SEQ ID NO: 1799322 - DNA, 21 bp, Homo sapiens
agtgctctgatccctctacag

SEQ ID NO: 1799323 - DNA, 18 bp, Homo sapiens
agtggtatagaaatgctg

SEQ ID NO: 1799324 - DNA, 15 bp, Homo sapiens
agtgtacagtcttgt

SEQ ID NO: 1799325 - DNA, 13 bp, Homo sapiens
agtgtctttccac

SEQ ID NO: 1799326 - DNA, 21 bp, Homo sapiens
agtgttccccttccactgagg

SEQ ID NO: 1799327 - DNA, 19 bp, Homo sapiens
agttacacatttttcagat

SEQ ID NO: 1799328 - DNA, 20 bp, Homo sapiens
agttctgccaggagacaggt

SEQ ID NO: 1799329 - DNA, 23 bp, Homo sapiens
agttctgtactcaaatgtagcca

SEQ ID NO: 1799330 - DNA, 22 bp, Homo sapiens
agttcttagagcacttttaaca

SEQ ID NO: 1799331 - DNA, 21 bp, Homo sapiens
agttgttcgccgcgtggaatg

SEQ ID NO: 1799332 - DNA, 13 bp, Homo sapiens
agtttagggtggg

SEQ ID NO: 1799333 - DNA, 14 bp, Homo sapiens
agtttgattattca

SEQ ID NO: 1799334 - DNA, 18 bp, Homo sapiens
agtttgattattcagtgt

SEQ ID NO: 1799335 - DNA, 21 bp, Homo sapiens
ataaaagtacatgttaaactt

SEQ ID NO: 1799336 - DNA, 12 bp, Homo sapiens
ataaagtgaata

SEQ ID NO: 1799337 - DNA, 14 bp, Homo sapiens
ataaattacattaa

SEQ ID NO: 1799338 - DNA, 19 bp, Homo sapiens
ataaattttttttgtttca

SEQ ID NO: 1799339 - DNA, 22 bp, Homo sapiens
ataaattttttttgtttcatat

SEQ ID NO: 1799340 - DNA, 14 bp, Homo sapiens
ataacaattcctct

SEQ ID NO: 1799341 - DNA, 15 bp, Homo sapiens
ataacaattcctcta

SEQ ID NO: 1799342 - DNA, 18 bp, Homo sapiens
ataacttttttttaagtt

SEQ ID NO: 1799343 - DNA, 16 bp, Homo sapiens
ataagtatttcaaatt

SEQ ID NO: 1799344 - DNA, 18 bp, Homo sapiens
ataagtatttcaaattgg

SEQ ID NO: 1799345 - DNA, 14 bp, Homo sapiens
atacagaactcttt

SEQ ID NO: 1799346 - DNA, 18 bp, Homo sapiens
atacagaactctttcaaa

SEQ ID NO: 1799347 - DNA, 23 bp, Homo sapiens
atacagaactctttcaaaacctt

SEQ ID NO: 1799348 - DNA, 15 bp, Homo sapiens
atacagaggtaacta

SEQ ID NO: 1799349 - DNA, 19 bp, Homo sapiens
atacagtcttccatttgca

SEQ ID NO: 1799350 - DNA, 21 bp, Homo sapiens
ataccaatgaaaaaatgtata

SEQ ID NO: 1799351 - DNA, 22 bp, Homo sapiens
ataccagcgaggaggctccaga

SEQ ID NO: 1799352 - DNA, 19 bp, Homo sapiens
atagaaatgctggtttttc

SEQ ID NO: 1799353 - DNA, 22 bp, Homo sapiens
atagaaatgctggtttttcagt

SEQ ID NO: 1799354 - DNA, 20 bp, Homo sapiens
atagagatatttttgtacgt

SEQ ID NO: 1799355 - DNA, 13 bp, Homo sapiens
atagagcctgagg

SEQ ID NO: 1799356 - DNA, 15 bp, Homo sapiens
atagagcctgaggga

SEQ ID NO: 1799357 - DNA, 14 bp, Homo sapiens
atagagctgtatta

SEQ ID NO: 1799358 - DNA, 18 bp, Homo sapiens
atagcacatgattttctt

SEQ ID NO: 1799359 - DNA, 22 bp, Homo sapiens
atataaattttttttgtttcat

SEQ ID NO: 1799360 - DNA, 21 bp, Homo sapiens
atattaaagactaactaaaat

SEQ ID NO: 1799361 - DNA, 13 bp, Homo sapiens
atatttatttatg

SEQ ID NO: 1799362 - DNA, 22 bp, Homo sapiens
atcaccgtgggctccctgactg

SEQ ID NO: 1799363 - DNA, 21 bp, Homo sapiens
atcacgtaaagctagaaatga

SEQ ID NO: 1799364 - DNA, 13 bp, Homo sapiens
atcagctccttcc

SEQ ID NO: 1799365 - DNA, 14 bp, Homo sapiens
atcattctctgtct

SEQ ID NO: 1799366 - DNA, 16 bp, Homo sapiens
atcattctctgtctca

SEQ ID NO: 1799367 - DNA, 19 bp, Homo sapiens
atccaagatattttaaaat

SEQ ID NO: 1799368 - DNA, 19 bp, Homo sapiens
atccagagtccctgcctgg

SEQ ID NO: 1799369 - DNA, 21 bp, Homo sapiens
atccagagtccctgcctggac

SEQ ID NO: 1799370 - DNA, 14 bp, Homo sapiens
atccaggtaatcca

SEQ ID NO: 1799371 - DNA, 13 bp, Homo sapiens
atccctcatctgt

SEQ ID NO: 1799372 - DNA, 21 bp, Homo sapiens
atccctctacagagcttccct

SEQ ID NO: 1799373 - DNA, 23 bp, Homo sapiens
atccctctacagagcttccctga

SEQ ID NO: 1799374 - DNA, 22 bp, Homo sapiens
atccgagtgtttgccaggctta

SEQ ID NO: 1799375 - DNA, 14 bp, Homo sapiens
atcctaccccctgt

SEQ ID NO: 1799376 - DNA, 16 bp, Homo sapiens
atcctaccccctgtgc

SEQ ID NO: 1799377 - DNA, 21 bp, Homo sapiens
ccttacagtaggagcccagct

SEQ ID NO: 1799378 - DNA, 15 bp, Homo sapiens
ccttccactgagggc

SEQ ID NO: 1799379 - DNA, 17 bp, Homo sapiens
ccttccactgagggcag

SEQ ID NO: 1799380 - DNA, 13 bp, Homo sapiens
ccttcctcctggg

SEQ ID NO: 1799381 - DNA, 20 bp, Homo sapiens
ccttcctggagactgcccag

SEQ ID NO: 1799382 - DNA, 17 bp, Homo sapiens
ccttgggccctttgagt

SEQ ID NO: 1799383 - DNA, 12 bp, Homo sapiens
ccttgggctccc

SEQ ID NO: 1799384 - DNA, 13 bp, Homo sapiens
ccttgggctccct

SEQ ID NO: 1799385 - DNA, 15 bp, Homo sapiens
ccttgtcacgccaga

SEQ ID NO: 1799386 - DNA, 21 bp, Homo sapiens
cctttgattaaagactccagt

SEQ ID NO: 1799387 - DNA, 15 bp, Homo sapiens
cgcccacaaactgat

SEQ ID NO: 1799388 - DNA, 20 bp, Homo sapiens
cgcctgaggaacccttacag

SEQ ID NO: 1799389 - DNA, 13 bp, Homo sapiens
cggagccactcct

SEQ ID NO: 1799390 - DNA, 18 bp, Homo sapiens
cggagccactcctctgac

SEQ ID NO: 1799391 - DNA, 23 bp, Homo sapiens
cggctcctcgagatcccaacact

SEQ ID NO: 1799392 - DNA, 18 bp, Homo sapiens
cggctgggaggagggcag

SEQ ID NO: 1799393 - DNA, 13 bp, Homo sapiens
cgggacctggtgc

SEQ ID NO: 1799394 - DNA, 17 bp, Homo sapiens
cgggagcctgaccctca

SEQ ID NO: 1799395 - DNA, 16 bp, Homo sapiens
cgggagctcaggaacc

SEQ ID NO: 1799396 - DNA, 21 bp, Homo sapiens
cgggggcagtctgagagaggc

SEQ ID NO: 1799397 - DNA, 12 bp, Homo sapiens
cggggtgcagaa

SEQ ID NO: 1799398 - DNA, 16 bp, Homo sapiens
cggtgtgcaccagggt

SEQ ID NO: 1799399 - DNA, 12 bp, Homo sapiens
cgtagatttttg

SEQ ID NO: 1799400 - DNA, 16 bp, Homo sapiens
cgtgaatgtctcagcg

SEQ ID NO: 1799401 - DNA, 17 bp, Homo sapiens
cgtgagtgtgacttttt

SEQ ID NO: 1799402 - DNA, 23 bp, Homo sapiens
cgtggctgtggcatccagagtcc

SEQ ID NO: 1799403 - DNA, 17 bp, Homo sapiens
cgtgggctccctgactg

SEQ ID NO: 1799404 - DNA, 14 bp, Homo sapiens
cgtgtctggcacag

SEQ ID NO: 1799405 - DNA, 15 bp, Homo sapiens
cgttatatattgtat

SEQ ID NO: 1799406 - DNA, 15 bp, Homo sapiens
ctaacctcatcttct

SEQ ID NO: 1799407 - DNA, 19 bp, Homo sapiens
ctaacctgccgagagtcca

SEQ ID NO: 1799408 - DNA, 16 bp, Homo sapiens
ctacagagcttccctg

SEQ ID NO: 1799409 - DNA, 17 bp, Homo sapiens
ctacagagcttccctga

SEQ ID NO: 1799410 - DNA, 16 bp, Homo sapiens
ctagaaacttccaaat

SEQ ID NO: 1799411 - DNA, 21 bp, Homo sapiens
ctagtgaaggcttctctctgt

SEQ ID NO: 1799412 - DNA, 13 bp, Homo sapiens
ctagttctgccag

SEQ ID NO: 1799413 - DNA, 15 bp, Homo sapiens
ctatatgttgtaact

SEQ ID NO: 1799414 - DNA, 15 bp, Homo sapiens
ctatcaatatttaag

SEQ ID NO: 1799415 - DNA, 22 bp, Homo sapiens
ctatgtttttgttcaaagccag

SEQ ID NO: 1799416 - DNA, 21 bp, Homo sapiens
ctattacttgaactttccaaa

SEQ ID NO: 1799417 - DNA, 19 bp, Homo sapiens
ctattttaagacgtgaatg

SEQ ID NO: 1799418 - DNA, 11 bp, Homo sapiens
ctcacttctgg

SEQ ID NO: 1799419 - DNA, 16 bp, Homo sapiens
ctcagagggtgtcctg

SEQ ID NO: 1799420 - DNA, 14 bp, Homo sapiens
ctcagtctctgagc

SEQ ID NO: 1799421 - DNA, 13 bp, Homo sapiens
ctcatcattctct

SEQ ID NO: 1799422 - DNA, 14 bp, Homo sapiens
ctcatcattctctg

SEQ ID NO: 1799423 - DNA, 20 bp, Homo sapiens
ctcatcattctctgtctcat

SEQ ID NO: 1799424 - DNA, 22 bp, Homo sapiens
ctcatcattctctgtctcatcc

SEQ ID NO: 1799425 - DNA, 23 bp, Homo sapiens
ctcatcattctctgtctcatcca

SEQ ID NO: 1799426 - DNA, 13 bp, Homo sapiens
ctcatctgtccct

SEQ ID NO: 1799427 - DNA, 15 bp, Homo sapiens
ctcatctgtccctcc

SEQ ID NO: 1799428 - DNA, 17 bp, Homo sapiens
ctcatctgtccctccgg

SEQ ID NO: 1799429 - DNA, 16 bp, Homo sapiens
ctcatctttcttccaa

SEQ ID NO: 1799430 - DNA, 18 bp, Homo sapiens
ctcatgtgactctttcca

SEQ ID NO: 1799431 - DNA, 15 bp, Homo sapiens
ctccacgttctgctc

SEQ ID NO: 1799432 - DNA, 16 bp, Homo sapiens
ctccactcatgtgact

SEQ ID NO: 1799433 - DNA, 23 bp, Homo sapiens
ctccatcctaccccctgtgcctt

SEQ ID NO: 1799434 - DNA, 13 bp, Homo sapiens
ctccctcctctgc

SEQ ID NO: 1799435 - DNA, 22 bp, Homo sapiens
ctcctctgcccgggagctcagg

SEQ ID NO: 1799436 - DNA, 22 bp, Homo sapiens
ctcctctgtgaccaatgtcttg

SEQ ID NO: 1799437 - DNA, 18 bp, Homo sapiens
ctcctgccttcctcctgg

SEQ ID NO: 1799438 - DNA, 19 bp, Homo sapiens
ctcctgccttcctcctggg

SEQ ID NO: 1799439 - DNA, 16 bp, Homo sapiens
ctcctgtctccctcct

SEQ ID NO: 1799440 - DNA, 13 bp, Homo sapiens
ctccttaaggctc

SEQ ID NO: 1799441 - DNA, 13 bp, Homo sapiens
ctccttcctggag

SEQ ID NO: 1799442 - DNA, 17 bp, Homo sapiens
ctcgcccacaaactgat

SEQ ID NO: 1799443 - DNA, 15 bp, Homo sapiens
ctcgctggactctca

SEQ ID NO: 1799444 - DNA, 16 bp, Homo sapiens
ctcgctggactctcag

SEQ ID NO: 1799445 - DNA, 15 bp, Homo sapiens
ctctaaaactctcaa

SEQ ID NO: 1799446 - DNA, 17 bp, Homo sapiens
ctctcaggaccaaagct

SEQ ID NO: 1799447 - DNA, 15 bp, Homo sapiens
ctctcagtctctgag

SEQ ID NO: 1799448 - DNA, 19 bp, Homo sapiens
ctctccactcatgtgactc

SEQ ID NO: 1799449 - DNA, 22 bp, Homo sapiens
ctctccactcatgtgactcttt

SEQ ID NO: 1799450 - DNA, 15 bp, Homo sapiens
ctctcctgtctccct

SEQ ID NO: 1799451 - DNA, 14 bp, Homo sapiens
ctctctgctctgcg

SEQ ID NO: 1799452 - DNA, 22 bp, Homo sapiens
ctctctgctctgcgtgtcacct

SEQ ID NO: 1799453 - DNA, 17 bp, Homo sapiens
ctctgaaaccagtgtta

SEQ ID NO: 1799454 - DNA, 14 bp, Homo sapiens
ctctgactcagggc

SEQ ID NO: 1799455 - DNA, 15 bp, Homo sapiens
ctctgactcagggct

SEQ ID NO: 1799456 - DNA, 15 bp, Homo sapiens
ctctgagctgtgcag

SEQ ID NO: 1799457 - DNA, 21 bp, Homo sapiens
ctctgatccctctacagagct

SEQ ID NO: 1799458 - DNA, 22 bp, Homo sapiens
ctctgcgtgtcacctgtgcttc

SEQ ID NO: 1799459 - DNA, 14 bp, Homo sapiens
ctctgtctcatcca

SEQ ID NO: 1799460 - DNA, 13 bp, Homo sapiens
ctcttcagaggcc

SEQ ID NO: 1799461 - DNA, 21 bp, Homo sapiens
ctcttctgggagggcagcagg

SEQ ID NO: 1799462 - DNA, 21 bp, Homo sapiens
ctcttggggagtttagggtgg

SEQ ID NO: 1799463 - DNA, 12 bp, Homo sapiens
ctctttcaaaac

SEQ ID NO: 1799464 - DNA, 17 bp, Homo sapiens
ctgacactcccttgggc

SEQ ID NO: 1799465 - DNA, 20 bp, Homo sapiens
ctgacagccctgcggagacc

SEQ ID NO: 1799466 - DNA, 15 bp, Homo sapiens
ctgaccaatattgta

SEQ ID NO: 1799467 - DNA, 19 bp, Homo sapiens
ctgaccaatattgtacagt

SEQ ID NO: 1799468 - DNA, 20 bp, Homo sapiens
ctgaccaatattgtacagtt

SEQ ID NO: 1799469 - DNA, 14 bp, Homo sapiens
ctgactcagggctc

SEQ ID NO: 1799470 - DNA, 18 bp, Homo sapiens
ctgactcagggctcctgg

SEQ ID NO: 1799471 - DNA, 19 bp, Homo sapiens
ctgactcagggctcctggg

SEQ ID NO: 1799472 - DNA, 16 bp, Homo sapiens
ctgactcattctgaag

SEQ ID NO: 1799473 - DNA, 13 bp, Homo sapiens
ctgagagaggcca

SEQ ID NO: 1799474 - DNA, 14 bp, Homo sapiens
ctgagagaggccat

SEQ ID NO: 1799475 - DNA, 20 bp, Homo sapiens
ctgagcagtgaatgattcag

SEQ ID NO: 1799476 - DNA, 13 bp, Homo sapiens
ctgagctgaggca

SEQ ID NO: 1799477 - DNA, 12 bp, Homo sapiens
taaattacatta

SEQ ID NO: 1799478 - DNA, 13 bp, Homo sapiens
taaattacattaa

SEQ ID NO: 1799479 - DNA, 14 bp, Homo sapiens
taaattacattaaa

SEQ ID NO: 1799480 - DNA, 19 bp, Homo sapiens
taaattttttttgtttcat

SEQ ID NO: 1799481 - DNA, 13 bp, Homo sapiens
taacaattcctct

SEQ ID NO: 1799482 - DNA, 22 bp, Homo sapiens
taacatgtgttaagtattttca

SEQ ID NO: 1799483 - DNA, 14 bp, Homo sapiens
taacgtattttgat

SEQ ID NO: 1799484 - DNA, 18 bp, Homo sapiens
taactatcaatatttaag

SEQ ID NO: 1799485 - DNA, 18 bp, Homo sapiens
taacttcaaatatagaga

SEQ ID NO: 1799486 - DNA, 20 bp, Homo sapiens
taagacgtgaatgtctcagc

SEQ ID NO: 1799487 - DNA, 19 bp, Homo sapiens
taagccacttaaaatgttc

SEQ ID NO: 1799488 - DNA, 20 bp, Homo sapiens
taagccacttaaaatgttca

SEQ ID NO: 1799489 - DNA, 13 bp, Homo sapiens
taagggcatttta

SEQ ID NO: 1799490 - DNA, 17 bp, Homo sapiens
taataaaagtacatgtt

SEQ ID NO: 1799491 - DNA, 21 bp, Homo sapiens
taatccgaatctctttttgct

SEQ ID NO: 1799492 - DNA, 21 bp, Homo sapiens
taatgtgaaaatggtccagga

SEQ ID NO: 1799493 - DNA, 15 bp, Homo sapiens
tacacccttttccag

SEQ ID NO: 1799494 - DNA, 17 bp, Homo sapiens
tacagaactctttcaaa

SEQ ID NO: 1799495 - DNA, 14 bp, Homo sapiens
tacagtaggagccc

SEQ ID NO: 1799496 - DNA, 18 bp, Homo sapiens
tacagtaggagcccagct

SEQ ID NO: 1799497 - DNA, 22 bp, Homo sapiens
tacagtcttccatttgcaaggg

SEQ ID NO: 1799498 - DNA, 13 bp, Homo sapiens
tacatacagaggt

SEQ ID NO: 1799499 - DNA, 16 bp, Homo sapiens
tacattatattcctct

SEQ ID NO: 1799500 - DNA, 22 bp, Homo sapiens
tacattatattcctctaaaact

SEQ ID NO: 1799501 - DNA, 22 bp, Homo sapiens
tacattatgttattggaatttt

SEQ ID NO: 1799502 - DNA, 15 bp, Homo sapiens
taccagcgaggaggc

SEQ ID NO: 1799503 - DNA, 20 bp, Homo sapiens
taccagcgaggaggctccag

SEQ ID NO: 1799504 - DNA, 15 bp, Homo sapiens
taccccctgtgcctt

SEQ ID NO: 1799505 - DNA, 20 bp, Homo sapiens
tacctgaaaacactgtgcac

SEQ ID NO: 1799506 - DNA, 13 bp, Homo sapiens
taccttggttccc

SEQ ID NO: 1799507 - DNA, 22 bp, Homo sapiens
tacgcagcgtgctttaaaaaat

SEQ ID NO: 1799508 - DNA, 21 bp, Homo sapiens
tactagggatccctcatctgt

SEQ ID NO: 1799509 - DNA, 17 bp, Homo sapiens
tactgtattttgtattg

SEQ ID NO: 1799510 - DNA, 17 bp, Homo sapiens
tacttgaactttccaaa

SEQ ID NO: 1799511 - DNA, 15 bp, Homo sapiens
tacttttgccctttg

SEQ ID NO: 1799512 - DNA, 16 bp, Homo sapiens
tacttttggcatgaaa

SEQ ID NO: 1799513 - DNA, 17 bp, Homo sapiens
tagagattacctcctga

SEQ ID NO: 1799514 - DNA, 21 bp, Homo sapiens
tagagattacctcctgagaaa

SEQ ID NO: 1799515 - DNA, 15 bp, Homo sapiens
tagagtgtctttcca

SEQ ID NO: 1799516 - DNA, 17 bp, Homo sapiens
tagcacatgattttctt

SEQ ID NO: 1799517 - DNA, 18 bp, Homo sapiens
tagcacatgattttcttt

SEQ ID NO: 1799518 - DNA, 16 bp, Homo sapiens
taggaagtaaattata

SEQ ID NO: 1799519 - DNA, 17 bp, Homo sapiens
taggataaattacatta

SEQ ID NO: 1799520 - DNA, 14 bp, Homo sapiens
taggcaggacctgt

SEQ ID NO: 1799521 - DNA, 17 bp, Homo sapiens
tagggatccctcatctg

SEQ ID NO: 1799522 - DNA, 16 bp, Homo sapiens
tagggccaagcccagc

SEQ ID NO: 1799523 - DNA, 21 bp, Homo sapiens
tagtgaatcacgtaaagctag

SEQ ID NO: 1799524 - DNA, 14 bp, Homo sapiens
tagttctgccagga

SEQ ID NO: 1799525 - DNA, 10 bp, Homo sapiens
tagtttttgt

SEQ ID NO: 1799526 - DNA, 17 bp, Homo sapiens
tataaattttttttgtt

SEQ ID NO: 1799527 - DNA, 19 bp, Homo sapiens
tatagagatatttttgtac

SEQ ID NO: 1799528 - DNA, 19 bp, Homo sapiens
tataggataaattacatta

SEQ ID NO: 1799529 - DNA, 13 bp, Homo sapiens
tatagtgatgtaa

SEQ ID NO: 1799530 - DNA, 13 bp, Homo sapiens
tatagttttgaca

SEQ ID NO: 1799531 - DNA, 16 bp, Homo sapiens
tatatattgtattaag

SEQ ID NO: 1799532 - DNA, 21 bp, Homo sapiens
tatatgcacttataattttcc

SEQ ID NO: 1799533 - DNA, 22 bp, Homo sapiens
tatattgtcctcccctatttta

SEQ ID NO: 1799534 - DNA, 19 bp, Homo sapiens
tatcaccgtgggctccctg

SEQ ID NO: 1799535 - DNA, 23 bp, Homo sapiens
tatgttattggaattttctttca

SEQ ID NO: 1799536 - DNA, 15 bp, Homo sapiens
tattaagggcatttt

SEQ ID NO: 1799537 - DNA, 14 bp, Homo sapiens
tattacttgaactt

SEQ ID NO: 1799538 - DNA, 12 bp, Homo sapiens
tattggaatttt

SEQ ID NO: 1799539 - DNA, 13 bp, Homo sapiens
tattggaattttc

SEQ ID NO: 1799540 - DNA, 16 bp, Homo sapiens
tattgtattaagggca

SEQ ID NO: 1799541 - DNA, 12 bp, Homo sapiens
tattgtttcaat

SEQ ID NO: 1799542 - DNA, 22 bp, Homo sapiens
tatttaagtttgttgctgtcaa

SEQ ID NO: 1799543 - DNA, 18 bp, Homo sapiens
tatttcaaattggagctt

SEQ ID NO: 1799544 - DNA, 16 bp, Homo sapiens
tatttttgtacgttat

SEQ ID NO: 1799545 - DNA, 17 bp, Homo sapiens
tcaaccgcttgccatat

SEQ ID NO: 1799546 - DNA, 17 bp, Homo sapiens
tcaacctgggcaaagcc

SEQ ID NO: 1799547 - DNA, 18 bp, Homo sapiens
tcaagattttttttgtaa

SEQ ID NO: 1799548 - DNA, 19 bp, Homo sapiens
tcaagattttttttgtaac

SEQ ID NO: 1799549 - DNA, 15 bp, Homo sapiens
tcaatccagctatgt

SEQ ID NO: 1799550 - DNA, 21 bp, Homo sapiens
tcacatgtcagtaccttcaaa

SEQ ID NO: 1799551 - DNA, 22 bp, Homo sapiens
tcaccatttgattatgtagcaa

SEQ ID NO: 1799552 - DNA, 13 bp, Homo sapiens
tcacccccttctc

SEQ ID NO: 1799553 - DNA, 13 bp, Homo sapiens
tcaccgtgggctc

SEQ ID NO: 1799554 - DNA, 19 bp, Homo sapiens
tcaccgtgggctccctgac

SEQ ID NO: 1799555 - DNA, 20 bp, Homo sapiens
tcacctgtgcttcgggccct

SEQ ID NO: 1799556 - DNA, 20 bp, Homo sapiens
tcactggcgacacgtagcag

SEQ ID NO: 1799557 - DNA, 18 bp, Homo sapiens
tcacttttgacaaaggca

SEQ ID NO: 1799558 - DNA, 16 bp, Homo sapiens
tcagagccgtggtcct

SEQ ID NO: 1799559 - DNA, 17 bp, Homo sapiens
tcagatataaaagactg

SEQ ID NO: 1799560 - DNA, 18 bp, Homo sapiens
tcagatataaaagactga

SEQ ID NO: 1799561 - DNA, 22 bp, Homo sapiens
tcagcacctacagtgtacagtc

SEQ ID NO: 1799562 - DNA, 23 bp, Homo sapiens
tcagcctccatcctaccccctgt

SEQ ID NO: 1799563 - DNA, 15 bp, Homo sapiens
tcagtctctgagcag

SEQ ID NO: 1799564 - DNA, 13 bp, Homo sapiens
tcagtgctccctc

SEQ ID NO: 1799565 - DNA, 21 bp, Homo sapiens
tcagtgttaaatgtgatgaat

SEQ ID NO: 1799566 - DNA, 15 bp, Homo sapiens
tcataagtatttcaa

SEQ ID NO: 1799567 - DNA, 22 bp, Homo sapiens
tcataatttcagttctagttga

SEQ ID NO: 1799568 - DNA, 12 bp, Homo sapiens
tcatacattata

SEQ ID NO: 1799569 - DNA, 15 bp, Homo sapiens
tcatctcctgccttc

SEQ ID NO: 1799570 - DNA, 21 bp, Homo sapiens
tcatctcctgccttcctcctg

SEQ ID NO: 1799571 - DNA, 17 bp, Homo sapiens
tcatctttcttccaaac

SEQ ID NO: 1799572 - DNA, 19 bp, Homo sapiens
tcatgtgactctttccaac

SEQ ID NO: 1799573 - DNA, 21 bp, Homo sapiens
tcatttctatttctcctccat

SEQ ID NO: 1799574 - DNA, 21 bp, Homo sapiens
tccaaccggctttgtggcact

SEQ ID NO: 1799575 - DNA, 18 bp, Homo sapiens
tccaagatattttaaaat

SEQ ID NO: 1799576 - DNA, 19 bp, Homo sapiens
tccacatcctccacgttct

SEQ ID NO: 1799577 - DNA, 19 bp, Homo sapiens
tccacgactgtctccatgg

SEQ ID NO: 1799578 - DNA, 14 bp, Homo sapiens
tccacggagccact

SEQ ID NO: 1799579 - DNA, 20 bp, Homo sapiens
tccacggagccactcctctg

SEQ ID NO: 1799580 - DNA, 14 bp, Homo sapiens
tccactcatgtgac

SEQ ID NO: 1799581 - DNA, 21 bp, Homo sapiens
tccactcatgtgactctttcc

SEQ ID NO: 1799582 - DNA, 21 bp, Homo sapiens
tccagttaaaaaaaattttaa

SEQ ID NO: 1799583 - DNA, 13 bp, Homo sapiens
tgggccctttgag

SEQ ID NO: 1799584 - DNA, 11 bp, Homo sapiens
tgggctccctg

SEQ ID NO: 1799585 - DNA, 15 bp, Homo sapiens
tgggctccctgactg

SEQ ID NO: 1799586 - DNA, 12 bp, Homo sapiens
tgggctgaggga

SEQ ID NO: 1799587 - DNA, 16 bp, Homo sapiens
tggggcaggggccggg

SEQ ID NO: 1799588 - DNA, 13 bp, Homo sapiens
tggtatagaaatg

SEQ ID NO: 1799589 - DNA, 16 bp, Homo sapiens
tggtccaggagaaggc

SEQ ID NO: 1799590 - DNA, 20 bp, Homo sapiens
tggtgttcataatttcagtt

SEQ ID NO: 1799591 - DNA, 14 bp, Homo sapiens
tgtaaactgtgcac

SEQ ID NO: 1799592 - DNA, 18 bp, Homo sapiens
tgtacctgcccccaatcc

SEQ ID NO: 1799593 - DNA, 17 bp, Homo sapiens
tgtacgttatatattgt

SEQ ID NO: 1799594 - DNA, 16 bp, Homo sapiens
tgtacttttgtgttac

SEQ ID NO: 1799595 - DNA, 23 bp, Homo sapiens
tgtagaaaagggaactgaacatt

SEQ ID NO: 1799596 - DNA, 22 bp, Homo sapiens
tgtagtgaatcacgtaaagcta

SEQ ID NO: 1799597 - DNA, 14 bp, Homo sapiens
tgtattaagccact

SEQ ID NO: 1799598 - DNA, 14 bp, Homo sapiens
tgtattctctgagc

SEQ ID NO: 1799599 - DNA, 20 bp, Homo sapiens
tgtattctctgagctgtgca

SEQ ID NO: 1799600 - DNA, 14 bp, Homo sapiens
tgtcacgccagact

SEQ ID NO: 1799601 - DNA, 14 bp, Homo sapiens
tgtccattgtccaa

SEQ ID NO: 1799602 - DNA, 16 bp, Homo sapiens
tgtcccttaaacaaaa

SEQ ID NO: 1799603 - DNA, 21 bp, Homo sapiens
tgtctcatccatcatcatgtg

SEQ ID NO: 1799604 - DNA, 22 bp, Homo sapiens
tgtcttgatgcatgcactgttc

SEQ ID NO: 1799605 - DNA, 18 bp, Homo sapiens
tgtgaaaatggtccagga

SEQ ID NO: 1799606 - DNA, 16 bp, Homo sapiens
tgtgaccaatgtcttg

SEQ ID NO: 1799607 - DNA, 17 bp, Homo sapiens
tgtgactctttccaacc

SEQ ID NO: 1799608 - DNA, 15 bp, Homo sapiens
tgtgaggccagggca

SEQ ID NO: 1799609 - DNA, 17 bp, Homo sapiens
tgtgaggccagggcaga

SEQ ID NO: 1799610 - DNA, 13 bp, Homo sapiens
tgtgatcgtctga

SEQ ID NO: 1799611 - DNA, 16 bp, Homo sapiens
tgtgatgaatactgta

SEQ ID NO: 1799612 - DNA, 17 bp, Homo sapiens
tgtgcacatctgtgtct

SEQ ID NO: 1799613 - DNA, 16 bp, Homo sapiens
tgtgcaggtggggaga

SEQ ID NO: 1799614 - DNA, 17 bp, Homo sapiens
tgtgccttgtcacgcca

SEQ ID NO: 1799615 - DNA, 19 bp, Homo sapiens
tgtgcttcgggcccttccc

SEQ ID NO: 1799616 - DNA, 19 bp, Homo sapiens
tgtggcactggggcagggg

SEQ ID NO: 1799617 - DNA, 16 bp, Homo sapiens
tgtggcatccagagtc

SEQ ID NO: 1799618 - DNA, 18 bp, Homo sapiens
tgtggccaagttcttagt

SEQ ID NO: 1799619 - DNA, 20 bp, Homo sapiens
tgtgtagggcttttttttga

SEQ ID NO: 1799620 - DNA, 16 bp, Homo sapiens
tgtgtccccctctgtc

SEQ ID NO: 1799621 - DNA, 18 bp, Homo sapiens
tgtgtccccctctgtcca

SEQ ID NO: 1799622 - DNA, 23 bp, Homo sapiens
tgtgttacctgaaaacactgtgc

SEQ ID NO: 1799623 - DNA, 13 bp, Homo sapiens
tgttaataaaagt

SEQ ID NO: 1799624 - DNA, 23 bp, Homo sapiens
tgttacctgaaaacactgtgcac

SEQ ID NO: 1799625 - DNA, 16 bp, Homo sapiens
tgttattggaattttc

SEQ ID NO: 1799626 - DNA, 23 bp, Homo sapiens
tgttattggaattttctttcata

SEQ ID NO: 1799627 - DNA, 21 bp, Homo sapiens
tgttcaaagccagcgtcctcc

SEQ ID NO: 1799628 - DNA, 22 bp, Homo sapiens
tgttcaaagccagcgtcctcct

SEQ ID NO: 1799629 - DNA, 23 bp, Homo sapiens
tgttcttgaatttaataatctgt

SEQ ID NO: 1799630 - DNA, 17 bp, Homo sapiens
tgttggatttttgtctt

SEQ ID NO: 1799631 - DNA, 22 bp, Homo sapiens
tgttgtacatacagaggtaact

SEQ ID NO: 1799632 - DNA, 16 bp, Homo sapiens
tgtttcaattgcatct

SEQ ID NO: 1799633 - DNA, 20 bp, Homo sapiens
tgtttcatattgatgtgtgt

SEQ ID NO: 1799634 - DNA, 14 bp, Homo sapiens
tgtttgtgctgtgg

SEQ ID NO: 1799635 - DNA, 15 bp, Homo sapiens
tgtttgtgctgtggt

SEQ ID NO: 1799636 - DNA, 15 bp, Homo sapiens
ttaaaactatattta

SEQ ID NO: 1799637 - DNA, 18 bp, Homo sapiens
ttaaaatagcacatgatt

SEQ ID NO: 1799638 - DNA, 12 bp, Homo sapiens
ttaaaatcctca

SEQ ID NO: 1799639 - DNA, 22 bp, Homo sapiens
ttaacaaaaaaggaaaatgaac

SEQ ID NO: 1799640 - DNA, 18 bp, Homo sapiens
ttaacctgaattattcca

SEQ ID NO: 1799641 - DNA, 15 bp, Homo sapiens
ttaactgtgcagtga

SEQ ID NO: 1799642 - DNA, 15 bp, Homo sapiens
ttaagacgtgaatgt

SEQ ID NO: 1799643 - DNA, 20 bp, Homo sapiens
ttaagacgtgaatgtctcag

SEQ ID NO: 1799644 - DNA, 14 bp, Homo sapiens
ttaaggcagtgact

SEQ ID NO: 1799645 - DNA, 13 bp, Homo sapiens
ttaatatattaag

SEQ ID NO: 1799646 - DNA, 23 bp, Homo sapiens
ttaatgaagaaagtggaaaacaa

SEQ ID NO: 1799647 - DNA, 15 bp, Homo sapiens
ttaattttctatgaa

SEQ ID NO: 1799648 - DNA, 17 bp, Homo sapiens
ttacagtaggagcccag

SEQ ID NO: 1799649 - DNA, 19 bp, Homo sapiens
ttacatctttgtttaccat

SEQ ID NO: 1799650 - DNA, 16 bp, Homo sapiens
ttactagggatccctc

SEQ ID NO: 1799651 - DNA, 15 bp, Homo sapiens
ttacttgaactttcc

SEQ ID NO: 1799652 - DNA, 17 bp, Homo sapiens
ttacttgaactttccaa

SEQ ID NO: 1799653 - DNA, 18 bp, Homo sapiens
ttacttgaactttccaaa

SEQ ID NO: 1799654 - DNA, 18 bp, Homo sapiens
ttagactaaggccattat

SEQ ID NO: 1799655 - DNA, 17 bp, Homo sapiens
ttagagtgtctttccac

SEQ ID NO: 1799656 - DNA, 13 bp, Homo sapiens
ttagatgttctaa

SEQ ID NO: 1799657 - DNA, 14 bp, Homo sapiens
ttagccttgctcag

SEQ ID NO: 1799658 - DNA, 23 bp, Homo sapiens
ttagtaacatgtgttaagtattt

SEQ ID NO: 1799659 - DNA, 11 bp, Homo sapiens
ttatatattgt

SEQ ID NO: 1799660 - DNA, 18 bp, Homo sapiens
ttatatattgtattaagg

SEQ ID NO: 1799661 - DNA, 21 bp, Homo sapiens
ttatattcctctaaaactctc

SEQ ID NO: 1799662 - DNA, 13 bp, Homo sapiens
ttatgccacctga

SEQ ID NO: 1799663 - DNA, 14 bp, Homo sapiens
ttattggaattttc

SEQ ID NO: 1799664 - DNA, 12 bp, Homo sapiens
ttattttgcaac

SEQ ID NO: 1799665 - DNA, 17 bp, Homo sapiens
ttcaaaaccttttgaaa

SEQ ID NO: 1799666 - DNA, 18 bp, Homo sapiens
ttcaaccgcttgccatat

SEQ ID NO: 1799667 - DNA, 17 bp, Homo sapiens
ttcaattgcatctccca

SEQ ID NO: 1799668 - DNA, 18 bp, Homo sapiens
ttcacatctaacctcatc

SEQ ID NO: 1799669 - DNA, 20 bp, Homo sapiens
ttcacttttgacaaaggcaa

SEQ ID NO: 1799670 - DNA, 22 bp, Homo sapiens
ttcagaggccctcgctgccagc

SEQ ID NO: 1799671 - DNA, 23 bp, Homo sapiens
ttcagaggccctcgctgccagct

SEQ ID NO: 1799672 - DNA, 14 bp, Homo sapiens
ttcagatataaaag

SEQ ID NO: 1799673 - DNA, 19 bp, Homo sapiens
ttcagatataaaagactga

SEQ ID NO: 1799674 - DNA, 22 bp, Homo sapiens
ttcagatataaaagactgacca

SEQ ID NO: 1799675 - DNA, 23 bp, Homo sapiens
ttcagcacctacagtgtacagtc

SEQ ID NO: 1799676 - DNA, 14 bp, Homo sapiens
ttcagtggggcagt

SEQ ID NO: 1799677 - DNA, 12 bp, Homo sapiens
ttcagtgttaaa

SEQ ID NO: 1799678 - DNA, 12 bp, Homo sapiens
ttcatacattat

SEQ ID NO: 1799679 - DNA, 14 bp, Homo sapiens
ttcatgtaaactgt

SEQ ID NO: 1799680 - DNA, 17 bp, Homo sapiens
ttcatgtaaactgtgca

SEQ ID NO: 1799681 - DNA, 21 bp, Homo sapiens
ttccacggagccactcctctg

SEQ ID NO: 1799682 - DNA, 15 bp, Homo sapiens
ttccactgagggcag

SEQ ID NO: 1799683 - DNA, 16 bp, Homo sapiens
ttccactgagggcagt

SEQ ID NO: 1799684 - DNA, 16 bp, Homo sapiens
ttccattggatctcat

SEQ ID NO: 1799685 - DNA, 17 bp, Homo sapiens
ttccatttgcaagggaa

SEQ ID NO: 1799686 - DNA, 14 bp, Homo sapiens
ttcccaattcacat

SEQ ID NO: 1799687 - DNA, 15 bp, Homo sapiens
ttccccttccactga

SEQ ID NO: 1799688 - DNA, 21 bp, Homo sapiens
ttccccttccactgagggcag

SEQ ID NO: 1799689 - DNA, 14 bp, Homo sapiens
tgaaaatgtcttgt

SEQ ID NO: 1799690 - DNA, 16 bp, Homo sapiens
tgaaaatgtcttgtgt

SEQ ID NO: 1799691 - DNA, 21 bp, Homo sapiens
tgaagattctttcccaattca

SEQ ID NO: 1799692 - DNA, 23 bp, Homo sapiens
tgaatcacgtaaagctagaaatg

SEQ ID NO: 1799693 - DNA, 17 bp, Homo sapiens
tgaattgctaattctga

SEQ ID NO: 1799694 - DNA, 18 bp, Homo sapiens
tgaattgctaattctgag

SEQ ID NO: 1799695 - DNA, 19 bp, Homo sapiens
tgaattgtaactgttcttg

SEQ ID NO: 1799696 - DNA, 19 bp, Homo sapiens
tgaatttaataatctgtag

SEQ ID NO: 1799697 - DNA, 19 bp, Homo sapiens
tgacaacatttttgtacat

SEQ ID NO: 1799698 - DNA, 23 bp, Homo sapiens
tgacaacatttttgtacattatg

SEQ ID NO: 1799699 - DNA, 14 bp, Homo sapiens
tgacactcccttgg

SEQ ID NO: 1799700 - DNA, 12 bp, Homo sapiens
ttctgccaggag

SEQ ID NO: 1799701 - DNA, 13 bp, Homo sapiens
ttctgctcatcat

SEQ ID NO: 1799702 - DNA, 19 bp, Homo sapiens
ttctgctcatcattctctg

SEQ ID NO: 1799703 - DNA, 14 bp, Homo sapiens
ttctgggagggcag

SEQ ID NO: 1799704 - DNA, 18 bp, Homo sapiens
ttctgtactcaaatgtag

SEQ ID NO: 1799705 - DNA, 21 bp, Homo sapiens
ttcttaagacgtgattttgct

SEQ ID NO: 1799706 - DNA, 21 bp, Homo sapiens
ttcttgaatttaataatctgt

SEQ ID NO: 1799707 - DNA, 17 bp, Homo sapiens
ttctttcatacattata

SEQ ID NO: 1799708 - DNA, 21 bp, Homo sapiens
ttgaattcttggttgaggaaa

SEQ ID NO: 1799709 - DNA, 23 bp, Homo sapiens
ttgaggaaaacaagcattcacaa

SEQ ID NO: 1799710 - DNA, 14 bp, Homo sapiens
ttgagtctgtgcca

SEQ ID NO: 1799711 - DNA, 14 bp, Homo sapiens
ttgagtgctctgat

SEQ ID NO: 1799712 - DNA, 14 bp, Homo sapiens
ttgagttttcagtg

SEQ ID NO: 1799713 - DNA, 19 bp, Homo sapiens
ttgatcgcctttcccaggt

SEQ ID NO: 1799714 - DNA, 18 bp, Homo sapiens
ttgatgactatatataaa

SEQ ID NO: 1799715 - DNA, 14 bp, Homo sapiens
ttgcaacctcgctg

SEQ ID NO: 1799716 - DNA, 19 bp, Homo sapiens
ttgcaagggaaaagtctct

SEQ ID NO: 1799717 - DNA, 22 bp, Homo sapiens
ttgcaagggaaaagtctcttgt

SEQ ID NO: 1799718 - DNA, 19 bp, Homo sapiens
ttgcataacaattcctcta

SEQ ID NO: 1799719 - DNA, 20 bp, Homo sapiens
ttgcatctcccagataatgt

SEQ ID NO: 1799720 - DNA, 20 bp, Homo sapiens
ttgctgccccatcagtgctc

SEQ ID NO: 1799721 - DNA, 23 bp, Homo sapiens
ttggaatattgtccattgtccaa

SEQ ID NO: 1799722 - DNA, 14 bp, Homo sapiens
ttggaattttcttt

SEQ ID NO: 1799723 - DNA, 22 bp, Homo sapiens
ttggaattttctttcatacatt

SEQ ID NO: 1799724 - DNA, 23 bp, Homo sapiens
ttggaattttctttcatacatta

SEQ ID NO: 1799725 - DNA, 16 bp, Homo sapiens
ttggacccttccatgg

SEQ ID NO: 1799726 - DNA, 13 bp, Homo sapiens
ttggactacttgt

SEQ ID NO: 1799727 - DNA, 22 bp, Homo sapiens
ttggagtgttccccttccactg

SEQ ID NO: 1799728 - DNA, 18 bp, Homo sapiens
ttggatttttgtcttgtg

SEQ ID NO: 1799729 - DNA, 20 bp, Homo sapiens
ttgggtcaagaagtgatctt

SEQ ID NO: 1799730 - DNA, 12 bp, Homo sapiens
ttgtacagtttt

SEQ ID NO: 1799731 - DNA, 17 bp, Homo sapiens
ttgtacattatgttatt

SEQ ID NO: 1799732 - DNA, 16 bp, Homo sapiens
ttgtacgttatatatt

SEQ ID NO: 1799733 - DNA, 16 bp, Homo sapiens
ttgtattgtttcaatt

SEQ ID NO: 1799734 - DNA, 19 bp, Homo sapiens
ttgtgtttctttagttttt

SEQ ID NO: 1799735 - DNA, 14 bp, Homo sapiens
ttgttaataaaagt

SEQ ID NO: 1799736 - DNA, 14 bp, Homo sapiens
tttaaaagtccact

SEQ ID NO: 1799737 - DNA, 14 bp, Homo sapiens
tttaacaaaaaagg

SEQ ID NO: 1799738 - DNA, 18 bp, Homo sapiens
tttactagggatccctca

SEQ ID NO: 1799739 - DNA, 20 bp, Homo sapiens
tttatatgtacatacatata

SEQ ID NO: 1799740 - DNA, 13 bp, Homo sapiens
tttattgcttgtt

SEQ ID NO: 1799741 - DNA, 18 bp, Homo sapiens
tttcaaaaccttttgaaa

SEQ ID NO: 1799742 - DNA, 18 bp, Homo sapiens
tttcaattgcatctccca

SEQ ID NO: 1799743 - DNA, 18 bp, Homo sapiens
tttcagatataaaagact

SEQ ID NO: 1799744 - DNA, 15 bp, Homo sapiens
tttcagttttcagga

SEQ ID NO: 1799745 - DNA, 21 bp, Homo sapiens
tttcatacattatattcctct

SEQ ID NO: 1799746 - DNA, 19 bp, Homo sapiens
tttccaaccggctttgtgg

SEQ ID NO: 1799747 - DNA, 13 bp, Homo sapiens
tttgagtgctctg

SEQ ID NO: 1799748 - DNA, 21 bp, Homo sapiens
tttgcaagggaaaagtctctt

SEQ ID NO: 1799749 - DNA, 12 bp, Homo sapiens
tttgccctttga

SEQ ID NO: 1799750 - DNA, 17 bp, Homo sapiens
tttggcaatgccatcat

SEQ ID NO: 1799751 - DNA, 11 bp, Homo sapiens
tttgtaacttc

SEQ ID NO: 1799752 - DNA, 13 bp, Homo sapiens
tttgtaacttcaa

SEQ ID NO: 1799753 - DNA, 14 bp, Homo sapiens
tttgtaacttcaaa

SEQ ID NO: 1799754 - DNA, 15 bp, Homo sapiens
tttgtaacttcaaat

SEQ ID NO: 1799755 - DNA, 18 bp, Homo sapiens
tttgtacattatgttatt

SEQ ID NO: 1799756 - DNA, 19 bp, Homo sapiens
tttgtacgttatatattgt

SEQ ID NO: 1799757 - DNA, 22 bp, Homo sapiens
tttgtagtgatttttatgccac

SEQ ID NO: 1799758 - DNA, 16 bp, Homo sapiens
tttgtattctctgagc

SEQ ID NO: 1799759 - DNA, 12 bp, Homo sapiens
tttgttttgcac

SEQ ID NO: 1799760 - DNA, 21 bp, Homo sapiens
ttttaagttacacatttttca

SEQ ID NO: 1799761 - DNA, 17 bp, Homo sapiens
ttttcagatataaaaga

SEQ ID NO: 1799762 - DNA, 21 bp, Homo sapiens
ttttcagatataaaagactga

SEQ ID NO: 1799763 - DNA, 17 bp, Homo sapiens
ttttgaaattaacctct

SEQ ID NO: 1799764 - DNA, 23 bp, Homo sapiens
ttttgacagagttggtgttcata

SEQ ID NO: 1799765 - DNA, 17 bp, Homo sapiens
ttttgcaacctcgctgg

SEQ ID NO: 1799766 - DNA, 13 bp, Homo sapiens
ttttgccctttga

SEQ ID NO: 1799767 - DNA, 14 bp, Homo sapiens
ttttgctgtagaag

SEQ ID NO: 1799768 - DNA, 17 bp, Homo sapiens
ttttgtattctctgagc

SEQ ID NO: 1799769 - DNA, 21 bp, Homo sapiens
ttttgtgaagtttaattgact

SEQ ID NO: 1799770 - DNA, 14 bp, Homo sapiens
tttttgtacattat

SEQ ID NO: 1799771 - DNA, 11 bp, Homo sapiens
ttttttgtaac

SEQ ID NO: 1799772 - DNA, 12 bp, Homo sapiens
ttttttgtttca

SEQ ID NO: 1799773 - DNA, 15 bp, Homo sapiens
aaaaagggaggggga

SEQ ID NO: 1799774 - DNA, 12 bp, Homo sapiens
aaaaggaaaatg

SEQ ID NO: 1799775 - DNA, 18 bp, Homo sapiens
aaaagggaactgaacatt

SEQ ID NO: 1799776 - DNA, 18 bp, Homo sapiens
aaaagttggagttatatt

SEQ ID NO: 1799777 - DNA, 20 bp, Homo sapiens
aaaatctgtcacgtagaact

SEQ ID NO: 1799778 - DNA, 22 bp, Homo sapiens
aaacaacaatttctactttgaa

SEQ ID NO: 1799779 - DNA, 13 bp, Homo sapiens
aaacactgtgcac

SEQ ID NO: 1799780 - DNA, 23 bp, Homo sapiens
aaactatatttatttatgtagga

SEQ ID NO: 1799781 - DNA, 13 bp, Homo sapiens
aaactgagaaatg

SEQ ID NO: 1799782 - DNA, 12 bp, Homo sapiens
aaactgtgcacc

SEQ ID NO: 1799783 - DNA, 15 bp, Homo sapiens
aaagcaattatattg

SEQ ID NO: 1799784 - DNA, 14 bp, Homo sapiens
aaagctagaaatga

SEQ ID NO: 1799785 - DNA, 17 bp, Homo sapiens
aaaggaatcatttctat

SEQ ID NO: 1799786 - DNA, 16 bp, Homo sapiens
aaagggaactgaacat

SEQ ID NO: 1799787 - DNA, 15 bp, Homo sapiens
aaagtgcaatgcgtg

SEQ ID NO: 1799788 - DNA, 19 bp, Homo sapiens
aaataaccaatcctggaca

SEQ ID NO: 1799789 - DNA, 20 bp, Homo sapiens
aaatatagagatatttttgt

SEQ ID NO: 1799790 - DNA, 18 bp, Homo sapiens
aaatattccctagaaact

SEQ ID NO: 1799791 - DNA, 19 bp, Homo sapiens
aaatattccctagaaactt

SEQ ID NO: 1799792 - DNA, 16 bp, Homo sapiens
aaatcagttatgtcaa

SEQ ID NO: 1799793 - DNA, 15 bp, Homo sapiens
aaatgaaaatgtctt

SEQ ID NO: 1799794 - DNA, 22 bp, Homo sapiens
aaatgctggtttttcagttttc

SEQ ID NO: 1799795 - DNA, 14 bp, Homo sapiens
aaatgtatatgcac

SEQ ID NO: 1799796 - DNA, 14 bp, Homo sapiens
aaattaatatatta

SEQ ID NO: 1799797 - DNA, 13 bp, Homo sapiens
aaattatttgcat

SEQ ID NO: 1799798 - DNA, 19 bp, Homo sapiens
aaatttgttattttgcaac

SEQ ID NO: 1799799 - DNA, 11 bp, Homo sapiens
aacaatgaatg

SEQ ID NO: 1799800 - DNA, 20 bp, Homo sapiens
aacatgaccctaaatcttga

SEQ ID NO: 1799801 - DNA, 17 bp, Homo sapiens
aacatttttgtacatta

SEQ ID NO: 1799802 - DNA, 20 bp, Homo sapiens
aacccatcaacaaaaattgt

SEQ ID NO: 1799803 - DNA, 14 bp, Homo sapiens
aaccgcttgccata

SEQ ID NO: 1799804 - DNA, 16 bp, Homo sapiens
aacctcatcttcttca

SEQ ID NO: 1799805 - DNA, 18 bp, Homo sapiens
aacctcttcagaggccct

SEQ ID NO: 1799806 - DNA, 16 bp, Homo sapiens
aactatcaatatttaa

SEQ ID NO: 1799807 - DNA, 19 bp, Homo sapiens
aactcgtgtctggcacagc

SEQ ID NO: 1799808 - DNA, 17 bp, Homo sapiens
aacttcaaatatagaga

SEQ ID NO: 1799809 - DNA, 15 bp, Homo sapiens
aagaaaacaccctta

SEQ ID NO: 1799810 - DNA, 13 bp, Homo sapiens
aagaaagctgctt

SEQ ID NO: 1799811 - DNA, 16 bp, Homo sapiens
aagacgtgattttgct

SEQ ID NO: 1799812 - DNA, 22 bp, Homo sapiens
aagacgtgattttgctgtagaa

SEQ ID NO: 1799813 - DNA, 13 bp, Homo sapiens
aagagtagaaact

SEQ ID NO: 1799814 - DNA, 19 bp, Homo sapiens
aagatattttaaaatctgt

SEQ ID NO: 1799815 - DNA, 23 bp, Homo sapiens
aagatggcacttataaccaaagc

SEQ ID NO: 1799816 - DNA, 14 bp, Homo sapiens
aagattttttttgt

SEQ ID NO: 1799817 - DNA, 13 bp, Homo sapiens
aagcaattatatt

SEQ ID NO: 1799818 - DNA, 21 bp, Homo sapiens
aagcagaccactgataaaacc

SEQ ID NO: 1799819 - DNA, 22 bp, Homo sapiens
aagcagacgtgagtgtgacttt

SEQ ID NO: 1799820 - DNA, 23 bp, Homo sapiens
aagcagacgtgagtgtgactttt

SEQ ID NO: 1799821 - DNA, 22 bp, Homo sapiens
aagcaggaaatgaaaatgtctt

SEQ ID NO: 1799822 - DNA, 13 bp, Homo sapiens
aagcattcacaac

SEQ ID NO: 1799823 - DNA, 18 bp, Homo sapiens
aagccacttaaaatgttc

SEQ ID NO: 1799824 - DNA, 14 bp, Homo sapiens
aagccagcgtcctc

SEQ ID NO: 1799825 - DNA, 19 bp, Homo sapiens
aagccagcgtcctcctctg

SEQ ID NO: 1799826 - DNA, 20 bp, Homo sapiens
aagccagcgtcctcctctgt

SEQ ID NO: 1799827 - DNA, 21 bp, Homo sapiens
aaggaagtcaaagcaaggaaa

SEQ ID NO: 1799828 - DNA, 19 bp, Homo sapiens
aaggagccccattcctggg

SEQ ID NO: 1799829 - DNA, 20 bp, Homo sapiens
aaggcaaacccatcaacaaa

SEQ ID NO: 1799830 - DNA, 18 bp, Homo sapiens
aaggcaagcacttgtggg

SEQ ID NO: 1799831 - DNA, 21 bp, Homo sapiens
aaggccaattcctatacgcag

SEQ ID NO: 1799832 - DNA, 14 bp, Homo sapiens
aagggcattttaaa

SEQ ID NO: 1799833 - DNA, 16 bp, Homo sapiens
aagggcattttaaaag

SEQ ID NO: 1799834 - DNA, 18 bp, Homo sapiens
aagggctttgttttgcac

SEQ ID NO: 1799835 - DNA, 17 bp, Homo sapiens
aaggggccagaggctcg

SEQ ID NO: 1799836 - DNA, 13 bp, Homo sapiens
aagtaggaagtaa

SEQ ID NO: 1799837 - DNA, 17 bp, Homo sapiens
aagtattttcataagta

SEQ ID NO: 1799838 - DNA, 16 bp, Homo sapiens
aagtcaacctgcctga

SEQ ID NO: 1799839 - DNA, 13 bp, Homo sapiens
aagtggtatagaa

SEQ ID NO: 1799840 - DNA, 14 bp, Homo sapiens
aagttacacatttt

SEQ ID NO: 1799841 - DNA, 17 bp, Homo sapiens
aagttacacatttttca

SEQ ID NO: 1799842 - DNA, 18 bp, Homo sapiens
ctgagccacagccgtgct

SEQ ID NO: 1799843 - DNA, 12 bp, Homo sapiens
ctgagctgaggc

SEQ ID NO: 1799844 - DNA, 15 bp, Homo sapiens
ctgagctgaggcagc

SEQ ID NO: 1799845 - DNA, 15 bp, Homo sapiens
ctgagctgtgcaggt

SEQ ID NO: 1799846 - DNA, 22 bp, Homo sapiens
ctgaggaacccttacagtagga

SEQ ID NO: 1799847 - DNA, 15 bp, Homo sapiens
ctgagggatctttac

SEQ ID NO: 1799848 - DNA, 23 bp, Homo sapiens
ctgataaaaccatgtagaaaatt

SEQ ID NO: 1799849 - DNA, 15 bp, Homo sapiens
ctgatccctctacag

SEQ ID NO: 1799850 - DNA, 12 bp, Homo sapiens
ctgatttctcac

SEQ ID NO: 1799851 - DNA, 12 bp, Homo sapiens
ctgcagggaaaa

SEQ ID NO: 1799852 - DNA, 22 bp, Homo sapiens
ctgcagggaaaattatttgcat

SEQ ID NO: 1799853 - DNA, 22 bp, Homo sapiens
ctgccacagcctcccctgccag

SEQ ID NO: 1799854 - DNA, 23 bp, Homo sapiens
ctgccacagcctcccctgccagg

SEQ ID NO: 1799855 - DNA, 16 bp, Homo sapiens
ctgccaggagacaggt

SEQ ID NO: 1799856 - DNA, 12 bp, Homo sapiens
ctgccagggcag

SEQ ID NO: 1799857 - DNA, 15 bp, Homo sapiens
ctgccagggcagggc

SEQ ID NO: 1799858 - DNA, 23 bp, Homo sapiens
ctgccgagagtccatcagcctcc

SEQ ID NO: 1799859 - DNA, 16 bp, Homo sapiens
ctgcctcttctgggag

SEQ ID NO: 1799860 - DNA, 17 bp, Homo sapiens
ctgcctcttctgggagg

SEQ ID NO: 1799861 - DNA, 17 bp, Homo sapiens
ctgcctggaccagcctc

SEQ ID NO: 1799862 - DNA, 21 bp, Homo sapiens
ctgccttcctcctgggccctc

SEQ ID NO: 1799863 - DNA, 13 bp, Homo sapiens
ctgccttgccatg

SEQ ID NO: 1799864 - DNA, 16 bp, Homo sapiens
ctgctcatcattctct

SEQ ID NO: 1799865 - DNA, 16 bp, Homo sapiens
ctgcttgaggaaaaca

SEQ ID NO: 1799866 - DNA, 12 bp, Homo sapiens
ctggaccagcct

SEQ ID NO: 1799867 - DNA, 17 bp, Homo sapiens
ctggactctcagtctct

SEQ ID NO: 1799868 - DNA, 19 bp, Homo sapiens
ctggactctcagtctctga

SEQ ID NO: 1799869 - DNA, 18 bp, Homo sapiens
ctggatacagaatgaatc

SEQ ID NO: 1799870 - DNA, 21 bp, Homo sapiens
ctggcacagcctggctgtggc

SEQ ID NO: 1799871 - DNA, 12 bp, Homo sapiens
cagagaaaaagg

SEQ ID NO: 1799872 - DNA, 18 bp, Homo sapiens
cagagaaaaagggagggg

SEQ ID NO: 1799873 - DNA, 19 bp, Homo sapiens
cagagccgtggtcctttgg

SEQ ID NO: 1799874 - DNA, 20 bp, Homo sapiens
cagagccgtggtcctttggg

SEQ ID NO: 1799875 - DNA, 21 bp, Homo sapiens
cagaggaaggggccagaggct

SEQ ID NO: 1799876 - DNA, 17 bp, Homo sapiens
cagagttggtgttcata

SEQ ID NO: 1799877 - DNA, 16 bp, Homo sapiens
cagataatgtgaaaat

SEQ ID NO: 1799878 - DNA, 15 bp, Homo sapiens
cagcacctacagtgt

SEQ ID NO: 1799879 - DNA, 20 bp, Homo sapiens
cagcagtgtgaggccagggc

SEQ ID NO: 1799880 - DNA, 18 bp, Homo sapiens
cagccctagggtggagag

SEQ ID NO: 1799881 - DNA, 14 bp, Homo sapiens
cagccctcatcccg

SEQ ID NO: 1799882 - DNA, 21 bp, Homo sapiens
cagcctccatcctaccccctg

SEQ ID NO: 1799883 - DNA, 16 bp, Homo sapiens
cagcctcccctgccag

SEQ ID NO: 1799884 - DNA, 17 bp, Homo sapiens
cagcctcccctgccagg

SEQ ID NO: 1799885 - DNA, 13 bp, Homo sapiens
cagctccttcctg

SEQ ID NO: 1799886 - DNA, 16 bp, Homo sapiens
cagctccttcctggag

SEQ ID NO: 1799887 - DNA, 20 bp, Homo sapiens
caggaaatgaaaatgtcttg

SEQ ID NO: 1799888 - DNA, 17 bp, Homo sapiens
caggaaccgaggcaggg

SEQ ID NO: 1799889 - DNA, 18 bp, Homo sapiens
caggaaccgaggcaggga

SEQ ID NO: 1799890 - DNA, 18 bp, Homo sapiens
caggacatttctctaaga

SEQ ID NO: 1799891 - DNA, 22 bp, Homo sapiens
caggagaaggccaattcctata

SEQ ID NO: 1799892 - DNA, 11 bp, Homo sapiens
caggctcagag

SEQ ID NO: 1799893 - DNA, 20 bp, Homo sapiens
cagggaaaattatttgcata

SEQ ID NO: 1799894 - DNA, 20 bp, Homo sapiens
cagggccccaggcattgcca

SEQ ID NO: 1799895 - DNA, 19 bp, Homo sapiens
cagggctaccctgagctga

SEQ ID NO: 1799896 - DNA, 13 bp, Homo sapiens
cagggctcctggg

SEQ ID NO: 1799897 - DNA, 21 bp, Homo sapiens
caggtgctacacccttttcca

SEQ ID NO: 1799898 - DNA, 23 bp, Homo sapiens
cagtaccttcaaactagggccaa

SEQ ID NO: 1799899 - DNA, 22 bp, Homo sapiens
cagtaggagcccagctctgaaa

SEQ ID NO: 1799900 - DNA, 14 bp, Homo sapiens
cagtcaacctgggc

SEQ ID NO: 1799901 - DNA, 13 bp, Homo sapiens
cagtccacaaaat

SEQ ID NO: 1799902 - DNA, 16 bp, Homo sapiens
cagtcgatagagctgt

SEQ ID NO: 1799903 - DNA, 12 bp, Homo sapiens
cagtctctgagc

SEQ ID NO: 1799904 - DNA, 14 bp, Homo sapiens
cagtctctgagcag

SEQ ID NO: 1799905 - DNA, 17 bp, Homo sapiens
cagtctgagagaggcca

SEQ ID NO: 1799906 - DNA, 17 bp, Homo sapiens
cagtcttgtattaagtt

SEQ ID NO: 1799907 - DNA, 14 bp, Homo sapiens
cagtgctccctcac

SEQ ID NO: 1799908 - DNA, 14 bp, Homo sapiens
cagtgttaaatgtg

SEQ ID NO: 1799909 - DNA, 19 bp, Homo sapiens
cagtgttaaatgtgatgaa

SEQ ID NO: 1799910 - DNA, 16 bp, Homo sapiens
cagttaaaaaaaattt

SEQ ID NO: 1799911 - DNA, 13 bp, Homo sapiens
cagttctagttga

SEQ ID NO: 1799912 - DNA, 15 bp, Homo sapiens
cataacaattcctct

SEQ ID NO: 1799913 - DNA, 18 bp, Homo sapiens
cataatttcagttctagt

SEQ ID NO: 1799914 - DNA, 16 bp, Homo sapiens
catacagaggtaacta

SEQ ID NO: 1799915 - DNA, 11 bp, Homo sapiens
catacattata

SEQ ID NO: 1799916 - DNA, 14 bp, Homo sapiens
cataccaatgaaaa

SEQ ID NO: 1799917 - DNA, 21 bp, Homo sapiens
catcatctcctgccttcctcc

SEQ ID NO: 1799918 - DNA, 12 bp, Homo sapiens
catcattctctg

SEQ ID NO: 1799919 - DNA, 14 bp, Homo sapiens
catcattctctgtc

SEQ ID NO: 1799920 - DNA, 22 bp, Homo sapiens
catcattctctgtctcatccat

SEQ ID NO: 1799921 - DNA, 24 bp, Homo sapiens
catcattctctgtctcatccatca

SEQ ID NO: 1799922 - DNA, 21 bp, Homo sapiens
catccagagtccctgcctgga

SEQ ID NO: 1799923 - DNA, 18 bp, Homo sapiens
catcctccacgttctgct

SEQ ID NO: 1799924 - DNA, 15 bp, Homo sapiens
catctaacctcatct

SEQ ID NO: 1799925 - DNA, 19 bp, Homo sapiens
catctaacctcatcttctt

SEQ ID NO: 1799926 - DNA, 19 bp, Homo sapiens
catctcctgccttcctcct

SEQ ID NO: 1799927 - DNA, 16 bp, Homo sapiens
catctgtccctccggg

SEQ ID NO: 1799928 - DNA, 19 bp, Homo sapiens
catgaaagagaaagactga

SEQ ID NO: 1799929 - DNA, 12 bp, Homo sapiens
catgattttctt

SEQ ID NO: 1799930 - DNA, 19 bp, Homo sapiens
catgcactgttccccctgt

SEQ ID NO: 1799931 - DNA, 13 bp, Homo sapiens
catgggagccggg

SEQ ID NO: 1799932 - DNA, 14 bp, Homo sapiens
catgggaggctcac

SEQ ID NO: 1799933 - DNA, 18 bp, Homo sapiens
catgtaggaagtaggaag

SEQ ID NO: 1799934 - DNA, 14 bp, Homo sapiens
catgtgactctttc

SEQ ID NO: 1799935 - DNA, 16 bp, Homo sapiens
catgtgactctttcca

SEQ ID NO: 1799936 - DNA, 17 bp, Homo sapiens
catgtgactctttccaa

SEQ ID NO: 1799937 - DNA, 21 bp, Homo sapiens
cattatgttattggaattttc

SEQ ID NO: 1799938 - DNA, 23 bp, Homo sapiens
cattatgttattggaattttctt

SEQ ID NO: 1799939 - DNA, 23 bp, Homo sapiens
cattctctgtctcatccatcatc

SEQ ID NO: 1799940 - DNA, 16 bp, Homo sapiens
cattctgaaggagccc

SEQ ID NO: 1799941 - DNA, 21 bp, Homo sapiens
cattgaattcttggttgagga

SEQ ID NO: 1799942 - DNA, 15 bp, Homo sapiens
cattgccaagggctt

SEQ ID NO: 1799943 - DNA, 20 bp, Homo sapiens
catttaaatacagtcttcca

SEQ ID NO: 1799944 - DNA, 15 bp, Homo sapiens
catttctctaagaga

SEQ ID NO: 1799945 - DNA, 20 bp, Homo sapiens
catttggcaatgccatcatc

SEQ ID NO: 1799946 - DNA, 15 bp, Homo sapiens
catttttgtacatta

SEQ ID NO: 1799947 - DNA, 17 bp, Homo sapiens
catttttgtacattatg

SEQ ID NO: 1799948 - DNA, 16 bp, Homo sapiens
ccaaacaggctcagag

SEQ ID NO: 1799949 - DNA, 16 bp, Homo sapiens
ccaaagctttcatgta

SEQ ID NO: 1799950 - DNA, 21 bp, Homo sapiens
ccaagggctttgttttgcaca

SEQ ID NO: 1799951 - DNA, 15 bp, Homo sapiens
ccaatattgtacagt

SEQ ID NO: 1799952 - DNA, 16 bp, Homo sapiens
ccaatattgtacagtt

SEQ ID NO: 1799953 - DNA, 14 bp, Homo sapiens
ccaatcctatgttt

SEQ ID NO: 1799954 - DNA, 23 bp, Homo sapiens
ccaatgaaaaaatgtatatgcac

SEQ ID NO: 1799955 - DNA, 12 bp, Homo sapiens
ccaatgtcttga

SEQ ID NO: 1799956 - DNA, 13 bp, Homo sapiens
cgagatcccaaca

SEQ ID NO: 1799957 - DNA, 21 bp, Homo sapiens
cgagatcccaacactgccagc

SEQ ID NO: 1799958 - DNA, 22 bp, Homo sapiens
cgagatcccaacactgccagca

SEQ ID NO: 1799959 - DNA, 19 bp, Homo sapiens
cgaggaggctccagagggc

SEQ ID NO: 1799960 - DNA, 20 bp, Homo sapiens
cgatcttggctcactgcaac

SEQ ID NO: 1799961 - DNA, 13 bp, Homo sapiens
cgcctttcccagg

SEQ ID NO: 1799962 - DNA, 12 bp, Homo sapiens
cgcggctgggag

SEQ ID NO: 1799963 - DNA, 16 bp, Homo sapiens
cgcggctgggaggagg

SEQ ID NO: 1799964 - DNA, 19 bp, Homo sapiens
cgctgccagctctgtatca

SEQ ID NO: 1799965 - DNA, 20 bp, Homo sapiens
cgctggactctcagtctctg

SEQ ID NO: 1799966 - DNA, 15 bp, Homo sapiens
cggagaccctgagtc

SEQ ID NO: 1799967 - DNA, 17 bp, Homo sapiens
cggagccactcctctga

SEQ ID NO: 1799968 - DNA, 12 bp, Homo sapiens
cggctgggagga

SEQ ID NO: 1799969 - DNA, 15 bp, Homo sapiens
cgggctctgacagcc

SEQ ID NO: 1799970 - DNA, 17 bp, Homo sapiens
cggggcctgggcaggag

SEQ ID NO: 1799971 - DNA, 19 bp, Homo sapiens
cggggcctgggcaggaggg

SEQ ID NO: 1799972 - DNA, 17 bp, Homo sapiens
cgtaaagctagaaatga

SEQ ID NO: 1799973 - DNA, 14 bp, Homo sapiens
cgtcctcctctgtg

SEQ ID NO: 1799974 - DNA, 18 bp, Homo sapiens
cgtgattttgctgtagaa

SEQ ID NO: 1799975 - DNA, 15 bp, Homo sapiens
cgtggaacgtttttc

SEQ ID NO: 1799976 - DNA, 16 bp, Homo sapiens
cgttgtcctcagcccc

SEQ ID NO: 1799977 - DNA, 13 bp, Homo sapiens
ctaaaactctcaa

SEQ ID NO: 1799978 - DNA, 22 bp, Homo sapiens
ctaacaatcagctccttcctgg

SEQ ID NO: 1799979 - DNA, 12 bp, Homo sapiens
ctaacctgccga

SEQ ID NO: 1799980 - DNA, 21 bp, Homo sapiens
ctaacctgccgagagtccatc

SEQ ID NO: 1799981 - DNA, 15 bp, Homo sapiens
acttgaactttccaa

SEQ ID NO: 1799982 - DNA, 20 bp, Homo sapiens
acttgaactttccaaaacct

SEQ ID NO: 1799983 - DNA, 23 bp, Homo sapiens
acttgtcccgggacacctaggct

SEQ ID NO: 1799984 - DNA, 15 bp, Homo sapiens
acttttttttaagtt

SEQ ID NO: 1799985 - DNA, 20 bp, Homo sapiens
agaaaagggaactgaacatt

SEQ ID NO: 1799986 - DNA, 18 bp, Homo sapiens
agaaacaacaatttctac

SEQ ID NO: 1799987 - DNA, 17 bp, Homo sapiens
agaaacaactctttgag

SEQ ID NO: 1799988 - DNA, 13 bp, Homo sapiens
agaaatgaatgct

SEQ ID NO: 1799989 - DNA, 14 bp, Homo sapiens
agaactctttcaaa

SEQ ID NO: 1799990 - DNA, 18 bp, Homo sapiens
agaatttgagtgctctga

SEQ ID NO: 1799991 - DNA, 13 bp, Homo sapiens
agacgcctgagga

SEQ ID NO: 1799992 - DNA, 12 bp, Homo sapiens
agacgtgaatgt

SEQ ID NO: 1799993 - DNA, 17 bp, Homo sapiens
agagacgggccctggtg

SEQ ID NO: 1799994 - DNA, 11 bp, Homo sapiens
agagcctgagg

SEQ ID NO: 1799995 - DNA, 14 bp, Homo sapiens
agagcctgagggat

SEQ ID NO: 1799996 - DNA, 12 bp, Homo sapiens
agagcttccctg

SEQ ID NO: 1799997 - DNA, 17 bp, Homo sapiens
agagcttccctgactca

SEQ ID NO: 1799998 - DNA, 15 bp, Homo sapiens
agaggaaggggccag

SEQ ID NO: 1799999 - DNA, 18 bp, Homo sapiens
agaggaaggggccagagg

SEQ ID NO: 1800000 - DNA, 20 bp, Homo sapiens
agaggaaggggccagaggct

SEQ ID NO: 1800001 - DNA, 23 bp, Homo sapiens
agaggaaggggccagaggctcgt

SEQ ID NO: 1800002 - DNA, 10 bp, Homo sapiens
agagggctgc

SEQ ID NO: 1800003 - DNA, 21 bp, Homo sapiens
agaggggctgaatagcagaag

SEQ ID NO: 1800004 - DNA, 23 bp, Homo sapiens
agatatttttgtacgttatatat

SEQ ID NO: 1800005 - DNA, 20 bp, Homo sapiens
agatgttctaagtctttcca

SEQ ID NO: 1800006 - DNA, 21 bp, Homo sapiens
agatgttctaagtctttccat

SEQ ID NO: 1800007 - DNA, 22 bp, Homo sapiens
agatgttctaagtctttccatt

SEQ ID NO: 1800008 - DNA, 13 bp, Homo sapiens
agatttattaatt

SEQ ID NO: 1800009 - DNA, 17 bp, Homo sapiens
agattttttttgtaact

SEQ ID NO: 1800010 - DNA, 18 bp, Homo sapiens
agattttttttgtaactt

SEQ ID NO: 1800011 - DNA, 18 bp, Homo sapiens
agcaagggacagaaaaga

SEQ ID NO: 1800012 - DNA, 12 bp, Homo sapiens
agcaatatgcat

SEQ ID NO: 1800013 - DNA, 18 bp, Homo sapiens
agcacatgattttctttt

SEQ ID NO: 1800014 - DNA, 19 bp, Homo sapiens
agcacctacagtgtacagt

SEQ ID NO: 1800015 - DNA, 17 bp, Homo sapiens
agcactgcttgaggaaa

SEQ ID NO: 1800016 - DNA, 23 bp, Homo sapiens
agcaggaaatgaaaatgtcttgt

SEQ ID NO: 1800017 - DNA, 17 bp, Homo sapiens
agcatttcccttccttc

SEQ ID NO: 1800018 - DNA, 14 bp, Homo sapiens
agccactcctctga

SEQ ID NO: 1800019 - DNA, 17 bp, Homo sapiens
agccacttaaaatgttc

SEQ ID NO: 1800020 - DNA, 16 bp, Homo sapiens
agccagcgtcctcctc

SEQ ID NO: 1800021 - DNA, 15 bp, Homo sapiens
agcccagcactgctt

SEQ ID NO: 1800022 - DNA, 19 bp, Homo sapiens
agccgctgagcgaggagat

SEQ ID NO: 1800023 - DNA, 14 bp, Homo sapiens
agccgggagcctga

SEQ ID NO: 1800024 - DNA, 23 bp, Homo sapiens
agccgtgctcgcccacaaactga

SEQ ID NO: 1800025 - DNA, 23 bp, Homo sapiens
agcctagtgaaggcttctctctg

SEQ ID NO: 1800026 - DNA, 22 bp, Homo sapiens
agcctcactattacttgaactt

SEQ ID NO: 1800027 - DNA, 17 bp, Homo sapiens
agcctcccctgccaggg

SEQ ID NO: 1800028 - DNA, 19 bp, Homo sapiens
agcctcccctgccagggca

SEQ ID NO: 1800029 - DNA, 18 bp, Homo sapiens
agctatgttatattgaaa

SEQ ID NO: 1800030 - DNA, 15 bp, Homo sapiens
agctccttcctggag

SEQ ID NO: 1800031 - DNA, 22 bp, Homo sapiens
agctctgtatcaggacccagag

SEQ ID NO: 1800032 - DNA, 17 bp, Homo sapiens
agctgaggcagcagtgt

SEQ ID NO: 1800033 - DNA, 19 bp, Homo sapiens
agctgctttcgaataaagt

SEQ ID NO: 1800034 - DNA, 10 bp, Homo sapiens
agctgtgcag

SEQ ID NO: 1800035 - DNA, 22 bp, Homo sapiens
agctgtttactagggatccctc

SEQ ID NO: 1800036 - DNA, 13 bp, Homo sapiens
agctgtttatgca

SEQ ID NO: 1800037 - DNA, 17 bp, Homo sapiens
aggaaaagtgcaatgcg

SEQ ID NO: 1800038 - DNA, 16 bp, Homo sapiens
aggacctgtggccaag

SEQ ID NO: 1800039 - DNA, 21 bp, Homo sapiens
aggacctgtggccaagttctt

SEQ ID NO: 1800040 - DNA, 12 bp, Homo sapiens
aggactctcagg

SEQ ID NO: 1800041 - DNA, 17 bp, Homo sapiens
aggagatgctccttggg

SEQ ID NO: 1800042 - DNA, 18 bp, Homo sapiens
aggagccccattcctggg

SEQ ID NO: 1800043 - DNA, 19 bp, Homo sapiens
aggagccccattcctggga

SEQ ID NO: 1800044 - DNA, 13 bp, Homo sapiens
aggaggctccaga

SEQ ID NO: 1800045 - DNA, 16 bp, Homo sapiens
aggaggctccagaggg

SEQ ID NO: 1800046 - DNA, 17 bp, Homo sapiens
aggaggctccagagggc

SEQ ID NO: 1800047 - DNA, 18 bp, Homo sapiens
aggaggctccagagggca

SEQ ID NO: 1800048 - DNA, 22 bp, Homo sapiens
aggcagcagtgtgaggccaggg

SEQ ID NO: 1800049 - DNA, 23 bp, Homo sapiens
aggcagcagtgtgaggccagggc

SEQ ID NO: 1800050 - DNA, 13 bp, Homo sapiens
aggccattattgt

SEQ ID NO: 1800051 - DNA, 15 bp, Homo sapiens
aggccattctttccc

SEQ ID NO: 1800052 - DNA, 18 bp, Homo sapiens
aggccattctttcccaac

SEQ ID NO: 1800053 - DNA, 19 bp, Homo sapiens
aggccattctttcccaaca

SEQ ID NO: 1800054 - DNA, 19 bp, Homo sapiens
aggctagggtggggagaga

SEQ ID NO: 1800055 - DNA, 21 bp, Homo sapiens
aggctcacccccttctccatc

SEQ ID NO: 1800056 - DNA, 13 bp, Homo sapiens
aggctccagaggg

SEQ ID NO: 1800057 - DNA, 14 bp, Homo sapiens
aggctccagagggc

SEQ ID NO: 1800058 - DNA, 15 bp, Homo sapiens
aggctccagagggca

SEQ ID NO: 1800059 - DNA, 23 bp, Homo sapiens
agggaaggatcccatgagctcct

SEQ ID NO: 1800060 - DNA, 19 bp, Homo sapiens
agggcagagtgagacccag

SEQ ID NO: 1800061 - DNA, 13 bp, Homo sapiens
agggcattttaaa

SEQ ID NO: 1800062 - DNA, 21 bp, Homo sapiens
agggccacatgggaggctcac

SEQ ID NO: 1800063 - DNA, 20 bp, Homo sapiens
agggctaccctgagctgagg

SEQ ID NO: 1800064 - DNA, 12 bp, Homo sapiens
agggctcctggg

SEQ ID NO: 1800065 - DNA, 12 bp, Homo sapiens
aggggccagagg

SEQ ID NO: 1800066 - DNA, 14 bp, Homo sapiens
aggggccagaggct

SEQ ID NO: 1800067 - DNA, 17 bp, Homo sapiens
aggggccagaggctcgt

SEQ ID NO: 1800068 - DNA, 15 bp, Homo sapiens
agggggagagggctg

SEQ ID NO: 1800069 - DNA, 16 bp, Homo sapiens
agggggagagggctgc

SEQ ID NO: 1800070 - DNA, 21 bp, Homo sapiens
aggtaatccaagatattttaa

SEQ ID NO: 1800071 - DNA, 17 bp, Homo sapiens
aggtgcaagtgccccag

SEQ ID NO: 1800072 - DNA, 20 bp, Homo sapiens
aggtgctacacccttttcca

SEQ ID NO: 1800073 - DNA, 21 bp, Homo sapiens
aggtgcttctagttctgccag

SEQ ID NO: 1800074 - DNA, 11 bp, Homo sapiens
atgtcttgtgt

SEQ ID NO: 1800075 - DNA, 21 bp, Homo sapiens
atgtgaaaatggtccaggaga

SEQ ID NO: 1800076 - DNA, 13 bp, Homo sapiens
atgtgacaacatt

SEQ ID NO: 1800077 - DNA, 21 bp, Homo sapiens
atgtgactctttccaaccggc

SEQ ID NO: 1800078 - DNA, 14 bp, Homo sapiens
atgtgtagttaatt

SEQ ID NO: 1800079 - DNA, 16 bp, Homo sapiens
atgttattggaatttt

SEQ ID NO: 1800080 - DNA, 23 bp, Homo sapiens
atgttattggaattttctttcat

SEQ ID NO: 1800081 - DNA, 18 bp, Homo sapiens
atgttcacttttgacaaa

SEQ ID NO: 1800082 - DNA, 20 bp, Homo sapiens
atgttcacttttgacaaagg

SEQ ID NO: 1800083 - DNA, 14 bp, Homo sapiens
attaaaatcctcaa

SEQ ID NO: 1800084 - DNA, 15 bp, Homo sapiens
attaaagactccagt

SEQ ID NO: 1800085 - DNA, 21 bp, Homo sapiens
attaaataacagtgtgtgacc

SEQ ID NO: 1800086 - DNA, 13 bp, Homo sapiens
attaacctctcac

SEQ ID NO: 1800087 - DNA, 13 bp, Homo sapiens
attaagttgttaa

SEQ ID NO: 1800088 - DNA, 20 bp, Homo sapiens
attaagttgttaataaaagt

SEQ ID NO: 1800089 - DNA, 16 bp, Homo sapiens
attacttgaactttcc

SEQ ID NO: 1800090 - DNA, 12 bp, Homo sapiens
tattgtacagtt

SEQ ID NO: 1800091 - DNA, 13 bp, Homo sapiens
tattgtacagttt

SEQ ID NO: 1800092 - DNA, 15 bp, Homo sapiens
tattgtccattgtcc

SEQ ID NO: 1800093 - DNA, 20 bp, Homo sapiens
tattgtcctcccctatttta

SEQ ID NO: 1800094 - DNA, 14 bp, Homo sapiens
tatttcaaattgga

SEQ ID NO: 1800095 - DNA, 21 bp, Homo sapiens
tatttgcataacaattcctct

SEQ ID NO: 1800096 - DNA, 15 bp, Homo sapiens
tcaaaaccttttgaa

SEQ ID NO: 1800097 - DNA, 20 bp, Homo sapiens
tcaaagcaaggaaactatgt

SEQ ID NO: 1800098 - DNA, 22 bp, Homo sapiens
tcaaagccagcgtcctcctctg

SEQ ID NO: 1800099 - DNA, 23 bp, Homo sapiens
tcaaagccagcgtcctcctctgt

SEQ ID NO: 1800100 - DNA, 16 bp, Homo sapiens
tcaaccgcttgccata

SEQ ID NO: 1800101 - DNA, 13 bp, Homo sapiens
tcaatatttaagt

SEQ ID NO: 1800102 - DNA, 16 bp, Homo sapiens
tcaattgcatctccca

SEQ ID NO: 1800103 - DNA, 15 bp, Homo sapiens
tcaccgtgggctccc

SEQ ID NO: 1800104 - DNA, 14 bp, Homo sapiens
tcacctgtgcttcg

SEQ ID NO: 1800105 - DNA, 18 bp, Homo sapiens
tcacgtaaagctagaaat

SEQ ID NO: 1800106 - DNA, 20 bp, Homo sapiens
tcacgtaaagctagaaatga

SEQ ID NO: 1800107 - DNA, 18 bp, Homo sapiens
tcactattacttgaactt

SEQ ID NO: 1800108 - DNA, 18 bp, Homo sapiens
tcagaggccctcgctgcc

SEQ ID NO: 1800109 - DNA, 21 bp, Homo sapiens
tcagaggccctcgctgccagc

SEQ ID NO: 1800110 - DNA, 14 bp, Homo sapiens
tcagctccttcctg

SEQ ID NO: 1800111 - DNA, 16 bp, Homo sapiens
tcagctccttcctgga

SEQ ID NO: 1800112 - DNA, 15 bp, Homo sapiens
tcaggaaaggaatca

SEQ ID NO: 1800113 - DNA, 18 bp, Homo sapiens
tcaggaaccgaggcaggg

SEQ ID NO: 1800114 - DNA, 16 bp, Homo sapiens
tcaggacccagaggaa

SEQ ID NO: 1800115 - DNA, 19 bp, Homo sapiens
tcaggacccagaggaaggg

SEQ ID NO: 1800116 - DNA, 13 bp, Homo sapiens
tcagtctctgagc

SEQ ID NO: 1800117 - DNA, 17 bp, Homo sapiens
tcagtctctgagcagtg

SEQ ID NO: 1800118 - DNA, 15 bp, Homo sapiens
tcataccaatgaaaa

SEQ ID NO: 1800119 - DNA, 14 bp, Homo sapiens
tcatcattctctgt

SEQ ID NO: 1800120 - DNA, 20 bp, Homo sapiens
tcatcattctctgtctcatc

SEQ ID NO: 1800121 - DNA, 11 bp, Homo sapiens
tcatccatcat

SEQ ID NO: 1800122 - DNA, 15 bp, Homo sapiens
tcatccatcatcatg

SEQ ID NO: 1800123 - DNA, 21 bp, Homo sapiens
tcatcccgagcacctccacat

SEQ ID NO: 1800124 - DNA, 18 bp, Homo sapiens
tcatctcctgccttcctc

SEQ ID NO: 1800125 - DNA, 17 bp, Homo sapiens
tcatctgtccctccggg

SEQ ID NO: 1800126 - DNA, 22 bp, Homo sapiens
tcatggcagaaggcaaacccat

SEQ ID NO: 1800127 - DNA, 17 bp, Homo sapiens
tcatgtgactctttcca

SEQ ID NO: 1800128 - DNA, 18 bp, Homo sapiens
tcatgtgactctttccaa

SEQ ID NO: 1800129 - DNA, 12 bp, Homo sapiens
tcatgtgtgtcc

SEQ ID NO: 1800130 - DNA, 23 bp, Homo sapiens
tcatgtgtgtccacgactgtctc

SEQ ID NO: 1800131 - DNA, 15 bp, Homo sapiens
tcattctctgtctca

SEQ ID NO: 1800132 - DNA, 16 bp, Homo sapiens
tcattctctgtctcat

SEQ ID NO: 1800133 - DNA, 22 bp, Homo sapiens
tcatttaccataaaaatccttc

SEQ ID NO: 1800134 - DNA, 13 bp, Homo sapiens
tcatttctatttc

SEQ ID NO: 1800135 - DNA, 22 bp, Homo sapiens
tccaaaaagatttattaattaa

SEQ ID NO: 1800136 - DNA, 14 bp, Homo sapiens
tccaaacaggctca

SEQ ID NO: 1800137 - DNA, 19 bp, Homo sapiens
tccaagctgatgtttgtac

SEQ ID NO: 1800138 - DNA, 16 bp, Homo sapiens
tccaatcctatgtttt

SEQ ID NO: 1800139 - DNA, 20 bp, Homo sapiens
tccacaaaataaccaatcct

SEQ ID NO: 1800140 - DNA, 12 bp, Homo sapiens
tccacatcctcc

SEQ ID NO: 1800141 - DNA, 22 bp, Homo sapiens
tccacgagctgtttactaggga

SEQ ID NO: 1800142 - DNA, 15 bp, Homo sapiens
tccagagtccctgcc

SEQ ID NO: 1800143 - DNA, 18 bp, Homo sapiens
tccagagtccctgcctgg

SEQ ID NO: 1800144 - DNA, 21 bp, Homo sapiens
tccagagtccctgcctggacc

SEQ ID NO: 1800145 - DNA, 16 bp, Homo sapiens
tccaggagaaggccaa

SEQ ID NO: 1800146 - DNA, 20 bp, Homo sapiens
tccaggagaaggccaattcc

SEQ ID NO: 1800147 - DNA, 16 bp, Homo sapiens
tccaggcactgagata

SEQ ID NO: 1800148 - DNA, 15 bp, Homo sapiens
tcccaacactgccag

SEQ ID NO: 1800149 - DNA, 15 bp, Homo sapiens
tcccaattcacatct

SEQ ID NO: 1800150 - DNA, 18 bp, Homo sapiens
tcccacaggacatttctc

SEQ ID NO: 1800151 - DNA, 21 bp, Homo sapiens
tcccacaggacatttctctaa

SEQ ID NO: 1800152 - DNA, 12 bp, Homo sapiens
tccccctctgtc

SEQ ID NO: 1800153 - DNA, 23 bp, Homo sapiens
gattttcttttgttttcttcatt

SEQ ID NO: 1800154 - DNA, 21 bp, Homo sapiens
gattttttttgtaacttcaaa

SEQ ID NO: 1800155 - DNA, 19 bp, Homo sapiens
gcaaacccatcaacaaaaa

SEQ ID NO: 1800156 - DNA, 18 bp, Homo sapiens
gcaatgccatcatctcct

SEQ ID NO: 1800157 - DNA, 14 bp, Homo sapiens
gcaattatattgtc

SEQ ID NO: 1800158 - DNA, 13 bp, Homo sapiens
gcacactttgcca

SEQ ID NO: 1800159 - DNA, 22 bp, Homo sapiens
gcacactttgccatattttcac

SEQ ID NO: 1800160 - DNA, 12 bp, Homo sapiens
gcacagcctggc

SEQ ID NO: 1800161 - DNA, 23 bp, Homo sapiens
gcaccagggttgaccccagagga

SEQ ID NO: 1800162 - DNA, 21 bp, Homo sapiens
gcacctacagtgtacagtctt

SEQ ID NO: 1800163 - DNA, 17 bp, Homo sapiens
gcactgcttgaggaaaa

SEQ ID NO: 1800164 - DNA, 23 bp, Homo sapiens
gcactggggcaggggccgggggc

SEQ ID NO: 1800165 - DNA, 18 bp, Homo sapiens
gcactgttccccctgtgc

SEQ ID NO: 1800166 - DNA, 19 bp, Homo sapiens
gcactgttccccctgtgca

SEQ ID NO: 1800167 - DNA, 15 bp, Homo sapiens
gcacttttaacaaaa

SEQ ID NO: 1800168 - DNA, 20 bp, Homo sapiens
gcagcagggctaccctgagc

SEQ ID NO: 1800169 - DNA, 16 bp, Homo sapiens
gcagccgctgagcgag

SEQ ID NO: 1800170 - DNA, 21 bp, Homo sapiens
gcaggaaatgaaaatgtcttg

SEQ ID NO: 1800171 - DNA, 15 bp, Homo sapiens
gcaggagggaggtgc

SEQ ID NO: 1800172 - DNA, 21 bp, Homo sapiens
gcagggaaaattatttgcata

SEQ ID NO: 1800173 - DNA, 22 bp, Homo sapiens
gcagggctaccctgagctgagg

SEQ ID NO: 1800174 - DNA, 15 bp, Homo sapiens
gcaggggtctgagcc

SEQ ID NO: 1800175 - DNA, 16 bp, Homo sapiens
gcaggggtctgagcca

SEQ ID NO: 1800176 - DNA, 17 bp, Homo sapiens
gcaggtggggagactgg

SEQ ID NO: 1800177 - DNA, 17 bp, Homo sapiens
gcataacaattcctcta

SEQ ID NO: 1800178 - DNA, 21 bp, Homo sapiens
gcatccagagtccctgcctgg

SEQ ID NO: 1800179 - DNA, 12 bp, Homo sapiens
gcatctcccaga

SEQ ID NO: 1800180 - DNA, 15 bp, Homo sapiens
gcatgaaagagaaag

SEQ ID NO: 1800181 - DNA, 21 bp, Homo sapiens
gcatgcactgttccccctgtg

SEQ ID NO: 1800182 - DNA, 14 bp, Homo sapiens
gcattgccaagggc

SEQ ID NO: 1800183 - DNA, 21 bp, Homo sapiens
gccacagcctcccctgccagg

SEQ ID NO: 1800184 - DNA, 14 bp, Homo sapiens
gccactcctctgac

SEQ ID NO: 1800185 - DNA, 15 bp, Homo sapiens
gccactcctctgact

SEQ ID NO: 1800186 - DNA, 21 bp, Homo sapiens
gccagacttcccacggctcct

SEQ ID NO: 1800187 - DNA, 22 bp, Homo sapiens
gccagaggctcgttgactggct

SEQ ID NO: 1800188 - DNA, 12 bp, Homo sapiens
gccagcgtcctc

SEQ ID NO: 1800189 - DNA, 23 bp, Homo sapiens
gccagctctgtatcaggacccag

SEQ ID NO: 1800190 - DNA, 15 bp, Homo sapiens
gccagggcagagtga

SEQ ID NO: 1800191 - DNA, 21 bp, Homo sapiens
gccagggcagagtgagaccca

SEQ ID NO: 1800192 - DNA, 19 bp, Homo sapiens
gccattctttcccaacacc

SEQ ID NO: 1800193 - DNA, 21 bp, Homo sapiens
gcccacaaactgatttctcac

SEQ ID NO: 1800194 - DNA, 20 bp, Homo sapiens
gcccagcactgcttgaggaa

SEQ ID NO: 1800195 - DNA, 15 bp, Homo sapiens
gccctcgctgccagc

SEQ ID NO: 1800196 - DNA, 14 bp, Homo sapiens
gccgggagcctgac

SEQ ID NO: 1800197 - DNA, 23 bp, Homo sapiens
gccgtgctcgcccacaaactgat

SEQ ID NO: 1800198 - DNA, 19 bp, Homo sapiens
gcctagtgaaggcttctct

SEQ ID NO: 1800199 - DNA, 22 bp, Homo sapiens
gcctagtgaaggcttctctctg

SEQ ID NO: 1800200 - DNA, 23 bp, Homo sapiens
gcctccatcctaccccctgtgcc

SEQ ID NO: 1800201 - DNA, 14 bp, Homo sapiens
gcctcccctgccag

SEQ ID NO: 1800202 - DNA, 15 bp, Homo sapiens
gcctcttctgggagg

SEQ ID NO: 1800203 - DNA, 17 bp, Homo sapiens
gcctgaccctcatcttt

SEQ ID NO: 1800204 - DNA, 17 bp, Homo sapiens
gcctggaccagcctctc

SEQ ID NO: 1800205 - DNA, 17 bp, Homo sapiens
gccttgtcacgccagac

SEQ ID NO: 1800206 - DNA, 13 bp, Homo sapiens
gcgagaattttca

SEQ ID NO: 1800207 - DNA, 19 bp, Homo sapiens
gcgaggagatgctccttgg

SEQ ID NO: 1800208 - DNA, 20 bp, Homo sapiens
gcgaggagatgctccttggg

SEQ ID NO: 1800209 - DNA, 20 bp, Homo sapiens
tcccctaagcagaccactga

SEQ ID NO: 1800210 - DNA, 14 bp, Homo sapiens
tcccctgccagggc

SEQ ID NO: 1800211 - DNA, 17 bp, Homo sapiens
tccccttccactgaggg

SEQ ID NO: 1800212 - DNA, 14 bp, Homo sapiens
tccctccgggacct

SEQ ID NO: 1800213 - DNA, 22 bp, Homo sapiens
tccctctacagagcttccctga

SEQ ID NO: 1800214 - DNA, 15 bp, Homo sapiens
tccctgactgggagt

SEQ ID NO: 1800215 - DNA, 13 bp, Homo sapiens
tccctgcctggac

SEQ ID NO: 1800216 - DNA, 18 bp, Homo sapiens
tccctgtaacctcttcag

SEQ ID NO: 1800217 - DNA, 12 bp, Homo sapiens
tcccttgggctc

SEQ ID NO: 1800218 - DNA, 21 bp, Homo sapiens
tccgggacctggtgctgcctc

SEQ ID NO: 1800219 - DNA, 12 bp, Homo sapiens
tcctccatggga

SEQ ID NO: 1800220 - DNA, 12 bp, Homo sapiens
tcctcctctgtg

SEQ ID NO: 1800221 - DNA, 20 bp, Homo sapiens
tcctcctgggccctctctgc

SEQ ID NO: 1800222 - DNA, 16 bp, Homo sapiens
tcctctgactcagggc

SEQ ID NO: 1800223 - DNA, 17 bp, Homo sapiens
tcctctgactcagggct

SEQ ID NO: 1800224 - DNA, 21 bp, Homo sapiens
tcctctgtgaccaatgtcttg

SEQ ID NO: 1800225 - DNA, 19 bp, Homo sapiens
tcctgagaaaaaaggttcc

SEQ ID NO: 1800226 - DNA, 15 bp, Homo sapiens
tcctgatcagagccg

SEQ ID NO: 1800227 - DNA, 16 bp, Homo sapiens
tcctgggaaatattcc

SEQ ID NO: 1800228 - DNA, 16 bp, Homo sapiens
tcctgggccctctctg

SEQ ID NO: 1800229 - DNA, 17 bp, Homo sapiens
tcctgggccctctctgc

SEQ ID NO: 1800230 - DNA, 15 bp, Homo sapiens
tcctgtctccctcct

SEQ ID NO: 1800231 - DNA, 18 bp, Homo sapiens
tcgagatcccaacactgc

SEQ ID NO: 1800232 - DNA, 23 bp, Homo sapiens
tcgcctttcccaggtgctacacc

SEQ ID NO: 1800233 - DNA, 16 bp, Homo sapiens
tcgctgccttgccatg

SEQ ID NO: 1800234 - DNA, 20 bp, Homo sapiens
tcgctggactctcagtctct

SEQ ID NO: 1800235 - DNA, 13 bp, Homo sapiens
tcgggcccttccc

SEQ ID NO: 1800236 - DNA, 14 bp, Homo sapiens
tcgtggtaggactg

SEQ ID NO: 1800237 - DNA, 21 bp, Homo sapiens
tcgtgtctggcacagcctggc

SEQ ID NO: 1800238 - DNA, 13 bp, Homo sapiens
tctaacctcatct

SEQ ID NO: 1800239 - DNA, 20 bp, Homo sapiens
tctaagagaacaatgtgcta

SEQ ID NO: 1800240 - DNA, 16 bp, Homo sapiens
tctacagagcttccct

SEQ ID NO: 1800241 - DNA, 20 bp, Homo sapiens
tctactttgaagtcatacca

SEQ ID NO: 1800242 - DNA, 15 bp, Homo sapiens
tctagttctgccagg

SEQ ID NO: 1800243 - DNA, 21 bp, Homo sapiens
tctagttgattgcgagaattt

SEQ ID NO: 1800244 - DNA, 14 bp, Homo sapiens
tctatttctcctcc

SEQ ID NO: 1800245 - DNA, 15 bp, Homo sapiens
tctatttctcctcca

SEQ ID NO: 1800246 - DNA, 23 bp, Homo sapiens
tctcaggaccaaagctttcatgt

SEQ ID NO: 1800247 - DNA, 11 bp, Homo sapiens
tctcagtctct

SEQ ID NO: 1800248 - DNA, 20 bp, Homo sapiens
tctcattggacccttccatg

SEQ ID NO: 1800249 - DNA, 14 bp, Homo sapiens
tgctaattctgagg

SEQ ID NO: 1800250 - DNA, 17 bp, Homo sapiens
tgctcaggtgcaagtgc

SEQ ID NO: 1800251 - DNA, 15 bp, Homo sapiens
tgctcatcattctct

SEQ ID NO: 1800252 - DNA, 15 bp, Homo sapiens
tgctccctcacatgt

SEQ ID NO: 1800253 - DNA, 13 bp, Homo sapiens
tgctctgatccct

SEQ ID NO: 1800254 - DNA, 16 bp, Homo sapiens
tgctgtggtgtgtccc

SEQ ID NO: 1800255 - DNA, 17 bp, Homo sapiens
tgctgtggtgtgtcccc

SEQ ID NO: 1800256 - DNA, 14 bp, Homo sapiens
tgcttgttggattt

SEQ ID NO: 1800257 - DNA, 18 bp, Homo sapiens
tgctttcgaactgctagt

SEQ ID NO: 1800258 - DNA, 21 bp, Homo sapiens
tggaacgtttttcctgttctt

SEQ ID NO: 1800259 - DNA, 22 bp, Homo sapiens
tggaattttctttcatacatta

SEQ ID NO: 1800260 - DNA, 23 bp, Homo sapiens
tggaattttctttcatacattat

SEQ ID NO: 1800261 - DNA, 15 bp, Homo sapiens
tggactctcagtctc

SEQ ID NO: 1800262 - DNA, 13 bp, Homo sapiens
tggagcagagggg

SEQ ID NO: 1800263 - DNA, 16 bp, Homo sapiens
tggagcagaggggctg

SEQ ID NO: 1800264 - DNA, 22 bp, Homo sapiens
tggcatccagagtccctgcctg

SEQ ID NO: 1800265 - DNA, 20 bp, Homo sapiens
tggctgtggcctaacctgcc

SEQ ID NO: 1800266 - DNA, 21 bp, Homo sapiens
tgggacaccccgacttttgtt

SEQ ID NO: 1800267 - DNA, 18 bp, Homo sapiens
tgggaggagggcaggcat

SEQ ID NO: 1800268 - DNA, 20 bp, Homo sapiens
tgggaggctcacccccttct

SEQ ID NO: 1800269 - DNA, 17 bp, Homo sapiens
tgggagggcagcagggc

SEQ ID NO: 1800270 - DNA, 19 bp, Homo sapiens
tgggattgagtctgtgcca

SEQ ID NO: 1800271 - DNA, 21 bp, Homo sapiens
tgggcaaagcctagtgaaggc

SEQ ID NO: 1800272 - DNA, 13 bp, Homo sapiens
tgggcagagccca

SEQ ID NO: 1800273 - DNA, 14 bp, Homo sapiens
tgggcagagcccaa

SEQ ID NO: 1800274 - DNA, 16 bp, Homo sapiens
tgggcaggagggaggt

SEQ ID NO: 1800275 - DNA, 18 bp, Homo sapiens
tgggcaggagggaggtgc

SEQ ID NO: 1800276 - DNA, 11 bp, Homo sapiens
tgggctgaggg

SEQ ID NO: 1800277 - DNA, 17 bp, Homo sapiens
tggggagactgggctga

SEQ ID NO: 1800278 - DNA, 21 bp, Homo sapiens
tggggagactgggctgaggga

SEQ ID NO: 1800279 - DNA, 13 bp, Homo sapiens
tggggagagacgg

SEQ ID NO: 1800280 - DNA, 20 bp, Homo sapiens
tggggagtttagggtggggg

SEQ ID NO: 1800281 - DNA, 18 bp, Homo sapiens
tggggcaggggccggggg

SEQ ID NO: 1800282 - DNA, 18 bp, Homo sapiens
tgggtccatgggcagagc

SEQ ID NO: 1800283 - DNA, 21 bp, Homo sapiens
tgggttttgtattctctgagc

SEQ ID NO: 1800284 - DNA, 17 bp, Homo sapiens
tggtaggactgtagaaa

SEQ ID NO: 1800285 - DNA, 14 bp, Homo sapiens
tggtatagaaatgc

SEQ ID NO: 1800286 - DNA, 19 bp, Homo sapiens
tggtcagccctagggtgga

SEQ ID NO: 1800287 - DNA, 22 bp, Homo sapiens
tggtcagccctagggtggagag

SEQ ID NO: 1800288 - DNA, 16 bp, Homo sapiens
tggtgtgatcgtctga

SEQ ID NO: 1800289 - DNA, 12 bp, Homo sapiens
tggttgaggaaa

SEQ ID NO: 1800290 - DNA, 16 bp, Homo sapiens
tgtaatccgaatctct

SEQ ID NO: 1800291 - DNA, 21 bp, Homo sapiens
tgtaatcttgaattgtaactg

SEQ ID NO: 1800292 - DNA, 14 bp, Homo sapiens
tgtacagtcttgta

SEQ ID NO: 1800293 - DNA, 17 bp, Homo sapiens
tgtacagtcttgtatta

SEQ ID NO: 1800294 - DNA, 12 bp, Homo sapiens
tgtacattatgt

SEQ ID NO: 1800295 - DNA, 20 bp, Homo sapiens
tgtagtgatttttatgccac

SEQ ID NO: 1800296 - DNA, 18 bp, Homo sapiens
tgtatgtctcgtggtagg

SEQ ID NO: 1800297 - DNA, 17 bp, Homo sapiens
tgtatgtgacaacattt

SEQ ID NO: 1800298 - DNA, 19 bp, Homo sapiens
tgtattctctgagctgtgc

SEQ ID NO: 1800299 - DNA, 13 bp, Homo sapiens
tgtcaagattttt

SEQ ID NO: 1800300 - DNA, 18 bp, Homo sapiens
tgtccacgactgtctcca

SEQ ID NO: 1800301 - DNA, 12 bp, Homo sapiens
tgtccctccggg

SEQ ID NO: 1800302 - DNA, 20 bp, Homo sapiens
tgtctcagcgaggtgtaaag

SEQ ID NO: 1800303 - DNA, 15 bp, Homo sapiens
tgtctccatggccct

SEQ ID NO: 1800304 - DNA, 17 bp, Homo sapiens
tgtctggcacagcctgg

SEQ ID NO: 1800305 - DNA, 22 bp, Homo sapiens
tgtgaaaatggtccaggagaag

SEQ ID NO: 1800306 - DNA, 12 bp, Homo sapiens
tgtgactctttc

SEQ ID NO: 1800307 - DNA, 14 bp, Homo sapiens
tgtgactctttcca

SEQ ID NO: 1800308 - DNA, 15 bp, Homo sapiens
tgtgactctttccaa

SEQ ID NO: 1800309 - DNA, 16 bp, Homo sapiens
tgtgaggccagggcag

SEQ ID NO: 1800310 - DNA, 14 bp, Homo sapiens
tgtgatgaatactg

SEQ ID NO: 1800311 - DNA, 19 bp, Homo sapiens
tgtgcagccgctgagcgag

SEQ ID NO: 1800312 - DNA, 20 bp, Homo sapiens
tgtgccttgtcacgccagac

SEQ ID NO: 1800313 - DNA, 15 bp, Homo sapiens
tgtggcctaacctgc

SEQ ID NO: 1800314 - DNA, 23 bp, Homo sapiens
tgtggtgtgtccccctctgtcca

SEQ ID NO: 1800315 - DNA, 18 bp, Homo sapiens
tgtgtccacgactgtctc

SEQ ID NO: 1800316 - DNA, 19 bp, Homo sapiens
tgtgtccacgactgtctcc

SEQ ID NO: 1800317 - DNA, 17 bp, Homo sapiens
tgtgtggaagaaggaaa

SEQ ID NO: 1800318 - DNA, 22 bp, Homo sapiens
tgtgtgtctaggcaggacctgt

SEQ ID NO: 1800319 - DNA, 15 bp, Homo sapiens
tgttaagtattttca

SEQ ID NO: 1800320 - DNA, 19 bp, Homo sapiens
tgttaataaaagtacatgt

SEQ ID NO: 1800321 - DNA, 15 bp, Homo sapiens
tgttacctgaaaaca

SEQ ID NO: 1800322 - DNA, 14 bp, Homo sapiens
tgttactgcagtga

SEQ ID NO: 1800323 - DNA, 16 bp, Homo sapiens
tgttactgcagtgacc

SEQ ID NO: 1800324 - DNA, 19 bp, Homo sapiens
tgttatcaccgtgggctcc

SEQ ID NO: 1800325 - DNA, 17 bp, Homo sapiens
tgttcacttttgacaaa

SEQ ID NO: 1800326 - DNA, 16 bp, Homo sapiens
tgttccccctgtgcag

SEQ ID NO: 1800327 - DNA, 14 bp, Homo sapiens
tgttccccttccac

SEQ ID NO: 1800328 - DNA, 17 bp, Homo sapiens
tgttctaagtctttcca

SEQ ID NO: 1800329 - DNA, 13 bp, Homo sapiens
tgttcttgaattt

SEQ ID NO: 1800330 - DNA, 12 bp, Homo sapiens
tgttgcaaaggg

SEQ ID NO: 1800331 - DNA, 16 bp, Homo sapiens
tgtttagaactactga

SEQ ID NO: 1800332 - DNA, 18 bp, Homo sapiens
tgtttggaatattgtcca

SEQ ID NO: 1800333 - DNA, 13 bp, Homo sapiens
tgttttcttcatt

SEQ ID NO: 1800334 - DNA, 13 bp, Homo sapiens
ttaaaatcctcaa

SEQ ID NO: 1800335 - DNA, 13 bp, Homo sapiens
ttaaaatgttcac

SEQ ID NO: 1800336 - DNA, 18 bp, Homo sapiens
ttaacaaagtaaaattaa

SEQ ID NO: 1800337 - DNA, 16 bp, Homo sapiens
ttaataaaagtacatg

SEQ ID NO: 1800338 - DNA, 23 bp, Homo sapiens
ttacacatttttcagatataaaa

SEQ ID NO: 1800339 - DNA, 24 bp, Homo sapiens
ttacattaaaatagcacatgattt

SEQ ID NO: 1800340 - DNA, 20 bp, Homo sapiens
ttacctgaaaacactgtgca

SEQ ID NO: 1800341 - DNA, 22 bp, Homo sapiens
ttacctgaaaacactgtgcaca

SEQ ID NO: 1800342 - DNA, 20 bp, Homo sapiens
ttactagggatccctcatct

SEQ ID NO: 1800343 - DNA, 14 bp, Homo sapiens
ttataattttccta

SEQ ID NO: 1800344 - DNA, 16 bp, Homo sapiens
ttataattttcctaat

SEQ ID NO: 1800345 - DNA, 23 bp, Homo sapiens
tttttgtacgttatatattgtat

SEQ ID NO: 1800346 - DNA, 21 bp, Homo sapiens
acttttgtgttactgcagtga

SEQ ID NO: 1800347 - DNA, 20 bp, Homo sapiens
agaaacaactctttgagaaa

SEQ ID NO: 1800348 - DNA, 19 bp, Homo sapiens
agaaagtggaaaacaagga

SEQ ID NO: 1800349 - DNA, 20 bp, Homo sapiens
agaaatgctggtttttcagt

SEQ ID NO: 1800350 - DNA, 23 bp, Homo sapiens
agaacttggatgtacctgccccc

SEQ ID NO: 1800351 - DNA, 19 bp, Homo sapiens
agaattttcaaataaggaa

SEQ ID NO: 1800352 - DNA, 19 bp, Homo sapiens
agacccagccctcatcccg

SEQ ID NO: 1800353 - DNA, 12 bp, Homo sapiens
agactgaccaat

SEQ ID NO: 1800354 - DNA, 12 bp, Homo sapiens
agactgattacc

SEQ ID NO: 1800355 - DNA, 19 bp, Homo sapiens
agacttcccacggctcctc

SEQ ID NO: 1800356 - DNA, 16 bp, Homo sapiens
agagattacctcctga

SEQ ID NO: 1800357 - DNA, 17 bp, Homo sapiens
agagctgtattaagcca

SEQ ID NO: 1800358 - DNA, 16 bp, Homo sapiens
agagcttccctgactc

SEQ ID NO: 1800359 - DNA, 16 bp, Homo sapiens
agaggaaggggccaga

SEQ ID NO: 1800360 - DNA, 14 bp, Homo sapiens
agaggccctcgctg

SEQ ID NO: 1800361 - DNA, 23 bp, Homo sapiens
agaggggaaaacaaaaatatctt

SEQ ID NO: 1800362 - DNA, 16 bp, Homo sapiens
agagggtgtcctgcac

SEQ ID NO: 1800363 - DNA, 12 bp, Homo sapiens
agataatgtgaa

SEQ ID NO: 1800364 - DNA, 18 bp, Homo sapiens
agatacagaactctttca

SEQ ID NO: 1800365 - DNA, 14 bp, Homo sapiens
agataccagcgagg

SEQ ID NO: 1800366 - DNA, 17 bp, Homo sapiens
agatatttttgtacgtt

SEQ ID NO: 1800367 - DNA, 19 bp, Homo sapiens
agatcccaacactgccagc

SEQ ID NO: 1800368 - DNA, 12 bp, Homo sapiens
agattctttccc

SEQ ID NO: 1800369 - DNA, 19 bp, Homo sapiens
agattttttttgtaacttc

SEQ ID NO: 1800370 - DNA, 14 bp, Homo sapiens
agcaattatattgt

SEQ ID NO: 1800371 - DNA, 14 bp, Homo sapiens
agcacctacagtgt

SEQ ID NO: 1800372 - DNA, 21 bp, Homo sapiens
agcacctacagtgtacagtct

SEQ ID NO: 1800373 - DNA, 15 bp, Homo sapiens
agcaggaaatgaaaa

SEQ ID NO: 1800374 - DNA, 21 bp, Homo sapiens
agcaggaaatgaaaatgtctt

SEQ ID NO: 1800375 - DNA, 23 bp, Homo sapiens
agcagggctaccctgagctgagg

SEQ ID NO: 1800376 - DNA, 20 bp, Homo sapiens
agcagtgaatgattcagtgt

SEQ ID NO: 1800377 - DNA, 15 bp, Homo sapiens
agcagtgtgaggcca

SEQ ID NO: 1800378 - DNA, 21 bp, Homo sapiens
agcagtgtgaggccagggcag

SEQ ID NO: 1800379 - DNA, 18 bp, Homo sapiens
agccaaagctatatgttg

SEQ ID NO: 1800380 - DNA, 12 bp, Homo sapiens
agccactcctct

SEQ ID NO: 1800381 - DNA, 15 bp, Homo sapiens
agccactcctctgac

SEQ ID NO: 1800382 - DNA, 18 bp, Homo sapiens
agccagcgtcctcctctg

SEQ ID NO: 1800383 - DNA, 19 bp, Homo sapiens
agccagcgtcctcctctgt

SEQ ID NO: 1800384 - DNA, 21 bp, Homo sapiens
agccagcgtcctcctctgtga

SEQ ID NO: 1800385 - DNA, 20 bp, Homo sapiens
agcccaaagtggtatagaaa

SEQ ID NO: 1800386 - DNA, 14 bp, Homo sapiens
agcccagctctgaa

SEQ ID NO: 1800387 - DNA, 23 bp, Homo sapiens
agccccgcgtggaactcgtgtct

SEQ ID NO: 1800388 - DNA, 17 bp, Homo sapiens
agccctagggtggagag

SEQ ID NO: 1800389 - DNA, 16 bp, Homo sapiens
agccgggtctgcctct

SEQ ID NO: 1800390 - DNA, 22 bp, Homo sapiens
agccgggtctgcctcttctggg

SEQ ID NO: 1800391 - DNA, 20 bp, Homo sapiens
agcctagtgaaggcttctct

SEQ ID NO: 1800392 - DNA, 22 bp, Homo sapiens
agcctcccctgccagggcaggg

SEQ ID NO: 1800393 - DNA, 18 bp, Homo sapiens
agcctgaccctcatcttt

SEQ ID NO: 1800394 - DNA, 19 bp, Homo sapiens
agcctgaccctcatctttc

SEQ ID NO: 1800395 - DNA, 17 bp, Homo sapiens
agcctggccccatggtc

SEQ ID NO: 1800396 - DNA, 15 bp, Homo sapiens
agcgaggaggctcca

SEQ ID NO: 1800397 - DNA, 17 bp, Homo sapiens
agcgtcctcctctgtga

SEQ ID NO: 1800398 - DNA, 12 bp, Homo sapiens
agctagaaatga

SEQ ID NO: 1800399 - DNA, 21 bp, Homo sapiens
agctcaggaaccgaggcaggg

SEQ ID NO: 1800400 - DNA, 22 bp, Homo sapiens
agctcaggaaccgaggcaggga

SEQ ID NO: 1800401 - DNA, 16 bp, Homo sapiens
agctccttaaggctct

SEQ ID NO: 1800402 - DNA, 22 bp, Homo sapiens
agctccttaaggctcttttgta

SEQ ID NO: 1800403 - DNA, 19 bp, Homo sapiens
agctccttcctggagactg

SEQ ID NO: 1800404 - DNA, 21 bp, Homo sapiens
agctgggacaccccgactttt

SEQ ID NO: 1800405 - DNA, 19 bp, Homo sapiens
agctgtgcaggtggggaga

SEQ ID NO: 1800406 - DNA, 19 bp, Homo sapiens
aggaaaagtgcaatgcgtg

SEQ ID NO: 1800407 - DNA, 19 bp, Homo sapiens
aggaaatgaaaatgtcttg

SEQ ID NO: 1800408 - DNA, 19 bp, Homo sapiens
aggaacccttacagtagga

SEQ ID NO: 1800409 - DNA, 16 bp, Homo sapiens
aggaaccgaggcaggg

SEQ ID NO: 1800410 - DNA, 16 bp, Homo sapiens
aggaaggggccagagg

SEQ ID NO: 1800411 - DNA, 20 bp, Homo sapiens
aggaaggggccagaggctcg

SEQ ID NO: 1800412 - DNA, 19 bp, Homo sapiens
aggaccagtcaacctgggc

SEQ ID NO: 1800413 - DNA, 22 bp, Homo sapiens
aggagatgctccttgggccctt

SEQ ID NO: 1800414 - DNA, 15 bp, Homo sapiens
aggagccccattcct

SEQ ID NO: 1800415 - DNA, 18 bp, Homo sapiens
aggagtgggttgatttca

SEQ ID NO: 1800416 - DNA, 22 bp, Homo sapiens
aggcaaacccatcaacaaaaat

SEQ ID NO: 1800417 - DNA, 23 bp, Homo sapiens
aggcactgagataccagcgagga

SEQ ID NO: 1800418 - DNA, 16 bp, Homo sapiens
aggcattgccaagggc

SEQ ID NO: 1800419 - DNA, 18 bp, Homo sapiens
aggcattgccaagggctt

SEQ ID NO: 1800420 - DNA, 20 bp, Homo sapiens
aggcattgccaagggctttg

SEQ ID NO: 1800421 - DNA, 18 bp, Homo sapiens
aggcgaagcgttgtcctc

SEQ ID NO: 1800422 - DNA, 22 bp, Homo sapiens
aggcttaaggagaggagaaact

SEQ ID NO: 1800423 - DNA, 18 bp, Homo sapiens
agggaaaattatttgcat

SEQ ID NO: 1800424 - DNA, 15 bp, Homo sapiens
agggaaggatcccat

SEQ ID NO: 1800425 - DNA, 13 bp, Homo sapiens
agggaagggcctg

SEQ ID NO: 1800426 - DNA, 16 bp, Homo sapiens
agggaagggcctgcca

SEQ ID NO: 1800427 - DNA, 18 bp, Homo sapiens
agggaagggcctgccaca

SEQ ID NO: 1800428 - DNA, 18 bp, Homo sapiens
agggacagaaaagaaagc

SEQ ID NO: 1800429 - DNA, 18 bp, Homo sapiens
agggacgcctgggggtgc

SEQ ID NO: 1800430 - DNA, 23 bp, Homo sapiens
agggacgcctgggggtgccagga

SEQ ID NO: 1800431 - DNA, 16 bp, Homo sapiens
agggatccctcatctg

SEQ ID NO: 1800432 - DNA, 22 bp, Homo sapiens
agggatccctcatctgtccctc

SEQ ID NO: 1800433 - DNA, 18 bp, Homo sapiens
agggctttgttttgcaca

SEQ ID NO: 1800434 - DNA, 13 bp, Homo sapiens
aggggccagaggc

SEQ ID NO: 1800435 - DNA, 14 bp, Homo sapiens
aggggtctgagcca

SEQ ID NO: 1800436 - DNA, 19 bp, Homo sapiens
agggtcagacgcctgagga

SEQ ID NO: 1800437 - DNA, 21 bp, Homo sapiens
agggtcagacgcctgaggaac

SEQ ID NO: 1800438 - DNA, 22 bp, Homo sapiens
aggtaactatcaatatttaagt

SEQ ID NO: 1800439 - DNA, 21 bp, Homo sapiens
aggtgctacacccttttccag

SEQ ID NO: 1800440 - DNA, 18 bp, Homo sapiens
aggtggggagactgggct

SEQ ID NO: 1800441 - DNA, 21 bp, Homo sapiens
aggtggggagactgggctgag

SEQ ID NO: 1800442 - DNA, 14 bp, Homo sapiens
aggtgtaaagttgt

SEQ ID NO: 1800443 - DNA, 23 bp, Homo sapiens
aggttccgcttggagcagagggg

SEQ ID NO: 1800444 - DNA, 22 bp, Homo sapiens
agtaacaaaagtatagttttga

SEQ ID NO: 1800445 - DNA, 14 bp, Homo sapiens
agtacatgttaaac

SEQ ID NO: 1800446 - DNA, 16 bp, Homo sapiens
agtatttcaaattgga

SEQ ID NO: 1800447 - DNA, 17 bp, Homo sapiens
agtcataccaatgaaaa

SEQ ID NO: 1800448 - DNA, 17 bp, Homo sapiens
agtccacttttaaaact

SEQ ID NO: 1800449 - DNA, 16 bp, Homo sapiens
agtctctgagcagtga

SEQ ID NO: 1800450 - DNA, 17 bp, Homo sapiens
agtcttccatttgcaag

SEQ ID NO: 1800451 - DNA, 16 bp, Homo sapiens
agtcttgtattaagtt

SEQ ID NO: 1800452 - DNA, 18 bp, Homo sapiens
agtcttgtattaagttgt

SEQ ID NO: 1800453 - DNA, 16 bp, Homo sapiens
agtgatttttatgcca

SEQ ID NO: 1800454 - DNA, 21 bp, Homo sapiens
agtgatttttatgccacctga

SEQ ID NO: 1800455 - DNA, 19 bp, Homo sapiens
agtgcaatgcgtgttgtac

SEQ ID NO: 1800456 - DNA, 15 bp, Homo sapiens
agtgcgtccacgagc

SEQ ID NO: 1800457 - DNA, 11 bp, Homo sapiens
agtgctctgat

SEQ ID NO: 1800458 - DNA, 15 bp, Homo sapiens
agtgtgaggccaggg

SEQ ID NO: 1800459 - DNA, 15 bp, Homo sapiens
agtgttaaatgtgat

SEQ ID NO: 1800460 - DNA, 16 bp, Homo sapiens
agtgttccccttccac

SEQ ID NO: 1800461 - DNA, 20 bp, Homo sapiens
agttcttagttgctgtatgt

SEQ ID NO: 1800462 - DNA, 21 bp, Homo sapiens
agttgatcgcctttcccaggt

SEQ ID NO: 1800463 - DNA, 19 bp, Homo sapiens
agttgattgcgagaatttt

SEQ ID NO: 1800464 - DNA, 12 bp, Homo sapiens
agtttagggtgg

SEQ ID NO: 1800465 - DNA, 15 bp, Homo sapiens
agtttttattgcttg

SEQ ID NO: 1800466 - DNA, 12 bp, Homo sapiens
ataaataacttt

SEQ ID NO: 1800467 - DNA, 20 bp, Homo sapiens
ataaccaaagcccaaagtgg

SEQ ID NO: 1800468 - DNA, 14 bp, Homo sapiens
ataatctatttaca

SEQ ID NO: 1800469 - DNA, 15 bp, Homo sapiens
ataatctatttacat

SEQ ID NO: 1800470 - DNA, 13 bp, Homo sapiens
ataatgtgaaaat

SEQ ID NO: 1800471 - DNA, 14 bp, Homo sapiens
atacagaatgaatc

SEQ ID NO: 1800472 - DNA, 19 bp, Homo sapiens
ataccaatgaaaaaatgta

SEQ ID NO: 1800473 - DNA, 13 bp, Homo sapiens
atacgataaataa

SEQ ID NO: 1800474 - DNA, 19 bp, Homo sapiens
atactgtattttgtattgt

SEQ ID NO: 1800475 - DNA, 16 bp, Homo sapiens
atacttttgccctttg

SEQ ID NO: 1800476 - DNA, 20 bp, Homo sapiens
atagataagagtagaaactg

SEQ ID NO: 1800477 - DNA, 17 bp, Homo sapiens
atagcacatgattttct

SEQ ID NO: 1800478 - DNA, 23 bp, Homo sapiens
atagcacatgattttcttttgtt

SEQ ID NO: 1800479 - DNA, 17 bp, Homo sapiens
atataaattttttttgt

SEQ ID NO: 1800480 - DNA, 13 bp, Homo sapiens
atatgcacttata

SEQ ID NO: 1800481 - DNA, 23 bp, Homo sapiens
atattccctagaaacttccaaat

SEQ ID NO: 1800482 - DNA, 21 bp, Homo sapiens
atattcctctaaaactctcaa

SEQ ID NO: 1800483 - DNA, 13 bp, Homo sapiens
atattgatgtgtg

SEQ ID NO: 1800484 - DNA, 14 bp, Homo sapiens
atattgtacagttt

SEQ ID NO: 1800485 - DNA, 15 bp, Homo sapiens
atatttaagtttgtt

SEQ ID NO: 1800486 - DNA, 14 bp, Homo sapiens
atatttatttatgt

SEQ ID NO: 1800487 - DNA, 23 bp, Homo sapiens
atatttttgtacgttatatattg

SEQ ID NO: 1800488 - DNA, 16 bp, Homo sapiens
atcaacaaaaattgtc

SEQ ID NO: 1800489 - DNA, 14 bp, Homo sapiens
atcacgtaaagcta

SEQ ID NO: 1800490 - DNA, 17 bp, Homo sapiens
atcagctccttcctgga

SEQ ID NO: 1800491 - DNA, 16 bp, Homo sapiens
atcaggacccagagga

SEQ ID NO: 1800492 - DNA, 21 bp, Homo sapiens
atcattctctgtctcatccat

SEQ ID NO: 1800493 - DNA, 15 bp, Homo sapiens
atcatttctatttct

SEQ ID NO: 1800494 - DNA, 20 bp, Homo sapiens
atccagagtccctgcctgga

SEQ ID NO: 1800495 - DNA, 14 bp, Homo sapiens
atccatcatcatgt

SEQ ID NO: 1800496 - DNA, 11 bp, Homo sapiens
atcccaacact

SEQ ID NO: 1800497 - DNA, 17 bp, Homo sapiens
atccctcatctgtccct

SEQ ID NO: 1800498 - DNA, 20 bp, Homo sapiens
atccctctacagagcttccc

SEQ ID NO: 1800499 - DNA, 22 bp, Homo sapiens
atccctctacagagcttccctg

SEQ ID NO: 1800500 - DNA, 21 bp, Homo sapiens
atccgtctttggcctcctcca

SEQ ID NO: 1800501 - DNA, 12 bp, Homo sapiens
atcctatgtttt

SEQ ID NO: 1800502 - DNA, 12 bp, Homo sapiens
atcctcaatcca

SEQ ID NO: 1800503 - DNA, 18 bp, Homo sapiens
atcggggagccgggagcc

SEQ ID NO: 1800504 - DNA, 18 bp, Homo sapiens
atctaacctcatcttctt

SEQ ID NO: 1800505 - DNA, 15 bp, Homo sapiens
atctcattggaccct

SEQ ID NO: 1800506 - DNA, 19 bp, Homo sapiens
atctcccagataatgtgaa

SEQ ID NO: 1800507 - DNA, 20 bp, Homo sapiens
atctcccagataatgtgaaa

SEQ ID NO: 1800508 - DNA, 22 bp, Homo sapiens
atctgtcaaagaaaacttccaa

SEQ ID NO: 1800509 - DNA, 15 bp, Homo sapiens
atcttaaaattcttg

SEQ ID NO: 1800510 - DNA, 16 bp, Homo sapiens
atgaaaaaatgtatat

SEQ ID NO: 1800511 - DNA, 13 bp, Homo sapiens
atgaaaatgtctt

SEQ ID NO: 1800512 - DNA, 14 bp, Homo sapiens
atgaaaatgtcttg

SEQ ID NO: 1800513 - DNA, 15 bp, Homo sapiens
atgaaaatgtcttgt

SEQ ID NO: 1800514 - DNA, 21 bp, Homo sapiens
atgaatactgtattttgtatt

SEQ ID NO: 1800515 - DNA, 12 bp, Homo sapiens
atgaattgatga

SEQ ID NO: 1800516 - DNA, 16 bp, Homo sapiens
atgaattgatgactat

SEQ ID NO: 1800517 - DNA, 19 bp, Homo sapiens
atgagctccttaaggctct

SEQ ID NO: 1800518 - DNA, 16 bp, Homo sapiens
atgattcagtgttaaa

SEQ ID NO: 1800519 - DNA, 14 bp, Homo sapiens
atgattttcttttg

SEQ ID NO: 1800520 - DNA, 20 bp, Homo sapiens
atggcagaaggcaaacccat

SEQ ID NO: 1800521 - DNA, 22 bp, Homo sapiens
gtatcaggacccagaggaaggg

SEQ ID NO: 1800522 - DNA, 18 bp, Homo sapiens
gtattttgtattgtttca

SEQ ID NO: 1800523 - DNA, 19 bp, Homo sapiens
gtcaacctgggcaaagcct

SEQ ID NO: 1800524 - DNA, 22 bp, Homo sapiens
gtcaagattttttttgtaactt

SEQ ID NO: 1800525 - DNA, 13 bp, Homo sapiens
gtcacctgtgctt

SEQ ID NO: 1800526 - DNA, 13 bp, Homo sapiens
gtcagccctaggg

SEQ ID NO: 1800527 - DNA, 22 bp, Homo sapiens
gtcagccctagggtggagagcc

SEQ ID NO: 1800528 - DNA, 22 bp, Homo sapiens
gtcagctgggacaccccgactt

SEQ ID NO: 1800529 - DNA, 22 bp, Homo sapiens
gtcagtaccttcaaactagggc

SEQ ID NO: 1800530 - DNA, 15 bp, Homo sapiens
gtcataccaatgaaa

SEQ ID NO: 1800531 - DNA, 15 bp, Homo sapiens
gtccacgactgtctc

SEQ ID NO: 1800532 - DNA, 15 bp, Homo sapiens
gtccatcagcctcca

SEQ ID NO: 1800533 - DNA, 23 bp, Homo sapiens
gtccatgggcagagcccaaggga

SEQ ID NO: 1800534 - DNA, 22 bp, Homo sapiens
gtcccgggacacctaggctagg

SEQ ID NO: 1800535 - DNA, 21 bp, Homo sapiens
gtccctgcctggaccagcctc

SEQ ID NO: 1800536 - DNA, 15 bp, Homo sapiens
gtcctcccctatttt

SEQ ID NO: 1800537 - DNA, 18 bp, Homo sapiens
gtcctcccctattttaag

SEQ ID NO: 1800538 - DNA, 12 bp, Homo sapiens
gtcctcctctgt

SEQ ID NO: 1800539 - DNA, 13 bp, Homo sapiens
gtcctcctctgtg

SEQ ID NO: 1800540 - DNA, 19 bp, Homo sapiens
gtcctgcaccggggcctgg

SEQ ID NO: 1800541 - DNA, 14 bp, Homo sapiens
gtcgatagagctgt

SEQ ID NO: 1800542 - DNA, 16 bp, Homo sapiens
gtctccctcctctgcc

SEQ ID NO: 1800543 - DNA, 13 bp, Homo sapiens
gtctgagagaggc

SEQ ID NO: 1800544 - DNA, 15 bp, Homo sapiens
gtctgagagaggcca

SEQ ID NO: 1800545 - DNA, 18 bp, Homo sapiens
gtctgagagaggccattc

SEQ ID NO: 1800546 - DNA, 19 bp, Homo sapiens
gtctggcacagcctggctg

SEQ ID NO: 1800547 - DNA, 22 bp, Homo sapiens
gtgaaggcttctctctgtggga

SEQ ID NO: 1800548 - DNA, 18 bp, Homo sapiens
gtgaatcacgtaaagcta

SEQ ID NO: 1800549 - DNA, 22 bp, Homo sapiens
gtgacaacatttttgtacatta

SEQ ID NO: 1800550 - DNA, 16 bp, Homo sapiens
gtgaccaatgtcttga

SEQ ID NO: 1800551 - DNA, 20 bp, Homo sapiens
gtgagacccagccctcatcc

SEQ ID NO: 1800552 - DNA, 14 bp, Homo sapiens
gtgaggccagggca

SEQ ID NO: 1800553 - DNA, 14 bp, Homo sapiens
gtgatgaatactgt

SEQ ID NO: 1800554 - DNA, 16 bp, Homo sapiens
gtgatttttatgccac

SEQ ID NO: 1800555 - DNA, 16 bp, Homo sapiens
gtgcagtcctgatcag

SEQ ID NO: 1800556 - DNA, 13 bp, Homo sapiens
gtgccaggaccag

SEQ ID NO: 1800557 - DNA, 19 bp, Homo sapiens
gtgccttgtcacgccagac

SEQ ID NO: 1800558 - DNA, 21 bp, Homo sapiens
gtgctacacccttttccagct

SEQ ID NO: 1800559 - DNA, 19 bp, Homo sapiens
gtgctgcctctacctgaca

SEQ ID NO: 1800560 - DNA, 22 bp, Homo sapiens
gtgcttctagttctgccaggag

SEQ ID NO: 1800561 - DNA, 17 bp, Homo sapiens
gtggcactggggcaggg

SEQ ID NO: 1800562 - DNA, 22 bp, Homo sapiens
gtggcctaacctgccgagagtc

SEQ ID NO: 1800563 - DNA, 13 bp, Homo sapiens
gtgggctccctga

SEQ ID NO: 1800564 - DNA, 14 bp, Homo sapiens
gtgggctccctgac

SEQ ID NO: 1800565 - DNA, 15 bp, Homo sapiens
gtgggctccctgact

SEQ ID NO: 1800566 - DNA, 14 bp, Homo sapiens
gtggtatagaaatg

SEQ ID NO: 1800567 - DNA, 14 bp, Homo sapiens
gtggtggctcggga

SEQ ID NO: 1800568 - DNA, 19 bp, Homo sapiens
gtgtctaggcaggacctgt

SEQ ID NO: 1800569 - DNA, 15 bp, Homo sapiens
gtgtgaggccagggc

SEQ ID NO: 1800570 - DNA, 14 bp, Homo sapiens
gtgtgatcgtctga

SEQ ID NO: 1800571 - DNA, 16 bp, Homo sapiens
gtgtgcaccagggttg

SEQ ID NO: 1800572 - DNA, 17 bp, Homo sapiens
gtgtgtccccctctgtc

SEQ ID NO: 1800573 - DNA, 16 bp, Homo sapiens
gtgttagggaagggcc

SEQ ID NO: 1800574 - DNA, 23 bp, Homo sapiens
gtgttagggaagggcctgccaca

SEQ ID NO: 1800575 - DNA, 17 bp, Homo sapiens
gttacacatttttcaga

SEQ ID NO: 1800576 - DNA, 15 bp, Homo sapiens
gttataaagatacag

SEQ ID NO: 1800577 - DNA, 21 bp, Homo sapiens
gttatatattgtattaagggc

SEQ ID NO: 1800578 - DNA, 22 bp, Homo sapiens
gttatcaccgtgggctccctga

SEQ ID NO: 1800579 - DNA, 16 bp, Homo sapiens
gttattggaattttct

SEQ ID NO: 1800580 - DNA, 12 bp, Homo sapiens
gttcaaagccag

SEQ ID NO: 1800581 - DNA, 16 bp, Homo sapiens
gttcacttttgacaaa

SEQ ID NO: 1800582 - DNA, 19 bp, Homo sapiens
gttctaagtctttccattg

SEQ ID NO: 1800583 - DNA, 14 bp, Homo sapiens
gttctgccaggaga

SEQ ID NO: 1800584 - DNA, 16 bp, Homo sapiens
gttcttaagacgtgat

SEQ ID NO: 1800585 - DNA, 22 bp, Homo sapiens
gttcttagctgaacaatgaatg

SEQ ID NO: 1800586 - DNA, 18 bp, Homo sapiens
gttgattgcgagaatttt

SEQ ID NO: 1800587 - DNA, 20 bp, Homo sapiens
gttggatttttgtcttgtgt

SEQ ID NO: 1800588 - DNA, 15 bp, Homo sapiens
gttgttaataaaagt

SEQ ID NO: 1800589 - DNA, 12 bp, Homo sapiens
gttttgtattct

SEQ ID NO: 1800590 - DNA, 14 bp, Homo sapiens
gtttttcagttttc

SEQ ID NO: 1800591 - DNA, 19 bp, Homo sapiens
taaaagcaattatattgtc

SEQ ID NO: 1800592 - DNA, 20 bp, Homo sapiens
taaaagtacatgttaaactt

SEQ ID NO: 1800593 - DNA, 22 bp, Homo sapiens
taaaatgttcacttttgacaaa

SEQ ID NO: 1800594 - DNA, 17 bp, Homo sapiens
taaaattcttgggagtg

SEQ ID NO: 1800595 - DNA, 14 bp, Homo sapiens
taaactgtgcacca

SEQ ID NO: 1800596 - DNA, 22 bp, Homo sapiens
taaataagaaacaactctttga

SEQ ID NO: 1800597 - DNA, 13 bp, Homo sapiens
taaatacagtctt

SEQ ID NO: 1800598 - DNA, 23 bp, Homo sapiens
taaatacagtcttccatttgcaa

SEQ ID NO: 1800599 - DNA, 19 bp, Homo sapiens
taaatgtgatgaatactgt

SEQ ID NO: 1800600 - DNA, 15 bp, Homo sapiens
taacatgtaggaagt

SEQ ID NO: 1800601 - DNA, 19 bp, Homo sapiens
taccagagaaaaagggagg

SEQ ID NO: 1800602 - DNA, 16 bp, Homo sapiens
taccctgagctgaggc

SEQ ID NO: 1800603 - DNA, 18 bp, Homo sapiens
taccctgagctgaggcag

SEQ ID NO: 1800604 - DNA, 23 bp, Homo sapiens
tactaacaatcagctccttcctg

SEQ ID NO: 1800605 - DNA, 14 bp, Homo sapiens
tactatggctgttt

SEQ ID NO: 1800606 - DNA, 15 bp, Homo sapiens
tactgcagtgacctg

SEQ ID NO: 1800607 - DNA, 16 bp, Homo sapiens
tacttgaactttccaa

SEQ ID NO: 1800608 - DNA, 23 bp, Homo sapiens
tacttgccttattagagtgtctt

SEQ ID NO: 1800609 - DNA, 23 bp, Homo sapiens
tagaaaatttgttattttgcaac

SEQ ID NO: 1800610 - DNA, 15 bp, Homo sapiens
tagaaacttccaaat

SEQ ID NO: 1800611 - DNA, 18 bp, Homo sapiens
tagagattacctcctgag

SEQ ID NO: 1800612 - DNA, 19 bp, Homo sapiens
tagagattacctcctgaga

SEQ ID NO: 1800613 - DNA, 21 bp, Homo sapiens
tagatgttctaagtctttcca

SEQ ID NO: 1800614 - DNA, 13 bp, Homo sapiens
tagcacatgattt

SEQ ID NO: 1800615 - DNA, 15 bp, Homo sapiens
tagctcatgtatatt

SEQ ID NO: 1800616 - DNA, 17 bp, Homo sapiens
tagctgaacaatgaatg

SEQ ID NO: 1800617 - DNA, 18 bp, Homo sapiens
taggataaattacattaa

SEQ ID NO: 1800618 - DNA, 19 bp, Homo sapiens
taggataaattacattaaa

SEQ ID NO: 1800619 - DNA, 15 bp, Homo sapiens
taggcaggacctgtg

SEQ ID NO: 1800620 - DNA, 23 bp, Homo sapiens
tagggccaagcccagcactgctt

SEQ ID NO: 1800621 - DNA, 20 bp, Homo sapiens
tagtgatttttatgccacct

SEQ ID NO: 1800622 - DNA, 21 bp, Homo sapiens
tagtgatttttatgccacctg

SEQ ID NO: 1800623 - DNA, 22 bp, Homo sapiens
tagttgattgcgagaattttca

SEQ ID NO: 1800624 - DNA, 21 bp, Homo sapiens
tataaattttttttgtttcat

SEQ ID NO: 1800625 - DNA, 22 bp, Homo sapiens
tataagccaaagctatatgttg

SEQ ID NO: 1800626 - DNA, 15 bp, Homo sapiens
tataatctatttaca

SEQ ID NO: 1800627 - DNA, 20 bp, Homo sapiens
tatacgcagcgtgctttaaa

SEQ ID NO: 1800628 - DNA, 13 bp, Homo sapiens
tataggataaatt

SEQ ID NO: 1800629 - DNA, 14 bp, Homo sapiens
tataggataaatta

SEQ ID NO: 1800630 - DNA, 18 bp, Homo sapiens
tataggataaattacatt

SEQ ID NO: 1800631 - DNA, 20 bp, Homo sapiens
tataggataaattacattaa

SEQ ID NO: 1800632 - DNA, 22 bp, Homo sapiens
tataggataaattacattaaaa

SEQ ID NO: 1800633 - DNA, 23 bp, Homo sapiens
tatataaattttttttgtttcat

SEQ ID NO: 1800634 - DNA, 12 bp, Homo sapiens
tatatattgtat

SEQ ID NO: 1800635 - DNA, 23 bp, Homo sapiens
tatcaccgtgggctccctgactg

SEQ ID NO: 1800636 - DNA, 20 bp, Homo sapiens
tatcaggacccagaggaagg

SEQ ID NO: 1800637 - DNA, 18 bp, Homo sapiens
tatccaggtaatccaaga

SEQ ID NO: 1800638 - DNA, 19 bp, Homo sapiens
tatgcacttataattttcc

SEQ ID NO: 1800639 - DNA, 20 bp, Homo sapiens
tatgcacttataattttcct

SEQ ID NO: 1800640 - DNA, 22 bp, Homo sapiens
tatgcacttataattttcctaa

SEQ ID NO: 1800641 - DNA, 11 bp, Homo sapiens
tatgtaacatg

SEQ ID NO: 1800642 - DNA, 12 bp, Homo sapiens
tatgtaacatgt

SEQ ID NO: 1800643 - DNA, 14 bp, Homo sapiens
tatgtgacaacatt

SEQ ID NO: 1800644 - DNA, 16 bp, Homo sapiens
tatgtgacaacatttt

SEQ ID NO: 1800645 - DNA, 22 bp, Homo sapiens
tatgtgacaacatttttgtaca

SEQ ID NO: 1800646 - DNA, 15 bp, Homo sapiens
tatgtttttgttcaa

SEQ ID NO: 1800647 - DNA, 16 bp, Homo sapiens
tatgtttttgttcaaa

SEQ ID NO: 1800648 - DNA, 15 bp, Homo sapiens
tattgtacagttttt

SEQ ID NO: 1800649 - DNA, 12 bp, Homo sapiens
tattgtattaag

SEQ ID NO: 1800650 - DNA, 14 bp, Homo sapiens
tatttatttatgta

SEQ ID NO: 1800651 - DNA, 22 bp, Homo sapiens
tatttgcataacaattcctcta

SEQ ID NO: 1800652 - DNA, 11 bp, Homo sapiens
tatttttgtac

SEQ ID NO: 1800653 - DNA, 14 bp, Homo sapiens
tatttttgtacgtt

SEQ ID NO: 1800654 - DNA, 18 bp, Homo sapiens
tcaaatatagagatattt

SEQ ID NO: 1800655 - DNA, 15 bp, Homo sapiens
tcaacaaaaattgtc

SEQ ID NO: 1800656 - DNA, 18 bp, Homo sapiens
tcaacaaaaattgtccct

SEQ ID NO: 1800657 - DNA, 13 bp, Homo sapiens
tcaacctgcctga

SEQ ID NO: 1800658 - DNA, 18 bp, Homo sapiens
tcaacctgggcaaagcct

SEQ ID NO: 1800659 - DNA, 20 bp, Homo sapiens
tcaagattttttttgtaact

SEQ ID NO: 1800660 - DNA, 22 bp, Homo sapiens
tcaagattttttttgtaacttc

SEQ ID NO: 1800661 - DNA, 17 bp, Homo sapiens
tcaatatttaagtttgt

SEQ ID NO: 1800662 - DNA, 17 bp, Homo sapiens
tcaattgcatctcccag

SEQ ID NO: 1800663 - DNA, 22 bp, Homo sapiens
tcaattgcatctcccagataat

SEQ ID NO: 1800664 - DNA, 17 bp, Homo sapiens
tcaccatttgattatgt

SEQ ID NO: 1800665 - DNA, 17 bp, Homo sapiens
tcaccgtgggctccctg

SEQ ID NO: 1800666 - DNA, 18 bp, Homo sapiens
tcaccgtgggctccctga

SEQ ID NO: 1800667 - DNA, 21 bp, Homo sapiens
tcacctgtgcttcgggccctt

SEQ ID NO: 1800668 - DNA, 19 bp, Homo sapiens
tcacgtaaagctagaaatg

SEQ ID NO: 1800669 - DNA, 22 bp, Homo sapiens
tcacttctggcactgtgactac

SEQ ID NO: 1800670 - DNA, 16 bp, Homo sapiens
tcagacgcctgaggaa

SEQ ID NO: 1800671 - DNA, 17 bp, Homo sapiens
tcagacgcctgaggaac

SEQ ID NO: 1800672 - DNA, 15 bp, Homo sapiens
tcagacttacttact

SEQ ID NO: 1800673 - DNA, 19 bp, Homo sapiens
tcagagggtgtcctgcacc

SEQ ID NO: 1800674 - DNA, 14 bp, Homo sapiens
tcagatataaaaga

SEQ ID NO: 1800675 - DNA, 20 bp, Homo sapiens
tcagatataaaagactgacc

SEQ ID NO: 1800676 - DNA, 21 bp, Homo sapiens
tcagcacctacagtgtacagt

SEQ ID NO: 1800677 - DNA, 19 bp, Homo sapiens
tcagccctagggtggagag

SEQ ID NO: 1800678 - DNA, 23 bp, Homo sapiens
tcagccctagggtggagagccac

SEQ ID NO: 1800679 - DNA, 15 bp, Homo sapiens
tcagctccttcctgg

SEQ ID NO: 1800680 - DNA, 17 bp, Homo sapiens
tcagctccttcctggag

SEQ ID NO: 1800681 - DNA, 15 bp, Homo sapiens
tcaggacccagagga

SEQ ID NO: 1800682 - DNA, 14 bp, Homo sapiens
tcagggctcctggg

SEQ ID NO: 1800683 - DNA, 19 bp, Homo sapiens
tcagtgctccctcacatgt

SEQ ID NO: 1800684 - DNA, 16 bp, Homo sapiens
tcagttttcaggagtg

SEQ ID NO: 1800685 - DNA, 20 bp, Homo sapiens
tcataagtatttcaaattgg

SEQ ID NO: 1800686 - DNA, 14 bp, Homo sapiens
tcatacattatatt

SEQ ID NO: 1800687 - DNA, 18 bp, Homo sapiens
tcatcattctctgtctca

SEQ ID NO: 1800688 - DNA, 19 bp, Homo sapiens
tcatcattctctgtctcat

SEQ ID NO: 1800689 - DNA, 22 bp, Homo sapiens
tcatcattctctgtctcatcca

SEQ ID NO: 1800690 - DNA, 16 bp, Homo sapiens
tcatccatcatcatgt

SEQ ID NO: 1800691 - DNA, 17 bp, Homo sapiens
tcatccatcatcatgtg

SEQ ID NO: 1800692 - DNA, 23 bp, Homo sapiens
tcatcccgagcacctccacatcc

SEQ ID NO: 1800693 - DNA, 22 bp, Homo sapiens
tcatctcctgccttcctcctgg

SEQ ID NO: 1800694 - DNA, 16 bp, Homo sapiens
tcatcttcttcaccat

SEQ ID NO: 1800695 - DNA, 14 bp, Homo sapiens
tcatctttcttcca

SEQ ID NO: 1800696 - DNA, 16 bp, Homo sapiens
tcatgtaaactgtgca

SEQ ID NO: 1800697 - DNA, 16 bp, Homo sapiens
tcatgtgtgtccacga

SEQ ID NO: 1800698 - DNA, 18 bp, Homo sapiens
tcattctctgtctcatcc

SEQ ID NO: 1800699 - DNA, 19 bp, Homo sapiens
tcattctctgtctcatcca

SEQ ID NO: 1800700 - DNA, 18 bp, Homo sapiens
tcattctgaaggagcccc

SEQ ID NO: 1800701 - DNA, 22 bp, Homo sapiens
tccaagatattttaaaatctgt

SEQ ID NO: 1800702 - DNA, 15 bp, Homo sapiens
tccacatgggagccg

SEQ ID NO: 1800703 - DNA, 14 bp, Homo sapiens
tccacgactgtctc

SEQ ID NO: 1800704 - DNA, 17 bp, Homo sapiens
tccacgactgtctccat

SEQ ID NO: 1800705 - DNA, 18 bp, Homo sapiens
tccacgactgtctccatg

SEQ ID NO: 1800706 - DNA, 15 bp, Homo sapiens
tccacggagccactc

SEQ ID NO: 1800707 - DNA, 14 bp, Homo sapiens
atgggcagagccca

SEQ ID NO: 1800708 - DNA, 15 bp, Homo sapiens
atgtacatacatata

SEQ ID NO: 1800709 - DNA, 19 bp, Homo sapiens
atgtctcgtggtaggactg

SEQ ID NO: 1800710 - DNA, 10 bp, Homo sapiens
atgtcttgtg

SEQ ID NO: 1800711 - DNA, 21 bp, Homo sapiens
atgtgtgggtgtgtgttacat

SEQ ID NO: 1800712 - DNA, 23 bp, Homo sapiens
atgtgtgtccacgactgtctcca

SEQ ID NO: 1800713 - DNA, 17 bp, Homo sapiens
atgttattggaattttc

SEQ ID NO: 1800714 - DNA, 19 bp, Homo sapiens
atgttctaagtctttccat

SEQ ID NO: 1800715 - DNA, 22 bp, Homo sapiens
atgtttgtacttttgtgttact

SEQ ID NO: 1800716 - DNA, 17 bp, Homo sapiens
attagagtgtctttcca

SEQ ID NO: 1800717 - DNA, 17 bp, Homo sapiens
attatgttattggaatt

SEQ ID NO: 1800718 - DNA, 14 bp, Homo sapiens
attattcagtgtca

SEQ ID NO: 1800719 - DNA, 21 bp, Homo sapiens
attatttcaaccgcttgccat

SEQ ID NO: 1800720 - DNA, 20 bp, Homo sapiens
attcacatctaacctcatct

SEQ ID NO: 1800721 - DNA, 14 bp, Homo sapiens
attcagtgtcactg

SEQ ID NO: 1800722 - DNA, 19 bp, Homo sapiens
attcagtgttaaatgtgat

SEQ ID NO: 1800723 - DNA, 20 bp, Homo sapiens
attccactgaaatagagtga

SEQ ID NO: 1800724 - DNA, 21 bp, Homo sapiens
tgtagaaaagggaactgaaca

SEQ ID NO: 1800725 - DNA, 23 bp, Homo sapiens
tgtagaaaatttgttattttgca

SEQ ID NO: 1800726 - DNA, 17 bp, Homo sapiens
tgtattaagggcatttt

SEQ ID NO: 1800727 - DNA, 20 bp, Homo sapiens
tgtcagtaccttcaaactag

SEQ ID NO: 1800728 - DNA, 14 bp, Homo sapiens
tgtccaatcctatg

SEQ ID NO: 1800729 - DNA, 16 bp, Homo sapiens
tgtccacgactgtctc

SEQ ID NO: 1800730 - DNA, 17 bp, Homo sapiens
tgtccacgactgtctcc

SEQ ID NO: 1800731 - DNA, 17 bp, Homo sapiens
tgtccattgtccaatcc

SEQ ID NO: 1800732 - DNA, 18 bp, Homo sapiens
tgtccccctctgtccagg

SEQ ID NO: 1800733 - DNA, 13 bp, Homo sapiens
tgtcctcagcccc

SEQ ID NO: 1800734 - DNA, 21 bp, Homo sapiens
tgtcctcagccccgcgtggaa

SEQ ID NO: 1800735 - DNA, 18 bp, Homo sapiens
tgtcctgcaccggggcct

SEQ ID NO: 1800736 - DNA, 17 bp, Homo sapiens
tgtctcatccatcatca

SEQ ID NO: 1800737 - DNA, 21 bp, Homo sapiens
tgtctcgtggtaggactgtag

SEQ ID NO: 1800738 - DNA, 15 bp, Homo sapiens
tgtcttgtgtttctt

SEQ ID NO: 1800739 - DNA, 18 bp, Homo sapiens
tgtgacaacatttttgta

SEQ ID NO: 1800740 - DNA, 23 bp, Homo sapiens
tgtgacaacatttttgtacatta

SEQ ID NO: 1800741 - DNA, 15 bp, Homo sapiens
tgtgaccaatgtctt

SEQ ID NO: 1800742 - DNA, 14 bp, Homo sapiens
tgtgaggccagggc

SEQ ID NO: 1800743 - DNA, 22 bp, Homo sapiens
tgtgaggccagggcagagtgag

SEQ ID NO: 1800744 - DNA, 22 bp, Homo sapiens
tgtgagtgtgtttgtgtgcatg

SEQ ID NO: 1800745 - DNA, 18 bp, Homo sapiens
tgtgatgaatactgtatt

SEQ ID NO: 1800746 - DNA, 20 bp, Homo sapiens
tgtgcacatctgtgtcttgt

SEQ ID NO: 1800747 - DNA, 21 bp, Homo sapiens
tgtgcacatctgtgtcttgtt

SEQ ID NO: 1800748 - DNA, 13 bp, Homo sapiens
tgtgcaccagggt

SEQ ID NO: 1800749 - DNA, 21 bp, Homo sapiens
tgtggcatccagagtccctgc

SEQ ID NO: 1800750 - DNA, 17 bp, Homo sapiens
tgtgtccacgactgtct

SEQ ID NO: 1800751 - DNA, 21 bp, Homo sapiens
tgtgtccccctctgtccaggc

SEQ ID NO: 1800752 - DNA, 19 bp, Homo sapiens
tgtgtctaggcaggacctg

SEQ ID NO: 1800753 - DNA, 17 bp, Homo sapiens
tgttaagtattttcata

SEQ ID NO: 1800754 - DNA, 18 bp, Homo sapiens
tgttaataaaagtacatg

SEQ ID NO: 1800755 - DNA, 21 bp, Homo sapiens
tgttattagagattacctcct

SEQ ID NO: 1800756 - DNA, 23 bp, Homo sapiens
tgttattagagattacctcctga

SEQ ID NO: 1800757 - DNA, 14 bp, Homo sapiens
tgttattggaattt

SEQ ID NO: 1800758 - DNA, 14 bp, Homo sapiens
tgttattttgcaac

SEQ ID NO: 1800759 - DNA, 17 bp, Homo sapiens
tgttccccttccactga

SEQ ID NO: 1800760 - DNA, 23 bp, Homo sapiens
tgttgtacatacagaggtaacta

SEQ ID NO: 1800761 - DNA, 13 bp, Homo sapiens
tgtttactaggga

SEQ ID NO: 1800762 - DNA, 19 bp, Homo sapiens
tgtttactagggatccctc

SEQ ID NO: 1800763 - DNA, 19 bp, Homo sapiens
tgtttagaactactgataa

SEQ ID NO: 1800764 - DNA, 14 bp, Homo sapiens
tgtttgtgtgcatg

SEQ ID NO: 1800765 - DNA, 16 bp, Homo sapiens
tgtttgtgtgcatgaa

SEQ ID NO: 1800766 - DNA, 20 bp, Homo sapiens
tgtttgtgtgcatgaaagag

SEQ ID NO: 1800767 - DNA, 11 bp, Homo sapiens
tgtttttcatt

SEQ ID NO: 1800768 - DNA, 22 bp, Homo sapiens
ttaaaagcaattatattgtcct

SEQ ID NO: 1800769 - DNA, 22 bp, Homo sapiens
ttaaaccagactctgttgcaat

SEQ ID NO: 1800770 - DNA, 13 bp, Homo sapiens
ttaaatacagtct

SEQ ID NO: 1800771 - DNA, 20 bp, Homo sapiens
ttaacaattaattttctatg

SEQ ID NO: 1800772 - DNA, 16 bp, Homo sapiens
ttaagacgtgaatgtc

SEQ ID NO: 1800773 - DNA, 21 bp, Homo sapiens
ttaaggagaggagaaactgag

SEQ ID NO: 1800774 - DNA, 15 bp, Homo sapiens
ttaagggcattttaa

SEQ ID NO: 1800775 - DNA, 22 bp, Homo sapiens
ttaagttacacatttttcagat

SEQ ID NO: 1800776 - DNA, 21 bp, Homo sapiens
ttaattgacttatttatataa

SEQ ID NO: 1800777 - DNA, 15 bp, Homo sapiens
ttacacatttttcag

SEQ ID NO: 1800778 - DNA, 22 bp, Homo sapiens
ttagatgttctaagtctttcca

SEQ ID NO: 1800779 - DNA, 22 bp, Homo sapiens
ttaggcgcccatggtacaagga

SEQ ID NO: 1800780 - DNA, 14 bp, Homo sapiens
ttagggaagggcct

SEQ ID NO: 1800781 - DNA, 13 bp, Homo sapiens
ttagttgctgtat

SEQ ID NO: 1800782 - DNA, 15 bp, Homo sapiens
ttagttgctgtatgt

SEQ ID NO: 1800783 - DNA, 13 bp, Homo sapiens
ttatatattgtat

SEQ ID NO: 1800784 - DNA, 12 bp, Homo sapiens
ttatattgtcct

SEQ ID NO: 1800785 - DNA, 18 bp, Homo sapiens
ttatcaccgtgggctccc

SEQ ID NO: 1800786 - DNA, 16 bp, Homo sapiens
ttatgccacctgaata

SEQ ID NO: 1800787 - DNA, 17 bp, Homo sapiens
ttattagagtgtctttc

SEQ ID NO: 1800788 - DNA, 14 bp, Homo sapiens
ttattcagtgtcac

SEQ ID NO: 1800789 - DNA, 13 bp, Homo sapiens
ttcaaagccagcg

SEQ ID NO: 1800790 - DNA, 19 bp, Homo sapiens
ttcaattgcatctcccaga

SEQ ID NO: 1800791 - DNA, 20 bp, Homo sapiens
ttcacatctaacctcatctt

SEQ ID NO: 1800792 - DNA, 23 bp, Homo sapiens
ttcacttcgatgactggatacag

SEQ ID NO: 1800793 - DNA, 12 bp, Homo sapiens
ttcagatataaa

SEQ ID NO: 1800794 - DNA, 22 bp, Homo sapiens
ttcagcacctacagtgtacagt

SEQ ID NO: 1800795 - DNA, 18 bp, Homo sapiens
ttcagtgttaaatgtgat

SEQ ID NO: 1800796 - DNA, 16 bp, Homo sapiens
ttccaaaacctaaaga

SEQ ID NO: 1800797 - DNA, 15 bp, Homo sapiens
ttccacggagccact

SEQ ID NO: 1800798 - DNA, 22 bp, Homo sapiens
ttccacggagccactcctctga

SEQ ID NO: 1800799 - DNA, 13 bp, Homo sapiens
ttccatttgcaag

SEQ ID NO: 1800800 - DNA, 19 bp, Homo sapiens
ttcctaataaagttctgta

SEQ ID NO: 1800801 - DNA, 13 bp, Homo sapiens
ttcctatacgcag

SEQ ID NO: 1800802 - DNA, 11 bp, Homo sapiens
ttcctcctggg

SEQ ID NO: 1800803 - DNA, 20 bp, Homo sapiens
ttcctgttcttaagacgtga

SEQ ID NO: 1800804 - DNA, 22 bp, Homo sapiens
ttccttaaaatgtgagtgacct

SEQ ID NO: 1800805 - DNA, 13 bp, Homo sapiens
ttcggtgtgcacc

SEQ ID NO: 1800806 - DNA, 12 bp, Homo sapiens
ttctaagtcttt

SEQ ID NO: 1800807 - DNA, 15 bp, Homo sapiens
ttctagttctgccag

SEQ ID NO: 1800808 - DNA, 21 bp, Homo sapiens
ttctgctcatcattctctgtc

SEQ ID NO: 1800809 - DNA, 16 bp, Homo sapiens
ttctttcatacattat

SEQ ID NO: 1800810 - DNA, 19 bp, Homo sapiens
ttcttttgttttcttcatt

SEQ ID NO: 1800811 - DNA, 15 bp, Homo sapiens
ttgaactttccaaaa

SEQ ID NO: 1800812 - DNA, 18 bp, Homo sapiens
ttgaactttccaaaacct

SEQ ID NO: 1800813 - DNA, 18 bp, Homo sapiens
ttgaattgtaactgttct

SEQ ID NO: 1800814 - DNA, 19 bp, Homo sapiens
ttgagttttcagtggggca

SEQ ID NO: 1800815 - DNA, 11 bp, Homo sapiens
ttgatattaaa

SEQ ID NO: 1800816 - DNA, 13 bp, Homo sapiens
ttgcaagggaaaa

SEQ ID NO: 1800817 - DNA, 20 bp, Homo sapiens
ttgcccaggctggagtgcag

SEQ ID NO: 1800818 - DNA, 13 bp, Homo sapiens
ttggaattttctt

SEQ ID NO: 1800819 - DNA, 13 bp, Homo sapiens
ttggacccttcca

SEQ ID NO: 1800820 - DNA, 17 bp, Homo sapiens
ttggcaatgccatcatc

SEQ ID NO: 1800821 - DNA, 13 bp, Homo sapiens
ttgtaacttcaaa

SEQ ID NO: 1800822 - DNA, 14 bp, Homo sapiens
ttgtaacttcaaat

SEQ ID NO: 1800823 - DNA, 15 bp, Homo sapiens
ttgtacattatgtta

SEQ ID NO: 1800824 - DNA, 21 bp, Homo sapiens
ttgtacattatgttattggaa

SEQ ID NO: 1800825 - DNA, 20 bp, Homo sapiens
ttgtacgttatatattgtat

SEQ ID NO: 1800826 - DNA, 21 bp, Homo sapiens
ttgtacttttggcatgaaagt

SEQ ID NO: 1800827 - DNA, 22 bp, Homo sapiens
ttgtattctctgagctgtgcag

SEQ ID NO: 1800828 - DNA, 20 bp, Homo sapiens
ttgtcacgccagacttccca

SEQ ID NO: 1800829 - DNA, 19 bp, Homo sapiens
ttgtcctcccctattttaa

SEQ ID NO: 1800830 - DNA, 22 bp, Homo sapiens
ttgttattttgcaacctcgctg

SEQ ID NO: 1800831 - DNA, 16 bp, Homo sapiens
ttgtttcaattgcatc

SEQ ID NO: 1800832 - DNA, 20 bp, Homo sapiens
ttgttttgcacactttgcca

SEQ ID NO: 1800833 - DNA, 15 bp, Homo sapiens
tttaaaatctgtcac

SEQ ID NO: 1800834 - DNA, 20 bp, Homo sapiens
tttaaatacagtcttccatt

SEQ ID NO: 1800835 - DNA, 21 bp, Homo sapiens
tttcaaattggagcttcatgg

SEQ ID NO: 1800836 - DNA, 14 bp, Homo sapiens
tttcagatataaaa

SEQ ID NO: 1800837 - DNA, 21 bp, Homo sapiens
tttcagtggggcagtcattat

SEQ ID NO: 1800838 - DNA, 18 bp, Homo sapiens
tttcataagtatttcaaa

SEQ ID NO: 1800839 - DNA, 19 bp, Homo sapiens
tttcatgtaaactgtgcac

SEQ ID NO: 1800840 - DNA, 12 bp, Homo sapiens
tttcccaattca

SEQ ID NO: 1800841 - DNA, 21 bp, Homo sapiens
tttcctaataaagttctgtac

SEQ ID NO: 1800842 - DNA, 23 bp, Homo sapiens
tttcctaataaagttctgtactc

SEQ ID NO: 1800843 - DNA, 24 bp, Homo sapiens
tttcctaataaagttctgtactca

SEQ ID NO: 1800844 - DNA, 14 bp, Homo sapiens
tttctcctccatgg

SEQ ID NO: 1800845 - DNA, 16 bp, Homo sapiens
tttctttcatacatta

SEQ ID NO: 1800846 - DNA, 20 bp, Homo sapiens
tttcttttgttttcttcatt

SEQ ID NO: 1800847 - DNA, 14 bp, Homo sapiens
tttgaacacattct

SEQ ID NO: 1800848 - DNA, 16 bp, Homo sapiens
tttgcataacaattcc

SEQ ID NO: 1800849 - DNA, 18 bp, Homo sapiens
tttgcataacaattcctc

SEQ ID NO: 1800850 - DNA, 20 bp, Homo sapiens
tttgcataacaattcctcta

SEQ ID NO: 1800851 - DNA, 19 bp, Homo sapiens
tttgctcttctgtatgtga

SEQ ID NO: 1800852 - DNA, 18 bp, Homo sapiens
tttgtaaggtttttgtag

SEQ ID NO: 1800853 - DNA, 12 bp, Homo sapiens
tttgtacattat

SEQ ID NO: 1800854 - DNA, 14 bp, Homo sapiens
tttgtattctctga

SEQ ID NO: 1800855 - DNA, 16 bp, Homo sapiens
tttgttattttgcaac

SEQ ID NO: 1800856 - DNA, 14 bp, Homo sapiens
tttgttgctgtcaa

SEQ ID NO: 1800857 - DNA, 15 bp, Homo sapiens
tttgttgctgtcaag

SEQ ID NO: 1800858 - DNA, 13 bp, Homo sapiens
tttgtttcatatt

SEQ ID NO: 1800859 - DNA, 16 bp, Homo sapiens
tttgttttcttcattt

SEQ ID NO: 1800860 - DNA, 18 bp, Homo sapiens
tttgttttcttcatttct

SEQ ID NO: 1800861 - DNA, 18 bp, Homo sapiens
ttttaaaagcaattatat

SEQ ID NO: 1800862 - DNA, 21 bp, Homo sapiens
ttttaaaagcaattatattgt

SEQ ID NO: 1800863 - DNA, 15 bp, Homo sapiens
ttttaacaaaaaagg

SEQ ID NO: 1800864 - DNA, 20 bp, Homo sapiens
ttttaacaaaaaaggaaaat

SEQ ID NO: 1800865 - DNA, 13 bp, Homo sapiens
ttttaagacgtga

SEQ ID NO: 1800866 - DNA, 19 bp, Homo sapiens
ttttcagatataaaagact

SEQ ID NO: 1800867 - DNA, 20 bp, Homo sapiens
ttttcctaataaagttctgt

SEQ ID NO: 1800868 - DNA, 16 bp, Homo sapiens
ttttcttcatttctct

SEQ ID NO: 1800869 - DNA, 14 bp, Homo sapiens
ttttctttcataca

SEQ ID NO: 1800870 - DNA, 21 bp, Homo sapiens
ttttcttttgttttcttcatt

SEQ ID NO: 1800871 - DNA, 19 bp, Homo sapiens
ttttgaaaaaagtatagga

SEQ ID NO: 1800872 - DNA, 15 bp, Homo sapiens
ttttgctcttctgta

SEQ ID NO: 1800873 - DNA, 21 bp, Homo sapiens
ttttgctttcgaactgctagt

SEQ ID NO: 1800874 - DNA, 17 bp, Homo sapiens
ttttggcatgaaagtgc

SEQ ID NO: 1800875 - DNA, 11 bp, Homo sapiens
ttttgtaactt

SEQ ID NO: 1800876 - DNA, 15 bp, Homo sapiens
ttttgtaacttcaaa

SEQ ID NO: 1800877 - DNA, 17 bp, Homo sapiens
ttttgtgttactgcagt

SEQ ID NO: 1800878 - DNA, 16 bp, Homo sapiens
ttttgttcaaagccag

SEQ ID NO: 1800879 - DNA, 14 bp, Homo sapiens
tttttgtaacttca
